United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 172

SEQ ID NO: 7187052 - DNA, 22 bp, Homo sapiens
cagcaggcggcccgcgggcccg

SEQ ID NO: 7187053 - DNA, 22 bp, Homo sapiens
cagcaggcggcccgcgggcccg

SEQ ID NO: 7187054 - DNA, 22 bp, Homo sapiens
cagcaggcccaggtgctggtga

SEQ ID NO: 7187055 - DNA, 22 bp, Homo sapiens
cagcaggcccaggtgctggtga

SEQ ID NO: 7187056 - DNA, 22 bp, Homo sapiens
cagcaggcccaggtgctggtga

SEQ ID NO: 7187057 - DNA, 22 bp, Homo sapiens
cagcaggcccaggtgctggtga

SEQ ID NO: 7187058 - DNA, 22 bp, Homo sapiens
cagcaggcccaggtgctggtga

SEQ ID NO: 7187059 - DNA, 22 bp, Homo sapiens
cagcaggcagccatttcactgt

SEQ ID NO: 7187060 - DNA, 22 bp, Homo sapiens
cagcaggatttgaaaggaagag

SEQ ID NO: 7187061 - DNA, 22 bp, Homo sapiens
cagcaggatttgaaaggaagag

SEQ ID NO: 7187062 - DNA, 22 bp, Homo sapiens
cagcaggatttgaaaggaagag

SEQ ID NO: 7187063 - DNA, 22 bp, Homo sapiens
cagcaggatatggtggagagag

SEQ ID NO: 7187064 - DNA, 22 bp, Homo sapiens
cagcaggattggatacatctca

SEQ ID NO: 7187065 - DNA, 22 bp, Homo sapiens
cagcaggatttgaaaggaagag

SEQ ID NO: 7187066 - DNA, 22 bp, Homo sapiens
cagcaggcagccatttcactgt

SEQ ID NO: 7187067 - DNA, 22 bp, Homo sapiens
cagcaggcaggtgggccaagtc

SEQ ID NO: 7187068 - DNA, 22 bp, Homo sapiens
cagcaggcaggtgggccaagtc

SEQ ID NO: 7187069 - DNA, 22 bp, Homo sapiens
cagcaggcaggtgggccaagtc

SEQ ID NO: 7187070 - DNA, 22 bp, Homo sapiens
cagcaggcaggtgggccaagtc

SEQ ID NO: 7187071 - DNA, 22 bp, Homo sapiens
cagcaggcaggtgggccaagtc

SEQ ID NO: 7187072 - DNA, 22 bp, Homo sapiens
cagcaggcaggtgggccaagtc

SEQ ID NO: 7187073 - DNA, 22 bp, Homo sapiens
cagcaggccatgctgcttttca

SEQ ID NO: 7187074 - DNA, 22 bp, Homo sapiens
cagcaggccatgctgcttttca

SEQ ID NO: 7187075 - DNA, 22 bp, Homo sapiens
cagcaggccatgctgcttttca

SEQ ID NO: 7187076 - DNA, 22 bp, Homo sapiens
cagccagtggttgaagatgcag

SEQ ID NO: 7187077 - DNA, 22 bp, Homo sapiens
cagccagtcccatttcaaatag

SEQ ID NO: 7187078 - DNA, 22 bp, Homo sapiens
cagccagtcccatttcaaatag

SEQ ID NO: 7187079 - DNA, 17 bp, Homo sapiens
cagccagtcccttcatt

SEQ ID NO: 7187080 - DNA, 22 bp, Homo sapiens
cagcccagagccagttcccgct

SEQ ID NO: 7187081 - DNA, 22 bp, Homo sapiens
cagccacttgtgatgctgggga

SEQ ID NO: 7187082 - DNA, 22 bp, Homo sapiens
cagccacttcgagcttcctgat

SEQ ID NO: 7187083 - DNA, 22 bp, Homo sapiens
cagccacttcccctctatgggt

SEQ ID NO: 7187084 - DNA, 22 bp, Homo sapiens
cagccacttgtgatgctgggga

SEQ ID NO: 7187085 - DNA, 22 bp, Homo sapiens
cagccaggttcaagtccttata

SEQ ID NO: 7187086 - DNA, 22 bp, Homo sapiens
cagccactgtggtctagctgca

SEQ ID NO: 7187087 - DNA, 22 bp, Homo sapiens
cagccactgtggtctagctgca

SEQ ID NO: 7187088 - DNA, 22 bp, Homo sapiens
cagccactgtggaatagccccc

SEQ ID NO: 7187089 - DNA, 22 bp, Homo sapiens
cagccactggtgccaggctgtt

SEQ ID NO: 7187090 - DNA, 22 bp, Homo sapiens
cagccactggtgccaggctgtt

SEQ ID NO: 7187091 - DNA, 22 bp, Homo sapiens
cagccactggtgccaggctgtt

SEQ ID NO: 7187092 - DNA, 22 bp, Homo sapiens
cagccactggtgccaggctgtt

SEQ ID NO: 7187093 - DNA, 22 bp, Homo sapiens
cagccactgacaggaatggtcc

SEQ ID NO: 7187094 - DNA, 22 bp, Homo sapiens
cagccactgaactcctggctat

SEQ ID NO: 7187095 - DNA, 22 bp, Homo sapiens
cagccactgacaggaatggtcc

SEQ ID NO: 7187096 - DNA, 22 bp, Homo sapiens
cagccactgaactcctggctat

SEQ ID NO: 7187097 - DNA, 22 bp, Homo sapiens
cagccactgaactcctggctat

SEQ ID NO: 7187098 - DNA, 22 bp, Homo sapiens
cagccactctcagacagtccca

SEQ ID NO: 7187099 - DNA, 22 bp, Homo sapiens
cagccactcggccataaaggct

SEQ ID NO: 7187100 - DNA, 22 bp, Homo sapiens
cagccactcggccataaaggct

SEQ ID NO: 7187101 - DNA, 22 bp, Homo sapiens
cagccactacaattggttccat

SEQ ID NO: 7187102 - DNA, 22 bp, Homo sapiens
cagccacgtagcccttggccgt

SEQ ID NO: 7187103 - DNA, 22 bp, Homo sapiens
cagccactctcagacagtccca

SEQ ID NO: 7187104 - DNA, 22 bp, Homo sapiens
cagccaccatacagcagaagct

SEQ ID NO: 7187105 - DNA, 22 bp, Homo sapiens
cagccaccatacagcagaagct

SEQ ID NO: 7187106 - DNA, 22 bp, Homo sapiens
cagcattttcttaatgtaggtg

SEQ ID NO: 7187107 - DNA, 22 bp, Homo sapiens
cagccaaatgagtcataaatgt

SEQ ID NO: 7187108 - DNA, 22 bp, Homo sapiens
cagccaagaaagcagtgctcca

SEQ ID NO: 7187109 - DNA, 22 bp, Homo sapiens
cagccaagaaagcagtgctcca

SEQ ID NO: 7187110 - DNA, 22 bp, Homo sapiens
cagccaaatgagtcataaatgt

SEQ ID NO: 7187111 - DNA, 22 bp, Homo sapiens
cagccaagaaccacagacccag

SEQ ID NO: 7187112 - DNA, 22 bp, Homo sapiens
cagccaagaaccacagacccag

SEQ ID NO: 7187113 - DNA, 22 bp, Homo sapiens
cagccaattctagcttgtgaat

SEQ ID NO: 7187114 - DNA, 22 bp, Homo sapiens
cagccacagctgggtgcctgac

SEQ ID NO: 7187115 - DNA, 22 bp, Homo sapiens
gtatttgtagtagcatagaatt

SEQ ID NO: 7187116 - DNA, 22 bp, Homo sapiens
gtatttgtagtagcatagaatt

SEQ ID NO: 7187117 - DNA, 22 bp, Homo sapiens
gtattttaagtgactactaggt

SEQ ID NO: 7187118 - DNA, 22 bp, Homo sapiens
gtattttaagtgactactaggt

SEQ ID NO: 7187119 - DNA, 22 bp, Homo sapiens
gtattttaagtgactactaggt

SEQ ID NO: 7187120 - DNA, 22 bp, Homo sapiens
gtattttaagtgactactaggt

SEQ ID NO: 7187121 - DNA, 22 bp, Homo sapiens
gtatttgagctttatgtatatt

SEQ ID NO: 7187122 - DNA, 22 bp, Homo sapiens
gtatttgagggagaaaaggaag

SEQ ID NO: 7187123 - DNA, 22 bp, Homo sapiens
gtatttgatacatgaaatggtg

SEQ ID NO: 7187124 - DNA, 22 bp, Homo sapiens
gtatttgacaccagtgaatggt

SEQ ID NO: 7187125 - DNA, 22 bp, Homo sapiens
gtatttgatagatttcaaagga

SEQ ID NO: 7187126 - DNA, 22 bp, Homo sapiens
gtatttgatcattagaatgatt

SEQ ID NO: 7187127 - DNA, 22 bp, Homo sapiens
gtatttgatgtaatttcagtgc

SEQ ID NO: 7187128 - DNA, 22 bp, Homo sapiens
gtatttgcaaatctaaaagaga

SEQ ID NO: 7187129 - DNA, 22 bp, Homo sapiens
gtattttactgctcaaagctct

SEQ ID NO: 7187130 - DNA, 22 bp, Homo sapiens
gtattttaagtgactactaggt

SEQ ID NO: 7187131 - DNA, 22 bp, Homo sapiens
gtattttactgctcaaagctct

SEQ ID NO: 7187132 - DNA, 22 bp, Homo sapiens
gtattttactgctcaaagctct

SEQ ID NO: 7187133 - DNA, 22 bp, Homo sapiens
gtattttactgctcaaagctct

SEQ ID NO: 7187134 - DNA, 22 bp, Homo sapiens
gtattttactgctcaaagctct

SEQ ID NO: 7187135 - DNA, 22 bp, Homo sapiens
gtattttacttacgcatgactt

SEQ ID NO: 7187136 - DNA, 22 bp, Homo sapiens
gtattttacttacgcatgactt

SEQ ID NO: 7187137 - DNA, 22 bp, Homo sapiens
cagcatgcccagactgagctaa

SEQ ID NO: 7187138 - DNA, 22 bp, Homo sapiens
cagcatgcccagactgagctaa

SEQ ID NO: 7187139 - DNA, 22 bp, Homo sapiens
cagcatgcctgggctgcctgcc

SEQ ID NO: 7187140 - DNA, 22 bp, Homo sapiens
cagcatttggtgatcatcttaa

SEQ ID NO: 7187141 - DNA, 22 bp, Homo sapiens
cagcatttggaggagaggcttt

SEQ ID NO: 7187142 - DNA, 22 bp, Homo sapiens
cagcatttggtgatcatcttaa

SEQ ID NO: 7187143 - DNA, 22 bp, Homo sapiens
cagcatttatcttgtagcagga

SEQ ID NO: 7187144 - DNA, 22 bp, Homo sapiens
cagcatttggaggagaggcttt

SEQ ID NO: 7187145 - DNA, 22 bp, Homo sapiens
cagcatttagaatttgaagtgt

SEQ ID NO: 7187146 - DNA, 22 bp, Homo sapiens
cagcatttatcttgtagcagga

SEQ ID NO: 7187147 - DNA, 22 bp, Homo sapiens
cagcatttaatgcagtgcttcc

SEQ ID NO: 7187148 - DNA, 22 bp, Homo sapiens
cagcattgggttacctttgttt

SEQ ID NO: 7187149 - DNA, 22 bp, Homo sapiens
cagcatgcctgggctgcctgcc

SEQ ID NO: 7187150 - DNA, 22 bp, Homo sapiens
cagcatgcttgggggagggagc

SEQ ID NO: 7187151 - DNA, 22 bp, Homo sapiens
cagcatggacaggggtggcgtt

SEQ ID NO: 7187152 - DNA, 18 bp, Homo sapiens
cagcattagcagcttcca

SEQ ID NO: 7187153 - DNA, 18 bp, Homo sapiens
cagcattagcagcttcca

SEQ ID NO: 7187154 - DNA, 22 bp, Homo sapiens
cagcattctactttgtgaactg

SEQ ID NO: 7187155 - DNA, 22 bp, Homo sapiens
cagcattgagcacagaaggaaa

SEQ ID NO: 7187156 - DNA, 22 bp, Homo sapiens
cagcccagcactaagtagattt

SEQ ID NO: 7187157 - DNA, 22 bp, Homo sapiens
cagcccagcactaagtagattt

SEQ ID NO: 7187158 - DNA, 22 bp, Homo sapiens
cagcccagagccagttcccgct

SEQ ID NO: 7187159 - DNA, 22 bp, Homo sapiens
cagcccagagccagttcccgct

SEQ ID NO: 7187160 - DNA, 22 bp, Homo sapiens
cagcccagagccagttcccgct

SEQ ID NO: 7187161 - DNA, 22 bp, Homo sapiens
cagcccagagccagttcccgct

SEQ ID NO: 7187162 - DNA, 22 bp, Homo sapiens
cagcccagcactaagtagattt

SEQ ID NO: 7187163 - DNA, 22 bp, Homo sapiens
cagcccagcagactgttaccac

SEQ ID NO: 7187164 - DNA, 22 bp, Homo sapiens
cagcccagcagactgttaccac

SEQ ID NO: 7187165 - DNA, 22 bp, Homo sapiens
cagcccagcagggtctggccct

SEQ ID NO: 7187166 - DNA, 22 bp, Homo sapiens
cagcccagcagggtctggccct

SEQ ID NO: 7187167 - DNA, 22 bp, Homo sapiens
cagcccagcagggtctggccct

SEQ ID NO: 7187168 - DNA, 22 bp, Homo sapiens
cagcccagcagggtctggccct

SEQ ID NO: 7187169 - DNA, 22 bp, Homo sapiens
cagcccagcagggtctggccct

SEQ ID NO: 7187170 - DNA, 22 bp, Homo sapiens
cagcccagcagggtctggccct

SEQ ID NO: 7187171 - DNA, 22 bp, Homo sapiens
cagcccagcagtcttagcctgc

SEQ ID NO: 7187172 - DNA, 21 bp, Homo sapiens
cagcccagcccattgacagtg

SEQ ID NO: 7187173 - DNA, 21 bp, Homo sapiens
cagcccagcccattgacagtg

SEQ ID NO: 7187174 - DNA, 21 bp, Homo sapiens
cagcccagcccattgacagtg

SEQ ID NO: 7187175 - DNA, 21 bp, Homo sapiens
cagcccagcccattgacagtg

SEQ ID NO: 7187176 - DNA, 20 bp, Homo sapiens
ggggaagaaaaggatgtgat

SEQ ID NO: 7187177 - DNA, 20 bp, Homo sapiens
ggggaagaaaaggatgtgat

SEQ ID NO: 7187178 - DNA, 22 bp, Homo sapiens
ggggaacaccgggcagaggcgc

SEQ ID NO: 7187179 - DNA, 22 bp, Homo sapiens
ggggaacaccgggcagaggcgc

SEQ ID NO: 7187180 - DNA, 22 bp, Homo sapiens
ggggaaaggccatggcaagaac

SEQ ID NO: 7187181 - DNA, 22 bp, Homo sapiens
ggggaaaggccatggcaagaac

SEQ ID NO: 7187182 - DNA, 22 bp, Homo sapiens
ggggaaagtgaattgtgtagtg

SEQ ID NO: 7187183 - DNA, 22 bp, Homo sapiens
ggggaaagtgaattgtgtagtg

SEQ ID NO: 7187184 - DNA, 23 bp, Homo sapiens
ggggaaagaccatgcttgaggac

SEQ ID NO: 7187185 - DNA, 23 bp, Homo sapiens
ggggaaagaccatgcttgaggac

SEQ ID NO: 7187186 - DNA, 22 bp, Homo sapiens
ggggaaagccagccctgcttcc

SEQ ID NO: 7187187 - DNA, 22 bp, Homo sapiens
ggggaaagccagccctgcttcc

SEQ ID NO: 7187188 - DNA, 22 bp, Homo sapiens
ggggaaactgaggcacagacag

SEQ ID NO: 7187189 - DNA, 22 bp, Homo sapiens
ggggaaactgaggcacagacag

SEQ ID NO: 7187190 - DNA, 22 bp, Homo sapiens
ggggaaactgaggcacagacag

SEQ ID NO: 7187191 - DNA, 23 bp, Homo sapiens
ggggaaagaccatgcttgaggac

SEQ ID NO: 7187192 - DNA, 22 bp, Homo sapiens
gggctgtgtactatgaggaggg

SEQ ID NO: 7187193 - DNA, 22 bp, Homo sapiens
gggctgtgtatcagttatctat

SEQ ID NO: 7187194 - DNA, 22 bp, Homo sapiens
gggctgtgtgcagtacgggtcc

SEQ ID NO: 7187195 - DNA, 18 bp, Homo sapiens
ggggaaaagccaggtgtc

SEQ ID NO: 7187196 - DNA, 22 bp, Homo sapiens
ggggaaacatgttgttcagacc

SEQ ID NO: 7187197 - DNA, 19 bp, Homo sapiens
cagagctgctggcctcgtc

SEQ ID NO: 7187198 - DNA, 22 bp, Homo sapiens
cagagctgctcatggtggccag

SEQ ID NO: 7187199 - DNA, 19 bp, Homo sapiens
cagagctgctggcctcgtc

SEQ ID NO: 7187200 - DNA, 22 bp, Homo sapiens
gggctgtgtactatgaggaggg

SEQ ID NO: 7187201 - DNA, 22 bp, Homo sapiens
cagagctgctcatggtggccag

SEQ ID NO: 7187202 - DNA, 22 bp, Homo sapiens
cagagctgcgctttttcctggt

SEQ ID NO: 7187203 - DNA, 22 bp, Homo sapiens
cagagctgcgctttttcctggt

SEQ ID NO: 7187204 - DNA, 22 bp, Homo sapiens
cagagctgcagattgaaggcat

SEQ ID NO: 7187205 - DNA, 22 bp, Homo sapiens
cagagctgcagattgaaggcat

SEQ ID NO: 7187206 - DNA, 22 bp, Homo sapiens
cagagctgcgctttttcctggt

SEQ ID NO: 7187207 - DNA, 22 bp, Homo sapiens
cagagctgcagattgaaggcat

SEQ ID NO: 7187208 - DNA, 22 bp, Homo sapiens
gggcgcatcacctgaggtcagg

SEQ ID NO: 7187209 - DNA, 22 bp, Homo sapiens
gggcgcagccaatcctggccct

SEQ ID NO: 7187210 - DNA, 22 bp, Homo sapiens
gggcgccgtgggaaacagccgg

SEQ ID NO: 7187211 - DNA, 22 bp, Homo sapiens
gggcgccgtgggaaacagccgg

SEQ ID NO: 7187212 - DNA, 22 bp, Homo sapiens
gggcgccgtgggaaacagccgg

SEQ ID NO: 7187213 - DNA, 22 bp, Homo sapiens
cagagcctgctcacgtctctgt

SEQ ID NO: 7187214 - DNA, 22 bp, Homo sapiens
cagagcctgctgccttctgaag

SEQ ID NO: 7187215 - DNA, 21 bp, Homo sapiens
cagagctctttctgcttgctg

SEQ ID NO: 7187216 - DNA, 21 bp, Homo sapiens
cagagctctttctgcttgctg

SEQ ID NO: 7187217 - DNA, 21 bp, Homo sapiens
cagagctgaagggtgtagtgt

SEQ ID NO: 7187218 - DNA, 21 bp, Homo sapiens
cagagctgaagggtgtagtgt

SEQ ID NO: 7187219 - DNA, 22 bp, Homo sapiens
cagagctgacccaaggattgaa

SEQ ID NO: 7187220 - DNA, 22 bp, Homo sapiens
cagagctgacccaaggattgaa

SEQ ID NO: 7187221 - DNA, 22 bp, Homo sapiens
cagagctgacccaaggattgaa

SEQ ID NO: 7187222 - DNA, 22 bp, Homo sapiens
cagagctgagtcttcaaggttg

SEQ ID NO: 7187223 - DNA, 22 bp, Homo sapiens
cagagctgagaatgttgatgct

SEQ ID NO: 7187224 - DNA, 22 bp, Homo sapiens
cagagctgagaatgttgatgct

SEQ ID NO: 7187225 - DNA, 23 bp, Homo sapiens
cagagctgattaaacttaatctc

SEQ ID NO: 7187226 - DNA, 22 bp, Homo sapiens
cagagctgattggatccagaga

SEQ ID NO: 7187227 - DNA, 22 bp, Homo sapiens
cagagctgcaaatgcccctccg

SEQ ID NO: 7187228 - DNA, 22 bp, Homo sapiens
cagagctgcaaatgcccctccg

SEQ ID NO: 7187229 - DNA, 22 bp, Homo sapiens
cagagctgattggatccagaga

SEQ ID NO: 7187230 - DNA, 22 bp, Homo sapiens
cagagctgcacattctatgatg

SEQ ID NO: 7187231 - DNA, 22 bp, Homo sapiens
cagagctgcacattctatgatg

SEQ ID NO: 7187232 - DNA, 22 bp, Homo sapiens
gggcgaggactgactctgggca

SEQ ID NO: 7187233 - DNA, 22 bp, Homo sapiens
gggcgaggactgactctgggca

SEQ ID NO: 7187234 - DNA, 21 bp, Homo sapiens
gggcgaggcctgatgtggctc

SEQ ID NO: 7187235 - DNA, 21 bp, Homo sapiens
gggcgaggcctgatgtggctc

SEQ ID NO: 7187236 - DNA, 22 bp, Homo sapiens
gggcgagggcgaaagcgagagc

SEQ ID NO: 7187237 - DNA, 21 bp, Homo sapiens
gggcgaggcctgatgtggctc

SEQ ID NO: 7187238 - DNA, 21 bp, Homo sapiens
gggcgaggcctgatgtggctc

SEQ ID NO: 7187239 - DNA, 21 bp, Homo sapiens
gggcgaggcctgatgtggctc

SEQ ID NO: 7187240 - DNA, 22 bp, Homo sapiens
gggcgagggcgaaagcgagagc

SEQ ID NO: 7187241 - DNA, 22 bp, Homo sapiens
gggcgagggcgaaagcgagagc

SEQ ID NO: 7187242 - DNA, 22 bp, Homo sapiens
gggcgagggcgaaagcgagagc

SEQ ID NO: 7187243 - DNA, 22 bp, Homo sapiens
gggcgagggcgaaagcgagagc

SEQ ID NO: 7187244 - DNA, 22 bp, Homo sapiens
gggcgagggcgaaagcgagagc

SEQ ID NO: 7187245 - DNA, 22 bp, Homo sapiens
gggcgagggcgaaagcgagagc

SEQ ID NO: 7187246 - DNA, 22 bp, Homo sapiens
cagagcccttggctggagccca

SEQ ID NO: 7187247 - DNA, 22 bp, Homo sapiens
cagagcccttggctggagccca

SEQ ID NO: 7187248 - DNA, 22 bp, Homo sapiens
cagagcccttcctcccacgggg

SEQ ID NO: 7187249 - DNA, 22 bp, Homo sapiens
cagagcccttcctcccacgggg

SEQ ID NO: 7187250 - DNA, 22 bp, Homo sapiens
cagagcccttcctcccacgggg

SEQ ID NO: 7187251 - DNA, 22 bp, Homo sapiens
gggccttcagccttggactgag

SEQ ID NO: 7187252 - DNA, 22 bp, Homo sapiens
gggccttccgactcccaaggcc

SEQ ID NO: 7187253 - DNA, 22 bp, Homo sapiens
gggccttctagttagccccaat

SEQ ID NO: 7187254 - DNA, 21 bp, Homo sapiens
gggccttgagtgtgcggtggg

SEQ ID NO: 7187255 - DNA, 21 bp, Homo sapiens
gggccttgagtgtgcggtggg

SEQ ID NO: 7187256 - DNA, 22 bp, Homo sapiens
gggccttgccatggagcctgag

SEQ ID NO: 7187257 - DNA, 22 bp, Homo sapiens
gggccttgccatggagcctgag

SEQ ID NO: 7187258 - DNA, 23 bp, Homo sapiens
gggccttggatttgtggagttca

SEQ ID NO: 7187259 - DNA, 22 bp, Homo sapiens
gggccttggcgaagtgtggtgg

SEQ ID NO: 7187260 - DNA, 22 bp, Homo sapiens
gggcgaggactgactctgggca

SEQ ID NO: 7187261 - DNA, 22 bp, Homo sapiens
cagagccctgtgtgccatgtga

SEQ ID NO: 7187262 - DNA, 22 bp, Homo sapiens
cagagccctgtgtgccatgtga

SEQ ID NO: 7187263 - DNA, 22 bp, Homo sapiens
cagagccctgtgtgccatgtga

SEQ ID NO: 7187264 - DNA, 22 bp, Homo sapiens
cagagccctgcatgctccatct

SEQ ID NO: 7187265 - DNA, 22 bp, Homo sapiens
cagagccctgggcacatggtag

SEQ ID NO: 7187266 - DNA, 22 bp, Homo sapiens
cagagccctcaaggccgatgca

SEQ ID NO: 7187267 - DNA, 22 bp, Homo sapiens
cagagccctcaaggccgatgca

SEQ ID NO: 7187268 - DNA, 22 bp, Homo sapiens
cagagccctccgctccccggct

SEQ ID NO: 7187269 - DNA, 22 bp, Homo sapiens
cagagccctgcatgctccatct

SEQ ID NO: 7187270 - DNA, 22 bp, Homo sapiens
cagagccctgcatgctccatct

SEQ ID NO: 7187271 - DNA, 22 bp, Homo sapiens
cagagcccctcgtctccaccac

SEQ ID NO: 7187272 - DNA, 22 bp, Homo sapiens
cagagcccctgggttgggagct

SEQ ID NO: 7187273 - DNA, 22 bp, Homo sapiens
cagagcccctgggttgggagct

SEQ ID NO: 7187274 - DNA, 22 bp, Homo sapiens
cagagccctagtcctgatggcc

SEQ ID NO: 7187275 - DNA, 22 bp, Homo sapiens
cagagccctagtcctgatggcc

SEQ ID NO: 7187276 - DNA, 22 bp, Homo sapiens
cagagcccctcagctctctccc

SEQ ID NO: 7187277 - DNA, 22 bp, Homo sapiens
cagagccccccttctgatcaca

SEQ ID NO: 7187278 - DNA, 22 bp, Homo sapiens
cagagcccctcgtctccaccac

SEQ ID NO: 7187279 - DNA, 22 bp, Homo sapiens
cagagcccctcgtctccaccac

SEQ ID NO: 7187280 - DNA, 22 bp, Homo sapiens
cagagcccctcagctctctccc

SEQ ID NO: 7187281 - DNA, 22 bp, Homo sapiens
gggcactgtgttcagagtgcag

SEQ ID NO: 7187282 - DNA, 22 bp, Homo sapiens
gggcactgtggggcccatgctg

SEQ ID NO: 7187283 - DNA, 22 bp, Homo sapiens
gggcactgtgttcagagtgcag

SEQ ID NO: 7187284 - DNA, 22 bp, Homo sapiens
gggcactgtgttcagagtgcag

SEQ ID NO: 7187285 - DNA, 22 bp, Homo sapiens
gggcactgtgttcagagtgcag

SEQ ID NO: 7187286 - DNA, 22 bp, Homo sapiens
gggcactgtggggcccatgctg

SEQ ID NO: 7187287 - DNA, 22 bp, Homo sapiens
gggcactgtgctgggtgcttta

SEQ ID NO: 7187288 - DNA, 22 bp, Homo sapiens
gggcactgtgctgggtgcttta

SEQ ID NO: 7187289 - DNA, 22 bp, Homo sapiens
gggcactgtgctgggtgcttta

SEQ ID NO: 7187290 - DNA, 22 bp, Homo sapiens
gggcactgtgctgggtgcttta

SEQ ID NO: 7187291 - DNA, 22 bp, Homo sapiens
gggcacagcccagtggggtccc

SEQ ID NO: 7187292 - DNA, 22 bp, Homo sapiens
gggcactgtgctaggtgctgag

SEQ ID NO: 7187293 - DNA, 22 bp, Homo sapiens
gggcactgtgctaggtgctgag

SEQ ID NO: 7187294 - DNA, 22 bp, Homo sapiens
gggcactgtgctaggtgctgag

SEQ ID NO: 7187295 - DNA, 22 bp, Homo sapiens
gggcactgtgctaggtgctgag

SEQ ID NO: 7187296 - DNA, 22 bp, Homo sapiens
gggcacagcccagtggggtccc

SEQ ID NO: 7187297 - DNA, 22 bp, Homo sapiens
gggcacagcccagtggggtccc

SEQ ID NO: 7187298 - DNA, 22 bp, Homo sapiens
gggcacagagggtcttgaagaa

SEQ ID NO: 7187299 - DNA, 22 bp, Homo sapiens
gggcacagaagtctaagacatc

SEQ ID NO: 7187300 - DNA, 22 bp, Homo sapiens
gggcacagaagtctaagacatc

SEQ ID NO: 7187301 - DNA, 22 bp, Homo sapiens
gggcacagagaaggttttagtg

SEQ ID NO: 7187302 - DNA, 22 bp, Homo sapiens
gggcacagagggtcttgaagaa

SEQ ID NO: 7187303 - DNA, 22 bp, Homo sapiens
gggcacagagggtcttgaagaa

SEQ ID NO: 7187304 - DNA, 22 bp, Homo sapiens
cagagcccatcctatactctcc

SEQ ID NO: 7187305 - DNA, 22 bp, Homo sapiens
cagagcccagggcctacgtccc

SEQ ID NO: 7187306 - DNA, 22 bp, Homo sapiens
cagagcccatggcacatgtgga

SEQ ID NO: 7187307 - DNA, 22 bp, Homo sapiens
cagagcccatggcacatgtgga

SEQ ID NO: 7187308 - DNA, 22 bp, Homo sapiens
cagagccccccttctgatcaca

SEQ ID NO: 7187309 - DNA, 22 bp, Homo sapiens
cagagccaggcctgccctcttt

SEQ ID NO: 7187310 - DNA, 22 bp, Homo sapiens
cagagccagctgtccttggcat

SEQ ID NO: 7187311 - DNA, 22 bp, Homo sapiens
cagagccagctgtccttggcat

SEQ ID NO: 7187312 - DNA, 22 bp, Homo sapiens
gggcagagaaatggacagttgg

SEQ ID NO: 7187313 - DNA, 22 bp, Homo sapiens
gggcagagaaatggacagttgg

SEQ ID NO: 7187314 - DNA, 22 bp, Homo sapiens
gggcagagaaatggacagttgg

SEQ ID NO: 7187315 - DNA, 22 bp, Homo sapiens
gggcagagaaatggacagttgg

SEQ ID NO: 7187316 - DNA, 22 bp, Homo sapiens
gggcagagaaatggacagttgg

SEQ ID NO: 7187317 - DNA, 22 bp, Homo sapiens
gggcacttgtgttcttcacttt

SEQ ID NO: 7187318 - DNA, 22 bp, Homo sapiens
gggcacttctaagcatggggct

SEQ ID NO: 7187319 - DNA, 22 bp, Homo sapiens
gggcacttaatgggcacagaga

SEQ ID NO: 7187320 - DNA, 22 bp, Homo sapiens
gggcacttactgccaaggcgag

SEQ ID NO: 7187321 - DNA, 22 bp, Homo sapiens
gggcacttgtgttcttcacttt

SEQ ID NO: 7187322 - DNA, 22 bp, Homo sapiens
gggcactttgtgcctcactgtg

SEQ ID NO: 7187323 - DNA, 22 bp, Homo sapiens
gggcactttgtgcctcactgtg

SEQ ID NO: 7187324 - DNA, 20 bp, Homo sapiens
ggggaagaaaaggatgtgat

SEQ ID NO: 7187325 - DNA, 20 bp, Homo sapiens
ggggaagaaaaggatgtgat

SEQ ID NO: 7187326 - DNA, 22 bp, Homo sapiens
ggggaagaaatagaacattttg

SEQ ID NO: 7187327 - DNA, 20 bp, Homo sapiens
ggggaagaaaaggatgtgat

SEQ ID NO: 7187328 - DNA, 22 bp, Homo sapiens
ggggaagaaatctgggttcttc

SEQ ID NO: 7187329 - DNA, 22 bp, Homo sapiens
ggggaagaaatctgggttcttc

SEQ ID NO: 7187330 - DNA, 22 bp, Homo sapiens
ggggaagaaccgggattcccat

SEQ ID NO: 7187331 - DNA, 22 bp, Homo sapiens
ggggaagaaccgggattcccat

SEQ ID NO: 7187332 - DNA, 22 bp, Homo sapiens
ggggaagaatgctctctagaga

SEQ ID NO: 7187333 - DNA, 22 bp, Homo sapiens
cagagctggtgtgtcctggcat

SEQ ID NO: 7187334 - DNA, 22 bp, Homo sapiens
cagagctggtaagtggtagagg

SEQ ID NO: 7187335 - DNA, 22 bp, Homo sapiens
cagagctggtaagtggtagagg

SEQ ID NO: 7187336 - DNA, 22 bp, Homo sapiens
cagagctggtgtgtcctggcat

SEQ ID NO: 7187337 - DNA, 22 bp, Homo sapiens
cagagctggtaagtggtagagg

SEQ ID NO: 7187338 - DNA, 22 bp, Homo sapiens
cagagctggtaagtggtagagg

SEQ ID NO: 7187339 - DNA, 20 bp, Homo sapiens
cagaggcattttcagactct

SEQ ID NO: 7187340 - DNA, 21 bp, Homo sapiens
cagaggcaggctctgtgtgtg

SEQ ID NO: 7187341 - DNA, 22 bp, Homo sapiens
cagaggccacctgtggccactg

SEQ ID NO: 7187342 - DNA, 22 bp, Homo sapiens
cagaggccacctgtggccactg

SEQ ID NO: 7187343 - DNA, 22 bp, Homo sapiens
cagaggccacctgtggccactg

SEQ ID NO: 7187344 - DNA, 22 bp, Homo sapiens
cagagctggtgttacaagtcca

SEQ ID NO: 7187345 - DNA, 22 bp, Homo sapiens
cagagctggtgtgtcctggcat

SEQ ID NO: 7187346 - DNA, 22 bp, Homo sapiens
cagagctggtgttacaagtcca

SEQ ID NO: 7187347 - DNA, 22 bp, Homo sapiens
cagagctggtgttacaagtcca

SEQ ID NO: 7187348 - DNA, 22 bp, Homo sapiens
cagagctgtatttatctttcca

SEQ ID NO: 7187349 - DNA, 22 bp, Homo sapiens
cagagctgtcatttgccagtga

SEQ ID NO: 7187350 - DNA, 22 bp, Homo sapiens
cagagctgtcatttgccagtga

SEQ ID NO: 7187351 - DNA, 21 bp, Homo sapiens
cagaggcctcatgctctgtgc

SEQ ID NO: 7187352 - DNA, 21 bp, Homo sapiens
cagaggcctcatgctctgtgc

SEQ ID NO: 7187353 - DNA, 22 bp, Homo sapiens
cagaggcctggcttggacacct

SEQ ID NO: 7187354 - DNA, 22 bp, Homo sapiens
cagaggcctggcttggacacct

SEQ ID NO: 7187355 - DNA, 21 bp, Homo sapiens
cagaggcctcatgctctgtgc

SEQ ID NO: 7187356 - DNA, 21 bp, Homo sapiens
cagaggcctcatgctctgtgc

SEQ ID NO: 7187357 - DNA, 21 bp, Homo sapiens
cagaggcctcatgctctgtgc

SEQ ID NO: 7187358 - DNA, 22 bp, Homo sapiens
cagaggcctcacttccagccag

SEQ ID NO: 7187359 - DNA, 22 bp, Homo sapiens
cagaggcctcacttccagccag

SEQ ID NO: 7187360 - DNA, 22 bp, Homo sapiens
cagaggcctcacttccagccag

SEQ ID NO: 7187361 - DNA, 22 bp, Homo sapiens
cagaggccccagaactagctct

SEQ ID NO: 7187362 - DNA, 21 bp, Homo sapiens
cagaggcctatcacagactcc

SEQ ID NO: 7187363 - DNA, 21 bp, Homo sapiens
cagaggcctatcacagactcc

SEQ ID NO: 7187364 - DNA, 21 bp, Homo sapiens
cagaggcctatcacagactcc

SEQ ID NO: 7187365 - DNA, 21 bp, Homo sapiens
cagaggcctatcacagactcc

SEQ ID NO: 7187366 - DNA, 21 bp, Homo sapiens
cagaggcctatcacagactcc

SEQ ID NO: 7187367 - DNA, 22 bp, Homo sapiens
cagaggcctatccagtgtccat

SEQ ID NO: 7187368 - DNA, 22 bp, Homo sapiens
cagaggcctatccagtgtccat

SEQ ID NO: 7187369 - DNA, 22 bp, Homo sapiens
cagaggcccagtgagagggctg

SEQ ID NO: 7187370 - DNA, 22 bp, Homo sapiens
cagaggccccagaactagctct

SEQ ID NO: 7187371 - DNA, 22 bp, Homo sapiens
cagaggccccagaactagctct

SEQ ID NO: 7187372 - DNA, 22 bp, Homo sapiens
cagaggccccagaactagctct

SEQ ID NO: 7187373 - DNA, 22 bp, Homo sapiens
cagaggcccagtgagagggctg

SEQ ID NO: 7187374 - DNA, 22 bp, Homo sapiens
cagaggcccagtgagagggctg

SEQ ID NO: 7187375 - DNA, 22 bp, Homo sapiens
cagaggccagtggacaagggcc

SEQ ID NO: 7187376 - DNA, 22 bp, Homo sapiens
cagaggccatatttcttcactc

SEQ ID NO: 7187377 - DNA, 22 bp, Homo sapiens
cagaggccagtggacaagggcc

SEQ ID NO: 7187378 - DNA, 22 bp, Homo sapiens
cagaggccagtggacaagggcc

SEQ ID NO: 7187379 - DNA, 22 bp, Homo sapiens
cagaggccagtggacaagggcc

SEQ ID NO: 7187380 - DNA, 22 bp, Homo sapiens
cagaggccagtggacaagggcc

SEQ ID NO: 7187381 - DNA, 19 bp, Homo sapiens
cagaggccagaagcacagg

SEQ ID NO: 7187382 - DNA, 19 bp, Homo sapiens
cagaggccagaagcacagg

SEQ ID NO: 7187383 - DNA, 19 bp, Homo sapiens
cagaggccagaagcacagg

SEQ ID NO: 7187384 - DNA, 22 bp, Homo sapiens
cagaggccaggctgcctgactg

SEQ ID NO: 7187385 - DNA, 22 bp, Homo sapiens
cagaggccaggctgcctgactg

SEQ ID NO: 7187386 - DNA, 22 bp, Homo sapiens
cagaggccagggggctcacaaa

SEQ ID NO: 7187387 - DNA, 22 bp, Homo sapiens
cagaggccagggggctcacaaa

SEQ ID NO: 7187388 - DNA, 22 bp, Homo sapiens
cagaggccagggggctcacaaa

SEQ ID NO: 7187389 - DNA, 22 bp, Homo sapiens
cagaggctggatggacttgcct

SEQ ID NO: 7187390 - DNA, 22 bp, Homo sapiens
gggtgctgaggaagacagcagg

SEQ ID NO: 7187391 - DNA, 22 bp, Homo sapiens
gggtgctgaggaagacagcagg

SEQ ID NO: 7187392 - DNA, 23 bp, Homo sapiens
gggtgctgcctgtagtcatgctg

SEQ ID NO: 7187393 - DNA, 22 bp, Homo sapiens
gggtgctcttgggaaacgtagt

SEQ ID NO: 7187394 - DNA, 22 bp, Homo sapiens
gggtgctgactggggcctgaaa

SEQ ID NO: 7187395 - DNA, 22 bp, Homo sapiens
gggtgctgactggggcctgaaa

SEQ ID NO: 7187396 - DNA, 22 bp, Homo sapiens
gggtgcagtggttcacgcctgt

SEQ ID NO: 7187397 - DNA, 22 bp, Homo sapiens
gggtgccacagagcttccactt

SEQ ID NO: 7187398 - DNA, 22 bp, Homo sapiens
gggtgccctgggtaggtcagtt

SEQ ID NO: 7187399 - DNA, 22 bp, Homo sapiens
gggtgccctgggtaggtcagtt

SEQ ID NO: 7187400 - DNA, 22 bp, Homo sapiens
gggtgcctgagttagggcagaa

SEQ ID NO: 7187401 - DNA, 22 bp, Homo sapiens
gggtgcctgagttagggcagaa

SEQ ID NO: 7187402 - DNA, 22 bp, Homo sapiens
gggtgcctgcctcaggcagtgt

SEQ ID NO: 7187403 - DNA, 22 bp, Homo sapiens
gggtgccttggtgtgctgtagg

SEQ ID NO: 7187404 - DNA, 22 bp, Homo sapiens
gggtgctcatggataaggcgaa

SEQ ID NO: 7187405 - DNA, 22 bp, Homo sapiens
gggtgctcctggcggcctcttt

SEQ ID NO: 7187406 - DNA, 22 bp, Homo sapiens
gggtgcagggtctccagcagct

SEQ ID NO: 7187407 - DNA, 22 bp, Homo sapiens
gggtgcagtggttcacgcctgt

SEQ ID NO: 7187408 - DNA, 22 bp, Homo sapiens
gggtgcaggggaccctagggac

SEQ ID NO: 7187409 - DNA, 22 bp, Homo sapiens
gggtgcaggggaccctagggac

SEQ ID NO: 7187410 - DNA, 22 bp, Homo sapiens
gggtgcaggggaccctagggac

SEQ ID NO: 7187411 - DNA, 22 bp, Homo sapiens
gggtgcaggggaccctagggac

SEQ ID NO: 7187412 - DNA, 22 bp, Homo sapiens
gggtcgggcaggcgccctcgtc

SEQ ID NO: 7187413 - DNA, 22 bp, Homo sapiens
gggtcgggcaggcgccctcgtc

SEQ ID NO: 7187414 - DNA, 22 bp, Homo sapiens
cagaggccttgtcttctttgct

SEQ ID NO: 7187415 - DNA, 19 bp, Homo sapiens
gggtcgggaagttgagaat

SEQ ID NO: 7187416 - DNA, 22 bp, Homo sapiens
cagaggcctggcttggacacct

SEQ ID NO: 7187417 - DNA, 22 bp, Homo sapiens
cagaggcctggcttggacacct

SEQ ID NO: 7187418 - DNA, 22 bp, Homo sapiens
cagaggcctggcttggacacct

SEQ ID NO: 7187419 - DNA, 22 bp, Homo sapiens
cagaggccttcaatactcattt

SEQ ID NO: 7187420 - DNA, 22 bp, Homo sapiens
cagaggctgggacctcaggcat

SEQ ID NO: 7187421 - DNA, 22 bp, Homo sapiens
cagaggctgggacctcaggcat

SEQ ID NO: 7187422 - DNA, 22 bp, Homo sapiens
cagaggctggcggccgccccga

SEQ ID NO: 7187423 - DNA, 22 bp, Homo sapiens
cagaggctgtgtaggcagactg

SEQ ID NO: 7187424 - DNA, 22 bp, Homo sapiens
cagaggctgggacctcaggcat

SEQ ID NO: 7187425 - DNA, 22 bp, Homo sapiens
cagaggctgtgtaggcagactg

SEQ ID NO: 7187426 - DNA, 22 bp, Homo sapiens
cagaggcttcaagtcattctcc

SEQ ID NO: 7187427 - DNA, 22 bp, Homo sapiens
cagaggcttcaagtcattctcc

SEQ ID NO: 7187428 - DNA, 22 bp, Homo sapiens
cagaggcttcaagtcattctcc

SEQ ID NO: 7187429 - DNA, 22 bp, Homo sapiens
cagaggcttatacctgattagg

SEQ ID NO: 7187430 - DNA, 22 bp, Homo sapiens
cagaggctgtgtaggcagactg

SEQ ID NO: 7187431 - DNA, 22 bp, Homo sapiens
cagaggctttgccctggaaacc

SEQ ID NO: 7187432 - DNA, 22 bp, Homo sapiens
cagaggctttgccctggaaacc

SEQ ID NO: 7187433 - DNA, 22 bp, Homo sapiens
cagaggcttggcattatcatgc

SEQ ID NO: 7187434 - DNA, 22 bp, Homo sapiens
cagaggcttcaagtcattctcc

SEQ ID NO: 7187435 - DNA, 22 bp, Homo sapiens
cagagtaaacctgtcatcaaga

SEQ ID NO: 7187436 - DNA, 22 bp, Homo sapiens
cagaggtttgatcgagtaggtc

SEQ ID NO: 7187437 - DNA, 22 bp, Homo sapiens
cagaggtttgatcgagtaggtc

SEQ ID NO: 7187438 - DNA, 22 bp, Homo sapiens
cagagtaaacctgtcatcaaga

SEQ ID NO: 7187439 - DNA, 22 bp, Homo sapiens
cagagtaaggagctgtcaaacg

SEQ ID NO: 7187440 - DNA, 22 bp, Homo sapiens
cagaggtgttggtgaatggaga

SEQ ID NO: 7187441 - DNA, 23 bp, Homo sapiens
cagaggtgtcagtgcccagtgtc

SEQ ID NO: 7187442 - DNA, 23 bp, Homo sapiens
cagaggtgtcagtgcccagtgtc

SEQ ID NO: 7187443 - DNA, 22 bp, Homo sapiens
cagaggtgtacagagggaggcc

SEQ ID NO: 7187444 - DNA, 23 bp, Homo sapiens
cagaggtgtcagtgcccagtgtc

SEQ ID NO: 7187445 - DNA, 23 bp, Homo sapiens
cagaggtgtcagtgcccagtgtc

SEQ ID NO: 7187446 - DNA, 22 bp, Homo sapiens
cagaggtgtacagagggaggcc

SEQ ID NO: 7187447 - DNA, 22 bp, Homo sapiens
cagaggtgtacagagggaggcc

SEQ ID NO: 7187448 - DNA, 22 bp, Homo sapiens
cagaggtgtacagagggaggcc

SEQ ID NO: 7187449 - DNA, 22 bp, Homo sapiens
cagaggtgtacagagggaggcc

SEQ ID NO: 7187450 - DNA, 22 bp, Homo sapiens
cagaggtagggagctatgttat

SEQ ID NO: 7187451 - DNA, 21 bp, Homo sapiens
cagaggtggcctgacctctga

SEQ ID NO: 7187452 - DNA, 22 bp, Homo sapiens
cagaggtggggagtatttcaag

SEQ ID NO: 7187453 - DNA, 22 bp, Homo sapiens
gggaaagagtgcttgtccagag

SEQ ID NO: 7187454 - DNA, 22 bp, Homo sapiens
gggaaagagaggtggacgcagg

SEQ ID NO: 7187455 - DNA, 22 bp, Homo sapiens
gggaaagagaggtggacgcagg

SEQ ID NO: 7187456 - DNA, 22 bp, Homo sapiens
gggaaagagaggtggacgcagg

SEQ ID NO: 7187457 - DNA, 22 bp, Homo sapiens
gggaaagagaggtggacgcagg

SEQ ID NO: 7187458 - DNA, 22 bp, Homo sapiens
gggaaagacttattttgacttc

SEQ ID NO: 7187459 - DNA, 22 bp, Homo sapiens
gggaaagagaggtggacgcagg

SEQ ID NO: 7187460 - DNA, 22 bp, Homo sapiens
gggaaagagaggtggacgcagg

SEQ ID NO: 7187461 - DNA, 22 bp, Homo sapiens
gggaaactcaggcatttccact

SEQ ID NO: 7187462 - DNA, 21 bp, Homo sapiens
gggaaactctgcttaacagag

SEQ ID NO: 7187463 - DNA, 22 bp, Homo sapiens
gggaaactgaattcaggactct

SEQ ID NO: 7187464 - DNA, 22 bp, Homo sapiens
gggaaactgcaactcagagagg

SEQ ID NO: 7187465 - DNA, 22 bp, Homo sapiens
gggaaactggggactgaatctg

SEQ ID NO: 7187466 - DNA, 22 bp, Homo sapiens
gggaaactggggactgaatctg

SEQ ID NO: 7187467 - DNA, 22 bp, Homo sapiens
gggaaactgtccagttctcccc

SEQ ID NO: 7187468 - DNA, 22 bp, Homo sapiens
gggaaacttctgctaaaaccag

SEQ ID NO: 7187469 - DNA, 22 bp, Homo sapiens
gggaaactttcacaatgtccag

SEQ ID NO: 7187470 - DNA, 22 bp, Homo sapiens
gggaaagaagaagagccatttt

SEQ ID NO: 7187471 - DNA, 22 bp, Homo sapiens
gggaaagaagaagagccatttt

SEQ ID NO: 7187472 - DNA, 22 bp, Homo sapiens
gggaaagaagatctagatactg

SEQ ID NO: 7187473 - DNA, 22 bp, Homo sapiens
gggaaagaccctgagtcttatt

SEQ ID NO: 7187474 - DNA, 21 bp, Homo sapiens
cagaagtaagggtaacttctc

SEQ ID NO: 7187475 - DNA, 22 bp, Homo sapiens
cagaagtaagattactgtgagt

SEQ ID NO: 7187476 - DNA, 22 bp, Homo sapiens
cagaagtaagattactgtgagt

SEQ ID NO: 7187477 - DNA, 22 bp, Homo sapiens
cagaagtaatgatgtcattcct

SEQ ID NO: 7187478 - DNA, 22 bp, Homo sapiens
cagaagtaagattactgtgagt

SEQ ID NO: 7187479 - DNA, 22 bp, Homo sapiens
cagaagtaagattactgtgaga

SEQ ID NO: 7187480 - DNA, 22 bp, Homo sapiens
cagaagtaagattactgtgaga

SEQ ID NO: 7187481 - DNA, 22 bp, Homo sapiens
cagaagtaagattactgtgaga

SEQ ID NO: 7187482 - DNA, 22 bp, Homo sapiens
cagaaggtttacactggactgt

SEQ ID NO: 7187483 - DNA, 22 bp, Homo sapiens
cagaaggtttgaaagatgtctt

SEQ ID NO: 7187484 - DNA, 22 bp, Homo sapiens
cagaaggtttgaaagatgtctt

SEQ ID NO: 7187485 - DNA, 22 bp, Homo sapiens
cagaaggtttacactggactgt

SEQ ID NO: 7187486 - DNA, 22 bp, Homo sapiens
cagaaggtattgtaattatgac

SEQ ID NO: 7187487 - DNA, 22 bp, Homo sapiens
cagaaggtattgtaattatgac

SEQ ID NO: 7187488 - DNA, 20 bp, Homo sapiens
cagaaggtctaagctttaga

SEQ ID NO: 7187489 - DNA, 22 bp, Homo sapiens
cagaaggttccacaagatagaa

SEQ ID NO: 7187490 - DNA, 22 bp, Homo sapiens
cagaaggttccacaagatagaa

SEQ ID NO: 7187491 - DNA, 22 bp, Homo sapiens
ggcttttgaattccaaggcatt

SEQ ID NO: 7187492 - DNA, 22 bp, Homo sapiens
cagaagtgaatgtgataaacca

SEQ ID NO: 7187493 - DNA, 22 bp, Homo sapiens
gggaaaaataatgcacagatat

SEQ ID NO: 7187494 - DNA, 22 bp, Homo sapiens
gggaaaaataatgcacagatat

SEQ ID NO: 7187495 - DNA, 22 bp, Homo sapiens
gggaaaacaaattaggttggct

SEQ ID NO: 7187496 - DNA, 22 bp, Homo sapiens
gggaaacaacaaagtatctatg

SEQ ID NO: 7187497 - DNA, 22 bp, Homo sapiens
gggaaactagaagcagggttat

SEQ ID NO: 7187498 - DNA, 22 bp, Homo sapiens
gggaaactcacaggtgcagggg

SEQ ID NO: 7187499 - DNA, 22 bp, Homo sapiens
cactggcccattcctgtctggc

SEQ ID NO: 7187500 - DNA, 22 bp, Homo sapiens
cactggcccattcctgtctggc

SEQ ID NO: 7187501 - DNA, 22 bp, Homo sapiens
cactggcccataaaggcctggg

SEQ ID NO: 7187502 - DNA, 22 bp, Homo sapiens
cactggcccagccaggcctgtt

SEQ ID NO: 7187503 - DNA, 22 bp, Homo sapiens
cactggctaaaaaagaggcaga

SEQ ID NO: 7187504 - DNA, 22 bp, Homo sapiens
cactggctaaaaaagaggcaga

SEQ ID NO: 7187505 - DNA, 22 bp, Homo sapiens
cactggctaaagataagctcaa

SEQ ID NO: 7187506 - DNA, 22 bp, Homo sapiens
cactgggacctaggactgagct

SEQ ID NO: 7187507 - DNA, 22 bp, Homo sapiens
cactgggacctaggactgagct

SEQ ID NO: 7187508 - DNA, 22 bp, Homo sapiens
cactgggacctaggactgagct

SEQ ID NO: 7187509 - DNA, 22 bp, Homo sapiens
cactgggaatctgggaaagaga

SEQ ID NO: 7187510 - DNA, 22 bp, Homo sapiens
cactgggaatctgggaaagaga

SEQ ID NO: 7187511 - DNA, 22 bp, Homo sapiens
cactgggaatctgggaaagaga

SEQ ID NO: 7187512 - DNA, 22 bp, Homo sapiens
cactgggaatctgggaaagaga

SEQ ID NO: 7187513 - DNA, 22 bp, Homo sapiens
cactggcttgatgggtaatgcc

SEQ ID NO: 7187514 - DNA, 22 bp, Homo sapiens
cactggctatgagggagatggg

SEQ ID NO: 7187515 - DNA, 22 bp, Homo sapiens
cactggctatgagggagatggg

SEQ ID NO: 7187516 - DNA, 22 bp, Homo sapiens
cactggctaaagataagctcaa

SEQ ID NO: 7187517 - DNA, 22 bp, Homo sapiens
cactggctccctgatttgaagc

SEQ ID NO: 7187518 - DNA, 22 bp, Homo sapiens
cactggctgagcttctctaggg

SEQ ID NO: 7187519 - DNA, 22 bp, Homo sapiens
cactggctgagcttctctaggg

SEQ ID NO: 7187520 - DNA, 22 bp, Homo sapiens
cactggctgagcttctctaggg

SEQ ID NO: 7187521 - DNA, 22 bp, Homo sapiens
cactggctgggccagcactcct

SEQ ID NO: 7187522 - DNA, 22 bp, Homo sapiens
cagaagggcagcactgggaagg

SEQ ID NO: 7187523 - DNA, 22 bp, Homo sapiens
cagaagggcagcactgggaagg

SEQ ID NO: 7187524 - DNA, 22 bp, Homo sapiens
cagaaggctttgtggagtagac

SEQ ID NO: 7187525 - DNA, 22 bp, Homo sapiens
cagaaggctttgtggagtagac

SEQ ID NO: 7187526 - DNA, 22 bp, Homo sapiens
cagaagggacagggtttgtaga

SEQ ID NO: 7187527 - DNA, 22 bp, Homo sapiens
cagaagggacagggtttgtaga

SEQ ID NO: 7187528 - DNA, 22 bp, Homo sapiens
cagaaggctttgtggagtagac

SEQ ID NO: 7187529 - DNA, 22 bp, Homo sapiens
cagaaggcctgaatctttgttc

SEQ ID NO: 7187530 - DNA, 22 bp, Homo sapiens
cagaaggctgcaggtttgctgt

SEQ ID NO: 7187531 - DNA, 22 bp, Homo sapiens
cagaaggcatagatgaaggcct

SEQ ID NO: 7187532 - DNA, 22 bp, Homo sapiens
cagaaggcatagatgaaggcct

SEQ ID NO: 7187533 - DNA, 22 bp, Homo sapiens
cagaaggcatagatgaaggcct

SEQ ID NO: 7187534 - DNA, 22 bp, Homo sapiens
cagaaggcagcaaatgaaaacc

SEQ ID NO: 7187535 - DNA, 22 bp, Homo sapiens
cactgggagagctggacttggg

SEQ ID NO: 7187536 - DNA, 22 bp, Homo sapiens
cagaaggcaaacaaaaggattt

SEQ ID NO: 7187537 - DNA, 22 bp, Homo sapiens
cagaaggcaaggcctgccacgc

SEQ ID NO: 7187538 - DNA, 22 bp, Homo sapiens
gggactggagtagaggccggtg

SEQ ID NO: 7187539 - DNA, 22 bp, Homo sapiens
gggactggatagatgtgggtga

SEQ ID NO: 7187540 - DNA, 22 bp, Homo sapiens
gggactggagtagaggccggtg

SEQ ID NO: 7187541 - DNA, 22 bp, Homo sapiens
gggactggatagatgtgggtga

SEQ ID NO: 7187542 - DNA, 22 bp, Homo sapiens
gggactggatagatgtgggtga

SEQ ID NO: 7187543 - DNA, 22 bp, Homo sapiens
gggactggcacagggctgggag

SEQ ID NO: 7187544 - DNA, 22 bp, Homo sapiens
gggactggcacagggctgggag

SEQ ID NO: 7187545 - DNA, 22 bp, Homo sapiens
gggactggcacagggctgggag

SEQ ID NO: 7187546 - DNA, 22 bp, Homo sapiens
gggactggatagatgtgggtga

SEQ ID NO: 7187547 - DNA, 22 bp, Homo sapiens
gggactggatagatgtgggtga

SEQ ID NO: 7187548 - DNA, 22 bp, Homo sapiens
gggactggcacagggctgggag

SEQ ID NO: 7187549 - DNA, 22 bp, Homo sapiens
gggactggcacagggctgggag

SEQ ID NO: 7187550 - DNA, 22 bp, Homo sapiens
gggactggcacagggctgggag

SEQ ID NO: 7187551 - DNA, 22 bp, Homo sapiens
gggactggccagggtttggaat

SEQ ID NO: 7187552 - DNA, 22 bp, Homo sapiens
gggactgggagatcctcctggc

SEQ ID NO: 7187553 - DNA, 22 bp, Homo sapiens
gggactggccagggtttggaat

SEQ ID NO: 7187554 - DNA, 22 bp, Homo sapiens
gggactggccagggtttggaat

SEQ ID NO: 7187555 - DNA, 22 bp, Homo sapiens
gggactggcacagggctgggag

SEQ ID NO: 7187556 - DNA, 22 bp, Homo sapiens
gggactggcacagggctgggag

SEQ ID NO: 7187557 - DNA, 22 bp, Homo sapiens
gggactggcacagggctgggag

SEQ ID NO: 7187558 - DNA, 22 bp, Homo sapiens
gggactggaactactggtgcag

SEQ ID NO: 7187559 - DNA, 22 bp, Homo sapiens
gggactggaactactggtgcag

SEQ ID NO: 7187560 - DNA, 22 bp, Homo sapiens
gggactctgagagcctgagggt

SEQ ID NO: 7187561 - DNA, 22 bp, Homo sapiens
gggactcctttaaggagggtga

SEQ ID NO: 7187562 - DNA, 22 bp, Homo sapiens
gggactctgagagcctgagggt

SEQ ID NO: 7187563 - DNA, 22 bp, Homo sapiens
gggactggaactactggtgcag

SEQ ID NO: 7187564 - DNA, 22 bp, Homo sapiens
gggactggaactactggtgcag

SEQ ID NO: 7187565 - DNA, 19 bp, Homo sapiens
gggactggaggatgtggag

SEQ ID NO: 7187566 - DNA, 19 bp, Homo sapiens
gggactggaggatgtggag

SEQ ID NO: 7187567 - DNA, 19 bp, Homo sapiens
gggactggaggatgtggag

SEQ ID NO: 7187568 - DNA, 19 bp, Homo sapiens
gggactggaggatgtggag

SEQ ID NO: 7187569 - DNA, 22 bp, Homo sapiens
gggactggagtagaggccggtg

SEQ ID NO: 7187570 - DNA, 19 bp, Homo sapiens
gggactggaggatgtggag

SEQ ID NO: 7187571 - DNA, 19 bp, Homo sapiens
gggactggaggatgtggag

SEQ ID NO: 7187572 - DNA, 22 bp, Homo sapiens
gggactggagtagaggccggtg

SEQ ID NO: 7187573 - DNA, 21 bp, Homo sapiens
gggacaccaactccagggctt

SEQ ID NO: 7187574 - DNA, 21 bp, Homo sapiens
gggacaccaactccagggctt

SEQ ID NO: 7187575 - DNA, 19 bp, Homo sapiens
gggacaccagaagaacaag

SEQ ID NO: 7187576 - DNA, 17 bp, Homo sapiens
gggacaccccagtttgt

SEQ ID NO: 7187577 - DNA, 22 bp, Homo sapiens
gggacactcaatgagacctgca

SEQ ID NO: 7187578 - DNA, 22 bp, Homo sapiens
gggacagaaggaagtgagcaca

SEQ ID NO: 7187579 - DNA, 22 bp, Homo sapiens
gggacagaaggaagtgagcaca

SEQ ID NO: 7187580 - DNA, 22 bp, Homo sapiens
gggacagaaggaagtgagcaca

SEQ ID NO: 7187581 - DNA, 22 bp, Homo sapiens
gggacagaaggaagtgagcaca

SEQ ID NO: 7187582 - DNA, 22 bp, Homo sapiens
gggacagaaggaagtgagcaca

SEQ ID NO: 7187583 - DNA, 22 bp, Homo sapiens
gggacagaaggaagtgagcaca

SEQ ID NO: 7187584 - DNA, 22 bp, Homo sapiens
gggacagaaggaagtgagcaca

SEQ ID NO: 7187585 - DNA, 22 bp, Homo sapiens
gggacagaaggaagtgagcaca

SEQ ID NO: 7187586 - DNA, 22 bp, Homo sapiens
gggacagaaggaagtgagcaca

SEQ ID NO: 7187587 - DNA, 22 bp, Homo sapiens
gggacagacccatgggccaggt

SEQ ID NO: 7187588 - DNA, 22 bp, Homo sapiens
gggacagacccatgggccaggt

SEQ ID NO: 7187589 - DNA, 22 bp, Homo sapiens
gggacagacccatgggccaggt

SEQ ID NO: 7187590 - DNA, 22 bp, Homo sapiens
gggacagacccatgggccaggt

SEQ ID NO: 7187591 - DNA, 22 bp, Homo sapiens
gggacagacccatgggccaggt

SEQ ID NO: 7187592 - DNA, 22 bp, Homo sapiens
gggacagacccatgggccaggt

SEQ ID NO: 7187593 - DNA, 22 bp, Homo sapiens
gggacagagcaacttgggatgg

SEQ ID NO: 7187594 - DNA, 22 bp, Homo sapiens
gggacagagcaacttgggatgg

SEQ ID NO: 7187595 - DNA, 22 bp, Homo sapiens
gggacagagcaacttgggatgg

SEQ ID NO: 7187596 - DNA, 22 bp, Homo sapiens
gggacagaggcaaactagcaga

SEQ ID NO: 7187597 - DNA, 22 bp, Homo sapiens
gggacagagcaacttgggatgg

SEQ ID NO: 7187598 - DNA, 22 bp, Homo sapiens
gggacagaggcaaactagcaga

SEQ ID NO: 7187599 - DNA, 22 bp, Homo sapiens
gggacagaggcaaactagcaga

SEQ ID NO: 7187600 - DNA, 22 bp, Homo sapiens
gggacagaggcaaactagcaga

SEQ ID NO: 7187601 - DNA, 22 bp, Homo sapiens
gggacagcagaaagaaggcaag

SEQ ID NO: 7187602 - DNA, 22 bp, Homo sapiens
gggacagcagaaagaaggcaag

SEQ ID NO: 7187603 - DNA, 22 bp, Homo sapiens
gggactccataagcacatggat

SEQ ID NO: 7187604 - DNA, 22 bp, Homo sapiens
gggactcctgcatttcaagtcc

SEQ ID NO: 7187605 - DNA, 22 bp, Homo sapiens
gggactcctgcatttcaagtcc

SEQ ID NO: 7187606 - DNA, 22 bp, Homo sapiens
gggactcctttaaggagggtga

SEQ ID NO: 7187607 - DNA, 18 bp, Homo sapiens
gggaagccgggaagccgg

SEQ ID NO: 7187608 - DNA, 22 bp, Homo sapiens
gggaaaggatcagtgggaggct

SEQ ID NO: 7187609 - DNA, 22 bp, Homo sapiens
gggaaaggatcagtgggaggct

SEQ ID NO: 7187610 - DNA, 23 bp, Homo sapiens
gggaaaggatatgatcctagggg

SEQ ID NO: 7187611 - DNA, 22 bp, Homo sapiens
gggaaggaaagttattagcaga

SEQ ID NO: 7187612 - DNA, 22 bp, Homo sapiens
gggaaggaaagttattagcaga

SEQ ID NO: 7187613 - DNA, 23 bp, Homo sapiens
gggaagctccatggaggtgctgg

SEQ ID NO: 7187614 - DNA, 22 bp, Homo sapiens
gggaaggacattctgggctcag

SEQ ID NO: 7187615 - DNA, 22 bp, Homo sapiens
gggaaggacacagccatgactg

SEQ ID NO: 7187616 - DNA, 22 bp, Homo sapiens
gggaaggacacagccatgactg

SEQ ID NO: 7187617 - DNA, 22 bp, Homo sapiens
gggaaggacacagccatgactg

SEQ ID NO: 7187618 - DNA, 22 bp, Homo sapiens
gggaaggacacagccatgactg

SEQ ID NO: 7187619 - DNA, 22 bp, Homo sapiens
gggaaggacacagccatgactg

SEQ ID NO: 7187620 - DNA, 22 bp, Homo sapiens
gggaaggaaatcttgcttgtga

SEQ ID NO: 7187621 - DNA, 22 bp, Homo sapiens
gggaaggaaatcttgcttgtga

SEQ ID NO: 7187622 - DNA, 22 bp, Homo sapiens
gggaaggacattctgggctcag

SEQ ID NO: 7187623 - DNA, 22 bp, Homo sapiens
gggaaggacattctgggctcag

SEQ ID NO: 7187624 - DNA, 22 bp, Homo sapiens
gggaaggacattctgggctcag

SEQ ID NO: 7187625 - DNA, 22 bp, Homo sapiens
gggaaggagcctgcttgctaga

SEQ ID NO: 7187626 - DNA, 22 bp, Homo sapiens
gggaaggaggtggcttgaagtg

SEQ ID NO: 7187627 - DNA, 22 bp, Homo sapiens
gggaaggaggtggcttgaagtg

SEQ ID NO: 7187628 - DNA, 22 bp, Homo sapiens
gggaaggaggtggacctgcccc

SEQ ID NO: 7187629 - DNA, 22 bp, Homo sapiens
gggaaggaggtggacctgcccc

SEQ ID NO: 7187630 - DNA, 22 bp, Homo sapiens
gggaaggaggtggacctgcccc

SEQ ID NO: 7187631 - DNA, 22 bp, Homo sapiens
gggaaggaggtggcttgaagtg

SEQ ID NO: 7187632 - DNA, 22 bp, Homo sapiens
gggaatgtggcaggcagcagtt

SEQ ID NO: 7187633 - DNA, 22 bp, Homo sapiens
gggaatgtggccctggggctcc

SEQ ID NO: 7187634 - DNA, 22 bp, Homo sapiens
gggaatgtggccctggggctcc

SEQ ID NO: 7187635 - DNA, 22 bp, Homo sapiens
gggaatgtggcaggcagcagtt

SEQ ID NO: 7187636 - DNA, 22 bp, Homo sapiens
gggaatgtggtgatagtctata

SEQ ID NO: 7187637 - DNA, 22 bp, Homo sapiens
gggaatgtgtctgatggaaaga

SEQ ID NO: 7187638 - DNA, 22 bp, Homo sapiens
gggaatgtgtctgatggaaaga

SEQ ID NO: 7187639 - DNA, 22 bp, Homo sapiens
gggaatgtggtgatagtctata

SEQ ID NO: 7187640 - DNA, 16 bp, Homo sapiens
gggaatgtgtcttctc

SEQ ID NO: 7187641 - DNA, 16 bp, Homo sapiens
gggaatgtgtcttctc

SEQ ID NO: 7187642 - DNA, 22 bp, Homo sapiens
gggaatgttgactgagagcagg

SEQ ID NO: 7187643 - DNA, 22 bp, Homo sapiens
gggaatgttgactgagagcagg

SEQ ID NO: 7187644 - DNA, 15 bp, Homo sapiens
gggaatgttttacaa

SEQ ID NO: 7187645 - DNA, 15 bp, Homo sapiens
gggaatgttttacaa

SEQ ID NO: 7187646 - DNA, 22 bp, Homo sapiens
gggaatgttgactgagagcagg

SEQ ID NO: 7187647 - DNA, 22 bp, Homo sapiens
gggacaatggaggcctctctcc

SEQ ID NO: 7187648 - DNA, 22 bp, Homo sapiens
gggacaatggaggcctctctcc

SEQ ID NO: 7187649 - DNA, 22 bp, Homo sapiens
gggaggtagcaagcctgcagct

SEQ ID NO: 7187650 - DNA, 22 bp, Homo sapiens
gggaggtcagggtgcctgctgg

SEQ ID NO: 7187651 - DNA, 22 bp, Homo sapiens
gggaggtaaagatgagctcagt

SEQ ID NO: 7187652 - DNA, 22 bp, Homo sapiens
gggaggtagcaagcctgcagct

SEQ ID NO: 7187653 - DNA, 22 bp, Homo sapiens
gggagggtctgccatgctccct

SEQ ID NO: 7187654 - DNA, 22 bp, Homo sapiens
gggagggtgttctcccaagaac

SEQ ID NO: 7187655 - DNA, 22 bp, Homo sapiens
gggagggtgttctcccaagaac

SEQ ID NO: 7187656 - DNA, 22 bp, Homo sapiens
gggagggtctgagagctgcacc

SEQ ID NO: 7187657 - DNA, 22 bp, Homo sapiens
gggagggtctgagagctgcacc

SEQ ID NO: 7187658 - DNA, 22 bp, Homo sapiens
gggaggggttgcatgtttgagt

SEQ ID NO: 7187659 - DNA, 22 bp, Homo sapiens
gggaggggttgcatgtttgagt

SEQ ID NO: 7187660 - DNA, 22 bp, Homo sapiens
gggaggtgaaaggttgctgcag

SEQ ID NO: 7187661 - DNA, 22 bp, Homo sapiens
cagacaggctagccagactcac

SEQ ID NO: 7187662 - DNA, 22 bp, Homo sapiens
gggaggtgaaaggtcatgtgtg

SEQ ID NO: 7187663 - DNA, 22 bp, Homo sapiens
gggaggtgaaaggttgctgcag

SEQ ID NO: 7187664 - DNA, 22 bp, Homo sapiens
gggaggtcagggtgcctgctgg

SEQ ID NO: 7187665 - DNA, 22 bp, Homo sapiens
gggaggtcctaaaggggaccag

SEQ ID NO: 7187666 - DNA, 22 bp, Homo sapiens
gggaggtgaaaggtcatgtgtg

SEQ ID NO: 7187667 - DNA, 22 bp, Homo sapiens
gggaggtgaaaggtcatgtgtg

SEQ ID NO: 7187668 - DNA, 22 bp, Homo sapiens
gggaggtgaaaggtcatgtgtg

SEQ ID NO: 7187669 - DNA, 22 bp, Homo sapiens
gggaggggttgcatgtttgagt

SEQ ID NO: 7187670 - DNA, 22 bp, Homo sapiens
gggaggggttgcatgtttgagt

SEQ ID NO: 7187671 - DNA, 22 bp, Homo sapiens
gggagggcttggacccagatgt

SEQ ID NO: 7187672 - DNA, 22 bp, Homo sapiens
gggagggcttggacccagatgt

SEQ ID NO: 7187673 - DNA, 22 bp, Homo sapiens
gggagggcttggacccagatgt

SEQ ID NO: 7187674 - DNA, 22 bp, Homo sapiens
gggagggccagtgctctctaga

SEQ ID NO: 7187675 - DNA, 22 bp, Homo sapiens
gggagggccagtgctctctaga

SEQ ID NO: 7187676 - DNA, 22 bp, Homo sapiens
gggagggccagtgctctctaga

SEQ ID NO: 7187677 - DNA, 22 bp, Homo sapiens
gggagggccagtgctctctaga

SEQ ID NO: 7187678 - DNA, 22 bp, Homo sapiens
gggagggcttggacccagatgt

SEQ ID NO: 7187679 - DNA, 22 bp, Homo sapiens
gggagggcttggacccagatgt

SEQ ID NO: 7187680 - DNA, 22 bp, Homo sapiens
gggagggcttggacccagatgt

SEQ ID NO: 7187681 - DNA, 22 bp, Homo sapiens
gggaggggttgcatgtttgagt

SEQ ID NO: 7187682 - DNA, 22 bp, Homo sapiens
gggaggggttgcatgtttgagt

SEQ ID NO: 7187683 - DNA, 22 bp, Homo sapiens
gggaggggttgcatgtttgagt

SEQ ID NO: 7187684 - DNA, 22 bp, Homo sapiens
gggaggggttgcatgtttgagt

SEQ ID NO: 7187685 - DNA, 22 bp, Homo sapiens
gggagcagttaaaatgattcct

SEQ ID NO: 7187686 - DNA, 22 bp, Homo sapiens
gggagcaggagcctgcctgcca

SEQ ID NO: 7187687 - DNA, 22 bp, Homo sapiens
gggagcaggagcctgcctgcca

SEQ ID NO: 7187688 - DNA, 22 bp, Homo sapiens
gggagcaggagcctgcctgcca

SEQ ID NO: 7187689 - DNA, 22 bp, Homo sapiens
gggagcagttaaaatgattcct

SEQ ID NO: 7187690 - DNA, 20 bp, Homo sapiens
gggaggcattggtccctcac

SEQ ID NO: 7187691 - DNA, 20 bp, Homo sapiens
gggaggccagcctcagagaa

SEQ ID NO: 7187692 - DNA, 22 bp, Homo sapiens
gggagggccaggctcacccagg

SEQ ID NO: 7187693 - DNA, 22 bp, Homo sapiens
gggagggccaggctcacccagg

SEQ ID NO: 7187694 - DNA, 22 bp, Homo sapiens
gggagggccaggctcacccagg

SEQ ID NO: 7187695 - DNA, 22 bp, Homo sapiens
gggagggccagtgctctctaga

SEQ ID NO: 7187696 - DNA, 22 bp, Homo sapiens
gggagggccagtgctctctaga

SEQ ID NO: 7187697 - DNA, 22 bp, Homo sapiens
gggcaagcagtggctaccagta

SEQ ID NO: 7187698 - DNA, 20 bp, Homo sapiens
gggcaaggaaacagccccca

SEQ ID NO: 7187699 - DNA, 22 bp, Homo sapiens
gggcaaggcagaagagttggag

SEQ ID NO: 7187700 - DNA, 22 bp, Homo sapiens
gggcaaggcagaagagttggag

SEQ ID NO: 7187701 - DNA, 22 bp, Homo sapiens
gggcaaggcagaagagttggag

SEQ ID NO: 7187702 - DNA, 20 bp, Homo sapiens
gggcaaggaaacagccccca

SEQ ID NO: 7187703 - DNA, 20 bp, Homo sapiens
gggcaaggaaacagccccca

SEQ ID NO: 7187704 - DNA, 20 bp, Homo sapiens
gggcaaggaaacagccccca

SEQ ID NO: 7187705 - DNA, 22 bp, Homo sapiens
gggcaatgctatgaagagctaa

SEQ ID NO: 7187706 - DNA, 22 bp, Homo sapiens
gggcaatggatgtgatgactcc

SEQ ID NO: 7187707 - DNA, 22 bp, Homo sapiens
gggcaatgggcttttctgtaag

SEQ ID NO: 7187708 - DNA, 22 bp, Homo sapiens
gggcaatggtcacatagagtga

SEQ ID NO: 7187709 - DNA, 22 bp, Homo sapiens
gggcaatggtcacatagagtga

SEQ ID NO: 7187710 - DNA, 22 bp, Homo sapiens
gggcaatggtcacatagagtga

SEQ ID NO: 7187711 - DNA, 22 bp, Homo sapiens
gggcaatgtctgtggccactaa

SEQ ID NO: 7187712 - DNA, 22 bp, Homo sapiens
gggcaatgtggcaaaaccctgt

SEQ ID NO: 7187713 - DNA, 22 bp, Homo sapiens
gggcaatgtgtgttcactatat

SEQ ID NO: 7187714 - DNA, 22 bp, Homo sapiens
gggcaattaaggtcccgtttcc

SEQ ID NO: 7187715 - DNA, 22 bp, Homo sapiens
gggcaattcacagggttgttat

SEQ ID NO: 7187716 - DNA, 22 bp, Homo sapiens
gggcacaccttgtctgagcaca

SEQ ID NO: 7187717 - DNA, 22 bp, Homo sapiens
gggcaagcagtgaggacagcac

SEQ ID NO: 7187718 - DNA, 20 bp, Homo sapiens
gggatgagagtcctagctct

SEQ ID NO: 7187719 - DNA, 22 bp, Homo sapiens
cagacagggtcctgtccgtcac

SEQ ID NO: 7187720 - DNA, 22 bp, Homo sapiens
cagacaggggtaaccttcctca

SEQ ID NO: 7187721 - DNA, 22 bp, Homo sapiens
gggatgagagtagggtgtgaaa

SEQ ID NO: 7187722 - DNA, 22 bp, Homo sapiens
gggatgagagtagggtgtgaaa

SEQ ID NO: 7187723 - DNA, 22 bp, Homo sapiens
cagacagggccctgtgatggta

SEQ ID NO: 7187724 - DNA, 22 bp, Homo sapiens
cagacagggccctgtgatggta

SEQ ID NO: 7187725 - DNA, 22 bp, Homo sapiens
cagacagggccctgtgatggta

SEQ ID NO: 7187726 - DNA, 22 bp, Homo sapiens
cagacagggccctgtgatggta

SEQ ID NO: 7187727 - DNA, 22 bp, Homo sapiens
cagacaggggtaaccttcctca

SEQ ID NO: 7187728 - DNA, 22 bp, Homo sapiens
cagacaggggtaaccttcctca

SEQ ID NO: 7187729 - DNA, 17 bp, Homo sapiens
cagacaggctgtcaccc

SEQ ID NO: 7187730 - DNA, 17 bp, Homo sapiens
cagacaggctgtcaccc

SEQ ID NO: 7187731 - DNA, 22 bp, Homo sapiens
cagacaggctagccagactcac

SEQ ID NO: 7187732 - DNA, 17 bp, Homo sapiens
cagacaggctgtcaccc

SEQ ID NO: 7187733 - DNA, 17 bp, Homo sapiens
cagacaggctgtcaccc

SEQ ID NO: 7187734 - DNA, 17 bp, Homo sapiens
cagacaggctgtcaccc

SEQ ID NO: 7187735 - DNA, 22 bp, Homo sapiens
cagacagggacctcgctccaga

SEQ ID NO: 7187736 - DNA, 22 bp, Homo sapiens
cagacagggacctcgctccaga

SEQ ID NO: 7187737 - DNA, 17 bp, Homo sapiens
cagacaggctgtcaccc

SEQ ID NO: 7187738 - DNA, 22 bp, Homo sapiens
cagacagggccctgtgatggta

SEQ ID NO: 7187739 - DNA, 22 bp, Homo sapiens
cagaagtggcctcagagggagt

SEQ ID NO: 7187740 - DNA, 22 bp, Homo sapiens
cagaagtggtattaattagatt

SEQ ID NO: 7187741 - DNA, 22 bp, Homo sapiens
cagaagttagtcttaattataa

SEQ ID NO: 7187742 - DNA, 22 bp, Homo sapiens
cagaagtgatgttgagctagtc

SEQ ID NO: 7187743 - DNA, 22 bp, Homo sapiens
cagaagtgcaatttaaattagg

SEQ ID NO: 7187744 - DNA, 22 bp, Homo sapiens
cagaagtgcaatttaaattagg

SEQ ID NO: 7187745 - DNA, 22 bp, Homo sapiens
cagaagtggatattagagtaat

SEQ ID NO: 7187746 - DNA, 22 bp, Homo sapiens
cagaagtggatattagagtaat

SEQ ID NO: 7187747 - DNA, 22 bp, Homo sapiens
cagaagtggcatcattcaagag

SEQ ID NO: 7187748 - DNA, 22 bp, Homo sapiens
cagaagtggcatcattcaagag

SEQ ID NO: 7187749 - DNA, 22 bp, Homo sapiens
gggactgtcctacatggagagg

SEQ ID NO: 7187750 - DNA, 22 bp, Homo sapiens
gggactgtccggcagaaggtac

SEQ ID NO: 7187751 - DNA, 22 bp, Homo sapiens
gggacttaatgcagagagggac

SEQ ID NO: 7187752 - DNA, 22 bp, Homo sapiens
cagaagtgaatgtgataaacca

SEQ ID NO: 7187753 - DNA, 22 bp, Homo sapiens
cagaagtgatgttgagctagtc

SEQ ID NO: 7187754 - DNA, 22 bp, Homo sapiens
cagaagtgatgttgagctagtc

SEQ ID NO: 7187755 - DNA, 22 bp, Homo sapiens
cagacaggaagttcagaagaaa

SEQ ID NO: 7187756 - DNA, 22 bp, Homo sapiens
cagacagaaggctccttgaggt

SEQ ID NO: 7187757 - DNA, 22 bp, Homo sapiens
cagacaggaattctggcgtggt

SEQ ID NO: 7187758 - DNA, 22 bp, Homo sapiens
cagacaggaattctggcgtggt

SEQ ID NO: 7187759 - DNA, 22 bp, Homo sapiens
cagacaggaattctggcgtggt

SEQ ID NO: 7187760 - DNA, 22 bp, Homo sapiens
cagaagttttgctctcttgggt

SEQ ID NO: 7187761 - DNA, 22 bp, Homo sapiens
cagaataaaaactcctatgtct

SEQ ID NO: 7187762 - DNA, 22 bp, Homo sapiens
cagacagaaggctccttgaggt

SEQ ID NO: 7187763 - DNA, 22 bp, Homo sapiens
cagaagttagtgtctgccagta

SEQ ID NO: 7187764 - DNA, 22 bp, Homo sapiens
cagaagttatgtcaatggtcat

SEQ ID NO: 7187765 - DNA, 22 bp, Homo sapiens
cagaagttctttcatataggct

SEQ ID NO: 7187766 - DNA, 22 bp, Homo sapiens
cagaagttctagatttgagtcc

SEQ ID NO: 7187767 - DNA, 22 bp, Homo sapiens
cagaagttgccacatgaccctt

SEQ ID NO: 7187768 - DNA, 22 bp, Homo sapiens
cagaagtttgaatgagagcctg

SEQ ID NO: 7187769 - DNA, 22 bp, Homo sapiens
gggagcaggagcctgcctgcca

SEQ ID NO: 7187770 - DNA, 22 bp, Homo sapiens
gggagcaggagcctgcctgcca

SEQ ID NO: 7187771 - DNA, 19 bp, Homo sapiens
gggagcaggaaagctgtgg

SEQ ID NO: 7187772 - DNA, 22 bp, Homo sapiens
gggagcaggacataatagcaat

SEQ ID NO: 7187773 - DNA, 22 bp, Homo sapiens
gggagcaggacataatagcaat

SEQ ID NO: 7187774 - DNA, 22 bp, Homo sapiens
gggagcaggacataatagcaat

SEQ ID NO: 7187775 - DNA, 22 bp, Homo sapiens
gggagcaggacataatagcaat

SEQ ID NO: 7187776 - DNA, 19 bp, Homo sapiens
gggagcaggaaagctgtgg

SEQ ID NO: 7187777 - DNA, 22 bp, Homo sapiens
gggagcagcctgcctcccacct

SEQ ID NO: 7187778 - DNA, 19 bp, Homo sapiens
gggagcaggaaagctgtgg

SEQ ID NO: 7187779 - DNA, 22 bp, Homo sapiens
gggagcagcctgcctcccacct

SEQ ID NO: 7187780 - DNA, 22 bp, Homo sapiens
gggagcactgagaggcaggtag

SEQ ID NO: 7187781 - DNA, 22 bp, Homo sapiens
gggagcacatctgagcacccgg

SEQ ID NO: 7187782 - DNA, 22 bp, Homo sapiens
gggagcacccgtggcctcaagg

SEQ ID NO: 7187783 - DNA, 22 bp, Homo sapiens
gggagcactaaggcagtcgctt

SEQ ID NO: 7187784 - DNA, 22 bp, Homo sapiens
gggagcactgagaggcaggtag

SEQ ID NO: 7187785 - DNA, 22 bp, Homo sapiens
cagacaggagactggatcatgg

SEQ ID NO: 7187786 - DNA, 22 bp, Homo sapiens
cagacaggagactggatcatgg

SEQ ID NO: 7187787 - DNA, 22 bp, Homo sapiens
cagacaggaattctggcgtggt

SEQ ID NO: 7187788 - DNA, 22 bp, Homo sapiens
cagacaggaattctggcgtggt

SEQ ID NO: 7187789 - DNA, 22 bp, Homo sapiens
cagacaggaattctggcgtggt

SEQ ID NO: 7187790 - DNA, 22 bp, Homo sapiens
cagacaggaattctggcgtggt

SEQ ID NO: 7187791 - DNA, 22 bp, Homo sapiens
cagacaggcaggtgagagctcc

SEQ ID NO: 7187792 - DNA, 22 bp, Homo sapiens
cagacaggagactggatcatgg

SEQ ID NO: 7187793 - DNA, 22 bp, Homo sapiens
cagacaggcaggtgagagctcc

SEQ ID NO: 7187794 - DNA, 22 bp, Homo sapiens
cagacaggcaggtgagagctcc

SEQ ID NO: 7187795 - DNA, 22 bp, Homo sapiens
cagacaggagactggatcatgg

SEQ ID NO: 7187796 - DNA, 22 bp, Homo sapiens
cagacaggcaggtgagagctcc

SEQ ID NO: 7187797 - DNA, 22 bp, Homo sapiens
cagacaggcaggtgagagctcc

SEQ ID NO: 7187798 - DNA, 22 bp, Homo sapiens
cagacaggcaggtgctgctttg

SEQ ID NO: 7187799 - DNA, 22 bp, Homo sapiens
cagacaggcaggtgctgctttg

SEQ ID NO: 7187800 - DNA, 22 bp, Homo sapiens
cagacaggcaggtgagagctcc

SEQ ID NO: 7187801 - DNA, 22 bp, Homo sapiens
cagacaggcaggtgagagctcc

SEQ ID NO: 7187802 - DNA, 22 bp, Homo sapiens
cagacaggcaggtgagagctcc

SEQ ID NO: 7187803 - DNA, 22 bp, Homo sapiens
cagacaggctagccagactcac

SEQ ID NO: 7187804 - DNA, 22 bp, Homo sapiens
cagacaggcaggtgctgctttg

SEQ ID NO: 7187805 - DNA, 22 bp, Homo sapiens
cagacaggcaggtgctgctttg

SEQ ID NO: 7187806 - DNA, 22 bp, Homo sapiens
cagacaggctagccagactcac

SEQ ID NO: 7187807 - DNA, 22 bp, Homo sapiens
cagacaggctagccagactcac

SEQ ID NO: 7187808 - DNA, 23 bp, Homo sapiens
gggagcacagcctggtgggcgcg

SEQ ID NO: 7187809 - DNA, 23 bp, Homo sapiens
gggagcacagcctggtgggcgcg

SEQ ID NO: 7187810 - DNA, 19 bp, Homo sapiens
gggagcacaagcgttaaga

SEQ ID NO: 7187811 - DNA, 22 bp, Homo sapiens
gcttggcccattgatcagctgg

SEQ ID NO: 7187812 - DNA, 22 bp, Homo sapiens
gcttggccctgccgcctgggtc

SEQ ID NO: 7187813 - DNA, 22 bp, Homo sapiens
gcttggccctgccgcctgggtc

SEQ ID NO: 7187814 - DNA, 22 bp, Homo sapiens
gcttggctcctggctcacaggt

SEQ ID NO: 7187815 - DNA, 22 bp, Homo sapiens
gcttggctctaagacacctatt

SEQ ID NO: 7187816 - DNA, 18 bp, Homo sapiens
gcttggctgcagagagag

SEQ ID NO: 7187817 - DNA, 22 bp, Homo sapiens
gcttggctgcctttggatgttg

SEQ ID NO: 7187818 - DNA, 22 bp, Homo sapiens
gcttggctgcctttggatgttg

SEQ ID NO: 7187819 - DNA, 22 bp, Homo sapiens
gcttggctggaaataggttgag

SEQ ID NO: 7187820 - DNA, 22 bp, Homo sapiens
gcttctgacagcacctgaactt

SEQ ID NO: 7187821 - DNA, 22 bp, Homo sapiens
gcttctctttctcccctggcgg

SEQ ID NO: 7187822 - DNA, 22 bp, Homo sapiens
gcttctcttgtccaagggcagg

SEQ ID NO: 7187823 - DNA, 22 bp, Homo sapiens
gcttctcttcgcctaggtcctt

SEQ ID NO: 7187824 - DNA, 22 bp, Homo sapiens
gcttctgaggaaggctcagcct

SEQ ID NO: 7187825 - DNA, 22 bp, Homo sapiens
gcttggcatttgctgggagctg

SEQ ID NO: 7187826 - DNA, 22 bp, Homo sapiens
gcttggccagcagccgggatgc

SEQ ID NO: 7187827 - DNA, 22 bp, Homo sapiens
gcttggccagcagccgggatgc

SEQ ID NO: 7187828 - DNA, 22 bp, Homo sapiens
caatttctcgaactctaatcca

SEQ ID NO: 7187829 - DNA, 22 bp, Homo sapiens
cacaaaatatcaagcactttta

SEQ ID NO: 7187830 - DNA, 22 bp, Homo sapiens
cacaaaatatcaagcactttta

SEQ ID NO: 7187831 - DNA, 22 bp, Homo sapiens
caatttctcgaactctaatcca

SEQ ID NO: 7187832 - DNA, 22 bp, Homo sapiens
gcttggctggagaaagttacct

SEQ ID NO: 7187833 - DNA, 22 bp, Homo sapiens
gcttggctgtgagctttgctgt

SEQ ID NO: 7187834 - DNA, 22 bp, Homo sapiens
gcttggctgtgttcaagggcgg

SEQ ID NO: 7187835 - DNA, 22 bp, Homo sapiens
gcttggctgtgttcaagggcgg

SEQ ID NO: 7187836 - DNA, 22 bp, Homo sapiens
gcttggcttgggctcagaggcc

SEQ ID NO: 7187837 - DNA, 22 bp, Homo sapiens
gcttggctttactagggggaca

SEQ ID NO: 7187838 - DNA, 22 bp, Homo sapiens
gcttggctttgtcttgttcact

SEQ ID NO: 7187839 - DNA, 19 bp, Homo sapiens
gcttgggagagggagctaa

SEQ ID NO: 7187840 - DNA, 22 bp, Homo sapiens
gcttctcttaatgcctggcttt

SEQ ID NO: 7187841 - DNA, 22 bp, Homo sapiens
gcttctctggctggtctgccac

SEQ ID NO: 7187842 - DNA, 22 bp, Homo sapiens
gcttctcttaatgcctggcttt

SEQ ID NO: 7187843 - DNA, 22 bp, Homo sapiens
gcttctctggctggtctgccac

SEQ ID NO: 7187844 - DNA, 22 bp, Homo sapiens
gcttctctggctggtctgccac

SEQ ID NO: 7187845 - DNA, 22 bp, Homo sapiens
gcttctctctcagactgcaagc

SEQ ID NO: 7187846 - DNA, 22 bp, Homo sapiens
gcttctctggcctgcagggcat

SEQ ID NO: 7187847 - DNA, 22 bp, Homo sapiens
gcttctctcaggagcatcagcc

SEQ ID NO: 7187848 - DNA, 22 bp, Homo sapiens
gcttctctcaggagcatcagcc

SEQ ID NO: 7187849 - DNA, 22 bp, Homo sapiens
gcttctctctcagactgcaagc

SEQ ID NO: 7187850 - DNA, 22 bp, Homo sapiens
gcttctccctacagatgtcagt

SEQ ID NO: 7187851 - DNA, 22 bp, Homo sapiens
gcttctcctcccgctcccaggc

SEQ ID NO: 7187852 - DNA, 22 bp, Homo sapiens
gcttctcctcccgctcccaggc

SEQ ID NO: 7187853 - DNA, 22 bp, Homo sapiens
gcttctcctcccgctcccaggc

SEQ ID NO: 7187854 - DNA, 22 bp, Homo sapiens
gcttctcctcccgctcccaggc

SEQ ID NO: 7187855 - DNA, 22 bp, Homo sapiens
gctgtggcctggcgcagagctg

SEQ ID NO: 7187856 - DNA, 22 bp, Homo sapiens
gctgtggcctggcgcagagctg

SEQ ID NO: 7187857 - DNA, 20 bp, Homo sapiens
gcttctcagggcttctctga

SEQ ID NO: 7187858 - DNA, 22 bp, Homo sapiens
gcttctccagaccttcatcccc

SEQ ID NO: 7187859 - DNA, 22 bp, Homo sapiens
gctgtggcccttggcatctgcg

SEQ ID NO: 7187860 - DNA, 22 bp, Homo sapiens
gctgtggccgggcccaggccgc

SEQ ID NO: 7187861 - DNA, 22 bp, Homo sapiens
gctgtggcctagtttgttatat

SEQ ID NO: 7187862 - DNA, 22 bp, Homo sapiens
gctgtggcctccagcactcccc

SEQ ID NO: 7187863 - DNA, 22 bp, Homo sapiens
gctgtggcctccagcactcccc

SEQ ID NO: 7187864 - DNA, 22 bp, Homo sapiens
gctgtggcctggcgcagagctg

SEQ ID NO: 7187865 - DNA, 22 bp, Homo sapiens
gctgtggcctggcgcagagctg

SEQ ID NO: 7187866 - DNA, 22 bp, Homo sapiens
gctgtggatgctatggatcatc

SEQ ID NO: 7187867 - DNA, 22 bp, Homo sapiens
gctgtggagtacagagctggtt

SEQ ID NO: 7187868 - DNA, 22 bp, Homo sapiens
gctgtggagtacagagctggtt

SEQ ID NO: 7187869 - DNA, 20 bp, Homo sapiens
gctgtggcaaagctttgtgt

SEQ ID NO: 7187870 - DNA, 20 bp, Homo sapiens
gctgtggcaaagctttgtgt

SEQ ID NO: 7187871 - DNA, 22 bp, Homo sapiens
gctgtggcaatgtttataatta

SEQ ID NO: 7187872 - DNA, 22 bp, Homo sapiens
gctgtggccaacaaaccacttt

SEQ ID NO: 7187873 - DNA, 22 bp, Homo sapiens
gctgtggcccttggcatctgcg

SEQ ID NO: 7187874 - DNA, 22 bp, Homo sapiens
gctgtgctgtttccacctctct

SEQ ID NO: 7187875 - DNA, 22 bp, Homo sapiens
gctgtgcttgggaagaatctct

SEQ ID NO: 7187876 - DNA, 22 bp, Homo sapiens
gctgtggaaatgcctaacatga

SEQ ID NO: 7187877 - DNA, 18 bp, Homo sapiens
gctgtggaagtctttata

SEQ ID NO: 7187878 - DNA, 22 bp, Homo sapiens
gctgtggagtacagagctggtt

SEQ ID NO: 7187879 - DNA, 22 bp, Homo sapiens
gctgtctgccgcaggctgccac

SEQ ID NO: 7187880 - DNA, 22 bp, Homo sapiens
gctgtctgcatctctagagctt

SEQ ID NO: 7187881 - DNA, 22 bp, Homo sapiens
gctgtctgcatctctagagctt

SEQ ID NO: 7187882 - DNA, 22 bp, Homo sapiens
gctgtctgcatctctagagctt

SEQ ID NO: 7187883 - DNA, 22 bp, Homo sapiens
gctgtctgccgcaggctgccac

SEQ ID NO: 7187884 - DNA, 19 bp, Homo sapiens
gctgtctgatgctgaggtc

SEQ ID NO: 7187885 - DNA, 22 bp, Homo sapiens
gctgtctgcaagccaggaaatg

SEQ ID NO: 7187886 - DNA, 18 bp, Homo sapiens
gctgtctgaggtctgagg

SEQ ID NO: 7187887 - DNA, 22 bp, Homo sapiens
gctgtctgagtaagagaatcct

SEQ ID NO: 7187888 - DNA, 19 bp, Homo sapiens
gctgtctgatgctgaggtc

SEQ ID NO: 7187889 - DNA, 22 bp, Homo sapiens
gctgtctgagaacatggtggaa

SEQ ID NO: 7187890 - DNA, 20 bp, Homo sapiens
gctgtctgacagttcccaga

SEQ ID NO: 7187891 - DNA, 22 bp, Homo sapiens
gctgtctcggggctttctcctg

SEQ ID NO: 7187892 - DNA, 21 bp, Homo sapiens
gctgtctctggctcctgggaa

SEQ ID NO: 7187893 - DNA, 20 bp, Homo sapiens
caaggcagaccagagtgagt

SEQ ID NO: 7187894 - DNA, 20 bp, Homo sapiens
caaggcagaccagagtgagt

SEQ ID NO: 7187895 - DNA, 22 bp, Homo sapiens
caaggcagaattcagactcagg

SEQ ID NO: 7187896 - DNA, 22 bp, Homo sapiens
caaggcagaattcagactcagg

SEQ ID NO: 7187897 - DNA, 22 bp, Homo sapiens
caaggcagaattcagactcagg

SEQ ID NO: 7187898 - DNA, 22 bp, Homo sapiens
caaggcagaattcagactcagg

SEQ ID NO: 7187899 - DNA, 22 bp, Homo sapiens
caaggattaatagaatgaatca

SEQ ID NO: 7187900 - DNA, 20 bp, Homo sapiens
caaggcagaccagagtgagt

SEQ ID NO: 7187901 - DNA, 20 bp, Homo sapiens
caaggcagaccagagtgagt

SEQ ID NO: 7187902 - DNA, 20 bp, Homo sapiens
caaggcagaccagagtgagt

SEQ ID NO: 7187903 - DNA, 22 bp, Homo sapiens
caaggcagcccgctgaaccaca

SEQ ID NO: 7187904 - DNA, 22 bp, Homo sapiens
caaggcagcccgctgaaccaca

SEQ ID NO: 7187905 - DNA, 22 bp, Homo sapiens
caaggcagcccgctgaaccaca

SEQ ID NO: 7187906 - DNA, 22 bp, Homo sapiens
caaggcagcgttcctttctgga

SEQ ID NO: 7187907 - DNA, 22 bp, Homo sapiens
caaggcagcgttcctttctgga

SEQ ID NO: 7187908 - DNA, 22 bp, Homo sapiens
caaggcagcccgctgaaccaca

SEQ ID NO: 7187909 - DNA, 22 bp, Homo sapiens
caaggcagcgttcctttctgga

SEQ ID NO: 7187910 - DNA, 22 bp, Homo sapiens
caaggcagctattgtctccata

SEQ ID NO: 7187911 - DNA, 22 bp, Homo sapiens
caaggcagctattgtctccata

SEQ ID NO: 7187912 - DNA, 22 bp, Homo sapiens
caaggcagcgttcctttctgga

SEQ ID NO: 7187913 - DNA, 22 bp, Homo sapiens
caaggcagctattgtctccata

SEQ ID NO: 7187914 - DNA, 22 bp, Homo sapiens
caaggcagctattgtctccata

SEQ ID NO: 7187915 - DNA, 22 bp, Homo sapiens
caaggcagctattgtctccata

SEQ ID NO: 7187916 - DNA, 22 bp, Homo sapiens
caaggcagctattgtctccata

SEQ ID NO: 7187917 - DNA, 22 bp, Homo sapiens
caaggcagctgtagggatttgg

SEQ ID NO: 7187918 - DNA, 22 bp, Homo sapiens
caaggcagctgtagggatttgg

SEQ ID NO: 7187919 - DNA, 22 bp, Homo sapiens
caaggcagctgtagggatttgg

SEQ ID NO: 7187920 - DNA, 22 bp, Homo sapiens
caaggcagctgtagggatttgg

SEQ ID NO: 7187921 - DNA, 22 bp, Homo sapiens
gctgtacaaattccacaagaga

SEQ ID NO: 7187922 - DNA, 22 bp, Homo sapiens
gctgtacaaggcctctgccatc

SEQ ID NO: 7187923 - DNA, 23 bp, Homo sapiens
gctgtacaggaaccagtttggag

SEQ ID NO: 7187924 - DNA, 22 bp, Homo sapiens
gctgtctccatagctgtgtgtc

SEQ ID NO: 7187925 - DNA, 22 bp, Homo sapiens
gctgtctccatagctgtgtgtc

SEQ ID NO: 7187926 - DNA, 21 bp, Homo sapiens
gctgtctcctccttgcaccag

SEQ ID NO: 7187927 - DNA, 22 bp, Homo sapiens
gctgtctcgcctgacactggct

SEQ ID NO: 7187928 - DNA, 22 bp, Homo sapiens
cacaaagttggacaacgcaccc

SEQ ID NO: 7187929 - DNA, 22 bp, Homo sapiens
ggaaaactgtatttgaataact

SEQ ID NO: 7187930 - DNA, 22 bp, Homo sapiens
cacaaaggtaactggagtattt

SEQ ID NO: 7187931 - DNA, 22 bp, Homo sapiens
cacaaagtctgcagctgctgta

SEQ ID NO: 7187932 - DNA, 22 bp, Homo sapiens
cacaaagtggcaggagaggaga

SEQ ID NO: 7187933 - DNA, 22 bp, Homo sapiens
cacaaagtgggtggaaaactaa

SEQ ID NO: 7187934 - DNA, 22 bp, Homo sapiens
cacaaagtgggtggaaaactaa

SEQ ID NO: 7187935 - DNA, 22 bp, Homo sapiens
cacaaagtgttagatgccactc

SEQ ID NO: 7187936 - DNA, 17 bp, Homo sapiens
ggaaaagaagagtagga

SEQ ID NO: 7187937 - DNA, 17 bp, Homo sapiens
ggaaaagaagagtagga

SEQ ID NO: 7187938 - DNA, 17 bp, Homo sapiens
ggaaaagaagagtagga

SEQ ID NO: 7187939 - DNA, 22 bp, Homo sapiens
ggaaaagaattgcagtgaagta

SEQ ID NO: 7187940 - DNA, 22 bp, Homo sapiens
ggaaaagaattgcagtgaagta

SEQ ID NO: 7187941 - DNA, 22 bp, Homo sapiens
ggaaaagaattgcagtgaagta

SEQ ID NO: 7187942 - DNA, 22 bp, Homo sapiens
ggaaaagacagaattctagaat

SEQ ID NO: 7187943 - DNA, 22 bp, Homo sapiens
cacaaaatctttctcgattatt

SEQ ID NO: 7187944 - DNA, 22 bp, Homo sapiens
cacaaaatctttctcgattatt

SEQ ID NO: 7187945 - DNA, 22 bp, Homo sapiens
cacaaaatctttctcgattatt

SEQ ID NO: 7187946 - DNA, 22 bp, Homo sapiens
cacaaaatctttctcgattatt

SEQ ID NO: 7187947 - DNA, 22 bp, Homo sapiens
cacaaaatatcaagcactttta

SEQ ID NO: 7187948 - DNA, 22 bp, Homo sapiens
cacaaaatatcaagcactttta

SEQ ID NO: 7187949 - DNA, 22 bp, Homo sapiens
cacaaacatcaatcctgttttc

SEQ ID NO: 7187950 - DNA, 22 bp, Homo sapiens
cacaaacatcaatcctgttttc

SEQ ID NO: 7187951 - DNA, 22 bp, Homo sapiens
cacaaacatcaatcctgttttc

SEQ ID NO: 7187952 - DNA, 22 bp, Homo sapiens
cacaaacatcaatcctgttttc

SEQ ID NO: 7187953 - DNA, 22 bp, Homo sapiens
cacaaacctgccagccctgccc

SEQ ID NO: 7187954 - DNA, 22 bp, Homo sapiens
cacaaaccttctgcagcctgta

SEQ ID NO: 7187955 - DNA, 22 bp, Homo sapiens
cacaaaggagaatgtcagcata

SEQ ID NO: 7187956 - DNA, 22 bp, Homo sapiens
cacaaaggagaatgtcagcata

SEQ ID NO: 7187957 - DNA, 22 bp, Homo sapiens
cacaaaggagaatgtcagcata

SEQ ID NO: 7187958 - DNA, 23 bp, Homo sapiens
cacaaaggttccattctctcacc

SEQ ID NO: 7187959 - DNA, 23 bp, Homo sapiens
cacaaaggttccattctctcacc

SEQ ID NO: 7187960 - DNA, 23 bp, Homo sapiens
cacaaaggttccattctctcacc

SEQ ID NO: 7187961 - DNA, 22 bp, Homo sapiens
ggaaaaggccattgtttctctg

SEQ ID NO: 7187962 - DNA, 22 bp, Homo sapiens
ggaaaaggccacagggacacat

SEQ ID NO: 7187963 - DNA, 18 bp, Homo sapiens
ggaaaaggagtgtctagc

SEQ ID NO: 7187964 - DNA, 17 bp, Homo sapiens
ggaaaaggatgatacag

SEQ ID NO: 7187965 - DNA, 22 bp, Homo sapiens
ggaaaagtgttaaggtgttgat

SEQ ID NO: 7187966 - DNA, 22 bp, Homo sapiens
ggaaaatactgattcatgccat

SEQ ID NO: 7187967 - DNA, 22 bp, Homo sapiens
cacaagtcattttcagcaggct

SEQ ID NO: 7187968 - DNA, 22 bp, Homo sapiens
cacaagtatctcccaccaggtt

SEQ ID NO: 7187969 - DNA, 22 bp, Homo sapiens
cacaagtcattttcagcaggct

SEQ ID NO: 7187970 - DNA, 22 bp, Homo sapiens
cacaagtctgtggtctccaaca

SEQ ID NO: 7187971 - DNA, 22 bp, Homo sapiens
cacaataaatgtttgctgatga

SEQ ID NO: 7187972 - DNA, 22 bp, Homo sapiens
cacaataaatgtttgctgatga

SEQ ID NO: 7187973 - DNA, 18 bp, Homo sapiens
cacaatagacaccgataa

SEQ ID NO: 7187974 - DNA, 22 bp, Homo sapiens
cacaatgatttggttcaaaaat

SEQ ID NO: 7187975 - DNA, 22 bp, Homo sapiens
cacaatgcagcatgtaaatgca

SEQ ID NO: 7187976 - DNA, 22 bp, Homo sapiens
cacaattacttttgcaccaaca

SEQ ID NO: 7187977 - DNA, 22 bp, Homo sapiens
cacaattagcagctctttattt

SEQ ID NO: 7187978 - DNA, 22 bp, Homo sapiens
cacaatgtggtttgtcatcttt

SEQ ID NO: 7187979 - DNA, 21 bp, Homo sapiens
cacaatgttggccaggttggt

SEQ ID NO: 7187980 - DNA, 22 bp, Homo sapiens
cacaatgcagcatgtaaatgca

SEQ ID NO: 7187981 - DNA, 22 bp, Homo sapiens
cacaatgcgtacatatatcaaa

SEQ ID NO: 7187982 - DNA, 22 bp, Homo sapiens
cacaatgtctggtaggccactt

SEQ ID NO: 7187983 - DNA, 22 bp, Homo sapiens
cacacctgtaataccagctact

SEQ ID NO: 7187984 - DNA, 22 bp, Homo sapiens
cacacctgtaatcctagcactt

SEQ ID NO: 7187985 - DNA, 22 bp, Homo sapiens
cacacccttgctaacacttgtt

SEQ ID NO: 7187986 - DNA, 22 bp, Homo sapiens
cacacctcacacctcgcatgct

SEQ ID NO: 7187987 - DNA, 22 bp, Homo sapiens
cacacctcacacctcgcatgct

SEQ ID NO: 7187988 - DNA, 22 bp, Homo sapiens
cacacctcagccatgtggaggc

SEQ ID NO: 7187989 - DNA, 23 bp, Homo sapiens
cacacctgttaagaagagtgcct

SEQ ID NO: 7187990 - DNA, 19 bp, Homo sapiens
cacacccatgcttgccaag

SEQ ID NO: 7187991 - DNA, 19 bp, Homo sapiens
cacacccatgcttgccaag

SEQ ID NO: 7187992 - DNA, 19 bp, Homo sapiens
cacacccatgcttgccaag

SEQ ID NO: 7187993 - DNA, 22 bp, Homo sapiens
cacaccctcgtgctccctcccg

SEQ ID NO: 7187994 - DNA, 21 bp, Homo sapiens
cacaccaggcatgtcttgagc

SEQ ID NO: 7187995 - DNA, 22 bp, Homo sapiens
cacacccaaatttctctctcag

SEQ ID NO: 7187996 - DNA, 22 bp, Homo sapiens
cacacccaaatttctctctcag

SEQ ID NO: 7187997 - DNA, 23 bp, Homo sapiens
cacacccatcactaagagctcct

SEQ ID NO: 7187998 - DNA, 21 bp, Homo sapiens
cacaccaaacaggaacaggga

SEQ ID NO: 7187999 - DNA, 22 bp, Homo sapiens
cacaccaaagtatttggtattt

SEQ ID NO: 7188000 - DNA, 22 bp, Homo sapiens
cacaccagaggttacctgcaaa

SEQ ID NO: 7188001 - DNA, 22 bp, Homo sapiens
cacaccagaggttacctgcaaa

SEQ ID NO: 7188002 - DNA, 22 bp, Homo sapiens
cacaccagaggttacctgcaaa

SEQ ID NO: 7188003 - DNA, 22 bp, Homo sapiens
cacaccagatggcagcgtggga

SEQ ID NO: 7188004 - DNA, 22 bp, Homo sapiens
cacaccagcatggtctcagtgt

SEQ ID NO: 7188005 - DNA, 22 bp, Homo sapiens
cacaccagcatggtctcagtgt

SEQ ID NO: 7188006 - DNA, 21 bp, Homo sapiens
cacaccaggcatgtcttgagc

SEQ ID NO: 7188007 - DNA, 21 bp, Homo sapiens
cacaccaggcatgtcttgagc

SEQ ID NO: 7188008 - DNA, 22 bp, Homo sapiens
cacacatttcagatgctacaat

SEQ ID NO: 7188009 - DNA, 22 bp, Homo sapiens
cacacatttcagatgctacaat

SEQ ID NO: 7188010 - DNA, 22 bp, Homo sapiens
cacacatttcagatgctacaat

SEQ ID NO: 7188011 - DNA, 22 bp, Homo sapiens
cacacattgagcagctgtttgt

SEQ ID NO: 7188012 - DNA, 22 bp, Homo sapiens
cacacattggttttactccttt

SEQ ID NO: 7188013 - DNA, 22 bp, Homo sapiens
cacacattccaaaatcaagggt

SEQ ID NO: 7188014 - DNA, 22 bp, Homo sapiens
cacacattgaattcattcttgt

SEQ ID NO: 7188015 - DNA, 22 bp, Homo sapiens
cacacattcaccatgactgaaa

SEQ ID NO: 7188016 - DNA, 22 bp, Homo sapiens
cacacattagagccaatgtcag

SEQ ID NO: 7188017 - DNA, 22 bp, Homo sapiens
cacacatcaacctagacattgt

SEQ ID NO: 7188018 - DNA, 22 bp, Homo sapiens
cacacatcaacctagacattgt

SEQ ID NO: 7188019 - DNA, 22 bp, Homo sapiens
cacacatcaacctagacattgt

SEQ ID NO: 7188020 - DNA, 22 bp, Homo sapiens
cacacatattgtccctagtgtg

SEQ ID NO: 7188021 - DNA, 22 bp, Homo sapiens
cacaatttgttttatcagtatt

SEQ ID NO: 7188022 - DNA, 22 bp, Homo sapiens
cacaatttgttttatcagtatt

SEQ ID NO: 7188023 - DNA, 22 bp, Homo sapiens
cacaatttgttttatcagtatt

SEQ ID NO: 7188024 - DNA, 22 bp, Homo sapiens
cacacatattgtccctagtgtg

SEQ ID NO: 7188025 - DNA, 22 bp, Homo sapiens
cacaatttggacttcactggtt

SEQ ID NO: 7188026 - DNA, 22 bp, Homo sapiens
cacaatttggggtgcccactgt

SEQ ID NO: 7188027 - DNA, 22 bp, Homo sapiens
cacaatttccttgcttcacttt

SEQ ID NO: 7188028 - DNA, 22 bp, Homo sapiens
cacaatttggtgctaaagaaag

SEQ ID NO: 7188029 - DNA, 22 bp, Homo sapiens
cacaatttggtgctaaagaaag

SEQ ID NO: 7188030 - DNA, 22 bp, Homo sapiens
cacaatttggtgctaaagaaag

SEQ ID NO: 7188031 - DNA, 22 bp, Homo sapiens
cacaatttgtattttgcatcca

SEQ ID NO: 7188032 - DNA, 22 bp, Homo sapiens
cacaatttgtattttgcatcca

SEQ ID NO: 7188033 - DNA, 22 bp, Homo sapiens
cacaatttgtttgctcttagtc

SEQ ID NO: 7188034 - DNA, 22 bp, Homo sapiens
cacaatttccaagtcatgttat

SEQ ID NO: 7188035 - DNA, 22 bp, Homo sapiens
cacaatttccattgagcagcag

SEQ ID NO: 7188036 - DNA, 22 bp, Homo sapiens
cacaatttcagttgcatgcaac

SEQ ID NO: 7188037 - DNA, 22 bp, Homo sapiens
cacaatttcagttgcatgcaac

SEQ ID NO: 7188038 - DNA, 22 bp, Homo sapiens
cacaatttccaagtcatgttat

SEQ ID NO: 7188039 - DNA, 22 bp, Homo sapiens
cacaattgtatcagaaaatagt

SEQ ID NO: 7188040 - DNA, 18 bp, Homo sapiens
cacaatttacagatgaca

SEQ ID NO: 7188041 - DNA, 18 bp, Homo sapiens
cacaatttacagatgaca

SEQ ID NO: 7188042 - DNA, 22 bp, Homo sapiens
cacaattattatctctttctac

SEQ ID NO: 7188043 - DNA, 22 bp, Homo sapiens
caaggaggaagatgcaggggac

SEQ ID NO: 7188044 - DNA, 22 bp, Homo sapiens
caaggaggaagatgcaggggac

SEQ ID NO: 7188045 - DNA, 22 bp, Homo sapiens
caaggagataaaatgttgagct

SEQ ID NO: 7188046 - DNA, 22 bp, Homo sapiens
caaggagagtaattgaatgaga

SEQ ID NO: 7188047 - DNA, 22 bp, Homo sapiens
caaggagaaaacggcttctgaa

SEQ ID NO: 7188048 - DNA, 22 bp, Homo sapiens
caaggagaaaacggcttctgaa

SEQ ID NO: 7188049 - DNA, 22 bp, Homo sapiens
caaggagaaaacggcttctgaa

SEQ ID NO: 7188050 - DNA, 22 bp, Homo sapiens
caaggagaaaacggcttctgaa

SEQ ID NO: 7188051 - DNA, 21 bp, Homo sapiens
caaggacaggttgcagggcaa

SEQ ID NO: 7188052 - DNA, 21 bp, Homo sapiens
caaggacaggttgcagggcaa

SEQ ID NO: 7188053 - DNA, 21 bp, Homo sapiens
caaggacaggttgcagggcaa

SEQ ID NO: 7188054 - DNA, 21 bp, Homo sapiens
caaggacaggttgcagggcaa

SEQ ID NO: 7188055 - DNA, 22 bp, Homo sapiens
caaggacactgatgttcatcct

SEQ ID NO: 7188056 - DNA, 22 bp, Homo sapiens
caaggacagcgtcaggtgcaac

SEQ ID NO: 7188057 - DNA, 22 bp, Homo sapiens
caaggacactgatgttcatcct

SEQ ID NO: 7188058 - DNA, 22 bp, Homo sapiens
caaggacactgagctttgtaaa

SEQ ID NO: 7188059 - DNA, 22 bp, Homo sapiens
caaggacactccctgctgggca

SEQ ID NO: 7188060 - DNA, 22 bp, Homo sapiens
caaggacactccctgctgggca

SEQ ID NO: 7188061 - DNA, 22 bp, Homo sapiens
caaggacaacttcatattgtgg

SEQ ID NO: 7188062 - DNA, 22 bp, Homo sapiens
caaggacactccctgctgggca

SEQ ID NO: 7188063 - DNA, 22 bp, Homo sapiens
caaggacaacttcatattgtgg

SEQ ID NO: 7188064 - DNA, 22 bp, Homo sapiens
caaggaagttttaggagaggaa

SEQ ID NO: 7188065 - DNA, 22 bp, Homo sapiens
caaggaagttttaggagaggaa

SEQ ID NO: 7188066 - DNA, 22 bp, Homo sapiens
caaggaatcccatttctaactc

SEQ ID NO: 7188067 - DNA, 22 bp, Homo sapiens
caagctgctataggttgctggg

SEQ ID NO: 7188068 - DNA, 22 bp, Homo sapiens
caagctgctataggttgctggg

SEQ ID NO: 7188069 - DNA, 22 bp, Homo sapiens
caagctgcttattctctgctct

SEQ ID NO: 7188070 - DNA, 22 bp, Homo sapiens
caagatggagaagcagcaaggg

SEQ ID NO: 7188071 - DNA, 22 bp, Homo sapiens
caagatgatccctgaaggcagc

SEQ ID NO: 7188072 - DNA, 22 bp, Homo sapiens
caagatgatccctgaaggcagc

SEQ ID NO: 7188073 - DNA, 22 bp, Homo sapiens
caagatgatccctgaaggcagc

SEQ ID NO: 7188074 - DNA, 22 bp, Homo sapiens
caagatggacataaggagagaa

SEQ ID NO: 7188075 - DNA, 22 bp, Homo sapiens
caagattaccaaggaccagcgg

SEQ ID NO: 7188076 - DNA, 22 bp, Homo sapiens
caagattactatccactgctgg

SEQ ID NO: 7188077 - DNA, 22 bp, Homo sapiens
caagattactatccactgctgg

SEQ ID NO: 7188078 - DNA, 22 bp, Homo sapiens
caagattatcttcttcttgtta

SEQ ID NO: 7188079 - DNA, 22 bp, Homo sapiens
caagaggctaaactgggctatt

SEQ ID NO: 7188080 - DNA, 22 bp, Homo sapiens
caagaggattattaataaataa

SEQ ID NO: 7188081 - DNA, 22 bp, Homo sapiens
caagaggctaaactgggctatt

SEQ ID NO: 7188082 - DNA, 22 bp, Homo sapiens
caagagggaacctaagatgtat

SEQ ID NO: 7188083 - DNA, 22 bp, Homo sapiens
caagagggaacctaagatgtat

SEQ ID NO: 7188084 - DNA, 22 bp, Homo sapiens
caagagttgagggatgtcagtt

SEQ ID NO: 7188085 - DNA, 22 bp, Homo sapiens
caagagttgagggatgtcagtt

SEQ ID NO: 7188086 - DNA, 22 bp, Homo sapiens
caagagtttaaatcaatggcca

SEQ ID NO: 7188087 - DNA, 22 bp, Homo sapiens
caagaggcaaattgtctagaag

SEQ ID NO: 7188088 - DNA, 22 bp, Homo sapiens
caagaggagcaggcaggtgtgc

SEQ ID NO: 7188089 - DNA, 18 bp, Homo sapiens
caagagctgctcctggcc

SEQ ID NO: 7188090 - DNA, 22 bp, Homo sapiens
caagagctggagaggcagtcta

SEQ ID NO: 7188091 - DNA, 22 bp, Homo sapiens
caagagctgggtggcaagctag

SEQ ID NO: 7188092 - DNA, 22 bp, Homo sapiens
caagatgaggtcatactggaat

SEQ ID NO: 7188093 - DNA, 22 bp, Homo sapiens
caagatgaggtcatactggaat

SEQ ID NO: 7188094 - DNA, 22 bp, Homo sapiens
caagatgactttgggggattaa

SEQ ID NO: 7188095 - DNA, 22 bp, Homo sapiens
caagatgacaaggctggaggct

SEQ ID NO: 7188096 - DNA, 22 bp, Homo sapiens
caagatgactttgggggattaa

SEQ ID NO: 7188097 - DNA, 22 bp, Homo sapiens
caagatgaagtgaagattagaa

SEQ ID NO: 7188098 - DNA, 22 bp, Homo sapiens
caagatgaagtgaagattagaa

SEQ ID NO: 7188099 - DNA, 22 bp, Homo sapiens
caagatgaatgatgaagtgtgt

SEQ ID NO: 7188100 - DNA, 22 bp, Homo sapiens
caagatgaatgatgaagtgtgt

SEQ ID NO: 7188101 - DNA, 22 bp, Homo sapiens
caagatgacaaggctggaggct

SEQ ID NO: 7188102 - DNA, 22 bp, Homo sapiens
caagatgaaactacagggagga

SEQ ID NO: 7188103 - DNA, 22 bp, Homo sapiens
caagatgaaactacagggagga

SEQ ID NO: 7188104 - DNA, 22 bp, Homo sapiens
caagatgaaattgtgatatttt

SEQ ID NO: 7188105 - DNA, 22 bp, Homo sapiens
caagatgaaattgtgatatttt

SEQ ID NO: 7188106 - DNA, 21 bp, Homo sapiens
caagatctcggcttgcttcct

SEQ ID NO: 7188107 - DNA, 22 bp, Homo sapiens
caagatcttcctcaatagacct

SEQ ID NO: 7188108 - DNA, 22 bp, Homo sapiens
caagatcttggctgaagtacag

SEQ ID NO: 7188109 - DNA, 22 bp, Homo sapiens
caagatcttggctgaagtacag

SEQ ID NO: 7188110 - DNA, 22 bp, Homo sapiens
caagatcaatcaatactcctta

SEQ ID NO: 7188111 - DNA, 22 bp, Homo sapiens
caagatcaatcaatactcctta

SEQ ID NO: 7188112 - DNA, 22 bp, Homo sapiens
caagatcacacaggtaacaagt

SEQ ID NO: 7188113 - DNA, 22 bp, Homo sapiens
caagatatcaatgacatagtat

SEQ ID NO: 7188114 - DNA, 22 bp, Homo sapiens
caagatactcagaaaggcattg

SEQ ID NO: 7188115 - DNA, 22 bp, Homo sapiens
caagatatcaatgacatagtat

SEQ ID NO: 7188116 - DNA, 22 bp, Homo sapiens
caagatatgtcctgttactaag

SEQ ID NO: 7188117 - DNA, 22 bp, Homo sapiens
caagatatgtcctgttactaag

SEQ ID NO: 7188118 - DNA, 22 bp, Homo sapiens
caagatatgtgttgttagctct

SEQ ID NO: 7188119 - DNA, 22 bp, Homo sapiens
caactacatccacactttgtta

SEQ ID NO: 7188120 - DNA, 22 bp, Homo sapiens
caactacaggaaaagtcattca

SEQ ID NO: 7188121 - DNA, 22 bp, Homo sapiens
caactacaggaaaagtcattca

SEQ ID NO: 7188122 - DNA, 22 bp, Homo sapiens
caactacaggaaaagtcattca

SEQ ID NO: 7188123 - DNA, 22 bp, Homo sapiens
caacctggccctagccctggga

SEQ ID NO: 7188124 - DNA, 22 bp, Homo sapiens
gctgcctgccttgcctggagga

SEQ ID NO: 7188125 - DNA, 22 bp, Homo sapiens
caaccgcggggcccagcggttc

SEQ ID NO: 7188126 - DNA, 22 bp, Homo sapiens
caacctcatagaaagaaaatgt

SEQ ID NO: 7188127 - DNA, 22 bp, Homo sapiens
caacctctatcggtcaggaagc

SEQ ID NO: 7188128 - DNA, 22 bp, Homo sapiens
caacctctggaaagtatggaca

SEQ ID NO: 7188129 - DNA, 22 bp, Homo sapiens
caacctctggaaagtatggaca

SEQ ID NO: 7188130 - DNA, 22 bp, Homo sapiens
caacctctgtaatgttctagga

SEQ ID NO: 7188131 - DNA, 22 bp, Homo sapiens
caacctctgtaatgttctagga

SEQ ID NO: 7188132 - DNA, 22 bp, Homo sapiens
caacctctttgggccttggttt

SEQ ID NO: 7188133 - DNA, 18 bp, Homo sapiens
gctgccttcccagtcaag

SEQ ID NO: 7188134 - DNA, 18 bp, Homo sapiens
gctgccttcccagtcaag

SEQ ID NO: 7188135 - DNA, 22 bp, Homo sapiens
gctgccttcccggaatgtcatc

SEQ ID NO: 7188136 - DNA, 22 bp, Homo sapiens
gctgccttccctgttctttcag

SEQ ID NO: 7188137 - DNA, 22 bp, Homo sapiens
gctgccttctgagaagttaaat

SEQ ID NO: 7188138 - DNA, 22 bp, Homo sapiens
gctgccttcccggaatgtcatc

SEQ ID NO: 7188139 - DNA, 22 bp, Homo sapiens
gctgccttgaacatcctaagta

SEQ ID NO: 7188140 - DNA, 22 bp, Homo sapiens
gctgccttgaacttggcctggg

SEQ ID NO: 7188141 - DNA, 22 bp, Homo sapiens
gctgccttgaacttggcctggg

SEQ ID NO: 7188142 - DNA, 20 bp, Homo sapiens
gctgccttgtcctgcttggt

SEQ ID NO: 7188143 - DNA, 20 bp, Homo sapiens
gctgccttgtcctgcttggt

SEQ ID NO: 7188144 - DNA, 20 bp, Homo sapiens
gctgccttggatggctacac

SEQ ID NO: 7188145 - DNA, 22 bp, Homo sapiens
gctgccttggtagtgaccatct

SEQ ID NO: 7188146 - DNA, 22 bp, Homo sapiens
gctgcctttagggggtgctcag

SEQ ID NO: 7188147 - DNA, 22 bp, Homo sapiens
gctgcctttagggggtgctcag

SEQ ID NO: 7188148 - DNA, 22 bp, Homo sapiens
gctgcctttgtgagccaagggg

SEQ ID NO: 7188149 - DNA, 22 bp, Homo sapiens
gctgcctttgtgagccaagggg

SEQ ID NO: 7188150 - DNA, 22 bp, Homo sapiens
gctgccttgaacttggcctggg

SEQ ID NO: 7188151 - DNA, 22 bp, Homo sapiens
gctgccttgaacttggcctggg

SEQ ID NO: 7188152 - DNA, 22 bp, Homo sapiens
gctgccttgccctcttcccata

SEQ ID NO: 7188153 - DNA, 22 bp, Homo sapiens
gctgccttgccctcttcccata

SEQ ID NO: 7188154 - DNA, 22 bp, Homo sapiens
gctgccttgcttactccactgc

SEQ ID NO: 7188155 - DNA, 22 bp, Homo sapiens
gctgccttgcttactccactgc

SEQ ID NO: 7188156 - DNA, 22 bp, Homo sapiens
gctgccttttgctcctcccacc

SEQ ID NO: 7188157 - DNA, 22 bp, Homo sapiens
gctgccttttgctcctcccacc

SEQ ID NO: 7188158 - DNA, 22 bp, Homo sapiens
gctgctggaagcatgcgatgaa

SEQ ID NO: 7188159 - DNA, 22 bp, Homo sapiens
gctgctggagagcgagactgtt

SEQ ID NO: 7188160 - DNA, 22 bp, Homo sapiens
gctgctggagagcgagactgtt

SEQ ID NO: 7188161 - DNA, 22 bp, Homo sapiens
gctgctggagagcgagactgtt

SEQ ID NO: 7188162 - DNA, 22 bp, Homo sapiens
gctgctggagagcgagactgtt

SEQ ID NO: 7188163 - DNA, 22 bp, Homo sapiens
gctgctggagagcgagactgtt

SEQ ID NO: 7188164 - DNA, 22 bp, Homo sapiens
gctgctggcactggagtgagcc

SEQ ID NO: 7188165 - DNA, 22 bp, Homo sapiens
gctgctggcactggagtgagcc

SEQ ID NO: 7188166 - DNA, 22 bp, Homo sapiens
gctgctggcactggagtgagcc

SEQ ID NO: 7188167 - DNA, 22 bp, Homo sapiens
gctgctggatgcgcttgatggt

SEQ ID NO: 7188168 - DNA, 22 bp, Homo sapiens
gctgctggagctttgcagaagg

SEQ ID NO: 7188169 - DNA, 22 bp, Homo sapiens
gctgctggagctttgcagaagg

SEQ ID NO: 7188170 - DNA, 22 bp, Homo sapiens
gctgctggatgcgcttgatggt

SEQ ID NO: 7188171 - DNA, 22 bp, Homo sapiens
gctgctggagctttgcagaagg

SEQ ID NO: 7188172 - DNA, 22 bp, Homo sapiens
caagagctctccactaggttgg

SEQ ID NO: 7188173 - DNA, 22 bp, Homo sapiens
caagagctctccactaggttgg

SEQ ID NO: 7188174 - DNA, 22 bp, Homo sapiens
caagagctcccagacctgggca

SEQ ID NO: 7188175 - DNA, 22 bp, Homo sapiens
caagagctcccagacctgggca

SEQ ID NO: 7188176 - DNA, 22 bp, Homo sapiens
caagagctcaccggagagcatt

SEQ ID NO: 7188177 - DNA, 22 bp, Homo sapiens
caagagctgcaaatagcgtgac

SEQ ID NO: 7188178 - DNA, 22 bp, Homo sapiens
caagagctgaggctggagaggt

SEQ ID NO: 7188179 - DNA, 22 bp, Homo sapiens
caagagctgcaaatagcgtgac

SEQ ID NO: 7188180 - DNA, 22 bp, Homo sapiens
gctgctggccccacatgctcca

SEQ ID NO: 7188181 - DNA, 22 bp, Homo sapiens
gctgctggccccacatgctcca

SEQ ID NO: 7188182 - DNA, 22 bp, Homo sapiens
gctgctggcatctagggggtgg

SEQ ID NO: 7188183 - DNA, 22 bp, Homo sapiens
gctgctggcatctagggggtgg

SEQ ID NO: 7188184 - DNA, 22 bp, Homo sapiens
gctgctggccccacatgctcca

SEQ ID NO: 7188185 - DNA, 22 bp, Homo sapiens
gctgctggcactggagtgagcc

SEQ ID NO: 7188186 - DNA, 22 bp, Homo sapiens
gctgctggcactggagtgagcc

SEQ ID NO: 7188187 - DNA, 22 bp, Homo sapiens
gctgctggcatctagggggtgg

SEQ ID NO: 7188188 - DNA, 22 bp, Homo sapiens
caaagtatattggattgaatgg

SEQ ID NO: 7188189 - DNA, 22 bp, Homo sapiens
caaagtacagtgcttcctggga

SEQ ID NO: 7188190 - DNA, 22 bp, Homo sapiens
caaagtacagtgcttcctggga

SEQ ID NO: 7188191 - DNA, 22 bp, Homo sapiens
caaagtatattggattgaatgg

SEQ ID NO: 7188192 - DNA, 22 bp, Homo sapiens
caaagtatattggattgaatgg

SEQ ID NO: 7188193 - DNA, 22 bp, Homo sapiens
caaaggtttcacagtagcccat

SEQ ID NO: 7188194 - DNA, 22 bp, Homo sapiens
caaagtaaactaccactgtttc

SEQ ID NO: 7188195 - DNA, 22 bp, Homo sapiens
caaagtaaactaccactgtttc

SEQ ID NO: 7188196 - DNA, 22 bp, Homo sapiens
caaaggttgttgagagtgcagg

SEQ ID NO: 7188197 - DNA, 22 bp, Homo sapiens
caaaggttggaaatgtttacca

SEQ ID NO: 7188198 - DNA, 22 bp, Homo sapiens
caaaggttatgaaccacttgta

SEQ ID NO: 7188199 - DNA, 22 bp, Homo sapiens
caaagtaactgcctttccaatt

SEQ ID NO: 7188200 - DNA, 22 bp, Homo sapiens
caaagtaactgcctttccaatt

SEQ ID NO: 7188201 - DNA, 22 bp, Homo sapiens
caaagtaatatggtcccagtga

SEQ ID NO: 7188202 - DNA, 22 bp, Homo sapiens
caaagtaatatggtcccagtga

SEQ ID NO: 7188203 - DNA, 22 bp, Homo sapiens
caaagtaatatggtcccagtga

SEQ ID NO: 7188204 - DNA, 22 bp, Homo sapiens
caaagtaatttggagatatata

SEQ ID NO: 7188205 - DNA, 22 bp, Homo sapiens
caaagtaatttggagatatata

SEQ ID NO: 7188206 - DNA, 22 bp, Homo sapiens
caaagtaatttggagatatata

SEQ ID NO: 7188207 - DNA, 17 bp, Homo sapiens
gctcctgcaggtcagga

SEQ ID NO: 7188208 - DNA, 22 bp, Homo sapiens
gctcctgcaggacccaggagac

SEQ ID NO: 7188209 - DNA, 18 bp, Homo sapiens
gctcctggaccaggtcac

SEQ ID NO: 7188210 - DNA, 22 bp, Homo sapiens
gctcctgcaggacccaggagac

SEQ ID NO: 7188211 - DNA, 22 bp, Homo sapiens
gctcctgcaggacccaggagac

SEQ ID NO: 7188212 - DNA, 22 bp, Homo sapiens
gctcctgcaggacccaggagac

SEQ ID NO: 7188213 - DNA, 22 bp, Homo sapiens
gctcctgcaggacccaggagac

SEQ ID NO: 7188214 - DNA, 17 bp, Homo sapiens
gctcctgcaggtcagga

SEQ ID NO: 7188215 - DNA, 22 bp, Homo sapiens
gctcctgcagagatgttccatg

SEQ ID NO: 7188216 - DNA, 22 bp, Homo sapiens
gctcctgcaggacccaggagac

SEQ ID NO: 7188217 - DNA, 22 bp, Homo sapiens
gctcctgcaggacccaggagac

SEQ ID NO: 7188218 - DNA, 22 bp, Homo sapiens
gctcctcttctcccactgaatg

SEQ ID NO: 7188219 - DNA, 22 bp, Homo sapiens
gctcctcttctcccactgaatg

SEQ ID NO: 7188220 - DNA, 22 bp, Homo sapiens
gctcctcttatttcatcagggc

SEQ ID NO: 7188221 - DNA, 22 bp, Homo sapiens
gctcctcttctcccactgaatg

SEQ ID NO: 7188222 - DNA, 22 bp, Homo sapiens
gctcctgaaggctctgcagggt

SEQ ID NO: 7188223 - DNA, 22 bp, Homo sapiens
caaagtatatttcatagtctca

SEQ ID NO: 7188224 - DNA, 22 bp, Homo sapiens
caaagtatcaactcccacactg

SEQ ID NO: 7188225 - DNA, 20 bp, Homo sapiens
gctgaggtggaggaaggaga

SEQ ID NO: 7188226 - DNA, 22 bp, Homo sapiens
gctgaggtggaggaaggagacc

SEQ ID NO: 7188227 - DNA, 22 bp, Homo sapiens
gctgaggtggaggaaggagacc

SEQ ID NO: 7188228 - DNA, 22 bp, Homo sapiens
gctgcagactgggaggcaggtg

SEQ ID NO: 7188229 - DNA, 22 bp, Homo sapiens
gctgcagacttctcatctcatt

SEQ ID NO: 7188230 - DNA, 22 bp, Homo sapiens
gctgcagacttctcatctcatt

SEQ ID NO: 7188231 - DNA, 22 bp, Homo sapiens
gctgcagagacagctgccgatg

SEQ ID NO: 7188232 - DNA, 22 bp, Homo sapiens
gctgcagagacagctgccgatg

SEQ ID NO: 7188233 - DNA, 22 bp, Homo sapiens
gctgcagagacagctgccgatg

SEQ ID NO: 7188234 - DNA, 22 bp, Homo sapiens
gctgcagagacagctgccgatg

SEQ ID NO: 7188235 - DNA, 22 bp, Homo sapiens
gctgcagacttctcatctcatt

SEQ ID NO: 7188236 - DNA, 18 bp, Homo sapiens
gctcctggaccaggtcac

SEQ ID NO: 7188237 - DNA, 18 bp, Homo sapiens
gctcctggaccaggtcac

SEQ ID NO: 7188238 - DNA, 22 bp, Homo sapiens
gctcctggagagattgagaaag

SEQ ID NO: 7188239 - DNA, 22 bp, Homo sapiens
gctcctggagagattgagaaag

SEQ ID NO: 7188240 - DNA, 22 bp, Homo sapiens
gctcctggagagattgagaaag

SEQ ID NO: 7188241 - DNA, 18 bp, Homo sapiens
gctcctggagtctgactc

SEQ ID NO: 7188242 - DNA, 19 bp, Homo sapiens
gctcctggatgacctgtgg

SEQ ID NO: 7188243 - DNA, 19 bp, Homo sapiens
gctcctggatgacctgtgg

SEQ ID NO: 7188244 - DNA, 19 bp, Homo sapiens
gctcctggatgacctgtgg

SEQ ID NO: 7188245 - DNA, 22 bp, Homo sapiens
gctgcagagggtcttagagagg

SEQ ID NO: 7188246 - DNA, 19 bp, Homo sapiens
gctgcagaggtgaagaaga

SEQ ID NO: 7188247 - DNA, 22 bp, Homo sapiens
gctgcagagatgggtgcccttt

SEQ ID NO: 7188248 - DNA, 22 bp, Homo sapiens
gctgcagagcctggagccctgg

SEQ ID NO: 7188249 - DNA, 22 bp, Homo sapiens
gctgcagagggaggggctcgca

SEQ ID NO: 7188250 - DNA, 22 bp, Homo sapiens
gctgcagatcccacccattccc

SEQ ID NO: 7188251 - DNA, 22 bp, Homo sapiens
gctgcagatcccacccattccc

SEQ ID NO: 7188252 - DNA, 19 bp, Homo sapiens
gctgcagagtattcttggg

SEQ ID NO: 7188253 - DNA, 19 bp, Homo sapiens
gctgcagagtattcttggg

SEQ ID NO: 7188254 - DNA, 19 bp, Homo sapiens
gctgcagagtattcttggg

SEQ ID NO: 7188255 - DNA, 22 bp, Homo sapiens
gctgcagagtgatgaagtgggg

SEQ ID NO: 7188256 - DNA, 22 bp, Homo sapiens
gctgcagagtgatgaagtgggg

SEQ ID NO: 7188257 - DNA, 22 bp, Homo sapiens
gctgcagcagaagttctcagag

SEQ ID NO: 7188258 - DNA, 22 bp, Homo sapiens
gctgcagtgagccaagatcgtg

SEQ ID NO: 7188259 - DNA, 22 bp, Homo sapiens
gctgcagtgagccaagatcgtg

SEQ ID NO: 7188260 - DNA, 22 bp, Homo sapiens
gctgcagtgagccaagatcgtg

SEQ ID NO: 7188261 - DNA, 22 bp, Homo sapiens
gctgcagtgagccaagatcgtg

SEQ ID NO: 7188262 - DNA, 22 bp, Homo sapiens
gctgcagtgagccaagatcgtg

SEQ ID NO: 7188263 - DNA, 22 bp, Homo sapiens
gctgcagtgagccaagatcgtg

SEQ ID NO: 7188264 - DNA, 22 bp, Homo sapiens
gctgcagtgagccaagatcgtg

SEQ ID NO: 7188265 - DNA, 22 bp, Homo sapiens
gctgcagtgagccaagatcgtg

SEQ ID NO: 7188266 - DNA, 22 bp, Homo sapiens
gctgcatgacagacaggcctgg

SEQ ID NO: 7188267 - DNA, 22 bp, Homo sapiens
gctgcaggtttgtctagtctgg

SEQ ID NO: 7188268 - DNA, 17 bp, Homo sapiens
gctgcagcggtaggcag

SEQ ID NO: 7188269 - DNA, 22 bp, Homo sapiens
gctgcagcctttgggaaggaca

SEQ ID NO: 7188270 - DNA, 19 bp, Homo sapiens
caacagtactggtttgtcc

SEQ ID NO: 7188271 - DNA, 22 bp, Homo sapiens
caacagtatagcttttgactgc

SEQ ID NO: 7188272 - DNA, 22 bp, Homo sapiens
caacagtctctatagctccttg

SEQ ID NO: 7188273 - DNA, 22 bp, Homo sapiens
gctgccaccgtggagatgagtg

SEQ ID NO: 7188274 - DNA, 22 bp, Homo sapiens
caacactgattatggctgagct

SEQ ID NO: 7188275 - DNA, 22 bp, Homo sapiens
caacactgattatggctgagct

SEQ ID NO: 7188276 - DNA, 22 bp, Homo sapiens
caacactgattatggctgagct

SEQ ID NO: 7188277 - DNA, 22 bp, Homo sapiens
gctgccaccgtggagatgagtg

SEQ ID NO: 7188278 - DNA, 22 bp, Homo sapiens
gctgccaccgtggagatgagtg

SEQ ID NO: 7188279 - DNA, 22 bp, Homo sapiens
gctgccacattttcaggactaa

SEQ ID NO: 7188280 - DNA, 21 bp, Homo sapiens
gctgccaccgcgtgctccagg

SEQ ID NO: 7188281 - DNA, 22 bp, Homo sapiens
gctgcatggagggtgcccagga

SEQ ID NO: 7188282 - DNA, 22 bp, Homo sapiens
gctgcatggagggtgcccagga

SEQ ID NO: 7188283 - DNA, 23 bp, Homo sapiens
gctgccacagggctcaggcaggt

SEQ ID NO: 7188284 - DNA, 23 bp, Homo sapiens
gctgccacagggctcaggcaggt

SEQ ID NO: 7188285 - DNA, 23 bp, Homo sapiens
gctgccacagggctcaggcaggt

SEQ ID NO: 7188286 - DNA, 22 bp, Homo sapiens
gctgccacattttcaggactaa

SEQ ID NO: 7188287 - DNA, 22 bp, Homo sapiens
caacatttgagtaaagaaatgg

SEQ ID NO: 7188288 - DNA, 22 bp, Homo sapiens
caacatttgtgatgagcaaact

SEQ ID NO: 7188289 - DNA, 22 bp, Homo sapiens
caacattatatagccacatgcc

SEQ ID NO: 7188290 - DNA, 22 bp, Homo sapiens
caacattcaaccaacatttatg

SEQ ID NO: 7188291 - DNA, 22 bp, Homo sapiens
caacatttcaaggtctttagga

SEQ ID NO: 7188292 - DNA, 22 bp, Homo sapiens
caacatctgtatcattagtaca

SEQ ID NO: 7188293 - DNA, 20 bp, Homo sapiens
caacatgagcaagtgaactg

SEQ ID NO: 7188294 - DNA, 20 bp, Homo sapiens
caacatgagcaagtgaactg

SEQ ID NO: 7188295 - DNA, 22 bp, Homo sapiens
caacatctttgtgtatgtgaga

SEQ ID NO: 7188296 - DNA, 22 bp, Homo sapiens
caacatgccagacattagtttg

SEQ ID NO: 7188297 - DNA, 22 bp, Homo sapiens
caacatgtctgatctctgtgaa

SEQ ID NO: 7188298 - DNA, 22 bp, Homo sapiens
caacatatataaggatttacta

SEQ ID NO: 7188299 - DNA, 22 bp, Homo sapiens
caacataacaaattggctgggc

SEQ ID NO: 7188300 - DNA, 22 bp, Homo sapiens
caacatataatatttgagttct

SEQ ID NO: 7188301 - DNA, 22 bp, Homo sapiens
caacagtgttgcaatctgaaaa

SEQ ID NO: 7188302 - DNA, 22 bp, Homo sapiens
caacagtgttgcaatctgaaaa

SEQ ID NO: 7188303 - DNA, 22 bp, Homo sapiens
caacagttctcatagcagattc

SEQ ID NO: 7188304 - DNA, 22 bp, Homo sapiens
caacagttctcatagcagattc

SEQ ID NO: 7188305 - DNA, 22 bp, Homo sapiens
caacatattgtgggatgagaga

SEQ ID NO: 7188306 - DNA, 22 bp, Homo sapiens
caacatattgtgggatgagaga

SEQ ID NO: 7188307 - DNA, 22 bp, Homo sapiens
caacatattttccaagagtgaa

SEQ ID NO: 7188308 - DNA, 22 bp, Homo sapiens
caacatatttttatgtaggtca

SEQ ID NO: 7188309 - DNA, 22 bp, Homo sapiens
caacatcagtcctcatgagaca

SEQ ID NO: 7188310 - DNA, 22 bp, Homo sapiens
caacatcagtcctcatgagaca

SEQ ID NO: 7188311 - DNA, 22 bp, Homo sapiens
caacatcagtcctcatgagaca

SEQ ID NO: 7188312 - DNA, 22 bp, Homo sapiens
caacatatgattttgtatataa

SEQ ID NO: 7188313 - DNA, 22 bp, Homo sapiens
caacatatgattttgtatataa

SEQ ID NO: 7188314 - DNA, 22 bp, Homo sapiens
caacatatgattttgtatataa

SEQ ID NO: 7188315 - DNA, 22 bp, Homo sapiens
caacatatgctttcatgaggta

SEQ ID NO: 7188316 - DNA, 22 bp, Homo sapiens
ggagggagcatccccttgctga

SEQ ID NO: 7188317 - DNA, 22 bp, Homo sapiens
ggagggagcagagaacccaacc

SEQ ID NO: 7188318 - DNA, 22 bp, Homo sapiens
ggagggagcagagaacccaacc

SEQ ID NO: 7188319 - DNA, 22 bp, Homo sapiens
ggagggagcagagaacccaacc

SEQ ID NO: 7188320 - DNA, 22 bp, Homo sapiens
ggaggcggaggttgcagtgagc

SEQ ID NO: 7188321 - DNA, 22 bp, Homo sapiens
ggaggcggaggctgcagtgagc

SEQ ID NO: 7188322 - DNA, 22 bp, Homo sapiens
ggaggcggaggctgcagtgagc

SEQ ID NO: 7188323 - DNA, 22 bp, Homo sapiens
ggaggcggaggctgcagtgagc

SEQ ID NO: 7188324 - DNA, 22 bp, Homo sapiens
ggaggcggaggctgcagtgagc

SEQ ID NO: 7188325 - DNA, 22 bp, Homo sapiens
ggaggcggaggctgcagtgagc

SEQ ID NO: 7188326 - DNA, 22 bp, Homo sapiens
ggagggaggttagattcaagct

SEQ ID NO: 7188327 - DNA, 22 bp, Homo sapiens
ggagggagggctagaccaaaga

SEQ ID NO: 7188328 - DNA, 22 bp, Homo sapiens
ggagggagcatccccttgctga

SEQ ID NO: 7188329 - DNA, 22 bp, Homo sapiens
ggagggagcatccccttgctga

SEQ ID NO: 7188330 - DNA, 22 bp, Homo sapiens
ggagggagcatccccttgctga

SEQ ID NO: 7188331 - DNA, 22 bp, Homo sapiens
ggagggagggctagaccaaaga

SEQ ID NO: 7188332 - DNA, 22 bp, Homo sapiens
ggagggagggctagaccaaaga

SEQ ID NO: 7188333 - DNA, 22 bp, Homo sapiens
ggagggagggctagaccaaaga

SEQ ID NO: 7188334 - DNA, 22 bp, Homo sapiens
ggagggagtcagctgattagaa

SEQ ID NO: 7188335 - DNA, 22 bp, Homo sapiens
ggagggagtttcattcctgccc

SEQ ID NO: 7188336 - DNA, 22 bp, Homo sapiens
ggatccttaactatcacagtga

SEQ ID NO: 7188337 - DNA, 22 bp, Homo sapiens
ggagggagtcagctgattagaa

SEQ ID NO: 7188338 - DNA, 22 bp, Homo sapiens
ggagggaggttagattcaagct

SEQ ID NO: 7188339 - DNA, 22 bp, Homo sapiens
ggagggagtcagctgattagaa

SEQ ID NO: 7188340 - DNA, 22 bp, Homo sapiens
ggagggagtcagctgattagaa

SEQ ID NO: 7188341 - DNA, 22 bp, Homo sapiens
ggagggagtcagctgattagaa

SEQ ID NO: 7188342 - DNA, 22 bp, Homo sapiens
ggatgggaacttggtagggcat

SEQ ID NO: 7188343 - DNA, 22 bp, Homo sapiens
ggatgggaacttggtagggcat

SEQ ID NO: 7188344 - DNA, 22 bp, Homo sapiens
ggatgggaacttggtagggcat

SEQ ID NO: 7188345 - DNA, 22 bp, Homo sapiens
ggatgggaacttggtagggcat

SEQ ID NO: 7188346 - DNA, 22 bp, Homo sapiens
ggatgggaacttggtagggcat

SEQ ID NO: 7188347 - DNA, 22 bp, Homo sapiens
ggatgggagcagaggacgacca

SEQ ID NO: 7188348 - DNA, 22 bp, Homo sapiens
ggatgggagcagaggacgacca

SEQ ID NO: 7188349 - DNA, 22 bp, Homo sapiens
ggatgggagcagaggacgacca

SEQ ID NO: 7188350 - DNA, 22 bp, Homo sapiens
ggatgggagcagaggacgacca

SEQ ID NO: 7188351 - DNA, 22 bp, Homo sapiens
ggatgggagcagaggacgacca

SEQ ID NO: 7188352 - DNA, 23 bp, Homo sapiens
ggatgggcaagcctagtgcctac

SEQ ID NO: 7188353 - DNA, 23 bp, Homo sapiens
ggatgggcaagcctagtgcctac

SEQ ID NO: 7188354 - DNA, 22 bp, Homo sapiens
ggatgggcagacaggacggcac

SEQ ID NO: 7188355 - DNA, 22 bp, Homo sapiens
cacagggaggcggtcactggct

SEQ ID NO: 7188356 - DNA, 22 bp, Homo sapiens
cacagggaggcggtcactggct

SEQ ID NO: 7188357 - DNA, 22 bp, Homo sapiens
cacagggaggcggtcactggct

SEQ ID NO: 7188358 - DNA, 22 bp, Homo sapiens
cacagggagttacagaagcact

SEQ ID NO: 7188359 - DNA, 22 bp, Homo sapiens
cacagggagttacagaagcact

SEQ ID NO: 7188360 - DNA, 22 bp, Homo sapiens
cacagggagttacagaagcact

SEQ ID NO: 7188361 - DNA, 22 bp, Homo sapiens
cacagggagttacagaagcact

SEQ ID NO: 7188362 - DNA, 22 bp, Homo sapiens
cacagggcaccagttggccatc

SEQ ID NO: 7188363 - DNA, 22 bp, Homo sapiens
cacagggcaccagttggccatc

SEQ ID NO: 7188364 - DNA, 22 bp, Homo sapiens
cacagggcagagacctgggtgc

SEQ ID NO: 7188365 - DNA, 22 bp, Homo sapiens
ggatgttctggggttctcttgt

SEQ ID NO: 7188366 - DNA, 19 bp, Homo sapiens
cacagggagaccacatgtc

SEQ ID NO: 7188367 - DNA, 19 bp, Homo sapiens
cacagggagaccacatgtc

SEQ ID NO: 7188368 - DNA, 22 bp, Homo sapiens
cacagggagaggaacagcgcag

SEQ ID NO: 7188369 - DNA, 22 bp, Homo sapiens
cacagggagaggaacagcgcag

SEQ ID NO: 7188370 - DNA, 22 bp, Homo sapiens
cacagggagaggaacagcgcag

SEQ ID NO: 7188371 - DNA, 22 bp, Homo sapiens
cacagggaggacatcaacagtg

SEQ ID NO: 7188372 - DNA, 22 bp, Homo sapiens
cacagggaggcagccatgctcc

SEQ ID NO: 7188373 - DNA, 22 bp, Homo sapiens
cacagggaggcagccatgctcc

SEQ ID NO: 7188374 - DNA, 22 bp, Homo sapiens
cacagggaggcagccatgctcc

SEQ ID NO: 7188375 - DNA, 22 bp, Homo sapiens
cacagggaggcagccatgctcc

SEQ ID NO: 7188376 - DNA, 22 bp, Homo sapiens
ggatgttctggggttctcttgt

SEQ ID NO: 7188377 - DNA, 22 bp, Homo sapiens
ggatgttctggggttctcttgt

SEQ ID NO: 7188378 - DNA, 22 bp, Homo sapiens
ggatgtggaccttgcctggtga

SEQ ID NO: 7188379 - DNA, 22 bp, Homo sapiens
ggatgtgaatctgggctgagac

SEQ ID NO: 7188380 - DNA, 22 bp, Homo sapiens
ggatgtgaatctgggctgagac

SEQ ID NO: 7188381 - DNA, 22 bp, Homo sapiens
ggatgtagtgcaaggagtgaat

SEQ ID NO: 7188382 - DNA, 22 bp, Homo sapiens
ggatgggctgaaaggtagcccc

SEQ ID NO: 7188383 - DNA, 22 bp, Homo sapiens
ggatgggttccgtgggcaaatg

SEQ ID NO: 7188384 - DNA, 19 bp, Homo sapiens
ggatggtggggtgcccatc

SEQ ID NO: 7188385 - DNA, 22 bp, Homo sapiens
ggatgggcagacaggacggcac

SEQ ID NO: 7188386 - DNA, 22 bp, Homo sapiens
ggatgggcccgggacggcgctg

SEQ ID NO: 7188387 - DNA, 22 bp, Homo sapiens
ggatgggcagacaggacggcac

SEQ ID NO: 7188388 - DNA, 22 bp, Homo sapiens
ggatgggcccgggacggcgctg

SEQ ID NO: 7188389 - DNA, 22 bp, Homo sapiens
cacagctgaccaccctgctccc

SEQ ID NO: 7188390 - DNA, 22 bp, Homo sapiens
cacagctgaccaccctgctccc

SEQ ID NO: 7188391 - DNA, 22 bp, Homo sapiens
cacactgtcaggtaaataacac

SEQ ID NO: 7188392 - DNA, 22 bp, Homo sapiens
cacagctgaagtagccatgtgg

SEQ ID NO: 7188393 - DNA, 22 bp, Homo sapiens
cacactcattagtcatttctct

SEQ ID NO: 7188394 - DNA, 22 bp, Homo sapiens
cacactgactggaatcaaggat

SEQ ID NO: 7188395 - DNA, 22 bp, Homo sapiens
cacactcattagtcatttctct

SEQ ID NO: 7188396 - DNA, 22 bp, Homo sapiens
cacactcattagtcatttctct

SEQ ID NO: 7188397 - DNA, 22 bp, Homo sapiens
cacactcattagtcatttctct

SEQ ID NO: 7188398 - DNA, 22 bp, Homo sapiens
cacactagcacttcagaggttc

SEQ ID NO: 7188399 - DNA, 22 bp, Homo sapiens
cacactagtctatccattagct

SEQ ID NO: 7188400 - DNA, 22 bp, Homo sapiens
cacagcttcccgtgcatggaga

SEQ ID NO: 7188401 - DNA, 22 bp, Homo sapiens
cacagcttcccaaagtggacct

SEQ ID NO: 7188402 - DNA, 22 bp, Homo sapiens
cacagcttccattagaatgaga

SEQ ID NO: 7188403 - DNA, 22 bp, Homo sapiens
cacagcttccattagaatgaga

SEQ ID NO: 7188404 - DNA, 22 bp, Homo sapiens
cacagcttcagtttctgacttg

SEQ ID NO: 7188405 - DNA, 22 bp, Homo sapiens
cacagcttatgccactgattgg

SEQ ID NO: 7188406 - DNA, 22 bp, Homo sapiens
cacagcttagaaaagaagccat

SEQ ID NO: 7188407 - DNA, 22 bp, Homo sapiens
cacagctgtcagctgacctagg

SEQ ID NO: 7188408 - DNA, 22 bp, Homo sapiens
cacagctgtcagctgacctagg

SEQ ID NO: 7188409 - DNA, 22 bp, Homo sapiens
cacagctgttttctccaggcag

SEQ ID NO: 7188410 - DNA, 22 bp, Homo sapiens
cacagctgttttctccaggcag

SEQ ID NO: 7188411 - DNA, 22 bp, Homo sapiens
ggaggcggaggctgcagtgagc

SEQ ID NO: 7188412 - DNA, 22 bp, Homo sapiens
ggaggcggagcttgcagtgagc

SEQ ID NO: 7188413 - DNA, 22 bp, Homo sapiens
ggaggcggagcttgcagtgagc

SEQ ID NO: 7188414 - DNA, 22 bp, Homo sapiens
ggaggcggagcttgcagtgagc

SEQ ID NO: 7188415 - DNA, 22 bp, Homo sapiens
ggaggcggagcttgcagtgagc

SEQ ID NO: 7188416 - DNA, 22 bp, Homo sapiens
ggaggcggagcttgcagtgagc

SEQ ID NO: 7188417 - DNA, 22 bp, Homo sapiens
ggaggcggagcttgcagtgagc

SEQ ID NO: 7188418 - DNA, 22 bp, Homo sapiens
ggaggcggacacaggtagtgtt

SEQ ID NO: 7188419 - DNA, 22 bp, Homo sapiens
ggaggcggacacaggtagtgtt

SEQ ID NO: 7188420 - DNA, 22 bp, Homo sapiens
ggaggcggacacaggtagtgtt

SEQ ID NO: 7188421 - DNA, 22 bp, Homo sapiens
ggaggcggacacaggtagtgtt

SEQ ID NO: 7188422 - DNA, 22 bp, Homo sapiens
ggaggcggacacaggtagtgtt

SEQ ID NO: 7188423 - DNA, 22 bp, Homo sapiens
ggaggcggaagttgcagtgagc

SEQ ID NO: 7188424 - DNA, 22 bp, Homo sapiens
ggaggcggaagttgcagtgagc

SEQ ID NO: 7188425 - DNA, 22 bp, Homo sapiens
ggaggcggaagttgcagtgagc

SEQ ID NO: 7188426 - DNA, 22 bp, Homo sapiens
ggaggcggaagttgcagtgagc

SEQ ID NO: 7188427 - DNA, 22 bp, Homo sapiens
ggaggcggaagttgcagtgagc

SEQ ID NO: 7188428 - DNA, 22 bp, Homo sapiens
ggaggcggaagttgcagtgagc

SEQ ID NO: 7188429 - DNA, 20 bp, Homo sapiens
ggaggcgctgggctcgcgct

SEQ ID NO: 7188430 - DNA, 22 bp, Homo sapiens
ggaggcgcggctcggctgtgcc

SEQ ID NO: 7188431 - DNA, 22 bp, Homo sapiens
ggaggcgcggctcggctgtgcc

SEQ ID NO: 7188432 - DNA, 22 bp, Homo sapiens
ggaggcgcggctcggctgtgcc

SEQ ID NO: 7188433 - DNA, 22 bp, Homo sapiens
ggaggcgatcctgggaaacacc

SEQ ID NO: 7188434 - DNA, 20 bp, Homo sapiens
cacagcttgccttttatgac

SEQ ID NO: 7188435 - DNA, 20 bp, Homo sapiens
cacagcttgccttttatgac

SEQ ID NO: 7188436 - DNA, 22 bp, Homo sapiens
cacagcttcttccattccactc

SEQ ID NO: 7188437 - DNA, 22 bp, Homo sapiens
cacagcttcttccattccactc

SEQ ID NO: 7188438 - DNA, 22 bp, Homo sapiens
cacagcttctgtctgacccatg

SEQ ID NO: 7188439 - DNA, 22 bp, Homo sapiens
cacagcttctgtctgacccatg

SEQ ID NO: 7188440 - DNA, 22 bp, Homo sapiens
cacagcttctgagtgaggattt

SEQ ID NO: 7188441 - DNA, 22 bp, Homo sapiens
cacagcttctgagtgaggattt

SEQ ID NO: 7188442 - DNA, 22 bp, Homo sapiens
cacagcttctccttgatatcgc

SEQ ID NO: 7188443 - DNA, 22 bp, Homo sapiens
cacagcttctccttgatatcgc

SEQ ID NO: 7188444 - DNA, 22 bp, Homo sapiens
cacagcttctccttgatatcgc

SEQ ID NO: 7188445 - DNA, 22 bp, Homo sapiens
cacagcttctccccgctgcggc

SEQ ID NO: 7188446 - DNA, 22 bp, Homo sapiens
cacagcttgtttagtgactcac

SEQ ID NO: 7188447 - DNA, 22 bp, Homo sapiens
ggaggccaaggcaggtggatca

SEQ ID NO: 7188448 - DNA, 22 bp, Homo sapiens
cacagcttgggctctgacaata

SEQ ID NO: 7188449 - DNA, 22 bp, Homo sapiens
cacagcttgtttagtgactcac

SEQ ID NO: 7188450 - DNA, 22 bp, Homo sapiens
ggaggccaaggcaggtggatcg

SEQ ID NO: 7188451 - DNA, 22 bp, Homo sapiens
ggaggccttgcctgcaggcaca

SEQ ID NO: 7188452 - DNA, 22 bp, Homo sapiens
ggaggccttgcctgcaggcaca

SEQ ID NO: 7188453 - DNA, 22 bp, Homo sapiens
ggaggccttgcctgcaggcaca

SEQ ID NO: 7188454 - DNA, 22 bp, Homo sapiens
cacagtggattgggtgatgccc

SEQ ID NO: 7188455 - DNA, 22 bp, Homo sapiens
cacagtgctttatgagagatct

SEQ ID NO: 7188456 - DNA, 22 bp, Homo sapiens
cacagtggaaacagctaagcct

SEQ ID NO: 7188457 - DNA, 22 bp, Homo sapiens
cacagtggaagtccaggatccc

SEQ ID NO: 7188458 - DNA, 22 bp, Homo sapiens
cacagtggtttccgattcagac

SEQ ID NO: 7188459 - DNA, 22 bp, Homo sapiens
cacagtggctttgctggtctcg

SEQ ID NO: 7188460 - DNA, 22 bp, Homo sapiens
cacagtggctttgctggtctcg

SEQ ID NO: 7188461 - DNA, 22 bp, Homo sapiens
cacagtggtccccgaagcccct

SEQ ID NO: 7188462 - DNA, 22 bp, Homo sapiens
cacagtggcaggtgtgggttgt

SEQ ID NO: 7188463 - DNA, 22 bp, Homo sapiens
ggcagagcttgcagtgagccga

SEQ ID NO: 7188464 - DNA, 22 bp, Homo sapiens
ggcagagcttgcagtgagccga

SEQ ID NO: 7188465 - DNA, 22 bp, Homo sapiens
cacagtgcgaaagaaacccagc

SEQ ID NO: 7188466 - DNA, 22 bp, Homo sapiens
cacagtgctcaaacacaagtgc

SEQ ID NO: 7188467 - DNA, 22 bp, Homo sapiens
ggcagagcgcatgcgtcgcaga

SEQ ID NO: 7188468 - DNA, 22 bp, Homo sapiens
ggcagagctagtggcttctctt

SEQ ID NO: 7188469 - DNA, 22 bp, Homo sapiens
ggcagagctctggactgagaac

SEQ ID NO: 7188470 - DNA, 20 bp, Homo sapiens
ggcagagctatgtctgttgc

SEQ ID NO: 7188471 - DNA, 22 bp, Homo sapiens
ggcagagctagtggcttctctt

SEQ ID NO: 7188472 - DNA, 22 bp, Homo sapiens
ggcagagctgcatgagcactca

SEQ ID NO: 7188473 - DNA, 22 bp, Homo sapiens
ggcagagctgcatgagcactca

SEQ ID NO: 7188474 - DNA, 21 bp, Homo sapiens
ggcagagctggggcctccagc

SEQ ID NO: 7188475 - DNA, 21 bp, Homo sapiens
ggcagagctggggcctccagc

SEQ ID NO: 7188476 - DNA, 17 bp, Homo sapiens
ggcagagctgacagggc

SEQ ID NO: 7188477 - DNA, 17 bp, Homo sapiens
ggcagagctgacagggc

SEQ ID NO: 7188478 - DNA, 17 bp, Homo sapiens
ggcagagctgacagggc

SEQ ID NO: 7188479 - DNA, 22 bp, Homo sapiens
ggcagcagttacaaatgtgcag

SEQ ID NO: 7188480 - DNA, 22 bp, Homo sapiens
ggcagcagtggctgctattgtc

SEQ ID NO: 7188481 - DNA, 22 bp, Homo sapiens
ggcagcagtggctgctattgtc

SEQ ID NO: 7188482 - DNA, 22 bp, Homo sapiens
ggcagatggaagaggctgggtc

SEQ ID NO: 7188483 - DNA, 22 bp, Homo sapiens
ggcagatggaaggacagacgga

SEQ ID NO: 7188484 - DNA, 22 bp, Homo sapiens
ggcagcagtggctgctattgtc

SEQ ID NO: 7188485 - DNA, 22 bp, Homo sapiens
ggcagcagtggctgctattgtc

SEQ ID NO: 7188486 - DNA, 22 bp, Homo sapiens
ggcagcagtggctgctattgtc

SEQ ID NO: 7188487 - DNA, 22 bp, Homo sapiens
cacagtgtggcaaatttcaact

SEQ ID NO: 7188488 - DNA, 22 bp, Homo sapiens
ggcagatggaagaggctgggtc

SEQ ID NO: 7188489 - DNA, 22 bp, Homo sapiens
ggcagatggaagaggctgggtc

SEQ ID NO: 7188490 - DNA, 22 bp, Homo sapiens
cacagtgtagactaataataga

SEQ ID NO: 7188491 - DNA, 22 bp, Homo sapiens
cacagtgtagttaatgtgacat

SEQ ID NO: 7188492 - DNA, 22 bp, Homo sapiens
ggcagccagagggcagctggat

SEQ ID NO: 7188493 - DNA, 22 bp, Homo sapiens
ggcagccaccctgggaggcaga

SEQ ID NO: 7188494 - DNA, 22 bp, Homo sapiens
ggcagccaccctgggaggcaga

SEQ ID NO: 7188495 - DNA, 22 bp, Homo sapiens
ggcagccaccctgggaggcaga

SEQ ID NO: 7188496 - DNA, 20 bp, Homo sapiens
ggcagccaatcagcgtgccg

SEQ ID NO: 7188497 - DNA, 20 bp, Homo sapiens
ggcagccaatcagcgtgccg

SEQ ID NO: 7188498 - DNA, 22 bp, Homo sapiens
ggcagccaccctgggaggcaga

SEQ ID NO: 7188499 - DNA, 22 bp, Homo sapiens
ggcagcatgtgtggtccgctgg

SEQ ID NO: 7188500 - DNA, 22 bp, Homo sapiens
ggcagcattgccaatccagaca

SEQ ID NO: 7188501 - DNA, 22 bp, Homo sapiens
ggcagcagttacaaatgtgcag

SEQ ID NO: 7188502 - DNA, 22 bp, Homo sapiens
ggcagcatatattcagtgggca

SEQ ID NO: 7188503 - DNA, 22 bp, Homo sapiens
ggcagcatctctggcagcagct

SEQ ID NO: 7188504 - DNA, 22 bp, Homo sapiens
ggcagcatctctggcagcagct

SEQ ID NO: 7188505 - DNA, 22 bp, Homo sapiens
ggcagcatgagcctggtgaatt

SEQ ID NO: 7188506 - DNA, 22 bp, Homo sapiens
ggcacagggaggccctggtgtg

SEQ ID NO: 7188507 - DNA, 22 bp, Homo sapiens
ggcacagggaggccctggtgtg

SEQ ID NO: 7188508 - DNA, 22 bp, Homo sapiens
ggcacagggaggccctggtgtg

SEQ ID NO: 7188509 - DNA, 22 bp, Homo sapiens
ggcacagggaggccctggtgtg

SEQ ID NO: 7188510 - DNA, 22 bp, Homo sapiens
ggcacagggggctgaggactag

SEQ ID NO: 7188511 - DNA, 22 bp, Homo sapiens
ggcacagggggctgaggactag

SEQ ID NO: 7188512 - DNA, 22 bp, Homo sapiens
ggcacagggtgatgttgcagtt

SEQ ID NO: 7188513 - DNA, 22 bp, Homo sapiens
ggcacagtccctggcacagagt

SEQ ID NO: 7188514 - DNA, 22 bp, Homo sapiens
ggcacagttttctacatatgct

SEQ ID NO: 7188515 - DNA, 22 bp, Homo sapiens
ggcacagggtgatgttgcagtt

SEQ ID NO: 7188516 - DNA, 22 bp, Homo sapiens
ggcacagggggctgaggactag

SEQ ID NO: 7188517 - DNA, 22 bp, Homo sapiens
ggcacagggagccgcagttgca

SEQ ID NO: 7188518 - DNA, 22 bp, Homo sapiens
ggcacagggagccgcagttgca

SEQ ID NO: 7188519 - DNA, 22 bp, Homo sapiens
ggcacagggagccgcagttgca

SEQ ID NO: 7188520 - DNA, 22 bp, Homo sapiens
ggcacagggagaggcggatttt

SEQ ID NO: 7188521 - DNA, 22 bp, Homo sapiens
ggcacagggagccgcagttgca

SEQ ID NO: 7188522 - DNA, 22 bp, Homo sapiens
ggcacaattgcagcaataaaca

SEQ ID NO: 7188523 - DNA, 22 bp, Homo sapiens
ggcacaatcatgaagttgagtt

SEQ ID NO: 7188524 - DNA, 22 bp, Homo sapiens
ggcacaggagtcacagcatttc

SEQ ID NO: 7188525 - DNA, 22 bp, Homo sapiens
ggcacaggagtcacagcatttc

SEQ ID NO: 7188526 - DNA, 22 bp, Homo sapiens
ggcacaaggtttaaataacatc

SEQ ID NO: 7188527 - DNA, 22 bp, Homo sapiens
ggcacaaggtttaaataacatc

SEQ ID NO: 7188528 - DNA, 22 bp, Homo sapiens
cacagggcaggccccaggcctc

SEQ ID NO: 7188529 - DNA, 22 bp, Homo sapiens
cacagggcaggccccaggcctc

SEQ ID NO: 7188530 - DNA, 22 bp, Homo sapiens
cacagggcaggccccaggcctc

SEQ ID NO: 7188531 - DNA, 22 bp, Homo sapiens
cacagggcagagacctgggtgc

SEQ ID NO: 7188532 - DNA, 22 bp, Homo sapiens
cacagggcagagggtccgtggc

SEQ ID NO: 7188533 - DNA, 22 bp, Homo sapiens
cacagggcagagggtccgtggc

SEQ ID NO: 7188534 - DNA, 22 bp, Homo sapiens
ggcactgggaatgcagtgatga

SEQ ID NO: 7188535 - DNA, 22 bp, Homo sapiens
ggcactgggaatgcagtgatga

SEQ ID NO: 7188536 - DNA, 22 bp, Homo sapiens
ggcactgggagaggtgagacgg

SEQ ID NO: 7188537 - DNA, 22 bp, Homo sapiens
ggcactgggagaggtgagacgg

SEQ ID NO: 7188538 - DNA, 22 bp, Homo sapiens
ggcactgggagaggtgagacgg

SEQ ID NO: 7188539 - DNA, 22 bp, Homo sapiens
ggcactgggagaggtgagacgg

SEQ ID NO: 7188540 - DNA, 22 bp, Homo sapiens
ggcactgggcaccggctgaggg

SEQ ID NO: 7188541 - DNA, 22 bp, Homo sapiens
ggcactgggcaccggctgaggg

SEQ ID NO: 7188542 - DNA, 22 bp, Homo sapiens
ggcactgggcaccggctgaggg

SEQ ID NO: 7188543 - DNA, 22 bp, Homo sapiens
ggcagagcagccccagggtttg

SEQ ID NO: 7188544 - DNA, 22 bp, Homo sapiens
ggcagagatgtgggtcagaatc

SEQ ID NO: 7188545 - DNA, 22 bp, Homo sapiens
ggcagagagttctccacctctc

SEQ ID NO: 7188546 - DNA, 22 bp, Homo sapiens
ggcagagatgtgggtcagaatc

SEQ ID NO: 7188547 - DNA, 22 bp, Homo sapiens
ggcagagatgtgggtcagaatc

SEQ ID NO: 7188548 - DNA, 22 bp, Homo sapiens
ggcagagatgtgggtcagaatc

SEQ ID NO: 7188549 - DNA, 22 bp, Homo sapiens
ggcagagccttctggagctcgc

SEQ ID NO: 7188550 - DNA, 22 bp, Homo sapiens
ggcagagccttctggagctcgc

SEQ ID NO: 7188551 - DNA, 22 bp, Homo sapiens
ggcagagccttctggagctcgc

SEQ ID NO: 7188552 - DNA, 22 bp, Homo sapiens
ggcagagcattcgatggacctg

SEQ ID NO: 7188553 - DNA, 22 bp, Homo sapiens
ggcagagcattcgatggacctg

SEQ ID NO: 7188554 - DNA, 22 bp, Homo sapiens
ggcagagcctcagccctccacc

SEQ ID NO: 7188555 - DNA, 22 bp, Homo sapiens
ggcacatgtatgtgggagtgtg

SEQ ID NO: 7188556 - DNA, 22 bp, Homo sapiens
ggcactgctgtaggcagtgagg

SEQ ID NO: 7188557 - DNA, 22 bp, Homo sapiens
ggcactgctgtaggcagtgagg

SEQ ID NO: 7188558 - DNA, 22 bp, Homo sapiens
ggcactgctgtaggcagtgagg

SEQ ID NO: 7188559 - DNA, 18 bp, Homo sapiens
ggcactgctgttcccctt

SEQ ID NO: 7188560 - DNA, 22 bp, Homo sapiens
ggcactgcttcctgagcctgag

SEQ ID NO: 7188561 - DNA, 22 bp, Homo sapiens
ggcactgcttcctgagcctgag

SEQ ID NO: 7188562 - DNA, 20 bp, Homo sapiens
ggcactggaagcacacagga

SEQ ID NO: 7188563 - DNA, 20 bp, Homo sapiens
ggcactggaagcacacagga

SEQ ID NO: 7188564 - DNA, 20 bp, Homo sapiens
ggcactggaagcacacagga

SEQ ID NO: 7188565 - DNA, 22 bp, Homo sapiens
ggcactggaaggatcatgtgag

SEQ ID NO: 7188566 - DNA, 22 bp, Homo sapiens
ggcactggaaggatcatgtgag

SEQ ID NO: 7188567 - DNA, 22 bp, Homo sapiens
ggcactggaaggatcatgtgag

SEQ ID NO: 7188568 - DNA, 22 bp, Homo sapiens
ggcactggaagtcccattgtct

SEQ ID NO: 7188569 - DNA, 22 bp, Homo sapiens
ggcactggagactgttatgaga

SEQ ID NO: 7188570 - DNA, 22 bp, Homo sapiens
ggcactggcaaagcaaagtctg

SEQ ID NO: 7188571 - DNA, 22 bp, Homo sapiens
ggcactggcaaagcaaagtctg

SEQ ID NO: 7188572 - DNA, 16 bp, Homo sapiens
ggcactggcaggtcct

SEQ ID NO: 7188573 - DNA, 16 bp, Homo sapiens
ggcactggcaggtcct

SEQ ID NO: 7188574 - DNA, 22 bp, Homo sapiens
ggcactggcctggggccaagag

SEQ ID NO: 7188575 - DNA, 22 bp, Homo sapiens
ggcactggcctggggccaagag

SEQ ID NO: 7188576 - DNA, 22 bp, Homo sapiens
ggcactggcctggggccaagag

SEQ ID NO: 7188577 - DNA, 22 bp, Homo sapiens
ggcactgggaatgcagtgatga

SEQ ID NO: 7188578 - DNA, 22 bp, Homo sapiens
ggctagggatctagaccaggac

SEQ ID NO: 7188579 - DNA, 22 bp, Homo sapiens
ggctagggatctagaccaggac

SEQ ID NO: 7188580 - DNA, 22 bp, Homo sapiens
ggctagggatctagaccaggac

SEQ ID NO: 7188581 - DNA, 22 bp, Homo sapiens
ggctagggatctagaccaggac

SEQ ID NO: 7188582 - DNA, 22 bp, Homo sapiens
ggctagggatctagaccaggac

SEQ ID NO: 7188583 - DNA, 22 bp, Homo sapiens
ggctagggatctagaccaggac

SEQ ID NO: 7188584 - DNA, 22 bp, Homo sapiens
ggctagggatctagaccaggac

SEQ ID NO: 7188585 - DNA, 22 bp, Homo sapiens
ggctagggatctagaccaggac

SEQ ID NO: 7188586 - DNA, 22 bp, Homo sapiens
ggctagggatctagaccaggac

SEQ ID NO: 7188587 - DNA, 22 bp, Homo sapiens
ggctagggatctagaccaggac

SEQ ID NO: 7188588 - DNA, 22 bp, Homo sapiens
ggctaggggaataatctgtggt

SEQ ID NO: 7188589 - DNA, 22 bp, Homo sapiens
ggctatgagatgggaccagtac

SEQ ID NO: 7188590 - DNA, 22 bp, Homo sapiens
ggctatgagatgggaccagtac

SEQ ID NO: 7188591 - DNA, 22 bp, Homo sapiens
ggctcaatgcaacttctgcctc

SEQ ID NO: 7188592 - DNA, 22 bp, Homo sapiens
ggctcaatgcaacttctgcctc

SEQ ID NO: 7188593 - DNA, 19 bp, Homo sapiens
ggctcaagcatccaggtag

SEQ ID NO: 7188594 - DNA, 22 bp, Homo sapiens
ggctcaagcagtctgcctgcct

SEQ ID NO: 7188595 - DNA, 22 bp, Homo sapiens
ggctcaagcagtctgcctgcct

SEQ ID NO: 7188596 - DNA, 22 bp, Homo sapiens
ggctatgggaagatggcagggg

SEQ ID NO: 7188597 - DNA, 22 bp, Homo sapiens
ggctatgggaagatggcagggg

SEQ ID NO: 7188598 - DNA, 22 bp, Homo sapiens
ggctatggaaatggcaggacat

SEQ ID NO: 7188599 - DNA, 22 bp, Homo sapiens
cactgcccactccttcgtccaa

SEQ ID NO: 7188600 - DNA, 22 bp, Homo sapiens
cactgcccagagggcagcattg

SEQ ID NO: 7188601 - DNA, 22 bp, Homo sapiens
cactgcccaactgttttccaaa

SEQ ID NO: 7188602 - DNA, 22 bp, Homo sapiens
cactgcccaccaagtggctggt

SEQ ID NO: 7188603 - DNA, 22 bp, Homo sapiens
ggctagggagacagagggcatg

SEQ ID NO: 7188604 - DNA, 22 bp, Homo sapiens
ggctagggagacagagggcatg

SEQ ID NO: 7188605 - DNA, 22 bp, Homo sapiens
ggctagggagacagagggcatg

SEQ ID NO: 7188606 - DNA, 22 bp, Homo sapiens
ggctagggagacagagggcatg

SEQ ID NO: 7188607 - DNA, 22 bp, Homo sapiens
ggctagggagacagagggcatg

SEQ ID NO: 7188608 - DNA, 22 bp, Homo sapiens
cactgcagtaactctaggactg

SEQ ID NO: 7188609 - DNA, 22 bp, Homo sapiens
cactgcagtcttcatcaaccaa

SEQ ID NO: 7188610 - DNA, 22 bp, Homo sapiens
cactgcagttccccagtgcgca

SEQ ID NO: 7188611 - DNA, 22 bp, Homo sapiens
cactgcatggatgatggctgta

SEQ ID NO: 7188612 - DNA, 22 bp, Homo sapiens
cactgccacctgcatgccctga

SEQ ID NO: 7188613 - DNA, 20 bp, Homo sapiens
cactgccagaatacactgtc

SEQ ID NO: 7188614 - DNA, 22 bp, Homo sapiens
cactgcctgctggctgtcactt

SEQ ID NO: 7188615 - DNA, 22 bp, Homo sapiens
cactgcctgctggctgtcactt

SEQ ID NO: 7188616 - DNA, 22 bp, Homo sapiens
cactgcctgtgagctgtgtgcc

SEQ ID NO: 7188617 - DNA, 22 bp, Homo sapiens
cactgcctggaaggagagacat

SEQ ID NO: 7188618 - DNA, 22 bp, Homo sapiens
cactgctttcacagtttgttcc

SEQ ID NO: 7188619 - DNA, 22 bp, Homo sapiens
cactgctttcacagtttgttcc

SEQ ID NO: 7188620 - DNA, 22 bp, Homo sapiens
cactgctttgcccaagagggca

SEQ ID NO: 7188621 - DNA, 22 bp, Homo sapiens
cactgcttttcagacagttatt

SEQ ID NO: 7188622 - DNA, 22 bp, Homo sapiens
cactgcttttcagacagttatt

SEQ ID NO: 7188623 - DNA, 22 bp, Homo sapiens
cactgctttttctcctcactgg

SEQ ID NO: 7188624 - DNA, 22 bp, Homo sapiens
cactgcttttttggctatgtac

SEQ ID NO: 7188625 - DNA, 22 bp, Homo sapiens
cactgcttttttggctatgtac

SEQ ID NO: 7188626 - DNA, 22 bp, Homo sapiens
cactgcttttttggctatgtac

SEQ ID NO: 7188627 - DNA, 22 bp, Homo sapiens
cactggaatggatagagcagag

SEQ ID NO: 7188628 - DNA, 22 bp, Homo sapiens
cactggaatggatagagcagag

SEQ ID NO: 7188629 - DNA, 22 bp, Homo sapiens
cactggaatggatagagcagag

SEQ ID NO: 7188630 - DNA, 22 bp, Homo sapiens
cactggcattagtcacgaggca

SEQ ID NO: 7188631 - DNA, 22 bp, Homo sapiens
cactggcattagtcacgaggca

SEQ ID NO: 7188632 - DNA, 22 bp, Homo sapiens
cactggcattagtcacgaggca

SEQ ID NO: 7188633 - DNA, 22 bp, Homo sapiens
cactggcatctaagggtggtag

SEQ ID NO: 7188634 - DNA, 22 bp, Homo sapiens
cactggcatctagtgggttgag

SEQ ID NO: 7188635 - DNA, 22 bp, Homo sapiens
cactggcatgtgaggcggtggc

SEQ ID NO: 7188636 - DNA, 22 bp, Homo sapiens
cactggcaaatggagagaatgt

SEQ ID NO: 7188637 - DNA, 22 bp, Homo sapiens
cactggcagatttgggatctgg

SEQ ID NO: 7188638 - DNA, 22 bp, Homo sapiens
cactggatttccaggaatactc

SEQ ID NO: 7188639 - DNA, 22 bp, Homo sapiens
cactggaggtcagtggagcact

SEQ ID NO: 7188640 - DNA, 22 bp, Homo sapiens
cactggaggtcagtggagcact

SEQ ID NO: 7188641 - DNA, 22 bp, Homo sapiens
cactggaatgttgaggagacaa

SEQ ID NO: 7188642 - DNA, 22 bp, Homo sapiens
cactggaccaaggaaactcttc

SEQ ID NO: 7188643 - DNA, 23 bp, Homo sapiens
cactgcagcgtggtctggcagga

SEQ ID NO: 7188644 - DNA, 21 bp, Homo sapiens
cactgcagccttgacctgggc

SEQ ID NO: 7188645 - DNA, 23 bp, Homo sapiens
cactgcagcgtggtctggcagga

SEQ ID NO: 7188646 - DNA, 23 bp, Homo sapiens
cactgcagcgtggtctggcagga

SEQ ID NO: 7188647 - DNA, 23 bp, Homo sapiens
cactgcagcgtggtctggcagga

SEQ ID NO: 7188648 - DNA, 22 bp, Homo sapiens
cactgcaggtctgagatggggg

SEQ ID NO: 7188649 - DNA, 22 bp, Homo sapiens
cactgcagcaccatgcagggct

SEQ ID NO: 7188650 - DNA, 22 bp, Homo sapiens
cactgcagcaccatgcagggct

SEQ ID NO: 7188651 - DNA, 22 bp, Homo sapiens
cactgcagcaccatgcagggct

SEQ ID NO: 7188652 - DNA, 22 bp, Homo sapiens
cactgcagccacatagatgacg

SEQ ID NO: 7188653 - DNA, 22 bp, Homo sapiens
cactgcagccacatagatgacg

SEQ ID NO: 7188654 - DNA, 22 bp, Homo sapiens
cactgcagcctcaaattcctgg

SEQ ID NO: 7188655 - DNA, 22 bp, Homo sapiens
cactgcagcaccatgcagggct

SEQ ID NO: 7188656 - DNA, 22 bp, Homo sapiens
cactgcagatcagaggctgaga

SEQ ID NO: 7188657 - DNA, 22 bp, Homo sapiens
cactgcagatcagaggctgaga

SEQ ID NO: 7188658 - DNA, 22 bp, Homo sapiens
cactgcactccatcctgggaaa

SEQ ID NO: 7188659 - DNA, 22 bp, Homo sapiens
cactgcactccatcctgggaaa

SEQ ID NO: 7188660 - DNA, 22 bp, Homo sapiens
cactgcactccatcctgggaaa

SEQ ID NO: 7188661 - DNA, 22 bp, Homo sapiens
cactgcactccatcctgggaaa

SEQ ID NO: 7188662 - DNA, 22 bp, Homo sapiens
ggcctctcatgcccagagccaa

SEQ ID NO: 7188663 - DNA, 22 bp, Homo sapiens
ggcctctcatgcccagagccaa

SEQ ID NO: 7188664 - DNA, 22 bp, Homo sapiens
ggcctctcatgcccagagccaa

SEQ ID NO: 7188665 - DNA, 23 bp, Homo sapiens
ggcctctcaccagggtcctttca

SEQ ID NO: 7188666 - DNA, 23 bp, Homo sapiens
ggcctctcaccagggtcctttca

SEQ ID NO: 7188667 - DNA, 22 bp, Homo sapiens
ggcctcgcggcttctggtggct

SEQ ID NO: 7188668 - DNA, 22 bp, Homo sapiens
ggcctcgcggcttctggtggct

SEQ ID NO: 7188669 - DNA, 22 bp, Homo sapiens
ggcctcggcccactgctgcggt

SEQ ID NO: 7188670 - DNA, 20 bp, Homo sapiens
ggcctcggacttcatcgtag

SEQ ID NO: 7188671 - DNA, 22 bp, Homo sapiens
ggcctctcgaagcttcagtcca

SEQ ID NO: 7188672 - DNA, 22 bp, Homo sapiens
ggcctctcattctccctggtcc

SEQ ID NO: 7188673 - DNA, 22 bp, Homo sapiens
ggcctctcattctccctggtcc

SEQ ID NO: 7188674 - DNA, 22 bp, Homo sapiens
ggcctctcatgtcctgggcttc

SEQ ID NO: 7188675 - DNA, 22 bp, Homo sapiens
ggcctctcatgtcctgggcttc

SEQ ID NO: 7188676 - DNA, 22 bp, Homo sapiens
ggcctctcatgtcctgggcttc

SEQ ID NO: 7188677 - DNA, 22 bp, Homo sapiens
ggcctctcatgtcctgggcttc

SEQ ID NO: 7188678 - DNA, 22 bp, Homo sapiens
ggcctctctagcatccagcctg

SEQ ID NO: 7188679 - DNA, 22 bp, Homo sapiens
ggcctctctagcatccagcctg

SEQ ID NO: 7188680 - DNA, 22 bp, Homo sapiens
ggcctctctagcatccagcctg

SEQ ID NO: 7188681 - DNA, 22 bp, Homo sapiens
ggcctctctccagtcagtgcag

SEQ ID NO: 7188682 - DNA, 22 bp, Homo sapiens
cactgcactccagcttgggtga

SEQ ID NO: 7188683 - DNA, 22 bp, Homo sapiens
cactgcactccagcttgggtga

SEQ ID NO: 7188684 - DNA, 22 bp, Homo sapiens
cactgcactccagcttgggtga

SEQ ID NO: 7188685 - DNA, 22 bp, Homo sapiens
cactgaggctgggggagaaggt

SEQ ID NO: 7188686 - DNA, 23 bp, Homo sapiens
ggcctcctggtctaggctagact

SEQ ID NO: 7188687 - DNA, 23 bp, Homo sapiens
ggcctcctggtctaggctagact

SEQ ID NO: 7188688 - DNA, 23 bp, Homo sapiens
ggcctcctggtctaggctagact

SEQ ID NO: 7188689 - DNA, 23 bp, Homo sapiens
ggcctcctggtctaggctagact

SEQ ID NO: 7188690 - DNA, 23 bp, Homo sapiens
ggcctcctggtctaggctagact

SEQ ID NO: 7188691 - DNA, 23 bp, Homo sapiens
ggcctcctggtctaggctagact

SEQ ID NO: 7188692 - DNA, 22 bp, Homo sapiens
ggcctcgcggcttctggtggct

SEQ ID NO: 7188693 - DNA, 22 bp, Homo sapiens
ggcctcgcggcttctggtggct

SEQ ID NO: 7188694 - DNA, 22 bp, Homo sapiens
ggcctcgcggcttctggtggct

SEQ ID NO: 7188695 - DNA, 22 bp, Homo sapiens
ggcctcgcggcttctggtggct

SEQ ID NO: 7188696 - DNA, 22 bp, Homo sapiens
ggcctcgcggcttctggtggct

SEQ ID NO: 7188697 - DNA, 19 bp, Homo sapiens
cactgagctctgttcacta

SEQ ID NO: 7188698 - DNA, 22 bp, Homo sapiens
cactgagagtagggcacaagtg

SEQ ID NO: 7188699 - DNA, 22 bp, Homo sapiens
cactgagcaagtcagtacagca

SEQ ID NO: 7188700 - DNA, 22 bp, Homo sapiens
cactgagcatgagtgggctgtg

SEQ ID NO: 7188701 - DNA, 22 bp, Homo sapiens
cactgactaagtttgtgaaggt

SEQ ID NO: 7188702 - DNA, 22 bp, Homo sapiens
cactgactccaaaaataaagaa

SEQ ID NO: 7188703 - DNA, 22 bp, Homo sapiens
cactgaccatggccaattggca

SEQ ID NO: 7188704 - DNA, 22 bp, Homo sapiens
cactgagaggtctcatttccaa

SEQ ID NO: 7188705 - DNA, 22 bp, Homo sapiens
cactgagacccgaatacttcca

SEQ ID NO: 7188706 - DNA, 22 bp, Homo sapiens
cactgaagatgcgactagtgct

SEQ ID NO: 7188707 - DNA, 22 bp, Homo sapiens
cactgaagccactggaagagga

SEQ ID NO: 7188708 - DNA, 22 bp, Homo sapiens
cactgaagccactggaagagga

SEQ ID NO: 7188709 - DNA, 22 bp, Homo sapiens
cactgaaggaaggactactgca

SEQ ID NO: 7188710 - DNA, 22 bp, Homo sapiens
cactgaaggaaggactactgca

SEQ ID NO: 7188711 - DNA, 22 bp, Homo sapiens
cactgaaggacagtaggaaggg

SEQ ID NO: 7188712 - DNA, 22 bp, Homo sapiens
cactgaaggctgcagctcagcc

SEQ ID NO: 7188713 - DNA, 22 bp, Homo sapiens
cactgaatctcaaggggagggt

SEQ ID NO: 7188714 - DNA, 22 bp, Homo sapiens
cactgacagtatcagagctgtt

SEQ ID NO: 7188715 - DNA, 22 bp, Homo sapiens
ggcatatgtagcgtgtgttctg

SEQ ID NO: 7188716 - DNA, 22 bp, Homo sapiens
ggcatatttatgagaacttagt

SEQ ID NO: 7188717 - DNA, 22 bp, Homo sapiens
cacccaggctggaatgcagtgg

SEQ ID NO: 7188718 - DNA, 22 bp, Homo sapiens
cacccaggctggaatgcagtgg

SEQ ID NO: 7188719 - DNA, 22 bp, Homo sapiens
cacccaggctggaatgcagtgg

SEQ ID NO: 7188720 - DNA, 22 bp, Homo sapiens
cacccaggctagagtgcagtgg

SEQ ID NO: 7188721 - DNA, 22 bp, Homo sapiens
cacccaggctagagtgcagtgg

SEQ ID NO: 7188722 - DNA, 22 bp, Homo sapiens
cacccaggctggaatgcaatgg

SEQ ID NO: 7188723 - DNA, 22 bp, Homo sapiens
ggcatagatttctttaggttta

SEQ ID NO: 7188724 - DNA, 22 bp, Homo sapiens
ggcatagatttctttaggttta

SEQ ID NO: 7188725 - DNA, 22 bp, Homo sapiens
ggcatacaagagaaatataaga

SEQ ID NO: 7188726 - DNA, 22 bp, Homo sapiens
ggcatagaaaatgtgccctctg

SEQ ID NO: 7188727 - DNA, 22 bp, Homo sapiens
ggcatacaagagaaatataaga

SEQ ID NO: 7188728 - DNA, 22 bp, Homo sapiens
ggcatacaagagaaatataaga

SEQ ID NO: 7188729 - DNA, 22 bp, Homo sapiens
ggcagttttaacagaggtagta

SEQ ID NO: 7188730 - DNA, 22 bp, Homo sapiens
ggcagtttggcaggatggaggg

SEQ ID NO: 7188731 - DNA, 22 bp, Homo sapiens
ggcagtttatattatgtgtgtg

SEQ ID NO: 7188732 - DNA, 22 bp, Homo sapiens
cacccattaaccaaagagtgaa

SEQ ID NO: 7188733 - DNA, 22 bp, Homo sapiens
cacccagtaagcatgaggccct

SEQ ID NO: 7188734 - DNA, 22 bp, Homo sapiens
cacccaggctggaatgcagtgg

SEQ ID NO: 7188735 - DNA, 22 bp, Homo sapiens
cacccaggttggagtgcagtgg

SEQ ID NO: 7188736 - DNA, 22 bp, Homo sapiens
cacccaggttggagtgcagtgg

SEQ ID NO: 7188737 - DNA, 23 bp, Homo sapiens
caccccaccctgaggaggaggga

SEQ ID NO: 7188738 - DNA, 22 bp, Homo sapiens
caccccacatcaggcttctcca

SEQ ID NO: 7188739 - DNA, 23 bp, Homo sapiens
caccccaccctgaggaggaggga

SEQ ID NO: 7188740 - DNA, 22 bp, Homo sapiens
cacccatgtttccctctgtctt

SEQ ID NO: 7188741 - DNA, 22 bp, Homo sapiens
caccccacatcaggcttctcca

SEQ ID NO: 7188742 - DNA, 22 bp, Homo sapiens
caccctccagctcccgggggct

SEQ ID NO: 7188743 - DNA, 20 bp, Homo sapiens
caccctacggcctcacctcc

SEQ ID NO: 7188744 - DNA, 22 bp, Homo sapiens
caccctagctgtcatttcagtt

SEQ ID NO: 7188745 - DNA, 20 bp, Homo sapiens
caccctcccagcacctatgc

SEQ ID NO: 7188746 - DNA, 22 bp, Homo sapiens
caccctcccgtcagcccctggg

SEQ ID NO: 7188747 - DNA, 18 bp, Homo sapiens
caccctccgcggctgccc

SEQ ID NO: 7188748 - DNA, 18 bp, Homo sapiens
caccctccgcggctgccc

SEQ ID NO: 7188749 - DNA, 22 bp, Homo sapiens
caccctcccgtcagcccctggg

SEQ ID NO: 7188750 - DNA, 20 bp, Homo sapiens
caccctcccagcacctatgc

SEQ ID NO: 7188751 - DNA, 20 bp, Homo sapiens
caccctcccagcacctatgc

SEQ ID NO: 7188752 - DNA, 22 bp, Homo sapiens
cacccccagcagggaaaggagg

SEQ ID NO: 7188753 - DNA, 22 bp, Homo sapiens
cacccccaggagctccagggac

SEQ ID NO: 7188754 - DNA, 22 bp, Homo sapiens
cacccccaggagctccagggac

SEQ ID NO: 7188755 - DNA, 22 bp, Homo sapiens
caccccctccatggttgtgaca

SEQ ID NO: 7188756 - DNA, 22 bp, Homo sapiens
cacccctacctgagtcaggagt

SEQ ID NO: 7188757 - DNA, 22 bp, Homo sapiens
cacccctcgccactgcccttgt

SEQ ID NO: 7188758 - DNA, 22 bp, Homo sapiens
cacccctgtggagcatggtggc

SEQ ID NO: 7188759 - DNA, 22 bp, Homo sapiens
caccctgactggccctgcagga

SEQ ID NO: 7188760 - DNA, 22 bp, Homo sapiens
caccctgctctgctgtgcggcc

SEQ ID NO: 7188761 - DNA, 22 bp, Homo sapiens
caccctggaaagaaggtctggg

SEQ ID NO: 7188762 - DNA, 22 bp, Homo sapiens
caccctgctctgctgtgcggcc

SEQ ID NO: 7188763 - DNA, 22 bp, Homo sapiens
caccctggaaagaaggtctggg

SEQ ID NO: 7188764 - DNA, 22 bp, Homo sapiens
caccctggaatagccccgggag

SEQ ID NO: 7188765 - DNA, 22 bp, Homo sapiens
caccctggcctcgctctctgca

SEQ ID NO: 7188766 - DNA, 22 bp, Homo sapiens
caccctggcctcgctctctgca

SEQ ID NO: 7188767 - DNA, 17 bp, Homo sapiens
caccctggctagtctga

SEQ ID NO: 7188768 - DNA, 22 bp, Homo sapiens
caccctggctggaggtgcagtg

SEQ ID NO: 7188769 - DNA, 22 bp, Homo sapiens
caccctggctggaggtgcagtg

SEQ ID NO: 7188770 - DNA, 22 bp, Homo sapiens
caccctggctggaggtgcagtg

SEQ ID NO: 7188771 - DNA, 22 bp, Homo sapiens
caccctggctggaggtgcagtg

SEQ ID NO: 7188772 - DNA, 22 bp, Homo sapiens
cactctgagaagtacaagctcc

SEQ ID NO: 7188773 - DNA, 22 bp, Homo sapiens
caccaggctggagtgcagtggc

SEQ ID NO: 7188774 - DNA, 22 bp, Homo sapiens
caccaggctggagtgcagtggc

SEQ ID NO: 7188775 - DNA, 22 bp, Homo sapiens
caccaggttccgggcagagctg

SEQ ID NO: 7188776 - DNA, 22 bp, Homo sapiens
ggcagctgattagcatcaagga

SEQ ID NO: 7188777 - DNA, 22 bp, Homo sapiens
caccagtctttattttgttatt

SEQ ID NO: 7188778 - DNA, 20 bp, Homo sapiens
caccagtcatgagtcaatac

SEQ ID NO: 7188779 - DNA, 22 bp, Homo sapiens
caccataaaaataagagatgcc

SEQ ID NO: 7188780 - DNA, 22 bp, Homo sapiens
caccataaccaacatgtcagtt

SEQ ID NO: 7188781 - DNA, 22 bp, Homo sapiens
caccatcagcagcaggtgtcaa

SEQ ID NO: 7188782 - DNA, 22 bp, Homo sapiens
ggcagctgagcatggctacctt

SEQ ID NO: 7188783 - DNA, 22 bp, Homo sapiens
ggcagctgagcatggctacctt

SEQ ID NO: 7188784 - DNA, 22 bp, Homo sapiens
ggcagctgattagcatcaagga

SEQ ID NO: 7188785 - DNA, 22 bp, Homo sapiens
ggcagccagagggcagctggat

SEQ ID NO: 7188786 - DNA, 22 bp, Homo sapiens
ggcagccagagggcagctggat

SEQ ID NO: 7188787 - DNA, 22 bp, Homo sapiens
ggcagccagagggcagctggat

SEQ ID NO: 7188788 - DNA, 19 bp, Homo sapiens
ggcagctcttgtcttctgc

SEQ ID NO: 7188789 - DNA, 19 bp, Homo sapiens
ggcagctcttgtcttctgc

SEQ ID NO: 7188790 - DNA, 21 bp, Homo sapiens
ggcagctgaccgcgcggtgca

SEQ ID NO: 7188791 - DNA, 21 bp, Homo sapiens
ggcagctgaccgcgcggtgca

SEQ ID NO: 7188792 - DNA, 21 bp, Homo sapiens
ggcagctgaccgcgcggtgca

SEQ ID NO: 7188793 - DNA, 22 bp, Homo sapiens
ggcagctgacctagcaccatcc

SEQ ID NO: 7188794 - DNA, 22 bp, Homo sapiens
ggcagctgacctagcaccatcc

SEQ ID NO: 7188795 - DNA, 22 bp, Homo sapiens
ggcagctgacctagcaccatcc

SEQ ID NO: 7188796 - DNA, 22 bp, Homo sapiens
ggcagctgagatcatgctgttg

SEQ ID NO: 7188797 - DNA, 22 bp, Homo sapiens
ggcagctgagcatggctacctt

SEQ ID NO: 7188798 - DNA, 22 bp, Homo sapiens
ggcagctgagcatggctacctt

SEQ ID NO: 7188799 - DNA, 20 bp, Homo sapiens
ggcagttaaggcacagtcat

SEQ ID NO: 7188800 - DNA, 20 bp, Homo sapiens
ggcagttaaggcacagtcat

SEQ ID NO: 7188801 - DNA, 22 bp, Homo sapiens
ggcagttgctgtggatgaggtt

SEQ ID NO: 7188802 - DNA, 22 bp, Homo sapiens
ggcagttgctgtggatgaggtt

SEQ ID NO: 7188803 - DNA, 22 bp, Homo sapiens
ggcagttgctgtggatgaggtt

SEQ ID NO: 7188804 - DNA, 22 bp, Homo sapiens
ggcagtgtgcatctgtgtggcc

SEQ ID NO: 7188805 - DNA, 22 bp, Homo sapiens
ggcagtgttccagaccttcacc

SEQ ID NO: 7188806 - DNA, 22 bp, Homo sapiens
cacccagagcctgagagggata

SEQ ID NO: 7188807 - DNA, 22 bp, Homo sapiens
cacccagagggcttgctgaaca

SEQ ID NO: 7188808 - DNA, 22 bp, Homo sapiens
cacccagcacagagggaggcga

SEQ ID NO: 7188809 - DNA, 22 bp, Homo sapiens
ggcagtgtccttgcagctctac

SEQ ID NO: 7188810 - DNA, 22 bp, Homo sapiens
cacccacattccatcactctgc

SEQ ID NO: 7188811 - DNA, 22 bp, Homo sapiens
cacccacattccatcactctgc

SEQ ID NO: 7188812 - DNA, 22 bp, Homo sapiens
cacccacattccatcactctgc

SEQ ID NO: 7188813 - DNA, 22 bp, Homo sapiens
cacccacatggaaattcacagt

SEQ ID NO: 7188814 - DNA, 22 bp, Homo sapiens
cacccacatggaaattcacagt

SEQ ID NO: 7188815 - DNA, 22 bp, Homo sapiens
cacccacattccatcactctgc

SEQ ID NO: 7188816 - DNA, 22 bp, Homo sapiens
cacccacattcctctagtatgt

SEQ ID NO: 7188817 - DNA, 22 bp, Homo sapiens
cacccacattcctctagtatgt

SEQ ID NO: 7188818 - DNA, 22 bp, Homo sapiens
cacccacccactgctcattggc

SEQ ID NO: 7188819 - DNA, 22 bp, Homo sapiens
cacccagagcagacactgtcca

SEQ ID NO: 7188820 - DNA, 22 bp, Homo sapiens
cacccacatggaaattcacagt

SEQ ID NO: 7188821 - DNA, 22 bp, Homo sapiens
cacccacatggaaattcacagt

SEQ ID NO: 7188822 - DNA, 22 bp, Homo sapiens
cacccacatggaaattcacagt

SEQ ID NO: 7188823 - DNA, 22 bp, Homo sapiens
caccattccaggccttaagaag

SEQ ID NO: 7188824 - DNA, 22 bp, Homo sapiens
caccatttaagaaagccaaatt

SEQ ID NO: 7188825 - DNA, 22 bp, Homo sapiens
caccatttaagaaagccaaatt

SEQ ID NO: 7188826 - DNA, 22 bp, Homo sapiens
caccatcttggcaaaggttcgc

SEQ ID NO: 7188827 - DNA, 22 bp, Homo sapiens
caccatctagcagagagatgga

SEQ ID NO: 7188828 - DNA, 22 bp, Homo sapiens
atttattggtttgcatggtgaa

SEQ ID NO: 7188829 - DNA, 22 bp, Homo sapiens
atttattggtttgcatggtgaa

SEQ ID NO: 7188830 - DNA, 22 bp, Homo sapiens
gccaggcattctagaagtagtg

SEQ ID NO: 7188831 - DNA, 22 bp, Homo sapiens
gccaggcatttgttaggtgctg

SEQ ID NO: 7188832 - DNA, 22 bp, Homo sapiens
gccaggcatttgttaggtgctg

SEQ ID NO: 7188833 - DNA, 22 bp, Homo sapiens
gccaggccactcccgggtcctg

SEQ ID NO: 7188834 - DNA, 22 bp, Homo sapiens
gccaggccactcccgggtcctg

SEQ ID NO: 7188835 - DNA, 22 bp, Homo sapiens
atttattgagcctttcctatgt

SEQ ID NO: 7188836 - DNA, 22 bp, Homo sapiens
atttattggatgcttacttggg

SEQ ID NO: 7188837 - DNA, 22 bp, Homo sapiens
atttattggatgcttacttggg

SEQ ID NO: 7188838 - DNA, 22 bp, Homo sapiens
atttattggatgcttacttggg

SEQ ID NO: 7188839 - DNA, 22 bp, Homo sapiens
atttattggatgcttacttggg

SEQ ID NO: 7188840 - DNA, 22 bp, Homo sapiens
atttattggatgcttacttggg

SEQ ID NO: 7188841 - DNA, 22 bp, Homo sapiens
atttattggatgcttacttggg

SEQ ID NO: 7188842 - DNA, 22 bp, Homo sapiens
atttattggatgcttacttggg

SEQ ID NO: 7188843 - DNA, 22 bp, Homo sapiens
atttattggatgcttacttggg

SEQ ID NO: 7188844 - DNA, 22 bp, Homo sapiens
atttattggtttgcatggtgaa

SEQ ID NO: 7188845 - DNA, 22 bp, Homo sapiens
atttattggtttgcatggtgaa

SEQ ID NO: 7188846 - DNA, 22 bp, Homo sapiens
atttattggtttgcatggtgaa

SEQ ID NO: 7188847 - DNA, 22 bp, Homo sapiens
atttattgagagggaggggaat

SEQ ID NO: 7188848 - DNA, 22 bp, Homo sapiens
atttattgagagggaggggaat

SEQ ID NO: 7188849 - DNA, 22 bp, Homo sapiens
atttattgagagggaggggaat

SEQ ID NO: 7188850 - DNA, 22 bp, Homo sapiens
atttattgagagggaggggaat

SEQ ID NO: 7188851 - DNA, 22 bp, Homo sapiens
atttattgagagggaggggaat

SEQ ID NO: 7188852 - DNA, 22 bp, Homo sapiens
atttattgagagggaggggaat

SEQ ID NO: 7188853 - DNA, 22 bp, Homo sapiens
atttattgagcctttcctatgt

SEQ ID NO: 7188854 - DNA, 22 bp, Homo sapiens
atttattgagcctttcctatgt

SEQ ID NO: 7188855 - DNA, 22 bp, Homo sapiens
atttattgagcctttcctatgt

SEQ ID NO: 7188856 - DNA, 22 bp, Homo sapiens
atttattgagcctttcctatgt

SEQ ID NO: 7188857 - DNA, 22 bp, Homo sapiens
atttattgagcctttcctatgt

SEQ ID NO: 7188858 - DNA, 21 bp, Homo sapiens
atttagaaggaaattttgcaa

SEQ ID NO: 7188859 - DNA, 21 bp, Homo sapiens
atttagaaggaaattttgcaa

SEQ ID NO: 7188860 - DNA, 22 bp, Homo sapiens
atttattatgggatttggcaca

SEQ ID NO: 7188861 - DNA, 22 bp, Homo sapiens
atttattatgggatttggctca

SEQ ID NO: 7188862 - DNA, 22 bp, Homo sapiens
atttattatgggatttggctca

SEQ ID NO: 7188863 - DNA, 22 bp, Homo sapiens
atttattgagacttaacaaccc

SEQ ID NO: 7188864 - DNA, 22 bp, Homo sapiens
atttattgagacttaacaaccc

SEQ ID NO: 7188865 - DNA, 22 bp, Homo sapiens
atttattgagacttaacaaccc

SEQ ID NO: 7188866 - DNA, 22 bp, Homo sapiens
atttcagaatgtcctaatttag

SEQ ID NO: 7188867 - DNA, 22 bp, Homo sapiens
atttcagactgtgttggaaaat

SEQ ID NO: 7188868 - DNA, 22 bp, Homo sapiens
atttcagagaatgaacctaatc

SEQ ID NO: 7188869 - DNA, 22 bp, Homo sapiens
atttcagagaatgaacctaatc

SEQ ID NO: 7188870 - DNA, 21 bp, Homo sapiens
atttcagagcacacaagtaaa

SEQ ID NO: 7188871 - DNA, 21 bp, Homo sapiens
atttcagagcacacaagtaaa

SEQ ID NO: 7188872 - DNA, 21 bp, Homo sapiens
atttcagagcacacaagtaaa

SEQ ID NO: 7188873 - DNA, 22 bp, Homo sapiens
atttcagagctttgcagctaat

SEQ ID NO: 7188874 - DNA, 22 bp, Homo sapiens
atttcagagtgagagtgctcaa

SEQ ID NO: 7188875 - DNA, 22 bp, Homo sapiens
atttcagatgaccaaatggaaa

SEQ ID NO: 7188876 - DNA, 22 bp, Homo sapiens
atttcagatgaccaaatggaaa

SEQ ID NO: 7188877 - DNA, 22 bp, Homo sapiens
atttcagattcagaaatgtagg

SEQ ID NO: 7188878 - DNA, 22 bp, Homo sapiens
atttcagattcgagaggaagtg

SEQ ID NO: 7188879 - DNA, 22 bp, Homo sapiens
atttcacaaaccatcctgattt

SEQ ID NO: 7188880 - DNA, 22 bp, Homo sapiens
gccaggcctgcaagtgctggtg

SEQ ID NO: 7188881 - DNA, 22 bp, Homo sapiens
gccaggcctgcaagtgctggtg

SEQ ID NO: 7188882 - DNA, 22 bp, Homo sapiens
gccaggcctgcaagtgctggtg

SEQ ID NO: 7188883 - DNA, 22 bp, Homo sapiens
gccaggcctgcaagtgctggtg

SEQ ID NO: 7188884 - DNA, 19 bp, Homo sapiens
gccaggcctggacctgcag

SEQ ID NO: 7188885 - DNA, 19 bp, Homo sapiens
gccaggcctggacctgcag

SEQ ID NO: 7188886 - DNA, 22 bp, Homo sapiens
gccaggccactcccgggtcctg

SEQ ID NO: 7188887 - DNA, 22 bp, Homo sapiens
gccaggccactcccgggtcctg

SEQ ID NO: 7188888 - DNA, 22 bp, Homo sapiens
gccaggccactcccgggtcctg

SEQ ID NO: 7188889 - DNA, 22 bp, Homo sapiens
gccaggccctgggcacttcgtg

SEQ ID NO: 7188890 - DNA, 22 bp, Homo sapiens
gccaggccctgggcacttcgtg

SEQ ID NO: 7188891 - DNA, 22 bp, Homo sapiens
gccaggccctgggcacttcgtg

SEQ ID NO: 7188892 - DNA, 22 bp, Homo sapiens
gccaggccctgggcacttcgtg

SEQ ID NO: 7188893 - DNA, 22 bp, Homo sapiens
gccaggcctgcaagtgctggtg

SEQ ID NO: 7188894 - DNA, 22 bp, Homo sapiens
gccaggcctgcaagtgctggtg

SEQ ID NO: 7188895 - DNA, 22 bp, Homo sapiens
gccaggcctgcaagtgctggtg

SEQ ID NO: 7188896 - DNA, 22 bp, Homo sapiens
gccaggcctgcaagtgctggtg

SEQ ID NO: 7188897 - DNA, 22 bp, Homo sapiens
atttctcaaaggaatagagtga

SEQ ID NO: 7188898 - DNA, 22 bp, Homo sapiens
atttctataggaggacagtatt

SEQ ID NO: 7188899 - DNA, 22 bp, Homo sapiens
atttctataggaggacagtatt

SEQ ID NO: 7188900 - DNA, 22 bp, Homo sapiens
atttctagacttagaactctta

SEQ ID NO: 7188901 - DNA, 22 bp, Homo sapiens
atttctactgtgagaaacatga

SEQ ID NO: 7188902 - DNA, 22 bp, Homo sapiens
atttctactgtgagaaacatga

SEQ ID NO: 7188903 - DNA, 18 bp, Homo sapiens
atttctactactataaag

SEQ ID NO: 7188904 - DNA, 18 bp, Homo sapiens
atttctactactataaag

SEQ ID NO: 7188905 - DNA, 22 bp, Homo sapiens
atttctacattgagttttagca

SEQ ID NO: 7188906 - DNA, 22 bp, Homo sapiens
atttctaaagagggtggtttgg

SEQ ID NO: 7188907 - DNA, 22 bp, Homo sapiens
atttctaaagagggtggtttgg

SEQ ID NO: 7188908 - DNA, 22 bp, Homo sapiens
atttcctagggtagatgtcaca

SEQ ID NO: 7188909 - DNA, 22 bp, Homo sapiens
atttcctagcctctcttgcagt

SEQ ID NO: 7188910 - DNA, 22 bp, Homo sapiens
atttcctagcctctcttgcagt

SEQ ID NO: 7188911 - DNA, 22 bp, Homo sapiens
atttcatgtgaagaagagataa

SEQ ID NO: 7188912 - DNA, 22 bp, Homo sapiens
atttcatgtgaagaagagataa

SEQ ID NO: 7188913 - DNA, 22 bp, Homo sapiens
atttccttgcaagtttctgtaa

SEQ ID NO: 7188914 - DNA, 22 bp, Homo sapiens
atttcagcagcccatgtttgga

SEQ ID NO: 7188915 - DNA, 22 bp, Homo sapiens
atttcagcagcccatgtttgga

SEQ ID NO: 7188916 - DNA, 22 bp, Homo sapiens
atttcagggagtcatttacaca

SEQ ID NO: 7188917 - DNA, 22 bp, Homo sapiens
atttcagggatgtctgtaaatt

SEQ ID NO: 7188918 - DNA, 22 bp, Homo sapiens
atttcagggtgtcttccaactg

SEQ ID NO: 7188919 - DNA, 22 bp, Homo sapiens
atttcagtagaaaatcttgatt

SEQ ID NO: 7188920 - DNA, 22 bp, Homo sapiens
atttcagtgttggttagcaagc

SEQ ID NO: 7188921 - DNA, 22 bp, Homo sapiens
atttcatgagttattatagtgg

SEQ ID NO: 7188922 - DNA, 22 bp, Homo sapiens
atttcatctctggaacataact

SEQ ID NO: 7188923 - DNA, 21 bp, Homo sapiens
atttcatggtgcttttaagaa

SEQ ID NO: 7188924 - DNA, 22 bp, Homo sapiens
atttcatgagttattatagtgg

SEQ ID NO: 7188925 - DNA, 22 bp, Homo sapiens
atttcatatgtatcacctagcc

SEQ ID NO: 7188926 - DNA, 22 bp, Homo sapiens
atttcatatgtatcacctagcc

SEQ ID NO: 7188927 - DNA, 22 bp, Homo sapiens
atttcatatgtatcacctagcc

SEQ ID NO: 7188928 - DNA, 22 bp, Homo sapiens
atttcatatgtatcacctagcc

SEQ ID NO: 7188929 - DNA, 22 bp, Homo sapiens
atttcatccagagtcctattag

SEQ ID NO: 7188930 - DNA, 22 bp, Homo sapiens
atttcatccattaagagtactc

SEQ ID NO: 7188931 - DNA, 22 bp, Homo sapiens
atttcatactaaggctcaaaaa

SEQ ID NO: 7188932 - DNA, 22 bp, Homo sapiens
atttcatactaaggctcaaaaa

SEQ ID NO: 7188933 - DNA, 22 bp, Homo sapiens
atttcatagattgtaaatccct

SEQ ID NO: 7188934 - DNA, 22 bp, Homo sapiens
gccaggaggggagagtgtgtca

SEQ ID NO: 7188935 - DNA, 22 bp, Homo sapiens
gccagctggctgcaggtcccag

SEQ ID NO: 7188936 - DNA, 22 bp, Homo sapiens
gccaggaggcttaactggacag

SEQ ID NO: 7188937 - DNA, 22 bp, Homo sapiens
gccaggaggcttaactggacag

SEQ ID NO: 7188938 - DNA, 22 bp, Homo sapiens
atttacagaagcatgtaatagc

SEQ ID NO: 7188939 - DNA, 22 bp, Homo sapiens
atttacagaagcatgtaatagc

SEQ ID NO: 7188940 - DNA, 22 bp, Homo sapiens
atttacagaagcatgtaatagc

SEQ ID NO: 7188941 - DNA, 22 bp, Homo sapiens
atttacagaagcatgtaatagc

SEQ ID NO: 7188942 - DNA, 22 bp, Homo sapiens
atttacacattcataagatttc

SEQ ID NO: 7188943 - DNA, 22 bp, Homo sapiens
atttacacattcataagatttc

SEQ ID NO: 7188944 - DNA, 22 bp, Homo sapiens
atttacacattcataagatttc

SEQ ID NO: 7188945 - DNA, 22 bp, Homo sapiens
atttacacattcataagatttc

SEQ ID NO: 7188946 - DNA, 22 bp, Homo sapiens
atttacactggttctcagagct

SEQ ID NO: 7188947 - DNA, 22 bp, Homo sapiens
atttacaccttcttcgattctc

SEQ ID NO: 7188948 - DNA, 22 bp, Homo sapiens
atttacactaaaggaaggagga

SEQ ID NO: 7188949 - DNA, 22 bp, Homo sapiens
atttacacttggtttactagag

SEQ ID NO: 7188950 - DNA, 22 bp, Homo sapiens
atttacagaaacttaatcatag

SEQ ID NO: 7188951 - DNA, 22 bp, Homo sapiens
atttacagaaacttaatcatag

SEQ ID NO: 7188952 - DNA, 22 bp, Homo sapiens
atttacagaaacttaatcatag

SEQ ID NO: 7188953 - DNA, 22 bp, Homo sapiens
atttacagaaacttaatcatag

SEQ ID NO: 7188954 - DNA, 22 bp, Homo sapiens
atttacagaaacttaatcatag

SEQ ID NO: 7188955 - DNA, 22 bp, Homo sapiens
atttacagaaacttaatcatag

SEQ ID NO: 7188956 - DNA, 22 bp, Homo sapiens
atttacagaaacttaatcatag

SEQ ID NO: 7188957 - DNA, 22 bp, Homo sapiens
atttacagaagcatgtaatagc

SEQ ID NO: 7188958 - DNA, 22 bp, Homo sapiens
atttacagaagcatgtaatagc

SEQ ID NO: 7188959 - DNA, 22 bp, Homo sapiens
atttacagaagcatgtaatagc

SEQ ID NO: 7188960 - DNA, 22 bp, Homo sapiens
atttagaagctaatttttcaga

SEQ ID NO: 7188961 - DNA, 22 bp, Homo sapiens
atttagaactttgtttgccaat

SEQ ID NO: 7188962 - DNA, 22 bp, Homo sapiens
atttagaaccccttccaacctg

SEQ ID NO: 7188963 - DNA, 22 bp, Homo sapiens
atttagaactttgtttgccaat

SEQ ID NO: 7188964 - DNA, 22 bp, Homo sapiens
atttagaaccccttccaacctg

SEQ ID NO: 7188965 - DNA, 22 bp, Homo sapiens
atttagaaattccaaaagtatt

SEQ ID NO: 7188966 - DNA, 22 bp, Homo sapiens
atttagaaattccaaaagtatt

SEQ ID NO: 7188967 - DNA, 22 bp, Homo sapiens
atttactgagcagctaccatgt

SEQ ID NO: 7188968 - DNA, 22 bp, Homo sapiens
atttactgaggtaaataaactg

SEQ ID NO: 7188969 - DNA, 22 bp, Homo sapiens
atttactgaggtaaataaactg

SEQ ID NO: 7188970 - DNA, 19 bp, Homo sapiens
atttactgcctaaaatctc

SEQ ID NO: 7188971 - DNA, 22 bp, Homo sapiens
atttactggaaaaactatgagc

SEQ ID NO: 7188972 - DNA, 22 bp, Homo sapiens
atttactttgctgagatccatc

SEQ ID NO: 7188973 - DNA, 22 bp, Homo sapiens
atttagaaattccaaaagtatt

SEQ ID NO: 7188974 - DNA, 22 bp, Homo sapiens
atttagaaattccaaaagtatt

SEQ ID NO: 7188975 - DNA, 22 bp, Homo sapiens
atttagaaattccaaaagtatt

SEQ ID NO: 7188976 - DNA, 22 bp, Homo sapiens
atttagaaattccaaaagtatt

SEQ ID NO: 7188977 - DNA, 22 bp, Homo sapiens
atttagaaattccaaaagtatt

SEQ ID NO: 7188978 - DNA, 22 bp, Homo sapiens
gccaggaggggagagtgtgtca

SEQ ID NO: 7188979 - DNA, 21 bp, Homo sapiens
gccaggagtagattacattta

SEQ ID NO: 7188980 - DNA, 17 bp, Homo sapiens
gccaggaggtttgagct

SEQ ID NO: 7188981 - DNA, 22 bp, Homo sapiens
gccaggaggtcagcccctcaac

SEQ ID NO: 7188982 - DNA, 20 bp, Homo sapiens
gccaggagggtgtgatgagc

SEQ ID NO: 7188983 - DNA, 22 bp, Homo sapiens
gccaggagtgtcccactcattt

SEQ ID NO: 7188984 - DNA, 22 bp, Homo sapiens
gccaggagtgtgtggctatgtt

SEQ ID NO: 7188985 - DNA, 22 bp, Homo sapiens
gccaggagtgtgtggctatgtt

SEQ ID NO: 7188986 - DNA, 22 bp, Homo sapiens
gccaggagtgtgtggctatgtt

SEQ ID NO: 7188987 - DNA, 22 bp, Homo sapiens
gccaggagtgtgtggctatgtt

SEQ ID NO: 7188988 - DNA, 22 bp, Homo sapiens
gccaggagtgtgtggctatgtt

SEQ ID NO: 7188989 - DNA, 22 bp, Homo sapiens
atttactcgtgtctccagtgct

SEQ ID NO: 7188990 - DNA, 22 bp, Homo sapiens
atttaattttctcaacagtgct

SEQ ID NO: 7188991 - DNA, 22 bp, Homo sapiens
atttaattttctcaacagtgct

SEQ ID NO: 7188992 - DNA, 22 bp, Homo sapiens
atttaattttctcaacagtgct

SEQ ID NO: 7188993 - DNA, 22 bp, Homo sapiens
atttaattttctcaacagtgct

SEQ ID NO: 7188994 - DNA, 22 bp, Homo sapiens
atttaattttctcaacagtgct

SEQ ID NO: 7188995 - DNA, 22 bp, Homo sapiens
atttaattttctcaacagtgct

SEQ ID NO: 7188996 - DNA, 21 bp, Homo sapiens
atttacaaaacagtcccttcc

SEQ ID NO: 7188997 - DNA, 22 bp, Homo sapiens
atttaattttctcaacagtgct

SEQ ID NO: 7188998 - DNA, 22 bp, Homo sapiens
atttaattttctcaacagtgct

SEQ ID NO: 7188999 - DNA, 21 bp, Homo sapiens
atttacaaaacagtcccttcc

SEQ ID NO: 7189000 - DNA, 22 bp, Homo sapiens
atttaatttgtgtctttagctg

SEQ ID NO: 7189001 - DNA, 22 bp, Homo sapiens
atttaatttggagagagaaacc

SEQ ID NO: 7189002 - DNA, 22 bp, Homo sapiens
atttaatttggagagagaaacc

SEQ ID NO: 7189003 - DNA, 22 bp, Homo sapiens
atttaatttatagatgtggata

SEQ ID NO: 7189004 - DNA, 22 bp, Homo sapiens
atttaatttatagatgtggata

SEQ ID NO: 7189005 - DNA, 22 bp, Homo sapiens
atttaatttggagagagaaacc

SEQ ID NO: 7189006 - DNA, 22 bp, Homo sapiens
atttaattaatcatggtgaatt

SEQ ID NO: 7189007 - DNA, 22 bp, Homo sapiens
atttaatttacatttgacagag

SEQ ID NO: 7189008 - DNA, 22 bp, Homo sapiens
atttaattgttcttctggctat

SEQ ID NO: 7189009 - DNA, 22 bp, Homo sapiens
atttaatttacatttgacagag

SEQ ID NO: 7189010 - DNA, 22 bp, Homo sapiens
atttaatttacatttgacagag

SEQ ID NO: 7189011 - DNA, 22 bp, Homo sapiens
atttaaattttctgatggagag

SEQ ID NO: 7189012 - DNA, 22 bp, Homo sapiens
atttaatgtcgagctattgtag

SEQ ID NO: 7189013 - DNA, 22 bp, Homo sapiens
atttaatgggtagacattgtta

SEQ ID NO: 7189014 - DNA, 22 bp, Homo sapiens
attggagaacagacttaaaaat

SEQ ID NO: 7189015 - DNA, 22 bp, Homo sapiens
attggagacagatgggctccag

SEQ ID NO: 7189016 - DNA, 19 bp, Homo sapiens
attggagcagaaaggtggt

SEQ ID NO: 7189017 - DNA, 22 bp, Homo sapiens
attggagccccagaagcaaggt

SEQ ID NO: 7189018 - DNA, 22 bp, Homo sapiens
attggagaagaacatgaattag

SEQ ID NO: 7189019 - DNA, 22 bp, Homo sapiens
attggagaaatggggctttagg

SEQ ID NO: 7189020 - DNA, 22 bp, Homo sapiens
attggactgcagcacaaaagcc

SEQ ID NO: 7189021 - DNA, 22 bp, Homo sapiens
attggacttagaaataaagtta

SEQ ID NO: 7189022 - DNA, 22 bp, Homo sapiens
attggaaatactgagagataaa

SEQ ID NO: 7189023 - DNA, 22 bp, Homo sapiens
attggaaataggccttgtacag

SEQ ID NO: 7189024 - DNA, 22 bp, Homo sapiens
attggaaataggccttgtacag

SEQ ID NO: 7189025 - DNA, 22 bp, Homo sapiens
attggaaatgctacaagttaga

SEQ ID NO: 7189026 - DNA, 22 bp, Homo sapiens
attggaaatacagtagaaaaat

SEQ ID NO: 7189027 - DNA, 22 bp, Homo sapiens
attggaaatacagtagaaaaat

SEQ ID NO: 7189028 - DNA, 22 bp, Homo sapiens
attggaaagttcttaagggata

SEQ ID NO: 7189029 - DNA, 21 bp, Homo sapiens
attggaaaaggtagttggctt

SEQ ID NO: 7189030 - DNA, 21 bp, Homo sapiens
attggaaaaggtagttggctt

SEQ ID NO: 7189031 - DNA, 22 bp, Homo sapiens
attggaaaatatggtttctgga

SEQ ID NO: 7189032 - DNA, 22 bp, Homo sapiens
attggaaaatatggtttctgga

SEQ ID NO: 7189033 - DNA, 22 bp, Homo sapiens
attggaaagtgtctagtgtggt

SEQ ID NO: 7189034 - DNA, 22 bp, Homo sapiens
attggaaagtgtctagtgtggt

SEQ ID NO: 7189035 - DNA, 22 bp, Homo sapiens
attgcttttccttaacacatgc

SEQ ID NO: 7189036 - DNA, 22 bp, Homo sapiens
attgcttatctatctttaagtc

SEQ ID NO: 7189037 - DNA, 22 bp, Homo sapiens
attgcttcaactgttcaatggg

SEQ ID NO: 7189038 - DNA, 22 bp, Homo sapiens
attgctttagaaagaaaaatat

SEQ ID NO: 7189039 - DNA, 22 bp, Homo sapiens
gcgagcctctggagtcctctgg

SEQ ID NO: 7189040 - DNA, 19 bp, Homo sapiens
gcgaggaagtcactgtggt

SEQ ID NO: 7189041 - DNA, 19 bp, Homo sapiens
gcgaggaagtcactgtggc

SEQ ID NO: 7189042 - DNA, 22 bp, Homo sapiens
caaaactatcaggctcaaagct

SEQ ID NO: 7189043 - DNA, 22 bp, Homo sapiens
caaaactatcaggctcaaagct

SEQ ID NO: 7189044 - DNA, 21 bp, Homo sapiens
caaaacttaggtgacttagga

SEQ ID NO: 7189045 - DNA, 21 bp, Homo sapiens
caaaacttaggtgacttagga

SEQ ID NO: 7189046 - DNA, 22 bp, Homo sapiens
caaaagaagctcttggggctag

SEQ ID NO: 7189047 - DNA, 22 bp, Homo sapiens
caaaagaagctcttggggctag

SEQ ID NO: 7189048 - DNA, 22 bp, Homo sapiens
caaaagaagctcttggggctag

SEQ ID NO: 7189049 - DNA, 22 bp, Homo sapiens
caaaacattctctgcagcaggg

SEQ ID NO: 7189050 - DNA, 22 bp, Homo sapiens
caaaacattctctgcagcaggg

SEQ ID NO: 7189051 - DNA, 22 bp, Homo sapiens
caaaacattctctgcagcaggg

SEQ ID NO: 7189052 - DNA, 22 bp, Homo sapiens
caaaacattctctgcagcaggg

SEQ ID NO: 7189053 - DNA, 22 bp, Homo sapiens
caaaaccaagaacattcatttc

SEQ ID NO: 7189054 - DNA, 22 bp, Homo sapiens
caaaaccaagaacattcatttc

SEQ ID NO: 7189055 - DNA, 22 bp, Homo sapiens
caaaactatcaggctcaaagct

SEQ ID NO: 7189056 - DNA, 22 bp, Homo sapiens
caaaactgtctagagagagaag

SEQ ID NO: 7189057 - DNA, 22 bp, Homo sapiens
attttttagaacctggcctgat

SEQ ID NO: 7189058 - DNA, 22 bp, Homo sapiens
gcctgtgctgttccctctgcca

SEQ ID NO: 7189059 - DNA, 22 bp, Homo sapiens
gcctgtgctgttccctctgcca

SEQ ID NO: 7189060 - DNA, 22 bp, Homo sapiens
gcctgtgctgttccctctgcca

SEQ ID NO: 7189061 - DNA, 22 bp, Homo sapiens
caaaaaacacctgtgtgagtat

SEQ ID NO: 7189062 - DNA, 22 bp, Homo sapiens
caaaaaacacctgtgtgagtat

SEQ ID NO: 7189063 - DNA, 22 bp, Homo sapiens
caaaaagcttaggtaacaagcc

SEQ ID NO: 7189064 - DNA, 22 bp, Homo sapiens
caaaaactgcaattacttttac

SEQ ID NO: 7189065 - DNA, 22 bp, Homo sapiens
caaaaagcttaggtaacaagcc

SEQ ID NO: 7189066 - DNA, 22 bp, Homo sapiens
caaaaagcttaggtaacaagcc

SEQ ID NO: 7189067 - DNA, 22 bp, Homo sapiens
caaaacattcagagagctcact

SEQ ID NO: 7189068 - DNA, 22 bp, Homo sapiens
caaaacattcagagagctcact

SEQ ID NO: 7189069 - DNA, 22 bp, Homo sapiens
gcctgggagtgcacagtgaggt

SEQ ID NO: 7189070 - DNA, 23 bp, Homo sapiens
gcctgggagttgcgatctgcccg

SEQ ID NO: 7189071 - DNA, 22 bp, Homo sapiens
gcctgggatagaggcaatgcat

SEQ ID NO: 7189072 - DNA, 22 bp, Homo sapiens
gcctgggatagaggcaatgcat

SEQ ID NO: 7189073 - DNA, 22 bp, Homo sapiens
gcctgtccactaaacagccaag

SEQ ID NO: 7189074 - DNA, 22 bp, Homo sapiens
gcctgggagtgcacagtgaggt

SEQ ID NO: 7189075 - DNA, 22 bp, Homo sapiens
gcctgggagtgcacagtgaggt

SEQ ID NO: 7189076 - DNA, 22 bp, Homo sapiens
gcctgggagtgcacagtgaggt

SEQ ID NO: 7189077 - DNA, 16 bp, Homo sapiens
gcctgggagggaacag

SEQ ID NO: 7189078 - DNA, 22 bp, Homo sapiens
gcctgggagggcagcagtgtgg

SEQ ID NO: 7189079 - DNA, 22 bp, Homo sapiens
gcctgggagggcagcagtgtgg

SEQ ID NO: 7189080 - DNA, 22 bp, Homo sapiens
gcctgggagggcagcagtgtgg

SEQ ID NO: 7189081 - DNA, 22 bp, Homo sapiens
gcctgggagggcagcagtgtgg

SEQ ID NO: 7189082 - DNA, 22 bp, Homo sapiens
gcctgtctgcagggctgtcatt

SEQ ID NO: 7189083 - DNA, 22 bp, Homo sapiens
gcctgtctgcgtcacgcttatt

SEQ ID NO: 7189084 - DNA, 22 bp, Homo sapiens
gcctgtgacccctccatctgct

SEQ ID NO: 7189085 - DNA, 22 bp, Homo sapiens
gcctgtgactcgtcttgggcca

SEQ ID NO: 7189086 - DNA, 22 bp, Homo sapiens
gcctgtgatgcccccataagta

SEQ ID NO: 7189087 - DNA, 22 bp, Homo sapiens
gcctgtgcatagcagcggactc

SEQ ID NO: 7189088 - DNA, 23 bp, Homo sapiens
gcctgtgcctatgcccagctctg

SEQ ID NO: 7189089 - DNA, 23 bp, Homo sapiens
gcctgtgcctatgcccagctctg

SEQ ID NO: 7189090 - DNA, 22 bp, Homo sapiens
gcctgtgcctcaattttctact

SEQ ID NO: 7189091 - DNA, 22 bp, Homo sapiens
gcctgtgcctcagcctgcagcc

SEQ ID NO: 7189092 - DNA, 22 bp, Homo sapiens
gcctgtgcctcagcctgcagcc

SEQ ID NO: 7189093 - DNA, 22 bp, Homo sapiens
caaactatttacaatggaatca

SEQ ID NO: 7189094 - DNA, 22 bp, Homo sapiens
caaactctgtaggacagttcaa

SEQ ID NO: 7189095 - DNA, 22 bp, Homo sapiens
caaactgaacacgaaagtcttt

SEQ ID NO: 7189096 - DNA, 22 bp, Homo sapiens
caaactgaacacgaaagtcttt

SEQ ID NO: 7189097 - DNA, 22 bp, Homo sapiens
caaactgagcatcagaaagttt

SEQ ID NO: 7189098 - DNA, 22 bp, Homo sapiens
caaactgagcatcagaaagttt

SEQ ID NO: 7189099 - DNA, 22 bp, Homo sapiens
caaactgagcatcagaaagttt

SEQ ID NO: 7189100 - DNA, 22 bp, Homo sapiens
caaactggctatgggaatcttg

SEQ ID NO: 7189101 - DNA, 22 bp, Homo sapiens
caaaccttgttccagtcaactc

SEQ ID NO: 7189102 - DNA, 22 bp, Homo sapiens
caaaccttgcagaactgggcag

SEQ ID NO: 7189103 - DNA, 22 bp, Homo sapiens
caaaccttgtaaatgccaaact

SEQ ID NO: 7189104 - DNA, 23 bp, Homo sapiens
caaacctgttctccccacatgca

SEQ ID NO: 7189105 - DNA, 22 bp, Homo sapiens
caaacattgcactttctgctat

SEQ ID NO: 7189106 - DNA, 22 bp, Homo sapiens
caaaccattaagcatgttgagt

SEQ ID NO: 7189107 - DNA, 22 bp, Homo sapiens
caaaccattaagcatgttgagt

SEQ ID NO: 7189108 - DNA, 22 bp, Homo sapiens
gcgcagagtagcagagtgctga

SEQ ID NO: 7189109 - DNA, 22 bp, Homo sapiens
gcgcagctcagtgagggaactt

SEQ ID NO: 7189110 - DNA, 22 bp, Homo sapiens
gcgcacatgttcagatgtgtga

SEQ ID NO: 7189111 - DNA, 22 bp, Homo sapiens
gcgcaccacctccaggtggccg

SEQ ID NO: 7189112 - DNA, 22 bp, Homo sapiens
gcgcaccacctccaggtggccg

SEQ ID NO: 7189113 - DNA, 22 bp, Homo sapiens
gcgcacacgcgtgtgactcatc

SEQ ID NO: 7189114 - DNA, 22 bp, Homo sapiens
gcgcactgggcgcacgcgtagg

SEQ ID NO: 7189115 - DNA, 22 bp, Homo sapiens
gcgagggcacgcggttgaaggc

SEQ ID NO: 7189116 - DNA, 22 bp, Homo sapiens
gcgagggcacgcggttgaaggc

SEQ ID NO: 7189117 - DNA, 22 bp, Homo sapiens
gcgagggcacgcggttgaaggc

SEQ ID NO: 7189118 - DNA, 22 bp, Homo sapiens
gcgagggcacgcggttgaaggc

SEQ ID NO: 7189119 - DNA, 22 bp, Homo sapiens
gcgaggaggggtgctgggcccc

SEQ ID NO: 7189120 - DNA, 22 bp, Homo sapiens
gcgaggaggggtgctgggcccc

SEQ ID NO: 7189121 - DNA, 22 bp, Homo sapiens
gcgagggcacgcggttgaaggc

SEQ ID NO: 7189122 - DNA, 22 bp, Homo sapiens
gctcaggaccgaggggtgggaa

SEQ ID NO: 7189123 - DNA, 22 bp, Homo sapiens
gctcaggactggaggagcgggg

SEQ ID NO: 7189124 - DNA, 22 bp, Homo sapiens
gctcaggaaggctcaaccagga

SEQ ID NO: 7189125 - DNA, 22 bp, Homo sapiens
caaacttttgaggagttcagga

SEQ ID NO: 7189126 - DNA, 22 bp, Homo sapiens
gctcaggaaaacagtctagtaa

SEQ ID NO: 7189127 - DNA, 22 bp, Homo sapiens
caaactttcagttataacatga

SEQ ID NO: 7189128 - DNA, 22 bp, Homo sapiens
caaactttcagttataacatga

SEQ ID NO: 7189129 - DNA, 22 bp, Homo sapiens
caaacttttcctggaaaagatt

SEQ ID NO: 7189130 - DNA, 22 bp, Homo sapiens
gctcaggatttcatccatgtgt

SEQ ID NO: 7189131 - DNA, 22 bp, Homo sapiens
gctcaggcaaatttctggtgaa

SEQ ID NO: 7189132 - DNA, 22 bp, Homo sapiens
gctcaggatcagccacctcttt

SEQ ID NO: 7189133 - DNA, 22 bp, Homo sapiens
gctcaggatcagccacctcttt

SEQ ID NO: 7189134 - DNA, 22 bp, Homo sapiens
gctcaggatcagccacctcttt

SEQ ID NO: 7189135 - DNA, 22 bp, Homo sapiens
gctcaggagctgacagcctcaa

SEQ ID NO: 7189136 - DNA, 22 bp, Homo sapiens
gctcaggagctgacagcctcaa

SEQ ID NO: 7189137 - DNA, 22 bp, Homo sapiens
gctcaggagctcttggtggcgc

SEQ ID NO: 7189138 - DNA, 22 bp, Homo sapiens
gctcaggcaaatttctggtgaa

SEQ ID NO: 7189139 - DNA, 22 bp, Homo sapiens
gctcaggcaaatttctggtgaa

SEQ ID NO: 7189140 - DNA, 22 bp, Homo sapiens
gctcaggcaccatatgatgtgt

SEQ ID NO: 7189141 - DNA, 22 bp, Homo sapiens
gctcaggcaggagtgcagtggc

SEQ ID NO: 7189142 - DNA, 22 bp, Homo sapiens
gctcaggcaggagtgcagtggc

SEQ ID NO: 7189143 - DNA, 22 bp, Homo sapiens
gctcaggcaggagtgcagtggc

SEQ ID NO: 7189144 - DNA, 22 bp, Homo sapiens
gctcaggcaggagtgcagtggc

SEQ ID NO: 7189145 - DNA, 22 bp, Homo sapiens
gctcaggcaggagtgcagtggc

SEQ ID NO: 7189146 - DNA, 22 bp, Homo sapiens
gctcaggcaggagtgcagtggc

SEQ ID NO: 7189147 - DNA, 22 bp, Homo sapiens
caaaggcaatcttgttctctgg

SEQ ID NO: 7189148 - DNA, 22 bp, Homo sapiens
caaaggcaggccccctgtgcag

SEQ ID NO: 7189149 - DNA, 22 bp, Homo sapiens
caaaggcaggccccctgtgcag

SEQ ID NO: 7189150 - DNA, 22 bp, Homo sapiens
caaaggtattctcattttggaa

SEQ ID NO: 7189151 - DNA, 22 bp, Homo sapiens
gcctctcctggagaaggcaggg

SEQ ID NO: 7189152 - DNA, 22 bp, Homo sapiens
gcctctcctggagaaggcaggg

SEQ ID NO: 7189153 - DNA, 22 bp, Homo sapiens
gcctctctccttggcttgcagt

SEQ ID NO: 7189154 - DNA, 22 bp, Homo sapiens
gcctctctccttggcttgcagt

SEQ ID NO: 7189155 - DNA, 22 bp, Homo sapiens
gcctctctcgggcttgtagcgg

SEQ ID NO: 7189156 - DNA, 22 bp, Homo sapiens
gcctctcctcttaataccatta

SEQ ID NO: 7189157 - DNA, 22 bp, Homo sapiens
gcctctcctcttaataccatta

SEQ ID NO: 7189158 - DNA, 22 bp, Homo sapiens
gcctctcctcttaataccatta

SEQ ID NO: 7189159 - DNA, 22 bp, Homo sapiens
gcctctccgagccactgcctct

SEQ ID NO: 7189160 - DNA, 22 bp, Homo sapiens
gcctctccgagccactgcctct

SEQ ID NO: 7189161 - DNA, 22 bp, Homo sapiens
gcctctccgagccactgcctct

SEQ ID NO: 7189162 - DNA, 21 bp, Homo sapiens
gcctctccaaatcctgccttc

SEQ ID NO: 7189163 - DNA, 21 bp, Homo sapiens
gcctctccaaatcctgccttc

SEQ ID NO: 7189164 - DNA, 21 bp, Homo sapiens
gcctctccaaatcctgccttc

SEQ ID NO: 7189165 - DNA, 21 bp, Homo sapiens
gcctctccaaatcctgccttc

SEQ ID NO: 7189166 - DNA, 22 bp, Homo sapiens
gcctctccgagccactgcctct

SEQ ID NO: 7189167 - DNA, 22 bp, Homo sapiens
gcctctccgagccactgcctct

SEQ ID NO: 7189168 - DNA, 22 bp, Homo sapiens
gcctctccgagccactgcctct

SEQ ID NO: 7189169 - DNA, 22 bp, Homo sapiens
gcctccccaggggtgtcatgag

SEQ ID NO: 7189170 - DNA, 21 bp, Homo sapiens
gcctctccaaatcctgccttc

SEQ ID NO: 7189171 - DNA, 21 bp, Homo sapiens
gcctctccaaatcctgccttc

SEQ ID NO: 7189172 - DNA, 22 bp, Homo sapiens
gcctccccaaagtgctgacagc

SEQ ID NO: 7189173 - DNA, 22 bp, Homo sapiens
gcctccccaaagtgctgacagc

SEQ ID NO: 7189174 - DNA, 22 bp, Homo sapiens
gcctccccaaagtgctgacagc

SEQ ID NO: 7189175 - DNA, 22 bp, Homo sapiens
gcctccccaaagtgctgacagc

SEQ ID NO: 7189176 - DNA, 22 bp, Homo sapiens
gcctccccaagcagcagggatt

SEQ ID NO: 7189177 - DNA, 22 bp, Homo sapiens
gcctccccaagcagcagggatt

SEQ ID NO: 7189178 - DNA, 22 bp, Homo sapiens
gcctccccaagcagcagggatt

SEQ ID NO: 7189179 - DNA, 22 bp, Homo sapiens
gcctccagtttttttctgaact

SEQ ID NO: 7189180 - DNA, 22 bp, Homo sapiens
gcctccagggtagaggaggaag

SEQ ID NO: 7189181 - DNA, 22 bp, Homo sapiens
gcctccagggatgattccttcc

SEQ ID NO: 7189182 - DNA, 22 bp, Homo sapiens
gcctccagctggggcatttcag

SEQ ID NO: 7189183 - DNA, 22 bp, Homo sapiens
gcctccagggtagaggaggaag

SEQ ID NO: 7189184 - DNA, 22 bp, Homo sapiens
gcctccagcccacgcaggcctg

SEQ ID NO: 7189185 - DNA, 22 bp, Homo sapiens
gcctccagcccacgcaggcctg

SEQ ID NO: 7189186 - DNA, 21 bp, Homo sapiens
gcctccagccagatggcctcc

SEQ ID NO: 7189187 - DNA, 21 bp, Homo sapiens
gcctccagccagatggcctcc

SEQ ID NO: 7189188 - DNA, 21 bp, Homo sapiens
gcctccagccagatggcctcc

SEQ ID NO: 7189189 - DNA, 22 bp, Homo sapiens
gcctccagcccacgcaggcctg

SEQ ID NO: 7189190 - DNA, 21 bp, Homo sapiens
gcctcaccatgtcaagccagg

SEQ ID NO: 7189191 - DNA, 21 bp, Homo sapiens
gcctcaccatgtcaagccagg

SEQ ID NO: 7189192 - DNA, 22 bp, Homo sapiens
gcctcactgcagccccaggaag

SEQ ID NO: 7189193 - DNA, 22 bp, Homo sapiens
gcctcactgcagccccaggaag

SEQ ID NO: 7189194 - DNA, 22 bp, Homo sapiens
gcctcagaaagcttttattcat

SEQ ID NO: 7189195 - DNA, 22 bp, Homo sapiens
gcctccacttttgctggcttct

SEQ ID NO: 7189196 - DNA, 21 bp, Homo sapiens
gcctccagccagatggcctcc

SEQ ID NO: 7189197 - DNA, 22 bp, Homo sapiens
atttctcagtgtacattatgtt

SEQ ID NO: 7189198 - DNA, 22 bp, Homo sapiens
atttctcagtgaaatgacaggc

SEQ ID NO: 7189199 - DNA, 22 bp, Homo sapiens
atttctcagtgaaatgacaggc

SEQ ID NO: 7189200 - DNA, 22 bp, Homo sapiens
atttctcagtgaaatgacaggc

SEQ ID NO: 7189201 - DNA, 22 bp, Homo sapiens
atttctcagggctgaggaggag

SEQ ID NO: 7189202 - DNA, 22 bp, Homo sapiens
atttctcagggtccaggtccca

SEQ ID NO: 7189203 - DNA, 22 bp, Homo sapiens
atttctcaggactccatgggcg

SEQ ID NO: 7189204 - DNA, 22 bp, Homo sapiens
atttctcagtaatctcagcaat

SEQ ID NO: 7189205 - DNA, 22 bp, Homo sapiens
atttctcagtaatctcagcaat

SEQ ID NO: 7189206 - DNA, 22 bp, Homo sapiens
atttctcagtaatctcagcaat

SEQ ID NO: 7189207 - DNA, 22 bp, Homo sapiens
atttctcagtaggtgcacagtg

SEQ ID NO: 7189208 - DNA, 22 bp, Homo sapiens
atttctcagtaggtgcacagtg

SEQ ID NO: 7189209 - DNA, 22 bp, Homo sapiens
atttctcactgagcagataaaa

SEQ ID NO: 7189210 - DNA, 22 bp, Homo sapiens
atttctcagaccagagaggtgt

SEQ ID NO: 7189211 - DNA, 22 bp, Homo sapiens
atttctcagcacttcctatctc

SEQ ID NO: 7189212 - DNA, 22 bp, Homo sapiens
atttctcagcacttcctatctc

SEQ ID NO: 7189213 - DNA, 22 bp, Homo sapiens
atttctcaccctacctcactcc

SEQ ID NO: 7189214 - DNA, 22 bp, Homo sapiens
atttctcaccctacctcactcc

SEQ ID NO: 7189215 - DNA, 22 bp, Homo sapiens
atttctcacagtggaatctctg

SEQ ID NO: 7189216 - DNA, 22 bp, Homo sapiens
atttctcactcacagtccatgt

SEQ ID NO: 7189217 - DNA, 22 bp, Homo sapiens
atttctcactgagcagataaaa

SEQ ID NO: 7189218 - DNA, 22 bp, Homo sapiens
atttctcaaccaggtcaaaaag

SEQ ID NO: 7189219 - DNA, 22 bp, Homo sapiens
atttctcaaccaggtcaaaaag

SEQ ID NO: 7189220 - DNA, 22 bp, Homo sapiens
atttctcaaccaggtcaaaaag

SEQ ID NO: 7189221 - DNA, 22 bp, Homo sapiens
atttctcaagtaaatgagtcat

SEQ ID NO: 7189222 - DNA, 22 bp, Homo sapiens
atttctcaagtaaatgagtcat

SEQ ID NO: 7189223 - DNA, 22 bp, Homo sapiens
atttctcacaaagttgcttatc

SEQ ID NO: 7189224 - DNA, 22 bp, Homo sapiens
gcctgctggaggagcctcaggg

SEQ ID NO: 7189225 - DNA, 22 bp, Homo sapiens
gcctgctggaggagcctcaggg

SEQ ID NO: 7189226 - DNA, 22 bp, Homo sapiens
gcctgctggatgtggccaggcc

SEQ ID NO: 7189227 - DNA, 22 bp, Homo sapiens
gcctgctggatgtggccaggcc

SEQ ID NO: 7189228 - DNA, 22 bp, Homo sapiens
gcctgctggctgtccattgcag

SEQ ID NO: 7189229 - DNA, 22 bp, Homo sapiens
gcctgctggctgtccattgcag

SEQ ID NO: 7189230 - DNA, 22 bp, Homo sapiens
gcctgctggctgtccattgcag

SEQ ID NO: 7189231 - DNA, 22 bp, Homo sapiens
gcctgctggctgtccattgcag

SEQ ID NO: 7189232 - DNA, 22 bp, Homo sapiens
gcctgctggctgtccattgcag

SEQ ID NO: 7189233 - DNA, 22 bp, Homo sapiens
gcctgctgccaccctggctccg

SEQ ID NO: 7189234 - DNA, 22 bp, Homo sapiens
gcctgctggaggagcctcaggg

SEQ ID NO: 7189235 - DNA, 22 bp, Homo sapiens
gcctgctctggaatccatgtaa

SEQ ID NO: 7189236 - DNA, 22 bp, Homo sapiens
gcctgctgaacctcatgcagtc

SEQ ID NO: 7189237 - DNA, 22 bp, Homo sapiens
gcctgctgaacctcatgcagtc

SEQ ID NO: 7189238 - DNA, 22 bp, Homo sapiens
gcctgctctggaatccatgtaa

SEQ ID NO: 7189239 - DNA, 22 bp, Homo sapiens
gcctgctgaacctcatgcagtc

SEQ ID NO: 7189240 - DNA, 22 bp, Homo sapiens
gcctgctgaacctcatgcagtc

SEQ ID NO: 7189241 - DNA, 22 bp, Homo sapiens
gcctgctgaacctcatgcagtc

SEQ ID NO: 7189242 - DNA, 22 bp, Homo sapiens
gcctgctgaacctcatgcagtc

SEQ ID NO: 7189243 - DNA, 22 bp, Homo sapiens
gcctgctgaacctcatgcagtc

SEQ ID NO: 7189244 - DNA, 22 bp, Homo sapiens
gcctgctgaagccagagtgtgt

SEQ ID NO: 7189245 - DNA, 18 bp, Homo sapiens
gcctgctctgctctcccc

SEQ ID NO: 7189246 - DNA, 18 bp, Homo sapiens
gcctgcctagagcttgcc

SEQ ID NO: 7189247 - DNA, 18 bp, Homo sapiens
gcctgcctagagcttgcc

SEQ ID NO: 7189248 - DNA, 19 bp, Homo sapiens
gcctctgagggcaggacac

SEQ ID NO: 7189249 - DNA, 22 bp, Homo sapiens
gcctctctgggctgccgaggct

SEQ ID NO: 7189250 - DNA, 22 bp, Homo sapiens
gcctctctctacccagtatgat

SEQ ID NO: 7189251 - DNA, 22 bp, Homo sapiens
gcctggagctcatgtgggcatt

SEQ ID NO: 7189252 - DNA, 22 bp, Homo sapiens
gcctggagctcggctgagggcg

SEQ ID NO: 7189253 - DNA, 22 bp, Homo sapiens
gcctggagctcggctgagggcg

SEQ ID NO: 7189254 - DNA, 22 bp, Homo sapiens
gcctggagctcggctgagggcg

SEQ ID NO: 7189255 - DNA, 22 bp, Homo sapiens
gcctggagctcggctgagggcg

SEQ ID NO: 7189256 - DNA, 22 bp, Homo sapiens
gcctggagctcggctgagggcg

SEQ ID NO: 7189257 - DNA, 22 bp, Homo sapiens
gcctggagctcggctgagggcg

SEQ ID NO: 7189258 - DNA, 22 bp, Homo sapiens
gcctggagctctccacttgggg

SEQ ID NO: 7189259 - DNA, 22 bp, Homo sapiens
gcctggagctctccacttgggg

SEQ ID NO: 7189260 - DNA, 22 bp, Homo sapiens
gcctggagctctccacttgggg

SEQ ID NO: 7189261 - DNA, 22 bp, Homo sapiens
gcctggagctcatgtgggcatt

SEQ ID NO: 7189262 - DNA, 22 bp, Homo sapiens
gcctggagctcatgtgggcatt

SEQ ID NO: 7189263 - DNA, 22 bp, Homo sapiens
gcctggagctactggacactga

SEQ ID NO: 7189264 - DNA, 22 bp, Homo sapiens
gcctggagctcatgtgggcatt

SEQ ID NO: 7189265 - DNA, 22 bp, Homo sapiens
gcctggagctcatgtgggcatt

SEQ ID NO: 7189266 - DNA, 22 bp, Homo sapiens
gcctggagctcatgtgggcatt

SEQ ID NO: 7189267 - DNA, 22 bp, Homo sapiens
gcctgctgggagacacccccag

SEQ ID NO: 7189268 - DNA, 22 bp, Homo sapiens
gcctggagctactggacactga

SEQ ID NO: 7189269 - DNA, 22 bp, Homo sapiens
gcctggagctactggacactga

SEQ ID NO: 7189270 - DNA, 22 bp, Homo sapiens
gcctggagcctcagcaaggagg

SEQ ID NO: 7189271 - DNA, 22 bp, Homo sapiens
gcctggagctactggacactga

SEQ ID NO: 7189272 - DNA, 22 bp, Homo sapiens
gcctggagctactggacactga

SEQ ID NO: 7189273 - DNA, 22 bp, Homo sapiens
gcctggagctactggacactga

SEQ ID NO: 7189274 - DNA, 22 bp, Homo sapiens
gcctggagctactggacactga

SEQ ID NO: 7189275 - DNA, 22 bp, Homo sapiens
gcctgggagcacatcggggtcc

SEQ ID NO: 7189276 - DNA, 22 bp, Homo sapiens
gcctgggagcacatcggggtcc

SEQ ID NO: 7189277 - DNA, 18 bp, Homo sapiens
gcctgggaggaggaaatg

SEQ ID NO: 7189278 - DNA, 22 bp, Homo sapiens
gcctgggagcacatcggggtcc

SEQ ID NO: 7189279 - DNA, 22 bp, Homo sapiens
gcctgggagcacatcggggtcc

SEQ ID NO: 7189280 - DNA, 22 bp, Homo sapiens
gcctgggagcacatcggggtcc

SEQ ID NO: 7189281 - DNA, 22 bp, Homo sapiens
gcctgggagatgcgttgtggcc

SEQ ID NO: 7189282 - DNA, 22 bp, Homo sapiens
gcctgggagatgcgttgtggcc

SEQ ID NO: 7189283 - DNA, 22 bp, Homo sapiens
gcctgggagattaattaggaag

SEQ ID NO: 7189284 - DNA, 22 bp, Homo sapiens
gcctggaggaatgtagctgagg

SEQ ID NO: 7189285 - DNA, 22 bp, Homo sapiens
gcctggaggaatgtagctgagg

SEQ ID NO: 7189286 - DNA, 22 bp, Homo sapiens
gcctggctctgagtttctctcc

SEQ ID NO: 7189287 - DNA, 22 bp, Homo sapiens
gcctggagctctccacttgggg

SEQ ID NO: 7189288 - DNA, 22 bp, Homo sapiens
gcctggagctctccacttgggg

SEQ ID NO: 7189289 - DNA, 22 bp, Homo sapiens
gcctggctgaggcctctgctaa

SEQ ID NO: 7189290 - DNA, 22 bp, Homo sapiens
gcctggctgaggcctctgctaa

SEQ ID NO: 7189291 - DNA, 22 bp, Homo sapiens
gcctggctgaggtggggaggca

SEQ ID NO: 7189292 - DNA, 22 bp, Homo sapiens
gcctggctgaggtggggaggca

SEQ ID NO: 7189293 - DNA, 22 bp, Homo sapiens
gcctgggagagggatagtgcag

SEQ ID NO: 7189294 - DNA, 22 bp, Homo sapiens
attattcaatcatattaaaagt

SEQ ID NO: 7189295 - DNA, 22 bp, Homo sapiens
attattcaacacttgagaaatt

SEQ ID NO: 7189296 - DNA, 22 bp, Homo sapiens
attattcaatgttatttcagtg

SEQ ID NO: 7189297 - DNA, 22 bp, Homo sapiens
attattcaatcatattaaaagt

SEQ ID NO: 7189298 - DNA, 22 bp, Homo sapiens
attagagagagcatattactgg

SEQ ID NO: 7189299 - DNA, 22 bp, Homo sapiens
attagagcagtaattgtggcag

SEQ ID NO: 7189300 - DNA, 20 bp, Homo sapiens
attagagctacatggctaca

SEQ ID NO: 7189301 - DNA, 22 bp, Homo sapiens
attattaaagctacatcaagga

SEQ ID NO: 7189302 - DNA, 20 bp, Homo sapiens
attattcatacatgtgtgac

SEQ ID NO: 7189303 - DNA, 22 bp, Homo sapiens
attattcagtcttgtaaggagt

SEQ ID NO: 7189304 - DNA, 22 bp, Homo sapiens
attattcagtcttgtaaggagt

SEQ ID NO: 7189305 - DNA, 22 bp, Homo sapiens
attattcattggtaggcaagct

SEQ ID NO: 7189306 - DNA, 22 bp, Homo sapiens
attattctctggaggaaagatt

SEQ ID NO: 7189307 - DNA, 22 bp, Homo sapiens
attattcatggtcttccacaat

SEQ ID NO: 7189308 - DNA, 22 bp, Homo sapiens
attattcatggtcttccacaat

SEQ ID NO: 7189309 - DNA, 22 bp, Homo sapiens
attattctttgataaatggcag

SEQ ID NO: 7189310 - DNA, 22 bp, Homo sapiens
attattcttaatgcagggatta

SEQ ID NO: 7189311 - DNA, 22 bp, Homo sapiens
attagacatcatatgattcagc

SEQ ID NO: 7189312 - DNA, 22 bp, Homo sapiens
attagacatcatatgattcagc

SEQ ID NO: 7189313 - DNA, 22 bp, Homo sapiens
attagacatcatatgattcagc

SEQ ID NO: 7189314 - DNA, 22 bp, Homo sapiens
attagaattatgcttgctaatg

SEQ ID NO: 7189315 - DNA, 22 bp, Homo sapiens
attagaattatgcttgctaatg

SEQ ID NO: 7189316 - DNA, 23 bp, Homo sapiens
attagacactttgggttgtcttc

SEQ ID NO: 7189317 - DNA, 22 bp, Homo sapiens
attagaattatgcttgctaatg

SEQ ID NO: 7189318 - DNA, 22 bp, Homo sapiens
attagaatgcagggttcattgt

SEQ ID NO: 7189319 - DNA, 22 bp, Homo sapiens
attagaatgacagaaatgaggc

SEQ ID NO: 7189320 - DNA, 22 bp, Homo sapiens
attagaatgcagggttcattgt

SEQ ID NO: 7189321 - DNA, 22 bp, Homo sapiens
attagaatgcagggttcattgt

SEQ ID NO: 7189322 - DNA, 21 bp, Homo sapiens
attagaaggtatttagggcct

SEQ ID NO: 7189323 - DNA, 22 bp, Homo sapiens
attagaagcgtgaatcctttca

SEQ ID NO: 7189324 - DNA, 21 bp, Homo sapiens
attagaaggtatttagggcct

SEQ ID NO: 7189325 - DNA, 22 bp, Homo sapiens
attagaatgaagtataggattt

SEQ ID NO: 7189326 - DNA, 22 bp, Homo sapiens
attagaatgaagtataggattt

SEQ ID NO: 7189327 - DNA, 22 bp, Homo sapiens
attagaatgaagtataggattt

SEQ ID NO: 7189328 - DNA, 22 bp, Homo sapiens
attagaatgaagtataggattt

SEQ ID NO: 7189329 - DNA, 22 bp, Homo sapiens
attagaagaggctgacgaatgt

SEQ ID NO: 7189330 - DNA, 22 bp, Homo sapiens
attagaagatagtgatttctgc

SEQ ID NO: 7189331 - DNA, 22 bp, Homo sapiens
attagaagatagtgatttctgc

SEQ ID NO: 7189332 - DNA, 22 bp, Homo sapiens
attagaagcgtgaatcctttca

SEQ ID NO: 7189333 - DNA, 23 bp, Homo sapiens
attagaaaggctttctggtgaaa

SEQ ID NO: 7189334 - DNA, 21 bp, Homo sapiens
gcaagtgtttctgacagtggc

SEQ ID NO: 7189335 - DNA, 22 bp, Homo sapiens
gcaagttatttccatttaaagc

SEQ ID NO: 7189336 - DNA, 22 bp, Homo sapiens
gcaagttggagactcatgagaa

SEQ ID NO: 7189337 - DNA, 22 bp, Homo sapiens
gcaagtcctttgcatgcaggga

SEQ ID NO: 7189338 - DNA, 20 bp, Homo sapiens
gcaagtgaaaactatgggtg

SEQ ID NO: 7189339 - DNA, 23 bp, Homo sapiens
gcaagtgaggcgtcagcagtcaa

SEQ ID NO: 7189340 - DNA, 22 bp, Homo sapiens
gcaagtgtctgaggttttgtat

SEQ ID NO: 7189341 - DNA, 21 bp, Homo sapiens
gcaagtgtttctgacagtggc

SEQ ID NO: 7189342 - DNA, 22 bp, Homo sapiens
gcaagggtgtgaaccaatgaga

SEQ ID NO: 7189343 - DNA, 22 bp, Homo sapiens
gcaaggtgttttaacaggaaaa

SEQ ID NO: 7189344 - DNA, 22 bp, Homo sapiens
gcaaggtgttttataggcagga

SEQ ID NO: 7189345 - DNA, 21 bp, Homo sapiens
gcaaggcttttgtgtttccca

SEQ ID NO: 7189346 - DNA, 17 bp, Homo sapiens
gcaagggatgggagatt

SEQ ID NO: 7189347 - DNA, 22 bp, Homo sapiens
gcaaggctgtgcactttgcatt

SEQ ID NO: 7189348 - DNA, 22 bp, Homo sapiens
gcaaggctgtgcactttgcatt

SEQ ID NO: 7189349 - DNA, 22 bp, Homo sapiens
gcaaggctgttgctgctgcaag

SEQ ID NO: 7189350 - DNA, 22 bp, Homo sapiens
gcaaggctgttgctgctgcaag

SEQ ID NO: 7189351 - DNA, 17 bp, Homo sapiens
gcaagggatgggagatt

SEQ ID NO: 7189352 - DNA, 22 bp, Homo sapiens
gcaagggtgtgaaccaatgaga

SEQ ID NO: 7189353 - DNA, 22 bp, Homo sapiens
gcaagggcatggctctgatcaa

SEQ ID NO: 7189354 - DNA, 21 bp, Homo sapiens
gcaaggcttttgtgtttccca

SEQ ID NO: 7189355 - DNA, 17 bp, Homo sapiens
gcaagggatgggagatt

SEQ ID NO: 7189356 - DNA, 17 bp, Homo sapiens
gcaagggatgggagatt

SEQ ID NO: 7189357 - DNA, 17 bp, Homo sapiens
gcaagggatgggagatt

SEQ ID NO: 7189358 - DNA, 22 bp, Homo sapiens
attaatatcccccgccgttctg

SEQ ID NO: 7189359 - DNA, 22 bp, Homo sapiens
attaatatcctgctggctaaat

SEQ ID NO: 7189360 - DNA, 22 bp, Homo sapiens
attaatatcctgctggctaaat

SEQ ID NO: 7189361 - DNA, 22 bp, Homo sapiens
attaatatcctgctggctaaat

SEQ ID NO: 7189362 - DNA, 22 bp, Homo sapiens
attaatatgagaaagtggcaga

SEQ ID NO: 7189363 - DNA, 22 bp, Homo sapiens
attaatatgagaaagtggcaga

SEQ ID NO: 7189364 - DNA, 22 bp, Homo sapiens
attaatattggttcattagctg

SEQ ID NO: 7189365 - DNA, 22 bp, Homo sapiens
attaatattggttcattagctg

SEQ ID NO: 7189366 - DNA, 21 bp, Homo sapiens
gatgatgccatcctccatctc

SEQ ID NO: 7189367 - DNA, 22 bp, Homo sapiens
gatgatgaggccatgaggcagg

SEQ ID NO: 7189368 - DNA, 22 bp, Homo sapiens
gatgatgagataaggataactt

SEQ ID NO: 7189369 - DNA, 22 bp, Homo sapiens
gatgatgagataaggataactt

SEQ ID NO: 7189370 - DNA, 22 bp, Homo sapiens
attaagatgtgggaaaatttaa

SEQ ID NO: 7189371 - DNA, 22 bp, Homo sapiens
gatgatgacagtgattagactg

SEQ ID NO: 7189372 - DNA, 22 bp, Homo sapiens
gatgatattttgactggagaat

SEQ ID NO: 7189373 - DNA, 22 bp, Homo sapiens
gatgatcatctgtaaagttaga

SEQ ID NO: 7189374 - DNA, 22 bp, Homo sapiens
gatgatcatctgtaaagttaga

SEQ ID NO: 7189375 - DNA, 22 bp, Homo sapiens
gatgatcatctgtaaagttaga

SEQ ID NO: 7189376 - DNA, 22 bp, Homo sapiens
attaattgggaacttgttgaaa

SEQ ID NO: 7189377 - DNA, 22 bp, Homo sapiens
attaatttccaggcactgtgct

SEQ ID NO: 7189378 - DNA, 22 bp, Homo sapiens
attaatttccaggcactgtgct

SEQ ID NO: 7189379 - DNA, 22 bp, Homo sapiens
attaatttccaggcactgtgct

SEQ ID NO: 7189380 - DNA, 22 bp, Homo sapiens
attaattttacctttgtaaaca

SEQ ID NO: 7189381 - DNA, 22 bp, Homo sapiens
attaattttacctttgtaaaca

SEQ ID NO: 7189382 - DNA, 22 bp, Homo sapiens
attaattttacctttgtaaaca

SEQ ID NO: 7189383 - DNA, 22 bp, Homo sapiens
attaattttacctttgtaaaca

SEQ ID NO: 7189384 - DNA, 22 bp, Homo sapiens
attaattttacctttgtaaaca

SEQ ID NO: 7189385 - DNA, 22 bp, Homo sapiens
attaattttacctttgtaaaca

SEQ ID NO: 7189386 - DNA, 22 bp, Homo sapiens
attaatattggttcattagctg

SEQ ID NO: 7189387 - DNA, 22 bp, Homo sapiens
attaatatttgcaccttctgtc

SEQ ID NO: 7189388 - DNA, 22 bp, Homo sapiens
attaatatttgcaccttctgtc

SEQ ID NO: 7189389 - DNA, 18 bp, Homo sapiens
attaatcataaaatgctg

SEQ ID NO: 7189390 - DNA, 22 bp, Homo sapiens
attaatgaaactttggttaagc

SEQ ID NO: 7189391 - DNA, 22 bp, Homo sapiens
attaatgaaactttggttaagc

SEQ ID NO: 7189392 - DNA, 22 bp, Homo sapiens
attaatgacgcagataataatt

SEQ ID NO: 7189393 - DNA, 22 bp, Homo sapiens
attaatgagcttctgcactcat

SEQ ID NO: 7189394 - DNA, 22 bp, Homo sapiens
attacaactgttcccactgtct

SEQ ID NO: 7189395 - DNA, 22 bp, Homo sapiens
attacaagatgcatccatattt

SEQ ID NO: 7189396 - DNA, 22 bp, Homo sapiens
attacaactacataatctcaga

SEQ ID NO: 7189397 - DNA, 22 bp, Homo sapiens
attacaataaggtttatttgta

SEQ ID NO: 7189398 - DNA, 22 bp, Homo sapiens
attacaataaggtttatttgta

SEQ ID NO: 7189399 - DNA, 22 bp, Homo sapiens
attacaaaagaagggagaaggt

SEQ ID NO: 7189400 - DNA, 22 bp, Homo sapiens
attaatttttctgacagccaca

SEQ ID NO: 7189401 - DNA, 22 bp, Homo sapiens
attaatttttctgacagccaca

SEQ ID NO: 7189402 - DNA, 22 bp, Homo sapiens
attaatttttctgacagccaca

SEQ ID NO: 7189403 - DNA, 22 bp, Homo sapiens
attacaaaagaagggagaaggt

SEQ ID NO: 7189404 - DNA, 22 bp, Homo sapiens
attacaaaagaagggagaaggt

SEQ ID NO: 7189405 - DNA, 22 bp, Homo sapiens
attacaataatacatgctcatt

SEQ ID NO: 7189406 - DNA, 22 bp, Homo sapiens
attacaataaggtttatttgta

SEQ ID NO: 7189407 - DNA, 22 bp, Homo sapiens
attacaataatacatgctcatt

SEQ ID NO: 7189408 - DNA, 22 bp, Homo sapiens
attacaataaggtttatttgta

SEQ ID NO: 7189409 - DNA, 22 bp, Homo sapiens
attacaataaggtttatttgta

SEQ ID NO: 7189410 - DNA, 22 bp, Homo sapiens
gcaactttagaaaaatctataa

SEQ ID NO: 7189411 - DNA, 22 bp, Homo sapiens
gcaactttagggccagcaagta

SEQ ID NO: 7189412 - DNA, 22 bp, Homo sapiens
gcaaggctggtggtggtgaagt

SEQ ID NO: 7189413 - DNA, 22 bp, Homo sapiens
gcaaggctgctgccacccatct

SEQ ID NO: 7189414 - DNA, 22 bp, Homo sapiens
gcaaggctgggagatgaggcct

SEQ ID NO: 7189415 - DNA, 22 bp, Homo sapiens
gcaaggctgacctctctagact

SEQ ID NO: 7189416 - DNA, 22 bp, Homo sapiens
gcaagaaaagagccttcagtgg

SEQ ID NO: 7189417 - DNA, 22 bp, Homo sapiens
gcaagaaaaaggcttcatgaac

SEQ ID NO: 7189418 - DNA, 22 bp, Homo sapiens
gcaagaaaagagccttcagtgg

SEQ ID NO: 7189419 - DNA, 23 bp, Homo sapiens
atgttttatgtctctagctgcca

SEQ ID NO: 7189420 - DNA, 23 bp, Homo sapiens
atgttttatgtctctagctgcca

SEQ ID NO: 7189421 - DNA, 22 bp, Homo sapiens
atgttttatgttccactcaagg

SEQ ID NO: 7189422 - DNA, 23 bp, Homo sapiens
atgttttatgtctctagctgcca

SEQ ID NO: 7189423 - DNA, 22 bp, Homo sapiens
atgttttatgttccactcaagg

SEQ ID NO: 7189424 - DNA, 22 bp, Homo sapiens
atgttttatgttccactcaagg

SEQ ID NO: 7189425 - DNA, 22 bp, Homo sapiens
atgttttattaccaacttgtac

SEQ ID NO: 7189426 - DNA, 22 bp, Homo sapiens
atgttttattaccaacttgtac

SEQ ID NO: 7189427 - DNA, 22 bp, Homo sapiens
atgttttatattttgcagcagt

SEQ ID NO: 7189428 - DNA, 22 bp, Homo sapiens
atgttttatgcttcagatgagg

SEQ ID NO: 7189429 - DNA, 22 bp, Homo sapiens
atgttttatgcttcagatgagg

SEQ ID NO: 7189430 - DNA, 22 bp, Homo sapiens
atgttttaccctttgcacaaac

SEQ ID NO: 7189431 - DNA, 22 bp, Homo sapiens
atgttttaccctttgcacaaac

SEQ ID NO: 7189432 - DNA, 22 bp, Homo sapiens
atgttttaccctttgcacaaac

SEQ ID NO: 7189433 - DNA, 20 bp, Homo sapiens
atgttttataaaagaacggg

SEQ ID NO: 7189434 - DNA, 22 bp, Homo sapiens
atgttttatattttgcagcagt

SEQ ID NO: 7189435 - DNA, 22 bp, Homo sapiens
atgttttatattttgcagcagt

SEQ ID NO: 7189436 - DNA, 22 bp, Homo sapiens
atgttttatattttgcagcagt

SEQ ID NO: 7189437 - DNA, 20 bp, Homo sapiens
atgttttataaaagaacggg

SEQ ID NO: 7189438 - DNA, 22 bp, Homo sapiens
atgttttatattttgcagcagt

SEQ ID NO: 7189439 - DNA, 22 bp, Homo sapiens
atgttttatattttgcagcagt

SEQ ID NO: 7189440 - DNA, 22 bp, Homo sapiens
atgttttctagagtttaaaatc

SEQ ID NO: 7189441 - DNA, 22 bp, Homo sapiens
atgttttctccatgttatgctt

SEQ ID NO: 7189442 - DNA, 22 bp, Homo sapiens
atgttttctagagtttaaaatc

SEQ ID NO: 7189443 - DNA, 22 bp, Homo sapiens
atgttttctccatgttatgctt

SEQ ID NO: 7189444 - DNA, 22 bp, Homo sapiens
atgttttcctgggagagcactc

SEQ ID NO: 7189445 - DNA, 22 bp, Homo sapiens
atgttttcctgggagagcactc

SEQ ID NO: 7189446 - DNA, 22 bp, Homo sapiens
atgttttctagagtttaaaatc

SEQ ID NO: 7189447 - DNA, 22 bp, Homo sapiens
atgttttctagagtttaaaatc

SEQ ID NO: 7189448 - DNA, 22 bp, Homo sapiens
atgttttctagagtttaaaatc

SEQ ID NO: 7189449 - DNA, 22 bp, Homo sapiens
atgttttctagagtttaaaatc

SEQ ID NO: 7189450 - DNA, 22 bp, Homo sapiens
atgttttgctggatgttggcta

SEQ ID NO: 7189451 - DNA, 22 bp, Homo sapiens
atgtttttaaatagacttacag

SEQ ID NO: 7189452 - DNA, 22 bp, Homo sapiens
atgttttctccatgttatgctt

SEQ ID NO: 7189453 - DNA, 22 bp, Homo sapiens
atgttttctccatgttatgctt

SEQ ID NO: 7189454 - DNA, 22 bp, Homo sapiens
atgttttctccatgttatgctt

SEQ ID NO: 7189455 - DNA, 22 bp, Homo sapiens
atgttttctttcagacttccct

SEQ ID NO: 7189456 - DNA, 22 bp, Homo sapiens
atgttttctttcagacttccct

SEQ ID NO: 7189457 - DNA, 22 bp, Homo sapiens
atgttttctttcagacttccct

SEQ ID NO: 7189458 - DNA, 22 bp, Homo sapiens
atgttttccattgccatggaaa

SEQ ID NO: 7189459 - DNA, 22 bp, Homo sapiens
atgttttccattgccatggaaa

SEQ ID NO: 7189460 - DNA, 22 bp, Homo sapiens
atgttttccccaaatgatcttc

SEQ ID NO: 7189461 - DNA, 22 bp, Homo sapiens
atgttttccccaaatgatcttc

SEQ ID NO: 7189462 - DNA, 22 bp, Homo sapiens
atgttttccccaaatgatcttc

SEQ ID NO: 7189463 - DNA, 22 bp, Homo sapiens
atgttttccccaaatgatcttc

SEQ ID NO: 7189464 - DNA, 22 bp, Homo sapiens
atgttttattaccaacttgtac

SEQ ID NO: 7189465 - DNA, 22 bp, Homo sapiens
atgttttattaccaacttgtac

SEQ ID NO: 7189466 - DNA, 22 bp, Homo sapiens
atgttttattaccaacttgtac

SEQ ID NO: 7189467 - DNA, 22 bp, Homo sapiens
atgttttcaaagtaaacttgta

SEQ ID NO: 7189468 - DNA, 22 bp, Homo sapiens
atgttttcaaagtaaacttgta

SEQ ID NO: 7189469 - DNA, 22 bp, Homo sapiens
atgttttcaaagtaaacttgta

SEQ ID NO: 7189470 - DNA, 22 bp, Homo sapiens
atgttttcaaagtaaacttgta

SEQ ID NO: 7189471 - DNA, 22 bp, Homo sapiens
atgttttcaaagtaaacttgta

SEQ ID NO: 7189472 - DNA, 22 bp, Homo sapiens
atgttttcaaagtaaacttgta

SEQ ID NO: 7189473 - DNA, 22 bp, Homo sapiens
atgtgttagtttgtgattatac

SEQ ID NO: 7189474 - DNA, 22 bp, Homo sapiens
atgtgttaattggagcagcagg

SEQ ID NO: 7189475 - DNA, 22 bp, Homo sapiens
atgtgttaatgtcaaccagaaa

SEQ ID NO: 7189476 - DNA, 22 bp, Homo sapiens
atgtgtgtgtttaatcctcaaa

SEQ ID NO: 7189477 - DNA, 22 bp, Homo sapiens
atgtgtgtgtttaatcctcaaa

SEQ ID NO: 7189478 - DNA, 22 bp, Homo sapiens
atgtgtgtgtgcgcgcgcagga

SEQ ID NO: 7189479 - DNA, 22 bp, Homo sapiens
atgtgtgtgtttaatcctcaaa

SEQ ID NO: 7189480 - DNA, 22 bp, Homo sapiens
atgtgtgtgtttaatcctcaaa

SEQ ID NO: 7189481 - DNA, 22 bp, Homo sapiens
atgtgtgtgtttaatcctcaaa

SEQ ID NO: 7189482 - DNA, 22 bp, Homo sapiens
atgtgtgtgtgcgcgcgcagga

SEQ ID NO: 7189483 - DNA, 22 bp, Homo sapiens
atgtgtgtgtgcgcgcgcagga

SEQ ID NO: 7189484 - DNA, 22 bp, Homo sapiens
atgtgtgtgtgcgcgcgcagga

SEQ ID NO: 7189485 - DNA, 22 bp, Homo sapiens
atgtgtgtgtatatacacacat

SEQ ID NO: 7189486 - DNA, 22 bp, Homo sapiens
atgtgtgtgtatatacacacat

SEQ ID NO: 7189487 - DNA, 22 bp, Homo sapiens
atgtgtgtgtgcgcgcgcagga

SEQ ID NO: 7189488 - DNA, 22 bp, Homo sapiens
atgtgtgtgtatatacacacat

SEQ ID NO: 7189489 - DNA, 22 bp, Homo sapiens
atgtgtgtgtatatacacacat

SEQ ID NO: 7189490 - DNA, 22 bp, Homo sapiens
atgtgtgtgtatatacacacat

SEQ ID NO: 7189491 - DNA, 22 bp, Homo sapiens
atgtgtgtgtatatacacacat

SEQ ID NO: 7189492 - DNA, 22 bp, Homo sapiens
atgttaaaaaccagtacagttg

SEQ ID NO: 7189493 - DNA, 22 bp, Homo sapiens
atgttaaaaaccagtacagttg

SEQ ID NO: 7189494 - DNA, 22 bp, Homo sapiens
atgttaaaaaccagtacagttg

SEQ ID NO: 7189495 - DNA, 22 bp, Homo sapiens
atgttaaaaaccagtacagttg

SEQ ID NO: 7189496 - DNA, 20 bp, Homo sapiens
atgtttctctgtcgtgattt

SEQ ID NO: 7189497 - DNA, 22 bp, Homo sapiens
atgtgttttggtaatttctgct

SEQ ID NO: 7189498 - DNA, 22 bp, Homo sapiens
atgtgtttttattctggcatgt

SEQ ID NO: 7189499 - DNA, 22 bp, Homo sapiens
atgtgtttttattctggcatgt

SEQ ID NO: 7189500 - DNA, 22 bp, Homo sapiens
atgtgtttgtcctgcagaaata

SEQ ID NO: 7189501 - DNA, 22 bp, Homo sapiens
atgtgtttgtcctgcagaaata

SEQ ID NO: 7189502 - DNA, 22 bp, Homo sapiens
atgtgtttgtacctttaaatat

SEQ ID NO: 7189503 - DNA, 22 bp, Homo sapiens
atgtgtttgtacctttaaatat

SEQ ID NO: 7189504 - DNA, 22 bp, Homo sapiens
atgtgtttggttatatggtatt

SEQ ID NO: 7189505 - DNA, 22 bp, Homo sapiens
atgtgtttaccaggggaacatg

SEQ ID NO: 7189506 - DNA, 22 bp, Homo sapiens
atgtgtttataattactcaatc

SEQ ID NO: 7189507 - DNA, 22 bp, Homo sapiens
atgtttttcataccagtgttgg

SEQ ID NO: 7189508 - DNA, 22 bp, Homo sapiens
atgtttttcataccagtgttgg

SEQ ID NO: 7189509 - DNA, 22 bp, Homo sapiens
atgtttttaaatagacttacag

SEQ ID NO: 7189510 - DNA, 22 bp, Homo sapiens
atgtttttaaatagacttacag

SEQ ID NO: 7189511 - DNA, 22 bp, Homo sapiens
atgtttttcataccagtgttgg

SEQ ID NO: 7189512 - DNA, 22 bp, Homo sapiens
atgtttttgagatacaaacaga

SEQ ID NO: 7189513 - DNA, 22 bp, Homo sapiens
atgtttttgagatacaaacaga

SEQ ID NO: 7189514 - DNA, 22 bp, Homo sapiens
atgtttttgagatacaaacaga

SEQ ID NO: 7189515 - DNA, 22 bp, Homo sapiens
atgtttttgagatacaaacaga

SEQ ID NO: 7189516 - DNA, 22 bp, Homo sapiens
atgtttttgagatacaaacaga

SEQ ID NO: 7189517 - DNA, 22 bp, Homo sapiens
atgtttttggaaatgggaacat

SEQ ID NO: 7189518 - DNA, 22 bp, Homo sapiens
atgtttttggaaatgggaacat

SEQ ID NO: 7189519 - DNA, 22 bp, Homo sapiens
atgtttttggaaatgggaacat

SEQ ID NO: 7189520 - DNA, 22 bp, Homo sapiens
atgtttttggcttcaagtttct

SEQ ID NO: 7189521 - DNA, 22 bp, Homo sapiens
atgtttttggcttcaagtttct

SEQ ID NO: 7189522 - DNA, 22 bp, Homo sapiens
attaaaagcttcccaagagtta

SEQ ID NO: 7189523 - DNA, 22 bp, Homo sapiens
attaaaactaaaatgcctgatt

SEQ ID NO: 7189524 - DNA, 22 bp, Homo sapiens
atgtttttggcttcaagtttct

SEQ ID NO: 7189525 - DNA, 22 bp, Homo sapiens
attaaatgttccttaaattata

SEQ ID NO: 7189526 - DNA, 22 bp, Homo sapiens
attaaatgttccttaaattata

SEQ ID NO: 7189527 - DNA, 22 bp, Homo sapiens
attaaatgttccttaaattata

SEQ ID NO: 7189528 - DNA, 22 bp, Homo sapiens
attaaatgttccttaaattata

SEQ ID NO: 7189529 - DNA, 22 bp, Homo sapiens
attaaatgttccttaaattata

SEQ ID NO: 7189530 - DNA, 22 bp, Homo sapiens
attaaatggtggtcattcattt

SEQ ID NO: 7189531 - DNA, 22 bp, Homo sapiens
attaaatgatggcatgtcttat

SEQ ID NO: 7189532 - DNA, 22 bp, Homo sapiens
attaaatggtggtcattcattt

SEQ ID NO: 7189533 - DNA, 22 bp, Homo sapiens
attaaatggtggtcattcattt

SEQ ID NO: 7189534 - DNA, 22 bp, Homo sapiens
attaaatactgcaggctaagca

SEQ ID NO: 7189535 - DNA, 22 bp, Homo sapiens
attaaacaatgtaaagttcttg

SEQ ID NO: 7189536 - DNA, 22 bp, Homo sapiens
attaaaattccaaggtatgcca

SEQ ID NO: 7189537 - DNA, 22 bp, Homo sapiens
attaaaagcttcccaagagtta

SEQ ID NO: 7189538 - DNA, 22 bp, Homo sapiens
attaaaagcttcccaagagtta

SEQ ID NO: 7189539 - DNA, 22 bp, Homo sapiens
attaaaattccaaggtatgcca

SEQ ID NO: 7189540 - DNA, 22 bp, Homo sapiens
attaaaagcttcccaagagtta

SEQ ID NO: 7189541 - DNA, 22 bp, Homo sapiens
gatgaggggtcattggctggga

SEQ ID NO: 7189542 - DNA, 22 bp, Homo sapiens
gatgaggtcatgttttacatat

SEQ ID NO: 7189543 - DNA, 22 bp, Homo sapiens
gatgaggtctacattgttaaaa

SEQ ID NO: 7189544 - DNA, 22 bp, Homo sapiens
gatgagggcctggtggctgtgc

SEQ ID NO: 7189545 - DNA, 22 bp, Homo sapiens
gatgagtaatagctaatggttc

SEQ ID NO: 7189546 - DNA, 21 bp, Homo sapiens
gatgagttttctgtgatgttc

SEQ ID NO: 7189547 - DNA, 22 bp, Homo sapiens
gatgatatatatggaaagccta

SEQ ID NO: 7189548 - DNA, 22 bp, Homo sapiens
gatgatattttgactggagaat

SEQ ID NO: 7189549 - DNA, 18 bp, Homo sapiens
gatgaggctgtctgagaa

SEQ ID NO: 7189550 - DNA, 22 bp, Homo sapiens
gatgaggctgtagagggtggca

SEQ ID NO: 7189551 - DNA, 22 bp, Homo sapiens
gatgaggctgtgtctgcacaag

SEQ ID NO: 7189552 - DNA, 22 bp, Homo sapiens
gatgaggcaagccagaggactg

SEQ ID NO: 7189553 - DNA, 22 bp, Homo sapiens
gatgaggcagctcagggggaaa

SEQ ID NO: 7189554 - DNA, 22 bp, Homo sapiens
gatgaggcataaacacagtcac

SEQ ID NO: 7189555 - DNA, 22 bp, Homo sapiens
gatgaggccacacggggtgggc

SEQ ID NO: 7189556 - DNA, 22 bp, Homo sapiens
gatgaggctagagacatgtgta

SEQ ID NO: 7189557 - DNA, 22 bp, Homo sapiens
attaaattagcaaactgtgaaa

SEQ ID NO: 7189558 - DNA, 22 bp, Homo sapiens
attaaattagcaaactgtgaaa

SEQ ID NO: 7189559 - DNA, 22 bp, Homo sapiens
attaaatgttggacgtatacat

SEQ ID NO: 7189560 - DNA, 22 bp, Homo sapiens
attaaatgttggcatattttgt

SEQ ID NO: 7189561 - DNA, 22 bp, Homo sapiens
attaaattaagtggctaattta

SEQ ID NO: 7189562 - DNA, 22 bp, Homo sapiens
attaaatgttggcatattttgt

SEQ ID NO: 7189563 - DNA, 22 bp, Homo sapiens
attaaatgttggcatattttgt

SEQ ID NO: 7189564 - DNA, 22 bp, Homo sapiens
gcagcagggagcaggggtgtca

SEQ ID NO: 7189565 - DNA, 22 bp, Homo sapiens
gcagcaggcttttcataccttg

SEQ ID NO: 7189566 - DNA, 22 bp, Homo sapiens
gcagcagggagcaggggtgtca

SEQ ID NO: 7189567 - DNA, 22 bp, Homo sapiens
gcagcaggcttttcataccttg

SEQ ID NO: 7189568 - DNA, 22 bp, Homo sapiens
gcagcaggcttttcataccttg

SEQ ID NO: 7189569 - DNA, 22 bp, Homo sapiens
gcagcagggagcaggggtgtca

SEQ ID NO: 7189570 - DNA, 22 bp, Homo sapiens
gcagcagggagcaggggtgtca

SEQ ID NO: 7189571 - DNA, 22 bp, Homo sapiens
gcagcagggagcaggggtgtca

SEQ ID NO: 7189572 - DNA, 22 bp, Homo sapiens
gcagcagggtgccagctttgca

SEQ ID NO: 7189573 - DNA, 22 bp, Homo sapiens
gcagcagggagcaggggtgtca

SEQ ID NO: 7189574 - DNA, 22 bp, Homo sapiens
gcagcagggtgccagctttgca

SEQ ID NO: 7189575 - DNA, 22 bp, Homo sapiens
gcagcagggtgccagctttgca

SEQ ID NO: 7189576 - DNA, 22 bp, Homo sapiens
gcagcagggtgccagctttgca

SEQ ID NO: 7189577 - DNA, 22 bp, Homo sapiens
attccttgtttcactgaaaagg

SEQ ID NO: 7189578 - DNA, 22 bp, Homo sapiens
attcctttggactcctccttgc

SEQ ID NO: 7189579 - DNA, 22 bp, Homo sapiens
attctacacaaagcaagaagac

SEQ ID NO: 7189580 - DNA, 22 bp, Homo sapiens
attctacacaaagcaagaagac

SEQ ID NO: 7189581 - DNA, 22 bp, Homo sapiens
attctacacaaagcaagaagac

SEQ ID NO: 7189582 - DNA, 18 bp, Homo sapiens
attctagaagatgccttg

SEQ ID NO: 7189583 - DNA, 22 bp, Homo sapiens
attctagaaaccagggaggcat

SEQ ID NO: 7189584 - DNA, 22 bp, Homo sapiens
attctacatttggagtgatgtc

SEQ ID NO: 7189585 - DNA, 22 bp, Homo sapiens
attctagaaggcaaagcaaggg

SEQ ID NO: 7189586 - DNA, 22 bp, Homo sapiens
attctagaatttaaatttgcca

SEQ ID NO: 7189587 - DNA, 21 bp, Homo sapiens
attctagacaacactgaaatc

SEQ ID NO: 7189588 - DNA, 21 bp, Homo sapiens
attctagacaacactgaaatc

SEQ ID NO: 7189589 - DNA, 22 bp, Homo sapiens
attctacacctctctcatttag

SEQ ID NO: 7189590 - DNA, 22 bp, Homo sapiens
attctacacctctctcatttag

SEQ ID NO: 7189591 - DNA, 22 bp, Homo sapiens
attctacacctctctcatttag

SEQ ID NO: 7189592 - DNA, 22 bp, Homo sapiens
attctacacctctctcatttag

SEQ ID NO: 7189593 - DNA, 22 bp, Homo sapiens
attctacacaacatgatgatgg

SEQ ID NO: 7189594 - DNA, 22 bp, Homo sapiens
attctacacaacatgatgatgg

SEQ ID NO: 7189595 - DNA, 22 bp, Homo sapiens
attctacacaacatgatgatgg

SEQ ID NO: 7189596 - DNA, 22 bp, Homo sapiens
attctacagatgaaagcggctg

SEQ ID NO: 7189597 - DNA, 22 bp, Homo sapiens
attctacaggactggcaatccc

SEQ ID NO: 7189598 - DNA, 22 bp, Homo sapiens
attctacagggtacgttgggga

SEQ ID NO: 7189599 - DNA, 22 bp, Homo sapiens
attctacagggtacgttgggga

SEQ ID NO: 7189600 - DNA, 22 bp, Homo sapiens
attctacatgatagaagggaga

SEQ ID NO: 7189601 - DNA, 22 bp, Homo sapiens
attctacatgatagaagggaga

SEQ ID NO: 7189602 - DNA, 22 bp, Homo sapiens
attctacatgatagaagggaga

SEQ ID NO: 7189603 - DNA, 22 bp, Homo sapiens
attctacatgatagaagggaga

SEQ ID NO: 7189604 - DNA, 22 bp, Homo sapiens
attctacatgatagaagggaga

SEQ ID NO: 7189605 - DNA, 22 bp, Homo sapiens
attctacatttggagtgatgtc

SEQ ID NO: 7189606 - DNA, 22 bp, Homo sapiens
attctacatttggagtgatgtc

SEQ ID NO: 7189607 - DNA, 22 bp, Homo sapiens
attcctcatttgttgagaacca

SEQ ID NO: 7189608 - DNA, 22 bp, Homo sapiens
attcctcattatttactgagga

SEQ ID NO: 7189609 - DNA, 20 bp, Homo sapiens
attcctcagccccagcctca

SEQ ID NO: 7189610 - DNA, 22 bp, Homo sapiens
attcctcagcaggccttttgtt

SEQ ID NO: 7189611 - DNA, 19 bp, Homo sapiens
attcctcaaggacagaaat

SEQ ID NO: 7189612 - DNA, 19 bp, Homo sapiens
attcctcaaggacagaaat

SEQ ID NO: 7189613 - DNA, 22 bp, Homo sapiens
attcctcaaaggtagcccatta

SEQ ID NO: 7189614 - DNA, 22 bp, Homo sapiens
attcctaaggaaggctggcaag

SEQ ID NO: 7189615 - DNA, 22 bp, Homo sapiens
attcctaaggaaggctggcaag

SEQ ID NO: 7189616 - DNA, 22 bp, Homo sapiens
attcctaaagtaatacactaga

SEQ ID NO: 7189617 - DNA, 22 bp, Homo sapiens
attcctaaagtaatacactaga

SEQ ID NO: 7189618 - DNA, 20 bp, Homo sapiens
attcccttctccctgtttga

SEQ ID NO: 7189619 - DNA, 22 bp, Homo sapiens
attccactttatgtctgtatga

SEQ ID NO: 7189620 - DNA, 22 bp, Homo sapiens
attccactttgctaatcttctg

SEQ ID NO: 7189621 - DNA, 21 bp, Homo sapiens
attccacttttccttcaggga

SEQ ID NO: 7189622 - DNA, 22 bp, Homo sapiens
attccctgaaattgtgctttca

SEQ ID NO: 7189623 - DNA, 22 bp, Homo sapiens
attcctgactgttagagtttgc

SEQ ID NO: 7189624 - DNA, 22 bp, Homo sapiens
attcctgactgctagtcattca

SEQ ID NO: 7189625 - DNA, 22 bp, Homo sapiens
attcctgagacttatctgtttc

SEQ ID NO: 7189626 - DNA, 22 bp, Homo sapiens
attcctgagacttatctgtttc

SEQ ID NO: 7189627 - DNA, 23 bp, Homo sapiens
attcctgaggctccttatgcacc

SEQ ID NO: 7189628 - DNA, 22 bp, Homo sapiens
attcctgattaacgacctttca

SEQ ID NO: 7189629 - DNA, 22 bp, Homo sapiens
gcagcaggcatggccgccctgg

SEQ ID NO: 7189630 - DNA, 22 bp, Homo sapiens
gcagcaggcttttcataccttg

SEQ ID NO: 7189631 - DNA, 22 bp, Homo sapiens
gcagcaggcttttcataccttg

SEQ ID NO: 7189632 - DNA, 22 bp, Homo sapiens
gcagcaggcatggccgccctgg

SEQ ID NO: 7189633 - DNA, 22 bp, Homo sapiens
gcagcaggcatggccgccctgg

SEQ ID NO: 7189634 - DNA, 22 bp, Homo sapiens
gcagcaggcatggccgccctgg

SEQ ID NO: 7189635 - DNA, 22 bp, Homo sapiens
gcagcaggcatggccgccctgg

SEQ ID NO: 7189636 - DNA, 22 bp, Homo sapiens
attcctgtcccttcattgttga

SEQ ID NO: 7189637 - DNA, 22 bp, Homo sapiens
attcctgtgtatgtcttgctgc

SEQ ID NO: 7189638 - DNA, 22 bp, Homo sapiens
gcagcaggcacttaccgttgct

SEQ ID NO: 7189639 - DNA, 22 bp, Homo sapiens
gcagcaggcacttaccgttgct

SEQ ID NO: 7189640 - DNA, 22 bp, Homo sapiens
gcagcaggcacttaccgttgct

SEQ ID NO: 7189641 - DNA, 22 bp, Homo sapiens
gcagagctgtctaagtcacttc

SEQ ID NO: 7189642 - DNA, 22 bp, Homo sapiens
gcagagctgttaatggagctga

SEQ ID NO: 7189643 - DNA, 22 bp, Homo sapiens
gcagagctgtctaagtcacttc

SEQ ID NO: 7189644 - DNA, 20 bp, Homo sapiens
gcagagctgttctgtgggga

SEQ ID NO: 7189645 - DNA, 22 bp, Homo sapiens
gcagagctgggtctgtatccaa

SEQ ID NO: 7189646 - DNA, 18 bp, Homo sapiens
gcagagctgggattccca

SEQ ID NO: 7189647 - DNA, 18 bp, Homo sapiens
gcagagctgggattccca

SEQ ID NO: 7189648 - DNA, 21 bp, Homo sapiens
gcagagctggaaccaggaccc

SEQ ID NO: 7189649 - DNA, 22 bp, Homo sapiens
gcagagctgcagcgaggcctgg

SEQ ID NO: 7189650 - DNA, 21 bp, Homo sapiens
gcagagctggaaccaggaccc

SEQ ID NO: 7189651 - DNA, 22 bp, Homo sapiens
attcagttagccacagctattc

SEQ ID NO: 7189652 - DNA, 22 bp, Homo sapiens
attcagttaaaaactgtacttc

SEQ ID NO: 7189653 - DNA, 22 bp, Homo sapiens
attcagtgtttgcagcaacttt

SEQ ID NO: 7189654 - DNA, 22 bp, Homo sapiens
attcagtgtttgcagcaacttt

SEQ ID NO: 7189655 - DNA, 22 bp, Homo sapiens
attcagtgggtgctcagcacaa

SEQ ID NO: 7189656 - DNA, 22 bp, Homo sapiens
attattgtactttcaataaggt

SEQ ID NO: 7189657 - DNA, 22 bp, Homo sapiens
attattgtactttcaataaggt

SEQ ID NO: 7189658 - DNA, 22 bp, Homo sapiens
attattgtcatcttaatcttaa

SEQ ID NO: 7189659 - DNA, 22 bp, Homo sapiens
attattgtcatcttaatcttaa

SEQ ID NO: 7189660 - DNA, 22 bp, Homo sapiens
attattgtcatcttaatcttaa

SEQ ID NO: 7189661 - DNA, 22 bp, Homo sapiens
attattgtgataggtgtcagtg

SEQ ID NO: 7189662 - DNA, 22 bp, Homo sapiens
attattgtgtaaaatgaggctt

SEQ ID NO: 7189663 - DNA, 22 bp, Homo sapiens
attattggtacaccgtagtcat

SEQ ID NO: 7189664 - DNA, 22 bp, Homo sapiens
attattggacacttcttctgca

SEQ ID NO: 7189665 - DNA, 22 bp, Homo sapiens
attattggtacaccgtagtcat

SEQ ID NO: 7189666 - DNA, 22 bp, Homo sapiens
attattggacacttcttctgca

SEQ ID NO: 7189667 - DNA, 22 bp, Homo sapiens
attattggacacttcttctgca

SEQ ID NO: 7189668 - DNA, 22 bp, Homo sapiens
attattgttttaatagtagaga

SEQ ID NO: 7189669 - DNA, 22 bp, Homo sapiens
attattgttagtgacagggtga

SEQ ID NO: 7189670 - DNA, 22 bp, Homo sapiens
attattgttgcggctgttaccg

SEQ ID NO: 7189671 - DNA, 22 bp, Homo sapiens
attatttagaaatcgattgaaa

SEQ ID NO: 7189672 - DNA, 22 bp, Homo sapiens
attatttagaaatcgattgaaa

SEQ ID NO: 7189673 - DNA, 22 bp, Homo sapiens
attatttacagtgtgctcgaag

SEQ ID NO: 7189674 - DNA, 22 bp, Homo sapiens
attatttacagtgtgctcgaag

SEQ ID NO: 7189675 - DNA, 22 bp, Homo sapiens
attatttacagtgtgctcgaag

SEQ ID NO: 7189676 - DNA, 22 bp, Homo sapiens
attatttcagtcagacactggc

SEQ ID NO: 7189677 - DNA, 22 bp, Homo sapiens
attatttcagtcagacactggc

SEQ ID NO: 7189678 - DNA, 22 bp, Homo sapiens
attcagactgtctaaatggttt

SEQ ID NO: 7189679 - DNA, 22 bp, Homo sapiens
attcagagcactgggtagaatt

SEQ ID NO: 7189680 - DNA, 21 bp, Homo sapiens
attcagagtaattcatcttta

SEQ ID NO: 7189681 - DNA, 22 bp, Homo sapiens
attatttatcctcttggtctat

SEQ ID NO: 7189682 - DNA, 22 bp, Homo sapiens
attatttatcctcttggtctat

SEQ ID NO: 7189683 - DNA, 22 bp, Homo sapiens
attatttatcctcttggtctat

SEQ ID NO: 7189684 - DNA, 22 bp, Homo sapiens
attatttatcctcttggtctat

SEQ ID NO: 7189685 - DNA, 22 bp, Homo sapiens
attcagtcaaaaatgatggaga

SEQ ID NO: 7189686 - DNA, 22 bp, Homo sapiens
attcagtcaaaccactggtcat

SEQ ID NO: 7189687 - DNA, 22 bp, Homo sapiens
attcagtgccaaggagaacttg

SEQ ID NO: 7189688 - DNA, 22 bp, Homo sapiens
attcagtggatatcttcacttt

SEQ ID NO: 7189689 - DNA, 22 bp, Homo sapiens
attcagtgggtgctcagcacaa

SEQ ID NO: 7189690 - DNA, 22 bp, Homo sapiens
attgcttactaatcatcttcag

SEQ ID NO: 7189691 - DNA, 22 bp, Homo sapiens
attgctggatgagctcttggat

SEQ ID NO: 7189692 - DNA, 22 bp, Homo sapiens
attgctggcatcagtgacaata

SEQ ID NO: 7189693 - DNA, 22 bp, Homo sapiens
attgctggcccagatgctttag

SEQ ID NO: 7189694 - DNA, 22 bp, Homo sapiens
attgctggctgccatcttgccc

SEQ ID NO: 7189695 - DNA, 22 bp, Homo sapiens
attgacaggagagcttggagtg

SEQ ID NO: 7189696 - DNA, 22 bp, Homo sapiens
attgacaggtctttgggagtat

SEQ ID NO: 7189697 - DNA, 22 bp, Homo sapiens
attgacagtggctagtgcccag

SEQ ID NO: 7189698 - DNA, 22 bp, Homo sapiens
attgacagtggtgttctgggga

SEQ ID NO: 7189699 - DNA, 22 bp, Homo sapiens
attgacagtgttaaagttgcct

SEQ ID NO: 7189700 - DNA, 23 bp, Homo sapiens
attgaccagctgtctcattttca

SEQ ID NO: 7189701 - DNA, 22 bp, Homo sapiens
attgacaaatggatgttgacat

SEQ ID NO: 7189702 - DNA, 22 bp, Homo sapiens
attgacaaatggatgttgacat

SEQ ID NO: 7189703 - DNA, 22 bp, Homo sapiens
attgacaaatggatgttgacat

SEQ ID NO: 7189704 - DNA, 22 bp, Homo sapiens
attgacaagacaatggctctta

SEQ ID NO: 7189705 - DNA, 22 bp, Homo sapiens
attgacaagacaatggctctta

SEQ ID NO: 7189706 - DNA, 22 bp, Homo sapiens
attgacaagcagtatgtcttag

SEQ ID NO: 7189707 - DNA, 22 bp, Homo sapiens
attgacaagcagtatgtcttag

SEQ ID NO: 7189708 - DNA, 22 bp, Homo sapiens
attgacaaggaaactataccag

SEQ ID NO: 7189709 - DNA, 22 bp, Homo sapiens
attgacaagtgagctgggctgc

SEQ ID NO: 7189710 - DNA, 22 bp, Homo sapiens
attgacaagtgagctgggctgc

SEQ ID NO: 7189711 - DNA, 22 bp, Homo sapiens
attgacaatctactatgttctg

SEQ ID NO: 7189712 - DNA, 22 bp, Homo sapiens
attgacaatctactatgttctg

SEQ ID NO: 7189713 - DNA, 22 bp, Homo sapiens
attgacaatgtatttgtatctg

SEQ ID NO: 7189714 - DNA, 22 bp, Homo sapiens
attgacaatgtatttgtatctg

SEQ ID NO: 7189715 - DNA, 22 bp, Homo sapiens
attgacaatgtatttgtatctg

SEQ ID NO: 7189716 - DNA, 22 bp, Homo sapiens
attgacaatgtatttgtatctg

SEQ ID NO: 7189717 - DNA, 22 bp, Homo sapiens
attgacaattagcccttaggtg

SEQ ID NO: 7189718 - DNA, 22 bp, Homo sapiens
attgacaattctatgcagagca

SEQ ID NO: 7189719 - DNA, 22 bp, Homo sapiens
attgacaattctatgcagagca

SEQ ID NO: 7189720 - DNA, 22 bp, Homo sapiens
attgacacaatgggatgtaagg

SEQ ID NO: 7189721 - DNA, 22 bp, Homo sapiens
attgacagaaaagatgttggat

SEQ ID NO: 7189722 - DNA, 22 bp, Homo sapiens
attgacagaaaattggatggca

SEQ ID NO: 7189723 - DNA, 20 bp, Homo sapiens
attgacagaaagtgttcacc

SEQ ID NO: 7189724 - DNA, 22 bp, Homo sapiens
attgacagagctttcaccatga

SEQ ID NO: 7189725 - DNA, 22 bp, Homo sapiens
attgacagcaggggctgtcact

SEQ ID NO: 7189726 - DNA, 22 bp, Homo sapiens
attgacagcaggggctgtcact

SEQ ID NO: 7189727 - DNA, 22 bp, Homo sapiens
attgaacagaaaaactcagaga

SEQ ID NO: 7189728 - DNA, 22 bp, Homo sapiens
attgaacagaaaccatcagagt

SEQ ID NO: 7189729 - DNA, 23 bp, Homo sapiens
attgaacagagagaaaaacatcc

SEQ ID NO: 7189730 - DNA, 22 bp, Homo sapiens
attgaactaaataagcagtcat

SEQ ID NO: 7189731 - DNA, 22 bp, Homo sapiens
attgaactaaataagcagtcat

SEQ ID NO: 7189732 - DNA, 22 bp, Homo sapiens
attgaactataattatgatttg

SEQ ID NO: 7189733 - DNA, 22 bp, Homo sapiens
attgaactataattatgatttg

SEQ ID NO: 7189734 - DNA, 22 bp, Homo sapiens
attgaactctgcaggagctgcc

SEQ ID NO: 7189735 - DNA, 22 bp, Homo sapiens
attgaactgaatcctggattgc

SEQ ID NO: 7189736 - DNA, 22 bp, Homo sapiens
attgaaattgatgaaattcttg

SEQ ID NO: 7189737 - DNA, 22 bp, Homo sapiens
attgaaattgatgaaattcttg

SEQ ID NO: 7189738 - DNA, 19 bp, Homo sapiens
attcttcagcagtgagacc

SEQ ID NO: 7189739 - DNA, 19 bp, Homo sapiens
attcttcagcagtgagacc

SEQ ID NO: 7189740 - DNA, 22 bp, Homo sapiens
attcttcagcaggggacactat

SEQ ID NO: 7189741 - DNA, 22 bp, Homo sapiens
attgaatagatgcattatacta

SEQ ID NO: 7189742 - DNA, 22 bp, Homo sapiens
attgaagtcctaatctccagta

SEQ ID NO: 7189743 - DNA, 22 bp, Homo sapiens
attgaagggcattagtcatcag

SEQ ID NO: 7189744 - DNA, 22 bp, Homo sapiens
attgaatagctgcttgttgtat

SEQ ID NO: 7189745 - DNA, 22 bp, Homo sapiens
attgaatgcttgctaacacttt

SEQ ID NO: 7189746 - DNA, 22 bp, Homo sapiens
attgaatgtcctttagtaaaaa

SEQ ID NO: 7189747 - DNA, 22 bp, Homo sapiens
attgaatgtcctttagtaaaaa

SEQ ID NO: 7189748 - DNA, 22 bp, Homo sapiens
attgacaaaaacaggtggttga

SEQ ID NO: 7189749 - DNA, 22 bp, Homo sapiens
attgacaaatctgaacatacgg

SEQ ID NO: 7189750 - DNA, 22 bp, Homo sapiens
attgaagatcagggaaagattc

SEQ ID NO: 7189751 - DNA, 22 bp, Homo sapiens
attgaagattctgacatcagaa

SEQ ID NO: 7189752 - DNA, 22 bp, Homo sapiens
attgaagattctgacatcagaa

SEQ ID NO: 7189753 - DNA, 22 bp, Homo sapiens
attgaagattctgacatcagaa

SEQ ID NO: 7189754 - DNA, 22 bp, Homo sapiens
attgaagagttgattattatct

SEQ ID NO: 7189755 - DNA, 22 bp, Homo sapiens
attgaagatcagggaaagattc

SEQ ID NO: 7189756 - DNA, 22 bp, Homo sapiens
attgaactgatatttggtgtag

SEQ ID NO: 7189757 - DNA, 22 bp, Homo sapiens
attgaactgtagtcttctgtct

SEQ ID NO: 7189758 - DNA, 22 bp, Homo sapiens
attgaactgtagtcttctgtct

SEQ ID NO: 7189759 - DNA, 22 bp, Homo sapiens
attgaactgtctttgaagaaat

SEQ ID NO: 7189760 - DNA, 22 bp, Homo sapiens
attgaactgtctttgaagaaat

SEQ ID NO: 7189761 - DNA, 22 bp, Homo sapiens
attgaactgttggagaggtttt

SEQ ID NO: 7189762 - DNA, 22 bp, Homo sapiens
attgaactgttggagaggtttt

SEQ ID NO: 7189763 - DNA, 22 bp, Homo sapiens
attgaacttaacagtaagtggc

SEQ ID NO: 7189764 - DNA, 22 bp, Homo sapiens
attctatagacagaaggtcaat

SEQ ID NO: 7189765 - DNA, 22 bp, Homo sapiens
attctatcaagctgtcttcttt

SEQ ID NO: 7189766 - DNA, 22 bp, Homo sapiens
attctattttttaagaagtagt

SEQ ID NO: 7189767 - DNA, 22 bp, Homo sapiens
attctattttttaagaagtagt

SEQ ID NO: 7189768 - DNA, 22 bp, Homo sapiens
attctattttttaagaagtagt

SEQ ID NO: 7189769 - DNA, 22 bp, Homo sapiens
attctcaaaacataacttcact

SEQ ID NO: 7189770 - DNA, 22 bp, Homo sapiens
attctcaaaacataacttcact

SEQ ID NO: 7189771 - DNA, 22 bp, Homo sapiens
attctcaaaacataacttcact

SEQ ID NO: 7189772 - DNA, 22 bp, Homo sapiens
attctcaaacaagtggtttgat

SEQ ID NO: 7189773 - DNA, 21 bp, Homo sapiens
attctagacaacactgaaatc

SEQ ID NO: 7189774 - DNA, 22 bp, Homo sapiens
attctagacatctgcagttgtt

SEQ ID NO: 7189775 - DNA, 22 bp, Homo sapiens
attctagagcagtgattctcat

SEQ ID NO: 7189776 - DNA, 22 bp, Homo sapiens
attctagagtttcaatccaagg

SEQ ID NO: 7189777 - DNA, 22 bp, Homo sapiens
attctagagtttcaatccaagg

SEQ ID NO: 7189778 - DNA, 22 bp, Homo sapiens
attctagataagaaaagggctg

SEQ ID NO: 7189779 - DNA, 22 bp, Homo sapiens
attctagataagaaaagggctg

SEQ ID NO: 7189780 - DNA, 17 bp, Homo sapiens
attctagatgaggtgct

SEQ ID NO: 7189781 - DNA, 17 bp, Homo sapiens
attctagatgaggtgct

SEQ ID NO: 7189782 - DNA, 22 bp, Homo sapiens
attctagatgctgtaagtagca

SEQ ID NO: 7189783 - DNA, 22 bp, Homo sapiens
attctagatgctgtaagtagca

SEQ ID NO: 7189784 - DNA, 22 bp, Homo sapiens
attctagccattgtattcttcc

SEQ ID NO: 7189785 - DNA, 22 bp, Homo sapiens
attctaggcttgaaacatgaag

SEQ ID NO: 7189786 - DNA, 22 bp, Homo sapiens
attctagtgtttccattacaag

SEQ ID NO: 7189787 - DNA, 22 bp, Homo sapiens
attctcagctttcaaatagaca

SEQ ID NO: 7189788 - DNA, 21 bp, Homo sapiens
attctcaggcccatcctcagg

SEQ ID NO: 7189789 - DNA, 22 bp, Homo sapiens
attctcaattttgccaaagggt

SEQ ID NO: 7189790 - DNA, 22 bp, Homo sapiens
attctcaatggctactttcata

SEQ ID NO: 7189791 - DNA, 22 bp, Homo sapiens
attctcaatggctactttcata

SEQ ID NO: 7189792 - DNA, 22 bp, Homo sapiens
attctcaatggctactttcata

SEQ ID NO: 7189793 - DNA, 22 bp, Homo sapiens
attctcaactactgcgagagct

SEQ ID NO: 7189794 - DNA, 22 bp, Homo sapiens
attctcaactactgcgagagct

SEQ ID NO: 7189795 - DNA, 22 bp, Homo sapiens
attctcaagctggctgggagca

SEQ ID NO: 7189796 - DNA, 22 bp, Homo sapiens
attctcaagctggctgggagca

SEQ ID NO: 7189797 - DNA, 22 bp, Homo sapiens
attctcaaacaagtggtttgat

SEQ ID NO: 7189798 - DNA, 22 bp, Homo sapiens
attctcaaagccagagtcaacg

SEQ ID NO: 7189799 - DNA, 22 bp, Homo sapiens
attctcaaagccagagtcaacg

SEQ ID NO: 7189800 - DNA, 22 bp, Homo sapiens
attctggaattctaagattctg

SEQ ID NO: 7189801 - DNA, 22 bp, Homo sapiens
attctggaagcaagcttttaaa

SEQ ID NO: 7189802 - DNA, 22 bp, Homo sapiens
attctggaattctaagattctg

SEQ ID NO: 7189803 - DNA, 22 bp, Homo sapiens
attctgtctttttatacatcta

SEQ ID NO: 7189804 - DNA, 22 bp, Homo sapiens
attctgtctttttatacatcta

SEQ ID NO: 7189805 - DNA, 22 bp, Homo sapiens
attctgtgtgtactgagatggg

SEQ ID NO: 7189806 - DNA, 22 bp, Homo sapiens
attctgtgtgtactgagatggg

SEQ ID NO: 7189807 - DNA, 22 bp, Homo sapiens
attcttcacctgagtcagtcta

SEQ ID NO: 7189808 - DNA, 22 bp, Homo sapiens
attcttcactgtttcagaatga

SEQ ID NO: 7189809 - DNA, 22 bp, Homo sapiens
attcttcactgtttcagaatga

SEQ ID NO: 7189810 - DNA, 22 bp, Homo sapiens
attcttcactgtttcagaatga

SEQ ID NO: 7189811 - DNA, 22 bp, Homo sapiens
attcttcacatggataggatct

SEQ ID NO: 7189812 - DNA, 22 bp, Homo sapiens
attcttcacactaaccctgtga

SEQ ID NO: 7189813 - DNA, 22 bp, Homo sapiens
attcttcacataagtgctgtac

SEQ ID NO: 7189814 - DNA, 22 bp, Homo sapiens
attcttaattccaaagactgag

SEQ ID NO: 7189815 - DNA, 22 bp, Homo sapiens
attcttaattccaaagactgag

SEQ ID NO: 7189816 - DNA, 22 bp, Homo sapiens
attcttaattccaaagactgag

SEQ ID NO: 7189817 - DNA, 22 bp, Homo sapiens
attcttaattccaaagactgag

SEQ ID NO: 7189818 - DNA, 22 bp, Homo sapiens
attctgtgttaggatagatggt

SEQ ID NO: 7189819 - DNA, 22 bp, Homo sapiens
attcttaattccaaagactgag

SEQ ID NO: 7189820 - DNA, 22 bp, Homo sapiens
attcttaattccaaagactgag

SEQ ID NO: 7189821 - DNA, 22 bp, Homo sapiens
attcttaattgccatgctgtat

SEQ ID NO: 7189822 - DNA, 22 bp, Homo sapiens
attcttaattgccatgctgtat

SEQ ID NO: 7189823 - DNA, 22 bp, Homo sapiens
attcttattatagtaaaacagt

SEQ ID NO: 7189824 - DNA, 22 bp, Homo sapiens
attcttattatagtaaaacagt

SEQ ID NO: 7189825 - DNA, 22 bp, Homo sapiens
attcttattatagtaaaacagt

SEQ ID NO: 7189826 - DNA, 22 bp, Homo sapiens
attcttattatagtaaaacagt

SEQ ID NO: 7189827 - DNA, 22 bp, Homo sapiens
cttgttcagtcctgacttcctg

SEQ ID NO: 7189828 - DNA, 22 bp, Homo sapiens
cttgttatctccgtgtccttgt

SEQ ID NO: 7189829 - DNA, 22 bp, Homo sapiens
cttgttatctgaaccaaaatta

SEQ ID NO: 7189830 - DNA, 22 bp, Homo sapiens
cttgttattggaaatgtcatgc

SEQ ID NO: 7189831 - DNA, 20 bp, Homo sapiens
cttgttaaatatgcaggtag

SEQ ID NO: 7189832 - DNA, 22 bp, Homo sapiens
cttgttaaattatataagcaga

SEQ ID NO: 7189833 - DNA, 22 bp, Homo sapiens
cttgttaaattatataagcaga

SEQ ID NO: 7189834 - DNA, 22 bp, Homo sapiens
cttgtgttgtacattctatggg

SEQ ID NO: 7189835 - DNA, 22 bp, Homo sapiens
cttgttaaaatgcagattccaa

SEQ ID NO: 7189836 - DNA, 22 bp, Homo sapiens
cttgttaaaatgccgattctga

SEQ ID NO: 7189837 - DNA, 22 bp, Homo sapiens
cttgtggccaatgtttgttata

SEQ ID NO: 7189838 - DNA, 22 bp, Homo sapiens
cttgtgtggtctggtcttgcta

SEQ ID NO: 7189839 - DNA, 22 bp, Homo sapiens
cttgtgtggtctggtcttgcta

SEQ ID NO: 7189840 - DNA, 22 bp, Homo sapiens
atgaaaagcataaacgctgaag

SEQ ID NO: 7189841 - DNA, 22 bp, Homo sapiens
cttgtggagtgcctgctgcagt

SEQ ID NO: 7189842 - DNA, 22 bp, Homo sapiens
cttgtggcaggtggatggtgcc

SEQ ID NO: 7189843 - DNA, 22 bp, Homo sapiens
cttgtttaaataagatagcagt

SEQ ID NO: 7189844 - DNA, 22 bp, Homo sapiens
cttgtttaataataccttagca

SEQ ID NO: 7189845 - DNA, 22 bp, Homo sapiens
cttgttgcaaacattcactcca

SEQ ID NO: 7189846 - DNA, 22 bp, Homo sapiens
cttgttgctaacatatgcttct

SEQ ID NO: 7189847 - DNA, 18 bp, Homo sapiens
cttgttcttctcttggcg

SEQ ID NO: 7189848 - DNA, 18 bp, Homo sapiens
cttgttcttctcttggcg

SEQ ID NO: 7189849 - DNA, 18 bp, Homo sapiens
cttgttcttctcttggcg

SEQ ID NO: 7189850 - DNA, 18 bp, Homo sapiens
cttgttcttctcttggcg

SEQ ID NO: 7189851 - DNA, 18 bp, Homo sapiens
cttgttcttctcttggcg

SEQ ID NO: 7189852 - DNA, 22 bp, Homo sapiens
atgaaatatcttgaagaaattc

SEQ ID NO: 7189853 - DNA, 22 bp, Homo sapiens
atgaaatatcttgaagaaattc

SEQ ID NO: 7189854 - DNA, 22 bp, Homo sapiens
atgaaatatcttgaagaaattc

SEQ ID NO: 7189855 - DNA, 22 bp, Homo sapiens
atgaaatatcttgaagaaattc

SEQ ID NO: 7189856 - DNA, 22 bp, Homo sapiens
atgaaatatcttgaagaaattc

SEQ ID NO: 7189857 - DNA, 22 bp, Homo sapiens
atgaaacagtgtgtatagcaaa

SEQ ID NO: 7189858 - DNA, 22 bp, Homo sapiens
cttgtttattatgcactgtaga

SEQ ID NO: 7189859 - DNA, 22 bp, Homo sapiens
atgaaacatgagaaatggagag

SEQ ID NO: 7189860 - DNA, 22 bp, Homo sapiens
atgaaacatgagaaatggagag

SEQ ID NO: 7189861 - DNA, 22 bp, Homo sapiens
atgaaacatgagaaatggagag

SEQ ID NO: 7189862 - DNA, 22 bp, Homo sapiens
atgaaacatgagaaatggagag

SEQ ID NO: 7189863 - DNA, 22 bp, Homo sapiens
atgaaacatgagaaatggagag

SEQ ID NO: 7189864 - DNA, 22 bp, Homo sapiens
atgaaacatgagaaatggagag

SEQ ID NO: 7189865 - DNA, 22 bp, Homo sapiens
atcttgatcaaggctatcatga

SEQ ID NO: 7189866 - DNA, 22 bp, Homo sapiens
atcttgctgctacaaagtgccc

SEQ ID NO: 7189867 - DNA, 22 bp, Homo sapiens
atcttgctgctacaaagtgccc

SEQ ID NO: 7189868 - DNA, 22 bp, Homo sapiens
atcttggactacagaagagagg

SEQ ID NO: 7189869 - DNA, 22 bp, Homo sapiens
atcttggactacagaagagagg

SEQ ID NO: 7189870 - DNA, 22 bp, Homo sapiens
atcttggattggagaaagaagt

SEQ ID NO: 7189871 - DNA, 22 bp, Homo sapiens
atcttttctgtttgctatgtct

SEQ ID NO: 7189872 - DNA, 22 bp, Homo sapiens
atcttttctgtttgctatgtct

SEQ ID NO: 7189873 - DNA, 22 bp, Homo sapiens
atctttgttgctctcatttctg

SEQ ID NO: 7189874 - DNA, 22 bp, Homo sapiens
atctttgttgctctcatttctg

SEQ ID NO: 7189875 - DNA, 22 bp, Homo sapiens
atctttgtttgtctctgaggtg

SEQ ID NO: 7189876 - DNA, 22 bp, Homo sapiens
atctttgttttgatgcagatct

SEQ ID NO: 7189877 - DNA, 22 bp, Homo sapiens
atctttttactaacactgctta

SEQ ID NO: 7189878 - DNA, 22 bp, Homo sapiens
atctttttactaacactgctta

SEQ ID NO: 7189879 - DNA, 22 bp, Homo sapiens
atctttttatctgtttggaaca

SEQ ID NO: 7189880 - DNA, 22 bp, Homo sapiens
atctttttatctgtttggaaca

SEQ ID NO: 7189881 - DNA, 22 bp, Homo sapiens
atctttttactaacactgctta

SEQ ID NO: 7189882 - DNA, 22 bp, Homo sapiens
atctttttactaacactgctta

SEQ ID NO: 7189883 - DNA, 22 bp, Homo sapiens
atctttttatctgtttggaaca

SEQ ID NO: 7189884 - DNA, 22 bp, Homo sapiens
atctttttgacatggtgatggt

SEQ ID NO: 7189885 - DNA, 22 bp, Homo sapiens
atctttttgacatggtgatggt

SEQ ID NO: 7189886 - DNA, 22 bp, Homo sapiens
atgaaaacggaccagagctatt

SEQ ID NO: 7189887 - DNA, 22 bp, Homo sapiens
atgaaaacggaccagagctatt

SEQ ID NO: 7189888 - DNA, 22 bp, Homo sapiens
atgaaaacggaccagagctatt

SEQ ID NO: 7189889 - DNA, 22 bp, Homo sapiens
atctttttgacatggtgatggt

SEQ ID NO: 7189890 - DNA, 22 bp, Homo sapiens
atcttttttgtcttggtcactg

SEQ ID NO: 7189891 - DNA, 22 bp, Homo sapiens
atcttttttgtcttggtcactg

SEQ ID NO: 7189892 - DNA, 22 bp, Homo sapiens
atgaaatgattgaaatctttac

SEQ ID NO: 7189893 - DNA, 23 bp, Homo sapiens
atgaaatgatactttattcactg

SEQ ID NO: 7189894 - DNA, 23 bp, Homo sapiens
atgaaatgatactttattcactg

SEQ ID NO: 7189895 - DNA, 23 bp, Homo sapiens
atgaaatgatactttattcactg

SEQ ID NO: 7189896 - DNA, 22 bp, Homo sapiens
atgaaatgagtcaatgcgacta

SEQ ID NO: 7189897 - DNA, 22 bp, Homo sapiens
atgaaatattctttggtaagaa

SEQ ID NO: 7189898 - DNA, 22 bp, Homo sapiens
atgaaatgaagttggcctggct

SEQ ID NO: 7189899 - DNA, 22 bp, Homo sapiens
atgaaatatcttgaagaaattc

SEQ ID NO: 7189900 - DNA, 22 bp, Homo sapiens
atgaaatatcttgaagaaattc

SEQ ID NO: 7189901 - DNA, 22 bp, Homo sapiens
atgaaatatcttgaagaaattc

SEQ ID NO: 7189902 - DNA, 22 bp, Homo sapiens
atgaaatatcttgaagaaattc

SEQ ID NO: 7189903 - DNA, 22 bp, Homo sapiens
atgaaatatcttgaagaaattc

SEQ ID NO: 7189904 - DNA, 22 bp, Homo sapiens
atgaaatgctattttggctaga

SEQ ID NO: 7189905 - DNA, 22 bp, Homo sapiens
atgaaatgctgagaggtgcttc

SEQ ID NO: 7189906 - DNA, 23 bp, Homo sapiens
atgaaatgctggctcagggaggt

SEQ ID NO: 7189907 - DNA, 22 bp, Homo sapiens
atgaaatggtggttttccattt

SEQ ID NO: 7189908 - DNA, 22 bp, Homo sapiens
atgaaatggtggttttccattt

SEQ ID NO: 7189909 - DNA, 22 bp, Homo sapiens
atgaaatgtaagtagagagttt

SEQ ID NO: 7189910 - DNA, 22 bp, Homo sapiens
atgaaatgtaagtagagagttt

SEQ ID NO: 7189911 - DNA, 22 bp, Homo sapiens
atgaaatgtaagtagagagttt

SEQ ID NO: 7189912 - DNA, 22 bp, Homo sapiens
atgaaatgtatgagtctgggtt

SEQ ID NO: 7189913 - DNA, 22 bp, Homo sapiens
atgaaatgtattcagatatgta

SEQ ID NO: 7189914 - DNA, 22 bp, Homo sapiens
atgaaatgtattcagatatgta

SEQ ID NO: 7189915 - DNA, 22 bp, Homo sapiens
atgaaatgtctggatctttttc

SEQ ID NO: 7189916 - DNA, 22 bp, Homo sapiens
atgaaatgtgaatgcttttcat

SEQ ID NO: 7189917 - DNA, 22 bp, Homo sapiens
cttttacatttgttgaagagta

SEQ ID NO: 7189918 - DNA, 22 bp, Homo sapiens
cttttacatttgttgaagagta

SEQ ID NO: 7189919 - DNA, 22 bp, Homo sapiens
ctttggtgtcatgtttctgcgg

SEQ ID NO: 7189920 - DNA, 22 bp, Homo sapiens
ctttggtgtcatgtttctgcgg

SEQ ID NO: 7189921 - DNA, 22 bp, Homo sapiens
ctttggtgttcattaaacatgg

SEQ ID NO: 7189922 - DNA, 22 bp, Homo sapiens
ctttggtggaggggtgcaggca

SEQ ID NO: 7189923 - DNA, 20 bp, Homo sapiens
ctttggtgggggtagcccag

SEQ ID NO: 7189924 - DNA, 22 bp, Homo sapiens
atgaaattaatcaacacataca

SEQ ID NO: 7189925 - DNA, 22 bp, Homo sapiens
atgaaattaatcaacacataca

SEQ ID NO: 7189926 - DNA, 22 bp, Homo sapiens
atgaaattaatcaacacataca

SEQ ID NO: 7189927 - DNA, 22 bp, Homo sapiens
atgaaatgttggtcccaatcgc

SEQ ID NO: 7189928 - DNA, 22 bp, Homo sapiens
atgaaattaatcaacacataca

SEQ ID NO: 7189929 - DNA, 22 bp, Homo sapiens
atgaaattaatcaacacataca

SEQ ID NO: 7189930 - DNA, 22 bp, Homo sapiens
cttttattttgaattaagggct

SEQ ID NO: 7189931 - DNA, 22 bp, Homo sapiens
cttttattttgaattaagggct

SEQ ID NO: 7189932 - DNA, 22 bp, Homo sapiens
cttttattttgaattaagggct

SEQ ID NO: 7189933 - DNA, 22 bp, Homo sapiens
cttttattttgaattaagggct

SEQ ID NO: 7189934 - DNA, 22 bp, Homo sapiens
cttttattttgaattaagggct

SEQ ID NO: 7189935 - DNA, 22 bp, Homo sapiens
cttttattttgaattaagggct

SEQ ID NO: 7189936 - DNA, 22 bp, Homo sapiens
cttttattttgaattaagggct

SEQ ID NO: 7189937 - DNA, 22 bp, Homo sapiens
cttttcagagctgagatcaccg

SEQ ID NO: 7189938 - DNA, 22 bp, Homo sapiens
cttttcagagctgagatcaccg

SEQ ID NO: 7189939 - DNA, 22 bp, Homo sapiens
cttttcaggctacattatggga

SEQ ID NO: 7189940 - DNA, 19 bp, Homo sapiens
cttttcatcaacagccaat

SEQ ID NO: 7189941 - DNA, 19 bp, Homo sapiens
cttttcatcaacagccaat

SEQ ID NO: 7189942 - DNA, 22 bp, Homo sapiens
cttttcaaacgctgatgtcagt

SEQ ID NO: 7189943 - DNA, 22 bp, Homo sapiens
cttttcatgagtctgttatggg

SEQ ID NO: 7189944 - DNA, 22 bp, Homo sapiens
cttttcatgccagcccatcaca

SEQ ID NO: 7189945 - DNA, 22 bp, Homo sapiens
cttttcatgagtctgttatggg

SEQ ID NO: 7189946 - DNA, 22 bp, Homo sapiens
cttttcatgagtctgttatggg

SEQ ID NO: 7189947 - DNA, 22 bp, Homo sapiens
cttttcatgagtctgttatggg

SEQ ID NO: 7189948 - DNA, 19 bp, Homo sapiens
cttttcatcaacagccaat

SEQ ID NO: 7189949 - DNA, 22 bp, Homo sapiens
cttttcatgccagcccatcaca

SEQ ID NO: 7189950 - DNA, 22 bp, Homo sapiens
cttttcatgccagcccatcaca

SEQ ID NO: 7189951 - DNA, 22 bp, Homo sapiens
cttttcatgccagcccatcaca

SEQ ID NO: 7189952 - DNA, 23 bp, Homo sapiens
cttttcattgccttagcgcagag

SEQ ID NO: 7189953 - DNA, 23 bp, Homo sapiens
cttttcattgccttagcgcagag

SEQ ID NO: 7189954 - DNA, 23 bp, Homo sapiens
cttttcattgccttagcgcagag

SEQ ID NO: 7189955 - DNA, 23 bp, Homo sapiens
cttttcattgccttagcgcagag

SEQ ID NO: 7189956 - DNA, 22 bp, Homo sapiens
cttttcattgtttgtacatgca

SEQ ID NO: 7189957 - DNA, 22 bp, Homo sapiens
cttttcattgtttgtacatgca

SEQ ID NO: 7189958 - DNA, 22 bp, Homo sapiens
atgaagactaatgtgaatggga

SEQ ID NO: 7189959 - DNA, 22 bp, Homo sapiens
atgaagactatttgaaggtgcc

SEQ ID NO: 7189960 - DNA, 22 bp, Homo sapiens
cttgctggcagtcactgttgcg

SEQ ID NO: 7189961 - DNA, 22 bp, Homo sapiens
cttgctggagcggagcgggtgt

SEQ ID NO: 7189962 - DNA, 22 bp, Homo sapiens
cttgctggcagtcactgttgcg

SEQ ID NO: 7189963 - DNA, 22 bp, Homo sapiens
cttgctggctggcaacctgggc

SEQ ID NO: 7189964 - DNA, 22 bp, Homo sapiens
cttgctggggtaagtctgtgct

SEQ ID NO: 7189965 - DNA, 22 bp, Homo sapiens
cttggcagcttttggaggagcc

SEQ ID NO: 7189966 - DNA, 22 bp, Homo sapiens
cttggcagggtggaggatgcag

SEQ ID NO: 7189967 - DNA, 22 bp, Homo sapiens
cttggcagtttcggaaggatga

SEQ ID NO: 7189968 - DNA, 22 bp, Homo sapiens
cttggcagggtggaggatgcag

SEQ ID NO: 7189969 - DNA, 20 bp, Homo sapiens
cttggcctacttagctttgt

SEQ ID NO: 7189970 - DNA, 20 bp, Homo sapiens
cttggcctacttagctttgt

SEQ ID NO: 7189971 - DNA, 21 bp, Homo sapiens
cttggcctctagctagagctg

SEQ ID NO: 7189972 - DNA, 21 bp, Homo sapiens
cttggcctctagctagagctg

SEQ ID NO: 7189973 - DNA, 22 bp, Homo sapiens
cttggcctcttctcagggtggg

SEQ ID NO: 7189974 - DNA, 22 bp, Homo sapiens
cttggcctcttctcagggtggg

SEQ ID NO: 7189975 - DNA, 22 bp, Homo sapiens
cttggcctcttctcagggtggg

SEQ ID NO: 7189976 - DNA, 21 bp, Homo sapiens
cttggcctactagaaaacctt

SEQ ID NO: 7189977 - DNA, 21 bp, Homo sapiens
cttggcctactagaaaacctt

SEQ ID NO: 7189978 - DNA, 22 bp, Homo sapiens
cttggcatgcagcaggcactca

SEQ ID NO: 7189979 - DNA, 22 bp, Homo sapiens
cttggcatgttcatctgcttgg

SEQ ID NO: 7189980 - DNA, 22 bp, Homo sapiens
cttggcattgtgttgatagaag

SEQ ID NO: 7189981 - DNA, 22 bp, Homo sapiens
cttggccagacagggagctcca

SEQ ID NO: 7189982 - DNA, 22 bp, Homo sapiens
cttggtaaaactgtcttaaatt

SEQ ID NO: 7189983 - DNA, 22 bp, Homo sapiens
cttggtaaattgtcttataaat

SEQ ID NO: 7189984 - DNA, 18 bp, Homo sapiens
cttggtaagtaaaacagc

SEQ ID NO: 7189985 - DNA, 22 bp, Homo sapiens
cttgggtgtgaccttggcattg

SEQ ID NO: 7189986 - DNA, 22 bp, Homo sapiens
cttggctgaactccaggatgca

SEQ ID NO: 7189987 - DNA, 22 bp, Homo sapiens
cttggctgaactccaggatgca

SEQ ID NO: 7189988 - DNA, 22 bp, Homo sapiens
cttggctcgtacccggggcagg

SEQ ID NO: 7189989 - DNA, 22 bp, Homo sapiens
cttggtcagctcgagagtttgt

SEQ ID NO: 7189990 - DNA, 22 bp, Homo sapiens
cttggtcaggcttttgtaactg

SEQ ID NO: 7189991 - DNA, 22 bp, Homo sapiens
cttggtcatgcaagatatcgat

SEQ ID NO: 7189992 - DNA, 22 bp, Homo sapiens
cttggtccgagggcgcctaggc

SEQ ID NO: 7189993 - DNA, 22 bp, Homo sapiens
cttggcctgacatgtggcaggg

SEQ ID NO: 7189994 - DNA, 22 bp, Homo sapiens
cttggcctgacatgtggcaggg

SEQ ID NO: 7189995 - DNA, 22 bp, Homo sapiens
cttggcctgcaggcagcagcgc

SEQ ID NO: 7189996 - DNA, 22 bp, Homo sapiens
cttggcctgcaggcagcagcgc

SEQ ID NO: 7189997 - DNA, 22 bp, Homo sapiens
cttggcctgcccagccagaagg

SEQ ID NO: 7189998 - DNA, 22 bp, Homo sapiens
cttggcctgcccagccagaagg

SEQ ID NO: 7189999 - DNA, 22 bp, Homo sapiens
cttggcctgcccagccagaagg

SEQ ID NO: 7190000 - DNA, 22 bp, Homo sapiens
cttggcctgggccgcagccact

SEQ ID NO: 7190001 - DNA, 22 bp, Homo sapiens
cttggcctgggccgcagccact

SEQ ID NO: 7190002 - DNA, 22 bp, Homo sapiens
cttggcctgtggctcaagaatt

SEQ ID NO: 7190003 - DNA, 22 bp, Homo sapiens
cttggcctgtggctcaagaatt

SEQ ID NO: 7190004 - DNA, 22 bp, Homo sapiens
atcttctgatttatggagcaat

SEQ ID NO: 7190005 - DNA, 22 bp, Homo sapiens
atcttctgatttatggagcaat

SEQ ID NO: 7190006 - DNA, 22 bp, Homo sapiens
cttgtaatagataggatcaaat

SEQ ID NO: 7190007 - DNA, 22 bp, Homo sapiens
cttgtaatggcagagacctgtc

SEQ ID NO: 7190008 - DNA, 22 bp, Homo sapiens
cttgtaattataatgtactgtt

SEQ ID NO: 7190009 - DNA, 22 bp, Homo sapiens
cttgtaatagataggatcaaat

SEQ ID NO: 7190010 - DNA, 22 bp, Homo sapiens
cttgtaaatgcagattctgatt

SEQ ID NO: 7190011 - DNA, 22 bp, Homo sapiens
atcttcctttgccatgggatag

SEQ ID NO: 7190012 - DNA, 22 bp, Homo sapiens
atcttcctttgccatgggatag

SEQ ID NO: 7190013 - DNA, 22 bp, Homo sapiens
atcttcttcaaggatctggagc

SEQ ID NO: 7190014 - DNA, 20 bp, Homo sapiens
atcttcttggccagcttgct

SEQ ID NO: 7190015 - DNA, 20 bp, Homo sapiens
atcttcttggccagcttgct

SEQ ID NO: 7190016 - DNA, 20 bp, Homo sapiens
atcttcttggccagcttgct

SEQ ID NO: 7190017 - DNA, 22 bp, Homo sapiens
atcttgaaaagcagcatggcct

SEQ ID NO: 7190018 - DNA, 22 bp, Homo sapiens
atcttgaaatactttctagaat

SEQ ID NO: 7190019 - DNA, 22 bp, Homo sapiens
atcttgaatgaatgactcttta

SEQ ID NO: 7190020 - DNA, 22 bp, Homo sapiens
cttgtaaatgcagattctgatt

SEQ ID NO: 7190021 - DNA, 22 bp, Homo sapiens
cttgtaaactttctaggcctat

SEQ ID NO: 7190022 - DNA, 19 bp, Homo sapiens
cttgtaaagggctgtttct

SEQ ID NO: 7190023 - DNA, 22 bp, Homo sapiens
cttgtaaatgcagattctgatt

SEQ ID NO: 7190024 - DNA, 22 bp, Homo sapiens
cttgtaaatgcagattctgatt

SEQ ID NO: 7190025 - DNA, 22 bp, Homo sapiens
cttggtttacctaaacaatagg

SEQ ID NO: 7190026 - DNA, 22 bp, Homo sapiens
cttgtaaaatatccagttaagg

SEQ ID NO: 7190027 - DNA, 22 bp, Homo sapiens
cttgtaaacttgagcagggcat

SEQ ID NO: 7190028 - DNA, 22 bp, Homo sapiens
cttgtaaacttgagcagggcat

SEQ ID NO: 7190029 - DNA, 22 bp, Homo sapiens
cttggtccgagggcgcctaggc

SEQ ID NO: 7190030 - DNA, 22 bp, Homo sapiens
cttggtcctgcagggtctcttg

SEQ ID NO: 7190031 - DNA, 22 bp, Homo sapiens
cttggtcctgcagggtctcttg

SEQ ID NO: 7190032 - DNA, 22 bp, Homo sapiens
cttggtgcaggggacagggcaa

SEQ ID NO: 7190033 - DNA, 22 bp, Homo sapiens
cttggtgcattactcaatctgt

SEQ ID NO: 7190034 - DNA, 22 bp, Homo sapiens
cttggtgccacagcagcttgcg

SEQ ID NO: 7190035 - DNA, 22 bp, Homo sapiens
cttggtgcccagcaggtggctg

SEQ ID NO: 7190036 - DNA, 22 bp, Homo sapiens
cttggtgcccagcaggtggctg

SEQ ID NO: 7190037 - DNA, 22 bp, Homo sapiens
cttggtgcccagcaggtggctg

SEQ ID NO: 7190038 - DNA, 19 bp, Homo sapiens
cttggtgcttgcccttggc

SEQ ID NO: 7190039 - DNA, 20 bp, Homo sapiens
cttggtggctctgggaagtg

SEQ ID NO: 7190040 - DNA, 19 bp, Homo sapiens
cttggtgcttgcccttggc

SEQ ID NO: 7190041 - DNA, 22 bp, Homo sapiens
cttggtgtcatgggtcagcagc

SEQ ID NO: 7190042 - DNA, 22 bp, Homo sapiens
cttgcctttgtcttcaaaggct

SEQ ID NO: 7190043 - DNA, 22 bp, Homo sapiens
cttgcctttgtcttcaaaggct

SEQ ID NO: 7190044 - DNA, 22 bp, Homo sapiens
cttgccttctgttcctatagaa

SEQ ID NO: 7190045 - DNA, 22 bp, Homo sapiens
cttgccttcagtccatcagtca

SEQ ID NO: 7190046 - DNA, 22 bp, Homo sapiens
cttgccttcagtgtccctttgc

SEQ ID NO: 7190047 - DNA, 22 bp, Homo sapiens
cttgccttcttttcctatagaa

SEQ ID NO: 7190048 - DNA, 22 bp, Homo sapiens
cttgctcattaagtagctcaca

SEQ ID NO: 7190049 - DNA, 22 bp, Homo sapiens
cttgctgaaggaacttcccaga

SEQ ID NO: 7190050 - DNA, 22 bp, Homo sapiens
cttgctgaaggaacttcccaga

SEQ ID NO: 7190051 - DNA, 22 bp, Homo sapiens
cttgctgagataaatgctgtct

SEQ ID NO: 7190052 - DNA, 22 bp, Homo sapiens
cttgctgagataaatgctgtct

SEQ ID NO: 7190053 - DNA, 22 bp, Homo sapiens
cttgctgattcatgtcttcctg

SEQ ID NO: 7190054 - DNA, 22 bp, Homo sapiens
cttgctgattcatgtcttcctg

SEQ ID NO: 7190055 - DNA, 22 bp, Homo sapiens
cttgctgctgcatctgagcatg

SEQ ID NO: 7190056 - DNA, 22 bp, Homo sapiens
cttgctgctgcatctgagcatg

SEQ ID NO: 7190057 - DNA, 22 bp, Homo sapiens
cttgctggaaactctctctgcc

SEQ ID NO: 7190058 - DNA, 22 bp, Homo sapiens
cttgctggaaactctctctgcc

SEQ ID NO: 7190059 - DNA, 22 bp, Homo sapiens
cttgctggagcggagcgggtgt

SEQ ID NO: 7190060 - DNA, 19 bp, Homo sapiens
cttgcctgttcctacagct

SEQ ID NO: 7190061 - DNA, 23 bp, Homo sapiens
cttgcctggcctctctgcccaga

SEQ ID NO: 7190062 - DNA, 23 bp, Homo sapiens
cttgcctggcctctctgcccaga

SEQ ID NO: 7190063 - DNA, 22 bp, Homo sapiens
cttgcctgggactgaggcattt

SEQ ID NO: 7190064 - DNA, 22 bp, Homo sapiens
cttgcctgtggctagttggctc

SEQ ID NO: 7190065 - DNA, 22 bp, Homo sapiens
cttgatcattcactggctctgt

SEQ ID NO: 7190066 - DNA, 22 bp, Homo sapiens
cttgatctacatagtgaaaccc

SEQ ID NO: 7190067 - DNA, 22 bp, Homo sapiens
cttgatctacatagtgaaaccc

SEQ ID NO: 7190068 - DNA, 22 bp, Homo sapiens
cttgatctacatagtgaaaccc

SEQ ID NO: 7190069 - DNA, 22 bp, Homo sapiens
cttgcctgctggagcagggctc

SEQ ID NO: 7190070 - DNA, 22 bp, Homo sapiens
atctatacccatcatgatttaa

SEQ ID NO: 7190071 - DNA, 22 bp, Homo sapiens
atctatatcatggggtaaggta

SEQ ID NO: 7190072 - DNA, 22 bp, Homo sapiens
atctatactcagagttaatatc

SEQ ID NO: 7190073 - DNA, 22 bp, Homo sapiens
atctatcaaaaccagagggttt

SEQ ID NO: 7190074 - DNA, 22 bp, Homo sapiens
atctattatgctgagaaactgt

SEQ ID NO: 7190075 - DNA, 22 bp, Homo sapiens
cttgagtcatataaagacagag

SEQ ID NO: 7190076 - DNA, 22 bp, Homo sapiens
atctacataaaacgaatacata

SEQ ID NO: 7190077 - DNA, 22 bp, Homo sapiens
atctacatgttgatttaaagaa

SEQ ID NO: 7190078 - DNA, 22 bp, Homo sapiens
atctacattctcaccaatgttt

SEQ ID NO: 7190079 - DNA, 22 bp, Homo sapiens
atctactcagtaactgcttagg

SEQ ID NO: 7190080 - DNA, 22 bp, Homo sapiens
atctactcctgaatatatctag

SEQ ID NO: 7190081 - DNA, 22 bp, Homo sapiens
atctactttacaaatcatctcc

SEQ ID NO: 7190082 - DNA, 22 bp, Homo sapiens
atctagaaaaggtgactaaaat

SEQ ID NO: 7190083 - DNA, 22 bp, Homo sapiens
atctacaggattttacagagtt

SEQ ID NO: 7190084 - DNA, 22 bp, Homo sapiens
atctacaggattttacagagtt

SEQ ID NO: 7190085 - DNA, 22 bp, Homo sapiens
atctacaggctgaggtgggagg

SEQ ID NO: 7190086 - DNA, 22 bp, Homo sapiens
atctacataaaacgaatacata

SEQ ID NO: 7190087 - DNA, 22 bp, Homo sapiens
atctacataaaacgaatacata

SEQ ID NO: 7190088 - DNA, 22 bp, Homo sapiens
atctacaggattttacagagtt

SEQ ID NO: 7190089 - DNA, 22 bp, Homo sapiens
atctacaggattttacagagtt

SEQ ID NO: 7190090 - DNA, 22 bp, Homo sapiens
atctacaggattttacagagtt

SEQ ID NO: 7190091 - DNA, 22 bp, Homo sapiens
atctacaggatagtttaatatt

SEQ ID NO: 7190092 - DNA, 22 bp, Homo sapiens
atctacaggaagagaaagggcc

SEQ ID NO: 7190093 - DNA, 22 bp, Homo sapiens
atctacaggaagagaaagggcc

SEQ ID NO: 7190094 - DNA, 22 bp, Homo sapiens
atctacaggatagtttaatatt

SEQ ID NO: 7190095 - DNA, 22 bp, Homo sapiens
atctacaggatagtttaatatt

SEQ ID NO: 7190096 - DNA, 22 bp, Homo sapiens
atctacagcagtgccaggtagc

SEQ ID NO: 7190097 - DNA, 22 bp, Homo sapiens
atctacagcagtgccaggtagc

SEQ ID NO: 7190098 - DNA, 22 bp, Homo sapiens
atctacagcagtgccaggtagc

SEQ ID NO: 7190099 - DNA, 22 bp, Homo sapiens
atctacagccagtctggtttgt

SEQ ID NO: 7190100 - DNA, 22 bp, Homo sapiens
atctacagccagtctggtttgt

SEQ ID NO: 7190101 - DNA, 22 bp, Homo sapiens
atctagaagtggcatgaattac

SEQ ID NO: 7190102 - DNA, 22 bp, Homo sapiens
atctagaagtcatggctttctt

SEQ ID NO: 7190103 - DNA, 22 bp, Homo sapiens
atctagaagtggcatgaattac

SEQ ID NO: 7190104 - DNA, 22 bp, Homo sapiens
atctagaacttaaagtcagtca

SEQ ID NO: 7190105 - DNA, 22 bp, Homo sapiens
atctagaacttaaagtcagtca

SEQ ID NO: 7190106 - DNA, 22 bp, Homo sapiens
atctagaagcctgagccaagat

SEQ ID NO: 7190107 - DNA, 23 bp, Homo sapiens
atctagaaacctgatgactctgt

SEQ ID NO: 7190108 - DNA, 22 bp, Homo sapiens
atctagaaagccaggggcctgc

SEQ ID NO: 7190109 - DNA, 22 bp, Homo sapiens
atctagaaagtgttgaagatca

SEQ ID NO: 7190110 - DNA, 22 bp, Homo sapiens
atctagaaagtgttgaagatca

SEQ ID NO: 7190111 - DNA, 22 bp, Homo sapiens
atctagaacaattattgtcaca

SEQ ID NO: 7190112 - DNA, 22 bp, Homo sapiens
atctagcagtgttataattgga

SEQ ID NO: 7190113 - DNA, 22 bp, Homo sapiens
atctagattaggtataagagct

SEQ ID NO: 7190114 - DNA, 19 bp, Homo sapiens
atctagattattgagaagg

SEQ ID NO: 7190115 - DNA, 22 bp, Homo sapiens
atctagattaggtataagagct

SEQ ID NO: 7190116 - DNA, 22 bp, Homo sapiens
atctagaagtggcatgaattac

SEQ ID NO: 7190117 - DNA, 21 bp, Homo sapiens
atctagaatctctctccccac

SEQ ID NO: 7190118 - DNA, 21 bp, Homo sapiens
atctagaatctctctccccac

SEQ ID NO: 7190119 - DNA, 22 bp, Homo sapiens
atctagacatctgaaacattta

SEQ ID NO: 7190120 - DNA, 22 bp, Homo sapiens
atctagaggcaatgaaggaggt

SEQ ID NO: 7190121 - DNA, 22 bp, Homo sapiens
atgagttgaagctacaagaggc

SEQ ID NO: 7190122 - DNA, 22 bp, Homo sapiens
atgagttcaattgtttcagtca

SEQ ID NO: 7190123 - DNA, 22 bp, Homo sapiens
atgagttaggggcctgagtgga

SEQ ID NO: 7190124 - DNA, 22 bp, Homo sapiens
atgagtgtttagaaaacactgg

SEQ ID NO: 7190125 - DNA, 22 bp, Homo sapiens
atgagtgatgggtacattggct

SEQ ID NO: 7190126 - DNA, 22 bp, Homo sapiens
atgagtgcttagagagtaatcc

SEQ ID NO: 7190127 - DNA, 22 bp, Homo sapiens
atgatacaagcaaaactaatca

SEQ ID NO: 7190128 - DNA, 22 bp, Homo sapiens
atgatacaagcaaaactaatca

SEQ ID NO: 7190129 - DNA, 22 bp, Homo sapiens
atgatacaagcaaaactaatca

SEQ ID NO: 7190130 - DNA, 22 bp, Homo sapiens
atgatacaagcaaaactaatca

SEQ ID NO: 7190131 - DNA, 22 bp, Homo sapiens
atgatacacctaggagtgggag

SEQ ID NO: 7190132 - DNA, 19 bp, Homo sapiens
atgatacaggtgaaaattg

SEQ ID NO: 7190133 - DNA, 22 bp, Homo sapiens
atgattagttaccttgatttaa

SEQ ID NO: 7190134 - DNA, 22 bp, Homo sapiens
atgagttgaagctacaagaggc

SEQ ID NO: 7190135 - DNA, 20 bp, Homo sapiens
atgagtttaaacattcagag

SEQ ID NO: 7190136 - DNA, 23 bp, Homo sapiens
atgataatgccattaactttgat

SEQ ID NO: 7190137 - DNA, 23 bp, Homo sapiens
atgataatgccattaactttgat

SEQ ID NO: 7190138 - DNA, 22 bp, Homo sapiens
atgattcagcaattttatatct

SEQ ID NO: 7190139 - DNA, 22 bp, Homo sapiens
atgattcagcccaatttttcta

SEQ ID NO: 7190140 - DNA, 20 bp, Homo sapiens
atgattttgcactaacttca

SEQ ID NO: 7190141 - DNA, 20 bp, Homo sapiens
atgattttgcactaacttca

SEQ ID NO: 7190142 - DNA, 20 bp, Homo sapiens
atgattttgcactaacttca

SEQ ID NO: 7190143 - DNA, 22 bp, Homo sapiens
atgatttttcagcagaggatct

SEQ ID NO: 7190144 - DNA, 22 bp, Homo sapiens
atgattttttctaacacagtcg

SEQ ID NO: 7190145 - DNA, 22 bp, Homo sapiens
atgcaaaagactatttgttgct

SEQ ID NO: 7190146 - DNA, 22 bp, Homo sapiens
atgcaaaaactgcacttacgct

SEQ ID NO: 7190147 - DNA, 22 bp, Homo sapiens
atgattttttctaacacagtcg

SEQ ID NO: 7190148 - DNA, 22 bp, Homo sapiens
atgattttttctaacacagtcg

SEQ ID NO: 7190149 - DNA, 22 bp, Homo sapiens
atgcaaaagtaactgtgatttt

SEQ ID NO: 7190150 - DNA, 22 bp, Homo sapiens
atgaggtattcgtaatatttcc

SEQ ID NO: 7190151 - DNA, 22 bp, Homo sapiens
atgaggtattcgtaatatttcc

SEQ ID NO: 7190152 - DNA, 22 bp, Homo sapiens
atgaggtggtcttcagtaggtc

SEQ ID NO: 7190153 - DNA, 22 bp, Homo sapiens
atgaggttatatttaattcact

SEQ ID NO: 7190154 - DNA, 22 bp, Homo sapiens
atgaggttcagtgtttatttcc

SEQ ID NO: 7190155 - DNA, 22 bp, Homo sapiens
atgaggtttaggttcctcctct

SEQ ID NO: 7190156 - DNA, 22 bp, Homo sapiens
atgaggtttgagcctcttgacc

SEQ ID NO: 7190157 - DNA, 22 bp, Homo sapiens
atgaggttttactgccattttc

SEQ ID NO: 7190158 - DNA, 22 bp, Homo sapiens
atgagtatatgatatggtttgg

SEQ ID NO: 7190159 - DNA, 22 bp, Homo sapiens
atgagtatatgatatggtttgg

SEQ ID NO: 7190160 - DNA, 22 bp, Homo sapiens
atgaggtatctcatttcctgaa

SEQ ID NO: 7190161 - DNA, 22 bp, Homo sapiens
atgaggtagtattagaaggaga

SEQ ID NO: 7190162 - DNA, 22 bp, Homo sapiens
atgaggtaggacatcaggaaat

SEQ ID NO: 7190163 - DNA, 19 bp, Homo sapiens
atgaggtagcagctggtgc

SEQ ID NO: 7190164 - DNA, 19 bp, Homo sapiens
atgaggtagcagctggtgc

SEQ ID NO: 7190165 - DNA, 22 bp, Homo sapiens
atgaggtagctgtggctggctg

SEQ ID NO: 7190166 - DNA, 22 bp, Homo sapiens
atgaggtagcttggcccagggg

SEQ ID NO: 7190167 - DNA, 22 bp, Homo sapiens
atgaggtactagtatatacgta

SEQ ID NO: 7190168 - DNA, 22 bp, Homo sapiens
atgaggtaatagggcagtgggg

SEQ ID NO: 7190169 - DNA, 22 bp, Homo sapiens
atgaggtaagcactgggcccaa

SEQ ID NO: 7190170 - DNA, 23 bp, Homo sapiens
atgaggtaaagatcagctttaaa

SEQ ID NO: 7190171 - DNA, 22 bp, Homo sapiens
atgaggccaccttctacatttc

SEQ ID NO: 7190172 - DNA, 22 bp, Homo sapiens
atgaggccacagttatagattt

SEQ ID NO: 7190173 - DNA, 22 bp, Homo sapiens
gaaagcagtaaatgggtcccat

SEQ ID NO: 7190174 - DNA, 22 bp, Homo sapiens
gaaagcagctaagtcttatgat

SEQ ID NO: 7190175 - DNA, 22 bp, Homo sapiens
gaaagcagctaagtcttatgat

SEQ ID NO: 7190176 - DNA, 22 bp, Homo sapiens
gaaagcactgtgagatcttgtt

SEQ ID NO: 7190177 - DNA, 22 bp, Homo sapiens
gaaagcagctaagtcttatgat

SEQ ID NO: 7190178 - DNA, 22 bp, Homo sapiens
atgaggcagcccttcccttctc

SEQ ID NO: 7190179 - DNA, 22 bp, Homo sapiens
atgaggcagcacatgggattgt

SEQ ID NO: 7190180 - DNA, 22 bp, Homo sapiens
atgaggcagatgttgcatgagg

SEQ ID NO: 7190181 - DNA, 22 bp, Homo sapiens
atgaggcagatgttgcatgagg

SEQ ID NO: 7190182 - DNA, 22 bp, Homo sapiens
atgaggcagagggctgtgccag

SEQ ID NO: 7190183 - DNA, 22 bp, Homo sapiens
atgaagcagaatttcccactct

SEQ ID NO: 7190184 - DNA, 22 bp, Homo sapiens
atgaagcagactcaggtggtgc

SEQ ID NO: 7190185 - DNA, 22 bp, Homo sapiens
atgaagcagatttattactcac

SEQ ID NO: 7190186 - DNA, 22 bp, Homo sapiens
atgaagcagcctcttccctctg

SEQ ID NO: 7190187 - DNA, 22 bp, Homo sapiens
atgaagcagcgttgtagagtga

SEQ ID NO: 7190188 - DNA, 22 bp, Homo sapiens
atgaagcagcgttgtagagtga

SEQ ID NO: 7190189 - DNA, 22 bp, Homo sapiens
atgagcttcccagacaggatgg

SEQ ID NO: 7190190 - DNA, 22 bp, Homo sapiens
atgagcttcccagacaggatgg

SEQ ID NO: 7190191 - DNA, 22 bp, Homo sapiens
atgagcttccagacaaaggcat

SEQ ID NO: 7190192 - DNA, 22 bp, Homo sapiens
atgagcttggtccagcaggctt

SEQ ID NO: 7190193 - DNA, 22 bp, Homo sapiens
atgaggaacagacttgctggat

SEQ ID NO: 7190194 - DNA, 22 bp, Homo sapiens
atgaagcagaatttcccactct

SEQ ID NO: 7190195 - DNA, 22 bp, Homo sapiens
atgaagcaacagccctcctatt

SEQ ID NO: 7190196 - DNA, 21 bp, Homo sapiens
atgaagcaagggtcacacgtg

SEQ ID NO: 7190197 - DNA, 22 bp, Homo sapiens
atgaagcaattagaaacttgaa

SEQ ID NO: 7190198 - DNA, 22 bp, Homo sapiens
atgaagatttcccagagacatg

SEQ ID NO: 7190199 - DNA, 22 bp, Homo sapiens
atgaagatttcccagagacatg

SEQ ID NO: 7190200 - DNA, 22 bp, Homo sapiens
atgaagattctatttatcactt

SEQ ID NO: 7190201 - DNA, 19 bp, Homo sapiens
atgaagattggtaaattca

SEQ ID NO: 7190202 - DNA, 19 bp, Homo sapiens
atgaagattggtaaattca

SEQ ID NO: 7190203 - DNA, 22 bp, Homo sapiens
atgaagatttataattgccttt

SEQ ID NO: 7190204 - DNA, 22 bp, Homo sapiens
atgaagatattcttgttttctg

SEQ ID NO: 7190205 - DNA, 22 bp, Homo sapiens
atgaagatattcttgttttctg

SEQ ID NO: 7190206 - DNA, 22 bp, Homo sapiens
atgaagatattcttgttttctg

SEQ ID NO: 7190207 - DNA, 21 bp, Homo sapiens
atgaagatgacaatttgagag

SEQ ID NO: 7190208 - DNA, 21 bp, Homo sapiens
atgaagatgacaatttgagag

SEQ ID NO: 7190209 - DNA, 22 bp, Homo sapiens
atgaagatggttcaactggcct

SEQ ID NO: 7190210 - DNA, 22 bp, Homo sapiens
atgaagatggttcaactggcct

SEQ ID NO: 7190211 - DNA, 22 bp, Homo sapiens
atgaagatgtgaaggctggatt

SEQ ID NO: 7190212 - DNA, 22 bp, Homo sapiens
atgaagatgtgaaggctggatt

SEQ ID NO: 7190213 - DNA, 22 bp, Homo sapiens
atgaagattctatttatcactt

SEQ ID NO: 7190214 - DNA, 22 bp, Homo sapiens
atgaagataatagcattggttg

SEQ ID NO: 7190215 - DNA, 22 bp, Homo sapiens
atgaagataatagcattggttg

SEQ ID NO: 7190216 - DNA, 22 bp, Homo sapiens
atgaagatacaggcagggccat

SEQ ID NO: 7190217 - DNA, 22 bp, Homo sapiens
atgaagataagaccaggctgga

SEQ ID NO: 7190218 - DNA, 22 bp, Homo sapiens
atgaagataatagcattggttg

SEQ ID NO: 7190219 - DNA, 22 bp, Homo sapiens
atgaagactatttgaaggtgcc

SEQ ID NO: 7190220 - DNA, 22 bp, Homo sapiens
atgaagactgaattgtctgaaa

SEQ ID NO: 7190221 - DNA, 22 bp, Homo sapiens
atgaagactgaattgtctgaaa

SEQ ID NO: 7190222 - DNA, 22 bp, Homo sapiens
atgaagataagaccaggctgga

SEQ ID NO: 7190223 - DNA, 22 bp, Homo sapiens
atgaggcagctgacagctgttc

SEQ ID NO: 7190224 - DNA, 22 bp, Homo sapiens
atgaggcagctgctggagaacg

SEQ ID NO: 7190225 - DNA, 22 bp, Homo sapiens
atgaggcagctggctttctccc

SEQ ID NO: 7190226 - DNA, 22 bp, Homo sapiens
atgaggcaggagtgcagtggca

SEQ ID NO: 7190227 - DNA, 22 bp, Homo sapiens
atgaggcaggagtgcagtggca

SEQ ID NO: 7190228 - DNA, 22 bp, Homo sapiens
atgaggcaggaaaggcgtatct

SEQ ID NO: 7190229 - DNA, 22 bp, Homo sapiens
atgaggcaggagcggggaccct

SEQ ID NO: 7190230 - DNA, 22 bp, Homo sapiens
atgaggcaggattaagctatca

SEQ ID NO: 7190231 - DNA, 22 bp, Homo sapiens
atgaggcaggtggaggctgcca

SEQ ID NO: 7190232 - DNA, 22 bp, Homo sapiens
atgaggcaggatattaactttt

SEQ ID NO: 7190233 - DNA, 22 bp, Homo sapiens
atgaggcagtacacacaaagcc

SEQ ID NO: 7190234 - DNA, 18 bp, Homo sapiens
gaaagatgaacttttttc

SEQ ID NO: 7190235 - DNA, 18 bp, Homo sapiens
gaaagatgaacttttttc

SEQ ID NO: 7190236 - DNA, 20 bp, Homo sapiens
gaaagattgtaagaggcaga

SEQ ID NO: 7190237 - DNA, 19 bp, Homo sapiens
gaaagatttcagttgagga

SEQ ID NO: 7190238 - DNA, 19 bp, Homo sapiens
gaaagatttcagttgagga

SEQ ID NO: 7190239 - DNA, 22 bp, Homo sapiens
gaaagcaagttgactgcagaat

SEQ ID NO: 7190240 - DNA, 22 bp, Homo sapiens
gaaagcaagttgactgcagaat

SEQ ID NO: 7190241 - DNA, 22 bp, Homo sapiens
gaaagcaagttgactgcagaat

SEQ ID NO: 7190242 - DNA, 22 bp, Homo sapiens
gaaagcaatttgtgtaatctgt

SEQ ID NO: 7190243 - DNA, 22 bp, Homo sapiens
gaaagcaatttgtgtaatctgt

SEQ ID NO: 7190244 - DNA, 22 bp, Homo sapiens
gaaagcacagttctgaccatgt

SEQ ID NO: 7190245 - DNA, 22 bp, Homo sapiens
gaaagcacagttctgaccatgt

SEQ ID NO: 7190246 - DNA, 22 bp, Homo sapiens
gaaagcactaaaagagaatcct

SEQ ID NO: 7190247 - DNA, 23 bp, Homo sapiens
atgcagagaataacaaatgccat

SEQ ID NO: 7190248 - DNA, 19 bp, Homo sapiens
atgcagagaatggcagtag

SEQ ID NO: 7190249 - DNA, 22 bp, Homo sapiens
atgcagagacagatgtggcatg

SEQ ID NO: 7190250 - DNA, 22 bp, Homo sapiens
atgcagagcttccagtggcctg

SEQ ID NO: 7190251 - DNA, 22 bp, Homo sapiens
atgcagaattgctaagtatctg

SEQ ID NO: 7190252 - DNA, 22 bp, Homo sapiens
atgcagacatgggagagttgag

SEQ ID NO: 7190253 - DNA, 22 bp, Homo sapiens
atgcagacatgggagagttgag

SEQ ID NO: 7190254 - DNA, 21 bp, Homo sapiens
atgcagagaactccagggaag

SEQ ID NO: 7190255 - DNA, 21 bp, Homo sapiens
atgcagagaactccagggaag

SEQ ID NO: 7190256 - DNA, 23 bp, Homo sapiens
atgcagagaataacaaatgccat

SEQ ID NO: 7190257 - DNA, 22 bp, Homo sapiens
atgcagataagaatcaggtttg

SEQ ID NO: 7190258 - DNA, 22 bp, Homo sapiens
atgcagatatgcaaactgtagt

SEQ ID NO: 7190259 - DNA, 22 bp, Homo sapiens
atgcagatatgcaaactgtagt

SEQ ID NO: 7190260 - DNA, 22 bp, Homo sapiens
atgcagatctgtgaaaggaata

SEQ ID NO: 7190261 - DNA, 22 bp, Homo sapiens
atgcagatgggtgccaaagtct

SEQ ID NO: 7190262 - DNA, 22 bp, Homo sapiens
atgcagatgggtgccaaagtct

SEQ ID NO: 7190263 - DNA, 22 bp, Homo sapiens
atgcagatggtggatggagaaa

SEQ ID NO: 7190264 - DNA, 22 bp, Homo sapiens
atgcagatgttcctactgtgtt

SEQ ID NO: 7190265 - DNA, 22 bp, Homo sapiens
atgcagatgtttggttcattgt

SEQ ID NO: 7190266 - DNA, 22 bp, Homo sapiens
atgcagatttaattagtatagg

SEQ ID NO: 7190267 - DNA, 22 bp, Homo sapiens
atgcagatttaattagtatagg

SEQ ID NO: 7190268 - DNA, 22 bp, Homo sapiens
atgcacagtatgtagggtctat

SEQ ID NO: 7190269 - DNA, 19 bp, Homo sapiens
atgcacagtcatttgtaag

SEQ ID NO: 7190270 - DNA, 22 bp, Homo sapiens
atgcacttcaagcatctctctg

SEQ ID NO: 7190271 - DNA, 22 bp, Homo sapiens
atgcacttgcgtgtttgcaaat

SEQ ID NO: 7190272 - DNA, 22 bp, Homo sapiens
atgcagaaagagaatgtaatgt

SEQ ID NO: 7190273 - DNA, 22 bp, Homo sapiens
atgcagaaagcggcaaacaggt

SEQ ID NO: 7190274 - DNA, 22 bp, Homo sapiens
atgcagaacgtttgtgaaactt

SEQ ID NO: 7190275 - DNA, 22 bp, Homo sapiens
atgcagaagaaaccatggcttc

SEQ ID NO: 7190276 - DNA, 22 bp, Homo sapiens
atgcagaagactgaaaagctga

SEQ ID NO: 7190277 - DNA, 22 bp, Homo sapiens
atgcagaagcagaacttacaca

SEQ ID NO: 7190278 - DNA, 22 bp, Homo sapiens
atgcagaagactgaaaagctga

SEQ ID NO: 7190279 - DNA, 22 bp, Homo sapiens
atgcagaagcagaacttacaca

SEQ ID NO: 7190280 - DNA, 22 bp, Homo sapiens
atgcagaaggagccatgcttgc

SEQ ID NO: 7190281 - DNA, 22 bp, Homo sapiens
atgcagaatcttgagaaaaatt

SEQ ID NO: 7190282 - DNA, 22 bp, Homo sapiens
atgcagaatcttgagaaaaatt

SEQ ID NO: 7190283 - DNA, 22 bp, Homo sapiens
atgcaaaataaggcagaaacat

SEQ ID NO: 7190284 - DNA, 22 bp, Homo sapiens
atgcaaaataaggcagaaacat

SEQ ID NO: 7190285 - DNA, 22 bp, Homo sapiens
atgcaaaagtagttgcagtttt

SEQ ID NO: 7190286 - DNA, 22 bp, Homo sapiens
atgcaaaataaggcagaaacat

SEQ ID NO: 7190287 - DNA, 22 bp, Homo sapiens
atgcaaaataaggcagaaacat

SEQ ID NO: 7190288 - DNA, 22 bp, Homo sapiens
atgcaaaagtaattgcaatttt

SEQ ID NO: 7190289 - DNA, 22 bp, Homo sapiens
atgcaaaagtaattgcaatttt

SEQ ID NO: 7190290 - DNA, 22 bp, Homo sapiens
atgcaaagcacacacagaatcc

SEQ ID NO: 7190291 - DNA, 22 bp, Homo sapiens
atgcaaaataaggcagaaacat

SEQ ID NO: 7190292 - DNA, 22 bp, Homo sapiens
atgcaaaattaccattctgttc

SEQ ID NO: 7190293 - DNA, 23 bp, Homo sapiens
atgcaaagtgctgtcatgtagac

SEQ ID NO: 7190294 - DNA, 23 bp, Homo sapiens
atgcaaagtgctgtcatgtagac

SEQ ID NO: 7190295 - DNA, 22 bp, Homo sapiens
atgcaaataaacagtctagttg

SEQ ID NO: 7190296 - DNA, 22 bp, Homo sapiens
atgcaaagcaccacactaagat

SEQ ID NO: 7190297 - DNA, 22 bp, Homo sapiens
atgcaaagcaccacactaagat

SEQ ID NO: 7190298 - DNA, 22 bp, Homo sapiens
atgcaaataaacagtctagttg

SEQ ID NO: 7190299 - DNA, 22 bp, Homo sapiens
atgcaaataaacagtctagttg

SEQ ID NO: 7190300 - DNA, 22 bp, Homo sapiens
atgcaaataaagcaactataca

SEQ ID NO: 7190301 - DNA, 22 bp, Homo sapiens
atgcaaataaagcaactataca

SEQ ID NO: 7190302 - DNA, 22 bp, Homo sapiens
atgcaaatcttaagtatgtgtg

SEQ ID NO: 7190303 - DNA, 22 bp, Homo sapiens
atgcaaatcttaagtatgtgtg

SEQ ID NO: 7190304 - DNA, 22 bp, Homo sapiens
atgcaaatcttaagtatgtgtg

SEQ ID NO: 7190305 - DNA, 22 bp, Homo sapiens
atgcaaatgaacatgttgctag

SEQ ID NO: 7190306 - DNA, 22 bp, Homo sapiens
atgcacagtaatgagctggttg

SEQ ID NO: 7190307 - DNA, 20 bp, Homo sapiens
atgcaaatcccaaaatcagg

SEQ ID NO: 7190308 - DNA, 22 bp, Homo sapiens
atgcaaatattaatggtatgac

SEQ ID NO: 7190309 - DNA, 20 bp, Homo sapiens
atgcaaatcccaaaatcagg

SEQ ID NO: 7190310 - DNA, 22 bp, Homo sapiens
atgcaaataagtgcaggcgtgg

SEQ ID NO: 7190311 - DNA, 22 bp, Homo sapiens
atgcaaataagtgcaggcgtgg

SEQ ID NO: 7190312 - DNA, 22 bp, Homo sapiens
atgcaaataagtgcaggcgtgg

SEQ ID NO: 7190313 - DNA, 19 bp, Homo sapiens
atgcaaatagatttggaat

SEQ ID NO: 7190314 - DNA, 19 bp, Homo sapiens
atgcaaatagatttggaat

SEQ ID NO: 7190315 - DNA, 22 bp, Homo sapiens
atgcaaatattaatggtatgac

SEQ ID NO: 7190316 - DNA, 22 bp, Homo sapiens
atgcatatgccgtagaataagt

SEQ ID NO: 7190317 - DNA, 22 bp, Homo sapiens
atgcatatgccgtagaataagt

SEQ ID NO: 7190318 - DNA, 22 bp, Homo sapiens
atgcatatgccgtagaataagt

SEQ ID NO: 7190319 - DNA, 22 bp, Homo sapiens
atgcatatgcatggacactcag

SEQ ID NO: 7190320 - DNA, 22 bp, Homo sapiens
atgcatatgccgtagaataagt

SEQ ID NO: 7190321 - DNA, 22 bp, Homo sapiens
atgcatcatggaaaactcagtt

SEQ ID NO: 7190322 - DNA, 22 bp, Homo sapiens
atgcatctatgacttagacatt

SEQ ID NO: 7190323 - DNA, 22 bp, Homo sapiens
atgcatctattcccaagggcag

SEQ ID NO: 7190324 - DNA, 20 bp, Homo sapiens
atgcatctggtatctttcct

SEQ ID NO: 7190325 - DNA, 22 bp, Homo sapiens
atgcatgaaagaatccaagcct

SEQ ID NO: 7190326 - DNA, 22 bp, Homo sapiens
atgcatgagaatatcccatgct

SEQ ID NO: 7190327 - DNA, 22 bp, Homo sapiens
atgcatgagaatatcccatgct

SEQ ID NO: 7190328 - DNA, 22 bp, Homo sapiens
atgcatgagctttgtgatcctg

SEQ ID NO: 7190329 - DNA, 22 bp, Homo sapiens
atgcatgagtcactcagtgcag

SEQ ID NO: 7190330 - DNA, 22 bp, Homo sapiens
atgcatgatcctgagcaaccca

SEQ ID NO: 7190331 - DNA, 22 bp, Homo sapiens
atgcatgatgaacttgctttca

SEQ ID NO: 7190332 - DNA, 22 bp, Homo sapiens
atgcatgcacacactgcattgc

SEQ ID NO: 7190333 - DNA, 20 bp, Homo sapiens
atgcatgcatgcacatgcac

SEQ ID NO: 7190334 - DNA, 22 bp, Homo sapiens
atgcatgcatccacaagttaaa

SEQ ID NO: 7190335 - DNA, 22 bp, Homo sapiens
atgcatgcattgtttatcatgg

SEQ ID NO: 7190336 - DNA, 22 bp, Homo sapiens
atgcatgcttcttatagtactt

SEQ ID NO: 7190337 - DNA, 22 bp, Homo sapiens
atgcatgcttcttatagtactt

SEQ ID NO: 7190338 - DNA, 23 bp, Homo sapiens
atgcaggacttataaggtaaggt

SEQ ID NO: 7190339 - DNA, 22 bp, Homo sapiens
atgcatatgcatggacactcag

SEQ ID NO: 7190340 - DNA, 22 bp, Homo sapiens
atgcatatgcatggacactcag

SEQ ID NO: 7190341 - DNA, 22 bp, Homo sapiens
atgcaggaagagccctggagct

SEQ ID NO: 7190342 - DNA, 22 bp, Homo sapiens
atgcagctgctgacagctttca

SEQ ID NO: 7190343 - DNA, 22 bp, Homo sapiens
atgcagcagtttacaaagcaat

SEQ ID NO: 7190344 - DNA, 22 bp, Homo sapiens
atgcagcagtttacaaagcaat

SEQ ID NO: 7190345 - DNA, 22 bp, Homo sapiens
atgcagccccctggtgcccggg

SEQ ID NO: 7190346 - DNA, 22 bp, Homo sapiens
atgcagctcatttgtttaaaag

SEQ ID NO: 7190347 - DNA, 22 bp, Homo sapiens
gacactctttcctcttctggaa

SEQ ID NO: 7190348 - DNA, 22 bp, Homo sapiens
atgcatttgacgggatatattt

SEQ ID NO: 7190349 - DNA, 22 bp, Homo sapiens
atgcatttatgtgtgtacattg

SEQ ID NO: 7190350 - DNA, 20 bp, Homo sapiens
atgcattgtgattctgtttt

SEQ ID NO: 7190351 - DNA, 20 bp, Homo sapiens
atgcattgtgattctgtttt

SEQ ID NO: 7190352 - DNA, 19 bp, Homo sapiens
atgcattgtttgaagttga

SEQ ID NO: 7190353 - DNA, 22 bp, Homo sapiens
atgcatttatgtgtgtacattg

SEQ ID NO: 7190354 - DNA, 22 bp, Homo sapiens
atgcatttatgtgtgtacattg

SEQ ID NO: 7190355 - DNA, 22 bp, Homo sapiens
atgcattgtctggtttcatttt

SEQ ID NO: 7190356 - DNA, 22 bp, Homo sapiens
atgcattgtatgaaaggaaata

SEQ ID NO: 7190357 - DNA, 22 bp, Homo sapiens
atgcattgtcaggcaatttcat

SEQ ID NO: 7190358 - DNA, 22 bp, Homo sapiens
atgcattgcttgagggtaggaa

SEQ ID NO: 7190359 - DNA, 22 bp, Homo sapiens
atgcattggataagaaccccat

SEQ ID NO: 7190360 - DNA, 22 bp, Homo sapiens
atgcattggtcagggtcttagg

SEQ ID NO: 7190361 - DNA, 22 bp, Homo sapiens
atgcattgtaacgatgtgcaca

SEQ ID NO: 7190362 - DNA, 22 bp, Homo sapiens
atgcattcattcattctttcta

SEQ ID NO: 7190363 - DNA, 22 bp, Homo sapiens
atgcattctagcctggacaaca

SEQ ID NO: 7190364 - DNA, 22 bp, Homo sapiens
atgcattctggaaagtagcaat

SEQ ID NO: 7190365 - DNA, 22 bp, Homo sapiens
atgcattgaggatgacatgagt

SEQ ID NO: 7190366 - DNA, 22 bp, Homo sapiens
atgcattgaggatgacatgagt

SEQ ID NO: 7190367 - DNA, 22 bp, Homo sapiens
atgcattgctcaacagaataca

SEQ ID NO: 7190368 - DNA, 22 bp, Homo sapiens
atgcattgctgctttcaaaaca

SEQ ID NO: 7190369 - DNA, 21 bp, Homo sapiens
atgcatggatttcagtgagag

SEQ ID NO: 7190370 - DNA, 21 bp, Homo sapiens
atgcatggatttcagtgagag

SEQ ID NO: 7190371 - DNA, 21 bp, Homo sapiens
atgcatggatttcagtgagag

SEQ ID NO: 7190372 - DNA, 22 bp, Homo sapiens
atgcatggtctgaagtcaacct

SEQ ID NO: 7190373 - DNA, 22 bp, Homo sapiens
atgcatggtctgaagtcaacct

SEQ ID NO: 7190374 - DNA, 22 bp, Homo sapiens
atgcatgtatatattacactca

SEQ ID NO: 7190375 - DNA, 22 bp, Homo sapiens
atgcatgtattatctagatgag

SEQ ID NO: 7190376 - DNA, 22 bp, Homo sapiens
atgcatgtattcatgtgtgaca

SEQ ID NO: 7190377 - DNA, 22 bp, Homo sapiens
atgcatgtctgccagttgctta

SEQ ID NO: 7190378 - DNA, 22 bp, Homo sapiens
atgcatgtgcatggctctatct

SEQ ID NO: 7190379 - DNA, 22 bp, Homo sapiens
atgcatgtgtacatgcatagca

SEQ ID NO: 7190380 - DNA, 22 bp, Homo sapiens
atgcatgtgtgaattatttgac

SEQ ID NO: 7190381 - DNA, 22 bp, Homo sapiens
atgcatgtgtgaattatttgac

SEQ ID NO: 7190382 - DNA, 22 bp, Homo sapiens
atgcatgtgtgagagcaagagg

SEQ ID NO: 7190383 - DNA, 22 bp, Homo sapiens
atgcatgttaagctcttaaaat

SEQ ID NO: 7190384 - DNA, 22 bp, Homo sapiens
atgcatgttaagctcttaaaat

SEQ ID NO: 7190385 - DNA, 21 bp, Homo sapiens
atgcatgttacagtatatgcc

SEQ ID NO: 7190386 - DNA, 22 bp, Homo sapiens
atgcatgttactgcccccgtct

SEQ ID NO: 7190387 - DNA, 22 bp, Homo sapiens
atgcattatcaattgatgtagg

SEQ ID NO: 7190388 - DNA, 22 bp, Homo sapiens
atgcattatcaattgatgtagg

SEQ ID NO: 7190389 - DNA, 22 bp, Homo sapiens
atgcattcagcggaatgcttag

SEQ ID NO: 7190390 - DNA, 22 bp, Homo sapiens
atgcattaggctctggaaataa

SEQ ID NO: 7190391 - DNA, 22 bp, Homo sapiens
atgcattcatgaagattgcaca

SEQ ID NO: 7190392 - DNA, 22 bp, Homo sapiens
gaggggagcatgatctagattg

SEQ ID NO: 7190393 - DNA, 22 bp, Homo sapiens
gaggggagcatgatctagattg

SEQ ID NO: 7190394 - DNA, 16 bp, Homo sapiens
gaggggagcagtaggc

SEQ ID NO: 7190395 - DNA, 16 bp, Homo sapiens
gaggggagcagtaggc

SEQ ID NO: 7190396 - DNA, 22 bp, Homo sapiens
gaggggagcatgatctagattg

SEQ ID NO: 7190397 - DNA, 22 bp, Homo sapiens
gaggggagcatgatctagattg

SEQ ID NO: 7190398 - DNA, 16 bp, Homo sapiens
gaggggagcagtaggc

SEQ ID NO: 7190399 - DNA, 22 bp, Homo sapiens
gaggggagcccccatcctccag

SEQ ID NO: 7190400 - DNA, 22 bp, Homo sapiens
gaggggagcccccatcctccag

SEQ ID NO: 7190401 - DNA, 22 bp, Homo sapiens
gaggggagcccccatcctccag

SEQ ID NO: 7190402 - DNA, 22 bp, Homo sapiens
atgtgtcttgagggggatggag

SEQ ID NO: 7190403 - DNA, 22 bp, Homo sapiens
atgtgtcttgagggggatggag

SEQ ID NO: 7190404 - DNA, 22 bp, Homo sapiens
gaggggagcccccatcctccag

SEQ ID NO: 7190405 - DNA, 22 bp, Homo sapiens
gaggggagcatgatctagattg

SEQ ID NO: 7190406 - DNA, 22 bp, Homo sapiens
gaggggagcatgatctagattg

SEQ ID NO: 7190407 - DNA, 22 bp, Homo sapiens
gaggggagacagggaaatcagt

SEQ ID NO: 7190408 - DNA, 22 bp, Homo sapiens
gaggggagacagggaaatcagt

SEQ ID NO: 7190409 - DNA, 22 bp, Homo sapiens
gaggggagacagggaaatcagt

SEQ ID NO: 7190410 - DNA, 22 bp, Homo sapiens
gaggggagacagggaaatcagt

SEQ ID NO: 7190411 - DNA, 22 bp, Homo sapiens
gaggggagaaggcactaaccag

SEQ ID NO: 7190412 - DNA, 22 bp, Homo sapiens
gaggggagaaggcactaaccag

SEQ ID NO: 7190413 - DNA, 22 bp, Homo sapiens
gaggggagaaggcactaaccag

SEQ ID NO: 7190414 - DNA, 22 bp, Homo sapiens
gaggggagacagggaaatcagt

SEQ ID NO: 7190415 - DNA, 22 bp, Homo sapiens
gaggggagaggcttatggatca

SEQ ID NO: 7190416 - DNA, 22 bp, Homo sapiens
gaggggagaggcttatggatca

SEQ ID NO: 7190417 - DNA, 22 bp, Homo sapiens
gaggggagaggcttatggatca

SEQ ID NO: 7190418 - DNA, 22 bp, Homo sapiens
gaggggagaggcttatggatca

SEQ ID NO: 7190419 - DNA, 22 bp, Homo sapiens
gaggggagaggcttatggatca

SEQ ID NO: 7190420 - DNA, 22 bp, Homo sapiens
atgtgtgtgcatttctctccct

SEQ ID NO: 7190421 - DNA, 22 bp, Homo sapiens
atgtgtgtgcatttctctccct

SEQ ID NO: 7190422 - DNA, 22 bp, Homo sapiens
atgtgtgtgcatttctctccct

SEQ ID NO: 7190423 - DNA, 22 bp, Homo sapiens
atgtgtgtgcatttctctccct

SEQ ID NO: 7190424 - DNA, 22 bp, Homo sapiens
atgtgtgtgatgggcgccgcca

SEQ ID NO: 7190425 - DNA, 22 bp, Homo sapiens
atgtgtgtgatgggcgccgcca

SEQ ID NO: 7190426 - DNA, 22 bp, Homo sapiens
atgtgtgtgcatttctctccct

SEQ ID NO: 7190427 - DNA, 22 bp, Homo sapiens
atgtgtgtatgtgcctatatct

SEQ ID NO: 7190428 - DNA, 22 bp, Homo sapiens
atgtgtgtatgtgcctatatct

SEQ ID NO: 7190429 - DNA, 22 bp, Homo sapiens
atgtgtgtatgtgcctatatct

SEQ ID NO: 7190430 - DNA, 22 bp, Homo sapiens
atgtgtgtatgtgcctatatct

SEQ ID NO: 7190431 - DNA, 22 bp, Homo sapiens
atgtgtgtgatgggcgccgcca

SEQ ID NO: 7190432 - DNA, 22 bp, Homo sapiens
atgtgtgtgatgggcgccgcca

SEQ ID NO: 7190433 - DNA, 22 bp, Homo sapiens
atgtgtgtgatgggcgccgcca

SEQ ID NO: 7190434 - DNA, 22 bp, Homo sapiens
atgtgtgtgatgggcgccgcca

SEQ ID NO: 7190435 - DNA, 22 bp, Homo sapiens
atgtgtgtatatatagtcattt

SEQ ID NO: 7190436 - DNA, 22 bp, Homo sapiens
atgtgtgtatatatagtcattt

SEQ ID NO: 7190437 - DNA, 22 bp, Homo sapiens
atgtgtgtatgtgcctatatct

SEQ ID NO: 7190438 - DNA, 22 bp, Homo sapiens
atgtgtgtatatatagtcattt

SEQ ID NO: 7190439 - DNA, 22 bp, Homo sapiens
atgtgtcttgcggcagttggta

SEQ ID NO: 7190440 - DNA, 22 bp, Homo sapiens
atgtgtcttgcggcagttggta

SEQ ID NO: 7190441 - DNA, 22 bp, Homo sapiens
atgtgtcttggagttttaatgt

SEQ ID NO: 7190442 - DNA, 22 bp, Homo sapiens
atgtgtcttggagttttaatgt

SEQ ID NO: 7190443 - DNA, 22 bp, Homo sapiens
atgtgtgtacacacgtgactct

SEQ ID NO: 7190444 - DNA, 22 bp, Homo sapiens
atgtgtgtatatatagtcattt

SEQ ID NO: 7190445 - DNA, 22 bp, Homo sapiens
atgtgtgtatatatagtcattt

SEQ ID NO: 7190446 - DNA, 22 bp, Homo sapiens
atgtgtgtatatatagtcattt

SEQ ID NO: 7190447 - DNA, 22 bp, Homo sapiens
atgtgtgtatatatagtcattt

SEQ ID NO: 7190448 - DNA, 22 bp, Homo sapiens
gaggctgctttgatgacaggag

SEQ ID NO: 7190449 - DNA, 22 bp, Homo sapiens
gaggctgctttgatgacaggag

SEQ ID NO: 7190450 - DNA, 22 bp, Homo sapiens
atgtggcttggcagggaatatg

SEQ ID NO: 7190451 - DNA, 22 bp, Homo sapiens
gaggctgctttcctcctatcct

SEQ ID NO: 7190452 - DNA, 22 bp, Homo sapiens
gaggctgctgttagccctgggc

SEQ ID NO: 7190453 - DNA, 22 bp, Homo sapiens
gaggctgctttgatgacaggag

SEQ ID NO: 7190454 - DNA, 22 bp, Homo sapiens
atgtgtattaccctttcattcc

SEQ ID NO: 7190455 - DNA, 22 bp, Homo sapiens
atgtgtattacctcgattgtga

SEQ ID NO: 7190456 - DNA, 22 bp, Homo sapiens
atgtgtattagttagtttaatg

SEQ ID NO: 7190457 - DNA, 22 bp, Homo sapiens
atgtgtattagttagtttaatg

SEQ ID NO: 7190458 - DNA, 22 bp, Homo sapiens
atgtgtattttgtactattggg

SEQ ID NO: 7190459 - DNA, 22 bp, Homo sapiens
atgtgtcaattttcaaatgctt

SEQ ID NO: 7190460 - DNA, 22 bp, Homo sapiens
atgtgtcaattttcaaatgctt

SEQ ID NO: 7190461 - DNA, 22 bp, Homo sapiens
atgtgtcaggcaatagaagcta

SEQ ID NO: 7190462 - DNA, 22 bp, Homo sapiens
atgtgtcaggcaatagaagcta

SEQ ID NO: 7190463 - DNA, 22 bp, Homo sapiens
atgtgtcaggcaatagaagcta

SEQ ID NO: 7190464 - DNA, 22 bp, Homo sapiens
atgtgtcaggtacactcattag

SEQ ID NO: 7190465 - DNA, 22 bp, Homo sapiens
atgtgtcattatccagaataac

SEQ ID NO: 7190466 - DNA, 22 bp, Homo sapiens
atgtgtcattatccagaataac

SEQ ID NO: 7190467 - DNA, 22 bp, Homo sapiens
atgtgtcatttttctgtgcata

SEQ ID NO: 7190468 - DNA, 22 bp, Homo sapiens
atgtgtcatttttctgtgcata

SEQ ID NO: 7190469 - DNA, 22 bp, Homo sapiens
atgtgtccaaggccacaatagc

SEQ ID NO: 7190470 - DNA, 22 bp, Homo sapiens
atgtgtccacaggtgtgagaga

SEQ ID NO: 7190471 - DNA, 22 bp, Homo sapiens
atgtgtccattatcagttctgg

SEQ ID NO: 7190472 - DNA, 22 bp, Homo sapiens
atgtgtcctctggcaggtttag

SEQ ID NO: 7190473 - DNA, 22 bp, Homo sapiens
atgtgtcctgctgtgtcacaca

SEQ ID NO: 7190474 - DNA, 22 bp, Homo sapiens
gaggggaagacttctggacagt

SEQ ID NO: 7190475 - DNA, 22 bp, Homo sapiens
gaggctgcggggaggagcctgc

SEQ ID NO: 7190476 - DNA, 20 bp, Homo sapiens
gaggctgcggactgctggac

SEQ ID NO: 7190477 - DNA, 20 bp, Homo sapiens
gaggctgcggactgctggac

SEQ ID NO: 7190478 - DNA, 22 bp, Homo sapiens
gaggctgctgagagccctgttt

SEQ ID NO: 7190479 - DNA, 22 bp, Homo sapiens
gaggctgctgttagccctgggc

SEQ ID NO: 7190480 - DNA, 22 bp, Homo sapiens
gaggctgctgttagccctgggc

SEQ ID NO: 7190481 - DNA, 22 bp, Homo sapiens
gaggctgcggggaggagcctgc

SEQ ID NO: 7190482 - DNA, 22 bp, Homo sapiens
gaggctgcggggaggagcctgc

SEQ ID NO: 7190483 - DNA, 22 bp, Homo sapiens
gaggctgctgagagccctgttt

SEQ ID NO: 7190484 - DNA, 22 bp, Homo sapiens
gaggctgctgagagccctgttt

SEQ ID NO: 7190485 - DNA, 22 bp, Homo sapiens
gaggctgctgagagccctgttt

SEQ ID NO: 7190486 - DNA, 22 bp, Homo sapiens
gaggctgccccttcctcagctg

SEQ ID NO: 7190487 - DNA, 20 bp, Homo sapiens
gaggctgcggactgctggac

SEQ ID NO: 7190488 - DNA, 20 bp, Homo sapiens
gaggctgcggactgctggac

SEQ ID NO: 7190489 - DNA, 22 bp, Homo sapiens
gaggctgccccttcctcagctg

SEQ ID NO: 7190490 - DNA, 20 bp, Homo sapiens
gaggctgcggactgctggac

SEQ ID NO: 7190491 - DNA, 22 bp, Homo sapiens
atgtgaaacgcaatgggatcat

SEQ ID NO: 7190492 - DNA, 21 bp, Homo sapiens
atgtgaaaccttccacgctga

SEQ ID NO: 7190493 - DNA, 22 bp, Homo sapiens
atgtgaaaaatttcttattaca

SEQ ID NO: 7190494 - DNA, 22 bp, Homo sapiens
atgtgaaaatccaatggcagca

SEQ ID NO: 7190495 - DNA, 22 bp, Homo sapiens
atgtcttttatggagatgtcat

SEQ ID NO: 7190496 - DNA, 22 bp, Homo sapiens
atgtgaaaaatttcttattaca

SEQ ID NO: 7190497 - DNA, 22 bp, Homo sapiens
atgtcttttatggagatgtcat

SEQ ID NO: 7190498 - DNA, 22 bp, Homo sapiens
atgtctttggctttgacatggc

SEQ ID NO: 7190499 - DNA, 22 bp, Homo sapiens
atgtctttggctttgacatggc

SEQ ID NO: 7190500 - DNA, 22 bp, Homo sapiens
atgtctttgccatagttcatat

SEQ ID NO: 7190501 - DNA, 22 bp, Homo sapiens
atgtctttgccatagttcatat

SEQ ID NO: 7190502 - DNA, 22 bp, Homo sapiens
atgtctttctcatacaagccca

SEQ ID NO: 7190503 - DNA, 22 bp, Homo sapiens
atgtctttcttatggtctgttg

SEQ ID NO: 7190504 - DNA, 22 bp, Homo sapiens
atgtctttcttgtgtcccaaga

SEQ ID NO: 7190505 - DNA, 23 bp, Homo sapiens
gaggcctggccctgccacatctc

SEQ ID NO: 7190506 - DNA, 22 bp, Homo sapiens
gaggcctggctctgccctcctg

SEQ ID NO: 7190507 - DNA, 22 bp, Homo sapiens
gaggcctggctctgccctcctg

SEQ ID NO: 7190508 - DNA, 22 bp, Homo sapiens
gaggcctggagccgcctaggcg

SEQ ID NO: 7190509 - DNA, 22 bp, Homo sapiens
gaggcctggagccgcctaggcg

SEQ ID NO: 7190510 - DNA, 23 bp, Homo sapiens
gaggcctggccctgccacatctc

SEQ ID NO: 7190511 - DNA, 22 bp, Homo sapiens
gaggcctggctgtcagtcccca

SEQ ID NO: 7190512 - DNA, 22 bp, Homo sapiens
gaggcctggctgtcagtcccca

SEQ ID NO: 7190513 - DNA, 22 bp, Homo sapiens
gaggcctgggagcctgtcctcc

SEQ ID NO: 7190514 - DNA, 22 bp, Homo sapiens
gaggcctgggagcctgtcctcc

SEQ ID NO: 7190515 - DNA, 22 bp, Homo sapiens
gaggcctggctgggaggaggtg

SEQ ID NO: 7190516 - DNA, 22 bp, Homo sapiens
gaggcctggctgggaggaggtg

SEQ ID NO: 7190517 - DNA, 22 bp, Homo sapiens
gaggcctggctgggaggaggtg

SEQ ID NO: 7190518 - DNA, 22 bp, Homo sapiens
gaggcctggctgggaggaggtg

SEQ ID NO: 7190519 - DNA, 22 bp, Homo sapiens
gaggcctggctgggaggaggtg

SEQ ID NO: 7190520 - DNA, 22 bp, Homo sapiens
gaggcctggctgggaggaggtg

SEQ ID NO: 7190521 - DNA, 19 bp, Homo sapiens
atgtctgggtaacagctgc

SEQ ID NO: 7190522 - DNA, 22 bp, Homo sapiens
atgtctggaggtcatctggtta

SEQ ID NO: 7190523 - DNA, 22 bp, Homo sapiens
atgtctggctaaaatccctggt

SEQ ID NO: 7190524 - DNA, 22 bp, Homo sapiens
gaggcctgggttacctactcgt

SEQ ID NO: 7190525 - DNA, 22 bp, Homo sapiens
gaggcctgggttacctactcgt

SEQ ID NO: 7190526 - DNA, 22 bp, Homo sapiens
gaggcctgggttacctactcgt

SEQ ID NO: 7190527 - DNA, 22 bp, Homo sapiens
gaggcctgggagcctgtcctcc

SEQ ID NO: 7190528 - DNA, 22 bp, Homo sapiens
gaggcctgggagcctgtcctcc

SEQ ID NO: 7190529 - DNA, 22 bp, Homo sapiens
gaggcctgggcaagggggtctg

SEQ ID NO: 7190530 - DNA, 22 bp, Homo sapiens
gaggcctgggcaagggggtctg

SEQ ID NO: 7190531 - DNA, 22 bp, Homo sapiens
gaggcctgggcaagggggtctg

SEQ ID NO: 7190532 - DNA, 22 bp, Homo sapiens
atgtctggtggtcgatgctaca

SEQ ID NO: 7190533 - DNA, 22 bp, Homo sapiens
atgtctttataaatgtataatg

SEQ ID NO: 7190534 - DNA, 22 bp, Homo sapiens
atgtctttataaatgtataatg

SEQ ID NO: 7190535 - DNA, 22 bp, Homo sapiens
atgtctttataaatgtataatg

SEQ ID NO: 7190536 - DNA, 22 bp, Homo sapiens
atgtctttattaatatcatgcc

SEQ ID NO: 7190537 - DNA, 22 bp, Homo sapiens
atgtctttcaaattctgcctag

SEQ ID NO: 7190538 - DNA, 22 bp, Homo sapiens
atgtctttcaaattctgcctag

SEQ ID NO: 7190539 - DNA, 22 bp, Homo sapiens
atgtctttcaaattctgcctag

SEQ ID NO: 7190540 - DNA, 22 bp, Homo sapiens
atgtctttctagttaagagcta

SEQ ID NO: 7190541 - DNA, 22 bp, Homo sapiens
atggggctgggattctcctcgg

SEQ ID NO: 7190542 - DNA, 22 bp, Homo sapiens
atggggctgggattctcctcgg

SEQ ID NO: 7190543 - DNA, 22 bp, Homo sapiens
atggggctgaaacatggaagag

SEQ ID NO: 7190544 - DNA, 22 bp, Homo sapiens
atggggctgaaacatggaagag

SEQ ID NO: 7190545 - DNA, 22 bp, Homo sapiens
atggggctctgcggctgctccc

SEQ ID NO: 7190546 - DNA, 22 bp, Homo sapiens
atggggctgggattctcctcgg

SEQ ID NO: 7190547 - DNA, 22 bp, Homo sapiens
atggggctgttctctgccctgc

SEQ ID NO: 7190548 - DNA, 22 bp, Homo sapiens
atggggctgttctctgccctgc

SEQ ID NO: 7190549 - DNA, 22 bp, Homo sapiens
atggtaaacatttaacaactag

SEQ ID NO: 7190550 - DNA, 22 bp, Homo sapiens
atggctggatagttgaagctct

SEQ ID NO: 7190551 - DNA, 22 bp, Homo sapiens
atggctggatttgatccatggg

SEQ ID NO: 7190552 - DNA, 22 bp, Homo sapiens
atggctggcactggcctgggtt

SEQ ID NO: 7190553 - DNA, 22 bp, Homo sapiens
atggctggatttgatccatggg

SEQ ID NO: 7190554 - DNA, 22 bp, Homo sapiens
atggctggatttgatccatggg

SEQ ID NO: 7190555 - DNA, 22 bp, Homo sapiens
atggggctctgcggctgctccc

SEQ ID NO: 7190556 - DNA, 22 bp, Homo sapiens
atggctggcactggcctgggtt

SEQ ID NO: 7190557 - DNA, 22 bp, Homo sapiens
atggtattcctttatgtagaag

SEQ ID NO: 7190558 - DNA, 22 bp, Homo sapiens
atggtattgcaacaactgtcat

SEQ ID NO: 7190559 - DNA, 22 bp, Homo sapiens
atggtattggagtaggacttgc

SEQ ID NO: 7190560 - DNA, 22 bp, Homo sapiens
atggtcaaagataaagtgatct

SEQ ID NO: 7190561 - DNA, 22 bp, Homo sapiens
atggtcaagatcctctagttta

SEQ ID NO: 7190562 - DNA, 22 bp, Homo sapiens
atggtcaagccacactcatcca

SEQ ID NO: 7190563 - DNA, 22 bp, Homo sapiens
atggtactggggtcccggagtt

SEQ ID NO: 7190564 - DNA, 22 bp, Homo sapiens
atggtatacaattatggactgt

SEQ ID NO: 7190565 - DNA, 22 bp, Homo sapiens
atggtatagagccacatgtatt

SEQ ID NO: 7190566 - DNA, 22 bp, Homo sapiens
atggtataggccattgggggca

SEQ ID NO: 7190567 - DNA, 22 bp, Homo sapiens
atggtattaagaacaattccaa

SEQ ID NO: 7190568 - DNA, 22 bp, Homo sapiens
atggtattaggaaatctgaatg

SEQ ID NO: 7190569 - DNA, 22 bp, Homo sapiens
atggtacaaaatgtataaagtc

SEQ ID NO: 7190570 - DNA, 22 bp, Homo sapiens
atggtacaatgtgtgtatcttt

SEQ ID NO: 7190571 - DNA, 22 bp, Homo sapiens
atggtacaatgtgtgtatcttt

SEQ ID NO: 7190572 - DNA, 22 bp, Homo sapiens
atggtacagataatacatgctg

SEQ ID NO: 7190573 - DNA, 22 bp, Homo sapiens
atggtacagtgcactgaatgga

SEQ ID NO: 7190574 - DNA, 19 bp, Homo sapiens
atggtacagtgtacacttg

SEQ ID NO: 7190575 - DNA, 21 bp, Homo sapiens
gagctgggcgaggctccgggg

SEQ ID NO: 7190576 - DNA, 21 bp, Homo sapiens
gagctgggcgaggctccgggg

SEQ ID NO: 7190577 - DNA, 21 bp, Homo sapiens
gagctgggcgaggctccgggg

SEQ ID NO: 7190578 - DNA, 21 bp, Homo sapiens
gagctgggcgaggctccgggg

SEQ ID NO: 7190579 - DNA, 21 bp, Homo sapiens
gagctgggcgaggctccgggg

SEQ ID NO: 7190580 - DNA, 21 bp, Homo sapiens
gagctgggcgaggctccgggg

SEQ ID NO: 7190581 - DNA, 21 bp, Homo sapiens
gagctgggcgaggctccgggg

SEQ ID NO: 7190582 - DNA, 22 bp, Homo sapiens
gagctggggcagcttaggagtg

SEQ ID NO: 7190583 - DNA, 22 bp, Homo sapiens
atgtacaatctatcacaagaag

SEQ ID NO: 7190584 - DNA, 22 bp, Homo sapiens
gagctgggctggcttcctccct

SEQ ID NO: 7190585 - DNA, 22 bp, Homo sapiens
gagctggggcagcttaggagtg

SEQ ID NO: 7190586 - DNA, 22 bp, Homo sapiens
atgtacaattctccttggtagg

SEQ ID NO: 7190587 - DNA, 22 bp, Homo sapiens
atgtacatctttataacaagct

SEQ ID NO: 7190588 - DNA, 22 bp, Homo sapiens
gagctgggcgagccggggaagt

SEQ ID NO: 7190589 - DNA, 22 bp, Homo sapiens
gagctgggcctgcgagtgctgc

SEQ ID NO: 7190590 - DNA, 22 bp, Homo sapiens
gagctgggcctgcgagtgctgc

SEQ ID NO: 7190591 - DNA, 22 bp, Homo sapiens
gagctgggcctgcgagtgctgc

SEQ ID NO: 7190592 - DNA, 22 bp, Homo sapiens
gagctgggcctgcgagtgctgc

SEQ ID NO: 7190593 - DNA, 22 bp, Homo sapiens
gagctgggcctgcgagtgctgc

SEQ ID NO: 7190594 - DNA, 22 bp, Homo sapiens
gagctgggcctgcgagtgctgc

SEQ ID NO: 7190595 - DNA, 22 bp, Homo sapiens
gagctgggcctgcgagtgctgc

SEQ ID NO: 7190596 - DNA, 22 bp, Homo sapiens
gagctgggcctgcgagtgctgc

SEQ ID NO: 7190597 - DNA, 22 bp, Homo sapiens
atggtcataagaggagggccca

SEQ ID NO: 7190598 - DNA, 22 bp, Homo sapiens
atggtcataagaggagggccca

SEQ ID NO: 7190599 - DNA, 22 bp, Homo sapiens
atggtcatatgctaattcagga

SEQ ID NO: 7190600 - DNA, 22 bp, Homo sapiens
atggtccaagtcatctttgtgt

SEQ ID NO: 7190601 - DNA, 22 bp, Homo sapiens
gagctgggcctcagaacacagt

SEQ ID NO: 7190602 - DNA, 22 bp, Homo sapiens
gaggccaggggcctggagatga

SEQ ID NO: 7190603 - DNA, 22 bp, Homo sapiens
gaggccaggggcctggagatga

SEQ ID NO: 7190604 - DNA, 22 bp, Homo sapiens
gaggccaggggcctggagatga

SEQ ID NO: 7190605 - DNA, 22 bp, Homo sapiens
gaggccaggggcctggagatga

SEQ ID NO: 7190606 - DNA, 22 bp, Homo sapiens
gaggccaggggcctggagatga

SEQ ID NO: 7190607 - DNA, 22 bp, Homo sapiens
gaggccagggtaccatcaacat

SEQ ID NO: 7190608 - DNA, 22 bp, Homo sapiens
gaggccagggtaccatcaacat

SEQ ID NO: 7190609 - DNA, 22 bp, Homo sapiens
gaggccagggtaccatcaacat

SEQ ID NO: 7190610 - DNA, 22 bp, Homo sapiens
gaggccagggtaccatcaacat

SEQ ID NO: 7190611 - DNA, 22 bp, Homo sapiens
gaggccagggatgcaatgagag

SEQ ID NO: 7190612 - DNA, 22 bp, Homo sapiens
gaggccaggggagtcagcgtcc

SEQ ID NO: 7190613 - DNA, 22 bp, Homo sapiens
gaggccagggatgcaatgagag

SEQ ID NO: 7190614 - DNA, 22 bp, Homo sapiens
gaggagctgggaccctgtcatc

SEQ ID NO: 7190615 - DNA, 22 bp, Homo sapiens
gaggagctggctgtcgggaggc

SEQ ID NO: 7190616 - DNA, 22 bp, Homo sapiens
gaggagctgggctgagagggtc

SEQ ID NO: 7190617 - DNA, 22 bp, Homo sapiens
gaggagctgggctgagagggtc

SEQ ID NO: 7190618 - DNA, 23 bp, Homo sapiens
gaggccacattcccctgcttgag

SEQ ID NO: 7190619 - DNA, 22 bp, Homo sapiens
gaggccaccctatgggtcccag

SEQ ID NO: 7190620 - DNA, 22 bp, Homo sapiens
gaggccacggaagggagctgtg

SEQ ID NO: 7190621 - DNA, 22 bp, Homo sapiens
gaggccaggagtgctgtaagtt

SEQ ID NO: 7190622 - DNA, 22 bp, Homo sapiens
gaggccaggagtgctgtaagtt

SEQ ID NO: 7190623 - DNA, 22 bp, Homo sapiens
gaggccaggaggatctctctaa

SEQ ID NO: 7190624 - DNA, 22 bp, Homo sapiens
gaggccaggagtgctgtaagtt

SEQ ID NO: 7190625 - DNA, 22 bp, Homo sapiens
gaggccaggagtgctgtaagtt

SEQ ID NO: 7190626 - DNA, 22 bp, Homo sapiens
gaggccaggagtgctgtaagtt

SEQ ID NO: 7190627 - DNA, 17 bp, Homo sapiens
gaggagctccagtaggt

SEQ ID NO: 7190628 - DNA, 22 bp, Homo sapiens
atgtactgactgtacttttaaa

SEQ ID NO: 7190629 - DNA, 22 bp, Homo sapiens
atgtactgactgtacttttaaa

SEQ ID NO: 7190630 - DNA, 19 bp, Homo sapiens
atgtacccagtgtcaatcc

SEQ ID NO: 7190631 - DNA, 19 bp, Homo sapiens
atgtacccagtgtcaatcc

SEQ ID NO: 7190632 - DNA, 20 bp, Homo sapiens
atgtactccccacaagcaac

SEQ ID NO: 7190633 - DNA, 22 bp, Homo sapiens
gaggagctctgctccatccttc

SEQ ID NO: 7190634 - DNA, 22 bp, Homo sapiens
gaggagctgaggctgaggcctc

SEQ ID NO: 7190635 - DNA, 22 bp, Homo sapiens
gaggagctgaggctgaggcctc

SEQ ID NO: 7190636 - DNA, 22 bp, Homo sapiens
gaggagctgcagggggagtcta

SEQ ID NO: 7190637 - DNA, 22 bp, Homo sapiens
gaggagctgcccgtgtgtctgc

SEQ ID NO: 7190638 - DNA, 18 bp, Homo sapiens
atgtacatttgctaaagc

SEQ ID NO: 7190639 - DNA, 18 bp, Homo sapiens
atgtacatttgctaaagc

SEQ ID NO: 7190640 - DNA, 22 bp, Homo sapiens
atgtacatttgtagtaatatca

SEQ ID NO: 7190641 - DNA, 22 bp, Homo sapiens
atgtacatttgtagtaatatca

SEQ ID NO: 7190642 - DNA, 22 bp, Homo sapiens
atgtacatttgtagtaatatca

SEQ ID NO: 7190643 - DNA, 19 bp, Homo sapiens
atgtacccagtgtcaatcc

SEQ ID NO: 7190644 - DNA, 18 bp, Homo sapiens
atgtacatgtactcacac

SEQ ID NO: 7190645 - DNA, 22 bp, Homo sapiens
atgtacatgtgaatttaggcaa

SEQ ID NO: 7190646 - DNA, 22 bp, Homo sapiens
atgtacatgtttaagtgaagga

SEQ ID NO: 7190647 - DNA, 22 bp, Homo sapiens
atgtacattattcgagtgatgg

SEQ ID NO: 7190648 - DNA, 21 bp, Homo sapiens
atgtacattcggcaacagata

SEQ ID NO: 7190649 - DNA, 22 bp, Homo sapiens
atgtacattctaagtatgtgta

SEQ ID NO: 7190650 - DNA, 22 bp, Homo sapiens
atgtacatttagatcatttctg

SEQ ID NO: 7190651 - DNA, 22 bp, Homo sapiens
atgtacatttagatcatttctg

SEQ ID NO: 7190652 - DNA, 22 bp, Homo sapiens
atgccactgcgctctagcctgg

SEQ ID NO: 7190653 - DNA, 22 bp, Homo sapiens
atgccactgcgctctagcctgg

SEQ ID NO: 7190654 - DNA, 22 bp, Homo sapiens
atgccactgcgctctagcctgg

SEQ ID NO: 7190655 - DNA, 22 bp, Homo sapiens
atgccactgcgctccagcctgg

SEQ ID NO: 7190656 - DNA, 22 bp, Homo sapiens
atgccactgcgctccagcctgg

SEQ ID NO: 7190657 - DNA, 22 bp, Homo sapiens
atgccactgcgctccagcctgg

SEQ ID NO: 7190658 - DNA, 22 bp, Homo sapiens
atgccacttcattccagcctcg

SEQ ID NO: 7190659 - DNA, 22 bp, Homo sapiens
atgccacttcattccagcctcg

SEQ ID NO: 7190660 - DNA, 22 bp, Homo sapiens
atgccacttcattccagcctcg

SEQ ID NO: 7190661 - DNA, 22 bp, Homo sapiens
atgccactgtactcaacaatag

SEQ ID NO: 7190662 - DNA, 22 bp, Homo sapiens
atggaaatggagggtgctagaa

SEQ ID NO: 7190663 - DNA, 22 bp, Homo sapiens
atggaaatggagggtgctagaa

SEQ ID NO: 7190664 - DNA, 22 bp, Homo sapiens
atggaaatgatggaacattaaa

SEQ ID NO: 7190665 - DNA, 22 bp, Homo sapiens
atggaaatgatggaacattaaa

SEQ ID NO: 7190666 - DNA, 22 bp, Homo sapiens
atggaaatgatggaacattaaa

SEQ ID NO: 7190667 - DNA, 22 bp, Homo sapiens
atggaaatgatggaacattaaa

SEQ ID NO: 7190668 - DNA, 22 bp, Homo sapiens
atgccacttcattccagcctcg

SEQ ID NO: 7190669 - DNA, 22 bp, Homo sapiens
atgccacttcattccagcctcg

SEQ ID NO: 7190670 - DNA, 22 bp, Homo sapiens
atgccacttcattccagcctcg

SEQ ID NO: 7190671 - DNA, 22 bp, Homo sapiens
atggaaatggagtgtgcttgct

SEQ ID NO: 7190672 - DNA, 22 bp, Homo sapiens
atggaaatggagggtgctagaa

SEQ ID NO: 7190673 - DNA, 22 bp, Homo sapiens
atggaaatgttaagtcagtccg

SEQ ID NO: 7190674 - DNA, 22 bp, Homo sapiens
atggaaatgttccatatattga

SEQ ID NO: 7190675 - DNA, 22 bp, Homo sapiens
atggaaattaagatttgtctca

SEQ ID NO: 7190676 - DNA, 22 bp, Homo sapiens
atggaaattaagatttgtctca

SEQ ID NO: 7190677 - DNA, 22 bp, Homo sapiens
atggaaattaagatttgtctca

SEQ ID NO: 7190678 - DNA, 22 bp, Homo sapiens
atggaaatgttccatatattga

SEQ ID NO: 7190679 - DNA, 22 bp, Homo sapiens
atggaaatgttccatatattga

SEQ ID NO: 7190680 - DNA, 21 bp, Homo sapiens
atggaaattggcaaatgctac

SEQ ID NO: 7190681 - DNA, 22 bp, Homo sapiens
atggaacaagaactcagattta

SEQ ID NO: 7190682 - DNA, 22 bp, Homo sapiens
atggaacaagaactcagattta

SEQ ID NO: 7190683 - DNA, 22 bp, Homo sapiens
atggaacaagaactcagattta

SEQ ID NO: 7190684 - DNA, 22 bp, Homo sapiens
atggaacagacagctgagacaa

SEQ ID NO: 7190685 - DNA, 22 bp, Homo sapiens
atggaacagattaaagtgaggg

SEQ ID NO: 7190686 - DNA, 22 bp, Homo sapiens
atggaacatcaggttaagaaat

SEQ ID NO: 7190687 - DNA, 22 bp, Homo sapiens
atggaacatgaattaatatggt

SEQ ID NO: 7190688 - DNA, 22 bp, Homo sapiens
atggaacatgaattaatatggt

SEQ ID NO: 7190689 - DNA, 22 bp, Homo sapiens
atggaacatgaattaatatggt

SEQ ID NO: 7190690 - DNA, 22 bp, Homo sapiens
atggaactgagcttgccaaact

SEQ ID NO: 7190691 - DNA, 22 bp, Homo sapiens
gacagagtgcagggctagaaga

SEQ ID NO: 7190692 - DNA, 22 bp, Homo sapiens
gacagatgagggagtattctca

SEQ ID NO: 7190693 - DNA, 22 bp, Homo sapiens
gacagatggtcagtgttgaagt

SEQ ID NO: 7190694 - DNA, 22 bp, Homo sapiens
gacagatgagggagtattctca

SEQ ID NO: 7190695 - DNA, 23 bp, Homo sapiens
gacagagtgagaccttgtcttac

SEQ ID NO: 7190696 - DNA, 23 bp, Homo sapiens
gacagagtgagaccttgtcttac

SEQ ID NO: 7190697 - DNA, 23 bp, Homo sapiens
gacagagtgagaccttgtcttac

SEQ ID NO: 7190698 - DNA, 23 bp, Homo sapiens
gacagagtgagaccttgtcttac

SEQ ID NO: 7190699 - DNA, 23 bp, Homo sapiens
gacagagtgagaccttgtcttac

SEQ ID NO: 7190700 - DNA, 23 bp, Homo sapiens
gacagagtgagaccttgtcttac

SEQ ID NO: 7190701 - DNA, 22 bp, Homo sapiens
gacagagggttccaaaattgat

SEQ ID NO: 7190702 - DNA, 22 bp, Homo sapiens
gacagaggtgtccttgagtcca

SEQ ID NO: 7190703 - DNA, 22 bp, Homo sapiens
gacagaggcaagaccagaagcc

SEQ ID NO: 7190704 - DNA, 22 bp, Homo sapiens
gacagaggctggagcacctcct

SEQ ID NO: 7190705 - DNA, 22 bp, Homo sapiens
gacagaggctggagcacctcct

SEQ ID NO: 7190706 - DNA, 22 bp, Homo sapiens
atgccactgcgctccagcctgg

SEQ ID NO: 7190707 - DNA, 22 bp, Homo sapiens
atgccactgcgctccagcctgg

SEQ ID NO: 7190708 - DNA, 22 bp, Homo sapiens
atgccactgcgctccagcctgg

SEQ ID NO: 7190709 - DNA, 22 bp, Homo sapiens
atgccactgcgctccagcctgg

SEQ ID NO: 7190710 - DNA, 22 bp, Homo sapiens
atgccactgcgctccagcctgg

SEQ ID NO: 7190711 - DNA, 22 bp, Homo sapiens
atgccactgcacttcagcttgg

SEQ ID NO: 7190712 - DNA, 22 bp, Homo sapiens
atgccactgcgctccagcctgg

SEQ ID NO: 7190713 - DNA, 22 bp, Homo sapiens
atgccactgcgctccagcctgg

SEQ ID NO: 7190714 - DNA, 22 bp, Homo sapiens
atgccactgcgctccagcctgg

SEQ ID NO: 7190715 - DNA, 22 bp, Homo sapiens
gacagatgtgggtgacagcagc

SEQ ID NO: 7190716 - DNA, 22 bp, Homo sapiens
gacagatgtgggtgacagcagc

SEQ ID NO: 7190717 - DNA, 22 bp, Homo sapiens
gacagatgtgggtgacagcagc

SEQ ID NO: 7190718 - DNA, 22 bp, Homo sapiens
gacagcaaagcagagccaaggc

SEQ ID NO: 7190719 - DNA, 22 bp, Homo sapiens
gacagcaaagcagagccaaggc

SEQ ID NO: 7190720 - DNA, 22 bp, Homo sapiens
gacagcaacacatgcttagtgc

SEQ ID NO: 7190721 - DNA, 22 bp, Homo sapiens
gacagcaacactcaattctgca

SEQ ID NO: 7190722 - DNA, 22 bp, Homo sapiens
gacagcaacactcaattctgca

SEQ ID NO: 7190723 - DNA, 22 bp, Homo sapiens
gacagcaacctcatgagaaact

SEQ ID NO: 7190724 - DNA, 22 bp, Homo sapiens
gagaaatgcatgcatgtcatca

SEQ ID NO: 7190725 - DNA, 22 bp, Homo sapiens
gagaaatgctagcttaggaatc

SEQ ID NO: 7190726 - DNA, 22 bp, Homo sapiens
gagaaatgctagcttaggaatc

SEQ ID NO: 7190727 - DNA, 22 bp, Homo sapiens
gagaaatgctagcttaggaatc

SEQ ID NO: 7190728 - DNA, 22 bp, Homo sapiens
gagaacacgaggaggcccagcg

SEQ ID NO: 7190729 - DNA, 22 bp, Homo sapiens
gagaaatgagtgattcactttt

SEQ ID NO: 7190730 - DNA, 22 bp, Homo sapiens
gagaaatgagtgattcactttt

SEQ ID NO: 7190731 - DNA, 22 bp, Homo sapiens
gagaaatgagtgattcactttt

SEQ ID NO: 7190732 - DNA, 22 bp, Homo sapiens
gagaaatgcatgcatgtcatca

SEQ ID NO: 7190733 - DNA, 22 bp, Homo sapiens
gagaaatgcatgcatgtcatca

SEQ ID NO: 7190734 - DNA, 22 bp, Homo sapiens
gagaaatgcatgcatgtcatca

SEQ ID NO: 7190735 - DNA, 22 bp, Homo sapiens
gagaaatgcatgcatgtcatca

SEQ ID NO: 7190736 - DNA, 18 bp, Homo sapiens
gagaaagtttgggcagaa

SEQ ID NO: 7190737 - DNA, 22 bp, Homo sapiens
atggaggatgtgcagcatgggc

SEQ ID NO: 7190738 - DNA, 22 bp, Homo sapiens
gagaaagggataatttgaagag

SEQ ID NO: 7190739 - DNA, 22 bp, Homo sapiens
atggaggatgtgcagcatgggc

SEQ ID NO: 7190740 - DNA, 22 bp, Homo sapiens
gagaaagggataatttgaagag

SEQ ID NO: 7190741 - DNA, 18 bp, Homo sapiens
gagaaagtttgggcagaa

SEQ ID NO: 7190742 - DNA, 18 bp, Homo sapiens
gagaaagtttgggcagaa

SEQ ID NO: 7190743 - DNA, 22 bp, Homo sapiens
gagaaatagattcatggtagat

SEQ ID NO: 7190744 - DNA, 22 bp, Homo sapiens
gagaaataggcaatggtatcta

SEQ ID NO: 7190745 - DNA, 22 bp, Homo sapiens
gagaaataggcaatggtatcta

SEQ ID NO: 7190746 - DNA, 22 bp, Homo sapiens
gagaaataggcaatggtatcta

SEQ ID NO: 7190747 - DNA, 22 bp, Homo sapiens
gagaaatatggctcagttccac

SEQ ID NO: 7190748 - DNA, 22 bp, Homo sapiens
gagaaatatggctcagttccac

SEQ ID NO: 7190749 - DNA, 22 bp, Homo sapiens
gagaaatatggctcagttccac

SEQ ID NO: 7190750 - DNA, 22 bp, Homo sapiens
gagaaatatggctcagttccac

SEQ ID NO: 7190751 - DNA, 20 bp, Homo sapiens
atggaggaagggcaagagaa

SEQ ID NO: 7190752 - DNA, 20 bp, Homo sapiens
atggaggaagggcaagagaa

SEQ ID NO: 7190753 - DNA, 22 bp, Homo sapiens
atggagctgtagggagcagtgg

SEQ ID NO: 7190754 - DNA, 22 bp, Homo sapiens
atggagctgtagggagcagtgg

SEQ ID NO: 7190755 - DNA, 20 bp, Homo sapiens
atggaggaagggcaagagaa

SEQ ID NO: 7190756 - DNA, 20 bp, Homo sapiens
atggaggaagggcaagagaa

SEQ ID NO: 7190757 - DNA, 22 bp, Homo sapiens
atggagccattcctgaagactt

SEQ ID NO: 7190758 - DNA, 21 bp, Homo sapiens
atggagcctaagagtggaggt

SEQ ID NO: 7190759 - DNA, 22 bp, Homo sapiens
atggagactgcgtctgccatcc

SEQ ID NO: 7190760 - DNA, 22 bp, Homo sapiens
atggagactgcgtctgccatcc

SEQ ID NO: 7190761 - DNA, 22 bp, Homo sapiens
atggagagtgaaagtctctcta

SEQ ID NO: 7190762 - DNA, 22 bp, Homo sapiens
atggagagtgaaagtctctcta

SEQ ID NO: 7190763 - DNA, 22 bp, Homo sapiens
atggagagttcacttctaagtt

SEQ ID NO: 7190764 - DNA, 23 bp, Homo sapiens
atggaagtcactgttttcttgtc

SEQ ID NO: 7190765 - DNA, 22 bp, Homo sapiens
atggaaggtcctacagagcgca

SEQ ID NO: 7190766 - DNA, 22 bp, Homo sapiens
atggaaggctttatgactcaaa

SEQ ID NO: 7190767 - DNA, 22 bp, Homo sapiens
atggaagggacagaagggcaag

SEQ ID NO: 7190768 - DNA, 22 bp, Homo sapiens
atggaagctgaaaaagacacgg

SEQ ID NO: 7190769 - DNA, 22 bp, Homo sapiens
atggaagactaacagaaacatg

SEQ ID NO: 7190770 - DNA, 22 bp, Homo sapiens
atggaagactaacagaaacatg

SEQ ID NO: 7190771 - DNA, 22 bp, Homo sapiens
atggaagactaacagaaacatg

SEQ ID NO: 7190772 - DNA, 22 bp, Homo sapiens
atggaagagtccccatggatga

SEQ ID NO: 7190773 - DNA, 22 bp, Homo sapiens
atggaagagtccccatggatga

SEQ ID NO: 7190774 - DNA, 22 bp, Homo sapiens
atggaagaacgctcagggttac

SEQ ID NO: 7190775 - DNA, 22 bp, Homo sapiens
atggaagaaagagacaatttga

SEQ ID NO: 7190776 - DNA, 22 bp, Homo sapiens
atggaagaaagagacaatttga

SEQ ID NO: 7190777 - DNA, 22 bp, Homo sapiens
atggaagaacgctcagggttac

SEQ ID NO: 7190778 - DNA, 22 bp, Homo sapiens
atggaagacagataaggcagaa

SEQ ID NO: 7190779 - DNA, 22 bp, Homo sapiens
atggaagacagataaggcagaa

SEQ ID NO: 7190780 - DNA, 22 bp, Homo sapiens
atggaagacagataaggcagaa

SEQ ID NO: 7190781 - DNA, 22 bp, Homo sapiens
atggaataattgtttcacagaa

SEQ ID NO: 7190782 - DNA, 22 bp, Homo sapiens
atggaatatagtcttatatctc

SEQ ID NO: 7190783 - DNA, 22 bp, Homo sapiens
atggaatatagtcttatatctc

SEQ ID NO: 7190784 - DNA, 22 bp, Homo sapiens
atggaataggctgctctttaaa

SEQ ID NO: 7190785 - DNA, 22 bp, Homo sapiens
atggaataggctgctctttaaa

SEQ ID NO: 7190786 - DNA, 22 bp, Homo sapiens
atggaatatagtcttatatctc

SEQ ID NO: 7190787 - DNA, 22 bp, Homo sapiens
atggaatgccaagttcactgct

SEQ ID NO: 7190788 - DNA, 22 bp, Homo sapiens
atggaatgcggtagtatgtgca

SEQ ID NO: 7190789 - DNA, 22 bp, Homo sapiens
atggaatggctccctgccccag

SEQ ID NO: 7190790 - DNA, 22 bp, Homo sapiens
atggaatgggaagagtgtgtga

SEQ ID NO: 7190791 - DNA, 22 bp, Homo sapiens
atggaatgggaagcagagccat

SEQ ID NO: 7190792 - DNA, 22 bp, Homo sapiens
atggacagtgtgaagcagatag

SEQ ID NO: 7190793 - DNA, 22 bp, Homo sapiens
atggacagtgtgaagcagatag

SEQ ID NO: 7190794 - DNA, 22 bp, Homo sapiens
atggacagtgtgtctgtttcca

SEQ ID NO: 7190795 - DNA, 22 bp, Homo sapiens
atggacagtgtgtctgtttcca

SEQ ID NO: 7190796 - DNA, 22 bp, Homo sapiens
atggacagtgtgtctgtttcca

SEQ ID NO: 7190797 - DNA, 22 bp, Homo sapiens
atggacatttgagttatttcca

SEQ ID NO: 7190798 - DNA, 22 bp, Homo sapiens
atggaccagagcctcattctgt

SEQ ID NO: 7190799 - DNA, 22 bp, Homo sapiens
atggaccatgagttttctctgg

SEQ ID NO: 7190800 - DNA, 22 bp, Homo sapiens
atggactcactaattcctccac

SEQ ID NO: 7190801 - DNA, 22 bp, Homo sapiens
atggactagccataagagaact

SEQ ID NO: 7190802 - DNA, 22 bp, Homo sapiens
atggactctggaggagatagag

SEQ ID NO: 7190803 - DNA, 22 bp, Homo sapiens
atggacttaagagtcagaagct

SEQ ID NO: 7190804 - DNA, 22 bp, Homo sapiens
gagaggaaagatatatacttct

SEQ ID NO: 7190805 - DNA, 22 bp, Homo sapiens
gagaggaactcccagtgcctgg

SEQ ID NO: 7190806 - DNA, 22 bp, Homo sapiens
gagaggaactcccagtgcctgg

SEQ ID NO: 7190807 - DNA, 22 bp, Homo sapiens
gagaggaactcccagtgcctgg

SEQ ID NO: 7190808 - DNA, 22 bp, Homo sapiens
gagaggaactcccagtgcctgg

SEQ ID NO: 7190809 - DNA, 22 bp, Homo sapiens
gagaggaagccagggggtgttg

SEQ ID NO: 7190810 - DNA, 22 bp, Homo sapiens
gagaggaagccagggggtgttg

SEQ ID NO: 7190811 - DNA, 22 bp, Homo sapiens
atggccagattatatggttttt

SEQ ID NO: 7190812 - DNA, 22 bp, Homo sapiens
atggccagtctattcatggtta

SEQ ID NO: 7190813 - DNA, 22 bp, Homo sapiens
atggccagtctattcatggtta

SEQ ID NO: 7190814 - DNA, 22 bp, Homo sapiens
atggccagtctgttggacagca

SEQ ID NO: 7190815 - DNA, 22 bp, Homo sapiens
atggcagttgtatgggctgtat

SEQ ID NO: 7190816 - DNA, 22 bp, Homo sapiens
atggcagtttcactctgggatt

SEQ ID NO: 7190817 - DNA, 22 bp, Homo sapiens
gagagctgtggtttgaccaggc

SEQ ID NO: 7190818 - DNA, 22 bp, Homo sapiens
gagagctgtggtttgaccaggc

SEQ ID NO: 7190819 - DNA, 22 bp, Homo sapiens
gagagctgtggtttgaccaggc

SEQ ID NO: 7190820 - DNA, 22 bp, Homo sapiens
gagagctgtggtttgaccaggc

SEQ ID NO: 7190821 - DNA, 22 bp, Homo sapiens
gagagctgtgttcattctacca

SEQ ID NO: 7190822 - DNA, 22 bp, Homo sapiens
gagagctgtgttcattctacca

SEQ ID NO: 7190823 - DNA, 22 bp, Homo sapiens
gagagctgtgttcattctacca

SEQ ID NO: 7190824 - DNA, 22 bp, Homo sapiens
gagagctgtttatcttcttcaa

SEQ ID NO: 7190825 - DNA, 22 bp, Homo sapiens
gagagctgtttatcttcttcaa

SEQ ID NO: 7190826 - DNA, 22 bp, Homo sapiens
gagagctgtttatcttcttcaa

SEQ ID NO: 7190827 - DNA, 22 bp, Homo sapiens
gagaggaaagaaccaatgaccc

SEQ ID NO: 7190828 - DNA, 22 bp, Homo sapiens
atggcagagggattgaacagct

SEQ ID NO: 7190829 - DNA, 22 bp, Homo sapiens
atggcagagggattgaacagct

SEQ ID NO: 7190830 - DNA, 23 bp, Homo sapiens
gagaacagccacagagagctgtg

SEQ ID NO: 7190831 - DNA, 23 bp, Homo sapiens
gagaacagccacagagagctgtg

SEQ ID NO: 7190832 - DNA, 22 bp, Homo sapiens
gagaacagatttttctgctgtc

SEQ ID NO: 7190833 - DNA, 23 bp, Homo sapiens
gagaacagccacagagagctgtg

SEQ ID NO: 7190834 - DNA, 22 bp, Homo sapiens
gagaacactaatggtttcttaa

SEQ ID NO: 7190835 - DNA, 22 bp, Homo sapiens
gagaacacttatggattattct

SEQ ID NO: 7190836 - DNA, 22 bp, Homo sapiens
gagaacacttatggattattct

SEQ ID NO: 7190837 - DNA, 22 bp, Homo sapiens
gagaacacgaggaggcccagcg

SEQ ID NO: 7190838 - DNA, 22 bp, Homo sapiens
gagaacagaagcattcctaatt

SEQ ID NO: 7190839 - DNA, 22 bp, Homo sapiens
gagaacagaagcattcctaatt

SEQ ID NO: 7190840 - DNA, 22 bp, Homo sapiens
gagaacagagataattttactt

SEQ ID NO: 7190841 - DNA, 22 bp, Homo sapiens
gagaacagagataattttactt

SEQ ID NO: 7190842 - DNA, 22 bp, Homo sapiens
gagaacagatttttctgctgtc

SEQ ID NO: 7190843 - DNA, 22 bp, Homo sapiens
atggcagctggcttgggcacct

SEQ ID NO: 7190844 - DNA, 22 bp, Homo sapiens
atggcagctttcattgtccaca

SEQ ID NO: 7190845 - DNA, 22 bp, Homo sapiens
atggcaggatacccagtccggc

SEQ ID NO: 7190846 - DNA, 22 bp, Homo sapiens
atggcaggatacccagtccggc

SEQ ID NO: 7190847 - DNA, 22 bp, Homo sapiens
atggcaggatacccagtccggc

SEQ ID NO: 7190848 - DNA, 22 bp, Homo sapiens
atggcaggatgagacaacaatt

SEQ ID NO: 7190849 - DNA, 22 bp, Homo sapiens
atggcaggcccaggtgttcatt

SEQ ID NO: 7190850 - DNA, 22 bp, Homo sapiens
atggcaggcccaggtgttcatt

SEQ ID NO: 7190851 - DNA, 22 bp, Homo sapiens
atggcagggaccaagctgtcat

SEQ ID NO: 7190852 - DNA, 22 bp, Homo sapiens
atggcagggcccttggctccca

SEQ ID NO: 7190853 - DNA, 22 bp, Homo sapiens
atggcagggtctgtcttcagct

SEQ ID NO: 7190854 - DNA, 22 bp, Homo sapiens
atggcagtacgttgaaaatttt

SEQ ID NO: 7190855 - DNA, 22 bp, Homo sapiens
atggcagtgacttgaagggtag

SEQ ID NO: 7190856 - DNA, 22 bp, Homo sapiens
atggcagtgataggctagtgat

SEQ ID NO: 7190857 - DNA, 22 bp, Homo sapiens
atggcagtggaatgggatgagt

SEQ ID NO: 7190858 - DNA, 22 bp, Homo sapiens
atggcagggcacagctctagtt

SEQ ID NO: 7190859 - DNA, 22 bp, Homo sapiens
atggcagggcacagctctagtt

SEQ ID NO: 7190860 - DNA, 22 bp, Homo sapiens
atggcagggactgtggcccttg

SEQ ID NO: 7190861 - DNA, 22 bp, Homo sapiens
atggcagggaccaagctgtcat

SEQ ID NO: 7190862 - DNA, 22 bp, Homo sapiens
atggcagggcccttggctccca

SEQ ID NO: 7190863 - DNA, 22 bp, Homo sapiens
atggcagggcccttggctccca

SEQ ID NO: 7190864 - DNA, 22 bp, Homo sapiens
gagcagtgactggagcatgaga

SEQ ID NO: 7190865 - DNA, 22 bp, Homo sapiens
gagccagccttcttctgaggtc

SEQ ID NO: 7190866 - DNA, 22 bp, Homo sapiens
atggccctaatgagttggtgtt

SEQ ID NO: 7190867 - DNA, 22 bp, Homo sapiens
atggcccaggcctcctgtggct

SEQ ID NO: 7190868 - DNA, 22 bp, Homo sapiens
atggccctatcacctttgcttc

SEQ ID NO: 7190869 - DNA, 22 bp, Homo sapiens
atggccctcagtccttccttgg

SEQ ID NO: 7190870 - DNA, 22 bp, Homo sapiens
atggccctctccttaggtcagc

SEQ ID NO: 7190871 - DNA, 22 bp, Homo sapiens
atggccctgaccttgatgacct

SEQ ID NO: 7190872 - DNA, 22 bp, Homo sapiens
atggccctgccaggaggaacaa

SEQ ID NO: 7190873 - DNA, 22 bp, Homo sapiens
atggccctgccaggaggaacaa

SEQ ID NO: 7190874 - DNA, 22 bp, Homo sapiens
atggccctgctaccacttttct

SEQ ID NO: 7190875 - DNA, 22 bp, Homo sapiens
atggccctgctggtttgatcgt

SEQ ID NO: 7190876 - DNA, 22 bp, Homo sapiens
atggccctggaaagagcttgag

SEQ ID NO: 7190877 - DNA, 22 bp, Homo sapiens
atggccctggcccagaccccac

SEQ ID NO: 7190878 - DNA, 22 bp, Homo sapiens
atggccctggcccagaccccac

SEQ ID NO: 7190879 - DNA, 22 bp, Homo sapiens
atggccagtgttgagatcaggc

SEQ ID NO: 7190880 - DNA, 19 bp, Homo sapiens
atggccagtttagaggttt

SEQ ID NO: 7190881 - DNA, 22 bp, Homo sapiens
gagccagggctgtgagctgagc

SEQ ID NO: 7190882 - DNA, 22 bp, Homo sapiens
gagccagggctgtgagctgagc

SEQ ID NO: 7190883 - DNA, 22 bp, Homo sapiens
gagccagggagggtctggtata

SEQ ID NO: 7190884 - DNA, 22 bp, Homo sapiens
gagccagggagggtctggtata

SEQ ID NO: 7190885 - DNA, 22 bp, Homo sapiens
gagccagggagggtctggtata

SEQ ID NO: 7190886 - DNA, 22 bp, Homo sapiens
gagccagggctgtgagctgagc

SEQ ID NO: 7190887 - DNA, 22 bp, Homo sapiens
atggctgcccacgttggtgctt

SEQ ID NO: 7190888 - DNA, 22 bp, Homo sapiens
gagccaggcccgtacttgctgt

SEQ ID NO: 7190889 - DNA, 22 bp, Homo sapiens
gagccaggcccgtacttgctgt

SEQ ID NO: 7190890 - DNA, 22 bp, Homo sapiens
gagccaggcaccttctgtgttg

SEQ ID NO: 7190891 - DNA, 22 bp, Homo sapiens
gagccaggcaccttctgtgttg

SEQ ID NO: 7190892 - DNA, 22 bp, Homo sapiens
gagccaggcccgtacttgctgt

SEQ ID NO: 7190893 - DNA, 22 bp, Homo sapiens
gagccaggcccgtacttgctgt

SEQ ID NO: 7190894 - DNA, 22 bp, Homo sapiens
atggctgccccaaattgttgct

SEQ ID NO: 7190895 - DNA, 22 bp, Homo sapiens
atggctgcctagaggtgagatg

SEQ ID NO: 7190896 - DNA, 22 bp, Homo sapiens
atggctgcctgggcgctggccg

SEQ ID NO: 7190897 - DNA, 19 bp, Homo sapiens
atggctgctgattggggat

SEQ ID NO: 7190898 - DNA, 22 bp, Homo sapiens
atggctgctctggatggagtcc

SEQ ID NO: 7190899 - DNA, 22 bp, Homo sapiens
atggctgcttacaaaaactgtg

SEQ ID NO: 7190900 - DNA, 22 bp, Homo sapiens
atggctgcttcagtaccagttc

SEQ ID NO: 7190901 - DNA, 22 bp, Homo sapiens
atggctgctttcccttagcacc

SEQ ID NO: 7190902 - DNA, 22 bp, Homo sapiens
gagccagctatgtagcaagagg

SEQ ID NO: 7190903 - DNA, 22 bp, Homo sapiens
gagccagcgccttgcctctggg

SEQ ID NO: 7190904 - DNA, 22 bp, Homo sapiens
gagccagctacatggtctgcaa

SEQ ID NO: 7190905 - DNA, 22 bp, Homo sapiens
gagccagctgagctgcactgtc

SEQ ID NO: 7190906 - DNA, 22 bp, Homo sapiens
gagccaggaggcagagactgca

SEQ ID NO: 7190907 - DNA, 22 bp, Homo sapiens
gagccaggaggcagagactgca

SEQ ID NO: 7190908 - DNA, 22 bp, Homo sapiens
gagccaggaggcagagactgca

SEQ ID NO: 7190909 - DNA, 22 bp, Homo sapiens
gagccaggaggcagagactgca

SEQ ID NO: 7190910 - DNA, 22 bp, Homo sapiens
gagccaggaggcagagactgca

SEQ ID NO: 7190911 - DNA, 22 bp, Homo sapiens
gagccaggagatacctaagggg

SEQ ID NO: 7190912 - DNA, 22 bp, Homo sapiens
gagccaggagatacctaagggg

SEQ ID NO: 7190913 - DNA, 22 bp, Homo sapiens
gagccaggagatacctaagggg

SEQ ID NO: 7190914 - DNA, 22 bp, Homo sapiens
gagccaggagatacctaagggg

SEQ ID NO: 7190915 - DNA, 22 bp, Homo sapiens
gagccaggaagaaggccttact

SEQ ID NO: 7190916 - DNA, 22 bp, Homo sapiens
gagccaggaagaaggccttact

SEQ ID NO: 7190917 - DNA, 22 bp, Homo sapiens
gagccaggaagaaggccttact

SEQ ID NO: 7190918 - DNA, 22 bp, Homo sapiens
gagccaggaagaaggccttact

SEQ ID NO: 7190919 - DNA, 22 bp, Homo sapiens
ctcaaagaagggaggtatttgg

SEQ ID NO: 7190920 - DNA, 22 bp, Homo sapiens
ctcaaactgtgcttgtaaattc

SEQ ID NO: 7190921 - DNA, 22 bp, Homo sapiens
ctatttatgtccaagtgtttta

SEQ ID NO: 7190922 - DNA, 22 bp, Homo sapiens
ctatttatgtccaagtgtttta

SEQ ID NO: 7190923 - DNA, 22 bp, Homo sapiens
ctatttatgtccaagtgtttta

SEQ ID NO: 7190924 - DNA, 22 bp, Homo sapiens
ctatttatgtgctattttgtat

SEQ ID NO: 7190925 - DNA, 22 bp, Homo sapiens
ctatttatgtgctattttgtat

SEQ ID NO: 7190926 - DNA, 22 bp, Homo sapiens
ctatttatgtgctattttgtat

SEQ ID NO: 7190927 - DNA, 22 bp, Homo sapiens
ctcaaaggtattttagctcaca

SEQ ID NO: 7190928 - DNA, 22 bp, Homo sapiens
ctcaaatagaactgatctataa

SEQ ID NO: 7190929 - DNA, 22 bp, Homo sapiens
ctcaaatagaactgatctataa

SEQ ID NO: 7190930 - DNA, 22 bp, Homo sapiens
ctcaaatataagctaaatgtgg

SEQ ID NO: 7190931 - DNA, 22 bp, Homo sapiens
ctcaaatataagctaaatgtgg

SEQ ID NO: 7190932 - DNA, 22 bp, Homo sapiens
agtcccagagaggtcggggcca

SEQ ID NO: 7190933 - DNA, 22 bp, Homo sapiens
agtcccagagaggtcggggcca

SEQ ID NO: 7190934 - DNA, 22 bp, Homo sapiens
ctcaagaagagggagacctaca

SEQ ID NO: 7190935 - DNA, 22 bp, Homo sapiens
ctcaagaaggatgagctattgc

SEQ ID NO: 7190936 - DNA, 22 bp, Homo sapiens
ctcaagaaggatgagctattgc

SEQ ID NO: 7190937 - DNA, 22 bp, Homo sapiens
ctcaaatccccgttcctcattc

SEQ ID NO: 7190938 - DNA, 21 bp, Homo sapiens
ctcaaatgccagttttattta

SEQ ID NO: 7190939 - DNA, 22 bp, Homo sapiens
ctcaacatatgactttggtggg

SEQ ID NO: 7190940 - DNA, 23 bp, Homo sapiens
ctcaacatccattcttgcccttc

SEQ ID NO: 7190941 - DNA, 22 bp, Homo sapiens
cgggtgtttctctttccctggc

SEQ ID NO: 7190942 - DNA, 22 bp, Homo sapiens
cgggttcacgccattctcctgc

SEQ ID NO: 7190943 - DNA, 22 bp, Homo sapiens
cgggttcacgccattctcctgc

SEQ ID NO: 7190944 - DNA, 23 bp, Homo sapiens
cgggttcacgccattctcctgcc

SEQ ID NO: 7190945 - DNA, 22 bp, Homo sapiens
cgggttcacgccattctcctgc

SEQ ID NO: 7190946 - DNA, 22 bp, Homo sapiens
cgggtggagacagagggcataa

SEQ ID NO: 7190947 - DNA, 22 bp, Homo sapiens
cgggtggagacagagggcataa

SEQ ID NO: 7190948 - DNA, 22 bp, Homo sapiens
cggggttcatccatgctgtggc

SEQ ID NO: 7190949 - DNA, 22 bp, Homo sapiens
cggggttcatccatgctgtggc

SEQ ID NO: 7190950 - DNA, 22 bp, Homo sapiens
cggggtgggaatagacctgtct

SEQ ID NO: 7190951 - DNA, 22 bp, Homo sapiens
cggggtgggaatagacctgtct

SEQ ID NO: 7190952 - DNA, 22 bp, Homo sapiens
cggggtgggaatagacctgtct

SEQ ID NO: 7190953 - DNA, 22 bp, Homo sapiens
cggggtggcactctaaatagaa

SEQ ID NO: 7190954 - DNA, 22 bp, Homo sapiens
cggggtggcactctaaatagaa

SEQ ID NO: 7190955 - DNA, 22 bp, Homo sapiens
cggggtggcactctaaatagaa

SEQ ID NO: 7190956 - DNA, 22 bp, Homo sapiens
cggggtggcactctaaatagaa

SEQ ID NO: 7190957 - DNA, 22 bp, Homo sapiens
cggggtgggaatagacctgtct

SEQ ID NO: 7190958 - DNA, 22 bp, Homo sapiens
cggggtgggaatagacctgtct

SEQ ID NO: 7190959 - DNA, 22 bp, Homo sapiens
cgggggagttgaggcacatggg

SEQ ID NO: 7190960 - DNA, 22 bp, Homo sapiens
cgggggagttgaggcacatggg

SEQ ID NO: 7190961 - DNA, 22 bp, Homo sapiens
cgggggcacccacaaatgagga

SEQ ID NO: 7190962 - DNA, 22 bp, Homo sapiens
cggggtggcactctaaatagaa

SEQ ID NO: 7190963 - DNA, 22 bp, Homo sapiens
agtatcatgttggaattaatca

SEQ ID NO: 7190964 - DNA, 22 bp, Homo sapiens
agtatcatgttggaattaatca

SEQ ID NO: 7190965 - DNA, 22 bp, Homo sapiens
agtatcatgttggaattaatca

SEQ ID NO: 7190966 - DNA, 22 bp, Homo sapiens
agtatcatctccatttcactga

SEQ ID NO: 7190967 - DNA, 21 bp, Homo sapiens
agtatcataatgaatagttct

SEQ ID NO: 7190968 - DNA, 22 bp, Homo sapiens
agtatcaataatagaggagcta

SEQ ID NO: 7190969 - DNA, 22 bp, Homo sapiens
agtatcaatcaccctttgaagt

SEQ ID NO: 7190970 - DNA, 22 bp, Homo sapiens
agtatctgcatgattttgagaa

SEQ ID NO: 7190971 - DNA, 22 bp, Homo sapiens
agtatcttaacagcttccagga

SEQ ID NO: 7190972 - DNA, 22 bp, Homo sapiens
agtatcttcaagtttcttctag

SEQ ID NO: 7190973 - DNA, 22 bp, Homo sapiens
agtatctttacttaaatagtca

SEQ ID NO: 7190974 - DNA, 22 bp, Homo sapiens
agtatctttacttaaatagtca

SEQ ID NO: 7190975 - DNA, 22 bp, Homo sapiens
agtatgaacctgggttctggat

SEQ ID NO: 7190976 - DNA, 22 bp, Homo sapiens
ctcagactggagccccaaggac

SEQ ID NO: 7190977 - DNA, 22 bp, Homo sapiens
ctcagactggagccccaaggac

SEQ ID NO: 7190978 - DNA, 22 bp, Homo sapiens
ctcagactaaaatgggaatgta

SEQ ID NO: 7190979 - DNA, 22 bp, Homo sapiens
ctcagactaaaatgggaatgta

SEQ ID NO: 7190980 - DNA, 22 bp, Homo sapiens
ctcagactggagccccaaggac

SEQ ID NO: 7190981 - DNA, 22 bp, Homo sapiens
ctcagactggggctccctgagt

SEQ ID NO: 7190982 - DNA, 22 bp, Homo sapiens
ctcagacttgctttttatggaa

SEQ ID NO: 7190983 - DNA, 22 bp, Homo sapiens
ctcagactttcagggtaggcca

SEQ ID NO: 7190984 - DNA, 22 bp, Homo sapiens
ctcagacatctgaaatgggtta

SEQ ID NO: 7190985 - DNA, 22 bp, Homo sapiens
ctcagacatttgtagaaagtgc

SEQ ID NO: 7190986 - DNA, 21 bp, Homo sapiens
ctcagaccacagctcacaccc

SEQ ID NO: 7190987 - DNA, 21 bp, Homo sapiens
ctcagaccacagctcacaccc

SEQ ID NO: 7190988 - DNA, 22 bp, Homo sapiens
ctcagacccccagagctgctaa

SEQ ID NO: 7190989 - DNA, 22 bp, Homo sapiens
ctcagacttttgttcaacgagt

SEQ ID NO: 7190990 - DNA, 22 bp, Homo sapiens
ctcagagggtctcctccagaat

SEQ ID NO: 7190991 - DNA, 22 bp, Homo sapiens
ctcagaggtcaagagcagagct

SEQ ID NO: 7190992 - DNA, 17 bp, Homo sapiens
ctcagagttgctttgtc

SEQ ID NO: 7190993 - DNA, 22 bp, Homo sapiens
ctcagataatctttgagtcttc

SEQ ID NO: 7190994 - DNA, 22 bp, Homo sapiens
ctcagagtggggctccctgagg

SEQ ID NO: 7190995 - DNA, 22 bp, Homo sapiens
ctcagagtccccagtgggtttg

SEQ ID NO: 7190996 - DNA, 23 bp, Homo sapiens
ctcagaggtgtttttcacttact

SEQ ID NO: 7190997 - DNA, 23 bp, Homo sapiens
ctcagaggtgtttttcacttact

SEQ ID NO: 7190998 - DNA, 22 bp, Homo sapiens
ctcagaggtcaagagcagagct

SEQ ID NO: 7190999 - DNA, 22 bp, Homo sapiens
ctcagaggtggatgccttgtgg

SEQ ID NO: 7191000 - DNA, 22 bp, Homo sapiens
ctcagatcatcagaaacaatgt

SEQ ID NO: 7191001 - DNA, 22 bp, Homo sapiens
ctcagatgtagaaagattgtga

SEQ ID NO: 7191002 - DNA, 22 bp, Homo sapiens
ctcagatgtttgatattgttat

SEQ ID NO: 7191003 - DNA, 22 bp, Homo sapiens
ctcagcaacacggcctattaag

SEQ ID NO: 7191004 - DNA, 22 bp, Homo sapiens
ctcagcaacagcgacttaaggg

SEQ ID NO: 7191005 - DNA, 22 bp, Homo sapiens
ctcagcaacccacacacggtct

SEQ ID NO: 7191006 - DNA, 22 bp, Homo sapiens
ctcagcaaccctagaacatttg

SEQ ID NO: 7191007 - DNA, 22 bp, Homo sapiens
ctcagcaagacccccaccgtgt

SEQ ID NO: 7191008 - DNA, 19 bp, Homo sapiens
ctcagcaagatagaaatgg

SEQ ID NO: 7191009 - DNA, 22 bp, Homo sapiens
ctcagcaagattaagcagcttg

SEQ ID NO: 7191010 - DNA, 22 bp, Homo sapiens
ctcagcaattacctgtgtctct

SEQ ID NO: 7191011 - DNA, 22 bp, Homo sapiens
ctcagacaaatgattaaggtta

SEQ ID NO: 7191012 - DNA, 18 bp, Homo sapiens
ctcagacaggctgtgcta

SEQ ID NO: 7191013 - DNA, 21 bp, Homo sapiens
ctcagacagggaggctctggg

SEQ ID NO: 7191014 - DNA, 22 bp, Homo sapiens
ctcagaagctctgctcctttgc

SEQ ID NO: 7191015 - DNA, 22 bp, Homo sapiens
ctcagaagaatcagcagctatt

SEQ ID NO: 7191016 - DNA, 22 bp, Homo sapiens
ctcagaagccttcagtcttggc

SEQ ID NO: 7191017 - DNA, 22 bp, Homo sapiens
ctcagaagttcagcctagagta

SEQ ID NO: 7191018 - DNA, 22 bp, Homo sapiens
ctcagaagttcagcctagagta

SEQ ID NO: 7191019 - DNA, 22 bp, Homo sapiens
ctcagaagttcagcctagagta

SEQ ID NO: 7191020 - DNA, 22 bp, Homo sapiens
ctcagaagaacaaaggctctac

SEQ ID NO: 7191021 - DNA, 22 bp, Homo sapiens
ctcagaagaacccagggtccca

SEQ ID NO: 7191022 - DNA, 22 bp, Homo sapiens
ctcagaaatcccactctgtgta

SEQ ID NO: 7191023 - DNA, 22 bp, Homo sapiens
agtcccagctactcaagaggct

SEQ ID NO: 7191024 - DNA, 22 bp, Homo sapiens
ctcaccagatgtcgggctgagt

SEQ ID NO: 7191025 - DNA, 20 bp, Homo sapiens
ctcaccaggtgtaggctgag

SEQ ID NO: 7191026 - DNA, 22 bp, Homo sapiens
ctcaccatatgactttactaac

SEQ ID NO: 7191027 - DNA, 22 bp, Homo sapiens
ctcaccatatgactttactaac

SEQ ID NO: 7191028 - DNA, 22 bp, Homo sapiens
agtcccagatgacccagctact

SEQ ID NO: 7191029 - DNA, 22 bp, Homo sapiens
agtcccagcccagtcctgtaag

SEQ ID NO: 7191030 - DNA, 22 bp, Homo sapiens
agtcccagatgacccagctact

SEQ ID NO: 7191031 - DNA, 22 bp, Homo sapiens
agtcccagatgacccagctact

SEQ ID NO: 7191032 - DNA, 20 bp, Homo sapiens
agtcccagatcaaatttctg

SEQ ID NO: 7191033 - DNA, 22 bp, Homo sapiens
agtcccagatctacaggaggga

SEQ ID NO: 7191034 - DNA, 22 bp, Homo sapiens
agtcccagatctacaggaggga

SEQ ID NO: 7191035 - DNA, 20 bp, Homo sapiens
agtgacagagactgtgtggc

SEQ ID NO: 7191036 - DNA, 22 bp, Homo sapiens
agtgacacggagagacagcatg

SEQ ID NO: 7191037 - DNA, 20 bp, Homo sapiens
agtgacagagactgtgtggc

SEQ ID NO: 7191038 - DNA, 22 bp, Homo sapiens
agtgacaacatcaattggggct

SEQ ID NO: 7191039 - DNA, 22 bp, Homo sapiens
agtgacaaggcctgaagctcct

SEQ ID NO: 7191040 - DNA, 22 bp, Homo sapiens
agtgacaaggcctgaagctcct

SEQ ID NO: 7191041 - DNA, 22 bp, Homo sapiens
agtgacaaggtagttagttgga

SEQ ID NO: 7191042 - DNA, 17 bp, Homo sapiens
agtgaaatttacattgc

SEQ ID NO: 7191043 - DNA, 17 bp, Homo sapiens
agtgaaatttacattgc

SEQ ID NO: 7191044 - DNA, 22 bp, Homo sapiens
ctcagtgttaaagactttccag

SEQ ID NO: 7191045 - DNA, 22 bp, Homo sapiens
ctcagtgttaaatataaggtat

SEQ ID NO: 7191046 - DNA, 22 bp, Homo sapiens
agtgacaaaacggaacatacag

SEQ ID NO: 7191047 - DNA, 22 bp, Homo sapiens
ctcagggagtagcacatgtgga

SEQ ID NO: 7191048 - DNA, 22 bp, Homo sapiens
ctcagggagtagcacatgtgga

SEQ ID NO: 7191049 - DNA, 22 bp, Homo sapiens
ctcagtggtcggcacagtttgt

SEQ ID NO: 7191050 - DNA, 22 bp, Homo sapiens
ctcagtggtggtcacttggtgg

SEQ ID NO: 7191051 - DNA, 22 bp, Homo sapiens
ctcagtggttgagagcctgggc

SEQ ID NO: 7191052 - DNA, 22 bp, Homo sapiens
ctcagtggttgagagcctgggc

SEQ ID NO: 7191053 - DNA, 20 bp, Homo sapiens
ctcagtgtattctgggtgct

SEQ ID NO: 7191054 - DNA, 20 bp, Homo sapiens
ctcagtgtattctgggtgct

SEQ ID NO: 7191055 - DNA, 20 bp, Homo sapiens
ctcagtgtattctgggtgct

SEQ ID NO: 7191056 - DNA, 22 bp, Homo sapiens
ctcagtgtctggggccccaggg

SEQ ID NO: 7191057 - DNA, 22 bp, Homo sapiens
ctcagtgtcttatttgagttct

SEQ ID NO: 7191058 - DNA, 22 bp, Homo sapiens
ctcagtgtgaatgctcagtaaa

SEQ ID NO: 7191059 - DNA, 22 bp, Homo sapiens
ctcagtgtgaatgctcagtaaa

SEQ ID NO: 7191060 - DNA, 22 bp, Homo sapiens
ctcagtgtgagtgagaagtgca

SEQ ID NO: 7191061 - DNA, 22 bp, Homo sapiens
ctcagtgtgagtgagaagtgca

SEQ ID NO: 7191062 - DNA, 20 bp, Homo sapiens
ctcagtgtggcctgagtgtt

SEQ ID NO: 7191063 - DNA, 20 bp, Homo sapiens
ctcagtgtggcctgagtgtt

SEQ ID NO: 7191064 - DNA, 20 bp, Homo sapiens
ctcagtgtggcctgagtgtt

SEQ ID NO: 7191065 - DNA, 23 bp, Homo sapiens
ctcagtgtgtgacccatggcctc

SEQ ID NO: 7191066 - DNA, 23 bp, Homo sapiens
ctcagtgtgtgacccatggcctc

SEQ ID NO: 7191067 - DNA, 22 bp, Homo sapiens
ctccactctggggtgggtgaga

SEQ ID NO: 7191068 - DNA, 22 bp, Homo sapiens
ctccactctggggtgggtgaga

SEQ ID NO: 7191069 - DNA, 22 bp, Homo sapiens
ctccagaaattcaacagcaaat

SEQ ID NO: 7191070 - DNA, 22 bp, Homo sapiens
ctccagaactgggagagaataa

SEQ ID NO: 7191071 - DNA, 22 bp, Homo sapiens
ctccagaagacccatcctcatg

SEQ ID NO: 7191072 - DNA, 22 bp, Homo sapiens
ctccagaaggtgggggagccac

SEQ ID NO: 7191073 - DNA, 22 bp, Homo sapiens
ctccagaaggtgggggagccac

SEQ ID NO: 7191074 - DNA, 22 bp, Homo sapiens
ctccagaattgtccattggaaa

SEQ ID NO: 7191075 - DNA, 22 bp, Homo sapiens
ctccagacagatcttctagcag

SEQ ID NO: 7191076 - DNA, 22 bp, Homo sapiens
ctccagagacacttctcatgat

SEQ ID NO: 7191077 - DNA, 22 bp, Homo sapiens
ctccagagacacttctcatgat

SEQ ID NO: 7191078 - DNA, 22 bp, Homo sapiens
ctccagagagaaaggaggccgc

SEQ ID NO: 7191079 - DNA, 22 bp, Homo sapiens
ctccagagagaaaggaggccgc

SEQ ID NO: 7191080 - DNA, 22 bp, Homo sapiens
agtgacagggaaggataggatt

SEQ ID NO: 7191081 - DNA, 22 bp, Homo sapiens
agtgacaggggaggcaggtgtg

SEQ ID NO: 7191082 - DNA, 22 bp, Homo sapiens
ctccactcaccagatgccagga

SEQ ID NO: 7191083 - DNA, 22 bp, Homo sapiens
ctccactcaccgaggcagagca

SEQ ID NO: 7191084 - DNA, 22 bp, Homo sapiens
ctccactcaccgaggcagagca

SEQ ID NO: 7191085 - DNA, 22 bp, Homo sapiens
ctccactcaggtgcttaagttg

SEQ ID NO: 7191086 - DNA, 22 bp, Homo sapiens
ctccactcaggtgcttaagttg

SEQ ID NO: 7191087 - DNA, 22 bp, Homo sapiens
agtgacaggaccaggtctggaa

SEQ ID NO: 7191088 - DNA, 22 bp, Homo sapiens
agtgacagctgggaaggtgaaa

SEQ ID NO: 7191089 - DNA, 22 bp, Homo sapiens
agtgacagattaccggcagagc

SEQ ID NO: 7191090 - DNA, 21 bp, Homo sapiens
agtgacagaggaaggtgcata

SEQ ID NO: 7191091 - DNA, 20 bp, Homo sapiens
agtgacagagactgtgtggc

SEQ ID NO: 7191092 - DNA, 17 bp, Homo sapiens
ctcagctgaaccccaga

SEQ ID NO: 7191093 - DNA, 22 bp, Homo sapiens
ctcagctctttatactagctgt

SEQ ID NO: 7191094 - DNA, 20 bp, Homo sapiens
ctcagctcttcagggcaagt

SEQ ID NO: 7191095 - DNA, 20 bp, Homo sapiens
ctcagctcttcagggcaagt

SEQ ID NO: 7191096 - DNA, 22 bp, Homo sapiens
ctcagctctttatactagctgt

SEQ ID NO: 7191097 - DNA, 22 bp, Homo sapiens
ctcagctccctccacccagacc

SEQ ID NO: 7191098 - DNA, 22 bp, Homo sapiens
ctcagctccctccacccagacc

SEQ ID NO: 7191099 - DNA, 22 bp, Homo sapiens
ctcagctccctccacccagacc

SEQ ID NO: 7191100 - DNA, 22 bp, Homo sapiens
ctcagctctgacaggaggcatc

SEQ ID NO: 7191101 - DNA, 22 bp, Homo sapiens
agtctcagccacacagacctat

SEQ ID NO: 7191102 - DNA, 18 bp, Homo sapiens
agtctcagcggaggagta

SEQ ID NO: 7191103 - DNA, 18 bp, Homo sapiens
agtctcagcggaggagta

SEQ ID NO: 7191104 - DNA, 22 bp, Homo sapiens
agtctcagctacttgggaggct

SEQ ID NO: 7191105 - DNA, 22 bp, Homo sapiens
agtctcagagtacctgagggac

SEQ ID NO: 7191106 - DNA, 22 bp, Homo sapiens
agtctcagcaagcatggctagt

SEQ ID NO: 7191107 - DNA, 22 bp, Homo sapiens
ctcagcctgtgaagagcagagg

SEQ ID NO: 7191108 - DNA, 20 bp, Homo sapiens
ctcagctaaacaacactgac

SEQ ID NO: 7191109 - DNA, 16 bp, Homo sapiens
ctcagctaaggagagg

SEQ ID NO: 7191110 - DNA, 22 bp, Homo sapiens
ctcagccctccccggggaataa

SEQ ID NO: 7191111 - DNA, 22 bp, Homo sapiens
ctcagcacactcccatctaatt

SEQ ID NO: 7191112 - DNA, 22 bp, Homo sapiens
ctcagcacactcccatctaatt

SEQ ID NO: 7191113 - DNA, 22 bp, Homo sapiens
ctcagcacactcccatctaatt

SEQ ID NO: 7191114 - DNA, 22 bp, Homo sapiens
ctcagcacatctttacatttcc

SEQ ID NO: 7191115 - DNA, 22 bp, Homo sapiens
ctcagcacattcctaagggatg

SEQ ID NO: 7191116 - DNA, 22 bp, Homo sapiens
ctcagcaccccgacaggacatt

SEQ ID NO: 7191117 - DNA, 22 bp, Homo sapiens
ctcagcaccccgacaggacatt

SEQ ID NO: 7191118 - DNA, 22 bp, Homo sapiens
ctcagccccaatttgccctctt

SEQ ID NO: 7191119 - DNA, 22 bp, Homo sapiens
ctcagctccagccctcagcagc

SEQ ID NO: 7191120 - DNA, 22 bp, Homo sapiens
ctcagctccaggtgtgcatctt

SEQ ID NO: 7191121 - DNA, 22 bp, Homo sapiens
ctcagctcattgtggatccggt

SEQ ID NO: 7191122 - DNA, 22 bp, Homo sapiens
ctcagctcattgtggatccggt

SEQ ID NO: 7191123 - DNA, 22 bp, Homo sapiens
ctcagctccagccctcagcagc

SEQ ID NO: 7191124 - DNA, 22 bp, Homo sapiens
ctcagctccagccctcagcagc

SEQ ID NO: 7191125 - DNA, 22 bp, Homo sapiens
ctcagctacgctttcaccagct

SEQ ID NO: 7191126 - DNA, 22 bp, Homo sapiens
ctcagctacgctttcaccagct

SEQ ID NO: 7191127 - DNA, 22 bp, Homo sapiens
ctcagctacttgggaagcttag

SEQ ID NO: 7191128 - DNA, 22 bp, Homo sapiens
ctcagctagtaacgtacatgtc

SEQ ID NO: 7191129 - DNA, 22 bp, Homo sapiens
ctcagctagtaacgtacatgtc

SEQ ID NO: 7191130 - DNA, 22 bp, Homo sapiens
ctcagctcaaaattcacctttg

SEQ ID NO: 7191131 - DNA, 22 bp, Homo sapiens
ctcagggaggtcctgtgctgaa

SEQ ID NO: 7191132 - DNA, 22 bp, Homo sapiens
ctcagggagtagcacatgtgga

SEQ ID NO: 7191133 - DNA, 22 bp, Homo sapiens
ctcagggaggcctctgctggtt

SEQ ID NO: 7191134 - DNA, 22 bp, Homo sapiens
ctcagggaggccctgggaccct

SEQ ID NO: 7191135 - DNA, 22 bp, Homo sapiens
ctcagggaggccaatttatcaa

SEQ ID NO: 7191136 - DNA, 22 bp, Homo sapiens
ctcagggaggccctgggaccct

SEQ ID NO: 7191137 - DNA, 22 bp, Homo sapiens
ctcagggacaaggggagacccc

SEQ ID NO: 7191138 - DNA, 22 bp, Homo sapiens
ctcagggacagtatcatttagg

SEQ ID NO: 7191139 - DNA, 22 bp, Homo sapiens
agtctccttaaatatttcccag

SEQ ID NO: 7191140 - DNA, 22 bp, Homo sapiens
agtctctagtcatttcacctct

SEQ ID NO: 7191141 - DNA, 22 bp, Homo sapiens
agtctctaggatcagacaccca

SEQ ID NO: 7191142 - DNA, 22 bp, Homo sapiens
agtctccttggcctcaatgcct

SEQ ID NO: 7191143 - DNA, 22 bp, Homo sapiens
agtctccttggcctcaatgcct

SEQ ID NO: 7191144 - DNA, 22 bp, Homo sapiens
agtctccagaaatatagcagtg

SEQ ID NO: 7191145 - DNA, 22 bp, Homo sapiens
agtctcctctttccttgttatt

SEQ ID NO: 7191146 - DNA, 23 bp, Homo sapiens
agtctctatggcaattcctttac

SEQ ID NO: 7191147 - DNA, 22 bp, Homo sapiens
agtctctatgttcctgcaatat

SEQ ID NO: 7191148 - DNA, 22 bp, Homo sapiens
agtctctatgttcctgcaatat

SEQ ID NO: 7191149 - DNA, 21 bp, Homo sapiens
ctcaggcatttgaggagagtc

SEQ ID NO: 7191150 - DNA, 21 bp, Homo sapiens
ctcaggcatttgaggagagtc

SEQ ID NO: 7191151 - DNA, 22 bp, Homo sapiens
ctcaggccaataagctccagcc

SEQ ID NO: 7191152 - DNA, 22 bp, Homo sapiens
ctcaggccaataagctccagcc

SEQ ID NO: 7191153 - DNA, 22 bp, Homo sapiens
ctcaggccaataagctccagcc

SEQ ID NO: 7191154 - DNA, 22 bp, Homo sapiens
ctcaggccaataagctccagcc

SEQ ID NO: 7191155 - DNA, 22 bp, Homo sapiens
ctcagggaattgaatctccttg

SEQ ID NO: 7191156 - DNA, 23 bp, Homo sapiens
agtctcagctggaaacatgtgtc

SEQ ID NO: 7191157 - DNA, 23 bp, Homo sapiens
agtctcagctggaaacatgtgtc

SEQ ID NO: 7191158 - DNA, 22 bp, Homo sapiens
agtctcaggcagaggaaggcta

SEQ ID NO: 7191159 - DNA, 22 bp, Homo sapiens
agtctcagggccacccggggaa

SEQ ID NO: 7191160 - DNA, 22 bp, Homo sapiens
agtctcatcaggcatgtagtca

SEQ ID NO: 7191161 - DNA, 22 bp, Homo sapiens
agtctcatcaggcatgtagtca

SEQ ID NO: 7191162 - DNA, 22 bp, Homo sapiens
agtctccacaacagccctgata

SEQ ID NO: 7191163 - DNA, 22 bp, Homo sapiens
agtctccacactggcagatgcc

SEQ ID NO: 7191164 - DNA, 22 bp, Homo sapiens
agtctccacactggcagatgcc

SEQ ID NO: 7191165 - DNA, 22 bp, Homo sapiens
agtctccacccatgacagtaca

SEQ ID NO: 7191166 - DNA, 22 bp, Homo sapiens
ctcttagtaatgccatgaagca

SEQ ID NO: 7191167 - DNA, 22 bp, Homo sapiens
ctcttagtttatctttgacaaa

SEQ ID NO: 7191168 - DNA, 22 bp, Homo sapiens
ctcttcttgtctctggttagaa

SEQ ID NO: 7191169 - DNA, 21 bp, Homo sapiens
ctcttgctgatgtctccttta

SEQ ID NO: 7191170 - DNA, 21 bp, Homo sapiens
ctcttgctgatgtctccttta

SEQ ID NO: 7191171 - DNA, 22 bp, Homo sapiens
ctcttgctgtcaaagcagggta

SEQ ID NO: 7191172 - DNA, 22 bp, Homo sapiens
ctcttgcttgcaagtggggata

SEQ ID NO: 7191173 - DNA, 22 bp, Homo sapiens
ctcttgccagagatgagactct

SEQ ID NO: 7191174 - DNA, 22 bp, Homo sapiens
ctcttgcatctgttgtattggt

SEQ ID NO: 7191175 - DNA, 21 bp, Homo sapiens
ctcttgaatgcttgataagat

SEQ ID NO: 7191176 - DNA, 22 bp, Homo sapiens
ctcttgatgactgttgctggtt

SEQ ID NO: 7191177 - DNA, 19 bp, Homo sapiens
ctcttgggtggcagaggcc

SEQ ID NO: 7191178 - DNA, 19 bp, Homo sapiens
ctcttgggtggcagaggcc

SEQ ID NO: 7191179 - DNA, 22 bp, Homo sapiens
ctcttgggatacactgccatag

SEQ ID NO: 7191180 - DNA, 22 bp, Homo sapiens
ctcttgggatttgcaggctcag

SEQ ID NO: 7191181 - DNA, 22 bp, Homo sapiens
ctcttgggatttgcaggctcag

SEQ ID NO: 7191182 - DNA, 22 bp, Homo sapiens
ctcttgggatttgcaggctcag

SEQ ID NO: 7191183 - DNA, 20 bp, Homo sapiens
ctcttgggcccaaagggcct

SEQ ID NO: 7191184 - DNA, 22 bp, Homo sapiens
ctcttgggagtgctctggagaa

SEQ ID NO: 7191185 - DNA, 22 bp, Homo sapiens
ctcttgggagtgctctggagaa

SEQ ID NO: 7191186 - DNA, 22 bp, Homo sapiens
ctcttgggagtgctctggagaa

SEQ ID NO: 7191187 - DNA, 19 bp, Homo sapiens
ctcttgggtggcagaggcc

SEQ ID NO: 7191188 - DNA, 22 bp, Homo sapiens
ctcttgggtgggcagtgggcct

SEQ ID NO: 7191189 - DNA, 22 bp, Homo sapiens
ctctttggcgttggcagagcca

SEQ ID NO: 7191190 - DNA, 22 bp, Homo sapiens
ctctgtcctggtttatactggc

SEQ ID NO: 7191191 - DNA, 22 bp, Homo sapiens
ctctgtcctatgcttgatagaa

SEQ ID NO: 7191192 - DNA, 22 bp, Homo sapiens
ctctgtcctccacctgctttca

SEQ ID NO: 7191193 - DNA, 22 bp, Homo sapiens
ctctgtcctccacctgctttca

SEQ ID NO: 7191194 - DNA, 22 bp, Homo sapiens
ctctgtcctatgcttgatagaa

SEQ ID NO: 7191195 - DNA, 22 bp, Homo sapiens
ctctgtgagggtctgtacagaa

SEQ ID NO: 7191196 - DNA, 22 bp, Homo sapiens
agtggtctccccagtagaataa

SEQ ID NO: 7191197 - DNA, 22 bp, Homo sapiens
agtggtctgcctgcctcagcct

SEQ ID NO: 7191198 - DNA, 22 bp, Homo sapiens
agtggtctgggctaaatgaggt

SEQ ID NO: 7191199 - DNA, 22 bp, Homo sapiens
ctctgtctatcccattctgtgc

SEQ ID NO: 7191200 - DNA, 22 bp, Homo sapiens
ctctgtgaacccctcctttctt

SEQ ID NO: 7191201 - DNA, 22 bp, Homo sapiens
ctctgtctatcccattctgtgc

SEQ ID NO: 7191202 - DNA, 22 bp, Homo sapiens
agtggtggagagatgaggacac

SEQ ID NO: 7191203 - DNA, 22 bp, Homo sapiens
agtggtggagagatgaggacac

SEQ ID NO: 7191204 - DNA, 22 bp, Homo sapiens
agtggtggagagatgaggacac

SEQ ID NO: 7191205 - DNA, 22 bp, Homo sapiens
agtggtcttagcttgctgggct

SEQ ID NO: 7191206 - DNA, 21 bp, Homo sapiens
agtggtctttttcacccagtg

SEQ ID NO: 7191207 - DNA, 22 bp, Homo sapiens
agtggtgataaccactatcata

SEQ ID NO: 7191208 - DNA, 22 bp, Homo sapiens
agtggtgatgtctctattattg

SEQ ID NO: 7191209 - DNA, 22 bp, Homo sapiens
agtggtggagccaggaaatgtg

SEQ ID NO: 7191210 - DNA, 22 bp, Homo sapiens
agtggtggagagatgaggacac

SEQ ID NO: 7191211 - DNA, 22 bp, Homo sapiens
agtggtggagccaggaaatgtg

SEQ ID NO: 7191212 - DNA, 22 bp, Homo sapiens
agtggtggagccaggaaatgtg

SEQ ID NO: 7191213 - DNA, 22 bp, Homo sapiens
agtggtggagccaggaaatgtg

SEQ ID NO: 7191214 - DNA, 22 bp, Homo sapiens
agtggtgtcgtgggagtggaag

SEQ ID NO: 7191215 - DNA, 22 bp, Homo sapiens
agtggtgtcgtgggagtggaag

SEQ ID NO: 7191216 - DNA, 22 bp, Homo sapiens
agtggtgtctgagtggccaggg

SEQ ID NO: 7191217 - DNA, 22 bp, Homo sapiens
agtggtgtgtcaggagcaaatt

SEQ ID NO: 7191218 - DNA, 22 bp, Homo sapiens
agtgtaaacttaagagaatatc

SEQ ID NO: 7191219 - DNA, 22 bp, Homo sapiens
ctctctccttagctgcagacca

SEQ ID NO: 7191220 - DNA, 20 bp, Homo sapiens
ctctctccatctcagtggcc

SEQ ID NO: 7191221 - DNA, 20 bp, Homo sapiens
ctctctccatctcagtggcc

SEQ ID NO: 7191222 - DNA, 19 bp, Homo sapiens
ctctctccagtggctggct

SEQ ID NO: 7191223 - DNA, 19 bp, Homo sapiens
ctctctccagtggctggct

SEQ ID NO: 7191224 - DNA, 20 bp, Homo sapiens
ctctctccatctcagtggcc

SEQ ID NO: 7191225 - DNA, 22 bp, Homo sapiens
ctctgctgcaggaaggcgtgca

SEQ ID NO: 7191226 - DNA, 22 bp, Homo sapiens
ctctctccttagctgcagacca

SEQ ID NO: 7191227 - DNA, 22 bp, Homo sapiens
ctctgctgccaccagaaccact

SEQ ID NO: 7191228 - DNA, 22 bp, Homo sapiens
ctctgctgcccaggcctgctag

SEQ ID NO: 7191229 - DNA, 22 bp, Homo sapiens
ctctgctgcccaggcctgctag

SEQ ID NO: 7191230 - DNA, 17 bp, Homo sapiens
ctctggaattggtgaag

SEQ ID NO: 7191231 - DNA, 17 bp, Homo sapiens
ctctggaattggtgaag

SEQ ID NO: 7191232 - DNA, 17 bp, Homo sapiens
ctctggaattggtgaag

SEQ ID NO: 7191233 - DNA, 22 bp, Homo sapiens
ctctggacactggcatggggtc

SEQ ID NO: 7191234 - DNA, 22 bp, Homo sapiens
ctctggacactggcatggggtc

SEQ ID NO: 7191235 - DNA, 22 bp, Homo sapiens
ctctggagaggttcccatggga

SEQ ID NO: 7191236 - DNA, 22 bp, Homo sapiens
ctctggagaactccttgtgtct

SEQ ID NO: 7191237 - DNA, 22 bp, Homo sapiens
ctctggagaggttcccatggga

SEQ ID NO: 7191238 - DNA, 22 bp, Homo sapiens
ctctggagaggttcccatggga

SEQ ID NO: 7191239 - DNA, 22 bp, Homo sapiens
ctctggagaactccttgtgtct

SEQ ID NO: 7191240 - DNA, 22 bp, Homo sapiens
ctctggagaacgctatggatct

SEQ ID NO: 7191241 - DNA, 22 bp, Homo sapiens
ctctggagaacgctatggatct

SEQ ID NO: 7191242 - DNA, 22 bp, Homo sapiens
ctctggacttgtacatactcag

SEQ ID NO: 7191243 - DNA, 19 bp, Homo sapiens
ctctggagaacaatagtgc

SEQ ID NO: 7191244 - DNA, 22 bp, Homo sapiens
ctctggagatggttctcaattg

SEQ ID NO: 7191245 - DNA, 23 bp, Homo sapiens
ctctggagatcctctgcctgggt

SEQ ID NO: 7191246 - DNA, 22 bp, Homo sapiens
ctctggagatggttctcaattg

SEQ ID NO: 7191247 - DNA, 23 bp, Homo sapiens
ctctggagatcctctgcctgggt

SEQ ID NO: 7191248 - DNA, 23 bp, Homo sapiens
ctctggagatcctctgcctgggt

SEQ ID NO: 7191249 - DNA, 23 bp, Homo sapiens
ctctggagatcctctgcctgggt

SEQ ID NO: 7191250 - DNA, 23 bp, Homo sapiens
ctctggagatcctctgcctgggt

SEQ ID NO: 7191251 - DNA, 22 bp, Homo sapiens
ctctggagcaccgggctatcca

SEQ ID NO: 7191252 - DNA, 22 bp, Homo sapiens
ctctggagcaccgggctatcca

SEQ ID NO: 7191253 - DNA, 19 bp, Homo sapiens
ctctggagcagacactgga

SEQ ID NO: 7191254 - DNA, 22 bp, Homo sapiens
agtggctttttagtggcagatg

SEQ ID NO: 7191255 - DNA, 22 bp, Homo sapiens
agtgggaaactggagagacttc

SEQ ID NO: 7191256 - DNA, 22 bp, Homo sapiens
agtgggaaactggagagacttc

SEQ ID NO: 7191257 - DNA, 22 bp, Homo sapiens
agtgggaatttcagtgctaaaa

SEQ ID NO: 7191258 - DNA, 21 bp, Homo sapiens
agtgggacacctaagagattt

SEQ ID NO: 7191259 - DNA, 22 bp, Homo sapiens
agtggcttccttcataagcttt

SEQ ID NO: 7191260 - DNA, 22 bp, Homo sapiens
agtggcttggctgcactacagg

SEQ ID NO: 7191261 - DNA, 22 bp, Homo sapiens
agtggctgtttataggtgggta

SEQ ID NO: 7191262 - DNA, 22 bp, Homo sapiens
agtggctgtttataggtgggta

SEQ ID NO: 7191263 - DNA, 22 bp, Homo sapiens
agtggctgttccaggtgaggac

SEQ ID NO: 7191264 - DNA, 22 bp, Homo sapiens
agtggctgtttataggtgggta

SEQ ID NO: 7191265 - DNA, 22 bp, Homo sapiens
agtggctgttccaggtgaggac

SEQ ID NO: 7191266 - DNA, 22 bp, Homo sapiens
agtggctgttccaggtgaggac

SEQ ID NO: 7191267 - DNA, 22 bp, Homo sapiens
ctctgtagccatgggtatattc

SEQ ID NO: 7191268 - DNA, 22 bp, Homo sapiens
ctctggtttttcttccattaag

SEQ ID NO: 7191269 - DNA, 22 bp, Homo sapiens
ctctgtacaggagacatctcta

SEQ ID NO: 7191270 - DNA, 22 bp, Homo sapiens
ctctgtatgggatttactggtt

SEQ ID NO: 7191271 - DNA, 22 bp, Homo sapiens
ctctgtcacttctccagctgag

SEQ ID NO: 7191272 - DNA, 22 bp, Homo sapiens
ctctgtcacttctccagctgag

SEQ ID NO: 7191273 - DNA, 22 bp, Homo sapiens
ctctgtcaggctgcagatgctc

SEQ ID NO: 7191274 - DNA, 22 bp, Homo sapiens
agtgggagaatgaataagggcc

SEQ ID NO: 7191275 - DNA, 22 bp, Homo sapiens
agtgggagagaagcaagtagta

SEQ ID NO: 7191276 - DNA, 22 bp, Homo sapiens
agtgggagaatgaataagggcc

SEQ ID NO: 7191277 - DNA, 22 bp, Homo sapiens
agtgggactgctatgacagaag

SEQ ID NO: 7191278 - DNA, 22 bp, Homo sapiens
agtgggagaatgaataagggcc

SEQ ID NO: 7191279 - DNA, 22 bp, Homo sapiens
ctctggggttagatctgatgct

SEQ ID NO: 7191280 - DNA, 22 bp, Homo sapiens
ctctggggttagatctgatgct

SEQ ID NO: 7191281 - DNA, 22 bp, Homo sapiens
ctctggggttagatctgatgct

SEQ ID NO: 7191282 - DNA, 22 bp, Homo sapiens
ctctggtttctgacctgaattt

SEQ ID NO: 7191283 - DNA, 21 bp, Homo sapiens
ctctggtttgcattggattat

SEQ ID NO: 7191284 - DNA, 15 bp, Homo sapiens
ctctggtttttcttc

SEQ ID NO: 7191285 - DNA, 22 bp, Homo sapiens
ctctggtttttcttccattaag

SEQ ID NO: 7191286 - DNA, 22 bp, Homo sapiens
ctcgcctgcctgtgtctctccc

SEQ ID NO: 7191287 - DNA, 22 bp, Homo sapiens
ctcggagatgctggctgagatc

SEQ ID NO: 7191288 - DNA, 22 bp, Homo sapiens
ctcggagggcaacagaagtgct

SEQ ID NO: 7191289 - DNA, 22 bp, Homo sapiens
ctcggaggtttgttaagtggct

SEQ ID NO: 7191290 - DNA, 22 bp, Homo sapiens
ctcggaggtttgttaagtggct

SEQ ID NO: 7191291 - DNA, 22 bp, Homo sapiens
ctccttttcctactcatactat

SEQ ID NO: 7191292 - DNA, 22 bp, Homo sapiens
ctcgcatgccctgcctcatcca

SEQ ID NO: 7191293 - DNA, 18 bp, Homo sapiens
ctcctttccctacacctc

SEQ ID NO: 7191294 - DNA, 22 bp, Homo sapiens
ctccttttcctactcatactat

SEQ ID NO: 7191295 - DNA, 22 bp, Homo sapiens
ctcctttgatcccaaatgaccc

SEQ ID NO: 7191296 - DNA, 22 bp, Homo sapiens
ctccttggtgtagtactgagca

SEQ ID NO: 7191297 - DNA, 18 bp, Homo sapiens
ctccttggagaagaggcc

SEQ ID NO: 7191298 - DNA, 19 bp, Homo sapiens
ctccttgccatttcttttc

SEQ ID NO: 7191299 - DNA, 22 bp, Homo sapiens
ctcctgaggggacaggactcat

SEQ ID NO: 7191300 - DNA, 22 bp, Homo sapiens
ctcctgagtagtagcattgtca

SEQ ID NO: 7191301 - DNA, 22 bp, Homo sapiens
ctcctgaggggacaggactcat

SEQ ID NO: 7191302 - DNA, 22 bp, Homo sapiens
ctcctgagtagtagcattgtca

SEQ ID NO: 7191303 - DNA, 22 bp, Homo sapiens
ctcctgagtctccacgccccgt

SEQ ID NO: 7191304 - DNA, 17 bp, Homo sapiens
ctcctgagtgaaaggga

SEQ ID NO: 7191305 - DNA, 22 bp, Homo sapiens
ctcctgcaggtcagcaggcttg

SEQ ID NO: 7191306 - DNA, 22 bp, Homo sapiens
ctccttctgaggctctgggttc

SEQ ID NO: 7191307 - DNA, 22 bp, Homo sapiens
ctccttctgggcctggcagtgg

SEQ ID NO: 7191308 - DNA, 22 bp, Homo sapiens
ctcctggttcagagagctgaga

SEQ ID NO: 7191309 - DNA, 22 bp, Homo sapiens
ctcctggttcagagagctgaga

SEQ ID NO: 7191310 - DNA, 22 bp, Homo sapiens
ctcctggttcctgtcttaaata

SEQ ID NO: 7191311 - DNA, 22 bp, Homo sapiens
ctccttctcctcgggaggccag

SEQ ID NO: 7191312 - DNA, 22 bp, Homo sapiens
ctcctgcagtatgtttctctat

SEQ ID NO: 7191313 - DNA, 22 bp, Homo sapiens
ctcctgcatgctcacatatgcc

SEQ ID NO: 7191314 - DNA, 22 bp, Homo sapiens
ctcctgccaccgcggtgtcctg

SEQ ID NO: 7191315 - DNA, 22 bp, Homo sapiens
ctcctgccaccgcggtgtcctg

SEQ ID NO: 7191316 - DNA, 22 bp, Homo sapiens
ctcctggtgctggggctgccgc

SEQ ID NO: 7191317 - DNA, 22 bp, Homo sapiens
ctcctgagggatgcttaggctt

SEQ ID NO: 7191318 - DNA, 22 bp, Homo sapiens
ctcctgaggggacaggactcat

SEQ ID NO: 7191319 - DNA, 22 bp, Homo sapiens
ctcctgaggacttctattgggt

SEQ ID NO: 7191320 - DNA, 22 bp, Homo sapiens
ctcctgagggatgcttaggctt

SEQ ID NO: 7191321 - DNA, 22 bp, Homo sapiens
ctcctgagggatgcttaggctt

SEQ ID NO: 7191322 - DNA, 22 bp, Homo sapiens
ctcctgaggaaaagcttggtca

SEQ ID NO: 7191323 - DNA, 22 bp, Homo sapiens
agtgctggattacaggcgtgag

SEQ ID NO: 7191324 - DNA, 22 bp, Homo sapiens
ctcctgaggaaaagcttggtca

SEQ ID NO: 7191325 - DNA, 22 bp, Homo sapiens
agtgctggattacaggcgtgag

SEQ ID NO: 7191326 - DNA, 22 bp, Homo sapiens
agtgctggattacaggcgtgag

SEQ ID NO: 7191327 - DNA, 22 bp, Homo sapiens
agtgctggagggaggcaggttc

SEQ ID NO: 7191328 - DNA, 22 bp, Homo sapiens
agtgctggagggaggcaggttc

SEQ ID NO: 7191329 - DNA, 22 bp, Homo sapiens
agtgctggagggaggcaggttc

SEQ ID NO: 7191330 - DNA, 23 bp, Homo sapiens
agtgctggagaagcttctggctt

SEQ ID NO: 7191331 - DNA, 22 bp, Homo sapiens
agtgctgagtgattgcaaagga

SEQ ID NO: 7191332 - DNA, 22 bp, Homo sapiens
agtgctggaaagggacggagga

SEQ ID NO: 7191333 - DNA, 22 bp, Homo sapiens
agtgctgaggccatactccata

SEQ ID NO: 7191334 - DNA, 22 bp, Homo sapiens
agtgctgactctgggcacagtg

SEQ ID NO: 7191335 - DNA, 22 bp, Homo sapiens
agtgctgactctgggcacagtg

SEQ ID NO: 7191336 - DNA, 22 bp, Homo sapiens
agtgctatcgagttctaatgct

SEQ ID NO: 7191337 - DNA, 22 bp, Homo sapiens
agtgctatcgagttctaatgct

SEQ ID NO: 7191338 - DNA, 22 bp, Homo sapiens
ctccagagagtccagctctggg

SEQ ID NO: 7191339 - DNA, 22 bp, Homo sapiens
ctccagagagtccagctctggg

SEQ ID NO: 7191340 - DNA, 22 bp, Homo sapiens
ctccagagagtccagctctggg

SEQ ID NO: 7191341 - DNA, 22 bp, Homo sapiens
ctctccattccctacagttttc

SEQ ID NO: 7191342 - DNA, 22 bp, Homo sapiens
ctctccatctgtgtgacctccc

SEQ ID NO: 7191343 - DNA, 22 bp, Homo sapiens
ctctccattccctacagttttc

SEQ ID NO: 7191344 - DNA, 22 bp, Homo sapiens
ctctccatctgtgtgacctccc

SEQ ID NO: 7191345 - DNA, 22 bp, Homo sapiens
ctctccatctgtgtgacctccc

SEQ ID NO: 7191346 - DNA, 22 bp, Homo sapiens
ctctccactcagcgtcatgtcc

SEQ ID NO: 7191347 - DNA, 19 bp, Homo sapiens
ctctccacctaacaggtat

SEQ ID NO: 7191348 - DNA, 23 bp, Homo sapiens
ctctccaccttcccacccaggga

SEQ ID NO: 7191349 - DNA, 19 bp, Homo sapiens
ctctccacctaacaggtat

SEQ ID NO: 7191350 - DNA, 22 bp, Homo sapiens
agtgctgggctatctactgcta

SEQ ID NO: 7191351 - DNA, 22 bp, Homo sapiens
agtgctgggattgcaggcatga

SEQ ID NO: 7191352 - DNA, 22 bp, Homo sapiens
agtgctgggattgcaggcatga

SEQ ID NO: 7191353 - DNA, 22 bp, Homo sapiens
agtgctgggattgcaggcatga

SEQ ID NO: 7191354 - DNA, 22 bp, Homo sapiens
agtgctgggctatctactgcta

SEQ ID NO: 7191355 - DNA, 22 bp, Homo sapiens
agtgctgggattgcaggcatga

SEQ ID NO: 7191356 - DNA, 22 bp, Homo sapiens
agtgctgggattgcaggcatga

SEQ ID NO: 7191357 - DNA, 22 bp, Homo sapiens
agtgctgggattgcaggcatga

SEQ ID NO: 7191358 - DNA, 22 bp, Homo sapiens
agtgctgggattacaggcataa

SEQ ID NO: 7191359 - DNA, 22 bp, Homo sapiens
agtgctgggattacaggcataa

SEQ ID NO: 7191360 - DNA, 22 bp, Homo sapiens
agtgctgggattacaggcataa

SEQ ID NO: 7191361 - DNA, 22 bp, Homo sapiens
agtgctgggattacaggcataa

SEQ ID NO: 7191362 - DNA, 22 bp, Homo sapiens
agtgctgggattacaggcataa

SEQ ID NO: 7191363 - DNA, 22 bp, Homo sapiens
agtgctggcccatagctgctgg

SEQ ID NO: 7191364 - DNA, 22 bp, Homo sapiens
agtgctgggattacaggcataa

SEQ ID NO: 7191365 - DNA, 22 bp, Homo sapiens
agtgctggcccatagctgctgg

SEQ ID NO: 7191366 - DNA, 22 bp, Homo sapiens
ctcgggcttgaggctgtttacc

SEQ ID NO: 7191367 - DNA, 22 bp, Homo sapiens
ctcgggcttgaggctgtttacc

SEQ ID NO: 7191368 - DNA, 22 bp, Homo sapiens
agtgctggcccatagctgctgg

SEQ ID NO: 7191369 - DNA, 22 bp, Homo sapiens
ctcggcaggtggaggttgtagt

SEQ ID NO: 7191370 - DNA, 22 bp, Homo sapiens
ctcggcaggtggaggttgtagt

SEQ ID NO: 7191371 - DNA, 22 bp, Homo sapiens
ctcggcaggtggaggttgtagt

SEQ ID NO: 7191372 - DNA, 22 bp, Homo sapiens
ctcggcaggtggaggttgtagt

SEQ ID NO: 7191373 - DNA, 22 bp, Homo sapiens
ctcggcaggtggaggttgtagt

SEQ ID NO: 7191374 - DNA, 22 bp, Homo sapiens
ctcggctgtgtgggtcccgggc

SEQ ID NO: 7191375 - DNA, 22 bp, Homo sapiens
ctcgggcaccctggttctggtg

SEQ ID NO: 7191376 - DNA, 22 bp, Homo sapiens
ctctcccagtcaggctcaggat

SEQ ID NO: 7191377 - DNA, 22 bp, Homo sapiens
ctctcccagtcaggctcaggat

SEQ ID NO: 7191378 - DNA, 20 bp, Homo sapiens
ctctcccagcacagcttcct

SEQ ID NO: 7191379 - DNA, 22 bp, Homo sapiens
ctctcccagtcaggctcaggat

SEQ ID NO: 7191380 - DNA, 22 bp, Homo sapiens
ctctcccagtcaggctcaggat

SEQ ID NO: 7191381 - DNA, 20 bp, Homo sapiens
ctctcccagcacagcttcct

SEQ ID NO: 7191382 - DNA, 20 bp, Homo sapiens
ctctcccagcacagcttcct

SEQ ID NO: 7191383 - DNA, 20 bp, Homo sapiens
ctctcccagcacagcttcct

SEQ ID NO: 7191384 - DNA, 22 bp, Homo sapiens
ctctcccagtcaggctcaggat

SEQ ID NO: 7191385 - DNA, 22 bp, Homo sapiens
ctctcccagtcaggctcaggat

SEQ ID NO: 7191386 - DNA, 22 bp, Homo sapiens
ctctcccagtcaggctcaggat

SEQ ID NO: 7191387 - DNA, 22 bp, Homo sapiens
ctctcccagtcaggctcaggat

SEQ ID NO: 7191388 - DNA, 22 bp, Homo sapiens
ctctccccacaccctctgcatg

SEQ ID NO: 7191389 - DNA, 22 bp, Homo sapiens
ctctccccacaccctctgcatg

SEQ ID NO: 7191390 - DNA, 22 bp, Homo sapiens
ctctccccacaccctctgcatg

SEQ ID NO: 7191391 - DNA, 17 bp, Homo sapiens
ctctccttcctctgagg

SEQ ID NO: 7191392 - DNA, 22 bp, Homo sapiens
ctctcgccagcggggctgcgct

SEQ ID NO: 7191393 - DNA, 22 bp, Homo sapiens
ctctcgccagcggggctgcgct

SEQ ID NO: 7191394 - DNA, 22 bp, Homo sapiens
ctctcgccagcggggctgcgct

SEQ ID NO: 7191395 - DNA, 22 bp, Homo sapiens
ctctcggggaaggaggtacatt

SEQ ID NO: 7191396 - DNA, 22 bp, Homo sapiens
ctctctaacgacattcccattc

SEQ ID NO: 7191397 - DNA, 22 bp, Homo sapiens
ctctctaacgacattcccattc

SEQ ID NO: 7191398 - DNA, 22 bp, Homo sapiens
ctctctaagaacttgatcttgt

SEQ ID NO: 7191399 - DNA, 22 bp, Homo sapiens
ctctctaagaacttgatcttgt

SEQ ID NO: 7191400 - DNA, 22 bp, Homo sapiens
ctctctaagctccacatttcct

SEQ ID NO: 7191401 - DNA, 22 bp, Homo sapiens
ctctctaagctccacatttcct

SEQ ID NO: 7191402 - DNA, 22 bp, Homo sapiens
ctctctagaggcccaccttgag

SEQ ID NO: 7191403 - DNA, 21 bp, Homo sapiens
ctctctagatggcttccagcc

SEQ ID NO: 7191404 - DNA, 22 bp, Homo sapiens
ctctctagaggcccaccttgag

SEQ ID NO: 7191405 - DNA, 22 bp, Homo sapiens
ctctctatggatgcagtttttc

SEQ ID NO: 7191406 - DNA, 22 bp, Homo sapiens
ctctctcagtgtaatacaggat

SEQ ID NO: 7191407 - DNA, 22 bp, Homo sapiens
ctctctcagtgtaatacaggat

SEQ ID NO: 7191408 - DNA, 19 bp, Homo sapiens
ctctctccagtggctggct

SEQ ID NO: 7191409 - DNA, 22 bp, Homo sapiens
ctctcctttactgcagagagcg

SEQ ID NO: 7191410 - DNA, 22 bp, Homo sapiens
ctctcctttactgcagagagcg

SEQ ID NO: 7191411 - DNA, 22 bp, Homo sapiens
ctctcctttactgcagagagcg

SEQ ID NO: 7191412 - DNA, 22 bp, Homo sapiens
ctctcctttcactaaatattct

SEQ ID NO: 7191413 - DNA, 22 bp, Homo sapiens
ctctcctttcactaaatattct

SEQ ID NO: 7191414 - DNA, 22 bp, Homo sapiens
ctctcctttgaagcaactgtat

SEQ ID NO: 7191415 - DNA, 22 bp, Homo sapiens
ctctcctttgaagcaactgtat

SEQ ID NO: 7191416 - DNA, 20 bp, Homo sapiens
ctctccttgccgacttggca

SEQ ID NO: 7191417 - DNA, 20 bp, Homo sapiens
ctctccttgccgacttggca

SEQ ID NO: 7191418 - DNA, 22 bp, Homo sapiens
ctctccttgcagatggctgcct

SEQ ID NO: 7191419 - DNA, 22 bp, Homo sapiens
ctctccttgcagatggctgcct

SEQ ID NO: 7191420 - DNA, 22 bp, Homo sapiens
ctctccttgaggcttggacttc

SEQ ID NO: 7191421 - DNA, 22 bp, Homo sapiens
ctctccttgaggcttggacttc

SEQ ID NO: 7191422 - DNA, 22 bp, Homo sapiens
ctctccttgcagatggctgcct

SEQ ID NO: 7191423 - DNA, 22 bp, Homo sapiens
ctctccttgcagatggctgcct

SEQ ID NO: 7191424 - DNA, 17 bp, Homo sapiens
ctctccttcctctgagg

SEQ ID NO: 7191425 - DNA, 22 bp, Homo sapiens
aggtggctctgacagctctggt

SEQ ID NO: 7191426 - DNA, 22 bp, Homo sapiens
aggtggcatgagactgtaccag

SEQ ID NO: 7191427 - DNA, 20 bp, Homo sapiens
aggtggctcttcctgggctt

SEQ ID NO: 7191428 - DNA, 20 bp, Homo sapiens
aggtggctcttcctgggctt

SEQ ID NO: 7191429 - DNA, 20 bp, Homo sapiens
aggtggctcttcctgggctt

SEQ ID NO: 7191430 - DNA, 22 bp, Homo sapiens
aggtgctgtttgtcagcagttt

SEQ ID NO: 7191431 - DNA, 22 bp, Homo sapiens
aggtgctgttggcagcgggcag

SEQ ID NO: 7191432 - DNA, 22 bp, Homo sapiens
aggtgctgtttgtcagcagttt

SEQ ID NO: 7191433 - DNA, 22 bp, Homo sapiens
aggtgctgttggcagcgggcag

SEQ ID NO: 7191434 - DNA, 22 bp, Homo sapiens
aggtgctgttggcagcgggcag

SEQ ID NO: 7191435 - DNA, 22 bp, Homo sapiens
aggtgctgtgctatgcacttgt

SEQ ID NO: 7191436 - DNA, 22 bp, Homo sapiens
aggtgctgggcagcagtcattg

SEQ ID NO: 7191437 - DNA, 19 bp, Homo sapiens
aggtgctggtgagggtgtt

SEQ ID NO: 7191438 - DNA, 22 bp, Homo sapiens
aggtgctgggcagcagtcattg

SEQ ID NO: 7191439 - DNA, 22 bp, Homo sapiens
aggtgctggcgccccaggagac

SEQ ID NO: 7191440 - DNA, 22 bp, Homo sapiens
aggtgctgggcagcagtcattg

SEQ ID NO: 7191441 - DNA, 22 bp, Homo sapiens
aggtgctggcgccccaggagac

SEQ ID NO: 7191442 - DNA, 22 bp, Homo sapiens
aggtgctggcgccccaggagac

SEQ ID NO: 7191443 - DNA, 22 bp, Homo sapiens
aggtgctggagtctgggcagga

SEQ ID NO: 7191444 - DNA, 22 bp, Homo sapiens
aggtgctggagtctgggcagga

SEQ ID NO: 7191445 - DNA, 22 bp, Homo sapiens
aggtgctggagtctgggcagga

SEQ ID NO: 7191446 - DNA, 22 bp, Homo sapiens
aggtgctggagtagaagaaaaa

SEQ ID NO: 7191447 - DNA, 17 bp, Homo sapiens
aggtgctggagcatcag

SEQ ID NO: 7191448 - DNA, 22 bp, Homo sapiens
aggtgctgaactggtgaggtct

SEQ ID NO: 7191449 - DNA, 22 bp, Homo sapiens
aggtgctgaactggtgaggtct

SEQ ID NO: 7191450 - DNA, 22 bp, Homo sapiens
aggtgctgaactggtgaggtct

SEQ ID NO: 7191451 - DNA, 22 bp, Homo sapiens
aggtgctgccccgagaaggatg

SEQ ID NO: 7191452 - DNA, 17 bp, Homo sapiens
aggtgctggagcatcag

SEQ ID NO: 7191453 - DNA, 17 bp, Homo sapiens
aggtgctggagcatcag

SEQ ID NO: 7191454 - DNA, 22 bp, Homo sapiens
cctgggaagtggaggttacagt

SEQ ID NO: 7191455 - DNA, 22 bp, Homo sapiens
cctgggaagtggaggttacagt

SEQ ID NO: 7191456 - DNA, 22 bp, Homo sapiens
cctgggaagttgtggctgcagt

SEQ ID NO: 7191457 - DNA, 22 bp, Homo sapiens
cctgggaagttgtggctgcagt

SEQ ID NO: 7191458 - DNA, 22 bp, Homo sapiens
cctgggaagttgtggctgcagt

SEQ ID NO: 7191459 - DNA, 22 bp, Homo sapiens
cctgggaatcggtgcgttgagg

SEQ ID NO: 7191460 - DNA, 22 bp, Homo sapiens
cctgggaatcggtgcgttgagg

SEQ ID NO: 7191461 - DNA, 22 bp, Homo sapiens
cctgggaatctgcattgtcagc

SEQ ID NO: 7191462 - DNA, 22 bp, Homo sapiens
cctgggaatctgcattgtcagc

SEQ ID NO: 7191463 - DNA, 22 bp, Homo sapiens
cctgggaatgatgaccttgcct

SEQ ID NO: 7191464 - DNA, 22 bp, Homo sapiens
cctgggaatgatgaccttgcct

SEQ ID NO: 7191465 - DNA, 21 bp, Homo sapiens
cctgggacactcaccagctcc

SEQ ID NO: 7191466 - DNA, 22 bp, Homo sapiens
cctgggacctcgcgggaagcgg

SEQ ID NO: 7191467 - DNA, 21 bp, Homo sapiens
cctgggacactcaccagctcc

SEQ ID NO: 7191468 - DNA, 22 bp, Homo sapiens
cctgggacctcgcgggaagcgg

SEQ ID NO: 7191469 - DNA, 22 bp, Homo sapiens
cctgggacctcgcgggaagcgg

SEQ ID NO: 7191470 - DNA, 22 bp, Homo sapiens
cctgggacgactctgtaccctt

SEQ ID NO: 7191471 - DNA, 22 bp, Homo sapiens
cctgggactcggccaggacaga

SEQ ID NO: 7191472 - DNA, 22 bp, Homo sapiens
aggtgcaggagctgtgcaggga

SEQ ID NO: 7191473 - DNA, 22 bp, Homo sapiens
aggtgcaggagctgtgcaggga

SEQ ID NO: 7191474 - DNA, 19 bp, Homo sapiens
cctgggacttaggctgggt

SEQ ID NO: 7191475 - DNA, 19 bp, Homo sapiens
cctgggacttaggctgggt

SEQ ID NO: 7191476 - DNA, 22 bp, Homo sapiens
cctgggacttggtctggggttt

SEQ ID NO: 7191477 - DNA, 22 bp, Homo sapiens
cctgggagaactgctgggttgg

SEQ ID NO: 7191478 - DNA, 22 bp, Homo sapiens
cctgggagaactgctgggttgg

SEQ ID NO: 7191479 - DNA, 22 bp, Homo sapiens
cctgggagaactgctgggttgg

SEQ ID NO: 7191480 - DNA, 22 bp, Homo sapiens
cctgggactcggccaggacaga

SEQ ID NO: 7191481 - DNA, 22 bp, Homo sapiens
cctgggactcggccaggacaga

SEQ ID NO: 7191482 - DNA, 19 bp, Homo sapiens
cctgggacttaggctgggt

SEQ ID NO: 7191483 - DNA, 22 bp, Homo sapiens
aggtgcaggagctgtgcaggga

SEQ ID NO: 7191484 - DNA, 22 bp, Homo sapiens
aggtgccagctctcaggcagga

SEQ ID NO: 7191485 - DNA, 22 bp, Homo sapiens
aggtgccaggagggaatttagg

SEQ ID NO: 7191486 - DNA, 22 bp, Homo sapiens
aggtgccattgcttgccagttt

SEQ ID NO: 7191487 - DNA, 23 bp, Homo sapiens
aggtgcccagggcaggtttactg

SEQ ID NO: 7191488 - DNA, 18 bp, Homo sapiens
aggtgccctccttacact

SEQ ID NO: 7191489 - DNA, 22 bp, Homo sapiens
aggtgcctatctggtctctgca

SEQ ID NO: 7191490 - DNA, 22 bp, Homo sapiens
aggtgcctatctggtctctgca

SEQ ID NO: 7191491 - DNA, 22 bp, Homo sapiens
aggtgcctgggagctccctgag

SEQ ID NO: 7191492 - DNA, 22 bp, Homo sapiens
aggtgcctgtcgtctctggtta

SEQ ID NO: 7191493 - DNA, 18 bp, Homo sapiens
aggtgctcaaatgggaaa

SEQ ID NO: 7191494 - DNA, 22 bp, Homo sapiens
aggtgctctaggtatctacttt

SEQ ID NO: 7191495 - DNA, 22 bp, Homo sapiens
aggtgctctaggtatctacttt

SEQ ID NO: 7191496 - DNA, 22 bp, Homo sapiens
aggtgggaacccagcagggccc

SEQ ID NO: 7191497 - DNA, 22 bp, Homo sapiens
aggtgggaacccagcagggccc

SEQ ID NO: 7191498 - DNA, 22 bp, Homo sapiens
aggtggcttctggccaggtgtg

SEQ ID NO: 7191499 - DNA, 22 bp, Homo sapiens
aggtgggaacccagcagggccc

SEQ ID NO: 7191500 - DNA, 22 bp, Homo sapiens
aggtgggacccgtggggtgcga

SEQ ID NO: 7191501 - DNA, 22 bp, Homo sapiens
aggtgggacccgtggggtgcga

SEQ ID NO: 7191502 - DNA, 22 bp, Homo sapiens
aggtgggacccgtggggtgcga

SEQ ID NO: 7191503 - DNA, 22 bp, Homo sapiens
aggtgggacccgtggggtgcga

SEQ ID NO: 7191504 - DNA, 22 bp, Homo sapiens
aggtgggcaatgaggcctgagt

SEQ ID NO: 7191505 - DNA, 22 bp, Homo sapiens
ccttctctctgaagaccccaaa

SEQ ID NO: 7191506 - DNA, 21 bp, Homo sapiens
aggtgggagaccatgtaggtc

SEQ ID NO: 7191507 - DNA, 21 bp, Homo sapiens
aggtgggagaccatgtaggtc

SEQ ID NO: 7191508 - DNA, 22 bp, Homo sapiens
aggtgggacccgtggggtgcga

SEQ ID NO: 7191509 - DNA, 22 bp, Homo sapiens
aggtgggacccgtggggtgcga

SEQ ID NO: 7191510 - DNA, 22 bp, Homo sapiens
aggtgggacccgtggggtgcga

SEQ ID NO: 7191511 - DNA, 22 bp, Homo sapiens
aggtgggacccgtggggtgcga

SEQ ID NO: 7191512 - DNA, 21 bp, Homo sapiens
aggtgggagaccatgtaggtc

SEQ ID NO: 7191513 - DNA, 21 bp, Homo sapiens
aggtgggagaccatgtaggtc

SEQ ID NO: 7191514 - DNA, 22 bp, Homo sapiens
aggtggcttctggccaggtgtg

SEQ ID NO: 7191515 - DNA, 22 bp, Homo sapiens
aggtggcttctggccaggtgtg

SEQ ID NO: 7191516 - DNA, 22 bp, Homo sapiens
aggtggctgtattcagctgtaa

SEQ ID NO: 7191517 - DNA, 22 bp, Homo sapiens
aggtggctgtattcagctgtaa

SEQ ID NO: 7191518 - DNA, 22 bp, Homo sapiens
aggtggctggtccaggctgcag

SEQ ID NO: 7191519 - DNA, 22 bp, Homo sapiens
aggtggctggtccaggctgcag

SEQ ID NO: 7191520 - DNA, 22 bp, Homo sapiens
aggtggctggtccaggctgcag

SEQ ID NO: 7191521 - DNA, 22 bp, Homo sapiens
aggtggctgcctccccgcgcgg

SEQ ID NO: 7191522 - DNA, 17 bp, Homo sapiens
aggtggctgctgcgcct

SEQ ID NO: 7191523 - DNA, 22 bp, Homo sapiens
ccttggagcggtcagcactggt

SEQ ID NO: 7191524 - DNA, 22 bp, Homo sapiens
ccttggagcggtcagcactggt

SEQ ID NO: 7191525 - DNA, 22 bp, Homo sapiens
ccttggagcggtcagcactggt

SEQ ID NO: 7191526 - DNA, 22 bp, Homo sapiens
ccttggaggactgctgcttctt

SEQ ID NO: 7191527 - DNA, 19 bp, Homo sapiens
ccttggagttccaggtgga

SEQ ID NO: 7191528 - DNA, 19 bp, Homo sapiens
ccttggagttccaggtgga

SEQ ID NO: 7191529 - DNA, 22 bp, Homo sapiens
ccttgctgcgtgctagcacaga

SEQ ID NO: 7191530 - DNA, 22 bp, Homo sapiens
ccttgctgttagcctacattat

SEQ ID NO: 7191531 - DNA, 22 bp, Homo sapiens
ccttggagaagacagtgccagg

SEQ ID NO: 7191532 - DNA, 22 bp, Homo sapiens
ccttggagaagacagtgccagg

SEQ ID NO: 7191533 - DNA, 22 bp, Homo sapiens
ccttggagaagacagtgccagg

SEQ ID NO: 7191534 - DNA, 22 bp, Homo sapiens
ccttggagacaggtttgctttc

SEQ ID NO: 7191535 - DNA, 22 bp, Homo sapiens
ccttggagacctgggtctgtgc

SEQ ID NO: 7191536 - DNA, 22 bp, Homo sapiens
ccttggagacctgggtctgtgc

SEQ ID NO: 7191537 - DNA, 22 bp, Homo sapiens
ccttggagacctgggtctgtgc

SEQ ID NO: 7191538 - DNA, 22 bp, Homo sapiens
ccttgctgaccatcacctttga

SEQ ID NO: 7191539 - DNA, 22 bp, Homo sapiens
ccttgctcatcccccagtgcct

SEQ ID NO: 7191540 - DNA, 22 bp, Homo sapiens
ccttgctcatcccccagtgcct

SEQ ID NO: 7191541 - DNA, 22 bp, Homo sapiens
ccttgctcatcccccagtgcct

SEQ ID NO: 7191542 - DNA, 22 bp, Homo sapiens
ccttgctcaagctagtgacggg

SEQ ID NO: 7191543 - DNA, 22 bp, Homo sapiens
ccttctctgcaggtagttggct

SEQ ID NO: 7191544 - DNA, 20 bp, Homo sapiens
ccttctctggaattgcctcc

SEQ ID NO: 7191545 - DNA, 22 bp, Homo sapiens
aggtggggctgggaaagattcc

SEQ ID NO: 7191546 - DNA, 22 bp, Homo sapiens
aggtgggggctgtgtccttgac

SEQ ID NO: 7191547 - DNA, 21 bp, Homo sapiens
aggtggggctgcacctctgct

SEQ ID NO: 7191548 - DNA, 22 bp, Homo sapiens
ccttggctgaggagggagctga

SEQ ID NO: 7191549 - DNA, 22 bp, Homo sapiens
aggtggggctgggaaagattcc

SEQ ID NO: 7191550 - DNA, 22 bp, Homo sapiens
aggtggggctgggaaagattcc

SEQ ID NO: 7191551 - DNA, 22 bp, Homo sapiens
ccttggccctagcctcaggcaa

SEQ ID NO: 7191552 - DNA, 22 bp, Homo sapiens
ccttggccctagcctcaggcaa

SEQ ID NO: 7191553 - DNA, 22 bp, Homo sapiens
ccttggctaaactcaatccagc

SEQ ID NO: 7191554 - DNA, 22 bp, Homo sapiens
ccttggctaggcagcggctgtc

SEQ ID NO: 7191555 - DNA, 22 bp, Homo sapiens
ccttggctgaggagggagctga

SEQ ID NO: 7191556 - DNA, 22 bp, Homo sapiens
ccttggagttctgtttggctta

SEQ ID NO: 7191557 - DNA, 22 bp, Homo sapiens
ccttggcaaaccagggcagctg

SEQ ID NO: 7191558 - DNA, 22 bp, Homo sapiens
ccttggcaaaccagggcagctg

SEQ ID NO: 7191559 - DNA, 22 bp, Homo sapiens
ccttggcaaaccagggcagctg

SEQ ID NO: 7191560 - DNA, 22 bp, Homo sapiens
ccttggcaagacagtggagggt

SEQ ID NO: 7191561 - DNA, 22 bp, Homo sapiens
ccttggcagtggagtgaggtgg

SEQ ID NO: 7191562 - DNA, 22 bp, Homo sapiens
ccttggcatcctctgaagaaat

SEQ ID NO: 7191563 - DNA, 22 bp, Homo sapiens
ccttggcatgtggcatgtggct

SEQ ID NO: 7191564 - DNA, 22 bp, Homo sapiens
ccttggccctagcctcaggcaa

SEQ ID NO: 7191565 - DNA, 22 bp, Homo sapiens
cggccctggcggaggcgggaga

SEQ ID NO: 7191566 - DNA, 22 bp, Homo sapiens
cggccctggcggaggcgggaga

SEQ ID NO: 7191567 - DNA, 22 bp, Homo sapiens
cggccgcagcagtgtcggccca

SEQ ID NO: 7191568 - DNA, 22 bp, Homo sapiens
cggccctgaccagaccttagtt

SEQ ID NO: 7191569 - DNA, 22 bp, Homo sapiens
cggccctgctgagcttgtctgg

SEQ ID NO: 7191570 - DNA, 22 bp, Homo sapiens
cggctcactgcagctccgcctc

SEQ ID NO: 7191571 - DNA, 22 bp, Homo sapiens
cggctcactgcagctccgcctc

SEQ ID NO: 7191572 - DNA, 22 bp, Homo sapiens
cggcgttggagcgggctttggt

SEQ ID NO: 7191573 - DNA, 22 bp, Homo sapiens
cggctcactgcagctccgcctc

SEQ ID NO: 7191574 - DNA, 22 bp, Homo sapiens
cggctcactgcagctccgcctc

SEQ ID NO: 7191575 - DNA, 22 bp, Homo sapiens
cggctcactgcagctccgcctc

SEQ ID NO: 7191576 - DNA, 22 bp, Homo sapiens
cggctcactgcagctccgcctc

SEQ ID NO: 7191577 - DNA, 22 bp, Homo sapiens
cggctcagacttcccaagaaca

SEQ ID NO: 7191578 - DNA, 22 bp, Homo sapiens
cggctcagacttcccaagaaca

SEQ ID NO: 7191579 - DNA, 22 bp, Homo sapiens
cggctcagacttcccaagaaca

SEQ ID NO: 7191580 - DNA, 20 bp, Homo sapiens
cggctcagcctctccctccc

SEQ ID NO: 7191581 - DNA, 20 bp, Homo sapiens
cggctcagcctctccctccc

SEQ ID NO: 7191582 - DNA, 20 bp, Homo sapiens
cggctcagcctctccctccc

SEQ ID NO: 7191583 - DNA, 20 bp, Homo sapiens
agtaggggaatgcaagagca

SEQ ID NO: 7191584 - DNA, 22 bp, Homo sapiens
agtatatttgttaagattattc

SEQ ID NO: 7191585 - DNA, 22 bp, Homo sapiens
agtatatttgttaagattattc

SEQ ID NO: 7191586 - DNA, 22 bp, Homo sapiens
agtatatttgttaagattattc

SEQ ID NO: 7191587 - DNA, 22 bp, Homo sapiens
agtatattttgattgtatgtgt

SEQ ID NO: 7191588 - DNA, 22 bp, Homo sapiens
agtatcaaagggcatgtggtta

SEQ ID NO: 7191589 - DNA, 22 bp, Homo sapiens
agtatcaaggatctccagcacc

SEQ ID NO: 7191590 - DNA, 22 bp, Homo sapiens
agtatatttgttaagattattc

SEQ ID NO: 7191591 - DNA, 22 bp, Homo sapiens
agtatatttgttaagattattc

SEQ ID NO: 7191592 - DNA, 22 bp, Homo sapiens
agtatatttgttaagattattc

SEQ ID NO: 7191593 - DNA, 22 bp, Homo sapiens
agtatatttaccattgggtggg

SEQ ID NO: 7191594 - DNA, 22 bp, Homo sapiens
agtatattgctcttaatcatag

SEQ ID NO: 7191595 - DNA, 22 bp, Homo sapiens
agtatattggtgttattcctca

SEQ ID NO: 7191596 - DNA, 22 bp, Homo sapiens
agtatattggtgttattcctca

SEQ ID NO: 7191597 - DNA, 22 bp, Homo sapiens
agtatattggtgttattcctca

SEQ ID NO: 7191598 - DNA, 22 bp, Homo sapiens
agtatatcacatgtagtaatgg

SEQ ID NO: 7191599 - DNA, 22 bp, Homo sapiens
agtatatggggaattgcataat

SEQ ID NO: 7191600 - DNA, 22 bp, Homo sapiens
agtatatgtgcacatatgcatg

SEQ ID NO: 7191601 - DNA, 22 bp, Homo sapiens
agtatattgctcttaatcatag

SEQ ID NO: 7191602 - DNA, 22 bp, Homo sapiens
agtatattgctcttaatcatag

SEQ ID NO: 7191603 - DNA, 22 bp, Homo sapiens
agtatattgctcttaatcatag

SEQ ID NO: 7191604 - DNA, 22 bp, Homo sapiens
agtatattgctcttaatcatag

SEQ ID NO: 7191605 - DNA, 22 bp, Homo sapiens
agtatatatgaggaaccacaaa

SEQ ID NO: 7191606 - DNA, 22 bp, Homo sapiens
agtatatatgaggaaccacaaa

SEQ ID NO: 7191607 - DNA, 22 bp, Homo sapiens
cggccaagccggggccccgaag

SEQ ID NO: 7191608 - DNA, 22 bp, Homo sapiens
cggccaagccggggccccgaag

SEQ ID NO: 7191609 - DNA, 21 bp, Homo sapiens
cggccaaattcctcctaggga

SEQ ID NO: 7191610 - DNA, 22 bp, Homo sapiens
cggccaagccggggccccgaag

SEQ ID NO: 7191611 - DNA, 22 bp, Homo sapiens
cggaggttgaggctgcagtgag

SEQ ID NO: 7191612 - DNA, 22 bp, Homo sapiens
cggcatgggcgtccccctcact

SEQ ID NO: 7191613 - DNA, 22 bp, Homo sapiens
cggaggttgaggctgcagtgag

SEQ ID NO: 7191614 - DNA, 22 bp, Homo sapiens
cggccaagccggggccccgaag

SEQ ID NO: 7191615 - DNA, 22 bp, Homo sapiens
cggccaggcacagtggcccacg

SEQ ID NO: 7191616 - DNA, 22 bp, Homo sapiens
cggccaagccggggccccgaag

SEQ ID NO: 7191617 - DNA, 22 bp, Homo sapiens
cggccaggcacagtggcccacg

SEQ ID NO: 7191618 - DNA, 22 bp, Homo sapiens
cggaggggtttgaacagaggag

SEQ ID NO: 7191619 - DNA, 22 bp, Homo sapiens
cggaggggtttgaacagaggag

SEQ ID NO: 7191620 - DNA, 22 bp, Homo sapiens
cggaggggtttgaacagaggag

SEQ ID NO: 7191621 - DNA, 22 bp, Homo sapiens
cggaggggtttgaacagaggag

SEQ ID NO: 7191622 - DNA, 22 bp, Homo sapiens
cggaggggtttgaacagaggag

SEQ ID NO: 7191623 - DNA, 22 bp, Homo sapiens
cggaggggatacattttctgaa

SEQ ID NO: 7191624 - DNA, 22 bp, Homo sapiens
cggaggggatacattttctgaa

SEQ ID NO: 7191625 - DNA, 22 bp, Homo sapiens
cggaggggatacattttctgaa

SEQ ID NO: 7191626 - DNA, 22 bp, Homo sapiens
cggaggggtttgaacagaggag

SEQ ID NO: 7191627 - DNA, 21 bp, Homo sapiens
cggagctgggcagggcatccc

SEQ ID NO: 7191628 - DNA, 22 bp, Homo sapiens
cggagctggcgtctgtgtggac

SEQ ID NO: 7191629 - DNA, 22 bp, Homo sapiens
cggaggcaaactcacctggctc

SEQ ID NO: 7191630 - DNA, 22 bp, Homo sapiens
cggaggcaaactcacctggctc

SEQ ID NO: 7191631 - DNA, 23 bp, Homo sapiens
cggaggcaaatcggccatttaag

SEQ ID NO: 7191632 - DNA, 22 bp, Homo sapiens
cggagcgctgggggactctgca

SEQ ID NO: 7191633 - DNA, 22 bp, Homo sapiens
cggagctggcgtctgtgtggac

SEQ ID NO: 7191634 - DNA, 22 bp, Homo sapiens
cggagcctgcttgttgcagctg

SEQ ID NO: 7191635 - DNA, 22 bp, Homo sapiens
cggagcctgcttgttgcagctg

SEQ ID NO: 7191636 - DNA, 22 bp, Homo sapiens
cggagcgctgggggactctgca

SEQ ID NO: 7191637 - DNA, 22 bp, Homo sapiens
cggagcagaaggcgccgccggc

SEQ ID NO: 7191638 - DNA, 22 bp, Homo sapiens
cggagcctgcttgttgcagctg

SEQ ID NO: 7191639 - DNA, 21 bp, Homo sapiens
cgctccaccccacccactggc

SEQ ID NO: 7191640 - DNA, 20 bp, Homo sapiens
cgctccaccctggacctggc

SEQ ID NO: 7191641 - DNA, 22 bp, Homo sapiens
cctttattcaattagtcctaat

SEQ ID NO: 7191642 - DNA, 22 bp, Homo sapiens
cctttattcaattagtcctaat

SEQ ID NO: 7191643 - DNA, 22 bp, Homo sapiens
aggtggggttcagtctcagccg

SEQ ID NO: 7191644 - DNA, 22 bp, Homo sapiens
aggtggggttcagtctcagccg

SEQ ID NO: 7191645 - DNA, 22 bp, Homo sapiens
aggtggggtgttggatgtttat

SEQ ID NO: 7191646 - DNA, 22 bp, Homo sapiens
aggtggggtgttggatgtttat

SEQ ID NO: 7191647 - DNA, 22 bp, Homo sapiens
aggtggggtgttggatgtttat

SEQ ID NO: 7191648 - DNA, 22 bp, Homo sapiens
aggtggggtgagctgcagacta

SEQ ID NO: 7191649 - DNA, 22 bp, Homo sapiens
aggtggggtgagctgcagacta

SEQ ID NO: 7191650 - DNA, 22 bp, Homo sapiens
aggtggggtgagctgcagacta

SEQ ID NO: 7191651 - DNA, 22 bp, Homo sapiens
aggtggggtgagctgcagacta

SEQ ID NO: 7191652 - DNA, 22 bp, Homo sapiens
aggtgggggctgtgtccttgac

SEQ ID NO: 7191653 - DNA, 22 bp, Homo sapiens
aggtgggggctgtgtccttgac

SEQ ID NO: 7191654 - DNA, 22 bp, Homo sapiens
aggtggggtgagctgcagacta

SEQ ID NO: 7191655 - DNA, 22 bp, Homo sapiens
aggtgggggctgtgtccttgac

SEQ ID NO: 7191656 - DNA, 22 bp, Homo sapiens
aggtgggggctgtgtccttgac

SEQ ID NO: 7191657 - DNA, 22 bp, Homo sapiens
cctttggtgttattgggagaca

SEQ ID NO: 7191658 - DNA, 22 bp, Homo sapiens
cctttggtgttattgggagaca

SEQ ID NO: 7191659 - DNA, 22 bp, Homo sapiens
cctttggtggcttcaaaatggc

SEQ ID NO: 7191660 - DNA, 22 bp, Homo sapiens
cctttggtggttttcagagatc

SEQ ID NO: 7191661 - DNA, 22 bp, Homo sapiens
cctttggttgagtgaaagtaag

SEQ ID NO: 7191662 - DNA, 19 bp, Homo sapiens
cctttggtttccatgacat

SEQ ID NO: 7191663 - DNA, 22 bp, Homo sapiens
cctttggtcacctccactctta

SEQ ID NO: 7191664 - DNA, 22 bp, Homo sapiens
cctttggtcttgatgaactgtt

SEQ ID NO: 7191665 - DNA, 22 bp, Homo sapiens
cctttggtcttgatgaactgtt

SEQ ID NO: 7191666 - DNA, 19 bp, Homo sapiens
cctttggtttttggttcat

SEQ ID NO: 7191667 - DNA, 22 bp, Homo sapiens
cctttgtaagatgtgaagactg

SEQ ID NO: 7191668 - DNA, 22 bp, Homo sapiens
cctttgtatacagttcttgtga

SEQ ID NO: 7191669 - DNA, 22 bp, Homo sapiens
cctttgtatttacctagtctca

SEQ ID NO: 7191670 - DNA, 22 bp, Homo sapiens
cctttgtgaatatgcagaaaat

SEQ ID NO: 7191671 - DNA, 22 bp, Homo sapiens
cctttgtgcatctctgctccta

SEQ ID NO: 7191672 - DNA, 22 bp, Homo sapiens
cctttgtggtggcccagtgtgg

SEQ ID NO: 7191673 - DNA, 22 bp, Homo sapiens
cctttgttcattgccttcagtc

SEQ ID NO: 7191674 - DNA, 22 bp, Homo sapiens
cctttgttctgtgtatctttgt

SEQ ID NO: 7191675 - DNA, 22 bp, Homo sapiens
cctttgttctgtgtatctttgt

SEQ ID NO: 7191676 - DNA, 22 bp, Homo sapiens
ccttttaagggagactagagat

SEQ ID NO: 7191677 - DNA, 22 bp, Homo sapiens
ccttttaagggagactagagat

SEQ ID NO: 7191678 - DNA, 22 bp, Homo sapiens
ccttttataaagttgtattgaa

SEQ ID NO: 7191679 - DNA, 22 bp, Homo sapiens
cgagcatgatgacggctgtggc

SEQ ID NO: 7191680 - DNA, 22 bp, Homo sapiens
cgagcatgatgacggctgtggc

SEQ ID NO: 7191681 - DNA, 22 bp, Homo sapiens
ccttttatgaacttgagcaggt

SEQ ID NO: 7191682 - DNA, 22 bp, Homo sapiens
ccttttcccatgtttctggagc

SEQ ID NO: 7191683 - DNA, 22 bp, Homo sapiens
cgagcatgatgacggctgtggc

SEQ ID NO: 7191684 - DNA, 22 bp, Homo sapiens
cgagcatgatgacggctgtggc

SEQ ID NO: 7191685 - DNA, 22 bp, Homo sapiens
ccttttataaagttgtattgaa

SEQ ID NO: 7191686 - DNA, 22 bp, Homo sapiens
ccttttataaagttgtattgaa

SEQ ID NO: 7191687 - DNA, 22 bp, Homo sapiens
ccttttatactcagtgatatca

SEQ ID NO: 7191688 - DNA, 22 bp, Homo sapiens
ccttttatactcagtgatatca

SEQ ID NO: 7191689 - DNA, 22 bp, Homo sapiens
ccttttatactctgtcctctgg

SEQ ID NO: 7191690 - DNA, 22 bp, Homo sapiens
ccttttatagatcagtgtgtta

SEQ ID NO: 7191691 - DNA, 22 bp, Homo sapiens
ccttttatagatcagtgtgtta

SEQ ID NO: 7191692 - DNA, 22 bp, Homo sapiens
ccttttatatggctcatcacag

SEQ ID NO: 7191693 - DNA, 22 bp, Homo sapiens
ccttttatgaacttgagcaggt

SEQ ID NO: 7191694 - DNA, 22 bp, Homo sapiens
cgaggaggaaacgcggagaact

SEQ ID NO: 7191695 - DNA, 22 bp, Homo sapiens
cgaggaggaaacgcggagaact

SEQ ID NO: 7191696 - DNA, 22 bp, Homo sapiens
cgaggaggaaacgcggagaact

SEQ ID NO: 7191697 - DNA, 22 bp, Homo sapiens
cgaggcaatagagcccagaggt

SEQ ID NO: 7191698 - DNA, 22 bp, Homo sapiens
cgaggcagacaaaagttggaag

SEQ ID NO: 7191699 - DNA, 22 bp, Homo sapiens
cgaggcagacaaaagttggaag

SEQ ID NO: 7191700 - DNA, 22 bp, Homo sapiens
cgaggcagaggctgaaacggct

SEQ ID NO: 7191701 - DNA, 22 bp, Homo sapiens
cgaggcagaggctgaaacggct

SEQ ID NO: 7191702 - DNA, 22 bp, Homo sapiens
cgaggcaggcaggcggaggata

SEQ ID NO: 7191703 - DNA, 22 bp, Homo sapiens
cgaggcaggcaggcggaggata

SEQ ID NO: 7191704 - DNA, 22 bp, Homo sapiens
cgaggcaggcaggcggaggata

SEQ ID NO: 7191705 - DNA, 18 bp, Homo sapiens
cgaggcaggcggatcacg

SEQ ID NO: 7191706 - DNA, 22 bp, Homo sapiens
cgaggcagggaagctgcaaaag

SEQ ID NO: 7191707 - DNA, 22 bp, Homo sapiens
cgaggcagggaagctgcaaaag

SEQ ID NO: 7191708 - DNA, 20 bp, Homo sapiens
cgaggccaaggggctgggcc

SEQ ID NO: 7191709 - DNA, 20 bp, Homo sapiens
cgaggccaaggggctgggcc

SEQ ID NO: 7191710 - DNA, 20 bp, Homo sapiens
cgaggccaaggggctgggcc

SEQ ID NO: 7191711 - DNA, 22 bp, Homo sapiens
cgaggccaatgtgttttatgaa

SEQ ID NO: 7191712 - DNA, 22 bp, Homo sapiens
cgaggccacacctgcttctggg

SEQ ID NO: 7191713 - DNA, 22 bp, Homo sapiens
cgaggccaccgtggtttccgag

SEQ ID NO: 7191714 - DNA, 22 bp, Homo sapiens
cgaggccagctctaagccctac

SEQ ID NO: 7191715 - DNA, 22 bp, Homo sapiens
cctggccacccagccttggcca

SEQ ID NO: 7191716 - DNA, 22 bp, Homo sapiens
cctggccactcaggtgtggggc

SEQ ID NO: 7191717 - DNA, 22 bp, Homo sapiens
cctggccactcaggtgtggggc

SEQ ID NO: 7191718 - DNA, 22 bp, Homo sapiens
cctggccagaggcgtgcctgtg

SEQ ID NO: 7191719 - DNA, 22 bp, Homo sapiens
cctggccagaggcgtgcctgtg

SEQ ID NO: 7191720 - DNA, 22 bp, Homo sapiens
cctggccagaggcgtgcctgtg

SEQ ID NO: 7191721 - DNA, 21 bp, Homo sapiens
cctggccaatctgatagggtt

SEQ ID NO: 7191722 - DNA, 21 bp, Homo sapiens
cctggccaatctgatagggtt

SEQ ID NO: 7191723 - DNA, 20 bp, Homo sapiens
cctggccaatgagataggaa

SEQ ID NO: 7191724 - DNA, 20 bp, Homo sapiens
cctggccaatgagataggaa

SEQ ID NO: 7191725 - DNA, 20 bp, Homo sapiens
cctggccaatgagataggaa

SEQ ID NO: 7191726 - DNA, 20 bp, Homo sapiens
cctggccaatgagataggaa

SEQ ID NO: 7191727 - DNA, 20 bp, Homo sapiens
cctggccaatgagataggaa

SEQ ID NO: 7191728 - DNA, 20 bp, Homo sapiens
cctggccaatgagataggaa

SEQ ID NO: 7191729 - DNA, 22 bp, Homo sapiens
cctggccacagggctctgcatt

SEQ ID NO: 7191730 - DNA, 22 bp, Homo sapiens
cctggccacagggctctgcatt

SEQ ID NO: 7191731 - DNA, 22 bp, Homo sapiens
cctggccacagggctctgcatt

SEQ ID NO: 7191732 - DNA, 22 bp, Homo sapiens
cctggccacagggctctgcatt

SEQ ID NO: 7191733 - DNA, 22 bp, Homo sapiens
cctggccacagggctctgcatt

SEQ ID NO: 7191734 - DNA, 22 bp, Homo sapiens
cctggcagctcctccccggcgg

SEQ ID NO: 7191735 - DNA, 22 bp, Homo sapiens
cctggcagctccgtggccttcc

SEQ ID NO: 7191736 - DNA, 22 bp, Homo sapiens
cctggcagctcctccccggcgg

SEQ ID NO: 7191737 - DNA, 22 bp, Homo sapiens
cctggcagctcctccccggcgg

SEQ ID NO: 7191738 - DNA, 22 bp, Homo sapiens
cctggcagcgtgccgagctgcg

SEQ ID NO: 7191739 - DNA, 22 bp, Homo sapiens
cctggcagctaagtgctttgag

SEQ ID NO: 7191740 - DNA, 22 bp, Homo sapiens
cctggcagctccgtggccttcc

SEQ ID NO: 7191741 - DNA, 22 bp, Homo sapiens
cctggcagctccgtggccttcc

SEQ ID NO: 7191742 - DNA, 22 bp, Homo sapiens
cctggcagctccgtggccttcc

SEQ ID NO: 7191743 - DNA, 22 bp, Homo sapiens
cctggcagctccgtggccttcc

SEQ ID NO: 7191744 - DNA, 22 bp, Homo sapiens
cctggcagctccgtggccttcc

SEQ ID NO: 7191745 - DNA, 22 bp, Homo sapiens
cctggcagctgtttggcttggc

SEQ ID NO: 7191746 - DNA, 22 bp, Homo sapiens
cctggcagctgtttggcttggc

SEQ ID NO: 7191747 - DNA, 22 bp, Homo sapiens
cctggcagctgtttggcttggc

SEQ ID NO: 7191748 - DNA, 22 bp, Homo sapiens
cctggcattttttgcttaaggt

SEQ ID NO: 7191749 - DNA, 17 bp, Homo sapiens
cctggcattgttcctga

SEQ ID NO: 7191750 - DNA, 22 bp, Homo sapiens
cctggccaatctagggctgtta

SEQ ID NO: 7191751 - DNA, 22 bp, Homo sapiens
cctggccaatctagggctgtta

SEQ ID NO: 7191752 - DNA, 21 bp, Homo sapiens
cctggccaatctgatagggtt

SEQ ID NO: 7191753 - DNA, 22 bp, Homo sapiens
cctgggaagtcagccaaggacg

SEQ ID NO: 7191754 - DNA, 22 bp, Homo sapiens
cctgggaagtcagccaaggacg

SEQ ID NO: 7191755 - DNA, 22 bp, Homo sapiens
cctgggaaggtgaggccctgga

SEQ ID NO: 7191756 - DNA, 22 bp, Homo sapiens
cctgggaaggggaagagaattc

SEQ ID NO: 7191757 - DNA, 22 bp, Homo sapiens
cctgggaaggtcttagcatcta

SEQ ID NO: 7191758 - DNA, 22 bp, Homo sapiens
cctgggaaggtcttagcatcta

SEQ ID NO: 7191759 - DNA, 17 bp, Homo sapiens
cctggctgggaatctga

SEQ ID NO: 7191760 - DNA, 22 bp, Homo sapiens
cctggctggggtagaagtgagg

SEQ ID NO: 7191761 - DNA, 20 bp, Homo sapiens
cctggctggtggaggaaagg

SEQ ID NO: 7191762 - DNA, 20 bp, Homo sapiens
cctggctggtggaggaaagg

SEQ ID NO: 7191763 - DNA, 22 bp, Homo sapiens
cctggctggtggcagcgacaag

SEQ ID NO: 7191764 - DNA, 22 bp, Homo sapiens
cctggctggtggcagcgacaag

SEQ ID NO: 7191765 - DNA, 23 bp, Homo sapiens
cctggctggattctctgcattca

SEQ ID NO: 7191766 - DNA, 22 bp, Homo sapiens
cctggctgctttcactatggag

SEQ ID NO: 7191767 - DNA, 22 bp, Homo sapiens
cctggctgctttcactatggag

SEQ ID NO: 7191768 - DNA, 22 bp, Homo sapiens
cctggctggactggaccgtggc

SEQ ID NO: 7191769 - DNA, 22 bp, Homo sapiens
cctggctggactggaccgtggc

SEQ ID NO: 7191770 - DNA, 22 bp, Homo sapiens
cctggctctgtcctcgcgcaaa

SEQ ID NO: 7191771 - DNA, 22 bp, Homo sapiens
cctggctcttcagaggttccta

SEQ ID NO: 7191772 - DNA, 21 bp, Homo sapiens
cctggctctgtgtttattatg

SEQ ID NO: 7191773 - DNA, 22 bp, Homo sapiens
cctggctcttcagaggttccta

SEQ ID NO: 7191774 - DNA, 19 bp, Homo sapiens
cctggctgctgtgggatgc

SEQ ID NO: 7191775 - DNA, 19 bp, Homo sapiens
cctggctgctgtgggatgc

SEQ ID NO: 7191776 - DNA, 19 bp, Homo sapiens
cctggctgctgtgggatgc

SEQ ID NO: 7191777 - DNA, 19 bp, Homo sapiens
cctggctgctgtgggatgc

SEQ ID NO: 7191778 - DNA, 22 bp, Homo sapiens
cctggctgcttcctctgccatg

SEQ ID NO: 7191779 - DNA, 22 bp, Homo sapiens
cctggctgcttcctctgccatg

SEQ ID NO: 7191780 - DNA, 22 bp, Homo sapiens
cctggaaggacaatagatagtg

SEQ ID NO: 7191781 - DNA, 22 bp, Homo sapiens
cctggaaggacaatagatagtg

SEQ ID NO: 7191782 - DNA, 22 bp, Homo sapiens
cctggaagattcaccactacca

SEQ ID NO: 7191783 - DNA, 20 bp, Homo sapiens
cctggaagagctccccaggc

SEQ ID NO: 7191784 - DNA, 20 bp, Homo sapiens
cctggaagagctccccaggc

SEQ ID NO: 7191785 - DNA, 22 bp, Homo sapiens
cctggaaggcaggcatggattg

SEQ ID NO: 7191786 - DNA, 22 bp, Homo sapiens
cctggaaggcaggcatggattg

SEQ ID NO: 7191787 - DNA, 22 bp, Homo sapiens
cctggaaggcaggcatggattg

SEQ ID NO: 7191788 - DNA, 22 bp, Homo sapiens
cctggaaggtgatggtacagca

SEQ ID NO: 7191789 - DNA, 22 bp, Homo sapiens
cctggaaggtgatggtacagca

SEQ ID NO: 7191790 - DNA, 22 bp, Homo sapiens
cctggaagttggaggttgcagt

SEQ ID NO: 7191791 - DNA, 22 bp, Homo sapiens
cctggacagggccaggccatgc

SEQ ID NO: 7191792 - DNA, 22 bp, Homo sapiens
cctggacagggccaggccatgc

SEQ ID NO: 7191793 - DNA, 22 bp, Homo sapiens
cctggacacccattccttggct

SEQ ID NO: 7191794 - DNA, 22 bp, Homo sapiens
cctggacagagggcagcggcca

SEQ ID NO: 7191795 - DNA, 22 bp, Homo sapiens
cctggacagagggcagcggcca

SEQ ID NO: 7191796 - DNA, 22 bp, Homo sapiens
cctggaccaaacactggcctgg

SEQ ID NO: 7191797 - DNA, 22 bp, Homo sapiens
cctggaccaaacactggcctgg

SEQ ID NO: 7191798 - DNA, 22 bp, Homo sapiens
cctggacaatgagatgtcaggg

SEQ ID NO: 7191799 - DNA, 22 bp, Homo sapiens
cctggcagctaagtgctttgag

SEQ ID NO: 7191800 - DNA, 22 bp, Homo sapiens
cctggcagcgtgccgagctgcg

SEQ ID NO: 7191801 - DNA, 22 bp, Homo sapiens
cctggcagcgtgccgagctgcg

SEQ ID NO: 7191802 - DNA, 22 bp, Homo sapiens
cctggcagcgtgccgagctgcg

SEQ ID NO: 7191803 - DNA, 22 bp, Homo sapiens
cctggcagcgtgccgagctgcg

SEQ ID NO: 7191804 - DNA, 22 bp, Homo sapiens
cctggcagcgccgaagctggcc

SEQ ID NO: 7191805 - DNA, 22 bp, Homo sapiens
cctggcagcgccgaagctggcc

SEQ ID NO: 7191806 - DNA, 22 bp, Homo sapiens
cctggcagcgccgaagctggcc

SEQ ID NO: 7191807 - DNA, 22 bp, Homo sapiens
cctggcagcgccgaagctggcc

SEQ ID NO: 7191808 - DNA, 22 bp, Homo sapiens
cctggcagcgccgaagctggcc

SEQ ID NO: 7191809 - DNA, 22 bp, Homo sapiens
cctggcagcgccgaagctggcc

SEQ ID NO: 7191810 - DNA, 22 bp, Homo sapiens
cctggcagcctcagccaattct

SEQ ID NO: 7191811 - DNA, 22 bp, Homo sapiens
cctggcagcctcagccaattct

SEQ ID NO: 7191812 - DNA, 22 bp, Homo sapiens
cctggaccaaacactggcctgg

SEQ ID NO: 7191813 - DNA, 22 bp, Homo sapiens
cctggacctgcagcatcagcat

SEQ ID NO: 7191814 - DNA, 22 bp, Homo sapiens
cctggcacataatagtggctca

SEQ ID NO: 7191815 - DNA, 22 bp, Homo sapiens
cctgctctccatacactttcta

SEQ ID NO: 7191816 - DNA, 22 bp, Homo sapiens
cctgctctagactctgggaagg

SEQ ID NO: 7191817 - DNA, 22 bp, Homo sapiens
cctgctctagactctgggaagg

SEQ ID NO: 7191818 - DNA, 22 bp, Homo sapiens
cctgctctagactctgggaagg

SEQ ID NO: 7191819 - DNA, 22 bp, Homo sapiens
cctgctctccatacactttcta

SEQ ID NO: 7191820 - DNA, 22 bp, Homo sapiens
cctgctctccatacactttcta

SEQ ID NO: 7191821 - DNA, 22 bp, Homo sapiens
cctgctctaaatctcatggaac

SEQ ID NO: 7191822 - DNA, 22 bp, Homo sapiens
cctgctctggtttagtcagtct

SEQ ID NO: 7191823 - DNA, 22 bp, Homo sapiens
cctgctctggtttagtcagtct

SEQ ID NO: 7191824 - DNA, 22 bp, Homo sapiens
cctgctctggtttagtcagtct

SEQ ID NO: 7191825 - DNA, 22 bp, Homo sapiens
cctgctctgccaagtcctcttt

SEQ ID NO: 7191826 - DNA, 22 bp, Homo sapiens
cctgctctgccaagtcctcttt

SEQ ID NO: 7191827 - DNA, 22 bp, Homo sapiens
cctgctctgccaagtcctcttt

SEQ ID NO: 7191828 - DNA, 22 bp, Homo sapiens
cctgctctgccaagtcctcttt

SEQ ID NO: 7191829 - DNA, 22 bp, Homo sapiens
cctgctctgccaagtcctcttt

SEQ ID NO: 7191830 - DNA, 22 bp, Homo sapiens
cctgctctgccaagtcctcttt

SEQ ID NO: 7191831 - DNA, 22 bp, Homo sapiens
cctgctctccatacactttcta

SEQ ID NO: 7191832 - DNA, 22 bp, Homo sapiens
cctgctctgccaagtcctcttt

SEQ ID NO: 7191833 - DNA, 22 bp, Homo sapiens
cctgctctgccaagtcctcttt

SEQ ID NO: 7191834 - DNA, 22 bp, Homo sapiens
cctggaaatgcaaaagccatga

SEQ ID NO: 7191835 - DNA, 22 bp, Homo sapiens
cctggaaatgtcgcgtgtagaa

SEQ ID NO: 7191836 - DNA, 22 bp, Homo sapiens
cctggaaatgtcgcgtgtagaa

SEQ ID NO: 7191837 - DNA, 22 bp, Homo sapiens
cctggaaatgtcgcgtgtagaa

SEQ ID NO: 7191838 - DNA, 22 bp, Homo sapiens
cctggaaatgtcgcgtgtagaa

SEQ ID NO: 7191839 - DNA, 22 bp, Homo sapiens
cctggaaagattgcagttgctg

SEQ ID NO: 7191840 - DNA, 22 bp, Homo sapiens
cctggaaagattgcagttgctg

SEQ ID NO: 7191841 - DNA, 22 bp, Homo sapiens
cctggaaatgcaaaagccatga

SEQ ID NO: 7191842 - DNA, 19 bp, Homo sapiens
cctgctgcccaccctctgc

SEQ ID NO: 7191843 - DNA, 22 bp, Homo sapiens
cctgctgctatgaaggtgacag

SEQ ID NO: 7191844 - DNA, 22 bp, Homo sapiens
cctggaaagaggaaggaagcct

SEQ ID NO: 7191845 - DNA, 22 bp, Homo sapiens
cctggaaagaggaaggaagcct

SEQ ID NO: 7191846 - DNA, 22 bp, Homo sapiens
cctgctcttatagctgtttcca

SEQ ID NO: 7191847 - DNA, 22 bp, Homo sapiens
cctgctcttatagctgtttcca

SEQ ID NO: 7191848 - DNA, 22 bp, Homo sapiens
cctgctgagaccctgaggtggg

SEQ ID NO: 7191849 - DNA, 22 bp, Homo sapiens
cctgctgagaccctgaggtggg

SEQ ID NO: 7191850 - DNA, 19 bp, Homo sapiens
cctgctgaagtgatgcagc

SEQ ID NO: 7191851 - DNA, 19 bp, Homo sapiens
cctgctgaagtgatgcagc

SEQ ID NO: 7191852 - DNA, 19 bp, Homo sapiens
cctgctgaagtgatgcagc

SEQ ID NO: 7191853 - DNA, 20 bp, Homo sapiens
cctgctgagccagtgtgagg

SEQ ID NO: 7191854 - DNA, 22 bp, Homo sapiens
cctgctgagacttccaagggag

SEQ ID NO: 7191855 - DNA, 22 bp, Homo sapiens
cctgctgaggtcagccacccaa

SEQ ID NO: 7191856 - DNA, 19 bp, Homo sapiens
cctgctgcaccacttgtta

SEQ ID NO: 7191857 - DNA, 22 bp, Homo sapiens
agggtctgaccaccagtaggga

SEQ ID NO: 7191858 - DNA, 22 bp, Homo sapiens
agggtctgaccaccagtaggga

SEQ ID NO: 7191859 - DNA, 22 bp, Homo sapiens
agggtctctacgcactagaggg

SEQ ID NO: 7191860 - DNA, 22 bp, Homo sapiens
agggtctcttgccatgcctcag

SEQ ID NO: 7191861 - DNA, 20 bp, Homo sapiens
agggtctgctgggtaggaca

SEQ ID NO: 7191862 - DNA, 20 bp, Homo sapiens
agggtctgctgggtaggaca

SEQ ID NO: 7191863 - DNA, 22 bp, Homo sapiens
agggtctgcattccaacttggg

SEQ ID NO: 7191864 - DNA, 20 bp, Homo sapiens
agggtctgctgggtaggaca

SEQ ID NO: 7191865 - DNA, 20 bp, Homo sapiens
agggtctggccctgttcctt

SEQ ID NO: 7191866 - DNA, 22 bp, Homo sapiens
agggtctgactgaatggaaaag

SEQ ID NO: 7191867 - DNA, 22 bp, Homo sapiens
agggtctgactcctctggcaag

SEQ ID NO: 7191868 - DNA, 22 bp, Homo sapiens
agggtctgactgaatggaaaag

SEQ ID NO: 7191869 - DNA, 20 bp, Homo sapiens
agggtctgatgtggtggccc

SEQ ID NO: 7191870 - DNA, 22 bp, Homo sapiens
agggtgactttgggcaagttac

SEQ ID NO: 7191871 - DNA, 20 bp, Homo sapiens
agggtgagacatgagcctcc

SEQ ID NO: 7191872 - DNA, 20 bp, Homo sapiens
agggtgagacatgagcctcc

SEQ ID NO: 7191873 - DNA, 20 bp, Homo sapiens
agggtgagacatgagcctcc

SEQ ID NO: 7191874 - DNA, 23 bp, Homo sapiens
agggtgagcaagctatggagacc

SEQ ID NO: 7191875 - DNA, 22 bp, Homo sapiens
agggtgaatctcacaactctta

SEQ ID NO: 7191876 - DNA, 22 bp, Homo sapiens
agggtgaatctcacaactctta

SEQ ID NO: 7191877 - DNA, 22 bp, Homo sapiens
agggtgaatctcacaactctta

SEQ ID NO: 7191878 - DNA, 22 bp, Homo sapiens
agggtgaatctcacaactctta

SEQ ID NO: 7191879 - DNA, 22 bp, Homo sapiens
agggtctgtggatgcatctggg

SEQ ID NO: 7191880 - DNA, 22 bp, Homo sapiens
agggtctgtggatgcatctggg

SEQ ID NO: 7191881 - DNA, 22 bp, Homo sapiens
agggtctgtgcaagaacacgcc

SEQ ID NO: 7191882 - DNA, 22 bp, Homo sapiens
agggtctgtgcaagaacacgcc

SEQ ID NO: 7191883 - DNA, 22 bp, Homo sapiens
agggtctgtggatgcatctggg

SEQ ID NO: 7191884 - DNA, 20 bp, Homo sapiens
agggtcagagagcgtgagtg

SEQ ID NO: 7191885 - DNA, 22 bp, Homo sapiens
agggtcagagatcggccatgtg

SEQ ID NO: 7191886 - DNA, 22 bp, Homo sapiens
agggtcagagatcggccatgtg

SEQ ID NO: 7191887 - DNA, 22 bp, Homo sapiens
agggtcagagtcaggtgcagta

SEQ ID NO: 7191888 - DNA, 22 bp, Homo sapiens
agggtcagagtcaggtgcagta

SEQ ID NO: 7191889 - DNA, 20 bp, Homo sapiens
agggtcagagagcgtgagtg

SEQ ID NO: 7191890 - DNA, 22 bp, Homo sapiens
cctgccctgtcactggctaggg

SEQ ID NO: 7191891 - DNA, 22 bp, Homo sapiens
cctgccctgtcactggctaggg

SEQ ID NO: 7191892 - DNA, 20 bp, Homo sapiens
agggtcagagagcgtgagtg

SEQ ID NO: 7191893 - DNA, 20 bp, Homo sapiens
agggtcagagagcgtgagtg

SEQ ID NO: 7191894 - DNA, 22 bp, Homo sapiens
agggtcagagtcaggtgcagta

SEQ ID NO: 7191895 - DNA, 22 bp, Homo sapiens
agggtcagagtcaggtgcagta

SEQ ID NO: 7191896 - DNA, 22 bp, Homo sapiens
agggtcagagtcaggtgcagta

SEQ ID NO: 7191897 - DNA, 22 bp, Homo sapiens
agggtcagctggctgtcagggg

SEQ ID NO: 7191898 - DNA, 21 bp, Homo sapiens
agggtcaggaaccagggtacc

SEQ ID NO: 7191899 - DNA, 19 bp, Homo sapiens
agggtcaggacaaggactt

SEQ ID NO: 7191900 - DNA, 19 bp, Homo sapiens
agggtcaggacaaggactt

SEQ ID NO: 7191901 - DNA, 21 bp, Homo sapiens
agggtcaggaaccagggtacc

SEQ ID NO: 7191902 - DNA, 21 bp, Homo sapiens
agggtcaggaaccagggtacc

SEQ ID NO: 7191903 - DNA, 22 bp, Homo sapiens
agggtcaggttaagggagtcat

SEQ ID NO: 7191904 - DNA, 22 bp, Homo sapiens
agggtcaggttaagggagtcat

SEQ ID NO: 7191905 - DNA, 20 bp, Homo sapiens
agggtcagtagcacagagct

SEQ ID NO: 7191906 - DNA, 20 bp, Homo sapiens
agggtcagtagcacagagct

SEQ ID NO: 7191907 - DNA, 20 bp, Homo sapiens
agggtcagtagcacagagct

SEQ ID NO: 7191908 - DNA, 22 bp, Homo sapiens
agggtccttctgttcctgagca

SEQ ID NO: 7191909 - DNA, 22 bp, Homo sapiens
agggtctcagagcctgagaacc

SEQ ID NO: 7191910 - DNA, 22 bp, Homo sapiens
cctctgccacctcccacgaggc

SEQ ID NO: 7191911 - DNA, 22 bp, Homo sapiens
cctctgccacctcccacgaggc

SEQ ID NO: 7191912 - DNA, 22 bp, Homo sapiens
cctctgcatctggctgctgcag

SEQ ID NO: 7191913 - DNA, 22 bp, Homo sapiens
cctctgcacttcaccttagctc

SEQ ID NO: 7191914 - DNA, 22 bp, Homo sapiens
cctctgcagcagagagccagag

SEQ ID NO: 7191915 - DNA, 22 bp, Homo sapiens
cctctgcagcagagagccagag

SEQ ID NO: 7191916 - DNA, 22 bp, Homo sapiens
cctctgcagcagagagccagag

SEQ ID NO: 7191917 - DNA, 22 bp, Homo sapiens
cctctgagttagagatctagat

SEQ ID NO: 7191918 - DNA, 22 bp, Homo sapiens
cctctgagttggcctgtcttgt

SEQ ID NO: 7191919 - DNA, 22 bp, Homo sapiens
cctctgcaccatagccttcagc

SEQ ID NO: 7191920 - DNA, 22 bp, Homo sapiens
cctctgcaccatagccttcagc

SEQ ID NO: 7191921 - DNA, 22 bp, Homo sapiens
cctctgagtcctttgggctctc

SEQ ID NO: 7191922 - DNA, 22 bp, Homo sapiens
cctctgagtctcactgtaacct

SEQ ID NO: 7191923 - DNA, 22 bp, Homo sapiens
cctctgagtgacagcctcctct

SEQ ID NO: 7191924 - DNA, 22 bp, Homo sapiens
cctctgagtgacagcctcctct

SEQ ID NO: 7191925 - DNA, 22 bp, Homo sapiens
cctctgagtgacagcctcctct

SEQ ID NO: 7191926 - DNA, 22 bp, Homo sapiens
cctctctccttcctttgccaaa

SEQ ID NO: 7191927 - DNA, 23 bp, Homo sapiens
cctctctccctgtttggcaaata

SEQ ID NO: 7191928 - DNA, 22 bp, Homo sapiens
cctctctccttcctttgccaaa

SEQ ID NO: 7191929 - DNA, 22 bp, Homo sapiens
cctctctccttcctttgccaaa

SEQ ID NO: 7191930 - DNA, 22 bp, Homo sapiens
cctctctccaattttcacctca

SEQ ID NO: 7191931 - DNA, 22 bp, Homo sapiens
cctctctccaattttcacctca

SEQ ID NO: 7191932 - DNA, 22 bp, Homo sapiens
cctctctccaattttcacctca

SEQ ID NO: 7191933 - DNA, 22 bp, Homo sapiens
cctctctccaattttcacctca

SEQ ID NO: 7191934 - DNA, 22 bp, Homo sapiens
cctctctctcctgcacacacac

SEQ ID NO: 7191935 - DNA, 22 bp, Homo sapiens
cctctctctcctgcacacacac

SEQ ID NO: 7191936 - DNA, 22 bp, Homo sapiens
cctctctctcctgcacacacac

SEQ ID NO: 7191937 - DNA, 22 bp, Homo sapiens
cctctctctcctgcacacacac

SEQ ID NO: 7191938 - DNA, 22 bp, Homo sapiens
cctctctctcctgcacacacac

SEQ ID NO: 7191939 - DNA, 22 bp, Homo sapiens
cctctctctgcatctggagggc

SEQ ID NO: 7191940 - DNA, 22 bp, Homo sapiens
cctctctctgcatctggagggc

SEQ ID NO: 7191941 - DNA, 22 bp, Homo sapiens
cctctctctgcatctggagggc

SEQ ID NO: 7191942 - DNA, 22 bp, Homo sapiens
cctctctcttgtagtccctgcc

SEQ ID NO: 7191943 - DNA, 22 bp, Homo sapiens
cctctctcttgtagtccctgcc

SEQ ID NO: 7191944 - DNA, 22 bp, Homo sapiens
cctgcccagcttcacctcaggc

SEQ ID NO: 7191945 - DNA, 21 bp, Homo sapiens
cctgccaggaaactgagtgtc

SEQ ID NO: 7191946 - DNA, 22 bp, Homo sapiens
cctgccaggacattgcttgaag

SEQ ID NO: 7191947 - DNA, 19 bp, Homo sapiens
cctctgccagcccgcctct

SEQ ID NO: 7191948 - DNA, 22 bp, Homo sapiens
cctctgccacctcccacgaggc

SEQ ID NO: 7191949 - DNA, 19 bp, Homo sapiens
cctctgccagcccgcctct

SEQ ID NO: 7191950 - DNA, 19 bp, Homo sapiens
cctctgccagcccgcctct

SEQ ID NO: 7191951 - DNA, 22 bp, Homo sapiens
cctgcccaggagtctctctgtg

SEQ ID NO: 7191952 - DNA, 22 bp, Homo sapiens
cctgcccagcttcccgagtgca

SEQ ID NO: 7191953 - DNA, 23 bp, Homo sapiens
cctgcccaggaatccggcggcgt

SEQ ID NO: 7191954 - DNA, 22 bp, Homo sapiens
cctgcccagcttcccgagtgca

SEQ ID NO: 7191955 - DNA, 22 bp, Homo sapiens
cctgcccaggagtctctctgtg

SEQ ID NO: 7191956 - DNA, 22 bp, Homo sapiens
cctgcccaggagtctctctgtg

SEQ ID NO: 7191957 - DNA, 22 bp, Homo sapiens
cctgcccaggagtctctctgtg

SEQ ID NO: 7191958 - DNA, 22 bp, Homo sapiens
cctgcccaggccctaagttagg

SEQ ID NO: 7191959 - DNA, 22 bp, Homo sapiens
cctgcccagggtcaccacagag

SEQ ID NO: 7191960 - DNA, 22 bp, Homo sapiens
cctgcccatactgacctctaat

SEQ ID NO: 7191961 - DNA, 22 bp, Homo sapiens
cctgcccatcccgtccttggcc

SEQ ID NO: 7191962 - DNA, 22 bp, Homo sapiens
cctgcccatcccgtccttggcc

SEQ ID NO: 7191963 - DNA, 22 bp, Homo sapiens
cctgcccagggtcaccacagag

SEQ ID NO: 7191964 - DNA, 22 bp, Homo sapiens
cctgcccagggtcaccacagag

SEQ ID NO: 7191965 - DNA, 22 bp, Homo sapiens
cctgcccatactgacctctaat

SEQ ID NO: 7191966 - DNA, 22 bp, Homo sapiens
cctgcccctcaaggcctggtgc

SEQ ID NO: 7191967 - DNA, 22 bp, Homo sapiens
cctgcccctcaaggcctggtgc

SEQ ID NO: 7191968 - DNA, 22 bp, Homo sapiens
cctgcccctcaaggcctggtgc

SEQ ID NO: 7191969 - DNA, 22 bp, Homo sapiens
cctgccctaatccagagactag

SEQ ID NO: 7191970 - DNA, 22 bp, Homo sapiens
cctgcccctcaaggcctggtgc

SEQ ID NO: 7191971 - DNA, 22 bp, Homo sapiens
cctgccctagagatgacacaat

SEQ ID NO: 7191972 - DNA, 22 bp, Homo sapiens
cctgccctatgaccagcttcac

SEQ ID NO: 7191973 - DNA, 22 bp, Homo sapiens
cctgccctgctcactgtcggta

SEQ ID NO: 7191974 - DNA, 22 bp, Homo sapiens
cctgccctgctcactgtcggta

SEQ ID NO: 7191975 - DNA, 22 bp, Homo sapiens
cctgccctatgaccagcttcac

SEQ ID NO: 7191976 - DNA, 22 bp, Homo sapiens
agtttaaatcatgttttgtaac

SEQ ID NO: 7191977 - DNA, 22 bp, Homo sapiens
agtttaactttggaaaactata

SEQ ID NO: 7191978 - DNA, 22 bp, Homo sapiens
agtttaactttggaaaactata

SEQ ID NO: 7191979 - DNA, 22 bp, Homo sapiens
agttgtcagtcaaagacatttg

SEQ ID NO: 7191980 - DNA, 22 bp, Homo sapiens
agttgtgaatagatctgattgg

SEQ ID NO: 7191981 - DNA, 22 bp, Homo sapiens
agtttaatatccttcaactttc

SEQ ID NO: 7191982 - DNA, 22 bp, Homo sapiens
agtttaatatccttcaactttc

SEQ ID NO: 7191983 - DNA, 22 bp, Homo sapiens
agtttaatatccttcaactttc

SEQ ID NO: 7191984 - DNA, 22 bp, Homo sapiens
agtttaatcctccagcccaact

SEQ ID NO: 7191985 - DNA, 22 bp, Homo sapiens
agtttaatcctccagcccaact

SEQ ID NO: 7191986 - DNA, 22 bp, Homo sapiens
agtttaattggaggcgtggctc

SEQ ID NO: 7191987 - DNA, 22 bp, Homo sapiens
agtttaattggaggcgtggctc

SEQ ID NO: 7191988 - DNA, 22 bp, Homo sapiens
agtttacaacagtagctatgga

SEQ ID NO: 7191989 - DNA, 22 bp, Homo sapiens
ctgcagagcaagttctctgttg

SEQ ID NO: 7191990 - DNA, 22 bp, Homo sapiens
ctgcagcctcctccagctacgt

SEQ ID NO: 7191991 - DNA, 22 bp, Homo sapiens
ctgcagcctcctccagctacgt

SEQ ID NO: 7191992 - DNA, 22 bp, Homo sapiens
ctgcagcctcctccagctacgt

SEQ ID NO: 7191993 - DNA, 22 bp, Homo sapiens
ctgcagcctcctggggtacatg

SEQ ID NO: 7191994 - DNA, 22 bp, Homo sapiens
ctgcagagcaagttctctgttg

SEQ ID NO: 7191995 - DNA, 22 bp, Homo sapiens
ctgcagagcagccagtccccca

SEQ ID NO: 7191996 - DNA, 22 bp, Homo sapiens
ctgcagcctccaccttttgggt

SEQ ID NO: 7191997 - DNA, 22 bp, Homo sapiens
ctgcagctaaggaatgtggttg

SEQ ID NO: 7191998 - DNA, 22 bp, Homo sapiens
ctgcagctaaggaatgtggttg

SEQ ID NO: 7191999 - DNA, 22 bp, Homo sapiens
ctgcagctcccctgagatcaag

SEQ ID NO: 7192000 - DNA, 22 bp, Homo sapiens
ctgcagctcctctctgtgcccc

SEQ ID NO: 7192001 - DNA, 22 bp, Homo sapiens
ctgcagctcctgagctcagaga

SEQ ID NO: 7192002 - DNA, 22 bp, Homo sapiens
ctgcagctcctgagctcagaga

SEQ ID NO: 7192003 - DNA, 22 bp, Homo sapiens
ctgcagctccttctggcatgtg

SEQ ID NO: 7192004 - DNA, 22 bp, Homo sapiens
ctgcagctccttctggcatgtg

SEQ ID NO: 7192005 - DNA, 22 bp, Homo sapiens
ctgcagctgcgggaccggagcg

SEQ ID NO: 7192006 - DNA, 22 bp, Homo sapiens
ctgcagctgctcatgttacttg

SEQ ID NO: 7192007 - DNA, 22 bp, Homo sapiens
ctgcagctgcagttctgagaga

SEQ ID NO: 7192008 - DNA, 22 bp, Homo sapiens
ctgcagctgcagttctgagaga

SEQ ID NO: 7192009 - DNA, 22 bp, Homo sapiens
ctgcagctggctcatgggatat

SEQ ID NO: 7192010 - DNA, 22 bp, Homo sapiens
agtttgaagaaggatctatgaa

SEQ ID NO: 7192011 - DNA, 20 bp, Homo sapiens
agtttgagaggaagtcagtg

SEQ ID NO: 7192012 - DNA, 22 bp, Homo sapiens
agtttgggttctggagaaattt

SEQ ID NO: 7192013 - DNA, 22 bp, Homo sapiens
agtttggggcaagaggacagat

SEQ ID NO: 7192014 - DNA, 22 bp, Homo sapiens
agtttgggtggaacagagtcgt

SEQ ID NO: 7192015 - DNA, 19 bp, Homo sapiens
agtttgaggaagttaagaa

SEQ ID NO: 7192016 - DNA, 22 bp, Homo sapiens
agtttgatctgacagattttaa

SEQ ID NO: 7192017 - DNA, 22 bp, Homo sapiens
agtttgatgattacagagaaaa

SEQ ID NO: 7192018 - DNA, 22 bp, Homo sapiens
agtttgattgtatgggttttaa

SEQ ID NO: 7192019 - DNA, 22 bp, Homo sapiens
agtttgcagattatattagtgt

SEQ ID NO: 7192020 - DNA, 22 bp, Homo sapiens
ataaaagtaggaccaacttaca

SEQ ID NO: 7192021 - DNA, 22 bp, Homo sapiens
ctgccaggcctccgctgtcccc

SEQ ID NO: 7192022 - DNA, 22 bp, Homo sapiens
ataaaagtaggaccaacttaca

SEQ ID NO: 7192023 - DNA, 22 bp, Homo sapiens
ataaaagtaggaccaacttaca

SEQ ID NO: 7192024 - DNA, 22 bp, Homo sapiens
ataaaagtctgcttatttgggc

SEQ ID NO: 7192025 - DNA, 22 bp, Homo sapiens
ataaaagtctgcttatttgggc

SEQ ID NO: 7192026 - DNA, 22 bp, Homo sapiens
ctgccaggcctcatcccagcca

SEQ ID NO: 7192027 - DNA, 22 bp, Homo sapiens
ctgccaggcagggagatggctg

SEQ ID NO: 7192028 - DNA, 22 bp, Homo sapiens
ctgccaggcctcatcccagcca

SEQ ID NO: 7192029 - DNA, 22 bp, Homo sapiens
ctgccaggcctcatcccagcca

SEQ ID NO: 7192030 - DNA, 22 bp, Homo sapiens
ctgccaggcagggagatggctg

SEQ ID NO: 7192031 - DNA, 22 bp, Homo sapiens
ctgccaggcagcagagggagaa

SEQ ID NO: 7192032 - DNA, 22 bp, Homo sapiens
ctgccaggcagggagatggctg

SEQ ID NO: 7192033 - DNA, 22 bp, Homo sapiens
ctgccaggcagggagatggctg

SEQ ID NO: 7192034 - DNA, 22 bp, Homo sapiens
ctgccaggcagcagagggagaa

SEQ ID NO: 7192035 - DNA, 22 bp, Homo sapiens
ctgccaggcagggagatggctg

SEQ ID NO: 7192036 - DNA, 22 bp, Homo sapiens
ctgccaggcactgggctctgca

SEQ ID NO: 7192037 - DNA, 22 bp, Homo sapiens
ctgccaggcactgggctctgca

SEQ ID NO: 7192038 - DNA, 22 bp, Homo sapiens
ctgccaggcagcagagggagaa

SEQ ID NO: 7192039 - DNA, 22 bp, Homo sapiens
ctgccaggcagcagagggagaa

SEQ ID NO: 7192040 - DNA, 22 bp, Homo sapiens
ctgccaggcagcagagggagaa

SEQ ID NO: 7192041 - DNA, 22 bp, Homo sapiens
ctgccaggcacgtgcagcatca

SEQ ID NO: 7192042 - DNA, 21 bp, Homo sapiens
ctgccaggatagcatgcaggc

SEQ ID NO: 7192043 - DNA, 22 bp, Homo sapiens
ctgccaggcacgtgcagcatca

SEQ ID NO: 7192044 - DNA, 22 bp, Homo sapiens
ctgccaggcacgtgcagcatca

SEQ ID NO: 7192045 - DNA, 22 bp, Homo sapiens
ctgccaggcacgtgcagcatca

SEQ ID NO: 7192046 - DNA, 22 bp, Homo sapiens
ctgccaggcactgggctctgca

SEQ ID NO: 7192047 - DNA, 22 bp, Homo sapiens
ctgccaggcactgggctctgca

SEQ ID NO: 7192048 - DNA, 22 bp, Homo sapiens
ctgccaaaaggtgcacctgctg

SEQ ID NO: 7192049 - DNA, 21 bp, Homo sapiens
ctgccaggatagcatgcaggc

SEQ ID NO: 7192050 - DNA, 22 bp, Homo sapiens
agtttgtatcaatttgctttat

SEQ ID NO: 7192051 - DNA, 22 bp, Homo sapiens
ctgcatttccacctggccacag

SEQ ID NO: 7192052 - DNA, 22 bp, Homo sapiens
ataaatatcactgttgtccctc

SEQ ID NO: 7192053 - DNA, 22 bp, Homo sapiens
ataaatatcactgttgtccctc

SEQ ID NO: 7192054 - DNA, 22 bp, Homo sapiens
ataaatatcactgttgtccctc

SEQ ID NO: 7192055 - DNA, 22 bp, Homo sapiens
ataaatagtgtgtcataaagtc

SEQ ID NO: 7192056 - DNA, 22 bp, Homo sapiens
ataaatagtgtgtcataaagtc

SEQ ID NO: 7192057 - DNA, 22 bp, Homo sapiens
ataaatagtgtgtcataaagtc

SEQ ID NO: 7192058 - DNA, 22 bp, Homo sapiens
ataaatagtgtgtcataaagtc

SEQ ID NO: 7192059 - DNA, 22 bp, Homo sapiens
ataaatagtgtgtcataaagtc

SEQ ID NO: 7192060 - DNA, 22 bp, Homo sapiens
ataaatagtgtgtcataaagtc

SEQ ID NO: 7192061 - DNA, 22 bp, Homo sapiens
ataaatagtgctgccatgagta

SEQ ID NO: 7192062 - DNA, 22 bp, Homo sapiens
ataaatagtgctgccatgagta

SEQ ID NO: 7192063 - DNA, 22 bp, Homo sapiens
ataaatagtgctgccatgagta

SEQ ID NO: 7192064 - DNA, 22 bp, Homo sapiens
ataaatagtgaagggagccggt

SEQ ID NO: 7192065 - DNA, 22 bp, Homo sapiens
ataaatagtgaagggagccggt

SEQ ID NO: 7192066 - DNA, 22 bp, Homo sapiens
ataaaatcaactggctccagtt

SEQ ID NO: 7192067 - DNA, 22 bp, Homo sapiens
ataaaggcagagtagggaggaa

SEQ ID NO: 7192068 - DNA, 22 bp, Homo sapiens
ataaagtagccactggaaagct

SEQ ID NO: 7192069 - DNA, 20 bp, Homo sapiens
ataaaataactgccacaaga

SEQ ID NO: 7192070 - DNA, 20 bp, Homo sapiens
ataaaataactgccacaaga

SEQ ID NO: 7192071 - DNA, 20 bp, Homo sapiens
ataaaataactgccacaaga

SEQ ID NO: 7192072 - DNA, 20 bp, Homo sapiens
ataaaataactgccacaaga

SEQ ID NO: 7192073 - DNA, 22 bp, Homo sapiens
ataaaagttcaagagagtacag

SEQ ID NO: 7192074 - DNA, 22 bp, Homo sapiens
ataaaagttcaagagagtacag

SEQ ID NO: 7192075 - DNA, 22 bp, Homo sapiens
ataaaagttcaagagagtacag

SEQ ID NO: 7192076 - DNA, 22 bp, Homo sapiens
ataaaagtttccaatcatgcct

SEQ ID NO: 7192077 - DNA, 22 bp, Homo sapiens
ataaaagtttccaatcatgcct

SEQ ID NO: 7192078 - DNA, 20 bp, Homo sapiens
ataaaataactgccacaaga

SEQ ID NO: 7192079 - DNA, 20 bp, Homo sapiens
ataaaataactgccacaaga

SEQ ID NO: 7192080 - DNA, 20 bp, Homo sapiens
ataaaataactgccacaaga

SEQ ID NO: 7192081 - DNA, 20 bp, Homo sapiens
ataaaataactgccacaaga

SEQ ID NO: 7192082 - DNA, 20 bp, Homo sapiens
ataaaataactgccacaaga

SEQ ID NO: 7192083 - DNA, 20 bp, Homo sapiens
ataaaataactgccacaaga

SEQ ID NO: 7192084 - DNA, 19 bp, Homo sapiens
agttggggcagggaagaga

SEQ ID NO: 7192085 - DNA, 19 bp, Homo sapiens
agttggggcagggaagaga

SEQ ID NO: 7192086 - DNA, 22 bp, Homo sapiens
agttgggagttatagactctat

SEQ ID NO: 7192087 - DNA, 22 bp, Homo sapiens
agttgggagttatagactctat

SEQ ID NO: 7192088 - DNA, 22 bp, Homo sapiens
agttgggattcttggttctggg

SEQ ID NO: 7192089 - DNA, 22 bp, Homo sapiens
agttggcttcaaaggcagagag

SEQ ID NO: 7192090 - DNA, 22 bp, Homo sapiens
agttgggaagtatttttagtgg

SEQ ID NO: 7192091 - DNA, 22 bp, Homo sapiens
agttgggacatgttctttcccc

SEQ ID NO: 7192092 - DNA, 22 bp, Homo sapiens
agttgggacatgttctttcccc

SEQ ID NO: 7192093 - DNA, 22 bp, Homo sapiens
agttggcacatagcaaattcgc

SEQ ID NO: 7192094 - DNA, 22 bp, Homo sapiens
agttggcactgagctgtgattg

SEQ ID NO: 7192095 - DNA, 17 bp, Homo sapiens
agttggcagccgttgct

SEQ ID NO: 7192096 - DNA, 23 bp, Homo sapiens
agttggcatattcaagcacagtc

SEQ ID NO: 7192097 - DNA, 22 bp, Homo sapiens
agttgcttccctattcttagca

SEQ ID NO: 7192098 - DNA, 22 bp, Homo sapiens
agttggagtgaacatgagattg

SEQ ID NO: 7192099 - DNA, 22 bp, Homo sapiens
agttggcaaggtctggccagcg

SEQ ID NO: 7192100 - DNA, 22 bp, Homo sapiens
agttggcaaggtctggccagcg

SEQ ID NO: 7192101 - DNA, 22 bp, Homo sapiens
agttgctgcttctctctagaga

SEQ ID NO: 7192102 - DNA, 21 bp, Homo sapiens
agttgctgctgctgcaggtga

SEQ ID NO: 7192103 - DNA, 23 bp, Homo sapiens
agttctttccaatgtcctcctct

SEQ ID NO: 7192104 - DNA, 22 bp, Homo sapiens
agttcttcccttttctatggag

SEQ ID NO: 7192105 - DNA, 22 bp, Homo sapiens
agttcttcttgttaacacataa

SEQ ID NO: 7192106 - DNA, 22 bp, Homo sapiens
agttcttgctataaaaacaaat

SEQ ID NO: 7192107 - DNA, 22 bp, Homo sapiens
ctctttggggctggaagcctag

SEQ ID NO: 7192108 - DNA, 22 bp, Homo sapiens
ctctttggtcgcatcatccatt

SEQ ID NO: 7192109 - DNA, 22 bp, Homo sapiens
ctgaggcctcactgtagtccct

SEQ ID NO: 7192110 - DNA, 22 bp, Homo sapiens
ctgaggcctcactgtagtccct

SEQ ID NO: 7192111 - DNA, 22 bp, Homo sapiens
ctgaggcctaagacatgaatga

SEQ ID NO: 7192112 - DNA, 22 bp, Homo sapiens
ctgaggcctcactgtagtccct

SEQ ID NO: 7192113 - DNA, 22 bp, Homo sapiens
ctgaggcctcgttggctggaac

SEQ ID NO: 7192114 - DNA, 21 bp, Homo sapiens
ctgaggcatgcaggcctgggc

SEQ ID NO: 7192115 - DNA, 22 bp, Homo sapiens
ctgaggcatgaatgtgggcttt

SEQ ID NO: 7192116 - DNA, 22 bp, Homo sapiens
ctgaggcctaagacatgaatga

SEQ ID NO: 7192117 - DNA, 22 bp, Homo sapiens
ctgaggcatgaatgtgggcttt

SEQ ID NO: 7192118 - DNA, 22 bp, Homo sapiens
ctgaggcatgaatgtgggcttt

SEQ ID NO: 7192119 - DNA, 22 bp, Homo sapiens
ctgaggcatgaatgtgggcttt

SEQ ID NO: 7192120 - DNA, 22 bp, Homo sapiens
ctgaggcatgaatgtgggcttt

SEQ ID NO: 7192121 - DNA, 22 bp, Homo sapiens
ctgaggcatcatggagaacagt

SEQ ID NO: 7192122 - DNA, 22 bp, Homo sapiens
ctgaggcaggggcagctggaga

SEQ ID NO: 7192123 - DNA, 22 bp, Homo sapiens
ctgaggcaggggcagctggaga

SEQ ID NO: 7192124 - DNA, 22 bp, Homo sapiens
ctgaggcatcatggagaacagt

SEQ ID NO: 7192125 - DNA, 22 bp, Homo sapiens
ctgaggcaggcagatcacttga

SEQ ID NO: 7192126 - DNA, 22 bp, Homo sapiens
ctgaggcaggagaattgctgga

SEQ ID NO: 7192127 - DNA, 22 bp, Homo sapiens
agttgtaagaggcacaaggaag

SEQ ID NO: 7192128 - DNA, 22 bp, Homo sapiens
agttgtaagctctcttgctggg

SEQ ID NO: 7192129 - DNA, 22 bp, Homo sapiens
agttgtaagagacagatataaa

SEQ ID NO: 7192130 - DNA, 22 bp, Homo sapiens
agttggtcctaggagttgagtt

SEQ ID NO: 7192131 - DNA, 22 bp, Homo sapiens
ctgaggtcagagtttagtctgg

SEQ ID NO: 7192132 - DNA, 22 bp, Homo sapiens
agttgtatctgaatgcatgtag

SEQ ID NO: 7192133 - DNA, 22 bp, Homo sapiens
agttgtatctgaatgcatgtag

SEQ ID NO: 7192134 - DNA, 22 bp, Homo sapiens
ctgaggtacgctggctccctgg

SEQ ID NO: 7192135 - DNA, 22 bp, Homo sapiens
ctgaggtagccatggcccaagt

SEQ ID NO: 7192136 - DNA, 20 bp, Homo sapiens
ctgaggtagggcagatcacc

SEQ ID NO: 7192137 - DNA, 23 bp, Homo sapiens
ctgaggtaaaatattctgaagga

SEQ ID NO: 7192138 - DNA, 22 bp, Homo sapiens
ctgaggtaattttccagataat

SEQ ID NO: 7192139 - DNA, 22 bp, Homo sapiens
ctgaggtacaagaaaggcacct

SEQ ID NO: 7192140 - DNA, 22 bp, Homo sapiens
ctgaggggtatccaaggggtaa

SEQ ID NO: 7192141 - DNA, 22 bp, Homo sapiens
ctgaggggtatccaaggggtaa

SEQ ID NO: 7192142 - DNA, 22 bp, Homo sapiens
ctgaggggtatccaaggggtaa

SEQ ID NO: 7192143 - DNA, 22 bp, Homo sapiens
ctgaggggtcgtgggagcccag

SEQ ID NO: 7192144 - DNA, 22 bp, Homo sapiens
ctgagggtcaacttgattgtat

SEQ ID NO: 7192145 - DNA, 22 bp, Homo sapiens
ctgagggtcaacttgattgtat

SEQ ID NO: 7192146 - DNA, 22 bp, Homo sapiens
ctgagggtcaacttgattgtat

SEQ ID NO: 7192147 - DNA, 22 bp, Homo sapiens
ctgagggaacttgggcaagtct

SEQ ID NO: 7192148 - DNA, 22 bp, Homo sapiens
ctgaggctttgtgtgcatgcct

SEQ ID NO: 7192149 - DNA, 22 bp, Homo sapiens
ctgaggctttgtgtgcatgcct

SEQ ID NO: 7192150 - DNA, 22 bp, Homo sapiens
ctgaggcttggaggggtctggt

SEQ ID NO: 7192151 - DNA, 22 bp, Homo sapiens
ctgaggcttggaggggtctggt

SEQ ID NO: 7192152 - DNA, 18 bp, Homo sapiens
ctgaggcttagagaggtt

SEQ ID NO: 7192153 - DNA, 22 bp, Homo sapiens
ctgaggctggggaagggaagtg

SEQ ID NO: 7192154 - DNA, 22 bp, Homo sapiens
ctgaggctggggaagggaagtg

SEQ ID NO: 7192155 - DNA, 22 bp, Homo sapiens
ctgaggcctctctcctgggctt

SEQ ID NO: 7192156 - DNA, 22 bp, Homo sapiens
ctgaggcctctctcctgggctt

SEQ ID NO: 7192157 - DNA, 22 bp, Homo sapiens
ctgaggcctctctcctgggctt

SEQ ID NO: 7192158 - DNA, 22 bp, Homo sapiens
ctgaggcctctcccactccagc

SEQ ID NO: 7192159 - DNA, 22 bp, Homo sapiens
ctgaggcctctcccactccagc

SEQ ID NO: 7192160 - DNA, 22 bp, Homo sapiens
ctgaggcctcgttggctggaac

SEQ ID NO: 7192161 - DNA, 22 bp, Homo sapiens
ctgaggcctctcccactccagc

SEQ ID NO: 7192162 - DNA, 22 bp, Homo sapiens
ctgaggcctctccttggcttgt

SEQ ID NO: 7192163 - DNA, 22 bp, Homo sapiens
ctgaggctgggctgagggtata

SEQ ID NO: 7192164 - DNA, 23 bp, Homo sapiens
ctgaggcctgctgcgttcaggtt

SEQ ID NO: 7192165 - DNA, 22 bp, Homo sapiens
ctgaggcctctttccttggctt

SEQ ID NO: 7192166 - DNA, 22 bp, Homo sapiens
ctgaggcctctgttcaccagaa

SEQ ID NO: 7192167 - DNA, 22 bp, Homo sapiens
ctgaggcctctgttcaccagaa

SEQ ID NO: 7192168 - DNA, 22 bp, Homo sapiens
ctgaggcctctgttcaccagaa

SEQ ID NO: 7192169 - DNA, 22 bp, Homo sapiens
ctgaggcctctctccttggctt

SEQ ID NO: 7192170 - DNA, 22 bp, Homo sapiens
ctgaggcctctgttcaccagaa

SEQ ID NO: 7192171 - DNA, 22 bp, Homo sapiens
ctggagagaccgaaagaggctg

SEQ ID NO: 7192172 - DNA, 22 bp, Homo sapiens
ctggagagaccgaaagaggctg

SEQ ID NO: 7192173 - DNA, 22 bp, Homo sapiens
ctggagcattttctgcttctgc

SEQ ID NO: 7192174 - DNA, 22 bp, Homo sapiens
ctggagcattttctgcttctgc

SEQ ID NO: 7192175 - DNA, 17 bp, Homo sapiens
ctggagccaagagggcc

SEQ ID NO: 7192176 - DNA, 22 bp, Homo sapiens
ctggagccagccagggccctct

SEQ ID NO: 7192177 - DNA, 22 bp, Homo sapiens
ctggagccactgggtcttgtat

SEQ ID NO: 7192178 - DNA, 22 bp, Homo sapiens
ctggagccactttttatccttt

SEQ ID NO: 7192179 - DNA, 22 bp, Homo sapiens
ctggagccccagacagggagag

SEQ ID NO: 7192180 - DNA, 22 bp, Homo sapiens
ctggagccccagacagggagag

SEQ ID NO: 7192181 - DNA, 22 bp, Homo sapiens
ctggagccccaggctgtgcaga

SEQ ID NO: 7192182 - DNA, 22 bp, Homo sapiens
atacagaattcactacagtttc

SEQ ID NO: 7192183 - DNA, 22 bp, Homo sapiens
atacagaattcactacagtttc

SEQ ID NO: 7192184 - DNA, 22 bp, Homo sapiens
atacagaattcactacagtttc

SEQ ID NO: 7192185 - DNA, 22 bp, Homo sapiens
atacagaattcactacagtttc

SEQ ID NO: 7192186 - DNA, 22 bp, Homo sapiens
atacagaattcactacagtttc

SEQ ID NO: 7192187 - DNA, 22 bp, Homo sapiens
atacagaatactaattcctgag

SEQ ID NO: 7192188 - DNA, 22 bp, Homo sapiens
atacagaatactaattcctgag

SEQ ID NO: 7192189 - DNA, 22 bp, Homo sapiens
ctggagccatgtatagcctatg

SEQ ID NO: 7192190 - DNA, 22 bp, Homo sapiens
ctggagccagccagggccctct

SEQ ID NO: 7192191 - DNA, 22 bp, Homo sapiens
ctggagccatgtatagcctatg

SEQ ID NO: 7192192 - DNA, 22 bp, Homo sapiens
ctggagccatgtcttgactgct

SEQ ID NO: 7192193 - DNA, 22 bp, Homo sapiens
ctggagcccaggcctggtgtct

SEQ ID NO: 7192194 - DNA, 22 bp, Homo sapiens
ctggagcccaggcctggtgtct

SEQ ID NO: 7192195 - DNA, 22 bp, Homo sapiens
ctggagcccaggcctggtgtct

SEQ ID NO: 7192196 - DNA, 22 bp, Homo sapiens
ctggagcccaggcctggtgtct

SEQ ID NO: 7192197 - DNA, 22 bp, Homo sapiens
ctggagccccagacagggagag

SEQ ID NO: 7192198 - DNA, 22 bp, Homo sapiens
ctggagccccagacagggagag

SEQ ID NO: 7192199 - DNA, 22 bp, Homo sapiens
ctggagccccagacagggagag

SEQ ID NO: 7192200 - DNA, 22 bp, Homo sapiens
ctggagggatgtagggtgtatt

SEQ ID NO: 7192201 - DNA, 22 bp, Homo sapiens
ctggagggagttaggacccgga

SEQ ID NO: 7192202 - DNA, 22 bp, Homo sapiens
ctggagggagttaggacccgga

SEQ ID NO: 7192203 - DNA, 22 bp, Homo sapiens
ctggagggagttaggacccgga

SEQ ID NO: 7192204 - DNA, 22 bp, Homo sapiens
ctggagggagttaggacccgga

SEQ ID NO: 7192205 - DNA, 22 bp, Homo sapiens
ctggagggatgtagggtgtatt

SEQ ID NO: 7192206 - DNA, 22 bp, Homo sapiens
ctggagggagttaggacccgga

SEQ ID NO: 7192207 - DNA, 22 bp, Homo sapiens
ctggagggagttaggacccgga

SEQ ID NO: 7192208 - DNA, 22 bp, Homo sapiens
ctggagggagttaggacccgga

SEQ ID NO: 7192209 - DNA, 22 bp, Homo sapiens
ctggagggagttaggacccgga

SEQ ID NO: 7192210 - DNA, 22 bp, Homo sapiens
ctggagggagttaggacccgga

SEQ ID NO: 7192211 - DNA, 22 bp, Homo sapiens
ctggagggaggaggctgctatt

SEQ ID NO: 7192212 - DNA, 22 bp, Homo sapiens
ctggagggaggaggctgctatt

SEQ ID NO: 7192213 - DNA, 22 bp, Homo sapiens
ctggagggaggaggctgctatt

SEQ ID NO: 7192214 - DNA, 22 bp, Homo sapiens
ctggagggaggaggctgctatt

SEQ ID NO: 7192215 - DNA, 22 bp, Homo sapiens
ctggagggagattcaaaggagg

SEQ ID NO: 7192216 - DNA, 22 bp, Homo sapiens
ctggagggagattcaaaggagg

SEQ ID NO: 7192217 - DNA, 20 bp, Homo sapiens
atacagatggttccagctgg

SEQ ID NO: 7192218 - DNA, 20 bp, Homo sapiens
atacagatggttccagctgg

SEQ ID NO: 7192219 - DNA, 22 bp, Homo sapiens
ctggaggaaaacaactgcagac

SEQ ID NO: 7192220 - DNA, 22 bp, Homo sapiens
ctggaggaaaacaactgcagac

SEQ ID NO: 7192221 - DNA, 22 bp, Homo sapiens
ctggaggaaaacaactgcagac

SEQ ID NO: 7192222 - DNA, 22 bp, Homo sapiens
atacagagaaggggtagaggat

SEQ ID NO: 7192223 - DNA, 22 bp, Homo sapiens
atacagaattcactacagtttc

SEQ ID NO: 7192224 - DNA, 22 bp, Homo sapiens
atacagaattcactacagtttc

SEQ ID NO: 7192225 - DNA, 22 bp, Homo sapiens
atacagaattcactacagtttc

SEQ ID NO: 7192226 - DNA, 22 bp, Homo sapiens
atacagaatttgcccttttcat

SEQ ID NO: 7192227 - DNA, 22 bp, Homo sapiens
atacagaatttgcccttttcat

SEQ ID NO: 7192228 - DNA, 22 bp, Homo sapiens
atacagatgctcatatgcccca

SEQ ID NO: 7192229 - DNA, 22 bp, Homo sapiens
atacagatgaaatactaagcta

SEQ ID NO: 7192230 - DNA, 22 bp, Homo sapiens
atacagatgaaatactaagcta

SEQ ID NO: 7192231 - DNA, 22 bp, Homo sapiens
atacagatgagatcaggcataa

SEQ ID NO: 7192232 - DNA, 22 bp, Homo sapiens
atacagataatgattgtatgtg

SEQ ID NO: 7192233 - DNA, 22 bp, Homo sapiens
atacagagcagtaatagaggag

SEQ ID NO: 7192234 - DNA, 22 bp, Homo sapiens
atacagatcccacagcatgtga

SEQ ID NO: 7192235 - DNA, 22 bp, Homo sapiens
atacagatcccacagcatgtga

SEQ ID NO: 7192236 - DNA, 22 bp, Homo sapiens
atacagatcccacagcatgtga

SEQ ID NO: 7192237 - DNA, 22 bp, Homo sapiens
atacagatcccacagcatgtga

SEQ ID NO: 7192238 - DNA, 22 bp, Homo sapiens
ctggagtgaggtctgggagcct

SEQ ID NO: 7192239 - DNA, 22 bp, Homo sapiens
ctggagtgaagtctggcagctt

SEQ ID NO: 7192240 - DNA, 22 bp, Homo sapiens
ctggagtgactttgttcctttt

SEQ ID NO: 7192241 - DNA, 22 bp, Homo sapiens
ctggagtgaagtctggcagctt

SEQ ID NO: 7192242 - DNA, 22 bp, Homo sapiens
ctggagtgaagtctggcagctt

SEQ ID NO: 7192243 - DNA, 22 bp, Homo sapiens
ctggagtcttcagcttgctgcc

SEQ ID NO: 7192244 - DNA, 21 bp, Homo sapiens
ctggagtctgggggtggcagt

SEQ ID NO: 7192245 - DNA, 22 bp, Homo sapiens
ctggagggctgcagcgaggctg

SEQ ID NO: 7192246 - DNA, 22 bp, Homo sapiens
ctggagggatgtagggtgtatt

SEQ ID NO: 7192247 - DNA, 22 bp, Homo sapiens
ctggagggatgtagggtgtatt

SEQ ID NO: 7192248 - DNA, 22 bp, Homo sapiens
ctggagggatgtagggtgtatt

SEQ ID NO: 7192249 - DNA, 22 bp, Homo sapiens
ctggagggctgcagcgaggctg

SEQ ID NO: 7192250 - DNA, 22 bp, Homo sapiens
ctggagggctgcagcgaggctg

SEQ ID NO: 7192251 - DNA, 22 bp, Homo sapiens
ctggagggctgcagcgaggctg

SEQ ID NO: 7192252 - DNA, 22 bp, Homo sapiens
ctggagggctgcagcgaggctg

SEQ ID NO: 7192253 - DNA, 22 bp, Homo sapiens
ctggagggctgcagcgaggctg

SEQ ID NO: 7192254 - DNA, 22 bp, Homo sapiens
ctggagggctgcagcgaggctg

SEQ ID NO: 7192255 - DNA, 22 bp, Homo sapiens
ctggagggctgcagcgaggctg

SEQ ID NO: 7192256 - DNA, 22 bp, Homo sapiens
ctggagggctggactaaggaaa

SEQ ID NO: 7192257 - DNA, 22 bp, Homo sapiens
ctggagtgatactcagaatgtg

SEQ ID NO: 7192258 - DNA, 22 bp, Homo sapiens
ctggagtgaggtctgggagcct

SEQ ID NO: 7192259 - DNA, 22 bp, Homo sapiens
ctggagtgatactcagaatgtg

SEQ ID NO: 7192260 - DNA, 22 bp, Homo sapiens
ctggagtgactttgttcctttt

SEQ ID NO: 7192261 - DNA, 22 bp, Homo sapiens
ctggagtgaggtctgggagcct

SEQ ID NO: 7192262 - DNA, 22 bp, Homo sapiens
ctggagtgaggtctgggagcct

SEQ ID NO: 7192263 - DNA, 22 bp, Homo sapiens
ctggagtgatactcagaatgtg

SEQ ID NO: 7192264 - DNA, 22 bp, Homo sapiens
ctggagtgcaacctctgcctcc

SEQ ID NO: 7192265 - DNA, 22 bp, Homo sapiens
ctggagtgcaacctctgcctcc

SEQ ID NO: 7192266 - DNA, 22 bp, Homo sapiens
ctggagtgcaatgaacaaggtc

SEQ ID NO: 7192267 - DNA, 22 bp, Homo sapiens
ctggagtgcagtggcatgatca

SEQ ID NO: 7192268 - DNA, 22 bp, Homo sapiens
atacttatgataaataattgct

SEQ ID NO: 7192269 - DNA, 22 bp, Homo sapiens
atacttatgataaataattgct

SEQ ID NO: 7192270 - DNA, 22 bp, Homo sapiens
atacttatgataaataattgct

SEQ ID NO: 7192271 - DNA, 22 bp, Homo sapiens
atacttatgataaataattgct

SEQ ID NO: 7192272 - DNA, 22 bp, Homo sapiens
atacttatgataaataattgct

SEQ ID NO: 7192273 - DNA, 22 bp, Homo sapiens
atacttcaacatatcagtcaga

SEQ ID NO: 7192274 - DNA, 22 bp, Homo sapiens
atactgaaaaatgatttgctgt

SEQ ID NO: 7192275 - DNA, 22 bp, Homo sapiens
atactgaaaaatgatttgctgt

SEQ ID NO: 7192276 - DNA, 22 bp, Homo sapiens
ctggcagctctactcagagcct

SEQ ID NO: 7192277 - DNA, 22 bp, Homo sapiens
ctggcagctgcccgagatgccc

SEQ ID NO: 7192278 - DNA, 22 bp, Homo sapiens
ctggcagctgcccgagatgccc

SEQ ID NO: 7192279 - DNA, 22 bp, Homo sapiens
ctggcagctctactcagagcct

SEQ ID NO: 7192280 - DNA, 22 bp, Homo sapiens
atactttagagctagattgcct

SEQ ID NO: 7192281 - DNA, 19 bp, Homo sapiens
ctggcagcctgtctgtgtc

SEQ ID NO: 7192282 - DNA, 22 bp, Homo sapiens
ctggcagcggtttgcagcctgg

SEQ ID NO: 7192283 - DNA, 22 bp, Homo sapiens
ctggcagcggtttgcagcctgg

SEQ ID NO: 7192284 - DNA, 22 bp, Homo sapiens
ctggcagcgtgagcagcatcca

SEQ ID NO: 7192285 - DNA, 22 bp, Homo sapiens
ctggcagcgtgagcagcatcca

SEQ ID NO: 7192286 - DNA, 22 bp, Homo sapiens
atacttctagaaatactatgca

SEQ ID NO: 7192287 - DNA, 22 bp, Homo sapiens
atacttctcatgggctctgagc

SEQ ID NO: 7192288 - DNA, 22 bp, Homo sapiens
atacttctctgaggtaggtaaa

SEQ ID NO: 7192289 - DNA, 22 bp, Homo sapiens
atacttctctgaggtaggtaaa

SEQ ID NO: 7192290 - DNA, 22 bp, Homo sapiens
atacttctttaagagtaagtct

SEQ ID NO: 7192291 - DNA, 22 bp, Homo sapiens
atactttagagctagattgcct

SEQ ID NO: 7192292 - DNA, 22 bp, Homo sapiens
atacttgttcctgttgctatag

SEQ ID NO: 7192293 - DNA, 22 bp, Homo sapiens
atactttaacgtggcgaacctt

SEQ ID NO: 7192294 - DNA, 22 bp, Homo sapiens
atactttagagctagattgcct

SEQ ID NO: 7192295 - DNA, 22 bp, Homo sapiens
atactttagagctagattgcct

SEQ ID NO: 7192296 - DNA, 22 bp, Homo sapiens
atacttctttgatgttcacagg

SEQ ID NO: 7192297 - DNA, 22 bp, Homo sapiens
atacttctttgatgttcacagg

SEQ ID NO: 7192298 - DNA, 22 bp, Homo sapiens
atacttgaggttgtataaatat

SEQ ID NO: 7192299 - DNA, 22 bp, Homo sapiens
atacttgatggtgtctgtcaaa

SEQ ID NO: 7192300 - DNA, 22 bp, Homo sapiens
atacaagactcagcacagacgg

SEQ ID NO: 7192301 - DNA, 22 bp, Homo sapiens
atacaagactcagcacagacgg

SEQ ID NO: 7192302 - DNA, 22 bp, Homo sapiens
atacaagatcactccagaaaat

SEQ ID NO: 7192303 - DNA, 22 bp, Homo sapiens
atacaagatcactccagaaaat

SEQ ID NO: 7192304 - DNA, 22 bp, Homo sapiens
atacaagatcactccagaaaat

SEQ ID NO: 7192305 - DNA, 22 bp, Homo sapiens
atacaagatcactccagaaaat

SEQ ID NO: 7192306 - DNA, 22 bp, Homo sapiens
atacaagatcactccagaaaat

SEQ ID NO: 7192307 - DNA, 20 bp, Homo sapiens
atacaagatgagtaatttct

SEQ ID NO: 7192308 - DNA, 18 bp, Homo sapiens
atacaagctctgttactt

SEQ ID NO: 7192309 - DNA, 22 bp, Homo sapiens
atacaagtgatataattgtttc

SEQ ID NO: 7192310 - DNA, 22 bp, Homo sapiens
atacaagtgatataattgtttc

SEQ ID NO: 7192311 - DNA, 22 bp, Homo sapiens
ctgctttaatgtaagatatacc

SEQ ID NO: 7192312 - DNA, 22 bp, Homo sapiens
atacaagacagtaggaaactga

SEQ ID NO: 7192313 - DNA, 19 bp, Homo sapiens
atacaagactagcatttac

SEQ ID NO: 7192314 - DNA, 19 bp, Homo sapiens
atacaagactagcatttac

SEQ ID NO: 7192315 - DNA, 22 bp, Homo sapiens
ctgctttaaaactgatacatga

SEQ ID NO: 7192316 - DNA, 22 bp, Homo sapiens
ctgctttaacaaggctgatcag

SEQ ID NO: 7192317 - DNA, 22 bp, Homo sapiens
ctgctttaactctgggaagcca

SEQ ID NO: 7192318 - DNA, 22 bp, Homo sapiens
ctgctttaagtattcaacaaag

SEQ ID NO: 7192319 - DNA, 22 bp, Homo sapiens
ctgctttaagtattcaacaaag

SEQ ID NO: 7192320 - DNA, 22 bp, Homo sapiens
ctgctttaatccctgcctggaa

SEQ ID NO: 7192321 - DNA, 20 bp, Homo sapiens
ctgcttgggcccctctggcc

SEQ ID NO: 7192322 - DNA, 22 bp, Homo sapiens
ctgcttggggttagggtgtcct

SEQ ID NO: 7192323 - DNA, 20 bp, Homo sapiens
ctgcttgggacactgccaga

SEQ ID NO: 7192324 - DNA, 22 bp, Homo sapiens
ctgcttggaggcctgggtgcta

SEQ ID NO: 7192325 - DNA, 22 bp, Homo sapiens
ctgcttggagtcctccagcacc

SEQ ID NO: 7192326 - DNA, 22 bp, Homo sapiens
ctgcttggagtcctccagcacc

SEQ ID NO: 7192327 - DNA, 22 bp, Homo sapiens
ctgcttggcattggtaaagaat

SEQ ID NO: 7192328 - DNA, 17 bp, Homo sapiens
ctgcttggcctctgggg

SEQ ID NO: 7192329 - DNA, 18 bp, Homo sapiens
ctgcttctgtctgccagt

SEQ ID NO: 7192330 - DNA, 18 bp, Homo sapiens
ctgcttctgtctgccagt

SEQ ID NO: 7192331 - DNA, 22 bp, Homo sapiens
ctgcttctccaaagtaggactt

SEQ ID NO: 7192332 - DNA, 22 bp, Homo sapiens
ctgcttctagcaccaagtccct

SEQ ID NO: 7192333 - DNA, 22 bp, Homo sapiens
ctgctgtgtgaccatggacagg

SEQ ID NO: 7192334 - DNA, 22 bp, Homo sapiens
ataatatttggataggacagta

SEQ ID NO: 7192335 - DNA, 22 bp, Homo sapiens
ataatatttggataggacagta

SEQ ID NO: 7192336 - DNA, 22 bp, Homo sapiens
ataatatttggataggacagta

SEQ ID NO: 7192337 - DNA, 22 bp, Homo sapiens
ataatcaaagtcctatgacatc

SEQ ID NO: 7192338 - DNA, 18 bp, Homo sapiens
ctgctgtgtcgtctgggc

SEQ ID NO: 7192339 - DNA, 22 bp, Homo sapiens
ataatatttgcattactgtgat

SEQ ID NO: 7192340 - DNA, 22 bp, Homo sapiens
ataatatttgcattactgtgat

SEQ ID NO: 7192341 - DNA, 22 bp, Homo sapiens
ataatatttgcattactgtgat

SEQ ID NO: 7192342 - DNA, 22 bp, Homo sapiens
ataatatttgcattactgtgat

SEQ ID NO: 7192343 - DNA, 22 bp, Homo sapiens
ataatataatcctacttcccat

SEQ ID NO: 7192344 - DNA, 22 bp, Homo sapiens
ataatattgagtcaggacctga

SEQ ID NO: 7192345 - DNA, 22 bp, Homo sapiens
ataatattgagtcaggacctga

SEQ ID NO: 7192346 - DNA, 22 bp, Homo sapiens
ataatattgagtcaggacctga

SEQ ID NO: 7192347 - DNA, 22 bp, Homo sapiens
ataatattgaagagccttggcc

SEQ ID NO: 7192348 - DNA, 22 bp, Homo sapiens
ataatattgaagagccttggcc

SEQ ID NO: 7192349 - DNA, 22 bp, Homo sapiens
ctgcccactatgttgtcatggg

SEQ ID NO: 7192350 - DNA, 22 bp, Homo sapiens
ctgcccactatgttgtcatggg

SEQ ID NO: 7192351 - DNA, 22 bp, Homo sapiens
ctgcccactatgttgtcatggg

SEQ ID NO: 7192352 - DNA, 22 bp, Homo sapiens
ctgcccactatgttgtcatggg

SEQ ID NO: 7192353 - DNA, 22 bp, Homo sapiens
ctgcccactatgttgtcatggg

SEQ ID NO: 7192354 - DNA, 22 bp, Homo sapiens
ctgcccaccgtgtgcacgtgcg

SEQ ID NO: 7192355 - DNA, 20 bp, Homo sapiens
ctgcccactagaactacctg

SEQ ID NO: 7192356 - DNA, 22 bp, Homo sapiens
ctgcccaccccgaggcaggaag

SEQ ID NO: 7192357 - DNA, 22 bp, Homo sapiens
ctgcccaccccgaggcaggaag

SEQ ID NO: 7192358 - DNA, 22 bp, Homo sapiens
ctgcccaccgtgtgcacgtgcg

SEQ ID NO: 7192359 - DNA, 22 bp, Homo sapiens
ctgcccaccgtgtgcacgtgcg

SEQ ID NO: 7192360 - DNA, 22 bp, Homo sapiens
ctgcccaccacacctgctcctg

SEQ ID NO: 7192361 - DNA, 22 bp, Homo sapiens
ctgcccaccacacctgctcctg

SEQ ID NO: 7192362 - DNA, 22 bp, Homo sapiens
ctgcccaccacacctgctcctg

SEQ ID NO: 7192363 - DNA, 22 bp, Homo sapiens
ctgcccacagttctctgccatg

SEQ ID NO: 7192364 - DNA, 22 bp, Homo sapiens
ctgcccacagttctctgccatg

SEQ ID NO: 7192365 - DNA, 22 bp, Homo sapiens
ctgcccacagttctctgccatg

SEQ ID NO: 7192366 - DNA, 22 bp, Homo sapiens
ctgcccaccacacctgctcctg

SEQ ID NO: 7192367 - DNA, 22 bp, Homo sapiens
ataaatatcactgttgtccctc

SEQ ID NO: 7192368 - DNA, 22 bp, Homo sapiens
ataaatcagttagtgccccact

SEQ ID NO: 7192369 - DNA, 22 bp, Homo sapiens
ataaatcagttagtgccccact

SEQ ID NO: 7192370 - DNA, 22 bp, Homo sapiens
ataaatatcactgttgtccctc

SEQ ID NO: 7192371 - DNA, 22 bp, Homo sapiens
ataaatatcactgttgtccctc

SEQ ID NO: 7192372 - DNA, 22 bp, Homo sapiens
ctgcccagaatcactcactcga

SEQ ID NO: 7192373 - DNA, 22 bp, Homo sapiens
ctgcccagaagcttagagctta

SEQ ID NO: 7192374 - DNA, 22 bp, Homo sapiens
ctgcccagaagcttagagctta

SEQ ID NO: 7192375 - DNA, 22 bp, Homo sapiens
ctgcccacttggccaccttcta

SEQ ID NO: 7192376 - DNA, 22 bp, Homo sapiens
ctgcccacttggccaccttcta

SEQ ID NO: 7192377 - DNA, 22 bp, Homo sapiens
ctgcccagaagccagatgggca

SEQ ID NO: 7192378 - DNA, 22 bp, Homo sapiens
ctgcccagaagccagatgggca

SEQ ID NO: 7192379 - DNA, 22 bp, Homo sapiens
ctgctcagtaatagtcctatct

SEQ ID NO: 7192380 - DNA, 19 bp, Homo sapiens
ctgctcaggtcagtctgtc

SEQ ID NO: 7192381 - DNA, 22 bp, Homo sapiens
ctgctccaagccagccctgcag

SEQ ID NO: 7192382 - DNA, 22 bp, Homo sapiens
ctgcccagaatcactcactcga

SEQ ID NO: 7192383 - DNA, 22 bp, Homo sapiens
ctgcccagaatcactcactcga

SEQ ID NO: 7192384 - DNA, 22 bp, Homo sapiens
ctgcccagaatcactcactcga

SEQ ID NO: 7192385 - DNA, 18 bp, Homo sapiens
ctgcccagagcacttgtg

SEQ ID NO: 7192386 - DNA, 22 bp, Homo sapiens
ctgctctggcgtactcggcatc

SEQ ID NO: 7192387 - DNA, 20 bp, Homo sapiens
ctgctctgctttgcaggtgg

SEQ ID NO: 7192388 - DNA, 20 bp, Homo sapiens
ctgctctgctttgcaggtgg

SEQ ID NO: 7192389 - DNA, 22 bp, Homo sapiens
ctgctctgctgatcagtgtctc

SEQ ID NO: 7192390 - DNA, 22 bp, Homo sapiens
ctgctctgctgatcagtgtctc

SEQ ID NO: 7192391 - DNA, 22 bp, Homo sapiens
ctgctctgagtattaacggagg

SEQ ID NO: 7192392 - DNA, 22 bp, Homo sapiens
ctgctctgcaaggcacagtgat

SEQ ID NO: 7192393 - DNA, 22 bp, Homo sapiens
ctgctctgcaaggcacagtgat

SEQ ID NO: 7192394 - DNA, 22 bp, Homo sapiens
ctgctctgctgatcagtgtctc

SEQ ID NO: 7192395 - DNA, 22 bp, Homo sapiens
ctgctctgctgatcagtgtctc

SEQ ID NO: 7192396 - DNA, 22 bp, Homo sapiens
ctgctctggggaagccagatgt

SEQ ID NO: 7192397 - DNA, 22 bp, Homo sapiens
ctgctctggcgtactcggcatc

SEQ ID NO: 7192398 - DNA, 22 bp, Homo sapiens
ataatacatggttgatcttttc

SEQ ID NO: 7192399 - DNA, 22 bp, Homo sapiens
ataatacatggttgatcttttc

SEQ ID NO: 7192400 - DNA, 22 bp, Homo sapiens
ctgctctggtctcttcatgttt

SEQ ID NO: 7192401 - DNA, 22 bp, Homo sapiens
ctgctctgtatatgagcaggaa

SEQ ID NO: 7192402 - DNA, 22 bp, Homo sapiens
ctgctctgtatatgagcaggaa

SEQ ID NO: 7192403 - DNA, 22 bp, Homo sapiens
ataatacatggttaacctcttt

SEQ ID NO: 7192404 - DNA, 22 bp, Homo sapiens
atccccagggagtgagctgtct

SEQ ID NO: 7192405 - DNA, 22 bp, Homo sapiens
atccccagggaggcctgacctg

SEQ ID NO: 7192406 - DNA, 22 bp, Homo sapiens
atccccagggagtgagctgtct

SEQ ID NO: 7192407 - DNA, 22 bp, Homo sapiens
atccccctcttggatggcggca

SEQ ID NO: 7192408 - DNA, 22 bp, Homo sapiens
atccccaggggcattcaagctt

SEQ ID NO: 7192409 - DNA, 22 bp, Homo sapiens
atccccaggggcattcaagctt

SEQ ID NO: 7192410 - DNA, 22 bp, Homo sapiens
atccccctcttggatggcggca

SEQ ID NO: 7192411 - DNA, 22 bp, Homo sapiens
atccctctgcagctggttcctg

SEQ ID NO: 7192412 - DNA, 20 bp, Homo sapiens
atccctcttcctagagtccc

SEQ ID NO: 7192413 - DNA, 20 bp, Homo sapiens
atccctcttcctagagtccc

SEQ ID NO: 7192414 - DNA, 22 bp, Homo sapiens
atccctctctgcatgactgtgt

SEQ ID NO: 7192415 - DNA, 22 bp, Homo sapiens
atccccttcacaccctctgcat

SEQ ID NO: 7192416 - DNA, 22 bp, Homo sapiens
atccccttatcccaggctgagc

SEQ ID NO: 7192417 - DNA, 22 bp, Homo sapiens
atcccgaacctctacttctttc

SEQ ID NO: 7192418 - DNA, 22 bp, Homo sapiens
atcccgaacctctacttctttc

SEQ ID NO: 7192419 - DNA, 22 bp, Homo sapiens
atccctcagcagacagcaaaat

SEQ ID NO: 7192420 - DNA, 17 bp, Homo sapiens
atccccagcatctagaa

SEQ ID NO: 7192421 - DNA, 17 bp, Homo sapiens
atccccagcatctagaa

SEQ ID NO: 7192422 - DNA, 22 bp, Homo sapiens
atccatttgtaaatgttagagt

SEQ ID NO: 7192423 - DNA, 17 bp, Homo sapiens
atccccagcatctagaa

SEQ ID NO: 7192424 - DNA, 22 bp, Homo sapiens
atccatttgtttactgatggac

SEQ ID NO: 7192425 - DNA, 22 bp, Homo sapiens
atccatttgccgtgctatgtgc

SEQ ID NO: 7192426 - DNA, 22 bp, Homo sapiens
atccatttgtaaatgttagagt

SEQ ID NO: 7192427 - DNA, 22 bp, Homo sapiens
atccatttgtaaatgttagagt

SEQ ID NO: 7192428 - DNA, 22 bp, Homo sapiens
atccatttgtaaatgttagagt

SEQ ID NO: 7192429 - DNA, 22 bp, Homo sapiens
atccacagtcttagccatcaaa

SEQ ID NO: 7192430 - DNA, 22 bp, Homo sapiens
atccacagtgcagcaagggccc

SEQ ID NO: 7192431 - DNA, 22 bp, Homo sapiens
atccacaggtcatgtaatgtgg

SEQ ID NO: 7192432 - DNA, 22 bp, Homo sapiens
atccacagggtgtgttaagatg

SEQ ID NO: 7192433 - DNA, 22 bp, Homo sapiens
atccacagggtgtgttaagatg

SEQ ID NO: 7192434 - DNA, 22 bp, Homo sapiens
atccacagagaggaagaatagt

SEQ ID NO: 7192435 - DNA, 22 bp, Homo sapiens
atccacagagaggaagaatagt

SEQ ID NO: 7192436 - DNA, 22 bp, Homo sapiens
atccacagagaggaagaatagt

SEQ ID NO: 7192437 - DNA, 22 bp, Homo sapiens
atccacagaaggaacttgaaag

SEQ ID NO: 7192438 - DNA, 22 bp, Homo sapiens
atcctcagacctcagcaaagcc

SEQ ID NO: 7192439 - DNA, 22 bp, Homo sapiens
atcctcacatttgggcaggtga

SEQ ID NO: 7192440 - DNA, 22 bp, Homo sapiens
atcctatggctagcagatgctg

SEQ ID NO: 7192441 - DNA, 23 bp, Homo sapiens
atcccttctccagtgtggtgagg

SEQ ID NO: 7192442 - DNA, 22 bp, Homo sapiens
atcccttgtgctcagcctcttg

SEQ ID NO: 7192443 - DNA, 22 bp, Homo sapiens
atccctgccctcatggagctta

SEQ ID NO: 7192444 - DNA, 22 bp, Homo sapiens
atccctgaggttcctcctgagc

SEQ ID NO: 7192445 - DNA, 22 bp, Homo sapiens
atccggggttcattttcactga

SEQ ID NO: 7192446 - DNA, 22 bp, Homo sapiens
atcctaaaattgttcaatttct

SEQ ID NO: 7192447 - DNA, 22 bp, Homo sapiens
atcctaaagaaatatttattaa

SEQ ID NO: 7192448 - DNA, 22 bp, Homo sapiens
atcctaaattgagagctctaat

SEQ ID NO: 7192449 - DNA, 22 bp, Homo sapiens
atcctcagtgtttctgacatct

SEQ ID NO: 7192450 - DNA, 20 bp, Homo sapiens
atcctctcctgattaattca

SEQ ID NO: 7192451 - DNA, 23 bp, Homo sapiens
atcctctctccatcccactgtgc

SEQ ID NO: 7192452 - DNA, 23 bp, Homo sapiens
atcctctctccatcccactgtgc

SEQ ID NO: 7192453 - DNA, 23 bp, Homo sapiens
atcctctctccatcccactgtgc

SEQ ID NO: 7192454 - DNA, 22 bp, Homo sapiens
atcctctctcccataccagtct

SEQ ID NO: 7192455 - DNA, 22 bp, Homo sapiens
atcctctctcccataccagtct

SEQ ID NO: 7192456 - DNA, 22 bp, Homo sapiens
atcctctctcccataccagtct

SEQ ID NO: 7192457 - DNA, 22 bp, Homo sapiens
atcctctctgtgacagggaacg

SEQ ID NO: 7192458 - DNA, 22 bp, Homo sapiens
atcctctctgtgacagggaacg

SEQ ID NO: 7192459 - DNA, 22 bp, Homo sapiens
atcctctctgttttcgtgtatg

SEQ ID NO: 7192460 - DNA, 22 bp, Homo sapiens
atcctttaagttaataaaattc

SEQ ID NO: 7192461 - DNA, 22 bp, Homo sapiens
atcctttataagacttgtattc

SEQ ID NO: 7192462 - DNA, 22 bp, Homo sapiens
atctacaacatcacatggcatt

SEQ ID NO: 7192463 - DNA, 22 bp, Homo sapiens
atctacaacccctcaaactgtg

SEQ ID NO: 7192464 - DNA, 22 bp, Homo sapiens
atctacaagaggttctcctctc

SEQ ID NO: 7192465 - DNA, 19 bp, Homo sapiens
atctacaattattctcagt

SEQ ID NO: 7192466 - DNA, 22 bp, Homo sapiens
atcatgttggctctgacaaaaa

SEQ ID NO: 7192467 - DNA, 22 bp, Homo sapiens
atcatgttgctcaaaattaaac

SEQ ID NO: 7192468 - DNA, 22 bp, Homo sapiens
atcatgttccagaaacagtgat

SEQ ID NO: 7192469 - DNA, 22 bp, Homo sapiens
atcatgttgctcaaaattaaac

SEQ ID NO: 7192470 - DNA, 22 bp, Homo sapiens
atcatgttttaattagcaaact

SEQ ID NO: 7192471 - DNA, 22 bp, Homo sapiens
atcatgttttaattagcaaact

SEQ ID NO: 7192472 - DNA, 22 bp, Homo sapiens
atcatgttgtatgtaatctttt

SEQ ID NO: 7192473 - DNA, 22 bp, Homo sapiens
atcatgttgtatgtaatctttt

SEQ ID NO: 7192474 - DNA, 22 bp, Homo sapiens
atcatgttgtatgtaatctttt

SEQ ID NO: 7192475 - DNA, 22 bp, Homo sapiens
ctgtggagatgcagaccaggcc

SEQ ID NO: 7192476 - DNA, 22 bp, Homo sapiens
ctgtggagatgcagaccaggcc

SEQ ID NO: 7192477 - DNA, 23 bp, Homo sapiens
ctgtggacttccttcattctact

SEQ ID NO: 7192478 - DNA, 22 bp, Homo sapiens
ctgtggagatgcagaccaggcc

SEQ ID NO: 7192479 - DNA, 22 bp, Homo sapiens
ctgtggagcagggcagggtcac

SEQ ID NO: 7192480 - DNA, 22 bp, Homo sapiens
ctgtggagcagggcagggtcac

SEQ ID NO: 7192481 - DNA, 22 bp, Homo sapiens
ctgtggagcttgtggcagtggg

SEQ ID NO: 7192482 - DNA, 23 bp, Homo sapiens
ctgtggagccctttgttgggaga

SEQ ID NO: 7192483 - DNA, 22 bp, Homo sapiens
ctgtggaggtaggagcaggaca

SEQ ID NO: 7192484 - DNA, 22 bp, Homo sapiens
ctgtggaggtaggagcaggaca

SEQ ID NO: 7192485 - DNA, 22 bp, Homo sapiens
ctgtggaggtaggagcaggaca

SEQ ID NO: 7192486 - DNA, 22 bp, Homo sapiens
ctgtggagtggggagtactggt

SEQ ID NO: 7192487 - DNA, 22 bp, Homo sapiens
ctgtggagtgcttggctcagtg

SEQ ID NO: 7192488 - DNA, 22 bp, Homo sapiens
ctgtggagtgcttggctcagtg

SEQ ID NO: 7192489 - DNA, 22 bp, Homo sapiens
ctgtggagtgcttggctcagtg

SEQ ID NO: 7192490 - DNA, 22 bp, Homo sapiens
ctgtggagtgcttggctcagtg

SEQ ID NO: 7192491 - DNA, 22 bp, Homo sapiens
atcattttatggctgagaggac

SEQ ID NO: 7192492 - DNA, 22 bp, Homo sapiens
atcattttgtgacaatgcctgt

SEQ ID NO: 7192493 - DNA, 22 bp, Homo sapiens
atcattttgtgacaatgcctgt

SEQ ID NO: 7192494 - DNA, 22 bp, Homo sapiens
atcattttgtgacaatgcctgt

SEQ ID NO: 7192495 - DNA, 22 bp, Homo sapiens
atcattttgtgacaatgcctgt

SEQ ID NO: 7192496 - DNA, 22 bp, Homo sapiens
atcatttttaagagactcttct

SEQ ID NO: 7192497 - DNA, 22 bp, Homo sapiens
atcatttttaagagactcttct

SEQ ID NO: 7192498 - DNA, 22 bp, Homo sapiens
atcatttttaagagactcttct

SEQ ID NO: 7192499 - DNA, 22 bp, Homo sapiens
atcatttttaagagactcttct

SEQ ID NO: 7192500 - DNA, 22 bp, Homo sapiens
atcatttttaagagactcttct

SEQ ID NO: 7192501 - DNA, 18 bp, Homo sapiens
atccaaaaagatggaagt

SEQ ID NO: 7192502 - DNA, 18 bp, Homo sapiens
atccaaaaagatggaagt

SEQ ID NO: 7192503 - DNA, 22 bp, Homo sapiens
atccaaaaccagtgcattttcc

SEQ ID NO: 7192504 - DNA, 22 bp, Homo sapiens
atccaaaatttactgtagcatt

SEQ ID NO: 7192505 - DNA, 22 bp, Homo sapiens
atccaaaatttactgtagcatt

SEQ ID NO: 7192506 - DNA, 22 bp, Homo sapiens
atccaaactatgactagtgttc

SEQ ID NO: 7192507 - DNA, 22 bp, Homo sapiens
atccaaatcatgtcagaagaac

SEQ ID NO: 7192508 - DNA, 22 bp, Homo sapiens
atccaaatatattttattcact

SEQ ID NO: 7192509 - DNA, 22 bp, Homo sapiens
atccaaatcttcacacataaca

SEQ ID NO: 7192510 - DNA, 22 bp, Homo sapiens
atccaacacgtatttgctggcc

SEQ ID NO: 7192511 - DNA, 22 bp, Homo sapiens
atccaaatatattttattcact

SEQ ID NO: 7192512 - DNA, 22 bp, Homo sapiens
atccaaagaatgcttagacctg

SEQ ID NO: 7192513 - DNA, 22 bp, Homo sapiens
atccaaagatggaaagaacttt

SEQ ID NO: 7192514 - DNA, 22 bp, Homo sapiens
atccaaaggtgacacagaatac

SEQ ID NO: 7192515 - DNA, 22 bp, Homo sapiens
atccacaagaccccttttcact

SEQ ID NO: 7192516 - DNA, 22 bp, Homo sapiens
atccacagaaggaacttgaaag

SEQ ID NO: 7192517 - DNA, 22 bp, Homo sapiens
atccaaatcatgtcagaagaac

SEQ ID NO: 7192518 - DNA, 20 bp, Homo sapiens
atccaagaaaggatgcaggt

SEQ ID NO: 7192519 - DNA, 22 bp, Homo sapiens
atccaagaatttgcactcctaa

SEQ ID NO: 7192520 - DNA, 22 bp, Homo sapiens
atccaagcagaatcacgtgaga

SEQ ID NO: 7192521 - DNA, 22 bp, Homo sapiens
atccaagcttcaccctaggatg

SEQ ID NO: 7192522 - DNA, 22 bp, Homo sapiens
ctgggtcccacagcctgctggg

SEQ ID NO: 7192523 - DNA, 22 bp, Homo sapiens
ctgggtcagtctgtccctaggg

SEQ ID NO: 7192524 - DNA, 22 bp, Homo sapiens
ctgggtcagtctgtccctaggg

SEQ ID NO: 7192525 - DNA, 22 bp, Homo sapiens
ctgggtcagtggcaagctgggt

SEQ ID NO: 7192526 - DNA, 20 bp, Homo sapiens
ctgggtcacttggctgctct

SEQ ID NO: 7192527 - DNA, 20 bp, Homo sapiens
ctgggtcacttggctgctct

SEQ ID NO: 7192528 - DNA, 20 bp, Homo sapiens
ctgggtcacttggctgctct

SEQ ID NO: 7192529 - DNA, 22 bp, Homo sapiens
ctgggtagggcaaggaactggc

SEQ ID NO: 7192530 - DNA, 22 bp, Homo sapiens
atatttgtggtttttggctcct

SEQ ID NO: 7192531 - DNA, 22 bp, Homo sapiens
atatttgttagagtctatgtgt

SEQ ID NO: 7192532 - DNA, 22 bp, Homo sapiens
atatttgttagagtctatgtgt

SEQ ID NO: 7192533 - DNA, 22 bp, Homo sapiens
ctgggtcctggtgctgagttct

SEQ ID NO: 7192534 - DNA, 22 bp, Homo sapiens
ctgggtcctggtgctgagttct

SEQ ID NO: 7192535 - DNA, 22 bp, Homo sapiens
ctgggtctaaaaattctcagat

SEQ ID NO: 7192536 - DNA, 22 bp, Homo sapiens
ctgggtcccacagcctgctggg

SEQ ID NO: 7192537 - DNA, 22 bp, Homo sapiens
ctgggtcccctcagtgacactg

SEQ ID NO: 7192538 - DNA, 22 bp, Homo sapiens
ctgggtcccctcagtgacactg

SEQ ID NO: 7192539 - DNA, 22 bp, Homo sapiens
ctgtcccttcccaagcccagcc

SEQ ID NO: 7192540 - DNA, 22 bp, Homo sapiens
ctgtccgccgacttggccaggc

SEQ ID NO: 7192541 - DNA, 22 bp, Homo sapiens
ctgtcctcaacccatccttctc

SEQ ID NO: 7192542 - DNA, 22 bp, Homo sapiens
ctgtccagtcagaacgtcatta

SEQ ID NO: 7192543 - DNA, 22 bp, Homo sapiens
ctgtccagtcagaacgtcatta

SEQ ID NO: 7192544 - DNA, 22 bp, Homo sapiens
ctgtccagtctttagcaagctg

SEQ ID NO: 7192545 - DNA, 22 bp, Homo sapiens
ctgtccagtctttagcaagctg

SEQ ID NO: 7192546 - DNA, 22 bp, Homo sapiens
atcacatatttaagaaacatgt

SEQ ID NO: 7192547 - DNA, 22 bp, Homo sapiens
atcacatatttaagaaacatgt

SEQ ID NO: 7192548 - DNA, 22 bp, Homo sapiens
atcacatatatgcaccaagaca

SEQ ID NO: 7192549 - DNA, 22 bp, Homo sapiens
atcacagtttacaaacctgctg

SEQ ID NO: 7192550 - DNA, 22 bp, Homo sapiens
atcacagttttaccatttggta

SEQ ID NO: 7192551 - DNA, 22 bp, Homo sapiens
atcacagttttgtgccttgtgg

SEQ ID NO: 7192552 - DNA, 22 bp, Homo sapiens
atcacatatttaagaaacatgt

SEQ ID NO: 7192553 - DNA, 22 bp, Homo sapiens
atcacatcgaggagcaatcaga

SEQ ID NO: 7192554 - DNA, 22 bp, Homo sapiens
atcacatctcaccactgcaacc

SEQ ID NO: 7192555 - DNA, 22 bp, Homo sapiens
atcacatggaatgattttagac

SEQ ID NO: 7192556 - DNA, 22 bp, Homo sapiens
atcacatggaatgattttagac

SEQ ID NO: 7192557 - DNA, 22 bp, Homo sapiens
atcacagtgtagaccttttaaa

SEQ ID NO: 7192558 - DNA, 22 bp, Homo sapiens
atcacagtggcagggatttggg

SEQ ID NO: 7192559 - DNA, 22 bp, Homo sapiens
atcacagtggctacctctggat

SEQ ID NO: 7192560 - DNA, 22 bp, Homo sapiens
atcacagtgtagaccttttaaa

SEQ ID NO: 7192561 - DNA, 22 bp, Homo sapiens
atcacagttactcaaataatga

SEQ ID NO: 7192562 - DNA, 22 bp, Homo sapiens
atcacaggtggtaggaaaagaa

SEQ ID NO: 7192563 - DNA, 22 bp, Homo sapiens
atcacagggtgaggattagacc

SEQ ID NO: 7192564 - DNA, 22 bp, Homo sapiens
atcacagtctttttcttaagta

SEQ ID NO: 7192565 - DNA, 22 bp, Homo sapiens
atcacagtgccttcgtaaattt

SEQ ID NO: 7192566 - DNA, 22 bp, Homo sapiens
atcacagtgctaggctgaggga

SEQ ID NO: 7192567 - DNA, 22 bp, Homo sapiens
ctgtcctcaccttggcaggggg

SEQ ID NO: 7192568 - DNA, 22 bp, Homo sapiens
ctgtcctcaccttggcaggggg

SEQ ID NO: 7192569 - DNA, 21 bp, Homo sapiens
ctgtcctcagatgtggacgag

SEQ ID NO: 7192570 - DNA, 21 bp, Homo sapiens
ctgtcctcagatgtggacgag

SEQ ID NO: 7192571 - DNA, 22 bp, Homo sapiens
ctgtcctcatctgccccaaggg

SEQ ID NO: 7192572 - DNA, 22 bp, Homo sapiens
ctgtcctcatctgccccaaggg

SEQ ID NO: 7192573 - DNA, 22 bp, Homo sapiens
ctgtcctcatctgccccaaggg

SEQ ID NO: 7192574 - DNA, 22 bp, Homo sapiens
ctgtcctcatctgccccaaggg

SEQ ID NO: 7192575 - DNA, 22 bp, Homo sapiens
ctgtcctccagacgacagtccc

SEQ ID NO: 7192576 - DNA, 22 bp, Homo sapiens
ctgtcctccagacgacagtccc

SEQ ID NO: 7192577 - DNA, 22 bp, Homo sapiens
ctgtcctccagacgacagtccc

SEQ ID NO: 7192578 - DNA, 22 bp, Homo sapiens
ctgtcctccggccacctacagt

SEQ ID NO: 7192579 - DNA, 22 bp, Homo sapiens
ctgtcctccggccacctacagt

SEQ ID NO: 7192580 - DNA, 22 bp, Homo sapiens
ctgtcctccggccacctacagt

SEQ ID NO: 7192581 - DNA, 22 bp, Homo sapiens
ctgtcctccggccacctacagt

SEQ ID NO: 7192582 - DNA, 22 bp, Homo sapiens
ctgtcctctgtcctcagcagga

SEQ ID NO: 7192583 - DNA, 22 bp, Homo sapiens
ctgtcctccggccacctacagt

SEQ ID NO: 7192584 - DNA, 22 bp, Homo sapiens
ctgtcctctgtcctcagcagga

SEQ ID NO: 7192585 - DNA, 22 bp, Homo sapiens
atcacaggctatgtgggttttg

SEQ ID NO: 7192586 - DNA, 22 bp, Homo sapiens
ctgtcttttcttctcattgatg

SEQ ID NO: 7192587 - DNA, 18 bp, Homo sapiens
ctgtcttttttctctcca

SEQ ID NO: 7192588 - DNA, 18 bp, Homo sapiens
ctgtcttttttctctcca

SEQ ID NO: 7192589 - DNA, 18 bp, Homo sapiens
ctgtcttttttctctcca

SEQ ID NO: 7192590 - DNA, 18 bp, Homo sapiens
ctgtcttttttctctcca

SEQ ID NO: 7192591 - DNA, 18 bp, Homo sapiens
ctgtcttttttctctcca

SEQ ID NO: 7192592 - DNA, 18 bp, Homo sapiens
ctgtcttttttctctcca

SEQ ID NO: 7192593 - DNA, 22 bp, Homo sapiens
ctgtgaaactggacagcacttg

SEQ ID NO: 7192594 - DNA, 22 bp, Homo sapiens
ctgtgagtgaccctggtcagca

SEQ ID NO: 7192595 - DNA, 22 bp, Homo sapiens
ctgtgatgacaggcagggccaa

SEQ ID NO: 7192596 - DNA, 22 bp, Homo sapiens
ctgtctttggtcctgtctgtta

SEQ ID NO: 7192597 - DNA, 22 bp, Homo sapiens
ctgtctttggtcctgtctgtta

SEQ ID NO: 7192598 - DNA, 22 bp, Homo sapiens
ctgtctttggtcctgtctgtta

SEQ ID NO: 7192599 - DNA, 22 bp, Homo sapiens
ctgtctttggtcctgtctgtta

SEQ ID NO: 7192600 - DNA, 22 bp, Homo sapiens
ctgtcttttactatcatttact

SEQ ID NO: 7192601 - DNA, 22 bp, Homo sapiens
ctgtcttttactatcatttact

SEQ ID NO: 7192602 - DNA, 22 bp, Homo sapiens
ctgtcttttactatcatttact

SEQ ID NO: 7192603 - DNA, 22 bp, Homo sapiens
ctgtcttttactatcatttact

SEQ ID NO: 7192604 - DNA, 22 bp, Homo sapiens
ctgtcttttactatcatttact

SEQ ID NO: 7192605 - DNA, 22 bp, Homo sapiens
ctgtcttttcatactttccctc

SEQ ID NO: 7192606 - DNA, 22 bp, Homo sapiens
ctgtcttttcatactttccctc

SEQ ID NO: 7192607 - DNA, 22 bp, Homo sapiens
ctgtcttttcatactttccctc

SEQ ID NO: 7192608 - DNA, 22 bp, Homo sapiens
ctgtcttttcttctcattgatg

SEQ ID NO: 7192609 - DNA, 22 bp, Homo sapiens
ctgtcttttcttctcattgatg

SEQ ID NO: 7192610 - DNA, 22 bp, Homo sapiens
ctgtcttttcttctcattgatg

SEQ ID NO: 7192611 - DNA, 22 bp, Homo sapiens
ctgtcttttcttctcattgatg

SEQ ID NO: 7192612 - DNA, 22 bp, Homo sapiens
ctgtctgtttctgattcaacct

SEQ ID NO: 7192613 - DNA, 22 bp, Homo sapiens
ctgtctgtttctgattcaacct

SEQ ID NO: 7192614 - DNA, 22 bp, Homo sapiens
ctgtctgttttaccttctccag

SEQ ID NO: 7192615 - DNA, 22 bp, Homo sapiens
ctgtctgttttaccttctccag

SEQ ID NO: 7192616 - DNA, 22 bp, Homo sapiens
ctgtctctgtcttaactcccag

SEQ ID NO: 7192617 - DNA, 22 bp, Homo sapiens
ctgtctctgttgcctgtaggtg

SEQ ID NO: 7192618 - DNA, 22 bp, Homo sapiens
ctgtctgtttctgattcaacct

SEQ ID NO: 7192619 - DNA, 22 bp, Homo sapiens
atcacatggaatgattttagac

SEQ ID NO: 7192620 - DNA, 19 bp, Homo sapiens
atcacatgtcaagagcagg

SEQ ID NO: 7192621 - DNA, 19 bp, Homo sapiens
atcacatgtcaagagcagg

SEQ ID NO: 7192622 - DNA, 22 bp, Homo sapiens
atcacattatgtagtgaaaagg

SEQ ID NO: 7192623 - DNA, 22 bp, Homo sapiens
atcacattatgtagtgaaaagg

SEQ ID NO: 7192624 - DNA, 22 bp, Homo sapiens
ctgtctgttttaccttctccag

SEQ ID NO: 7192625 - DNA, 22 bp, Homo sapiens
ctgtctgttttgtatacaggcc

SEQ ID NO: 7192626 - DNA, 22 bp, Homo sapiens
ctgtcttctaccttcaacctcc

SEQ ID NO: 7192627 - DNA, 22 bp, Homo sapiens
ctgtcttctaccttcaacctcc

SEQ ID NO: 7192628 - DNA, 22 bp, Homo sapiens
ctgtcttctcctttgtttcagg

SEQ ID NO: 7192629 - DNA, 22 bp, Homo sapiens
ctgtctttagtacaaaaaatgt

SEQ ID NO: 7192630 - DNA, 22 bp, Homo sapiens
ctgtctttagtacaaaaaatgt

SEQ ID NO: 7192631 - DNA, 22 bp, Homo sapiens
ctgtctttagtacaaaaaatgt

SEQ ID NO: 7192632 - DNA, 22 bp, Homo sapiens
ctgtctttagtacaaaaaatgt

SEQ ID NO: 7192633 - DNA, 22 bp, Homo sapiens
ctgtctttggtcctgtctgtta

SEQ ID NO: 7192634 - DNA, 19 bp, Homo sapiens
ctgtgcaggccgggctgag

SEQ ID NO: 7192635 - DNA, 22 bp, Homo sapiens
ctgtgcagcttggcttcaggcc

SEQ ID NO: 7192636 - DNA, 19 bp, Homo sapiens
ctgtgcaggccgggctgag

SEQ ID NO: 7192637 - DNA, 19 bp, Homo sapiens
ctgtgcaggccgggctgag

SEQ ID NO: 7192638 - DNA, 22 bp, Homo sapiens
atcatcatctaaattgtgtcgc

SEQ ID NO: 7192639 - DNA, 18 bp, Homo sapiens
ctgtgcagcaaactgagc

SEQ ID NO: 7192640 - DNA, 22 bp, Homo sapiens
ctgtgcaatgcctaatcacaaa

SEQ ID NO: 7192641 - DNA, 22 bp, Homo sapiens
ctgtgattgttagttcctatac

SEQ ID NO: 7192642 - DNA, 22 bp, Homo sapiens
ctgtgcaaaggccttatgtttt

SEQ ID NO: 7192643 - DNA, 22 bp, Homo sapiens
ctgtgatgatggaaactttctt

SEQ ID NO: 7192644 - DNA, 22 bp, Homo sapiens
ctgtgatgatggaaactttctt

SEQ ID NO: 7192645 - DNA, 22 bp, Homo sapiens
ctgtgatggtcaggccctatct

SEQ ID NO: 7192646 - DNA, 22 bp, Homo sapiens
ctgtgatgttagctctgtgtta

SEQ ID NO: 7192647 - DNA, 22 bp, Homo sapiens
ctgtgatgttagctctgtgtta

SEQ ID NO: 7192648 - DNA, 22 bp, Homo sapiens
ctgtgcaaataaagagcaacat

SEQ ID NO: 7192649 - DNA, 22 bp, Homo sapiens
ctgtgcaagacttactttaata

SEQ ID NO: 7192650 - DNA, 22 bp, Homo sapiens
ctgtgcaagcccaagataaaac

SEQ ID NO: 7192651 - DNA, 23 bp, Homo sapiens
ctgtgcaatatcccatggtatga

SEQ ID NO: 7192652 - DNA, 22 bp, Homo sapiens
atcatcatgcactctcaggttt

SEQ ID NO: 7192653 - DNA, 22 bp, Homo sapiens
atcatcatgcccacttgagact

SEQ ID NO: 7192654 - DNA, 22 bp, Homo sapiens
atcatcatgcccacttgagact

SEQ ID NO: 7192655 - DNA, 22 bp, Homo sapiens
atcatcattcttggataaagca

SEQ ID NO: 7192656 - DNA, 22 bp, Homo sapiens
atcatgaatcttgtgttctatg

SEQ ID NO: 7192657 - DNA, 22 bp, Homo sapiens
atcatgacatacttttgagaag

SEQ ID NO: 7192658 - DNA, 22 bp, Homo sapiens
atcatgacatctgagtttaagt

SEQ ID NO: 7192659 - DNA, 22 bp, Homo sapiens
atcatgcaataaggtgaggcct

SEQ ID NO: 7192660 - DNA, 22 bp, Homo sapiens
atcatgcagctaatccaattca

SEQ ID NO: 7192661 - DNA, 22 bp, Homo sapiens
atcatgcattgtattgagttga

SEQ ID NO: 7192662 - DNA, 22 bp, Homo sapiens
atcatgcattgtattgagttga

SEQ ID NO: 7192663 - DNA, 18 bp, Homo sapiens
atcatgctgaattaaaga

SEQ ID NO: 7192664 - DNA, 18 bp, Homo sapiens
atcatgctgaattaaaga

SEQ ID NO: 7192665 - DNA, 22 bp, Homo sapiens
atcatgttcatcgtatttaggc

SEQ ID NO: 7192666 - DNA, 22 bp, Homo sapiens
atcatgtgaagtggggggttga

SEQ ID NO: 7192667 - DNA, 22 bp, Homo sapiens
atcatgtgtaatttcaagctac

SEQ ID NO: 7192668 - DNA, 22 bp, Homo sapiens
atcatgttaaatatttcaatct

SEQ ID NO: 7192669 - DNA, 22 bp, Homo sapiens
atcatgttaaatatttcaatct

SEQ ID NO: 7192670 - DNA, 22 bp, Homo sapiens
atcatggaaaggttcagcaagc

SEQ ID NO: 7192671 - DNA, 22 bp, Homo sapiens
atcatggaagcctatcttgaga

SEQ ID NO: 7192672 - DNA, 22 bp, Homo sapiens
atcatgtagcactggaacatgg

SEQ ID NO: 7192673 - DNA, 22 bp, Homo sapiens
atatgaagtcagacaaactggg

SEQ ID NO: 7192674 - DNA, 22 bp, Homo sapiens
atatgaagttacaggtaagaaa

SEQ ID NO: 7192675 - DNA, 22 bp, Homo sapiens
atatgaagtcagacaaactggg

SEQ ID NO: 7192676 - DNA, 22 bp, Homo sapiens
atatgaagaattccaatttgga

SEQ ID NO: 7192677 - DNA, 22 bp, Homo sapiens
atatgaagaattccaatttgga

SEQ ID NO: 7192678 - DNA, 22 bp, Homo sapiens
atatgaagaatctaggataggc

SEQ ID NO: 7192679 - DNA, 22 bp, Homo sapiens
atatgacagcggattcacatat

SEQ ID NO: 7192680 - DNA, 22 bp, Homo sapiens
atatgacagcggattcacatat

SEQ ID NO: 7192681 - DNA, 22 bp, Homo sapiens
atatgacagcggattcacatat

SEQ ID NO: 7192682 - DNA, 22 bp, Homo sapiens
atatgaatttggctggaaaggt

SEQ ID NO: 7192683 - DNA, 22 bp, Homo sapiens
atatgacagaatgtgtgtgtat

SEQ ID NO: 7192684 - DNA, 22 bp, Homo sapiens
atatgacagcggattcacatat

SEQ ID NO: 7192685 - DNA, 22 bp, Homo sapiens
atatgagagtaaatgccgatct

SEQ ID NO: 7192686 - DNA, 22 bp, Homo sapiens
atatgagagaggaaagatttta

SEQ ID NO: 7192687 - DNA, 22 bp, Homo sapiens
atatgagagaggaaagatttta

SEQ ID NO: 7192688 - DNA, 22 bp, Homo sapiens
atatgagagaggaaagatttta

SEQ ID NO: 7192689 - DNA, 22 bp, Homo sapiens
atatgacataaaatcatttttg

SEQ ID NO: 7192690 - DNA, 22 bp, Homo sapiens
atatgacgatatttttcgatga

SEQ ID NO: 7192691 - DNA, 22 bp, Homo sapiens
atatgagaattggaaaatatca

SEQ ID NO: 7192692 - DNA, 22 bp, Homo sapiens
atatgacataaaatcatttttg

SEQ ID NO: 7192693 - DNA, 22 bp, Homo sapiens
atatgacataaaatcatttttg

SEQ ID NO: 7192694 - DNA, 22 bp, Homo sapiens
atatgacagcggattcacatat

SEQ ID NO: 7192695 - DNA, 22 bp, Homo sapiens
atatatctgcagtactgaagaa

SEQ ID NO: 7192696 - DNA, 22 bp, Homo sapiens
atatatctgcagtactgaagaa

SEQ ID NO: 7192697 - DNA, 22 bp, Homo sapiens
atatatcatgagtaaaacttga

SEQ ID NO: 7192698 - DNA, 22 bp, Homo sapiens
atatatcatgagtaaaacttga

SEQ ID NO: 7192699 - DNA, 22 bp, Homo sapiens
atatatcatgagtaaaacttga

SEQ ID NO: 7192700 - DNA, 22 bp, Homo sapiens
atatatattgcccaggctggtt

SEQ ID NO: 7192701 - DNA, 22 bp, Homo sapiens
atatatcatgagtaaaacttga

SEQ ID NO: 7192702 - DNA, 22 bp, Homo sapiens
atatcattctgatgtatatctt

SEQ ID NO: 7192703 - DNA, 18 bp, Homo sapiens
atatccaataatgaacac

SEQ ID NO: 7192704 - DNA, 21 bp, Homo sapiens
atatgaactgtggactttgga

SEQ ID NO: 7192705 - DNA, 22 bp, Homo sapiens
atatatgaagaagtcttgatta

SEQ ID NO: 7192706 - DNA, 22 bp, Homo sapiens
atatatgaagaagtcttgatta

SEQ ID NO: 7192707 - DNA, 19 bp, Homo sapiens
atatatgtatacaatgtgg

SEQ ID NO: 7192708 - DNA, 22 bp, Homo sapiens
atatgcaagcacatagaatact

SEQ ID NO: 7192709 - DNA, 22 bp, Homo sapiens
atatgcaagcacatagaatact

SEQ ID NO: 7192710 - DNA, 22 bp, Homo sapiens
atatgcaagcacatagaatact

SEQ ID NO: 7192711 - DNA, 22 bp, Homo sapiens
ctgggcaggatacttcatggga

SEQ ID NO: 7192712 - DNA, 22 bp, Homo sapiens
ctgggcaggatacttcatggga

SEQ ID NO: 7192713 - DNA, 22 bp, Homo sapiens
ctgggcaggagggctctatgga

SEQ ID NO: 7192714 - DNA, 22 bp, Homo sapiens
ctgggcaggagggctctatgga

SEQ ID NO: 7192715 - DNA, 22 bp, Homo sapiens
ctgggcaggagggctctatgga

SEQ ID NO: 7192716 - DNA, 22 bp, Homo sapiens
ctgggcaggtatacaaaaaatg

SEQ ID NO: 7192717 - DNA, 22 bp, Homo sapiens
ctgggcaggatacttcatggga

SEQ ID NO: 7192718 - DNA, 22 bp, Homo sapiens
ctgggcaggtatacaaaaaatg

SEQ ID NO: 7192719 - DNA, 22 bp, Homo sapiens
ctgggcaggtatacaaaaaatg

SEQ ID NO: 7192720 - DNA, 22 bp, Homo sapiens
ctgggcagtatgaatattcaaa

SEQ ID NO: 7192721 - DNA, 22 bp, Homo sapiens
ctgggcagtatgaatattcaaa

SEQ ID NO: 7192722 - DNA, 22 bp, Homo sapiens
ctgggcagtgcagctatagaac

SEQ ID NO: 7192723 - DNA, 22 bp, Homo sapiens
ctgggcagtatgaatattcaaa

SEQ ID NO: 7192724 - DNA, 22 bp, Homo sapiens
ctgggcagtatgaatattcaaa

SEQ ID NO: 7192725 - DNA, 20 bp, Homo sapiens
ctgggcaggtgtttgatctc

SEQ ID NO: 7192726 - DNA, 22 bp, Homo sapiens
ctgggcagtgcagctatagaac

SEQ ID NO: 7192727 - DNA, 22 bp, Homo sapiens
ctgggcagtgcagctatagaac

SEQ ID NO: 7192728 - DNA, 22 bp, Homo sapiens
ctgggcagtgcagctatagaac

SEQ ID NO: 7192729 - DNA, 22 bp, Homo sapiens
ctgggcagtggtggcccttccc

SEQ ID NO: 7192730 - DNA, 22 bp, Homo sapiens
ctgggcagtggtggcatctttg

SEQ ID NO: 7192731 - DNA, 22 bp, Homo sapiens
ctgggcagtggtggcatctttg

SEQ ID NO: 7192732 - DNA, 22 bp, Homo sapiens
ctgggcagtggtggcatctttg

SEQ ID NO: 7192733 - DNA, 22 bp, Homo sapiens
ctgggcagtgggcaagttgtat

SEQ ID NO: 7192734 - DNA, 22 bp, Homo sapiens
ctgggcagttcgctttcgtttt

SEQ ID NO: 7192735 - DNA, 22 bp, Homo sapiens
ctgggcagtggtggcccttccc

SEQ ID NO: 7192736 - DNA, 22 bp, Homo sapiens
atatgctggagtacaggaaata

SEQ ID NO: 7192737 - DNA, 22 bp, Homo sapiens
atatggcagaccaattagaagc

SEQ ID NO: 7192738 - DNA, 22 bp, Homo sapiens
atatggcattttaatgtatgag

SEQ ID NO: 7192739 - DNA, 22 bp, Homo sapiens
atatggcattttaatgtatgag

SEQ ID NO: 7192740 - DNA, 20 bp, Homo sapiens
atatggctccgttcagtcgg

SEQ ID NO: 7192741 - DNA, 22 bp, Homo sapiens
atatggctgtgtttatagccat

SEQ ID NO: 7192742 - DNA, 22 bp, Homo sapiens
atatgtgtgtgtgagaaaagct

SEQ ID NO: 7192743 - DNA, 18 bp, Homo sapiens
atatgttaattaggtagg

SEQ ID NO: 7192744 - DNA, 18 bp, Homo sapiens
atatgttaattaggtagg

SEQ ID NO: 7192745 - DNA, 22 bp, Homo sapiens
atatgtgtgtatttcttactag

SEQ ID NO: 7192746 - DNA, 22 bp, Homo sapiens
atatgtgtgcacatatgtattt

SEQ ID NO: 7192747 - DNA, 22 bp, Homo sapiens
atatgtgtgcacatatgtattt

SEQ ID NO: 7192748 - DNA, 20 bp, Homo sapiens
atatgtgtacgtgtatacat

SEQ ID NO: 7192749 - DNA, 22 bp, Homo sapiens
atatgtgtatggatttctatct

SEQ ID NO: 7192750 - DNA, 22 bp, Homo sapiens
atatgtgtaaatgcatttgttt

SEQ ID NO: 7192751 - DNA, 22 bp, Homo sapiens
atatgtgtacgtgcagtatata

SEQ ID NO: 7192752 - DNA, 22 bp, Homo sapiens
atatgtctctgtacaacagtct

SEQ ID NO: 7192753 - DNA, 22 bp, Homo sapiens
atatgggggggcgtgcagagga

SEQ ID NO: 7192754 - DNA, 22 bp, Homo sapiens
atatggtaagagtatatttact

SEQ ID NO: 7192755 - DNA, 22 bp, Homo sapiens
atatgtacacttacgttacaaa

SEQ ID NO: 7192756 - DNA, 22 bp, Homo sapiens
atatggctgttgcacatctaag

SEQ ID NO: 7192757 - DNA, 23 bp, Homo sapiens
atatggctgttgtgtgttaacat

SEQ ID NO: 7192758 - DNA, 22 bp, Homo sapiens
atatggcttatttatagagcaa

SEQ ID NO: 7192759 - DNA, 22 bp, Homo sapiens
atatgggggggcgtgcagagga

SEQ ID NO: 7192760 - DNA, 22 bp, Homo sapiens
atatgtatgtacgcacatattc

SEQ ID NO: 7192761 - DNA, 22 bp, Homo sapiens
atatgtactgaaactgcttttc

SEQ ID NO: 7192762 - DNA, 22 bp, Homo sapiens
atatgtatagccagtctttagg

SEQ ID NO: 7192763 - DNA, 22 bp, Homo sapiens
atatgtatagccagtctttagg

SEQ ID NO: 7192764 - DNA, 22 bp, Homo sapiens
atatgtttcagtattcaagtca

SEQ ID NO: 7192765 - DNA, 22 bp, Homo sapiens
atatgtttcagtattcaagtca

SEQ ID NO: 7192766 - DNA, 22 bp, Homo sapiens
atatgtttcagtattcaagtca

SEQ ID NO: 7192767 - DNA, 22 bp, Homo sapiens
atatgttttgtgcttcattggt

SEQ ID NO: 7192768 - DNA, 22 bp, Homo sapiens
atatgttttgtgcttcattggt

SEQ ID NO: 7192769 - DNA, 22 bp, Homo sapiens
atatgttactctttcaagcaga

SEQ ID NO: 7192770 - DNA, 22 bp, Homo sapiens
atatgttgagcaagcatgatta

SEQ ID NO: 7192771 - DNA, 23 bp, Homo sapiens
atatgttgtgaaattttagtagc

SEQ ID NO: 7192772 - DNA, 22 bp, Homo sapiens
atatttctctcagacatggaag

SEQ ID NO: 7192773 - DNA, 22 bp, Homo sapiens
atatttctctcagacatggaag

SEQ ID NO: 7192774 - DNA, 22 bp, Homo sapiens
atatttctctcagacatggaag

SEQ ID NO: 7192775 - DNA, 22 bp, Homo sapiens
atatttagcaacatccttggcc

SEQ ID NO: 7192776 - DNA, 22 bp, Homo sapiens
atatttagctcatttccagtgc

SEQ ID NO: 7192777 - DNA, 22 bp, Homo sapiens
atatttagctcatttccagtgc

SEQ ID NO: 7192778 - DNA, 22 bp, Homo sapiens
atatttagctcatttccagtgc

SEQ ID NO: 7192779 - DNA, 22 bp, Homo sapiens
atatttataagcaagcaggact

SEQ ID NO: 7192780 - DNA, 22 bp, Homo sapiens
atatttataagcaagcaggact

SEQ ID NO: 7192781 - DNA, 22 bp, Homo sapiens
atatttataagcaagcaggact

SEQ ID NO: 7192782 - DNA, 22 bp, Homo sapiens
atatgtttttcacaggtttaag

SEQ ID NO: 7192783 - DNA, 22 bp, Homo sapiens
atatgtttttggaaagaacaca

SEQ ID NO: 7192784 - DNA, 22 bp, Homo sapiens
atatgtttttggaaagaacaca

SEQ ID NO: 7192785 - DNA, 22 bp, Homo sapiens
atatgtttttggaaagaacaca

SEQ ID NO: 7192786 - DNA, 22 bp, Homo sapiens
atatttctgggggtgtgtttct

SEQ ID NO: 7192787 - DNA, 22 bp, Homo sapiens
atatttctgggggtgtgtttct

SEQ ID NO: 7192788 - DNA, 22 bp, Homo sapiens
atatttctctcagacatggaag

SEQ ID NO: 7192789 - DNA, 20 bp, Homo sapiens
atatttcttaagaactttca

SEQ ID NO: 7192790 - DNA, 22 bp, Homo sapiens
atatttcttgagcacctggtat

SEQ ID NO: 7192791 - DNA, 22 bp, Homo sapiens
atatttcttgagcacctggtat

SEQ ID NO: 7192792 - DNA, 22 bp, Homo sapiens
atatttgaaattatcacaggaa

SEQ ID NO: 7192793 - DNA, 22 bp, Homo sapiens
atatttgagggcaatagggtgg

SEQ ID NO: 7192794 - DNA, 22 bp, Homo sapiens
atatttgcaggaaactagtttt

SEQ ID NO: 7192795 - DNA, 22 bp, Homo sapiens
atatttgcaggaaactagtttt

SEQ ID NO: 7192796 - DNA, 22 bp, Homo sapiens
atatttgctgagaaggagggag

SEQ ID NO: 7192797 - DNA, 22 bp, Homo sapiens
atatttggaaagaaaatcattg

SEQ ID NO: 7192798 - DNA, 22 bp, Homo sapiens
atatttgtagtgggtaagaagt

SEQ ID NO: 7192799 - DNA, 22 bp, Homo sapiens
atatttgtatttcgtgtgtgta

SEQ ID NO: 7192800 - DNA, 22 bp, Homo sapiens
atatttgtaaaattctgtgtct

SEQ ID NO: 7192801 - DNA, 22 bp, Homo sapiens
atatttgtaaaattctgtgtct

SEQ ID NO: 7192802 - DNA, 22 bp, Homo sapiens
atatttgtagtgggtaagaagt

SEQ ID NO: 7192803 - DNA, 22 bp, Homo sapiens
atatttgtagtgggtaagaagt

SEQ ID NO: 7192804 - DNA, 22 bp, Homo sapiens
ctgggaagccacagggtgtggg

SEQ ID NO: 7192805 - DNA, 22 bp, Homo sapiens
ctgggaagccacagggtgtggg

SEQ ID NO: 7192806 - DNA, 22 bp, Homo sapiens
ctgggaagccacagggtgtggg

SEQ ID NO: 7192807 - DNA, 22 bp, Homo sapiens
ctgggaagcatggtgatggtat

SEQ ID NO: 7192808 - DNA, 22 bp, Homo sapiens
ctgggaagcatggtgatggtat

SEQ ID NO: 7192809 - DNA, 22 bp, Homo sapiens
ctgggaagcatggtgatggtat

SEQ ID NO: 7192810 - DNA, 22 bp, Homo sapiens
ctgggaagcatggtgatggtat

SEQ ID NO: 7192811 - DNA, 22 bp, Homo sapiens
ctgggaagcatggtgatggtat

SEQ ID NO: 7192812 - DNA, 22 bp, Homo sapiens
ctgggaagcatggtgatggtat

SEQ ID NO: 7192813 - DNA, 22 bp, Homo sapiens
ctggcttctgggccagggcaga

SEQ ID NO: 7192814 - DNA, 23 bp, Homo sapiens
ctggcttctggggcctctgtttc

SEQ ID NO: 7192815 - DNA, 22 bp, Homo sapiens
ctggcagctggaggctagaggc

SEQ ID NO: 7192816 - DNA, 22 bp, Homo sapiens
ctggcagctggaggctagaggc

SEQ ID NO: 7192817 - DNA, 22 bp, Homo sapiens
ctggcagctggaggctagaggc

SEQ ID NO: 7192818 - DNA, 22 bp, Homo sapiens
ctggcagctgtgtgaagaactg

SEQ ID NO: 7192819 - DNA, 22 bp, Homo sapiens
ctggcagcttagcactctggtt

SEQ ID NO: 7192820 - DNA, 22 bp, Homo sapiens
ctggcagcttagcactctggtt

SEQ ID NO: 7192821 - DNA, 22 bp, Homo sapiens
ctggcttctgggccagggcaga

SEQ ID NO: 7192822 - DNA, 22 bp, Homo sapiens
ctgggaagtagaatcagatgag

SEQ ID NO: 7192823 - DNA, 22 bp, Homo sapiens
ctgggaagtagaatcagatgag

SEQ ID NO: 7192824 - DNA, 22 bp, Homo sapiens
ctgggaagtagaatcagatgag

SEQ ID NO: 7192825 - DNA, 22 bp, Homo sapiens
ctgggaaggggaaggtcctctc

SEQ ID NO: 7192826 - DNA, 22 bp, Homo sapiens
ctgggaaggggaaggtcctctc

SEQ ID NO: 7192827 - DNA, 22 bp, Homo sapiens
ctgggaaggggaaggtcctctc

SEQ ID NO: 7192828 - DNA, 22 bp, Homo sapiens
ctgggaagtagaatcagatgag

SEQ ID NO: 7192829 - DNA, 22 bp, Homo sapiens
ctgggaagtggtgagggcctga

SEQ ID NO: 7192830 - DNA, 22 bp, Homo sapiens
ctgggaagtggtgagggcctga

SEQ ID NO: 7192831 - DNA, 22 bp, Homo sapiens
ctgggaatcagaatgaacgtct

SEQ ID NO: 7192832 - DNA, 22 bp, Homo sapiens
ctgggaatgagcaggtggctcc

SEQ ID NO: 7192833 - DNA, 22 bp, Homo sapiens
ctgggaatgagcaggtggctcc

SEQ ID NO: 7192834 - DNA, 22 bp, Homo sapiens
ctgggacaagctctgtctagct

SEQ ID NO: 7192835 - DNA, 22 bp, Homo sapiens
ctgggaagggacgccagtgcct

SEQ ID NO: 7192836 - DNA, 22 bp, Homo sapiens
ctgggaaggagggttgcgaagg

SEQ ID NO: 7192837 - DNA, 22 bp, Homo sapiens
ctgggaaggagggttgcgaagg

SEQ ID NO: 7192838 - DNA, 22 bp, Homo sapiens
ctgggaagcttcgagcaggaaa

SEQ ID NO: 7192839 - DNA, 22 bp, Homo sapiens
ctgggaagcttcgagcaggaaa

SEQ ID NO: 7192840 - DNA, 22 bp, Homo sapiens
ctgggaagcttcgagcaggaaa

SEQ ID NO: 7192841 - DNA, 22 bp, Homo sapiens
ctgggaagccatgtttctagga

SEQ ID NO: 7192842 - DNA, 22 bp, Homo sapiens
ctgggaagcttcgagcaggaaa

SEQ ID NO: 7192843 - DNA, 22 bp, Homo sapiens
ctgggaagcttcgagcaggaaa

SEQ ID NO: 7192844 - DNA, 22 bp, Homo sapiens
ctgggaagcttcgagcaggaaa

SEQ ID NO: 7192845 - DNA, 22 bp, Homo sapiens
atataacatacatacagaaaag

SEQ ID NO: 7192846 - DNA, 22 bp, Homo sapiens
atataacatacatacagaaaag

SEQ ID NO: 7192847 - DNA, 22 bp, Homo sapiens
atataacatacatacagaaaag

SEQ ID NO: 7192848 - DNA, 22 bp, Homo sapiens
atataacatacatacagaaaag

SEQ ID NO: 7192849 - DNA, 22 bp, Homo sapiens
atataacatacatacagaaaag

SEQ ID NO: 7192850 - DNA, 22 bp, Homo sapiens
ctgggacaagctctgtctagct

SEQ ID NO: 7192851 - DNA, 19 bp, Homo sapiens
ctgggacaatgaaagcatc

SEQ ID NO: 7192852 - DNA, 19 bp, Homo sapiens
ctgggacaatgaaagcatc

SEQ ID NO: 7192853 - DNA, 19 bp, Homo sapiens
ctgggacaatgaaagcatc

SEQ ID NO: 7192854 - DNA, 22 bp, Homo sapiens
ctgggacacccaaggaaagagc

SEQ ID NO: 7192855 - DNA, 22 bp, Homo sapiens
atataacatacatacagaaaag

SEQ ID NO: 7192856 - DNA, 22 bp, Homo sapiens
atataacatacatacagaaaag

SEQ ID NO: 7192857 - DNA, 22 bp, Homo sapiens
atataacatacatacagaaaag

SEQ ID NO: 7192858 - DNA, 22 bp, Homo sapiens
atataactcttgttcttatagt

SEQ ID NO: 7192859 - DNA, 22 bp, Homo sapiens
atataactcttgttcttatagt

SEQ ID NO: 7192860 - DNA, 22 bp, Homo sapiens
atataagtgtgtggctgttagt

SEQ ID NO: 7192861 - DNA, 22 bp, Homo sapiens
atataagttagtggtcatgttt

SEQ ID NO: 7192862 - DNA, 22 bp, Homo sapiens
atataatacaacctgctaagtg

SEQ ID NO: 7192863 - DNA, 22 bp, Homo sapiens
atataatacaacctgctaagtg

SEQ ID NO: 7192864 - DNA, 22 bp, Homo sapiens
atataatacaacctgctaagtg

SEQ ID NO: 7192865 - DNA, 22 bp, Homo sapiens
atatacttttcactaatggcta

SEQ ID NO: 7192866 - DNA, 22 bp, Homo sapiens
atatataatacttgctgtgggc

SEQ ID NO: 7192867 - DNA, 22 bp, Homo sapiens
atatataatacttgctgtgggc

SEQ ID NO: 7192868 - DNA, 22 bp, Homo sapiens
atatatacaactagattaaaag

SEQ ID NO: 7192869 - DNA, 22 bp, Homo sapiens
atatatacaactagattaaaag

SEQ ID NO: 7192870 - DNA, 22 bp, Homo sapiens
atatataagctgatgagccaca

SEQ ID NO: 7192871 - DNA, 22 bp, Homo sapiens
atatataatacttgctgtgggc

SEQ ID NO: 7192872 - DNA, 22 bp, Homo sapiens
atatataatacttgctgtgggc

SEQ ID NO: 7192873 - DNA, 22 bp, Homo sapiens
atatataacctggataaggctt

SEQ ID NO: 7192874 - DNA, 22 bp, Homo sapiens
atatataagctgatgagccaca

SEQ ID NO: 7192875 - DNA, 22 bp, Homo sapiens
atatataagctgatgagccaca

SEQ ID NO: 7192876 - DNA, 22 bp, Homo sapiens
atatataagctgatgagccaca

SEQ ID NO: 7192877 - DNA, 22 bp, Homo sapiens
atatatacaactagattaaaag

SEQ ID NO: 7192878 - DNA, 22 bp, Homo sapiens
atatatacaactagattaaaag

SEQ ID NO: 7192879 - DNA, 22 bp, Homo sapiens
atatatacaactagattaaaag

SEQ ID NO: 7192880 - DNA, 22 bp, Homo sapiens
atatatactttgacacattctg

SEQ ID NO: 7192881 - DNA, 22 bp, Homo sapiens
atatatactttgacacattctg

SEQ ID NO: 7192882 - DNA, 22 bp, Homo sapiens
atatatactttgacacattctg

SEQ ID NO: 7192883 - DNA, 22 bp, Homo sapiens
atatatactttgacacattctg

SEQ ID NO: 7192884 - DNA, 22 bp, Homo sapiens
atatatagagctagatgttaaa

SEQ ID NO: 7192885 - DNA, 22 bp, Homo sapiens
atatatagagctagatgttaaa

SEQ ID NO: 7192886 - DNA, 22 bp, Homo sapiens
atatatatcgagttcatgtctc

SEQ ID NO: 7192887 - DNA, 22 bp, Homo sapiens
atatatatcgagttcatgtctc

SEQ ID NO: 7192888 - DNA, 22 bp, Homo sapiens
ctgggactttaccctgtggccc

SEQ ID NO: 7192889 - DNA, 22 bp, Homo sapiens
ctgggactttgtaggccagttg

SEQ ID NO: 7192890 - DNA, 22 bp, Homo sapiens
ctgggactttaccctgtggccc

SEQ ID NO: 7192891 - DNA, 22 bp, Homo sapiens
ctgggactttgtaggccagttg

SEQ ID NO: 7192892 - DNA, 22 bp, Homo sapiens
ctgggagaatttgttgaaggat

SEQ ID NO: 7192893 - DNA, 22 bp, Homo sapiens
ctgggagaatttgttgaaggat

SEQ ID NO: 7192894 - DNA, 22 bp, Homo sapiens
ctgggagaatttgttgaaggat

SEQ ID NO: 7192895 - DNA, 22 bp, Homo sapiens
ctgggagaatttgttgaaggat

SEQ ID NO: 7192896 - DNA, 22 bp, Homo sapiens
ctgggagacaagagagggctga

SEQ ID NO: 7192897 - DNA, 22 bp, Homo sapiens
ctgggagacaagagagggctga

SEQ ID NO: 7192898 - DNA, 22 bp, Homo sapiens
ctgggagacaagagagggctga

SEQ ID NO: 7192899 - DNA, 22 bp, Homo sapiens
ctgggagacaagagagggctga

SEQ ID NO: 7192900 - DNA, 22 bp, Homo sapiens
ctgggagacaagagagggctga

SEQ ID NO: 7192901 - DNA, 22 bp, Homo sapiens
ctgggagacaagagagggctga

SEQ ID NO: 7192902 - DNA, 22 bp, Homo sapiens
ctgggagacaagagagggctga

SEQ ID NO: 7192903 - DNA, 22 bp, Homo sapiens
ctgggagacgcagctggggatc

SEQ ID NO: 7192904 - DNA, 22 bp, Homo sapiens
ctgggagacgcagctggggatc

SEQ ID NO: 7192905 - DNA, 22 bp, Homo sapiens
ctgggagacgcagctggggatc

SEQ ID NO: 7192906 - DNA, 22 bp, Homo sapiens
ctgggagacgcagctggggatc

SEQ ID NO: 7192907 - DNA, 22 bp, Homo sapiens
ctgggagagaagcgaagctggg

SEQ ID NO: 7192908 - DNA, 22 bp, Homo sapiens
ctgggagagaagcgaagctggg

SEQ ID NO: 7192909 - DNA, 22 bp, Homo sapiens
ctgggagagaagcgaagctggg

SEQ ID NO: 7192910 - DNA, 22 bp, Homo sapiens
ctgggagagaagcgaagctggg

SEQ ID NO: 7192911 - DNA, 22 bp, Homo sapiens
ctgggagagaagcgaagctggg

SEQ ID NO: 7192912 - DNA, 22 bp, Homo sapiens
ctgggagagaagcgaagctggg

SEQ ID NO: 7192913 - DNA, 22 bp, Homo sapiens
ctgggagagcctttcctgagtc

SEQ ID NO: 7192914 - DNA, 22 bp, Homo sapiens
ctgggagaggaacctcgagggt

SEQ ID NO: 7192915 - DNA, 22 bp, Homo sapiens
ctgggagaggaacctcgagggt

SEQ ID NO: 7192916 - DNA, 22 bp, Homo sapiens
ctgggagaggaacctcgagggt

SEQ ID NO: 7192917 - DNA, 22 bp, Homo sapiens
ctgggcacacagtgactctgca

SEQ ID NO: 7192918 - DNA, 22 bp, Homo sapiens
ctgggcacaagtggccctggat

SEQ ID NO: 7192919 - DNA, 22 bp, Homo sapiens
ctgggagtactgggggatgtca

SEQ ID NO: 7192920 - DNA, 19 bp, Homo sapiens
ctgggaggtgttcagagaa

SEQ ID NO: 7192921 - DNA, 22 bp, Homo sapiens
ctgggcacagaccccctgggcc

SEQ ID NO: 7192922 - DNA, 22 bp, Homo sapiens
ctgggcacaggggagcagagtc

SEQ ID NO: 7192923 - DNA, 22 bp, Homo sapiens
ctgggcacaggggagcagagtc

SEQ ID NO: 7192924 - DNA, 22 bp, Homo sapiens
ctgggcacaggggagcagagtc

SEQ ID NO: 7192925 - DNA, 22 bp, Homo sapiens
ctgggcacagcgttgggctctt

SEQ ID NO: 7192926 - DNA, 22 bp, Homo sapiens
atatatattgcccaggctggtt

SEQ ID NO: 7192927 - DNA, 22 bp, Homo sapiens
atatatattgcccaggctggtt

SEQ ID NO: 7192928 - DNA, 22 bp, Homo sapiens
atatatatgctgatggctgcca

SEQ ID NO: 7192929 - DNA, 22 bp, Homo sapiens
atatatatgctgatggctgcca

SEQ ID NO: 7192930 - DNA, 22 bp, Homo sapiens
ctgggcacctttgcagcaggct

SEQ ID NO: 7192931 - DNA, 22 bp, Homo sapiens
atatatatcgagttcatgtctc

SEQ ID NO: 7192932 - DNA, 22 bp, Homo sapiens
ctgggcacctttgcagcaggct

SEQ ID NO: 7192933 - DNA, 23 bp, Homo sapiens
ctgggcacccagtacctaggccc

SEQ ID NO: 7192934 - DNA, 20 bp, Homo sapiens
ctgggcacctgtctgcagtt

SEQ ID NO: 7192935 - DNA, 22 bp, Homo sapiens
ctgggcaccaggcatgacaggg

SEQ ID NO: 7192936 - DNA, 22 bp, Homo sapiens
ctgggcaccaggcatgacaggg

SEQ ID NO: 7192937 - DNA, 23 bp, Homo sapiens
ctgggcacccagtacctaggccc

SEQ ID NO: 7192938 - DNA, 22 bp, Homo sapiens
ctgggcacaggggagcagagtc

SEQ ID NO: 7192939 - DNA, 22 bp, Homo sapiens
ctgggcacattttgactagtgt

SEQ ID NO: 7192940 - DNA, 22 bp, Homo sapiens
aggccctcacagtctattgtga

SEQ ID NO: 7192941 - DNA, 18 bp, Homo sapiens
aggcccgttgtgtggaat

SEQ ID NO: 7192942 - DNA, 22 bp, Homo sapiens
aggccctaatccaacatgactg

SEQ ID NO: 7192943 - DNA, 22 bp, Homo sapiens
aggccctattcaatggggccca

SEQ ID NO: 7192944 - DNA, 22 bp, Homo sapiens
aggccctattcaatggggccca

SEQ ID NO: 7192945 - DNA, 22 bp, Homo sapiens
aggccctgaagtcggcccctca

SEQ ID NO: 7192946 - DNA, 22 bp, Homo sapiens
aggccctccattgatgtttatt

SEQ ID NO: 7192947 - DNA, 22 bp, Homo sapiens
aggccctctagaggagtgtttg

SEQ ID NO: 7192948 - DNA, 22 bp, Homo sapiens
aggccctgaagtcggcccctca

SEQ ID NO: 7192949 - DNA, 22 bp, Homo sapiens
aggccctgacctgggagatcta

SEQ ID NO: 7192950 - DNA, 22 bp, Homo sapiens
aggccctgacctgggagatcta

SEQ ID NO: 7192951 - DNA, 22 bp, Homo sapiens
aggccctggtcaggtctggctg

SEQ ID NO: 7192952 - DNA, 22 bp, Homo sapiens
aggccctggtcaggtctggctg

SEQ ID NO: 7192953 - DNA, 22 bp, Homo sapiens
aggccctgggttagggcccact

SEQ ID NO: 7192954 - DNA, 22 bp, Homo sapiens
aggccctggtcaggtctggctg

SEQ ID NO: 7192955 - DNA, 22 bp, Homo sapiens
aggccctggtcaggtctggctg

SEQ ID NO: 7192956 - DNA, 22 bp, Homo sapiens
aggccgcctggggagaggccct

SEQ ID NO: 7192957 - DNA, 22 bp, Homo sapiens
aggccgcctggggagaggccct

SEQ ID NO: 7192958 - DNA, 22 bp, Homo sapiens
aggccggcgcttcccaggaggc

SEQ ID NO: 7192959 - DNA, 22 bp, Homo sapiens
aggccgtgtgagcatgtgtgag

SEQ ID NO: 7192960 - DNA, 22 bp, Homo sapiens
aggcctagagctttggagggca

SEQ ID NO: 7192961 - DNA, 22 bp, Homo sapiens
aggcctagagctttggagggca

SEQ ID NO: 7192962 - DNA, 22 bp, Homo sapiens
aggcccagttatcctacttgtt

SEQ ID NO: 7192963 - DNA, 22 bp, Homo sapiens
aggcccatagtagctctgggca

SEQ ID NO: 7192964 - DNA, 22 bp, Homo sapiens
aggcccatgtgagtcttgtcct

SEQ ID NO: 7192965 - DNA, 22 bp, Homo sapiens
aggcccatgttcacttgctcag

SEQ ID NO: 7192966 - DNA, 22 bp, Homo sapiens
aggcccagttatcctacttgtt

SEQ ID NO: 7192967 - DNA, 22 bp, Homo sapiens
aggcccagttatcctacttgtt

SEQ ID NO: 7192968 - DNA, 22 bp, Homo sapiens
aggccccatcaggaaggaggcc

SEQ ID NO: 7192969 - DNA, 20 bp, Homo sapiens
aggccccaggtggacactag

SEQ ID NO: 7192970 - DNA, 20 bp, Homo sapiens
aggccccaggtggacactag

SEQ ID NO: 7192971 - DNA, 22 bp, Homo sapiens
aggcccccacaggcttgaggca

SEQ ID NO: 7192972 - DNA, 22 bp, Homo sapiens
aggccccctccacccattctgg

SEQ ID NO: 7192973 - DNA, 22 bp, Homo sapiens
aggccccccttgctggtttgct

SEQ ID NO: 7192974 - DNA, 18 bp, Homo sapiens
aggcccgttgtgtggaat

SEQ ID NO: 7192975 - DNA, 22 bp, Homo sapiens
aggccccaaagcagtgcaagta

SEQ ID NO: 7192976 - DNA, 22 bp, Homo sapiens
aggccccaaagcagtgcaagta

SEQ ID NO: 7192977 - DNA, 20 bp, Homo sapiens
aggccccaggaaactctcag

SEQ ID NO: 7192978 - DNA, 20 bp, Homo sapiens
aggccccaggaaactctcag

SEQ ID NO: 7192979 - DNA, 20 bp, Homo sapiens
aggccccaggaaactctcag

SEQ ID NO: 7192980 - DNA, 20 bp, Homo sapiens
aggccccaggaaactctcag

SEQ ID NO: 7192981 - DNA, 20 bp, Homo sapiens
aggccaggaaatgtagttct

SEQ ID NO: 7192982 - DNA, 20 bp, Homo sapiens
aggccaggaaatgtagttct

SEQ ID NO: 7192983 - DNA, 20 bp, Homo sapiens
aggccaggaaatgtagttct

SEQ ID NO: 7192984 - DNA, 22 bp, Homo sapiens
aggccaggaatccttgtcccag

SEQ ID NO: 7192985 - DNA, 22 bp, Homo sapiens
aggccaggaatccttgtcccag

SEQ ID NO: 7192986 - DNA, 22 bp, Homo sapiens
aggccagcttccagaggggcag

SEQ ID NO: 7192987 - DNA, 22 bp, Homo sapiens
aggccagcttccagaggggcag

SEQ ID NO: 7192988 - DNA, 22 bp, Homo sapiens
aggccagcttctaccctctgtt

SEQ ID NO: 7192989 - DNA, 22 bp, Homo sapiens
aggccaggaatccttgtcccag

SEQ ID NO: 7192990 - DNA, 22 bp, Homo sapiens
aggccaggacacttaagtaaga

SEQ ID NO: 7192991 - DNA, 22 bp, Homo sapiens
aggccaggacacttaagtaaga

SEQ ID NO: 7192992 - DNA, 22 bp, Homo sapiens
aggccaggacacttaagtaaga

SEQ ID NO: 7192993 - DNA, 22 bp, Homo sapiens
aggccaggacacttaagtaaga

SEQ ID NO: 7192994 - DNA, 22 bp, Homo sapiens
aggccaggaccattagcccaga

SEQ ID NO: 7192995 - DNA, 22 bp, Homo sapiens
aggccaggaccattagcccaga

SEQ ID NO: 7192996 - DNA, 22 bp, Homo sapiens
aggccaggaccattagcccaga

SEQ ID NO: 7192997 - DNA, 22 bp, Homo sapiens
aggccaggatagcatggatcag

SEQ ID NO: 7192998 - DNA, 22 bp, Homo sapiens
aggccaggatagcatggatcag

SEQ ID NO: 7192999 - DNA, 22 bp, Homo sapiens
aggcccagctgggccaggaaca

SEQ ID NO: 7193000 - DNA, 22 bp, Homo sapiens
aggcccagctgggccaggaaca

SEQ ID NO: 7193001 - DNA, 22 bp, Homo sapiens
aggccaggatagcatggatcag

SEQ ID NO: 7193002 - DNA, 22 bp, Homo sapiens
aggccaggatagcatggatcag

SEQ ID NO: 7193003 - DNA, 22 bp, Homo sapiens
aggccaggatagcatggatcag

SEQ ID NO: 7193004 - DNA, 22 bp, Homo sapiens
aggcccagctgggccaggaaca

SEQ ID NO: 7193005 - DNA, 22 bp, Homo sapiens
aggcccagtagtcgacggcgct

SEQ ID NO: 7193006 - DNA, 22 bp, Homo sapiens
aggcccagtagtgctgccttta

SEQ ID NO: 7193007 - DNA, 22 bp, Homo sapiens
aggcccagtagtgctgccttta

SEQ ID NO: 7193008 - DNA, 22 bp, Homo sapiens
aggcccagtagtgctgccttta

SEQ ID NO: 7193009 - DNA, 22 bp, Homo sapiens
aggcccagtgccattagttttg

SEQ ID NO: 7193010 - DNA, 22 bp, Homo sapiens
aggcccagtgtggcttcctgga

SEQ ID NO: 7193011 - DNA, 22 bp, Homo sapiens
aggcccagtgtggcttcctgga

SEQ ID NO: 7193012 - DNA, 22 bp, Homo sapiens
aggcccagtgtggcttcctgga

SEQ ID NO: 7193013 - DNA, 20 bp, Homo sapiens
aggcccagtgaatatattgc

SEQ ID NO: 7193014 - DNA, 22 bp, Homo sapiens
aggcccagtcctctgccgtctg

SEQ ID NO: 7193015 - DNA, 22 bp, Homo sapiens
aggcccagtcctctgccgtctg

SEQ ID NO: 7193016 - DNA, 22 bp, Homo sapiens
aggccaagtagctagcattgaa

SEQ ID NO: 7193017 - DNA, 22 bp, Homo sapiens
aggccaagtagctagcattgaa

SEQ ID NO: 7193018 - DNA, 22 bp, Homo sapiens
aggccaagtagccgctgtccta

SEQ ID NO: 7193019 - DNA, 22 bp, Homo sapiens
aggccaagtagccgctgtccta

SEQ ID NO: 7193020 - DNA, 22 bp, Homo sapiens
aggccaagtagccgctgtccta

SEQ ID NO: 7193021 - DNA, 22 bp, Homo sapiens
aggccaagggcaaagcggagag

SEQ ID NO: 7193022 - DNA, 22 bp, Homo sapiens
aggccaagctcccagagaagct

SEQ ID NO: 7193023 - DNA, 22 bp, Homo sapiens
aggccaagtgctgggacaggtg

SEQ ID NO: 7193024 - DNA, 22 bp, Homo sapiens
aggccaagtgctgggacaggtg

SEQ ID NO: 7193025 - DNA, 22 bp, Homo sapiens
aggccaagtgctgggacaggtg

SEQ ID NO: 7193026 - DNA, 22 bp, Homo sapiens
aggccacaaccaccctgtgccc

SEQ ID NO: 7193027 - DNA, 22 bp, Homo sapiens
aggccacaaccaccctgtgccc

SEQ ID NO: 7193028 - DNA, 22 bp, Homo sapiens
aggccaagttacttgggaaagc

SEQ ID NO: 7193029 - DNA, 22 bp, Homo sapiens
aggccaagttacttgggaaagc

SEQ ID NO: 7193030 - DNA, 22 bp, Homo sapiens
aggccaagctcccagagaagct

SEQ ID NO: 7193031 - DNA, 22 bp, Homo sapiens
aggccaagctcccagagaagct

SEQ ID NO: 7193032 - DNA, 22 bp, Homo sapiens
aggccaagattttggatcagct

SEQ ID NO: 7193033 - DNA, 22 bp, Homo sapiens
aggccaaagcacagagctggaa

SEQ ID NO: 7193034 - DNA, 22 bp, Homo sapiens
aggccaaagctcacctgcagct

SEQ ID NO: 7193035 - DNA, 22 bp, Homo sapiens
aggccaaagtgctccttttaga

SEQ ID NO: 7193036 - DNA, 22 bp, Homo sapiens
aggccaaatgtgtataaaacat

SEQ ID NO: 7193037 - DNA, 22 bp, Homo sapiens
aggccaaatgtgtataaaacat

SEQ ID NO: 7193038 - DNA, 22 bp, Homo sapiens
aggccaaattgatcatctttag

SEQ ID NO: 7193039 - DNA, 22 bp, Homo sapiens
aggccaagattttggatcagct

SEQ ID NO: 7193040 - DNA, 16 bp, Homo sapiens
aggccaaaaaggggca

SEQ ID NO: 7193041 - DNA, 20 bp, Homo sapiens
aggccaaacccagcgcgccc

SEQ ID NO: 7193042 - DNA, 22 bp, Homo sapiens
aggccaaaccggatggaaaagg

SEQ ID NO: 7193043 - DNA, 18 bp, Homo sapiens
aggccaaacttgtaagca

SEQ ID NO: 7193044 - DNA, 22 bp, Homo sapiens
aggccaaagcaagaccctgtaa

SEQ ID NO: 7193045 - DNA, 22 bp, Homo sapiens
aggccaaagcacagagctggaa

SEQ ID NO: 7193046 - DNA, 22 bp, Homo sapiens
aggcattttgttcaagatgaca

SEQ ID NO: 7193047 - DNA, 22 bp, Homo sapiens
aggcattttgttcaagatgaca

SEQ ID NO: 7193048 - DNA, 22 bp, Homo sapiens
aggcattttgttcaagatgaca

SEQ ID NO: 7193049 - DNA, 23 bp, Homo sapiens
aggccagcgcagacaccgagcac

SEQ ID NO: 7193050 - DNA, 23 bp, Homo sapiens
aggccagcgcagacaccgagcac

SEQ ID NO: 7193051 - DNA, 22 bp, Homo sapiens
aggccagcgctgctagctcccg

SEQ ID NO: 7193052 - DNA, 22 bp, Homo sapiens
aggccagcctgcccaaagctgc

SEQ ID NO: 7193053 - DNA, 22 bp, Homo sapiens
aggccagcctcaggcagggacc

SEQ ID NO: 7193054 - DNA, 23 bp, Homo sapiens
aggccagcgcagacaccgagcac

SEQ ID NO: 7193055 - DNA, 22 bp, Homo sapiens
aggccagcgctgctagctcccg

SEQ ID NO: 7193056 - DNA, 22 bp, Homo sapiens
aggccacaaccaccctgtgccc

SEQ ID NO: 7193057 - DNA, 22 bp, Homo sapiens
aggccacaagaaaatgcttcat

SEQ ID NO: 7193058 - DNA, 22 bp, Homo sapiens
aggccacaagaaaatgcttcat

SEQ ID NO: 7193059 - DNA, 22 bp, Homo sapiens
aggccacaagaaaatgcttcat

SEQ ID NO: 7193060 - DNA, 22 bp, Homo sapiens
aggccacaagaaaatgcttcat

SEQ ID NO: 7193061 - DNA, 22 bp, Homo sapiens
aggccacaagaaaatgcttcat

SEQ ID NO: 7193062 - DNA, 22 bp, Homo sapiens
aggccagatgtcgggctagaag

SEQ ID NO: 7193063 - DNA, 22 bp, Homo sapiens
aggccagcaagaaagagagtct

SEQ ID NO: 7193064 - DNA, 22 bp, Homo sapiens
aggccagcctcaggcagggacc

SEQ ID NO: 7193065 - DNA, 22 bp, Homo sapiens
aggccagctcaccctggctcct

SEQ ID NO: 7193066 - DNA, 22 bp, Homo sapiens
aggccagctcaccctggctcct

SEQ ID NO: 7193067 - DNA, 22 bp, Homo sapiens
aggccagctcaccctggctcct

SEQ ID NO: 7193068 - DNA, 22 bp, Homo sapiens
aggccagctcaccctggctcct

SEQ ID NO: 7193069 - DNA, 22 bp, Homo sapiens
aggccagctctacccttggact

SEQ ID NO: 7193070 - DNA, 22 bp, Homo sapiens
aggccagctctacccttggact

SEQ ID NO: 7193071 - DNA, 22 bp, Homo sapiens
aggccagctgccacccggtccg

SEQ ID NO: 7193072 - DNA, 22 bp, Homo sapiens
aggccagctgccacccggtccg

SEQ ID NO: 7193073 - DNA, 22 bp, Homo sapiens
aggccagctgttactagagcca

SEQ ID NO: 7193074 - DNA, 22 bp, Homo sapiens
aggccagctgttactagagcca

SEQ ID NO: 7193075 - DNA, 22 bp, Homo sapiens
aggccagctgttactagagcca

SEQ ID NO: 7193076 - DNA, 22 bp, Homo sapiens
aggccagctgttactagagcca

SEQ ID NO: 7193077 - DNA, 22 bp, Homo sapiens
aggccagcttccagaggggcag

SEQ ID NO: 7193078 - DNA, 22 bp, Homo sapiens
aggcagtctatctctggagcct

SEQ ID NO: 7193079 - DNA, 19 bp, Homo sapiens
aggcagtcattggaatata

SEQ ID NO: 7193080 - DNA, 22 bp, Homo sapiens
aggcaggtttcccggctgtcaa

SEQ ID NO: 7193081 - DNA, 22 bp, Homo sapiens
aggcaggtttcccggctgtcaa

SEQ ID NO: 7193082 - DNA, 23 bp, Homo sapiens
aggcaggtttgggctcttcttgt

SEQ ID NO: 7193083 - DNA, 18 bp, Homo sapiens
aggcaggtgctggaagtc

SEQ ID NO: 7193084 - DNA, 22 bp, Homo sapiens
aggcaggttggtgagaagactg

SEQ ID NO: 7193085 - DNA, 22 bp, Homo sapiens
aggcaggtttactcttatttgg

SEQ ID NO: 7193086 - DNA, 22 bp, Homo sapiens
aggcagcctttagacagtctgc

SEQ ID NO: 7193087 - DNA, 22 bp, Homo sapiens
aggcagcctggtttgaatggaa

SEQ ID NO: 7193088 - DNA, 22 bp, Homo sapiens
aggcagcctatggggagctcag

SEQ ID NO: 7193089 - DNA, 22 bp, Homo sapiens
aggcagcctggtttgaatggaa

SEQ ID NO: 7193090 - DNA, 22 bp, Homo sapiens
aggcagcctatggggagctcag

SEQ ID NO: 7193091 - DNA, 22 bp, Homo sapiens
aggcagccctgtgctggatgct

SEQ ID NO: 7193092 - DNA, 22 bp, Homo sapiens
aggcagccctgtgctggatgct

SEQ ID NO: 7193093 - DNA, 22 bp, Homo sapiens
aggcagccctgtgctggatgct

SEQ ID NO: 7193094 - DNA, 22 bp, Homo sapiens
aggcagccctgtgctggatgct

SEQ ID NO: 7193095 - DNA, 22 bp, Homo sapiens
aggcagcccacaggacacagga

SEQ ID NO: 7193096 - DNA, 22 bp, Homo sapiens
aggcagcccacaggacacagga

SEQ ID NO: 7193097 - DNA, 22 bp, Homo sapiens
aggcagccatctgcaggaagga

SEQ ID NO: 7193098 - DNA, 22 bp, Homo sapiens
aggcagccattaccaagggcat

SEQ ID NO: 7193099 - DNA, 22 bp, Homo sapiens
aggcagccattaccaagggcat

SEQ ID NO: 7193100 - DNA, 22 bp, Homo sapiens
aggcagccatccaggaggctca

SEQ ID NO: 7193101 - DNA, 22 bp, Homo sapiens
aggcagccatctgcaggaagga

SEQ ID NO: 7193102 - DNA, 22 bp, Homo sapiens
aggcagccatctgcaggaagga

SEQ ID NO: 7193103 - DNA, 22 bp, Homo sapiens
aggcagtgcctggaccccagct

SEQ ID NO: 7193104 - DNA, 22 bp, Homo sapiens
aggcagtgctcaagacagcagc

SEQ ID NO: 7193105 - DNA, 22 bp, Homo sapiens
aggcagtgctcaagacagcagc

SEQ ID NO: 7193106 - DNA, 22 bp, Homo sapiens
aggcagtgctcaagacagcagc

SEQ ID NO: 7193107 - DNA, 22 bp, Homo sapiens
aggcagtgctcaagacagcagc

SEQ ID NO: 7193108 - DNA, 22 bp, Homo sapiens
aggcagtgcagagtcctcttct

SEQ ID NO: 7193109 - DNA, 22 bp, Homo sapiens
aggcagtgcctggaccccagct

SEQ ID NO: 7193110 - DNA, 22 bp, Homo sapiens
aggcagtgagcagggtgtcatg

SEQ ID NO: 7193111 - DNA, 22 bp, Homo sapiens
aggcagtgagcagggtgtcatg

SEQ ID NO: 7193112 - DNA, 22 bp, Homo sapiens
aggcagtgagcagggtgtcatg

SEQ ID NO: 7193113 - DNA, 22 bp, Homo sapiens
aggcagtctatctctggagcct

SEQ ID NO: 7193114 - DNA, 22 bp, Homo sapiens
aggcagtgagaaatagcaagat

SEQ ID NO: 7193115 - DNA, 22 bp, Homo sapiens
aggcagtggagctggaataggc

SEQ ID NO: 7193116 - DNA, 22 bp, Homo sapiens
aggcagtggagctggaataggc

SEQ ID NO: 7193117 - DNA, 22 bp, Homo sapiens
aggcagtggagctggaataggc

SEQ ID NO: 7193118 - DNA, 22 bp, Homo sapiens
aggcagtggaaggagaaagcaa

SEQ ID NO: 7193119 - DNA, 22 bp, Homo sapiens
aggcagtggctgagaccagggg

SEQ ID NO: 7193120 - DNA, 22 bp, Homo sapiens
aggcagtggctgagaccagggg

SEQ ID NO: 7193121 - DNA, 22 bp, Homo sapiens
aggcagtggctgagaccagggg

SEQ ID NO: 7193122 - DNA, 22 bp, Homo sapiens
aggcagtggatgtcaggaatgg

SEQ ID NO: 7193123 - DNA, 22 bp, Homo sapiens
aggcagtggatgtcaggaatgg

SEQ ID NO: 7193124 - DNA, 22 bp, Homo sapiens
aggcagtggagctggaataggc

SEQ ID NO: 7193125 - DNA, 22 bp, Homo sapiens
aggcagtggagctggaataggc

SEQ ID NO: 7193126 - DNA, 22 bp, Homo sapiens
aggcatgactttggctgaagaa

SEQ ID NO: 7193127 - DNA, 17 bp, Homo sapiens
aggcatgaggcatcact

SEQ ID NO: 7193128 - DNA, 22 bp, Homo sapiens
aggcatgatgtgcagtggcaaa

SEQ ID NO: 7193129 - DNA, 20 bp, Homo sapiens
aggcatctgagtcacatctt

SEQ ID NO: 7193130 - DNA, 22 bp, Homo sapiens
aggcatctgagtttgcaagctt

SEQ ID NO: 7193131 - DNA, 22 bp, Homo sapiens
aggcatctgcagagcttggtga

SEQ ID NO: 7193132 - DNA, 22 bp, Homo sapiens
aggcatctgcctcctctacccc

SEQ ID NO: 7193133 - DNA, 22 bp, Homo sapiens
aggcatctgcctcctctacccc

SEQ ID NO: 7193134 - DNA, 22 bp, Homo sapiens
aggcatctgctgcccttctgga

SEQ ID NO: 7193135 - DNA, 23 bp, Homo sapiens
aggcatcttctgagttaagagca

SEQ ID NO: 7193136 - DNA, 22 bp, Homo sapiens
aggcatctctctgcttctgagc

SEQ ID NO: 7193137 - DNA, 21 bp, Homo sapiens
aggcatctaaagagagtagac

SEQ ID NO: 7193138 - DNA, 21 bp, Homo sapiens
aggcatctaaagagagtagac

SEQ ID NO: 7193139 - DNA, 22 bp, Homo sapiens
aggcatctaacagagatcttta

SEQ ID NO: 7193140 - DNA, 22 bp, Homo sapiens
aggcagttgtagagagggctct

SEQ ID NO: 7193141 - DNA, 22 bp, Homo sapiens
aggcagttggtcattgctcttt

SEQ ID NO: 7193142 - DNA, 22 bp, Homo sapiens
aggcagttgttgctgagcagct

SEQ ID NO: 7193143 - DNA, 22 bp, Homo sapiens
aggcagttgttgctgagcagct

SEQ ID NO: 7193144 - DNA, 22 bp, Homo sapiens
aggcataaccttttatctggat

SEQ ID NO: 7193145 - DNA, 22 bp, Homo sapiens
aggcatcaggagtatagccaga

SEQ ID NO: 7193146 - DNA, 22 bp, Homo sapiens
aggcatcaggagtatagccaga

SEQ ID NO: 7193147 - DNA, 22 bp, Homo sapiens
aggcagtggctgagaccagggg

SEQ ID NO: 7193148 - DNA, 22 bp, Homo sapiens
aggcagtggctgagaccagggg

SEQ ID NO: 7193149 - DNA, 23 bp, Homo sapiens
aggcagtgggggccactttgctt

SEQ ID NO: 7193150 - DNA, 23 bp, Homo sapiens
aggcagtggtggtaacatgtcaa

SEQ ID NO: 7193151 - DNA, 22 bp, Homo sapiens
aggcagttctcgtgtgtgtccc

SEQ ID NO: 7193152 - DNA, 22 bp, Homo sapiens
aggcagttctcgtgtgtgtccc

SEQ ID NO: 7193153 - DNA, 21 bp, Homo sapiens
aggcagttgagcatgttatga

SEQ ID NO: 7193154 - DNA, 22 bp, Homo sapiens
ccactggcatccagctgccatc

SEQ ID NO: 7193155 - DNA, 22 bp, Homo sapiens
ccactggcagttggctagcctt

SEQ ID NO: 7193156 - DNA, 22 bp, Homo sapiens
ccactggcatccagctgccatc

SEQ ID NO: 7193157 - DNA, 22 bp, Homo sapiens
ccactggctgtcagcaggactc

SEQ ID NO: 7193158 - DNA, 22 bp, Homo sapiens
ccactggcaaccccgcctcata

SEQ ID NO: 7193159 - DNA, 22 bp, Homo sapiens
ccactggcaaccccgcctcata

SEQ ID NO: 7193160 - DNA, 22 bp, Homo sapiens
ccactgctgttacttacgcaaa

SEQ ID NO: 7193161 - DNA, 23 bp, Homo sapiens
ccactgctttcattttgtcatgg

SEQ ID NO: 7193162 - DNA, 23 bp, Homo sapiens
ccactgctttcattttgtcatgg

SEQ ID NO: 7193163 - DNA, 21 bp, Homo sapiens
ccactgctcttccctagggcc

SEQ ID NO: 7193164 - DNA, 21 bp, Homo sapiens
ccactgctcttccctagggcc

SEQ ID NO: 7193165 - DNA, 22 bp, Homo sapiens
ccactgctcctgaccaaggtca

SEQ ID NO: 7193166 - DNA, 22 bp, Homo sapiens
aggcattgaggcggatgtggct

SEQ ID NO: 7193167 - DNA, 22 bp, Homo sapiens
aggcattgaggcggatgtggct

SEQ ID NO: 7193168 - DNA, 22 bp, Homo sapiens
aggcatttaaagatgtaagact

SEQ ID NO: 7193169 - DNA, 22 bp, Homo sapiens
aggcatttcctatgggcagaga

SEQ ID NO: 7193170 - DNA, 22 bp, Homo sapiens
aggcatttggctgtcatttgta

SEQ ID NO: 7193171 - DNA, 22 bp, Homo sapiens
aggcatggcatggggcagatgt

SEQ ID NO: 7193172 - DNA, 19 bp, Homo sapiens
ccactggggctccacatta

SEQ ID NO: 7193173 - DNA, 22 bp, Homo sapiens
aggcatggcatggggcagatgt

SEQ ID NO: 7193174 - DNA, 22 bp, Homo sapiens
aggcatggcatggggcagatgt

SEQ ID NO: 7193175 - DNA, 22 bp, Homo sapiens
ccactggctgtcagcaggactc

SEQ ID NO: 7193176 - DNA, 22 bp, Homo sapiens
ccactggcttttcctaggtctc

SEQ ID NO: 7193177 - DNA, 22 bp, Homo sapiens
ccactgggcgtttctgtccaat

SEQ ID NO: 7193178 - DNA, 22 bp, Homo sapiens
ccactgggcgtttctgtccaat

SEQ ID NO: 7193179 - DNA, 19 bp, Homo sapiens
ccactggggctccacatta

SEQ ID NO: 7193180 - DNA, 19 bp, Homo sapiens
ccactggggctccacatta

SEQ ID NO: 7193181 - DNA, 22 bp, Homo sapiens
ccagtgatctgacaccaaatca

SEQ ID NO: 7193182 - DNA, 22 bp, Homo sapiens
ccagtctgtgtgccagcctgcg

SEQ ID NO: 7193183 - DNA, 22 bp, Homo sapiens
ccagtctgtgtgccagcctgcg

SEQ ID NO: 7193184 - DNA, 22 bp, Homo sapiens
ccagtctgttctcacctctgag

SEQ ID NO: 7193185 - DNA, 22 bp, Homo sapiens
ccagtgcacagccaggcaggtg

SEQ ID NO: 7193186 - DNA, 22 bp, Homo sapiens
ccagtgcacaatggaacaactc

SEQ ID NO: 7193187 - DNA, 22 bp, Homo sapiens
ccagtgattcattcatttacct

SEQ ID NO: 7193188 - DNA, 22 bp, Homo sapiens
ccagtgattcctagtaatataa

SEQ ID NO: 7193189 - DNA, 23 bp, Homo sapiens
ccagtgattgcctggaaggaggt

SEQ ID NO: 7193190 - DNA, 23 bp, Homo sapiens
ccagtgattgcctggaaggaggt

SEQ ID NO: 7193191 - DNA, 23 bp, Homo sapiens
ccagtgattgcctggaaggaggt

SEQ ID NO: 7193192 - DNA, 22 bp, Homo sapiens
ccagtgatttagtacaatgtag

SEQ ID NO: 7193193 - DNA, 22 bp, Homo sapiens
aggctgagcggggtcccagagc

SEQ ID NO: 7193194 - DNA, 22 bp, Homo sapiens
aggctgagcctgggcgtggtgg

SEQ ID NO: 7193195 - DNA, 22 bp, Homo sapiens
aggctgagcggggtcccagagc

SEQ ID NO: 7193196 - DNA, 23 bp, Homo sapiens
aggctgagctctcccagcttcag

SEQ ID NO: 7193197 - DNA, 22 bp, Homo sapiens
aggctgagcggggtcccagagc

SEQ ID NO: 7193198 - DNA, 22 bp, Homo sapiens
ccagtctggcaggagggggaac

SEQ ID NO: 7193199 - DNA, 21 bp, Homo sapiens
ccagtctgtaaaatggggaca

SEQ ID NO: 7193200 - DNA, 22 bp, Homo sapiens
ccagtctgtactttgctctgtt

SEQ ID NO: 7193201 - DNA, 22 bp, Homo sapiens
ccagtcactggaaaatgggaat

SEQ ID NO: 7193202 - DNA, 22 bp, Homo sapiens
ccagtcactggaaaatgggaat

SEQ ID NO: 7193203 - DNA, 22 bp, Homo sapiens
ccagtctggcaggagggggaac

SEQ ID NO: 7193204 - DNA, 22 bp, Homo sapiens
aggctgagctgacctggtttgg

SEQ ID NO: 7193205 - DNA, 22 bp, Homo sapiens
ccagtcacaggtgtgtttatat

SEQ ID NO: 7193206 - DNA, 22 bp, Homo sapiens
ccagtcactctgtgagagctac

SEQ ID NO: 7193207 - DNA, 22 bp, Homo sapiens
ccagtcactctgtgagagctac

SEQ ID NO: 7193208 - DNA, 22 bp, Homo sapiens
ccagtcacaggtgtgtttatat

SEQ ID NO: 7193209 - DNA, 22 bp, Homo sapiens
aggctgaggcgggaggatcact

SEQ ID NO: 7193210 - DNA, 22 bp, Homo sapiens
aggctgaggcaggtggatcatt

SEQ ID NO: 7193211 - DNA, 22 bp, Homo sapiens
aggctgaggcgggaggatcact

SEQ ID NO: 7193212 - DNA, 22 bp, Homo sapiens
aggctgaggcaggtggatcatt

SEQ ID NO: 7193213 - DNA, 22 bp, Homo sapiens
aggctgaggcaggtggatcatt

SEQ ID NO: 7193214 - DNA, 22 bp, Homo sapiens
aggctgaggcaggtggatcatt

SEQ ID NO: 7193215 - DNA, 22 bp, Homo sapiens
aggctgaggcaggtggatcatt

SEQ ID NO: 7193216 - DNA, 22 bp, Homo sapiens
aggctgaggcaggtggatcact

SEQ ID NO: 7193217 - DNA, 22 bp, Homo sapiens
aggctgaggcaggtggatcact

SEQ ID NO: 7193218 - DNA, 22 bp, Homo sapiens
aggctgaggcaggtggatcact

SEQ ID NO: 7193219 - DNA, 22 bp, Homo sapiens
aggctgaggcaggtggatcact

SEQ ID NO: 7193220 - DNA, 22 bp, Homo sapiens
aggctgaggcaggtggatcact

SEQ ID NO: 7193221 - DNA, 22 bp, Homo sapiens
ccagtgcaggtgagcaccaggt

SEQ ID NO: 7193222 - DNA, 22 bp, Homo sapiens
ccagtgcacagccaggcaggtg

SEQ ID NO: 7193223 - DNA, 22 bp, Homo sapiens
ccagtttaggtactaggctcta

SEQ ID NO: 7193224 - DNA, 20 bp, Homo sapiens
ccagtttctttcccagcctc

SEQ ID NO: 7193225 - DNA, 22 bp, Homo sapiens
ccagttccagtgctcacatcca

SEQ ID NO: 7193226 - DNA, 23 bp, Homo sapiens
ccagttctcctttgaacagtgac

SEQ ID NO: 7193227 - DNA, 22 bp, Homo sapiens
ccagttcttcttgacacgaaag

SEQ ID NO: 7193228 - DNA, 22 bp, Homo sapiens
ccagtgtgcattatcatgtgtc

SEQ ID NO: 7193229 - DNA, 22 bp, Homo sapiens
aggctgaggcgggaggatcact

SEQ ID NO: 7193230 - DNA, 22 bp, Homo sapiens
ccagttatccagcatgctgtct

SEQ ID NO: 7193231 - DNA, 22 bp, Homo sapiens
ccagttatccagcatgctgtct

SEQ ID NO: 7193232 - DNA, 22 bp, Homo sapiens
aggctgagccacggggctggct

SEQ ID NO: 7193233 - DNA, 22 bp, Homo sapiens
aggctgagccacggggctggct

SEQ ID NO: 7193234 - DNA, 22 bp, Homo sapiens
aggctgagccacggggctggct

SEQ ID NO: 7193235 - DNA, 22 bp, Homo sapiens
aggctgagcctgggcgtggtgg

SEQ ID NO: 7193236 - DNA, 22 bp, Homo sapiens
aggctgagccacggggctggct

SEQ ID NO: 7193237 - DNA, 22 bp, Homo sapiens
aggctgagcaaagggccttacc

SEQ ID NO: 7193238 - DNA, 22 bp, Homo sapiens
aggctgagataggtggatcatt

SEQ ID NO: 7193239 - DNA, 22 bp, Homo sapiens
aggctgagataggtggatcatt

SEQ ID NO: 7193240 - DNA, 22 bp, Homo sapiens
aggctgagataggtggatcatt

SEQ ID NO: 7193241 - DNA, 22 bp, Homo sapiens
aggctgagataggtggatcatt

SEQ ID NO: 7193242 - DNA, 22 bp, Homo sapiens
aggctgagataggtggatcatt

SEQ ID NO: 7193243 - DNA, 22 bp, Homo sapiens
aggctgagagcaacgtgtcaga

SEQ ID NO: 7193244 - DNA, 22 bp, Homo sapiens
aggctgagagcaacgtgtcaga

SEQ ID NO: 7193245 - DNA, 22 bp, Homo sapiens
aggctgagactgtgcattagtg

SEQ ID NO: 7193246 - DNA, 20 bp, Homo sapiens
aggctctgcctgcaggccca

SEQ ID NO: 7193247 - DNA, 22 bp, Homo sapiens
aggctctgttattctagagggc

SEQ ID NO: 7193248 - DNA, 22 bp, Homo sapiens
aggctctgttattctagagggc

SEQ ID NO: 7193249 - DNA, 22 bp, Homo sapiens
aggctctgttattctagagggc

SEQ ID NO: 7193250 - DNA, 22 bp, Homo sapiens
aggctctgttattctagagggc

SEQ ID NO: 7193251 - DNA, 22 bp, Homo sapiens
aggctctgttattctagagggc

SEQ ID NO: 7193252 - DNA, 22 bp, Homo sapiens
aggctctgttattctagagggc

SEQ ID NO: 7193253 - DNA, 20 bp, Homo sapiens
aggctctgcctgcaggccca

SEQ ID NO: 7193254 - DNA, 20 bp, Homo sapiens
aggctctgccattgtccctg

SEQ ID NO: 7193255 - DNA, 22 bp, Homo sapiens
aggctctgccaattccttcctc

SEQ ID NO: 7193256 - DNA, 22 bp, Homo sapiens
aggctctgccaattccttcctc

SEQ ID NO: 7193257 - DNA, 20 bp, Homo sapiens
aggctctgccattgtccctg

SEQ ID NO: 7193258 - DNA, 20 bp, Homo sapiens
aggctctgccattgtccctg

SEQ ID NO: 7193259 - DNA, 20 bp, Homo sapiens
aggctctgcatttctgagtg

SEQ ID NO: 7193260 - DNA, 20 bp, Homo sapiens
aggctctgcatttctgagtg

SEQ ID NO: 7193261 - DNA, 20 bp, Homo sapiens
aggctctgcatttctgagtg

SEQ ID NO: 7193262 - DNA, 22 bp, Homo sapiens
aggctctgcatccaggctttat

SEQ ID NO: 7193263 - DNA, 22 bp, Homo sapiens
aggctctgcatccaggctttat

SEQ ID NO: 7193264 - DNA, 22 bp, Homo sapiens
aggctctgcagtgctggaggac

SEQ ID NO: 7193265 - DNA, 22 bp, Homo sapiens
aggctctgcagtgctggaggac

SEQ ID NO: 7193266 - DNA, 22 bp, Homo sapiens
aggctctgcagtgctggaggac

SEQ ID NO: 7193267 - DNA, 22 bp, Homo sapiens
aggctctgcagtccatcccgtg

SEQ ID NO: 7193268 - DNA, 22 bp, Homo sapiens
aggctctgcagtgctggaggac

SEQ ID NO: 7193269 - DNA, 22 bp, Homo sapiens
aggctctgcagtccatcccgtg

SEQ ID NO: 7193270 - DNA, 22 bp, Homo sapiens
aggctctgcaggtatttcttga

SEQ ID NO: 7193271 - DNA, 22 bp, Homo sapiens
aggctctgcagtccatcccgtg

SEQ ID NO: 7193272 - DNA, 22 bp, Homo sapiens
aggctctgcagaccccagctgt

SEQ ID NO: 7193273 - DNA, 22 bp, Homo sapiens
aggctctgcagaccccagctgt

SEQ ID NO: 7193274 - DNA, 22 bp, Homo sapiens
aggctctgatgcaagcccaggg

SEQ ID NO: 7193275 - DNA, 22 bp, Homo sapiens
aggctctgatgcaagcccaggg

SEQ ID NO: 7193276 - DNA, 22 bp, Homo sapiens
aggctctgatgcaagcccaggg

SEQ ID NO: 7193277 - DNA, 22 bp, Homo sapiens
aggctctgatgcaagcccaggg

SEQ ID NO: 7193278 - DNA, 22 bp, Homo sapiens
aggctctgcagaccccagctgt

SEQ ID NO: 7193279 - DNA, 22 bp, Homo sapiens
aggctctgagtagagctgccag

SEQ ID NO: 7193280 - DNA, 19 bp, Homo sapiens
aggctctgagctcctggag

SEQ ID NO: 7193281 - DNA, 22 bp, Homo sapiens
aggctctgagtagagctgccag

SEQ ID NO: 7193282 - DNA, 22 bp, Homo sapiens
aggctccttgctcacaggctca

SEQ ID NO: 7193283 - DNA, 22 bp, Homo sapiens
aggctccttgttcatcatccat

SEQ ID NO: 7193284 - DNA, 19 bp, Homo sapiens
aggctctgagctcctggag

SEQ ID NO: 7193285 - DNA, 19 bp, Homo sapiens
aggctctgagctcctggag

SEQ ID NO: 7193286 - DNA, 19 bp, Homo sapiens
aggctctgagctcctggag

SEQ ID NO: 7193287 - DNA, 19 bp, Homo sapiens
aggctctgagctcctggag

SEQ ID NO: 7193288 - DNA, 22 bp, Homo sapiens
aggctctgatcaggtggctgtg

SEQ ID NO: 7193289 - DNA, 22 bp, Homo sapiens
aggctctgatcaggtggctgtg

SEQ ID NO: 7193290 - DNA, 22 bp, Homo sapiens
aggctctgatgcaagcccaggg

SEQ ID NO: 7193291 - DNA, 22 bp, Homo sapiens
aggctctgatcaggtggctgtg

SEQ ID NO: 7193292 - DNA, 22 bp, Homo sapiens
aggctctgagtagagctgccag

SEQ ID NO: 7193293 - DNA, 22 bp, Homo sapiens
aggctctgagtagagctgccag

SEQ ID NO: 7193294 - DNA, 22 bp, Homo sapiens
aggctctgagtagagctgccag

SEQ ID NO: 7193295 - DNA, 22 bp, Homo sapiens
aggctctgagtagagctgccag

SEQ ID NO: 7193296 - DNA, 22 bp, Homo sapiens
aggctctgagtctggtgtctgc

SEQ ID NO: 7193297 - DNA, 22 bp, Homo sapiens
aggctctgagtctggtgtctgc

SEQ ID NO: 7193298 - DNA, 22 bp, Homo sapiens
aggctctgagtctggtgtctgc

SEQ ID NO: 7193299 - DNA, 22 bp, Homo sapiens
aggctctgagtctggtgtctgc

SEQ ID NO: 7193300 - DNA, 22 bp, Homo sapiens
aggctctgatcaggtggctgtg

SEQ ID NO: 7193301 - DNA, 22 bp, Homo sapiens
aggctccttgctcacaggctca

SEQ ID NO: 7193302 - DNA, 22 bp, Homo sapiens
ccaggctctgcgctggacatgg

SEQ ID NO: 7193303 - DNA, 22 bp, Homo sapiens
aggctccttgctcacaggctca

SEQ ID NO: 7193304 - DNA, 22 bp, Homo sapiens
ccaggctctgccaggcccttga

SEQ ID NO: 7193305 - DNA, 22 bp, Homo sapiens
ccaggctctgcgctggacatgg

SEQ ID NO: 7193306 - DNA, 22 bp, Homo sapiens
ccaggctctgcgctggacatgg

SEQ ID NO: 7193307 - DNA, 22 bp, Homo sapiens
ccaggctctgcgctggacatgg

SEQ ID NO: 7193308 - DNA, 22 bp, Homo sapiens
ccaggctctgcgctggacatgg

SEQ ID NO: 7193309 - DNA, 22 bp, Homo sapiens
ccaggctctgcgctggacatgg

SEQ ID NO: 7193310 - DNA, 22 bp, Homo sapiens
ccaggctctgcaaaatcaggct

SEQ ID NO: 7193311 - DNA, 22 bp, Homo sapiens
ccaggctctgcaaaatcaggct

SEQ ID NO: 7193312 - DNA, 22 bp, Homo sapiens
ccaggctctgcaaaatcaggct

SEQ ID NO: 7193313 - DNA, 15 bp, Homo sapiens
ccaggctctgcactc

SEQ ID NO: 7193314 - DNA, 22 bp, Homo sapiens
ccaggctctgccaggcccttga

SEQ ID NO: 7193315 - DNA, 22 bp, Homo sapiens
ccaggctctgccaggcccttga

SEQ ID NO: 7193316 - DNA, 22 bp, Homo sapiens
ccaggctctgccaggcccttga

SEQ ID NO: 7193317 - DNA, 22 bp, Homo sapiens
ccaggctctgccaggcccttga

SEQ ID NO: 7193318 - DNA, 22 bp, Homo sapiens
ccaggctctgagcctcactctt

SEQ ID NO: 7193319 - DNA, 22 bp, Homo sapiens
ccaggctctgagcctcactctt

SEQ ID NO: 7193320 - DNA, 22 bp, Homo sapiens
ccaggctctgagcctcactctt

SEQ ID NO: 7193321 - DNA, 22 bp, Homo sapiens
ccaggctctgagaggaatgtga

SEQ ID NO: 7193322 - DNA, 22 bp, Homo sapiens
ccaggctctgagaggaatgtga

SEQ ID NO: 7193323 - DNA, 22 bp, Homo sapiens
ccaggctctgagaggaatgtga

SEQ ID NO: 7193324 - DNA, 22 bp, Homo sapiens
ccaggctctgacatagatggga

SEQ ID NO: 7193325 - DNA, 22 bp, Homo sapiens
ccaggctctgacatagatggga

SEQ ID NO: 7193326 - DNA, 22 bp, Homo sapiens
ccaggctctgacatagatggga

SEQ ID NO: 7193327 - DNA, 22 bp, Homo sapiens
ccaggctctgagaggaatgtga

SEQ ID NO: 7193328 - DNA, 22 bp, Homo sapiens
ccaggctctgagcctcactctt

SEQ ID NO: 7193329 - DNA, 22 bp, Homo sapiens
ccaggctctgagcctcactctt

SEQ ID NO: 7193330 - DNA, 22 bp, Homo sapiens
ccaggctctgagcctcactctt

SEQ ID NO: 7193331 - DNA, 22 bp, Homo sapiens
ccaggctctgagcctcactctt

SEQ ID NO: 7193332 - DNA, 22 bp, Homo sapiens
ccaggctctgagcctcactctt

SEQ ID NO: 7193333 - DNA, 22 bp, Homo sapiens
ccaggctctgcaaaatcaggct

SEQ ID NO: 7193334 - DNA, 21 bp, Homo sapiens
ccaggctcctgaggctggtca

SEQ ID NO: 7193335 - DNA, 21 bp, Homo sapiens
ccaggctcctgaggctggtca

SEQ ID NO: 7193336 - DNA, 22 bp, Homo sapiens
aggctcccatggtgtggcagga

SEQ ID NO: 7193337 - DNA, 22 bp, Homo sapiens
aggctcccatggtgtggcagga

SEQ ID NO: 7193338 - DNA, 22 bp, Homo sapiens
aggctcccatggtgtggcagga

SEQ ID NO: 7193339 - DNA, 21 bp, Homo sapiens
aggctcccagaaatgggcatc

SEQ ID NO: 7193340 - DNA, 21 bp, Homo sapiens
aggctcccagaaatgggcatc

SEQ ID NO: 7193341 - DNA, 22 bp, Homo sapiens
ccaggctctatccctccttctt

SEQ ID NO: 7193342 - DNA, 22 bp, Homo sapiens
ccaggctctatccctccttctt

SEQ ID NO: 7193343 - DNA, 21 bp, Homo sapiens
ccaggctcctgaggctggtca

SEQ ID NO: 7193344 - DNA, 22 bp, Homo sapiens
ccaggctctatccctccttctt

SEQ ID NO: 7193345 - DNA, 22 bp, Homo sapiens
ccaggctctatccctccttctt

SEQ ID NO: 7193346 - DNA, 22 bp, Homo sapiens
ccaggctctatccctccttctt

SEQ ID NO: 7193347 - DNA, 22 bp, Homo sapiens
ccaggctctatccctccttctt

SEQ ID NO: 7193348 - DNA, 22 bp, Homo sapiens
ccaggctctatccctccttctt

SEQ ID NO: 7193349 - DNA, 22 bp, Homo sapiens
ccaggctctatccctccttctt

SEQ ID NO: 7193350 - DNA, 22 bp, Homo sapiens
ccaggctctatccctccttctt

SEQ ID NO: 7193351 - DNA, 22 bp, Homo sapiens
ccaggctctgacatagatggga

SEQ ID NO: 7193352 - DNA, 22 bp, Homo sapiens
aggctccattttcctgcagctg

SEQ ID NO: 7193353 - DNA, 22 bp, Homo sapiens
aggctcccaagcactgacccca

SEQ ID NO: 7193354 - DNA, 22 bp, Homo sapiens
aggctccattcatgtgaaggca

SEQ ID NO: 7193355 - DNA, 22 bp, Homo sapiens
aggctccattccaggagctaga

SEQ ID NO: 7193356 - DNA, 22 bp, Homo sapiens
aggctccattccaggagctaga

SEQ ID NO: 7193357 - DNA, 22 bp, Homo sapiens
aggctccattttcctgcagctg

SEQ ID NO: 7193358 - DNA, 22 bp, Homo sapiens
aggctccatgcaaaggctgttt

SEQ ID NO: 7193359 - DNA, 22 bp, Homo sapiens
aggctccatgcaaaggctgttt

SEQ ID NO: 7193360 - DNA, 22 bp, Homo sapiens
aggctccatgcaaaggctgttt

SEQ ID NO: 7193361 - DNA, 22 bp, Homo sapiens
aggctccataccatctccggag

SEQ ID NO: 7193362 - DNA, 22 bp, Homo sapiens
aggctccatgcaaaggctgttt

SEQ ID NO: 7193363 - DNA, 22 bp, Homo sapiens
aggctccatgcaaaggctgttt

SEQ ID NO: 7193364 - DNA, 22 bp, Homo sapiens
ccaggcctagcccctgagggta

SEQ ID NO: 7193365 - DNA, 22 bp, Homo sapiens
ccaggcctcacctgcccaccta

SEQ ID NO: 7193366 - DNA, 22 bp, Homo sapiens
ccaggcctcacctgcccaccta

SEQ ID NO: 7193367 - DNA, 22 bp, Homo sapiens
ccaggcctcacctgcccaccta

SEQ ID NO: 7193368 - DNA, 22 bp, Homo sapiens
ccaggcctcacctgcccaccta

SEQ ID NO: 7193369 - DNA, 22 bp, Homo sapiens
aggctccacggcaggatgctgt

SEQ ID NO: 7193370 - DNA, 22 bp, Homo sapiens
aggctccacggcaggatgctgt

SEQ ID NO: 7193371 - DNA, 22 bp, Homo sapiens
aggctccacggtcactggctct

SEQ ID NO: 7193372 - DNA, 22 bp, Homo sapiens
aggctccagtctcctctggcag

SEQ ID NO: 7193373 - DNA, 22 bp, Homo sapiens
aggctccagtctcctctggcag

SEQ ID NO: 7193374 - DNA, 22 bp, Homo sapiens
aggctccagtctgaaccttggg

SEQ ID NO: 7193375 - DNA, 22 bp, Homo sapiens
ccaggccctgctcctcacacca

SEQ ID NO: 7193376 - DNA, 22 bp, Homo sapiens
ccaggccctgcctgtggttcct

SEQ ID NO: 7193377 - DNA, 22 bp, Homo sapiens
ccaggccctgcctgtggttcct

SEQ ID NO: 7193378 - DNA, 22 bp, Homo sapiens
ccaggccctgctcctcacacca

SEQ ID NO: 7193379 - DNA, 22 bp, Homo sapiens
ccaggccctgctcctcacacca

SEQ ID NO: 7193380 - DNA, 22 bp, Homo sapiens
ccaggccctgcctgtggttcct

SEQ ID NO: 7193381 - DNA, 22 bp, Homo sapiens
ccaggcccgttcccttctccag

SEQ ID NO: 7193382 - DNA, 22 bp, Homo sapiens
ccaggcccgttcccttctccag

SEQ ID NO: 7193383 - DNA, 22 bp, Homo sapiens
ccaggcccgttcccttctccag

SEQ ID NO: 7193384 - DNA, 22 bp, Homo sapiens
ccaggccagagtgcagtggcac

SEQ ID NO: 7193385 - DNA, 22 bp, Homo sapiens
ccaggcctagcccctgagggta

SEQ ID NO: 7193386 - DNA, 22 bp, Homo sapiens
ccaggcctagcccctgagggta

SEQ ID NO: 7193387 - DNA, 22 bp, Homo sapiens
ccaggcccttgcaagtcccacc

SEQ ID NO: 7193388 - DNA, 22 bp, Homo sapiens
ccaggcctagcccctgagggta

SEQ ID NO: 7193389 - DNA, 22 bp, Homo sapiens
ccaggcctagcccctgagggta

SEQ ID NO: 7193390 - DNA, 22 bp, Homo sapiens
ccaggcctagcccctgagggta

SEQ ID NO: 7193391 - DNA, 22 bp, Homo sapiens
ccaggcccttgcaagtcccacc

SEQ ID NO: 7193392 - DNA, 22 bp, Homo sapiens
ccaggccctgctcctcacacca

SEQ ID NO: 7193393 - DNA, 22 bp, Homo sapiens
ccaggcccttgcaagtcccacc

SEQ ID NO: 7193394 - DNA, 22 bp, Homo sapiens
ccaggcccttgcaagtcccacc

SEQ ID NO: 7193395 - DNA, 22 bp, Homo sapiens
aggcctcagtttgtcatctgta

SEQ ID NO: 7193396 - DNA, 22 bp, Homo sapiens
aggcctcatagtagacctgccc

SEQ ID NO: 7193397 - DNA, 22 bp, Homo sapiens
aggcctcagtttgtcatctgta

SEQ ID NO: 7193398 - DNA, 22 bp, Homo sapiens
aggcctcagtttgtcatctgta

SEQ ID NO: 7193399 - DNA, 22 bp, Homo sapiens
aggcctcagtttgtcatctgta

SEQ ID NO: 7193400 - DNA, 22 bp, Homo sapiens
aggcctccagccacatgccagt

SEQ ID NO: 7193401 - DNA, 22 bp, Homo sapiens
aggcctcatgtcaaagcagcaa

SEQ ID NO: 7193402 - DNA, 22 bp, Homo sapiens
aggcctcatgtcaaagcagcaa

SEQ ID NO: 7193403 - DNA, 17 bp, Homo sapiens
aggcctccctccaggcc

SEQ ID NO: 7193404 - DNA, 21 bp, Homo sapiens
aggcctccctgttgacagggc

SEQ ID NO: 7193405 - DNA, 21 bp, Homo sapiens
aggcctccctgttgacagggc

SEQ ID NO: 7193406 - DNA, 22 bp, Homo sapiens
aggcctcctgcagggatgagtg

SEQ ID NO: 7193407 - DNA, 22 bp, Homo sapiens
aggcctcctgcagggatgagtg

SEQ ID NO: 7193408 - DNA, 22 bp, Homo sapiens
aggcctccagctgagttttgct

SEQ ID NO: 7193409 - DNA, 17 bp, Homo sapiens
aggcctccctccaggcc

SEQ ID NO: 7193410 - DNA, 22 bp, Homo sapiens
aggcctccagccacatgccagt

SEQ ID NO: 7193411 - DNA, 22 bp, Homo sapiens
aggcctccagccacatgccagt

SEQ ID NO: 7193412 - DNA, 22 bp, Homo sapiens
aggcctcagtttccccagttgt

SEQ ID NO: 7193413 - DNA, 22 bp, Homo sapiens
aggcctcagtgatcatcatcag

SEQ ID NO: 7193414 - DNA, 22 bp, Homo sapiens
aggcctcagttcttgccaggtg

SEQ ID NO: 7193415 - DNA, 22 bp, Homo sapiens
aggcctcagttcttgccaggtg

SEQ ID NO: 7193416 - DNA, 22 bp, Homo sapiens
aggcctcagtgatcatcatcag

SEQ ID NO: 7193417 - DNA, 22 bp, Homo sapiens
aggcctcaggaaggtaaagaag

SEQ ID NO: 7193418 - DNA, 22 bp, Homo sapiens
aggcctcagcctgccaggcctg

SEQ ID NO: 7193419 - DNA, 22 bp, Homo sapiens
aggcctcactctcagagcttct

SEQ ID NO: 7193420 - DNA, 22 bp, Homo sapiens
aggcctcactctcagagcttct

SEQ ID NO: 7193421 - DNA, 22 bp, Homo sapiens
aggcctcactctcagagcttct

SEQ ID NO: 7193422 - DNA, 22 bp, Homo sapiens
aggcctcacattgggcttcaag

SEQ ID NO: 7193423 - DNA, 22 bp, Homo sapiens
aggcctcacacaacagatgcat

SEQ ID NO: 7193424 - DNA, 22 bp, Homo sapiens
aggcctcacacaacagatgcat

SEQ ID NO: 7193425 - DNA, 22 bp, Homo sapiens
aggcctagaggaatggccaggg

SEQ ID NO: 7193426 - DNA, 22 bp, Homo sapiens
aggcctagaggaatggccaggg

SEQ ID NO: 7193427 - DNA, 22 bp, Homo sapiens
ccaggcagggctcaaggaacct

SEQ ID NO: 7193428 - DNA, 22 bp, Homo sapiens
ccaggcagggctcaaggaacct

SEQ ID NO: 7193429 - DNA, 22 bp, Homo sapiens
ccaggcacttcatcattagggt

SEQ ID NO: 7193430 - DNA, 22 bp, Homo sapiens
ccaggcagggctcaaggaacct

SEQ ID NO: 7193431 - DNA, 22 bp, Homo sapiens
ccaggcagggctcaaggaacct

SEQ ID NO: 7193432 - DNA, 22 bp, Homo sapiens
ccaggcagggctcaaggaacct

SEQ ID NO: 7193433 - DNA, 23 bp, Homo sapiens
ccaggcagtagctattgaagtga

SEQ ID NO: 7193434 - DNA, 23 bp, Homo sapiens
ccaggcagtagctattgaagtga

SEQ ID NO: 7193435 - DNA, 22 bp, Homo sapiens
ccaggcagtcagggttgtgtgt

SEQ ID NO: 7193436 - DNA, 22 bp, Homo sapiens
ccaggcacttcatcattagggt

SEQ ID NO: 7193437 - DNA, 22 bp, Homo sapiens
aggcctctgagcagcactcatg

SEQ ID NO: 7193438 - DNA, 22 bp, Homo sapiens
aggcctctgagcagcactcatg

SEQ ID NO: 7193439 - DNA, 22 bp, Homo sapiens
aggcctctgagcagcactcatg

SEQ ID NO: 7193440 - DNA, 22 bp, Homo sapiens
aggcctctgagcagcactcatg

SEQ ID NO: 7193441 - DNA, 22 bp, Homo sapiens
aggcctcctggctccaggcctt

SEQ ID NO: 7193442 - DNA, 22 bp, Homo sapiens
aggcctcctgcagggatgagtg

SEQ ID NO: 7193443 - DNA, 22 bp, Homo sapiens
aggcctcctggctccaggcctt

SEQ ID NO: 7193444 - DNA, 22 bp, Homo sapiens
ccaggcagtcagggttgtgtgt

SEQ ID NO: 7193445 - DNA, 22 bp, Homo sapiens
ccaggcagtggaagctaaaatt

SEQ ID NO: 7193446 - DNA, 22 bp, Homo sapiens
ccaggcatccattgcttcctct

SEQ ID NO: 7193447 - DNA, 21 bp, Homo sapiens
ccaggcatgactgcagagagc

SEQ ID NO: 7193448 - DNA, 22 bp, Homo sapiens
ccaggcattgtgagtgggcagg

SEQ ID NO: 7193449 - DNA, 22 bp, Homo sapiens
ccaggccaaattcagtcagcag

SEQ ID NO: 7193450 - DNA, 22 bp, Homo sapiens
ccaggccaaattcagtcagcag

SEQ ID NO: 7193451 - DNA, 22 bp, Homo sapiens
ccaggccaaattcagtcagcag

SEQ ID NO: 7193452 - DNA, 22 bp, Homo sapiens
ccaggccagagtgcagtggcac

SEQ ID NO: 7193453 - DNA, 22 bp, Homo sapiens
agggaggaccaatgtgtggtta

SEQ ID NO: 7193454 - DNA, 22 bp, Homo sapiens
agggaggaccaatgtgtggtta

SEQ ID NO: 7193455 - DNA, 22 bp, Homo sapiens
agggaggaccaatgtgtggtta

SEQ ID NO: 7193456 - DNA, 22 bp, Homo sapiens
agggaggaccaatgtgtggtta

SEQ ID NO: 7193457 - DNA, 22 bp, Homo sapiens
agggaggagaatggactccttc

SEQ ID NO: 7193458 - DNA, 22 bp, Homo sapiens
agggaggagaatggactccttc

SEQ ID NO: 7193459 - DNA, 22 bp, Homo sapiens
agggaggagaatggactccttc

SEQ ID NO: 7193460 - DNA, 22 bp, Homo sapiens
agggaggaaggatgttccaaag

SEQ ID NO: 7193461 - DNA, 22 bp, Homo sapiens
agggaggaaggatgttccaaag

SEQ ID NO: 7193462 - DNA, 22 bp, Homo sapiens
agggaggaaggatgttccaaag

SEQ ID NO: 7193463 - DNA, 22 bp, Homo sapiens
agggaggaccaatgtgtggtta

SEQ ID NO: 7193464 - DNA, 22 bp, Homo sapiens
agggaggaccaatgtgtggtta

SEQ ID NO: 7193465 - DNA, 22 bp, Homo sapiens
agggaggaccaatgtgtggtta

SEQ ID NO: 7193466 - DNA, 22 bp, Homo sapiens
agggaggaccaatgtgtggtta

SEQ ID NO: 7193467 - DNA, 22 bp, Homo sapiens
agggaggagtcctcaaagtcat

SEQ ID NO: 7193468 - DNA, 22 bp, Homo sapiens
agggcagagggtgcctcacctg

SEQ ID NO: 7193469 - DNA, 22 bp, Homo sapiens
agggcagagggtgcctcacctg

SEQ ID NO: 7193470 - DNA, 22 bp, Homo sapiens
agggcagagggtgcctcacctg

SEQ ID NO: 7193471 - DNA, 22 bp, Homo sapiens
agggaggagaatggactccttc

SEQ ID NO: 7193472 - DNA, 22 bp, Homo sapiens
agggaggagaatggactccttc

SEQ ID NO: 7193473 - DNA, 22 bp, Homo sapiens
agggaggagaatggactccttc

SEQ ID NO: 7193474 - DNA, 22 bp, Homo sapiens
agggaggagtcctcaaagtcat

SEQ ID NO: 7193475 - DNA, 22 bp, Homo sapiens
agggcagatggaacttccccga

SEQ ID NO: 7193476 - DNA, 22 bp, Homo sapiens
agggcagcagctcctcctagct

SEQ ID NO: 7193477 - DNA, 22 bp, Homo sapiens
agggcagcagctcctcctagct

SEQ ID NO: 7193478 - DNA, 22 bp, Homo sapiens
agggcagcagctgtccctgaga

SEQ ID NO: 7193479 - DNA, 22 bp, Homo sapiens
agggcagcagctgtccctgaga

SEQ ID NO: 7193480 - DNA, 22 bp, Homo sapiens
agggcagcattgcctttctcca

SEQ ID NO: 7193481 - DNA, 22 bp, Homo sapiens
agggcagcattgcctttctcca

SEQ ID NO: 7193482 - DNA, 22 bp, Homo sapiens
agggcagccatgagccttcagg

SEQ ID NO: 7193483 - DNA, 22 bp, Homo sapiens
agggcagccatgagccttcagg

SEQ ID NO: 7193484 - DNA, 22 bp, Homo sapiens
agggcagccatgagccttcagg

SEQ ID NO: 7193485 - DNA, 22 bp, Homo sapiens
agggcagccatgagccttcagg

SEQ ID NO: 7193486 - DNA, 22 bp, Homo sapiens
agggcagccatgagccttcagg

SEQ ID NO: 7193487 - DNA, 22 bp, Homo sapiens
agggcagccatgagccttcagg

SEQ ID NO: 7193488 - DNA, 22 bp, Homo sapiens
agggcagccattgagggattct

SEQ ID NO: 7193489 - DNA, 22 bp, Homo sapiens
agggcagccattgagggattct

SEQ ID NO: 7193490 - DNA, 22 bp, Homo sapiens
agggcagccattgagggattct

SEQ ID NO: 7193491 - DNA, 22 bp, Homo sapiens
agggcagccattgagggattct

SEQ ID NO: 7193492 - DNA, 22 bp, Homo sapiens
agggcagcccttctgggagggc

SEQ ID NO: 7193493 - DNA, 22 bp, Homo sapiens
agggcagcccttctgggagggc

SEQ ID NO: 7193494 - DNA, 22 bp, Homo sapiens
agggcagcccttctgggagggc

SEQ ID NO: 7193495 - DNA, 22 bp, Homo sapiens
agggcagcccttctgggagggc

SEQ ID NO: 7193496 - DNA, 22 bp, Homo sapiens
agggcagctagctgtagaaaga

SEQ ID NO: 7193497 - DNA, 22 bp, Homo sapiens
agggcagctctcacctctggcc

SEQ ID NO: 7193498 - DNA, 22 bp, Homo sapiens
agggcagctctcacctctggcc

SEQ ID NO: 7193499 - DNA, 22 bp, Homo sapiens
agggcagcctgagtgctggccc

SEQ ID NO: 7193500 - DNA, 22 bp, Homo sapiens
agggcagcggtgcttgtgttat

SEQ ID NO: 7193501 - DNA, 22 bp, Homo sapiens
agggcagctaaggtgctgactg

SEQ ID NO: 7193502 - DNA, 22 bp, Homo sapiens
agggcagctaaggtgctgactg

SEQ ID NO: 7193503 - DNA, 22 bp, Homo sapiens
agggcagcctgagtgctggccc

SEQ ID NO: 7193504 - DNA, 22 bp, Homo sapiens
agggcagcctgagtgctggccc

SEQ ID NO: 7193505 - DNA, 22 bp, Homo sapiens
agggcagcctgagtgctggccc

SEQ ID NO: 7193506 - DNA, 22 bp, Homo sapiens
agggcagcctctcagcctaggt

SEQ ID NO: 7193507 - DNA, 22 bp, Homo sapiens
agggcagcctctcagcctaggt

SEQ ID NO: 7193508 - DNA, 22 bp, Homo sapiens
agggcagcccttctgggagggc

SEQ ID NO: 7193509 - DNA, 22 bp, Homo sapiens
agggcagcctctcagcctaggt

SEQ ID NO: 7193510 - DNA, 22 bp, Homo sapiens
agggcagcctctcagcctaggt

SEQ ID NO: 7193511 - DNA, 22 bp, Homo sapiens
agggcagcctctcagcctaggt

SEQ ID NO: 7193512 - DNA, 22 bp, Homo sapiens
agggcagctgtgagccactgtg

SEQ ID NO: 7193513 - DNA, 22 bp, Homo sapiens
agggcagctgtgagccactgtg

SEQ ID NO: 7193514 - DNA, 22 bp, Homo sapiens
agggcagctgtgagccactgtg

SEQ ID NO: 7193515 - DNA, 22 bp, Homo sapiens
agggcagctctcacctctggcc

SEQ ID NO: 7193516 - DNA, 22 bp, Homo sapiens
agggcagctctcacctctggcc

SEQ ID NO: 7193517 - DNA, 22 bp, Homo sapiens
agggcagctggaaggtggcttc

SEQ ID NO: 7193518 - DNA, 21 bp, Homo sapiens
agggccagatcaccaaggagc

SEQ ID NO: 7193519 - DNA, 21 bp, Homo sapiens
agggccagatcaccaaggagc

SEQ ID NO: 7193520 - DNA, 22 bp, Homo sapiens
agggccagagtggcaaaagcct

SEQ ID NO: 7193521 - DNA, 22 bp, Homo sapiens
agggccagagtctgtgtagata

SEQ ID NO: 7193522 - DNA, 22 bp, Homo sapiens
agggccagagtctgtgtagata

SEQ ID NO: 7193523 - DNA, 22 bp, Homo sapiens
agggccagagtctgtgtagata

SEQ ID NO: 7193524 - DNA, 22 bp, Homo sapiens
agggccagagtctgtgtagata

SEQ ID NO: 7193525 - DNA, 21 bp, Homo sapiens
agggccagatcaccaaggagc

SEQ ID NO: 7193526 - DNA, 22 bp, Homo sapiens
agggccagccccaccctctctg

SEQ ID NO: 7193527 - DNA, 22 bp, Homo sapiens
agggccagccccaccctctctg

SEQ ID NO: 7193528 - DNA, 22 bp, Homo sapiens
ccctggcccctcactccgaggc

SEQ ID NO: 7193529 - DNA, 21 bp, Homo sapiens
ccctgggatgggcttggactt

SEQ ID NO: 7193530 - DNA, 21 bp, Homo sapiens
ccctgggatgggcttggactt

SEQ ID NO: 7193531 - DNA, 22 bp, Homo sapiens
ccctgggattcaatttcactct

SEQ ID NO: 7193532 - DNA, 22 bp, Homo sapiens
ccctggcccctcactccgaggc

SEQ ID NO: 7193533 - DNA, 22 bp, Homo sapiens
ccctggcccctcactccgaggc

SEQ ID NO: 7193534 - DNA, 22 bp, Homo sapiens
agggccagggaagctgtatttt

SEQ ID NO: 7193535 - DNA, 22 bp, Homo sapiens
agggccagggaagctgtatttt

SEQ ID NO: 7193536 - DNA, 22 bp, Homo sapiens
agggccagggaagctgtatttt

SEQ ID NO: 7193537 - DNA, 22 bp, Homo sapiens
ccctggcccctcactccgaggc

SEQ ID NO: 7193538 - DNA, 22 bp, Homo sapiens
agggccaggctcccatgtcagg

SEQ ID NO: 7193539 - DNA, 22 bp, Homo sapiens
agggccaggctcccatgtcagg

SEQ ID NO: 7193540 - DNA, 22 bp, Homo sapiens
agggccaggctcccatgtcagg

SEQ ID NO: 7193541 - DNA, 22 bp, Homo sapiens
agggccaggctcccatgtcagg

SEQ ID NO: 7193542 - DNA, 22 bp, Homo sapiens
agggccagggaaacgatcagca

SEQ ID NO: 7193543 - DNA, 22 bp, Homo sapiens
agggccagggaaacgatcagca

SEQ ID NO: 7193544 - DNA, 22 bp, Homo sapiens
agggccagggaaacgatcagca

SEQ ID NO: 7193545 - DNA, 22 bp, Homo sapiens
agggccagggaaacgatcagca

SEQ ID NO: 7193546 - DNA, 22 bp, Homo sapiens
ccctgggctcagagcaggtagc

SEQ ID NO: 7193547 - DNA, 22 bp, Homo sapiens
ccctggggagcaggcgaaggag

SEQ ID NO: 7193548 - DNA, 22 bp, Homo sapiens
ccctggggagcaggcgaaggag

SEQ ID NO: 7193549 - DNA, 22 bp, Homo sapiens
ccctggggctgagggatggccg

SEQ ID NO: 7193550 - DNA, 22 bp, Homo sapiens
ccctggggctgagggatggccg

SEQ ID NO: 7193551 - DNA, 22 bp, Homo sapiens
ccctggggagcaggcgaaggag

SEQ ID NO: 7193552 - DNA, 22 bp, Homo sapiens
ccctggggagcaggcgaaggag

SEQ ID NO: 7193553 - DNA, 22 bp, Homo sapiens
ccctggggagcaggcgaaggag

SEQ ID NO: 7193554 - DNA, 22 bp, Homo sapiens
ccctggggagcaggcgaaggag

SEQ ID NO: 7193555 - DNA, 22 bp, Homo sapiens
ccctgggcagtctgcacttcag

SEQ ID NO: 7193556 - DNA, 22 bp, Homo sapiens
ccctgggcaccaggcctggtaa

SEQ ID NO: 7193557 - DNA, 22 bp, Homo sapiens
ccctgggattgccttggccttg

SEQ ID NO: 7193558 - DNA, 22 bp, Homo sapiens
ccctgggattgccttggccttg

SEQ ID NO: 7193559 - DNA, 22 bp, Homo sapiens
agggccagctgcagaattagca

SEQ ID NO: 7193560 - DNA, 22 bp, Homo sapiens
agggccagctgcagaattagca

SEQ ID NO: 7193561 - DNA, 22 bp, Homo sapiens
agggccagctgcagaattagca

SEQ ID NO: 7193562 - DNA, 22 bp, Homo sapiens
agggccagctgcagaattagca

SEQ ID NO: 7193563 - DNA, 22 bp, Homo sapiens
agggccagctgatgagaatgag

SEQ ID NO: 7193564 - DNA, 22 bp, Homo sapiens
agggccagctgatgagaatgag

SEQ ID NO: 7193565 - DNA, 22 bp, Homo sapiens
agggccagctgatgagaatgag

SEQ ID NO: 7193566 - DNA, 22 bp, Homo sapiens
agggccagctgatgagaatgag

SEQ ID NO: 7193567 - DNA, 22 bp, Homo sapiens
agggccagctgatgagaatgag

SEQ ID NO: 7193568 - DNA, 22 bp, Homo sapiens
agggccagctgatgagaatgag

SEQ ID NO: 7193569 - DNA, 22 bp, Homo sapiens
agggccagctgatgagaatgag

SEQ ID NO: 7193570 - DNA, 22 bp, Homo sapiens
agggccagctgatgagaatgag

SEQ ID NO: 7193571 - DNA, 22 bp, Homo sapiens
agggccagccgacttccagcct

SEQ ID NO: 7193572 - DNA, 22 bp, Homo sapiens
agggccagccgacttccagcct

SEQ ID NO: 7193573 - DNA, 22 bp, Homo sapiens
agggccagccgacttccagcct

SEQ ID NO: 7193574 - DNA, 22 bp, Homo sapiens
agggccagccgacttccagcct

SEQ ID NO: 7193575 - DNA, 22 bp, Homo sapiens
agggccagctagagccctcgcc

SEQ ID NO: 7193576 - DNA, 22 bp, Homo sapiens
agggccagctagagccctcgcc

SEQ ID NO: 7193577 - DNA, 22 bp, Homo sapiens
agggccagctagagccctcgcc

SEQ ID NO: 7193578 - DNA, 22 bp, Homo sapiens
agggccagctagagccctcgcc

SEQ ID NO: 7193579 - DNA, 22 bp, Homo sapiens
agggccaggaacacctgaaggg

SEQ ID NO: 7193580 - DNA, 18 bp, Homo sapiens
agggccagctgtgagtag

SEQ ID NO: 7193581 - DNA, 18 bp, Homo sapiens
agggccagctgtgagtag

SEQ ID NO: 7193582 - DNA, 22 bp, Homo sapiens
agggccaggaacacctgaaggg

SEQ ID NO: 7193583 - DNA, 22 bp, Homo sapiens
agggccaggaacacctgaaggg

SEQ ID NO: 7193584 - DNA, 22 bp, Homo sapiens
agggccaggaacacctgaaggg

SEQ ID NO: 7193585 - DNA, 22 bp, Homo sapiens
agggccaggaacacctgaaggg

SEQ ID NO: 7193586 - DNA, 22 bp, Homo sapiens
agggccaggctcccatgtcagg

SEQ ID NO: 7193587 - DNA, 19 bp, Homo sapiens
agggccaggattctggaac

SEQ ID NO: 7193588 - DNA, 22 bp, Homo sapiens
agggccaggatcacagccaaga

SEQ ID NO: 7193589 - DNA, 22 bp, Homo sapiens
agggccaggatcacagccaaga

SEQ ID NO: 7193590 - DNA, 19 bp, Homo sapiens
agggccaggattctggaac

SEQ ID NO: 7193591 - DNA, 22 bp, Homo sapiens
agggccaggaacacctgaaggg

SEQ ID NO: 7193592 - DNA, 22 bp, Homo sapiens
agggccaggaacacctgaaggg

SEQ ID NO: 7193593 - DNA, 22 bp, Homo sapiens
ccctgttaatgtcaacctgcct

SEQ ID NO: 7193594 - DNA, 21 bp, Homo sapiens
ccctgtgttccacagcagaca

SEQ ID NO: 7193595 - DNA, 22 bp, Homo sapiens
ccctgttttaagttgatattga

SEQ ID NO: 7193596 - DNA, 22 bp, Homo sapiens
cccttaaaggctttgcctctct

SEQ ID NO: 7193597 - DNA, 22 bp, Homo sapiens
cccttagccaggaaatcgacct

SEQ ID NO: 7193598 - DNA, 18 bp, Homo sapiens
cccttagcctttcctctc

SEQ ID NO: 7193599 - DNA, 22 bp, Homo sapiens
ccctgtggttgctagggcacag

SEQ ID NO: 7193600 - DNA, 22 bp, Homo sapiens
ccctggggctgagggatggccg

SEQ ID NO: 7193601 - DNA, 22 bp, Homo sapiens
ccctggggctgagggatggccg

SEQ ID NO: 7193602 - DNA, 22 bp, Homo sapiens
ccctggggctgagggatggccg

SEQ ID NO: 7193603 - DNA, 22 bp, Homo sapiens
ccctggggctgagggatggccg

SEQ ID NO: 7193604 - DNA, 19 bp, Homo sapiens
ccctgggggtttctggtac

SEQ ID NO: 7193605 - DNA, 19 bp, Homo sapiens
ccctgggggtttctggtac

SEQ ID NO: 7193606 - DNA, 19 bp, Homo sapiens
ccctgggggtttctggtac

SEQ ID NO: 7193607 - DNA, 20 bp, Homo sapiens
cctcaaataagtgccagcat

SEQ ID NO: 7193608 - DNA, 22 bp, Homo sapiens
cctcaaataagttttatttatc

SEQ ID NO: 7193609 - DNA, 22 bp, Homo sapiens
cctcaaataagttttatttatc

SEQ ID NO: 7193610 - DNA, 22 bp, Homo sapiens
cctagactagaggcagggagcc

SEQ ID NO: 7193611 - DNA, 22 bp, Homo sapiens
cctcaaagcggtatgcagacgg

SEQ ID NO: 7193612 - DNA, 22 bp, Homo sapiens
cctcaaagcggtatgcagacgg

SEQ ID NO: 7193613 - DNA, 22 bp, Homo sapiens
cctagaatgtgcagacttaggg

SEQ ID NO: 7193614 - DNA, 22 bp, Homo sapiens
cctagaattataaacttattag

SEQ ID NO: 7193615 - DNA, 22 bp, Homo sapiens
cccttagctccaaggggtttgg

SEQ ID NO: 7193616 - DNA, 22 bp, Homo sapiens
cccttagctggtgagcccagcg

SEQ ID NO: 7193617 - DNA, 22 bp, Homo sapiens
cccttagctcaatttcttgccc

SEQ ID NO: 7193618 - DNA, 22 bp, Homo sapiens
cccttagctcacaagctaaagc

SEQ ID NO: 7193619 - DNA, 22 bp, Homo sapiens
cccttagctcacaagctaaagc

SEQ ID NO: 7193620 - DNA, 23 bp, Homo sapiens
cccttcagcgagggcattaaggt

SEQ ID NO: 7193621 - DNA, 23 bp, Homo sapiens
cccttcagcgagggcattaaggt

SEQ ID NO: 7193622 - DNA, 22 bp, Homo sapiens
cccttcagctgagtgggacagc

SEQ ID NO: 7193623 - DNA, 22 bp, Homo sapiens
cccttcagctgagtgggacagc

SEQ ID NO: 7193624 - DNA, 22 bp, Homo sapiens
cccttcagggttaagtagaggg

SEQ ID NO: 7193625 - DNA, 22 bp, Homo sapiens
cccttcagggttaagtagaggg

SEQ ID NO: 7193626 - DNA, 22 bp, Homo sapiens
cccttcagggttaagtagaggg

SEQ ID NO: 7193627 - DNA, 22 bp, Homo sapiens
cctcagagacagtaactggaat

SEQ ID NO: 7193628 - DNA, 21 bp, Homo sapiens
cctcagagacagatacgggtg

SEQ ID NO: 7193629 - DNA, 22 bp, Homo sapiens
cctcagagaaatgtctattcaa

SEQ ID NO: 7193630 - DNA, 22 bp, Homo sapiens
cctcagagaaaggtatggctga

SEQ ID NO: 7193631 - DNA, 22 bp, Homo sapiens
cctcagagaaaggtatggctga

SEQ ID NO: 7193632 - DNA, 22 bp, Homo sapiens
cctcagacccctgctgagcttc

SEQ ID NO: 7193633 - DNA, 22 bp, Homo sapiens
cctcagacccctgctgagcttc

SEQ ID NO: 7193634 - DNA, 22 bp, Homo sapiens
cctcagaccttgctagtagtct

SEQ ID NO: 7193635 - DNA, 21 bp, Homo sapiens
cctcagagacagatacgggtg

SEQ ID NO: 7193636 - DNA, 22 bp, Homo sapiens
cctcagagactgcatcttccct

SEQ ID NO: 7193637 - DNA, 22 bp, Homo sapiens
cctcagagactgcatcttccct

SEQ ID NO: 7193638 - DNA, 23 bp, Homo sapiens
cctcagagaggcagagccacatg

SEQ ID NO: 7193639 - DNA, 22 bp, Homo sapiens
cctcagagcagcacccagatga

SEQ ID NO: 7193640 - DNA, 22 bp, Homo sapiens
cctcagagccatgcctgagttc

SEQ ID NO: 7193641 - DNA, 22 bp, Homo sapiens
cctcagagcctccagaaggaat

SEQ ID NO: 7193642 - DNA, 22 bp, Homo sapiens
cctcagagcctccagaaggaat

SEQ ID NO: 7193643 - DNA, 22 bp, Homo sapiens
cctcagagcctccagaaggaat

SEQ ID NO: 7193644 - DNA, 20 bp, Homo sapiens
cctcagagcgcaggccccct

SEQ ID NO: 7193645 - DNA, 21 bp, Homo sapiens
cctcagtctccctgctccact

SEQ ID NO: 7193646 - DNA, 22 bp, Homo sapiens
cctcagacacagtcaagctttt

SEQ ID NO: 7193647 - DNA, 18 bp, Homo sapiens
cctcacagacttccatgt

SEQ ID NO: 7193648 - DNA, 22 bp, Homo sapiens
cctcacacagttatctcttcat

SEQ ID NO: 7193649 - DNA, 22 bp, Homo sapiens
cctcaagtcaattctgtctcgc

SEQ ID NO: 7193650 - DNA, 22 bp, Homo sapiens
cctcaagtcaattctgtctcgc

SEQ ID NO: 7193651 - DNA, 21 bp, Homo sapiens
cctcaagtgcctcctgctgct

SEQ ID NO: 7193652 - DNA, 22 bp, Homo sapiens
cctcaagtcattccggagacct

SEQ ID NO: 7193653 - DNA, 22 bp, Homo sapiens
cctcaagttggaaataaaatgt

SEQ ID NO: 7193654 - DNA, 22 bp, Homo sapiens
cctcaaatagcccccagtctag

SEQ ID NO: 7193655 - DNA, 22 bp, Homo sapiens
cctcaaatctttagagttattt

SEQ ID NO: 7193656 - DNA, 23 bp, Homo sapiens
cctcaaatgtagcctttttccca

SEQ ID NO: 7193657 - DNA, 22 bp, Homo sapiens
cctcaaattgctcagcgtctag

SEQ ID NO: 7193658 - DNA, 22 bp, Homo sapiens
cctcaaattggcattaattaag

SEQ ID NO: 7193659 - DNA, 22 bp, Homo sapiens
cctcaaattggcattaattaag

SEQ ID NO: 7193660 - DNA, 22 bp, Homo sapiens
cctcaaattgtcaaataagaat

SEQ ID NO: 7193661 - DNA, 22 bp, Homo sapiens
cctcaagatgcactgaacatat

SEQ ID NO: 7193662 - DNA, 22 bp, Homo sapiens
cctctctccaagggaaatccta

SEQ ID NO: 7193663 - DNA, 22 bp, Homo sapiens
cctctctccaagggaaatccta

SEQ ID NO: 7193664 - DNA, 21 bp, Homo sapiens
cctctctcattgtaatgaagt

SEQ ID NO: 7193665 - DNA, 21 bp, Homo sapiens
cctctctcattgtaatgaagt

SEQ ID NO: 7193666 - DNA, 22 bp, Homo sapiens
cctctctccaattttcacctca

SEQ ID NO: 7193667 - DNA, 22 bp, Homo sapiens
cctctctccaattttcacctca

SEQ ID NO: 7193668 - DNA, 22 bp, Homo sapiens
cctctctccaattttcacctca

SEQ ID NO: 7193669 - DNA, 22 bp, Homo sapiens
cctctctcagcttgctgcaact

SEQ ID NO: 7193670 - DNA, 22 bp, Homo sapiens
cctctctcagcttgctgcaact

SEQ ID NO: 7193671 - DNA, 22 bp, Homo sapiens
cctctctcagcttgctgcaact

SEQ ID NO: 7193672 - DNA, 22 bp, Homo sapiens
cctctccttgcacccgtcccgc

SEQ ID NO: 7193673 - DNA, 22 bp, Homo sapiens
cctctccttgcacccgtcccgc

SEQ ID NO: 7193674 - DNA, 22 bp, Homo sapiens
cctctcggcagcccatcttgtc

SEQ ID NO: 7193675 - DNA, 22 bp, Homo sapiens
cctctccttgcacccgtcccgc

SEQ ID NO: 7193676 - DNA, 22 bp, Homo sapiens
cctctccttgcacccgtcccgc

SEQ ID NO: 7193677 - DNA, 22 bp, Homo sapiens
cctctccttgcacccgtcccgc

SEQ ID NO: 7193678 - DNA, 22 bp, Homo sapiens
cctctccttgcacccgtcccgc

SEQ ID NO: 7193679 - DNA, 22 bp, Homo sapiens
cctctccttgcacccgtcccgc

SEQ ID NO: 7193680 - DNA, 22 bp, Homo sapiens
cctccccacccacggctggtgg

SEQ ID NO: 7193681 - DNA, 22 bp, Homo sapiens
cctccccacgggcagccggcgc

SEQ ID NO: 7193682 - DNA, 22 bp, Homo sapiens
cctccccacaggccaaataggc

SEQ ID NO: 7193683 - DNA, 23 bp, Homo sapiens
cctccccaccagactctaacata

SEQ ID NO: 7193684 - DNA, 23 bp, Homo sapiens
cctccccaccagactctaacata

SEQ ID NO: 7193685 - DNA, 22 bp, Homo sapiens
cctccccacagcccaggagact

SEQ ID NO: 7193686 - DNA, 22 bp, Homo sapiens
cctccccacagcccaggagact

SEQ ID NO: 7193687 - DNA, 22 bp, Homo sapiens
cctcccagtgcctccagagcag

SEQ ID NO: 7193688 - DNA, 22 bp, Homo sapiens
cctcccagtgccggggccggct

SEQ ID NO: 7193689 - DNA, 22 bp, Homo sapiens
cctcccagtgcctccagagcag

SEQ ID NO: 7193690 - DNA, 22 bp, Homo sapiens
cctcccatccctgcaagagagc

SEQ ID NO: 7193691 - DNA, 22 bp, Homo sapiens
cctcccagtgccggggccggct

SEQ ID NO: 7193692 - DNA, 22 bp, Homo sapiens
cctccaggctgaatatctagaa

SEQ ID NO: 7193693 - DNA, 22 bp, Homo sapiens
cctccaggctggttatcagctg

SEQ ID NO: 7193694 - DNA, 22 bp, Homo sapiens
cctccaggctggttatcagctg

SEQ ID NO: 7193695 - DNA, 23 bp, Homo sapiens
cctcccaggctgcgagtcccgag

SEQ ID NO: 7193696 - DNA, 23 bp, Homo sapiens
cctcccaggctgcgagtcccgag

SEQ ID NO: 7193697 - DNA, 22 bp, Homo sapiens
cctccaggccttgcaggttaac

SEQ ID NO: 7193698 - DNA, 22 bp, Homo sapiens
cctccaggccttgcaggttaac

SEQ ID NO: 7193699 - DNA, 22 bp, Homo sapiens
cctccaggccttgcaggttaac

SEQ ID NO: 7193700 - DNA, 22 bp, Homo sapiens
cctccaggctgaatatctagaa

SEQ ID NO: 7193701 - DNA, 22 bp, Homo sapiens
cctccaggctgaatatctagaa

SEQ ID NO: 7193702 - DNA, 22 bp, Homo sapiens
cctccaggctgaatatctagaa

SEQ ID NO: 7193703 - DNA, 22 bp, Homo sapiens
cctccaggataagtcagggcct

SEQ ID NO: 7193704 - DNA, 22 bp, Homo sapiens
cctccaggataagtcagggcct

SEQ ID NO: 7193705 - DNA, 22 bp, Homo sapiens
cctccaggataagtcagggcct

SEQ ID NO: 7193706 - DNA, 22 bp, Homo sapiens
cctccaggataagtcagggcct

SEQ ID NO: 7193707 - DNA, 20 bp, Homo sapiens
cctccaggcacacccatgtg

SEQ ID NO: 7193708 - DNA, 20 bp, Homo sapiens
cctccaggcacacccatgtg

SEQ ID NO: 7193709 - DNA, 22 bp, Homo sapiens
cctccagctgcctcagtctctt

SEQ ID NO: 7193710 - DNA, 22 bp, Homo sapiens
cctccaggaacttgagagacac

SEQ ID NO: 7193711 - DNA, 22 bp, Homo sapiens
cctccaggaacttgagagacac

SEQ ID NO: 7193712 - DNA, 22 bp, Homo sapiens
cctccaggaacttgagagacac

SEQ ID NO: 7193713 - DNA, 22 bp, Homo sapiens
cctccaggaacttgagagacac

SEQ ID NO: 7193714 - DNA, 22 bp, Homo sapiens
cctcagtcttgaattagccaga

SEQ ID NO: 7193715 - DNA, 22 bp, Homo sapiens
cctcagtgacctattgcattca

SEQ ID NO: 7193716 - DNA, 22 bp, Homo sapiens
cctccagctgcctcagtctctt

SEQ ID NO: 7193717 - DNA, 21 bp, Homo sapiens
cctccaggagcagagccctga

SEQ ID NO: 7193718 - DNA, 21 bp, Homo sapiens
cctccaggagcagagccctga

SEQ ID NO: 7193719 - DNA, 21 bp, Homo sapiens
cctccaggagcagagccctga

SEQ ID NO: 7193720 - DNA, 21 bp, Homo sapiens
cctccaggagcagagccctga

SEQ ID NO: 7193721 - DNA, 22 bp, Homo sapiens
cctccaggataagtcagggcct

SEQ ID NO: 7193722 - DNA, 22 bp, Homo sapiens
cctccaggataagtcagggcct

SEQ ID NO: 7193723 - DNA, 22 bp, Homo sapiens
agggagcatgggtgaagcaggc

SEQ ID NO: 7193724 - DNA, 22 bp, Homo sapiens
agggagcatgggtgaagcaggc

SEQ ID NO: 7193725 - DNA, 22 bp, Homo sapiens
agggagcatgggtgaagcaggc

SEQ ID NO: 7193726 - DNA, 22 bp, Homo sapiens
agggagcatgggtgaagcaggc

SEQ ID NO: 7193727 - DNA, 22 bp, Homo sapiens
agggagcatgggtgaagcaggc

SEQ ID NO: 7193728 - DNA, 22 bp, Homo sapiens
agggagccagagttgggagctc

SEQ ID NO: 7193729 - DNA, 21 bp, Homo sapiens
agggagcatgttagctttcga

SEQ ID NO: 7193730 - DNA, 22 bp, Homo sapiens
agggagcattgtgacatatcac

SEQ ID NO: 7193731 - DNA, 22 bp, Homo sapiens
agggagcatgggtgaagcaggc

SEQ ID NO: 7193732 - DNA, 22 bp, Homo sapiens
agggagcatgggtgaagcaggc

SEQ ID NO: 7193733 - DNA, 22 bp, Homo sapiens
agggagccaggggccagctatt

SEQ ID NO: 7193734 - DNA, 22 bp, Homo sapiens
agggagccaggggccagctatt

SEQ ID NO: 7193735 - DNA, 22 bp, Homo sapiens
agggagccctgaaccagagggt

SEQ ID NO: 7193736 - DNA, 22 bp, Homo sapiens
agggagccctgaaccagagggt

SEQ ID NO: 7193737 - DNA, 22 bp, Homo sapiens
agggagccagagttgggagctc

SEQ ID NO: 7193738 - DNA, 22 bp, Homo sapiens
agggagccagagttgggagctc

SEQ ID NO: 7193739 - DNA, 22 bp, Homo sapiens
agggagccagagttgggagctc

SEQ ID NO: 7193740 - DNA, 22 bp, Homo sapiens
agggagccagagttgggagctc

SEQ ID NO: 7193741 - DNA, 22 bp, Homo sapiens
agggagccaggaacgcaggtcg

SEQ ID NO: 7193742 - DNA, 22 bp, Homo sapiens
agggagccaggaacgcaggtcg

SEQ ID NO: 7193743 - DNA, 22 bp, Homo sapiens
agggagcatgggtgaagcaggc

SEQ ID NO: 7193744 - DNA, 18 bp, Homo sapiens
agggagcatctggttgcc

SEQ ID NO: 7193745 - DNA, 18 bp, Homo sapiens
agggagcatctggttgcc

SEQ ID NO: 7193746 - DNA, 22 bp, Homo sapiens
agggagcagggctcctttgggt

SEQ ID NO: 7193747 - DNA, 22 bp, Homo sapiens
agggagcagcagccacaggatg

SEQ ID NO: 7193748 - DNA, 22 bp, Homo sapiens
agggagcagcagccacaggatg

SEQ ID NO: 7193749 - DNA, 22 bp, Homo sapiens
agggagcagcagccacaggatg

SEQ ID NO: 7193750 - DNA, 22 bp, Homo sapiens
agggagcagcagccacaggatg

SEQ ID NO: 7193751 - DNA, 22 bp, Homo sapiens
agggagcagcagccacaggatg

SEQ ID NO: 7193752 - DNA, 22 bp, Homo sapiens
agggagcaaaggtttcagggtt

SEQ ID NO: 7193753 - DNA, 22 bp, Homo sapiens
agggagcagcagccacaggatg

SEQ ID NO: 7193754 - DNA, 22 bp, Homo sapiens
agggagagtttgatgtttcctc

SEQ ID NO: 7193755 - DNA, 22 bp, Homo sapiens
agggagatcgaccgtgttatat

SEQ ID NO: 7193756 - DNA, 23 bp, Homo sapiens
agggagatgccacaaagatgccc

SEQ ID NO: 7193757 - DNA, 22 bp, Homo sapiens
agggagcaaaggtttcagggtt

SEQ ID NO: 7193758 - DNA, 22 bp, Homo sapiens
agggagagtagatatcaggtgt

SEQ ID NO: 7193759 - DNA, 22 bp, Homo sapiens
agggagagtagatatcaggtgt

SEQ ID NO: 7193760 - DNA, 22 bp, Homo sapiens
agggagagtttgatgtttcctc

SEQ ID NO: 7193761 - DNA, 22 bp, Homo sapiens
agggagagtttgatgtttcctc

SEQ ID NO: 7193762 - DNA, 19 bp, Homo sapiens
ccccagggtaggctagggg

SEQ ID NO: 7193763 - DNA, 19 bp, Homo sapiens
ccccagggtaggctagggg

SEQ ID NO: 7193764 - DNA, 19 bp, Homo sapiens
ccccagggtaggctagggg

SEQ ID NO: 7193765 - DNA, 19 bp, Homo sapiens
ccccagggtaggctagggg

SEQ ID NO: 7193766 - DNA, 22 bp, Homo sapiens
ccccagggactggtttcatgga

SEQ ID NO: 7193767 - DNA, 22 bp, Homo sapiens
ccccagggactggtttcatgga

SEQ ID NO: 7193768 - DNA, 22 bp, Homo sapiens
ccccagggactggtttcatgga

SEQ ID NO: 7193769 - DNA, 22 bp, Homo sapiens
ccccagggaagctttgcttact

SEQ ID NO: 7193770 - DNA, 22 bp, Homo sapiens
ccccagcagactcagggcaggt

SEQ ID NO: 7193771 - DNA, 22 bp, Homo sapiens
ccccagcagactcagggcaggt

SEQ ID NO: 7193772 - DNA, 22 bp, Homo sapiens
ccccagggtcagtgtgtggagg

SEQ ID NO: 7193773 - DNA, 22 bp, Homo sapiens
ccccagggtcagtgtgtggagg

SEQ ID NO: 7193774 - DNA, 19 bp, Homo sapiens
ccccagggtaggctagggg

SEQ ID NO: 7193775 - DNA, 22 bp, Homo sapiens
ccccagggtcagtgtgtggagg

SEQ ID NO: 7193776 - DNA, 22 bp, Homo sapiens
ccccattctggccagcccagct

SEQ ID NO: 7193777 - DNA, 22 bp, Homo sapiens
agggagctttcaggtagcttaa

SEQ ID NO: 7193778 - DNA, 22 bp, Homo sapiens
agggagctttttcatgtgtcta

SEQ ID NO: 7193779 - DNA, 22 bp, Homo sapiens
agggagctttttcatgtgtcta

SEQ ID NO: 7193780 - DNA, 22 bp, Homo sapiens
agggagctttttcatgtgtcta

SEQ ID NO: 7193781 - DNA, 22 bp, Homo sapiens
agggaggaaggaactccttcta

SEQ ID NO: 7193782 - DNA, 22 bp, Homo sapiens
agggaggaaggaactccttcta

SEQ ID NO: 7193783 - DNA, 22 bp, Homo sapiens
agggaggaaggaactccttcta

SEQ ID NO: 7193784 - DNA, 22 bp, Homo sapiens
ccccatcccacctgagtgtcac

SEQ ID NO: 7193785 - DNA, 22 bp, Homo sapiens
ccccagtggaggtgagggtcct

SEQ ID NO: 7193786 - DNA, 22 bp, Homo sapiens
ccccagtggttgcaacagcaga

SEQ ID NO: 7193787 - DNA, 22 bp, Homo sapiens
ccccatcctattcatgtttctg

SEQ ID NO: 7193788 - DNA, 22 bp, Homo sapiens
ccccatgaagtagggtctctga

SEQ ID NO: 7193789 - DNA, 22 bp, Homo sapiens
ccccatgaagtagggtctctga

SEQ ID NO: 7193790 - DNA, 22 bp, Homo sapiens
agggaaggtagaggtcaccggc

SEQ ID NO: 7193791 - DNA, 22 bp, Homo sapiens
agggaaggtagaggtcaccggc

SEQ ID NO: 7193792 - DNA, 22 bp, Homo sapiens
agggaaggtagaggtcaccggc

SEQ ID NO: 7193793 - DNA, 22 bp, Homo sapiens
agggaaggtagaggtcaccggc

SEQ ID NO: 7193794 - DNA, 22 bp, Homo sapiens
agggaaggtagaggtcaccggc

SEQ ID NO: 7193795 - DNA, 22 bp, Homo sapiens
agggaagtgaatgacagatatc

SEQ ID NO: 7193796 - DNA, 19 bp, Homo sapiens
agggaatccggctgaggga

SEQ ID NO: 7193797 - DNA, 19 bp, Homo sapiens
agggaatccggctgaggga

SEQ ID NO: 7193798 - DNA, 22 bp, Homo sapiens
agggaagtgataggacgtctct

SEQ ID NO: 7193799 - DNA, 22 bp, Homo sapiens
agggaagggcagggtctatgca

SEQ ID NO: 7193800 - DNA, 22 bp, Homo sapiens
agggaagggcagggtctatgca

SEQ ID NO: 7193801 - DNA, 22 bp, Homo sapiens
agggaagggaaaaacactcgtc

SEQ ID NO: 7193802 - DNA, 22 bp, Homo sapiens
agggaagggcagggtctatgca

SEQ ID NO: 7193803 - DNA, 22 bp, Homo sapiens
agggaagggcagggtctatgca

SEQ ID NO: 7193804 - DNA, 23 bp, Homo sapiens
agggaagggggcttattccacag

SEQ ID NO: 7193805 - DNA, 23 bp, Homo sapiens
agggaagggggcttattccacag

SEQ ID NO: 7193806 - DNA, 23 bp, Homo sapiens
agggaagggggcttattccacag

SEQ ID NO: 7193807 - DNA, 22 bp, Homo sapiens
agggaagggcagggtctatgca

SEQ ID NO: 7193808 - DNA, 23 bp, Homo sapiens
agggaagggggcttattccacag

SEQ ID NO: 7193809 - DNA, 23 bp, Homo sapiens
agggaagggggcttattccacag

SEQ ID NO: 7193810 - DNA, 23 bp, Homo sapiens
agggaagggggcttattccacag

SEQ ID NO: 7193811 - DNA, 23 bp, Homo sapiens
agggaagggggcttattccacag

SEQ ID NO: 7193812 - DNA, 22 bp, Homo sapiens
agggagaggttgaaacctcagt

SEQ ID NO: 7193813 - DNA, 22 bp, Homo sapiens
agggagaggttgaaacctcagt

SEQ ID NO: 7193814 - DNA, 22 bp, Homo sapiens
agggagaggctgaactatccta

SEQ ID NO: 7193815 - DNA, 22 bp, Homo sapiens
agggagaggctgaactatccta

SEQ ID NO: 7193816 - DNA, 22 bp, Homo sapiens
agggagaggctgaactatccta

SEQ ID NO: 7193817 - DNA, 22 bp, Homo sapiens
agggagaggttgaaacctcagt

SEQ ID NO: 7193818 - DNA, 22 bp, Homo sapiens
agggagaggttgaaacctcagt

SEQ ID NO: 7193819 - DNA, 22 bp, Homo sapiens
agggagaggttgaaacctcagt

SEQ ID NO: 7193820 - DNA, 22 bp, Homo sapiens
agggagagtagatatcaggtgt

SEQ ID NO: 7193821 - DNA, 22 bp, Homo sapiens
agggagagtagatatcaggtgt

SEQ ID NO: 7193822 - DNA, 22 bp, Homo sapiens
agggagaggttgaaacctcagt

SEQ ID NO: 7193823 - DNA, 22 bp, Homo sapiens
agggagagtagatatcaggtgt

SEQ ID NO: 7193824 - DNA, 22 bp, Homo sapiens
agggagagtagatatcaggtgt

SEQ ID NO: 7193825 - DNA, 22 bp, Homo sapiens
agggagaggttgaaacctcagt

SEQ ID NO: 7193826 - DNA, 22 bp, Homo sapiens
agggagaaggtttagctgtgag

SEQ ID NO: 7193827 - DNA, 19 bp, Homo sapiens
agggaatccggctgaggga

SEQ ID NO: 7193828 - DNA, 19 bp, Homo sapiens
agggaatccggctgaggga

SEQ ID NO: 7193829 - DNA, 19 bp, Homo sapiens
agggaatccggctgaggga

SEQ ID NO: 7193830 - DNA, 22 bp, Homo sapiens
agggaatggatgatggcaggtt

SEQ ID NO: 7193831 - DNA, 22 bp, Homo sapiens
agggaatggatgatggcaggtt

SEQ ID NO: 7193832 - DNA, 22 bp, Homo sapiens
agggagaaggtttagctgtgag

SEQ ID NO: 7193833 - DNA, 22 bp, Homo sapiens
agggagaaggtttagctgtgag

SEQ ID NO: 7193834 - DNA, 19 bp, Homo sapiens
agggagaattccaagagga

SEQ ID NO: 7193835 - DNA, 19 bp, Homo sapiens
agggagaattccaagagga

SEQ ID NO: 7193836 - DNA, 22 bp, Homo sapiens
agggagaggctgaactatccta

SEQ ID NO: 7193837 - DNA, 22 bp, Homo sapiens
agggaaggaggccatgtgtccc

SEQ ID NO: 7193838 - DNA, 22 bp, Homo sapiens
agggaaggaggccatgtgtccc

SEQ ID NO: 7193839 - DNA, 22 bp, Homo sapiens
agggaaggaggccatgtgtccc

SEQ ID NO: 7193840 - DNA, 22 bp, Homo sapiens
agggaaggaaaagctgtcgctt

SEQ ID NO: 7193841 - DNA, 22 bp, Homo sapiens
agggaaggaaaagctgtcgctt

SEQ ID NO: 7193842 - DNA, 22 bp, Homo sapiens
agggaaggaaaagctgtcgctt

SEQ ID NO: 7193843 - DNA, 22 bp, Homo sapiens
agggaaggaaaagctgtcgctt

SEQ ID NO: 7193844 - DNA, 22 bp, Homo sapiens
agggaaggaaaagctgtcgctt

SEQ ID NO: 7193845 - DNA, 22 bp, Homo sapiens
agggaaggaaaagctgtcgctt

SEQ ID NO: 7193846 - DNA, 22 bp, Homo sapiens
agggaaggaaaagctgtcgctt

SEQ ID NO: 7193847 - DNA, 22 bp, Homo sapiens
agggaaggaaaagctgtcgctt

SEQ ID NO: 7193848 - DNA, 22 bp, Homo sapiens
agggaagaatcactgggatgtt

SEQ ID NO: 7193849 - DNA, 22 bp, Homo sapiens
agggaagaatcactgggatgtt

SEQ ID NO: 7193850 - DNA, 22 bp, Homo sapiens
agggaagaagctggtagtaggt

SEQ ID NO: 7193851 - DNA, 22 bp, Homo sapiens
agggaagaagctggtagtaggt

SEQ ID NO: 7193852 - DNA, 20 bp, Homo sapiens
aggcttcaaccatacacctt

SEQ ID NO: 7193853 - DNA, 22 bp, Homo sapiens
aggcttaatgagttaaatcact

SEQ ID NO: 7193854 - DNA, 19 bp, Homo sapiens
agggaaggattctgtcatt

SEQ ID NO: 7193855 - DNA, 19 bp, Homo sapiens
agggaaggattctgtcatt

SEQ ID NO: 7193856 - DNA, 22 bp, Homo sapiens
agggaaggaggttagaacccac

SEQ ID NO: 7193857 - DNA, 22 bp, Homo sapiens
agggaaggaggttagaacccac

SEQ ID NO: 7193858 - DNA, 19 bp, Homo sapiens
agggaaggattctgtcatt

SEQ ID NO: 7193859 - DNA, 22 bp, Homo sapiens
agggaaggaggttagaacccac

SEQ ID NO: 7193860 - DNA, 22 bp, Homo sapiens
agggaaggaggttagaacccac

SEQ ID NO: 7193861 - DNA, 22 bp, Homo sapiens
agggaaggaggttagaacccac

SEQ ID NO: 7193862 - DNA, 22 bp, Homo sapiens
agggaaggaggttagaacccac

SEQ ID NO: 7193863 - DNA, 22 bp, Homo sapiens
agggaaggaggccatgtgtccc

SEQ ID NO: 7193864 - DNA, 19 bp, Homo sapiens
agggaaggattctgtcatt

SEQ ID NO: 7193865 - DNA, 19 bp, Homo sapiens
agggaaggattctgtcatt

SEQ ID NO: 7193866 - DNA, 19 bp, Homo sapiens
agggaaggattctgtcatt

SEQ ID NO: 7193867 - DNA, 22 bp, Homo sapiens
agggaaggcttttgacatttcc

SEQ ID NO: 7193868 - DNA, 22 bp, Homo sapiens
agggaaggcttttgacatttcc

SEQ ID NO: 7193869 - DNA, 22 bp, Homo sapiens
agggaaggcttttgacatttcc

SEQ ID NO: 7193870 - DNA, 22 bp, Homo sapiens
agggaaggcttttgacatttcc

SEQ ID NO: 7193871 - DNA, 22 bp, Homo sapiens
agggaagggaaaaacactcgtc

SEQ ID NO: 7193872 - DNA, 22 bp, Homo sapiens
agggaagggaaaaacactcgtc

SEQ ID NO: 7193873 - DNA, 22 bp, Homo sapiens
agggaagggaaaaacactcgtc

SEQ ID NO: 7193874 - DNA, 22 bp, Homo sapiens
aggcttaaagatagtaagaaac

SEQ ID NO: 7193875 - DNA, 21 bp, Homo sapiens
aggcttaaagccattatttcc

SEQ ID NO: 7193876 - DNA, 23 bp, Homo sapiens
aggcttaaatccttggttttgcc

SEQ ID NO: 7193877 - DNA, 22 bp, Homo sapiens
aggcttaaatgctcatatcagt

SEQ ID NO: 7193878 - DNA, 22 bp, Homo sapiens
aggcttaaatgctcatatcagt

SEQ ID NO: 7193879 - DNA, 22 bp, Homo sapiens
aggcttaaatgctgtaaccgaa

SEQ ID NO: 7193880 - DNA, 22 bp, Homo sapiens
aggcttaacctgatcacatgag

SEQ ID NO: 7193881 - DNA, 22 bp, Homo sapiens
aggcttaactacaatttttgcc

SEQ ID NO: 7193882 - DNA, 22 bp, Homo sapiens
aggcttaactttactgttatgc

SEQ ID NO: 7193883 - DNA, 22 bp, Homo sapiens
aggcttaacttaactttagagc

SEQ ID NO: 7193884 - DNA, 22 bp, Homo sapiens
aggcttaagcctgaggccccag

SEQ ID NO: 7193885 - DNA, 22 bp, Homo sapiens
aggcttaatgagttaaatcact

SEQ ID NO: 7193886 - DNA, 22 bp, Homo sapiens
aggctgtgtttcttgcgttttc

SEQ ID NO: 7193887 - DNA, 22 bp, Homo sapiens
aggctgtgtttcttgcgttttc

SEQ ID NO: 7193888 - DNA, 22 bp, Homo sapiens
aggctgtgtggtcatggtggct

SEQ ID NO: 7193889 - DNA, 22 bp, Homo sapiens
aggctgtgtggatgagtcttac

SEQ ID NO: 7193890 - DNA, 22 bp, Homo sapiens
aggctgtgtggtcatggtggct

SEQ ID NO: 7193891 - DNA, 22 bp, Homo sapiens
aggctgtgtcctcattttatat

SEQ ID NO: 7193892 - DNA, 22 bp, Homo sapiens
aggctgtgtgctccttatgaga

SEQ ID NO: 7193893 - DNA, 22 bp, Homo sapiens
aggctgtgtggataatattggg

SEQ ID NO: 7193894 - DNA, 22 bp, Homo sapiens
aggctgtgtggatgagtcttac

SEQ ID NO: 7193895 - DNA, 22 bp, Homo sapiens
aggctgtgtggatgagtcttac

SEQ ID NO: 7193896 - DNA, 22 bp, Homo sapiens
aggctgtgttctgccctctccc

SEQ ID NO: 7193897 - DNA, 22 bp, Homo sapiens
aggctgtgttctgccctctccc

SEQ ID NO: 7193898 - DNA, 22 bp, Homo sapiens
aggctgtgttctggttcttagc

SEQ ID NO: 7193899 - DNA, 22 bp, Homo sapiens
aggctgtgtttcccctggagct

SEQ ID NO: 7193900 - DNA, 22 bp, Homo sapiens
aggctgtgtttcccctggagct

SEQ ID NO: 7193901 - DNA, 22 bp, Homo sapiens
aggctgtgtttaagtggtaatg

SEQ ID NO: 7193902 - DNA, 22 bp, Homo sapiens
aggctgtgtttaagtggtaatg

SEQ ID NO: 7193903 - DNA, 22 bp, Homo sapiens
aggctgtgtaaagtgctttccc

SEQ ID NO: 7193904 - DNA, 22 bp, Homo sapiens
aggctgtgtaaagtgctttccc

SEQ ID NO: 7193905 - DNA, 22 bp, Homo sapiens
aggctgtggtgggctttgagcc

SEQ ID NO: 7193906 - DNA, 22 bp, Homo sapiens
cccagctctggaaggtggggga

SEQ ID NO: 7193907 - DNA, 22 bp, Homo sapiens
cccagctctggaaggtggggga

SEQ ID NO: 7193908 - DNA, 22 bp, Homo sapiens
cccagctctgccatctacccac

SEQ ID NO: 7193909 - DNA, 22 bp, Homo sapiens
cccagctctgccatctacccac

SEQ ID NO: 7193910 - DNA, 22 bp, Homo sapiens
cccagctctgccatctacccac

SEQ ID NO: 7193911 - DNA, 22 bp, Homo sapiens
cccagctctggaaggtggggga

SEQ ID NO: 7193912 - DNA, 22 bp, Homo sapiens
cccagctctggaaggtggggga

SEQ ID NO: 7193913 - DNA, 22 bp, Homo sapiens
cccagctctgcagacctgccct

SEQ ID NO: 7193914 - DNA, 22 bp, Homo sapiens
cccagctctgcagacctgccct

SEQ ID NO: 7193915 - DNA, 22 bp, Homo sapiens
cccagctctgcagacctgccct

SEQ ID NO: 7193916 - DNA, 22 bp, Homo sapiens
cccagctctgcagacctgccct

SEQ ID NO: 7193917 - DNA, 22 bp, Homo sapiens
cccagctctgcagacctgccct

SEQ ID NO: 7193918 - DNA, 22 bp, Homo sapiens
cccagctctgccatctacccac

SEQ ID NO: 7193919 - DNA, 22 bp, Homo sapiens
cccagctctgccatctacccac

SEQ ID NO: 7193920 - DNA, 22 bp, Homo sapiens
cccagctctgcagacctgccct

SEQ ID NO: 7193921 - DNA, 22 bp, Homo sapiens
cccagctctgccatctacccac

SEQ ID NO: 7193922 - DNA, 22 bp, Homo sapiens
cccagctctctgctcttagcct

SEQ ID NO: 7193923 - DNA, 22 bp, Homo sapiens
cccagctctctgctcttagcct

SEQ ID NO: 7193924 - DNA, 22 bp, Homo sapiens
cccagctctctgctcttagcct

SEQ ID NO: 7193925 - DNA, 22 bp, Homo sapiens
cccagctctctgctcttagcct

SEQ ID NO: 7193926 - DNA, 22 bp, Homo sapiens
cccagctctctcagttctgctt

SEQ ID NO: 7193927 - DNA, 22 bp, Homo sapiens
cccagctctctcagttctgctt

SEQ ID NO: 7193928 - DNA, 22 bp, Homo sapiens
cccagctctctgctcttagcct

SEQ ID NO: 7193929 - DNA, 19 bp, Homo sapiens
cccagctctcgtggtgtgc

SEQ ID NO: 7193930 - DNA, 22 bp, Homo sapiens
cccagctctcgcacttactagc

SEQ ID NO: 7193931 - DNA, 22 bp, Homo sapiens
cccagctctcgcacttactagc

SEQ ID NO: 7193932 - DNA, 19 bp, Homo sapiens
cccagctctcgtggtgtgc

SEQ ID NO: 7193933 - DNA, 19 bp, Homo sapiens
cccagctctcgtggtgtgc

SEQ ID NO: 7193934 - DNA, 22 bp, Homo sapiens
cccagctctctcagttctgctt

SEQ ID NO: 7193935 - DNA, 22 bp, Homo sapiens
cccagctctcgcacttactagc

SEQ ID NO: 7193936 - DNA, 22 bp, Homo sapiens
cccagctctcgcacttactagc

SEQ ID NO: 7193937 - DNA, 22 bp, Homo sapiens
cccagctctaggagtggtggca

SEQ ID NO: 7193938 - DNA, 22 bp, Homo sapiens
cccagctcgccgccgatgtgcg

SEQ ID NO: 7193939 - DNA, 22 bp, Homo sapiens
cccagctccttgtttgcatctc

SEQ ID NO: 7193940 - DNA, 22 bp, Homo sapiens
cccagctccttgtttgcatctc

SEQ ID NO: 7193941 - DNA, 22 bp, Homo sapiens
cccagctccttgtttgcatctc

SEQ ID NO: 7193942 - DNA, 22 bp, Homo sapiens
cccagctccttgtttgcatctc

SEQ ID NO: 7193943 - DNA, 22 bp, Homo sapiens
cccagctcgccgccgatgtgcg

SEQ ID NO: 7193944 - DNA, 22 bp, Homo sapiens
cccagctccttggatgggcagg

SEQ ID NO: 7193945 - DNA, 22 bp, Homo sapiens
cccagctccttggatgggcagg

SEQ ID NO: 7193946 - DNA, 22 bp, Homo sapiens
cccagctccttggatgggcagg

SEQ ID NO: 7193947 - DNA, 22 bp, Homo sapiens
cccagctccttggatgggcagg

SEQ ID NO: 7193948 - DNA, 22 bp, Homo sapiens
cccagcctggtgcactgtgggg

SEQ ID NO: 7193949 - DNA, 22 bp, Homo sapiens
cccagcctggtgcactgtgggg

SEQ ID NO: 7193950 - DNA, 22 bp, Homo sapiens
cccagcctggtgcactgtgggg

SEQ ID NO: 7193951 - DNA, 22 bp, Homo sapiens
cccagcctggtgcactgtgggg

SEQ ID NO: 7193952 - DNA, 22 bp, Homo sapiens
cccagcctggtgcactgtgggg

SEQ ID NO: 7193953 - DNA, 22 bp, Homo sapiens
cccagcctctgtttgctcctct

SEQ ID NO: 7193954 - DNA, 22 bp, Homo sapiens
cccagcctctgtttgctcctct

SEQ ID NO: 7193955 - DNA, 22 bp, Homo sapiens
cccagcctctgtttgctcctct

SEQ ID NO: 7193956 - DNA, 22 bp, Homo sapiens
cccagcctgatctcggccagct

SEQ ID NO: 7193957 - DNA, 22 bp, Homo sapiens
cccagcctgatctcggccagct

SEQ ID NO: 7193958 - DNA, 22 bp, Homo sapiens
cccagcctgatctcggccagct

SEQ ID NO: 7193959 - DNA, 22 bp, Homo sapiens
cccagcctgatctcggccagct

SEQ ID NO: 7193960 - DNA, 18 bp, Homo sapiens
cccagcctctcctttcta

SEQ ID NO: 7193961 - DNA, 22 bp, Homo sapiens
cccagcctctggattctgccct

SEQ ID NO: 7193962 - DNA, 22 bp, Homo sapiens
cccagcctctggattctgccct

SEQ ID NO: 7193963 - DNA, 22 bp, Homo sapiens
cccagcctctggattctgccct

SEQ ID NO: 7193964 - DNA, 22 bp, Homo sapiens
cccagcctctggattctgccct

SEQ ID NO: 7193965 - DNA, 22 bp, Homo sapiens
cccagcctctggattctgccct

SEQ ID NO: 7193966 - DNA, 22 bp, Homo sapiens
cccagcctctgggctcacccaa

SEQ ID NO: 7193967 - DNA, 22 bp, Homo sapiens
cccagcctctgggctcacccaa

SEQ ID NO: 7193968 - DNA, 22 bp, Homo sapiens
cccagcctctgggctcacccaa

SEQ ID NO: 7193969 - DNA, 22 bp, Homo sapiens
cccagcctctgggctcacccaa

SEQ ID NO: 7193970 - DNA, 22 bp, Homo sapiens
cccagcctctgggttctgccgg

SEQ ID NO: 7193971 - DNA, 22 bp, Homo sapiens
cccagcctctgggttctgccgg

SEQ ID NO: 7193972 - DNA, 22 bp, Homo sapiens
cccagcctctgggttctgccgg

SEQ ID NO: 7193973 - DNA, 22 bp, Homo sapiens
cccagcctctgggttctgccgg

SEQ ID NO: 7193974 - DNA, 22 bp, Homo sapiens
cccagcctctgggttctgccgg

SEQ ID NO: 7193975 - DNA, 22 bp, Homo sapiens
cccagcctctgtttgctcctct

SEQ ID NO: 7193976 - DNA, 22 bp, Homo sapiens
cccagcctctgtttgctcctct

SEQ ID NO: 7193977 - DNA, 22 bp, Homo sapiens
cccagcctctgtttgctcctct

SEQ ID NO: 7193978 - DNA, 22 bp, Homo sapiens
cccagcctctgtttgctcctct

SEQ ID NO: 7193979 - DNA, 22 bp, Homo sapiens
cccagcctctgtttgctcctct

SEQ ID NO: 7193980 - DNA, 22 bp, Homo sapiens
cccagcctctgtttgctcctct

SEQ ID NO: 7193981 - DNA, 22 bp, Homo sapiens
cccagcagtggttctcaaactt

SEQ ID NO: 7193982 - DNA, 22 bp, Homo sapiens
cccagcagtggttctcaaactt

SEQ ID NO: 7193983 - DNA, 22 bp, Homo sapiens
cccagcagtggttctcaaactt

SEQ ID NO: 7193984 - DNA, 22 bp, Homo sapiens
cccagcagtggttctcaaactt

SEQ ID NO: 7193985 - DNA, 22 bp, Homo sapiens
cccagcagttgttggtgcacat

SEQ ID NO: 7193986 - DNA, 22 bp, Homo sapiens
cccagcagttgttggtgcacat

SEQ ID NO: 7193987 - DNA, 22 bp, Homo sapiens
cccagcagttgttggtgcacat

SEQ ID NO: 7193988 - DNA, 22 bp, Homo sapiens
cccagcagtttgcttagagtga

SEQ ID NO: 7193989 - DNA, 22 bp, Homo sapiens
cccagcatcccagtgggcagca

SEQ ID NO: 7193990 - DNA, 22 bp, Homo sapiens
cccagcatcccagtgggcagca

SEQ ID NO: 7193991 - DNA, 22 bp, Homo sapiens
cccagcatcccagtgggcagca

SEQ ID NO: 7193992 - DNA, 22 bp, Homo sapiens
cccagcatcctcagggagcggg

SEQ ID NO: 7193993 - DNA, 22 bp, Homo sapiens
cccagcatctccaggcatggcc

SEQ ID NO: 7193994 - DNA, 22 bp, Homo sapiens
cccagcctcagctttacttcca

SEQ ID NO: 7193995 - DNA, 22 bp, Homo sapiens
cccagcctcagctttacttcca

SEQ ID NO: 7193996 - DNA, 18 bp, Homo sapiens
cccagcctctcctttcta

SEQ ID NO: 7193997 - DNA, 22 bp, Homo sapiens
cccagcagtacccaagcccttg

SEQ ID NO: 7193998 - DNA, 22 bp, Homo sapiens
cccagcagtagagctcatatgg

SEQ ID NO: 7193999 - DNA, 22 bp, Homo sapiens
cccagcagtacccaagcccttg

SEQ ID NO: 7194000 - DNA, 22 bp, Homo sapiens
cccagcagtgacccagtgatac

SEQ ID NO: 7194001 - DNA, 22 bp, Homo sapiens
cccagcagtgacccagtgatac

SEQ ID NO: 7194002 - DNA, 22 bp, Homo sapiens
cccagcagtgacccagtgatac

SEQ ID NO: 7194003 - DNA, 22 bp, Homo sapiens
ccatgcaacagaatccagattt

SEQ ID NO: 7194004 - DNA, 22 bp, Homo sapiens
ccatgcaagaagtccaaccatc

SEQ ID NO: 7194005 - DNA, 22 bp, Homo sapiens
ccatgcaaggagaactctcact

SEQ ID NO: 7194006 - DNA, 22 bp, Homo sapiens
ccatgcaagggtctggtcctgc

SEQ ID NO: 7194007 - DNA, 22 bp, Homo sapiens
ccatgcaagggtctggtcctgc

SEQ ID NO: 7194008 - DNA, 22 bp, Homo sapiens
ccatgcaatatatatcctcaag

SEQ ID NO: 7194009 - DNA, 22 bp, Homo sapiens
ccatgcaatttctgtaaaacca

SEQ ID NO: 7194010 - DNA, 22 bp, Homo sapiens
cccagcacaggcaattccatac

SEQ ID NO: 7194011 - DNA, 22 bp, Homo sapiens
cccagcactcagcaggctcata

SEQ ID NO: 7194012 - DNA, 22 bp, Homo sapiens
cccagcacaggcaattccatac

SEQ ID NO: 7194013 - DNA, 22 bp, Homo sapiens
cccagcactcagcaggctcata

SEQ ID NO: 7194014 - DNA, 22 bp, Homo sapiens
cccagcactcagcaggctcata

SEQ ID NO: 7194015 - DNA, 22 bp, Homo sapiens
cccagcagtaaccagtggaaat

SEQ ID NO: 7194016 - DNA, 22 bp, Homo sapiens
cccagcagtacccaagcccttg

SEQ ID NO: 7194017 - DNA, 22 bp, Homo sapiens
cccagcagtacccaagcccttg

SEQ ID NO: 7194018 - DNA, 22 bp, Homo sapiens
ccatctggatctgtccactgac

SEQ ID NO: 7194019 - DNA, 22 bp, Homo sapiens
ccatctccagtttattcttcct

SEQ ID NO: 7194020 - DNA, 22 bp, Homo sapiens
ccatctccactgtccctgtcaa

SEQ ID NO: 7194021 - DNA, 22 bp, Homo sapiens
ccatctccactgtccctgtcaa

SEQ ID NO: 7194022 - DNA, 22 bp, Homo sapiens
ccatctgtctcctgatctagct

SEQ ID NO: 7194023 - DNA, 22 bp, Homo sapiens
ccatctgtctcctgatctagct

SEQ ID NO: 7194024 - DNA, 22 bp, Homo sapiens
ccatcttctcttgaacctcctt

SEQ ID NO: 7194025 - DNA, 22 bp, Homo sapiens
ccatgaattcactccatgctag

SEQ ID NO: 7194026 - DNA, 22 bp, Homo sapiens
ccatgacattttaattttcact

SEQ ID NO: 7194027 - DNA, 22 bp, Homo sapiens
ccatgacccctggcatccaggg

SEQ ID NO: 7194028 - DNA, 22 bp, Homo sapiens
ccatgagaagttagactagcca

SEQ ID NO: 7194029 - DNA, 22 bp, Homo sapiens
ccatgagaagttagactagcca

SEQ ID NO: 7194030 - DNA, 22 bp, Homo sapiens
ccatgagacagcaactgaaagt

SEQ ID NO: 7194031 - DNA, 22 bp, Homo sapiens
ccatgagacagcaactgaaagt

SEQ ID NO: 7194032 - DNA, 22 bp, Homo sapiens
ccatgagcttcaactgacacag

SEQ ID NO: 7194033 - DNA, 22 bp, Homo sapiens
ccatgcaaagaatgtgggcata

SEQ ID NO: 7194034 - DNA, 22 bp, Homo sapiens
ccatgcaacagaatccagattt

SEQ ID NO: 7194035 - DNA, 22 bp, Homo sapiens
ccatccttggctcgctctctgt

SEQ ID NO: 7194036 - DNA, 22 bp, Homo sapiens
ccatctactgacttagcctcat

SEQ ID NO: 7194037 - DNA, 22 bp, Homo sapiens
ccatctcactcatgtttctaga

SEQ ID NO: 7194038 - DNA, 22 bp, Homo sapiens
ccatctccaaataccatcacat

SEQ ID NO: 7194039 - DNA, 21 bp, Homo sapiens
ccataattttgtttcagaagt

SEQ ID NO: 7194040 - DNA, 22 bp, Homo sapiens
ccatcctgtctgtggcctcagg

SEQ ID NO: 7194041 - DNA, 22 bp, Homo sapiens
ccatcctgtctgtggcctcagg

SEQ ID NO: 7194042 - DNA, 21 bp, Homo sapiens
ccataatcttaggatcaaaat

SEQ ID NO: 7194043 - DNA, 21 bp, Homo sapiens
ccataatcttaggatcaaaat

SEQ ID NO: 7194044 - DNA, 22 bp, Homo sapiens
ccataattgggtagccatctga

SEQ ID NO: 7194045 - DNA, 21 bp, Homo sapiens
ccataattttgtttcagaagt

SEQ ID NO: 7194046 - DNA, 21 bp, Homo sapiens
ccataattttgtttcagaagt

SEQ ID NO: 7194047 - DNA, 21 bp, Homo sapiens
ccataaacagatggtaactgt

SEQ ID NO: 7194048 - DNA, 22 bp, Homo sapiens
ccagtttttccagtgctttctg

SEQ ID NO: 7194049 - DNA, 22 bp, Homo sapiens
ccagttttgccatggtaacact

SEQ ID NO: 7194050 - DNA, 22 bp, Homo sapiens
ccagttttgccatggtaacact

SEQ ID NO: 7194051 - DNA, 23 bp, Homo sapiens
ccataatcagggttgtggggtcc

SEQ ID NO: 7194052 - DNA, 22 bp, Homo sapiens
ccataatcatgtaagtaaattc

SEQ ID NO: 7194053 - DNA, 22 bp, Homo sapiens
ccataatcgtgtgttaaataat

SEQ ID NO: 7194054 - DNA, 22 bp, Homo sapiens
ccataatctggctttgagagag

SEQ ID NO: 7194055 - DNA, 22 bp, Homo sapiens
cagggccagcgcccaggcccag

SEQ ID NO: 7194056 - DNA, 22 bp, Homo sapiens
cagggccagcgtctcgggctat

SEQ ID NO: 7194057 - DNA, 22 bp, Homo sapiens
aggaaaggggtaggtgtggacg

SEQ ID NO: 7194058 - DNA, 22 bp, Homo sapiens
aggaaaggggtaggtgtggacg

SEQ ID NO: 7194059 - DNA, 22 bp, Homo sapiens
aggaaaggggtaggtgtggacg

SEQ ID NO: 7194060 - DNA, 22 bp, Homo sapiens
aggaaaggggtaggtgtggacg

SEQ ID NO: 7194061 - DNA, 22 bp, Homo sapiens
aggaaatgggaatagatggtat

SEQ ID NO: 7194062 - DNA, 22 bp, Homo sapiens
aggaaataggaccagacaaagc

SEQ ID NO: 7194063 - DNA, 22 bp, Homo sapiens
aggaaataggaccagacaaagc

SEQ ID NO: 7194064 - DNA, 22 bp, Homo sapiens
aggaaatgcaggcaaatactct

SEQ ID NO: 7194065 - DNA, 22 bp, Homo sapiens
aggaaatgcaggcaaatactct

SEQ ID NO: 7194066 - DNA, 22 bp, Homo sapiens
aggaacaattgataaactcaca

SEQ ID NO: 7194067 - DNA, 22 bp, Homo sapiens
aggaacacaatgcttctgtgtg

SEQ ID NO: 7194068 - DNA, 22 bp, Homo sapiens
aggaacacatggacatttctga

SEQ ID NO: 7194069 - DNA, 22 bp, Homo sapiens
aggaacaagggagccttttctc

SEQ ID NO: 7194070 - DNA, 22 bp, Homo sapiens
aggaacaagggagccttttctc

SEQ ID NO: 7194071 - DNA, 22 bp, Homo sapiens
aggaacaattgataaactcaca

SEQ ID NO: 7194072 - DNA, 22 bp, Homo sapiens
aggaacaactgattcagtcaac

SEQ ID NO: 7194073 - DNA, 22 bp, Homo sapiens
aggaacaactgattcagtcaac

SEQ ID NO: 7194074 - DNA, 22 bp, Homo sapiens
aggaaatgggaatagatggtat

SEQ ID NO: 7194075 - DNA, 22 bp, Homo sapiens
aggaaatgtagtcctcatctcc

SEQ ID NO: 7194076 - DNA, 22 bp, Homo sapiens
aggaaattgagaatcagaataa

SEQ ID NO: 7194077 - DNA, 22 bp, Homo sapiens
aggaaattgtctttttccttgt

SEQ ID NO: 7194078 - DNA, 20 bp, Homo sapiens
aggaactggaagggaggaaa

SEQ ID NO: 7194079 - DNA, 22 bp, Homo sapiens
aggaactggatataatgtgaga

SEQ ID NO: 7194080 - DNA, 22 bp, Homo sapiens
aggaactgatttataactttag

SEQ ID NO: 7194081 - DNA, 22 bp, Homo sapiens
aggaactctgtctccagagttg

SEQ ID NO: 7194082 - DNA, 23 bp, Homo sapiens
aggaactgaggcctagggaggta

SEQ ID NO: 7194083 - DNA, 22 bp, Homo sapiens
aggaactgatgagcagccaggg

SEQ ID NO: 7194084 - DNA, 22 bp, Homo sapiens
aggaaccagaggttgagcaact

SEQ ID NO: 7194085 - DNA, 22 bp, Homo sapiens
aggaaccagacagaactgaatg

SEQ ID NO: 7194086 - DNA, 22 bp, Homo sapiens
aggaacctaagagcctgcagtc

SEQ ID NO: 7194087 - DNA, 22 bp, Homo sapiens
aggaacctgagtctgatcattt

SEQ ID NO: 7194088 - DNA, 22 bp, Homo sapiens
aggaacagaagagcaatgcagg

SEQ ID NO: 7194089 - DNA, 22 bp, Homo sapiens
aggaacagaagagcaatgcagg

SEQ ID NO: 7194090 - DNA, 22 bp, Homo sapiens
aggaagctcggagagggcaaat

SEQ ID NO: 7194091 - DNA, 22 bp, Homo sapiens
aggaagctcggagagggcaaat

SEQ ID NO: 7194092 - DNA, 22 bp, Homo sapiens
aggaagctcctggagagccagt

SEQ ID NO: 7194093 - DNA, 22 bp, Homo sapiens
aggaagctcctggagagccagt

SEQ ID NO: 7194094 - DNA, 22 bp, Homo sapiens
aggaagctcctggagagccagt

SEQ ID NO: 7194095 - DNA, 22 bp, Homo sapiens
aggaagctcattttgacatatc

SEQ ID NO: 7194096 - DNA, 22 bp, Homo sapiens
aggaagctcagagaagtctttt

SEQ ID NO: 7194097 - DNA, 22 bp, Homo sapiens
aggaagctcaaagccatgatgt

SEQ ID NO: 7194098 - DNA, 22 bp, Homo sapiens
aggaagctccatgaaggcagag

SEQ ID NO: 7194099 - DNA, 22 bp, Homo sapiens
aggaagctcctggagagccagt

SEQ ID NO: 7194100 - DNA, 18 bp, Homo sapiens
aggaagcaggaggaaggc

SEQ ID NO: 7194101 - DNA, 22 bp, Homo sapiens
aggaagctcaaagccatgatgt

SEQ ID NO: 7194102 - DNA, 18 bp, Homo sapiens
aggaagcaggaggaaggc

SEQ ID NO: 7194103 - DNA, 22 bp, Homo sapiens
cagggccagccgcagcatccac

SEQ ID NO: 7194104 - DNA, 22 bp, Homo sapiens
cagggccagcgcccaggcccag

SEQ ID NO: 7194105 - DNA, 22 bp, Homo sapiens
cagggccagccgcagcatccac

SEQ ID NO: 7194106 - DNA, 22 bp, Homo sapiens
cagggccagccgcagcatccac

SEQ ID NO: 7194107 - DNA, 22 bp, Homo sapiens
cagggccagcccactagcgagg

SEQ ID NO: 7194108 - DNA, 22 bp, Homo sapiens
cagggccagccatcctgctggg

SEQ ID NO: 7194109 - DNA, 22 bp, Homo sapiens
cagggccagagagggctggctg

SEQ ID NO: 7194110 - DNA, 22 bp, Homo sapiens
cagggccagagagggctggctg

SEQ ID NO: 7194111 - DNA, 22 bp, Homo sapiens
cagggccagagagggctggctg

SEQ ID NO: 7194112 - DNA, 22 bp, Homo sapiens
cagggccactgtagatgaggag

SEQ ID NO: 7194113 - DNA, 22 bp, Homo sapiens
cagggccagagagggctggctg

SEQ ID NO: 7194114 - DNA, 22 bp, Homo sapiens
aggaaagatggaaggaggataa

SEQ ID NO: 7194115 - DNA, 22 bp, Homo sapiens
aggaaagatggaaggaggataa

SEQ ID NO: 7194116 - DNA, 22 bp, Homo sapiens
aggaaagactggggccccagaa

SEQ ID NO: 7194117 - DNA, 22 bp, Homo sapiens
aggaaagatggaaggaggataa

SEQ ID NO: 7194118 - DNA, 22 bp, Homo sapiens
aggaaagatggaaggaggataa

SEQ ID NO: 7194119 - DNA, 22 bp, Homo sapiens
aggaaagctcccagtagggctc

SEQ ID NO: 7194120 - DNA, 21 bp, Homo sapiens
aggaaaggaagtccccagggt

SEQ ID NO: 7194121 - DNA, 21 bp, Homo sapiens
aggaaaggaagtccccagggt

SEQ ID NO: 7194122 - DNA, 21 bp, Homo sapiens
aggaaaggaagtccccagggt

SEQ ID NO: 7194123 - DNA, 21 bp, Homo sapiens
aggaaaggaagtccccagggt

SEQ ID NO: 7194124 - DNA, 22 bp, Homo sapiens
agctttatataaaagagtacat

SEQ ID NO: 7194125 - DNA, 22 bp, Homo sapiens
agctttatatgttgtttctcca

SEQ ID NO: 7194126 - DNA, 22 bp, Homo sapiens
agctttatataaaagagtacat

SEQ ID NO: 7194127 - DNA, 22 bp, Homo sapiens
agctttatataaaagagtacat

SEQ ID NO: 7194128 - DNA, 22 bp, Homo sapiens
agctttatataaaagagtacat

SEQ ID NO: 7194129 - DNA, 22 bp, Homo sapiens
agctttatagaaaggatcagtg

SEQ ID NO: 7194130 - DNA, 22 bp, Homo sapiens
agctttatatgttgtttctcca

SEQ ID NO: 7194131 - DNA, 22 bp, Homo sapiens
aggaaaccggagctcagagagg

SEQ ID NO: 7194132 - DNA, 22 bp, Homo sapiens
aggaaagactggggccccagaa

SEQ ID NO: 7194133 - DNA, 18 bp, Homo sapiens
aggaaagacgaagagggc

SEQ ID NO: 7194134 - DNA, 18 bp, Homo sapiens
aggaaagacgaagagggc

SEQ ID NO: 7194135 - DNA, 18 bp, Homo sapiens
aggaaagacgaagagggc

SEQ ID NO: 7194136 - DNA, 18 bp, Homo sapiens
aggaaagacgaagagggc

SEQ ID NO: 7194137 - DNA, 18 bp, Homo sapiens
aggaaagacgaagagggc

SEQ ID NO: 7194138 - DNA, 18 bp, Homo sapiens
aggaaagacgaagagggc

SEQ ID NO: 7194139 - DNA, 22 bp, Homo sapiens
agctttatagaaaggatcagtg

SEQ ID NO: 7194140 - DNA, 22 bp, Homo sapiens
agctttacctgccttggggcac

SEQ ID NO: 7194141 - DNA, 22 bp, Homo sapiens
agctttaaagcatatttctaag

SEQ ID NO: 7194142 - DNA, 22 bp, Homo sapiens
agctttaaatcaatccagtgag

SEQ ID NO: 7194143 - DNA, 22 bp, Homo sapiens
agcttgttaaggatgcatatta

SEQ ID NO: 7194144 - DNA, 22 bp, Homo sapiens
agcttgttttgttgaatactta

SEQ ID NO: 7194145 - DNA, 21 bp, Homo sapiens
agcttgttattaattcagaac

SEQ ID NO: 7194146 - DNA, 18 bp, Homo sapiens
agctgttgttgactctgt

SEQ ID NO: 7194147 - DNA, 20 bp, Homo sapiens
agctgtttacatggatttct

SEQ ID NO: 7194148 - DNA, 22 bp, Homo sapiens
agctgtttaaatgacttacttt

SEQ ID NO: 7194149 - DNA, 22 bp, Homo sapiens
agctgtttccataaatgagaca

SEQ ID NO: 7194150 - DNA, 22 bp, Homo sapiens
agctgtttccataaatgagaca

SEQ ID NO: 7194151 - DNA, 23 bp, Homo sapiens
agctgtttcattattacaacacc

SEQ ID NO: 7194152 - DNA, 23 bp, Homo sapiens
agctgtttcattattacaacacc

SEQ ID NO: 7194153 - DNA, 21 bp, Homo sapiens
agctgtttgaagctatattgg

SEQ ID NO: 7194154 - DNA, 22 bp, Homo sapiens
agctgtttgtacttagatagta

SEQ ID NO: 7194155 - DNA, 22 bp, Homo sapiens
agctgttttactggttgtataa

SEQ ID NO: 7194156 - DNA, 22 bp, Homo sapiens
agctgttttcctggttagagac

SEQ ID NO: 7194157 - DNA, 22 bp, Homo sapiens
agctgttggctggctgagctct

SEQ ID NO: 7194158 - DNA, 22 bp, Homo sapiens
agctgttgtctgcaggagaagc

SEQ ID NO: 7194159 - DNA, 22 bp, Homo sapiens
agctgttgtctgcaggagaagc

SEQ ID NO: 7194160 - DNA, 22 bp, Homo sapiens
agctgtgtttccagatggtagc

SEQ ID NO: 7194161 - DNA, 22 bp, Homo sapiens
agctgttgctgggaggagagaa

SEQ ID NO: 7194162 - DNA, 22 bp, Homo sapiens
agctgtgttctggttgattcac

SEQ ID NO: 7194163 - DNA, 22 bp, Homo sapiens
agctgtgttattagaaacctgc

SEQ ID NO: 7194164 - DNA, 22 bp, Homo sapiens
agctgtgtgtttccactgagct

SEQ ID NO: 7194165 - DNA, 22 bp, Homo sapiens
agctgtgtggtttgggcaaatt

SEQ ID NO: 7194166 - DNA, 22 bp, Homo sapiens
agctgtgtgtttgtcatgggcg

SEQ ID NO: 7194167 - DNA, 22 bp, Homo sapiens
agctgtgtgcccatggtggagg

SEQ ID NO: 7194168 - DNA, 23 bp, Homo sapiens
agctgtgtgcgcgtccgggttct

SEQ ID NO: 7194169 - DNA, 23 bp, Homo sapiens
agctgtgtggccttgggcaagtt

SEQ ID NO: 7194170 - DNA, 22 bp, Homo sapiens
agctgtgtggtgtctgacagct

SEQ ID NO: 7194171 - DNA, 22 bp, Homo sapiens
agcttcttttacagctcatgct

SEQ ID NO: 7194172 - DNA, 22 bp, Homo sapiens
agcttcttagttcacttttaat

SEQ ID NO: 7194173 - DNA, 22 bp, Homo sapiens
agcttcttaagttcctgcagca

SEQ ID NO: 7194174 - DNA, 21 bp, Homo sapiens
agcttacattaccattgttgc

SEQ ID NO: 7194175 - DNA, 22 bp, Homo sapiens
agcttctgttcatcttccaggc

SEQ ID NO: 7194176 - DNA, 22 bp, Homo sapiens
agcttcttttaccaggaagttg

SEQ ID NO: 7194177 - DNA, 22 bp, Homo sapiens
agcttaaactctttgaagttat

SEQ ID NO: 7194178 - DNA, 22 bp, Homo sapiens
agctgttttttcctcaccactt

SEQ ID NO: 7194179 - DNA, 22 bp, Homo sapiens
agctgtttttgtgggcatgtga

SEQ ID NO: 7194180 - DNA, 22 bp, Homo sapiens
agctgtttttgtctgctgatcc

SEQ ID NO: 7194181 - DNA, 22 bp, Homo sapiens
agctgtttttccagtctctgga

SEQ ID NO: 7194182 - DNA, 22 bp, Homo sapiens
agcttaaagccgccatctagta

SEQ ID NO: 7194183 - DNA, 22 bp, Homo sapiens
agcttaaactctttgaagttat

SEQ ID NO: 7194184 - DNA, 22 bp, Homo sapiens
agcttaaagtatttaaatttca

SEQ ID NO: 7194185 - DNA, 22 bp, Homo sapiens
agcttaaataggagccccaggg

SEQ ID NO: 7194186 - DNA, 22 bp, Homo sapiens
agcttacaccccccaagattct

SEQ ID NO: 7194187 - DNA, 22 bp, Homo sapiens
agcttacagttcaatgacaaag

SEQ ID NO: 7194188 - DNA, 22 bp, Homo sapiens
agcttggtgttgcctgcttgag

SEQ ID NO: 7194189 - DNA, 22 bp, Homo sapiens
agcttggtggccctcctggctg

SEQ ID NO: 7194190 - DNA, 17 bp, Homo sapiens
agcttggagcagcatga

SEQ ID NO: 7194191 - DNA, 22 bp, Homo sapiens
agcttgggtgtgcctgcgagct

SEQ ID NO: 7194192 - DNA, 22 bp, Homo sapiens
agcttgtaacagacataaaaat

SEQ ID NO: 7194193 - DNA, 22 bp, Homo sapiens
agcttgtctttcaaaggagttt

SEQ ID NO: 7194194 - DNA, 22 bp, Homo sapiens
agcttgcagtttctgctgtttt

SEQ ID NO: 7194195 - DNA, 22 bp, Homo sapiens
agcttgatagtggctatcaagc

SEQ ID NO: 7194196 - DNA, 22 bp, Homo sapiens
agcttgatagtggctatcaagc

SEQ ID NO: 7194197 - DNA, 22 bp, Homo sapiens
agcttgcctgtttcctagggct

SEQ ID NO: 7194198 - DNA, 22 bp, Homo sapiens
agcttgcctgtttcctagggct

SEQ ID NO: 7194199 - DNA, 23 bp, Homo sapiens
agcttgcttttcccagtactgca

SEQ ID NO: 7194200 - DNA, 22 bp, Homo sapiens
agctgggaagactggaagacag

SEQ ID NO: 7194201 - DNA, 22 bp, Homo sapiens
agctgggaagagttttctgcag

SEQ ID NO: 7194202 - DNA, 22 bp, Homo sapiens
agctgggaagagttttctgcag

SEQ ID NO: 7194203 - DNA, 22 bp, Homo sapiens
agctgggaagactggaagacag

SEQ ID NO: 7194204 - DNA, 22 bp, Homo sapiens
agctgggaagactggaagacag

SEQ ID NO: 7194205 - DNA, 22 bp, Homo sapiens
agctgggaagactggaagacag

SEQ ID NO: 7194206 - DNA, 22 bp, Homo sapiens
agctgggacagacaactatgtt

SEQ ID NO: 7194207 - DNA, 22 bp, Homo sapiens
agctgggacagacaactatgtt

SEQ ID NO: 7194208 - DNA, 23 bp, Homo sapiens
agctgggaattttctgaagcttt

SEQ ID NO: 7194209 - DNA, 23 bp, Homo sapiens
agctgggaattttctgaagcttt

SEQ ID NO: 7194210 - DNA, 23 bp, Homo sapiens
agctgggaattttctgaagcttt

SEQ ID NO: 7194211 - DNA, 23 bp, Homo sapiens
agctgggaattttctgaagcttt

SEQ ID NO: 7194212 - DNA, 21 bp, Homo sapiens
caggccccaggcctggggtgc

SEQ ID NO: 7194213 - DNA, 21 bp, Homo sapiens
caggccccaggcctggggtgc

SEQ ID NO: 7194214 - DNA, 22 bp, Homo sapiens
caggccccattcctcttgggac

SEQ ID NO: 7194215 - DNA, 22 bp, Homo sapiens
caggccccattcctcttgggac

SEQ ID NO: 7194216 - DNA, 22 bp, Homo sapiens
caggccccattcctcttgggac

SEQ ID NO: 7194217 - DNA, 22 bp, Homo sapiens
agctgggactcaactgtctggg

SEQ ID NO: 7194218 - DNA, 21 bp, Homo sapiens
caggccccaggcctggggtgc

SEQ ID NO: 7194219 - DNA, 22 bp, Homo sapiens
caggcccatttgtagccacttt

SEQ ID NO: 7194220 - DNA, 22 bp, Homo sapiens
caggcctccactccacgcagac

SEQ ID NO: 7194221 - DNA, 22 bp, Homo sapiens
caggcctccactccacgcagac

SEQ ID NO: 7194222 - DNA, 22 bp, Homo sapiens
caggcctccactccacgcagac

SEQ ID NO: 7194223 - DNA, 22 bp, Homo sapiens
caggcctcaggggctcaggctg

SEQ ID NO: 7194224 - DNA, 22 bp, Homo sapiens
caggcctcatggtgtgtccttc

SEQ ID NO: 7194225 - DNA, 22 bp, Homo sapiens
caggcctcaggggctcaggctg

SEQ ID NO: 7194226 - DNA, 22 bp, Homo sapiens
caggcctcaggggctcaggctg

SEQ ID NO: 7194227 - DNA, 22 bp, Homo sapiens
caggcctcaggggctcaggctg

SEQ ID NO: 7194228 - DNA, 22 bp, Homo sapiens
caggcctcaccagcggagctgc

SEQ ID NO: 7194229 - DNA, 22 bp, Homo sapiens
caggcctcaccagcggagctgc

SEQ ID NO: 7194230 - DNA, 21 bp, Homo sapiens
caggccgggtgagcaggcagc

SEQ ID NO: 7194231 - DNA, 22 bp, Homo sapiens
caggccggtgattctggatgta

SEQ ID NO: 7194232 - DNA, 22 bp, Homo sapiens
caggccggtgattctggatgta

SEQ ID NO: 7194233 - DNA, 22 bp, Homo sapiens
caggccggtgattctggatgta

SEQ ID NO: 7194234 - DNA, 22 bp, Homo sapiens
caggcctcagagagtggcgggg

SEQ ID NO: 7194235 - DNA, 22 bp, Homo sapiens
caggcctcagagagtggcgggg

SEQ ID NO: 7194236 - DNA, 22 bp, Homo sapiens
caggcctcagggctgtccgtag

SEQ ID NO: 7194237 - DNA, 22 bp, Homo sapiens
caggcctcagggctgtccgtag

SEQ ID NO: 7194238 - DNA, 22 bp, Homo sapiens
caggcctcaggggctcaggctg

SEQ ID NO: 7194239 - DNA, 22 bp, Homo sapiens
caggcctcaggggctcaggctg

SEQ ID NO: 7194240 - DNA, 22 bp, Homo sapiens
caggcctcaggggctcaggctg

SEQ ID NO: 7194241 - DNA, 22 bp, Homo sapiens
caggcctggctgcagctcgcct

SEQ ID NO: 7194242 - DNA, 22 bp, Homo sapiens
caggcctggctgcagctcgcct

SEQ ID NO: 7194243 - DNA, 22 bp, Homo sapiens
caggcctggctgcagctcgcct

SEQ ID NO: 7194244 - DNA, 22 bp, Homo sapiens
caggcctggctgcagctcgcct

SEQ ID NO: 7194245 - DNA, 22 bp, Homo sapiens
caggcctggcccccggcacacc

SEQ ID NO: 7194246 - DNA, 22 bp, Homo sapiens
caggcctggctgcagctcgcct

SEQ ID NO: 7194247 - DNA, 22 bp, Homo sapiens
caggcctgggctgggtatcagg

SEQ ID NO: 7194248 - DNA, 22 bp, Homo sapiens
caggcctgggcttcggggctga

SEQ ID NO: 7194249 - DNA, 22 bp, Homo sapiens
caggcctgggcttcggggctga

SEQ ID NO: 7194250 - DNA, 22 bp, Homo sapiens
caggcctgggcttcggggctga

SEQ ID NO: 7194251 - DNA, 22 bp, Homo sapiens
caggcctgggcttcggggctga

SEQ ID NO: 7194252 - DNA, 22 bp, Homo sapiens
caggcctggagtgcaatggcac

SEQ ID NO: 7194253 - DNA, 22 bp, Homo sapiens
caggcctcctatgagcactagc

SEQ ID NO: 7194254 - DNA, 22 bp, Homo sapiens
caggcctcctatgagcactagc

SEQ ID NO: 7194255 - DNA, 22 bp, Homo sapiens
caggcctggcccccggcacacc

SEQ ID NO: 7194256 - DNA, 22 bp, Homo sapiens
caggcctcccggtgcacactga

SEQ ID NO: 7194257 - DNA, 22 bp, Homo sapiens
caggcctccactccacgcagac

SEQ ID NO: 7194258 - DNA, 22 bp, Homo sapiens
caggcctcccggtgcacactga

SEQ ID NO: 7194259 - DNA, 22 bp, Homo sapiens
agctgtggccagatgtgagcgg

SEQ ID NO: 7194260 - DNA, 22 bp, Homo sapiens
agctgtggccagatgtgagcgg

SEQ ID NO: 7194261 - DNA, 22 bp, Homo sapiens
agctgtggcagcagccgtggca

SEQ ID NO: 7194262 - DNA, 22 bp, Homo sapiens
agctgtggcagcagccgtggca

SEQ ID NO: 7194263 - DNA, 22 bp, Homo sapiens
agctgtgtagggaatcagagaa

SEQ ID NO: 7194264 - DNA, 22 bp, Homo sapiens
agctgtgtcctgaagacactgc

SEQ ID NO: 7194265 - DNA, 22 bp, Homo sapiens
agctgtgtcatcctggaaaatg

SEQ ID NO: 7194266 - DNA, 22 bp, Homo sapiens
agctgtgtgacctagggcaagc

SEQ ID NO: 7194267 - DNA, 22 bp, Homo sapiens
agctgtgtgactctaagcaagt

SEQ ID NO: 7194268 - DNA, 22 bp, Homo sapiens
agctgtgtgcatttgggtctca

SEQ ID NO: 7194269 - DNA, 22 bp, Homo sapiens
agctgtgtgcatttgggtctca

SEQ ID NO: 7194270 - DNA, 22 bp, Homo sapiens
agctgtgtgccaggggagatgt

SEQ ID NO: 7194271 - DNA, 22 bp, Homo sapiens
agctgtgtgccaggggagatgt

SEQ ID NO: 7194272 - DNA, 22 bp, Homo sapiens
caggcctgggcttcggggctga

SEQ ID NO: 7194273 - DNA, 22 bp, Homo sapiens
caggcctggggctggcttccag

SEQ ID NO: 7194274 - DNA, 22 bp, Homo sapiens
caggcctggggctggcttccag

SEQ ID NO: 7194275 - DNA, 22 bp, Homo sapiens
caggcctgggttcaaatccctt

SEQ ID NO: 7194276 - DNA, 22 bp, Homo sapiens
caggcctgggttcaaatccctt

SEQ ID NO: 7194277 - DNA, 22 bp, Homo sapiens
caggcctggttgagccctgaga

SEQ ID NO: 7194278 - DNA, 22 bp, Homo sapiens
caggcctggttgagccctgaga

SEQ ID NO: 7194279 - DNA, 22 bp, Homo sapiens
caggcctggttgagccctgaga

SEQ ID NO: 7194280 - DNA, 22 bp, Homo sapiens
caggcctggttgagccctgaga

SEQ ID NO: 7194281 - DNA, 22 bp, Homo sapiens
agctggcattacaggagcatgc

SEQ ID NO: 7194282 - DNA, 22 bp, Homo sapiens
agctggcattacaggagcatgc

SEQ ID NO: 7194283 - DNA, 22 bp, Homo sapiens
agctggcattacaggagcatgc

SEQ ID NO: 7194284 - DNA, 22 bp, Homo sapiens
agctggcattctccttgttatt

SEQ ID NO: 7194285 - DNA, 22 bp, Homo sapiens
agctggcattgaagaatggtta

SEQ ID NO: 7194286 - DNA, 22 bp, Homo sapiens
agctggcattgaagaatggtta

SEQ ID NO: 7194287 - DNA, 22 bp, Homo sapiens
agctggcatctgaagtcagggc

SEQ ID NO: 7194288 - DNA, 22 bp, Homo sapiens
agctggcatctgaagtcagggc

SEQ ID NO: 7194289 - DNA, 22 bp, Homo sapiens
agctggcatctgaagtcagggc

SEQ ID NO: 7194290 - DNA, 22 bp, Homo sapiens
agctggcattgcagggagctgc

SEQ ID NO: 7194291 - DNA, 22 bp, Homo sapiens
agctggcattgcagggagctgc

SEQ ID NO: 7194292 - DNA, 22 bp, Homo sapiens
agctggcattgcagggagctgc

SEQ ID NO: 7194293 - DNA, 22 bp, Homo sapiens
agctggcattgcagggagctgc

SEQ ID NO: 7194294 - DNA, 22 bp, Homo sapiens
agctggccagatgtcccaaaga

SEQ ID NO: 7194295 - DNA, 22 bp, Homo sapiens
agctggccagcacctccaggtc

SEQ ID NO: 7194296 - DNA, 22 bp, Homo sapiens
agctggccagcacctccaggtc

SEQ ID NO: 7194297 - DNA, 22 bp, Homo sapiens
agctggccagcacctccaggtc

SEQ ID NO: 7194298 - DNA, 22 bp, Homo sapiens
agctggccagcacctccaggtc

SEQ ID NO: 7194299 - DNA, 22 bp, Homo sapiens
agctggccattgtgagtggcct

SEQ ID NO: 7194300 - DNA, 22 bp, Homo sapiens
caggagggtgtggaaaactggg

SEQ ID NO: 7194301 - DNA, 22 bp, Homo sapiens
caggagggtgtggaaaactggg

SEQ ID NO: 7194302 - DNA, 22 bp, Homo sapiens
caggagggtgtggaaaactggg

SEQ ID NO: 7194303 - DNA, 22 bp, Homo sapiens
caggaggtacatagattcagat

SEQ ID NO: 7194304 - DNA, 22 bp, Homo sapiens
caggaggtgaaggagaaccagt

SEQ ID NO: 7194305 - DNA, 22 bp, Homo sapiens
caggaggtgaaggagaaccagt

SEQ ID NO: 7194306 - DNA, 22 bp, Homo sapiens
caggaggtacatagattcagat

SEQ ID NO: 7194307 - DNA, 22 bp, Homo sapiens
caggaggtacatagattcagat

SEQ ID NO: 7194308 - DNA, 22 bp, Homo sapiens
caggaggtgccctctagtggca

SEQ ID NO: 7194309 - DNA, 22 bp, Homo sapiens
caggaggtgccctctagtggca

SEQ ID NO: 7194310 - DNA, 22 bp, Homo sapiens
caggaggtggagctcaagtggt

SEQ ID NO: 7194311 - DNA, 22 bp, Homo sapiens
caggaggttgagggtgcagtga

SEQ ID NO: 7194312 - DNA, 22 bp, Homo sapiens
caggaggttgagggtgcagtga

SEQ ID NO: 7194313 - DNA, 22 bp, Homo sapiens
caggaggttggtagcagtagat

SEQ ID NO: 7194314 - DNA, 22 bp, Homo sapiens
caggaggttggtagcagtagat

SEQ ID NO: 7194315 - DNA, 22 bp, Homo sapiens
caggaggttgtaagagcaggcc

SEQ ID NO: 7194316 - DNA, 22 bp, Homo sapiens
caggaggttgtaagagcaggcc

SEQ ID NO: 7194317 - DNA, 22 bp, Homo sapiens
caggagtccagagtgtcatttt

SEQ ID NO: 7194318 - DNA, 22 bp, Homo sapiens
agctggctgccttctccttagg

SEQ ID NO: 7194319 - DNA, 20 bp, Homo sapiens
agctggcctgtcctaggcct

SEQ ID NO: 7194320 - DNA, 20 bp, Homo sapiens
agctggcctgtcctaggcct

SEQ ID NO: 7194321 - DNA, 22 bp, Homo sapiens
agctggctgccttctccttagg

SEQ ID NO: 7194322 - DNA, 22 bp, Homo sapiens
agctggctggccccttcctgcc

SEQ ID NO: 7194323 - DNA, 22 bp, Homo sapiens
agctggctggccccttcctgcc

SEQ ID NO: 7194324 - DNA, 22 bp, Homo sapiens
agctggctggccccttcctgcc

SEQ ID NO: 7194325 - DNA, 22 bp, Homo sapiens
caggagtctctcttgagcccag

SEQ ID NO: 7194326 - DNA, 22 bp, Homo sapiens
agctggcctccgggtgcctggg

SEQ ID NO: 7194327 - DNA, 21 bp, Homo sapiens
agctggcctggtttgagctcc

SEQ ID NO: 7194328 - DNA, 22 bp, Homo sapiens
agctggctgggtgccagtctcc

SEQ ID NO: 7194329 - DNA, 22 bp, Homo sapiens
agctggctgggtgccagtctcc

SEQ ID NO: 7194330 - DNA, 22 bp, Homo sapiens
agctggctgggtgccagtctcc

SEQ ID NO: 7194331 - DNA, 22 bp, Homo sapiens
agctggcttcacaggcagtgtg

SEQ ID NO: 7194332 - DNA, 22 bp, Homo sapiens
agctggcttctctgcagacatt

SEQ ID NO: 7194333 - DNA, 22 bp, Homo sapiens
agctggcttcacaggcagtgtg

SEQ ID NO: 7194334 - DNA, 22 bp, Homo sapiens
agctggcttctctgcagacatt

SEQ ID NO: 7194335 - DNA, 22 bp, Homo sapiens
agctggcttgcatgctaaggag

SEQ ID NO: 7194336 - DNA, 22 bp, Homo sapiens
agctggcttgcatgctaaggag

SEQ ID NO: 7194337 - DNA, 22 bp, Homo sapiens
agctggctttatggttggctaa

SEQ ID NO: 7194338 - DNA, 22 bp, Homo sapiens
agctggctttatggttggctaa

SEQ ID NO: 7194339 - DNA, 22 bp, Homo sapiens
agctggctttgagctgggaggt

SEQ ID NO: 7194340 - DNA, 22 bp, Homo sapiens
agctggctttgagctgggaggt

SEQ ID NO: 7194341 - DNA, 22 bp, Homo sapiens
agctgctccctatcctttcctt

SEQ ID NO: 7194342 - DNA, 22 bp, Homo sapiens
agctgctccttggctgtggttc

SEQ ID NO: 7194343 - DNA, 22 bp, Homo sapiens
agctgctcctttcctgcaggcg

SEQ ID NO: 7194344 - DNA, 21 bp, Homo sapiens
agctgctccagggagctcagg

SEQ ID NO: 7194345 - DNA, 22 bp, Homo sapiens
agctgcctggccggagccactg

SEQ ID NO: 7194346 - DNA, 22 bp, Homo sapiens
agctgcctggccggagccactg

SEQ ID NO: 7194347 - DNA, 22 bp, Homo sapiens
agctgctcattcccagcacatg

SEQ ID NO: 7194348 - DNA, 22 bp, Homo sapiens
agctgctccaatttttaccatt

SEQ ID NO: 7194349 - DNA, 22 bp, Homo sapiens
caggaaaaggagactttagcac

SEQ ID NO: 7194350 - DNA, 22 bp, Homo sapiens
agctgcctggagtcatttcctg

SEQ ID NO: 7194351 - DNA, 21 bp, Homo sapiens
caggaaaagcggaagtctagc

SEQ ID NO: 7194352 - DNA, 21 bp, Homo sapiens
caggaaaagcggaagtctagc

SEQ ID NO: 7194353 - DNA, 21 bp, Homo sapiens
caggaaaagcggaagtctagc

SEQ ID NO: 7194354 - DNA, 22 bp, Homo sapiens
caggaaaaatgccaggagtcag

SEQ ID NO: 7194355 - DNA, 22 bp, Homo sapiens
caggaaaaatgccaggagtcag

SEQ ID NO: 7194356 - DNA, 22 bp, Homo sapiens
caggaaaaatgccaggagtcag

SEQ ID NO: 7194357 - DNA, 21 bp, Homo sapiens
caggaaaagcggaagtctagc

SEQ ID NO: 7194358 - DNA, 21 bp, Homo sapiens
caggaaaagcggaagtctagc

SEQ ID NO: 7194359 - DNA, 21 bp, Homo sapiens
caggaaaagcggaagtctagc

SEQ ID NO: 7194360 - DNA, 22 bp, Homo sapiens
agctgctccttggctgtggttc

SEQ ID NO: 7194361 - DNA, 22 bp, Homo sapiens
agctgctcctttcctgcaggcg

SEQ ID NO: 7194362 - DNA, 22 bp, Homo sapiens
agctgctcgaagccggtggccc

SEQ ID NO: 7194363 - DNA, 22 bp, Homo sapiens
agctgctctacatgatggggaa

SEQ ID NO: 7194364 - DNA, 22 bp, Homo sapiens
agctgctctcagcagttccagg

SEQ ID NO: 7194365 - DNA, 20 bp, Homo sapiens
agctgctctcatccagacct

SEQ ID NO: 7194366 - DNA, 22 bp, Homo sapiens
agctgctctgagccctgattct

SEQ ID NO: 7194367 - DNA, 22 bp, Homo sapiens
agctgctctgagccctgattct

SEQ ID NO: 7194368 - DNA, 22 bp, Homo sapiens
agctgctcttgggtgacttcaa

SEQ ID NO: 7194369 - DNA, 22 bp, Homo sapiens
agctgctctttgaaggacactt

SEQ ID NO: 7194370 - DNA, 22 bp, Homo sapiens
agctgctctttgaaggacactt

SEQ ID NO: 7194371 - DNA, 22 bp, Homo sapiens
agctgctctttgaaggacactt

SEQ ID NO: 7194372 - DNA, 22 bp, Homo sapiens
agctgctgaagtgagagaattg

SEQ ID NO: 7194373 - DNA, 22 bp, Homo sapiens
agctgctgaagtgagagaattg

SEQ ID NO: 7194374 - DNA, 22 bp, Homo sapiens
agctgctgaagtgagagaattg

SEQ ID NO: 7194375 - DNA, 22 bp, Homo sapiens
agctgctgaatgacactgcaag

SEQ ID NO: 7194376 - DNA, 22 bp, Homo sapiens
agctgctgagagtctgccgggc

SEQ ID NO: 7194377 - DNA, 22 bp, Homo sapiens
agctgctgagagtctgccgggc

SEQ ID NO: 7194378 - DNA, 22 bp, Homo sapiens
agctgctgagccaggctgatgt

SEQ ID NO: 7194379 - DNA, 22 bp, Homo sapiens
agctgctgagccaggctgatgt

SEQ ID NO: 7194380 - DNA, 22 bp, Homo sapiens
agctgctgagccaggctgatgt

SEQ ID NO: 7194381 - DNA, 19 bp, Homo sapiens
caggacagacttcaaagcc

SEQ ID NO: 7194382 - DNA, 19 bp, Homo sapiens
caggacagacttcaaagcc

SEQ ID NO: 7194383 - DNA, 19 bp, Homo sapiens
caggacagacttcaaagcc

SEQ ID NO: 7194384 - DNA, 19 bp, Homo sapiens
caggacagacttcaaagcc

SEQ ID NO: 7194385 - DNA, 22 bp, Homo sapiens
caggacagaccaagatcgtgct

SEQ ID NO: 7194386 - DNA, 22 bp, Homo sapiens
caggacagaccaagatcgtgct

SEQ ID NO: 7194387 - DNA, 22 bp, Homo sapiens
caggacagaccaagatcgtgct

SEQ ID NO: 7194388 - DNA, 22 bp, Homo sapiens
caggacagaccaagatcgtgct

SEQ ID NO: 7194389 - DNA, 22 bp, Homo sapiens
caggacagaccaagatcgtgct

SEQ ID NO: 7194390 - DNA, 22 bp, Homo sapiens
caggacagaccaagatcgtgct

SEQ ID NO: 7194391 - DNA, 22 bp, Homo sapiens
caggacagacagaatgcctaac

SEQ ID NO: 7194392 - DNA, 22 bp, Homo sapiens
caggacagacagaatgcctaac

SEQ ID NO: 7194393 - DNA, 22 bp, Homo sapiens
caggacagacagaatgcctaac

SEQ ID NO: 7194394 - DNA, 22 bp, Homo sapiens
caggacagacagaatgcctaac

SEQ ID NO: 7194395 - DNA, 22 bp, Homo sapiens
caggacagaaataaggaatata

SEQ ID NO: 7194396 - DNA, 22 bp, Homo sapiens
caggacagaaataaggaatata

SEQ ID NO: 7194397 - DNA, 22 bp, Homo sapiens
caggacagacagaatgcctaac

SEQ ID NO: 7194398 - DNA, 22 bp, Homo sapiens
caggacagacagaatgcctaac

SEQ ID NO: 7194399 - DNA, 22 bp, Homo sapiens
caggacagaaataaggaatata

SEQ ID NO: 7194400 - DNA, 22 bp, Homo sapiens
caggacagaaataaggaatata

SEQ ID NO: 7194401 - DNA, 22 bp, Homo sapiens
caggacagaaataaggaatata

SEQ ID NO: 7194402 - DNA, 22 bp, Homo sapiens
caggacagaaataaggaatata

SEQ ID NO: 7194403 - DNA, 22 bp, Homo sapiens
agctggcagtcatcctagtgag

SEQ ID NO: 7194404 - DNA, 22 bp, Homo sapiens
agctggcagtatgactggtgac

SEQ ID NO: 7194405 - DNA, 22 bp, Homo sapiens
agctggcagtcggccttgatgc

SEQ ID NO: 7194406 - DNA, 22 bp, Homo sapiens
agctggcagtcatcctagtgag

SEQ ID NO: 7194407 - DNA, 22 bp, Homo sapiens
agctggcagttgcgataatgca

SEQ ID NO: 7194408 - DNA, 22 bp, Homo sapiens
agctggcatactttgctaggaa

SEQ ID NO: 7194409 - DNA, 22 bp, Homo sapiens
agctggcatactttgctaggaa

SEQ ID NO: 7194410 - DNA, 21 bp, Homo sapiens
agctggcagtgcctggacctc

SEQ ID NO: 7194411 - DNA, 22 bp, Homo sapiens
agctggcagtcggccttgatgc

SEQ ID NO: 7194412 - DNA, 22 bp, Homo sapiens
caggacagagcccagactgtgt

SEQ ID NO: 7194413 - DNA, 22 bp, Homo sapiens
caggacagagcccagactgtgt

SEQ ID NO: 7194414 - DNA, 19 bp, Homo sapiens
caggacagacttcaaagcc

SEQ ID NO: 7194415 - DNA, 22 bp, Homo sapiens
caggacagagcccagactgtgt

SEQ ID NO: 7194416 - DNA, 22 bp, Homo sapiens
caggacagagcccagactgtgt

SEQ ID NO: 7194417 - DNA, 22 bp, Homo sapiens
caggacagagcccagactgtgt

SEQ ID NO: 7194418 - DNA, 22 bp, Homo sapiens
agctggaggataactcacttct

SEQ ID NO: 7194419 - DNA, 22 bp, Homo sapiens
agctggcagtatgactggtgac

SEQ ID NO: 7194420 - DNA, 22 bp, Homo sapiens
agctggcagtatgactggtgac

SEQ ID NO: 7194421 - DNA, 22 bp, Homo sapiens
agctctcttccagatccacttg

SEQ ID NO: 7194422 - DNA, 22 bp, Homo sapiens
agctctcttgtgttctgtatgg

SEQ ID NO: 7194423 - DNA, 22 bp, Homo sapiens
agctctcttgtgttctgtatgg

SEQ ID NO: 7194424 - DNA, 22 bp, Homo sapiens
agctcctgtgtgaagcctccct

SEQ ID NO: 7194425 - DNA, 22 bp, Homo sapiens
agctctcccaccttcttcttac

SEQ ID NO: 7194426 - DNA, 22 bp, Homo sapiens
agctctcccatagggcaagatc

SEQ ID NO: 7194427 - DNA, 18 bp, Homo sapiens
agctctcccccacatgcc

SEQ ID NO: 7194428 - DNA, 18 bp, Homo sapiens
agctctcccccacatgcc

SEQ ID NO: 7194429 - DNA, 18 bp, Homo sapiens
agctctcccccacatgcc

SEQ ID NO: 7194430 - DNA, 18 bp, Homo sapiens
agctctcccccacatgcc

SEQ ID NO: 7194431 - DNA, 22 bp, Homo sapiens
agctctctcatgacagtgcagt

SEQ ID NO: 7194432 - DNA, 22 bp, Homo sapiens
agctctctcatgacagtgcagt

SEQ ID NO: 7194433 - DNA, 22 bp, Homo sapiens
agctctgacattgattctcagc

SEQ ID NO: 7194434 - DNA, 22 bp, Homo sapiens
agctctgactgaagagatgcaa

SEQ ID NO: 7194435 - DNA, 16 bp, Homo sapiens
agctctgagtagagtt

SEQ ID NO: 7194436 - DNA, 22 bp, Homo sapiens
agctctgatctttacaacaaag

SEQ ID NO: 7194437 - DNA, 22 bp, Homo sapiens
agctctgatctttacaacaaag

SEQ ID NO: 7194438 - DNA, 22 bp, Homo sapiens
agctctgctactctgtggggtg

SEQ ID NO: 7194439 - DNA, 23 bp, Homo sapiens
agctctgctcgggcatgccctgc

SEQ ID NO: 7194440 - DNA, 22 bp, Homo sapiens
agctctgcttcttgggaagatg

SEQ ID NO: 7194441 - DNA, 22 bp, Homo sapiens
agctctggaactcccggctgct

SEQ ID NO: 7194442 - DNA, 22 bp, Homo sapiens
agctctggaactcccggctgct

SEQ ID NO: 7194443 - DNA, 22 bp, Homo sapiens
agctctggaactcccggctgct

SEQ ID NO: 7194444 - DNA, 22 bp, Homo sapiens
agctctgcaggcacagctgagg

SEQ ID NO: 7194445 - DNA, 22 bp, Homo sapiens
agctctgcaggcacagctgagg

SEQ ID NO: 7194446 - DNA, 22 bp, Homo sapiens
agctctgcaggcacagctgagg

SEQ ID NO: 7194447 - DNA, 22 bp, Homo sapiens
agctctgccttgacaccttctc

SEQ ID NO: 7194448 - DNA, 22 bp, Homo sapiens
agctctgccttgacaccttctc

SEQ ID NO: 7194449 - DNA, 22 bp, Homo sapiens
agctctggaagccctggtagtt

SEQ ID NO: 7194450 - DNA, 22 bp, Homo sapiens
agctctggaagccctggtagtt

SEQ ID NO: 7194451 - DNA, 22 bp, Homo sapiens
agctctggaagccctggtagtt

SEQ ID NO: 7194452 - DNA, 22 bp, Homo sapiens
cagctcctgcagctggctccca

SEQ ID NO: 7194453 - DNA, 22 bp, Homo sapiens
cagctcctgcagctggctccca

SEQ ID NO: 7194454 - DNA, 22 bp, Homo sapiens
cagctcctgcctgggcagctgt

SEQ ID NO: 7194455 - DNA, 22 bp, Homo sapiens
cagctcctgggccatctcctag

SEQ ID NO: 7194456 - DNA, 22 bp, Homo sapiens
cagctcctgggccatctcctag

SEQ ID NO: 7194457 - DNA, 22 bp, Homo sapiens
cagctcctgttggtcttgagga

SEQ ID NO: 7194458 - DNA, 22 bp, Homo sapiens
cagctcctgggccatctcctag

SEQ ID NO: 7194459 - DNA, 22 bp, Homo sapiens
cagctctgaagaaaggtgtcta

SEQ ID NO: 7194460 - DNA, 22 bp, Homo sapiens
cagctctgaagaaaggtgtcta

SEQ ID NO: 7194461 - DNA, 22 bp, Homo sapiens
cagctctgaagaaaggtgtcta

SEQ ID NO: 7194462 - DNA, 22 bp, Homo sapiens
cagctctgaagaaaggtgtcta

SEQ ID NO: 7194463 - DNA, 22 bp, Homo sapiens
cagctctgacacagtacaaaat

SEQ ID NO: 7194464 - DNA, 22 bp, Homo sapiens
cagctgttgtcacctcacatcc

SEQ ID NO: 7194465 - DNA, 22 bp, Homo sapiens
cagctgttgtctctcacatatt

SEQ ID NO: 7194466 - DNA, 22 bp, Homo sapiens
cagctgttgtgatccatttacg

SEQ ID NO: 7194467 - DNA, 22 bp, Homo sapiens
cagctctcacacttagcttcta

SEQ ID NO: 7194468 - DNA, 22 bp, Homo sapiens
cagctctcacaccctcctccca

SEQ ID NO: 7194469 - DNA, 22 bp, Homo sapiens
cagctctcacaccctcctccca

SEQ ID NO: 7194470 - DNA, 22 bp, Homo sapiens
cagctctcacacttagcttcta

SEQ ID NO: 7194471 - DNA, 22 bp, Homo sapiens
cagctctccaccctcctggttc

SEQ ID NO: 7194472 - DNA, 22 bp, Homo sapiens
cagctctccaccctcctggttc

SEQ ID NO: 7194473 - DNA, 22 bp, Homo sapiens
cagctctccaccctcctggttc

SEQ ID NO: 7194474 - DNA, 22 bp, Homo sapiens
cagctctccaccctcctggttc

SEQ ID NO: 7194475 - DNA, 22 bp, Homo sapiens
cagctctctaaggtcttgcttt

SEQ ID NO: 7194476 - DNA, 22 bp, Homo sapiens
cagctctctaaggtcttgcttt

SEQ ID NO: 7194477 - DNA, 22 bp, Homo sapiens
cagctctcacaccctcctccca

SEQ ID NO: 7194478 - DNA, 22 bp, Homo sapiens
cagctctcacaccctcctccca

SEQ ID NO: 7194479 - DNA, 22 bp, Homo sapiens
cagctctactgggcaccattcg

SEQ ID NO: 7194480 - DNA, 22 bp, Homo sapiens
cagctctcacaccctcctccca

SEQ ID NO: 7194481 - DNA, 22 bp, Homo sapiens
cagctcctgttggtcttgagga

SEQ ID NO: 7194482 - DNA, 23 bp, Homo sapiens
cagctcgcttttgttccctccct

SEQ ID NO: 7194483 - DNA, 22 bp, Homo sapiens
cagctgttgtgatccatttacg

SEQ ID NO: 7194484 - DNA, 22 bp, Homo sapiens
cagcttctgctcatggaggggt

SEQ ID NO: 7194485 - DNA, 22 bp, Homo sapiens
cagcttctgctcatggaggggt

SEQ ID NO: 7194486 - DNA, 22 bp, Homo sapiens
cagcttctggcgtggagcctga

SEQ ID NO: 7194487 - DNA, 22 bp, Homo sapiens
cagcttctggcgtggagcctga

SEQ ID NO: 7194488 - DNA, 22 bp, Homo sapiens
cagcttctgtcctagaaactgg

SEQ ID NO: 7194489 - DNA, 22 bp, Homo sapiens
cagcttctggcgtggagcctga

SEQ ID NO: 7194490 - DNA, 22 bp, Homo sapiens
cagcttctgtctgattagcaag

SEQ ID NO: 7194491 - DNA, 22 bp, Homo sapiens
cagcttctgtttattgtgtgcc

SEQ ID NO: 7194492 - DNA, 22 bp, Homo sapiens
cagcttctgtttattgtgtgcc

SEQ ID NO: 7194493 - DNA, 22 bp, Homo sapiens
cagcttctgtttctagcccctg

SEQ ID NO: 7194494 - DNA, 22 bp, Homo sapiens
cagcttctgtttctagcccctg

SEQ ID NO: 7194495 - DNA, 22 bp, Homo sapiens
cagcttcttacgagctggtact

SEQ ID NO: 7194496 - DNA, 22 bp, Homo sapiens
cagcttcttagtctttccttgt

SEQ ID NO: 7194497 - DNA, 22 bp, Homo sapiens
cagcttcttagtctttccttgt

SEQ ID NO: 7194498 - DNA, 22 bp, Homo sapiens
cagcttcttcagtcctggagct

SEQ ID NO: 7194499 - DNA, 22 bp, Homo sapiens
cagcttcttcagtcctggagct

SEQ ID NO: 7194500 - DNA, 22 bp, Homo sapiens
cagcttcttcagtcctggagct

SEQ ID NO: 7194501 - DNA, 21 bp, Homo sapiens
cagcttcttctgtgacctggt

SEQ ID NO: 7194502 - DNA, 21 bp, Homo sapiens
cagcttcttctgtgacctggt

SEQ ID NO: 7194503 - DNA, 22 bp, Homo sapiens
cagcttctttgggattctttat

SEQ ID NO: 7194504 - DNA, 22 bp, Homo sapiens
agctgaggctctgagagggaag

SEQ ID NO: 7194505 - DNA, 22 bp, Homo sapiens
agctgaggcctgatttcgccgt

SEQ ID NO: 7194506 - DNA, 22 bp, Homo sapiens
agctgaggccacgagtgaaggg

SEQ ID NO: 7194507 - DNA, 22 bp, Homo sapiens
agctgaggccacgagtgaaggg

SEQ ID NO: 7194508 - DNA, 22 bp, Homo sapiens
agctgaggccacgagtgaaggg

SEQ ID NO: 7194509 - DNA, 22 bp, Homo sapiens
agctgaggcatggacaggctgc

SEQ ID NO: 7194510 - DNA, 22 bp, Homo sapiens
agctgaggcatggacaggctgc

SEQ ID NO: 7194511 - DNA, 22 bp, Homo sapiens
agctgaggcatggacaggctgc

SEQ ID NO: 7194512 - DNA, 22 bp, Homo sapiens
agctgaggcatggacaggctgc

SEQ ID NO: 7194513 - DNA, 22 bp, Homo sapiens
agctgaggccacgagtgaaggg

SEQ ID NO: 7194514 - DNA, 22 bp, Homo sapiens
agctgaggcatggacaggctgc

SEQ ID NO: 7194515 - DNA, 22 bp, Homo sapiens
agctgaggcatgatgctatcag

SEQ ID NO: 7194516 - DNA, 22 bp, Homo sapiens
agctgaggcatgatgctatcag

SEQ ID NO: 7194517 - DNA, 22 bp, Homo sapiens
cagcttgcagtacttgtttttg

SEQ ID NO: 7194518 - DNA, 23 bp, Homo sapiens
cagcttctttgggattctttata

SEQ ID NO: 7194519 - DNA, 23 bp, Homo sapiens
cagcttctttgggattctttata

SEQ ID NO: 7194520 - DNA, 23 bp, Homo sapiens
agctgaggctgtgggtgtcagag

SEQ ID NO: 7194521 - DNA, 23 bp, Homo sapiens
agctgaggctgtgggtgtcagag

SEQ ID NO: 7194522 - DNA, 23 bp, Homo sapiens
agctgaggctgtgggtgtcagag

SEQ ID NO: 7194523 - DNA, 23 bp, Homo sapiens
agctgaggctgtgggtgtcagag

SEQ ID NO: 7194524 - DNA, 22 bp, Homo sapiens
agctgaggctctgagagggaag

SEQ ID NO: 7194525 - DNA, 22 bp, Homo sapiens
agctgaggctctgagagggaag

SEQ ID NO: 7194526 - DNA, 22 bp, Homo sapiens
agctgaggctctgagagggaag

SEQ ID NO: 7194527 - DNA, 22 bp, Homo sapiens
agctgaggctctgagagggaag

SEQ ID NO: 7194528 - DNA, 22 bp, Homo sapiens
agctgaggctctgagagggaag

SEQ ID NO: 7194529 - DNA, 22 bp, Homo sapiens
agctgcaggcccatgctcagtc

SEQ ID NO: 7194530 - DNA, 22 bp, Homo sapiens
agctgcaggcccatgctcagtc

SEQ ID NO: 7194531 - DNA, 22 bp, Homo sapiens
agctgcagccctcctgcatggc

SEQ ID NO: 7194532 - DNA, 22 bp, Homo sapiens
agctgcagccctcctgcatggc

SEQ ID NO: 7194533 - DNA, 22 bp, Homo sapiens
agctgcagccctcctgcatggc

SEQ ID NO: 7194534 - DNA, 22 bp, Homo sapiens
agctgcagccctcctgcatggc

SEQ ID NO: 7194535 - DNA, 21 bp, Homo sapiens
agctgcagccatgtacatggc

SEQ ID NO: 7194536 - DNA, 22 bp, Homo sapiens
agctgcaggcctctcctgggga

SEQ ID NO: 7194537 - DNA, 21 bp, Homo sapiens
agctgcaggcctcccagggat

SEQ ID NO: 7194538 - DNA, 22 bp, Homo sapiens
agctgcaggttcagcattccac

SEQ ID NO: 7194539 - DNA, 22 bp, Homo sapiens
agctgcagggcttgggtttccc

SEQ ID NO: 7194540 - DNA, 22 bp, Homo sapiens
agctgcaggttcagcattccac

SEQ ID NO: 7194541 - DNA, 22 bp, Homo sapiens
agctgcaggcgccggggccgat

SEQ ID NO: 7194542 - DNA, 22 bp, Homo sapiens
agctgcaggcctctcctgggga

SEQ ID NO: 7194543 - DNA, 22 bp, Homo sapiens
agctgcaggcctctcctgggga

SEQ ID NO: 7194544 - DNA, 22 bp, Homo sapiens
agctgcagtatgaggctggtgg

SEQ ID NO: 7194545 - DNA, 22 bp, Homo sapiens
agctgcagtatgaggctggtgg

SEQ ID NO: 7194546 - DNA, 21 bp, Homo sapiens
agctgcagtcaagccagaggt

SEQ ID NO: 7194547 - DNA, 21 bp, Homo sapiens
agctgcagtcaagccagaggt

SEQ ID NO: 7194548 - DNA, 22 bp, Homo sapiens
agctgcagtatgaggctggtgg

SEQ ID NO: 7194549 - DNA, 21 bp, Homo sapiens
agctgcagtcaagccagaggt

SEQ ID NO: 7194550 - DNA, 22 bp, Homo sapiens
agctgcagtcaagctgggccac

SEQ ID NO: 7194551 - DNA, 22 bp, Homo sapiens
agctgcagtcaagctgggccac

SEQ ID NO: 7194552 - DNA, 22 bp, Homo sapiens
agctgcagtcaagctgggccac

SEQ ID NO: 7194553 - DNA, 22 bp, Homo sapiens
cagctttggcccagtcgggagg

SEQ ID NO: 7194554 - DNA, 22 bp, Homo sapiens
cagctttggagtgtgagtgctg

SEQ ID NO: 7194555 - DNA, 22 bp, Homo sapiens
cagctttgtcatttgatttggg

SEQ ID NO: 7194556 - DNA, 22 bp, Homo sapiens
cagctttgtcctgcaaacctga

SEQ ID NO: 7194557 - DNA, 22 bp, Homo sapiens
cagctttgtcctgcaaacctga

SEQ ID NO: 7194558 - DNA, 16 bp, Homo sapiens
cagctttgtctcctcg

SEQ ID NO: 7194559 - DNA, 22 bp, Homo sapiens
cagctttgtctgattcctcttt

SEQ ID NO: 7194560 - DNA, 22 bp, Homo sapiens
cagctttgtctgattcctcttt

SEQ ID NO: 7194561 - DNA, 22 bp, Homo sapiens
cagctttgattctttctgccat

SEQ ID NO: 7194562 - DNA, 22 bp, Homo sapiens
cagctttgcaggctggtcagtg

SEQ ID NO: 7194563 - DNA, 22 bp, Homo sapiens
cagctttgcaggctggtcagtg

SEQ ID NO: 7194564 - DNA, 22 bp, Homo sapiens
cagctttgccaagtaaggtctt

SEQ ID NO: 7194565 - DNA, 22 bp, Homo sapiens
cagctttgccctttgcccaatc

SEQ ID NO: 7194566 - DNA, 22 bp, Homo sapiens
cagcttttaggactgtgagaaa

SEQ ID NO: 7194567 - DNA, 22 bp, Homo sapiens
cagcttttggcaggatgaccag

SEQ ID NO: 7194568 - DNA, 21 bp, Homo sapiens
cagctttgtctgtcttcgggg

SEQ ID NO: 7194569 - DNA, 21 bp, Homo sapiens
cagctttgtctgtcttcgggg

SEQ ID NO: 7194570 - DNA, 21 bp, Homo sapiens
cagctttgtctgtcttcgggg

SEQ ID NO: 7194571 - DNA, 22 bp, Homo sapiens
cagctttgtgacttcggacaag

SEQ ID NO: 7194572 - DNA, 22 bp, Homo sapiens
cagctttgtgacttcggacaag

SEQ ID NO: 7194573 - DNA, 22 bp, Homo sapiens
cagctttgtgcaatgcagtctc

SEQ ID NO: 7194574 - DNA, 22 bp, Homo sapiens
cagctttgtgcaatgcagtctc

SEQ ID NO: 7194575 - DNA, 22 bp, Homo sapiens
cagctttgtggccttgacctcg

SEQ ID NO: 7194576 - DNA, 22 bp, Homo sapiens
cagcttttaggactgtgagaaa

SEQ ID NO: 7194577 - DNA, 22 bp, Homo sapiens
cattcaaaagctccatgtttgt

SEQ ID NO: 7194578 - DNA, 22 bp, Homo sapiens
cattcaaaatgggctgacctgt

SEQ ID NO: 7194579 - DNA, 22 bp, Homo sapiens
cattcaaaagctccatgtttgt

SEQ ID NO: 7194580 - DNA, 22 bp, Homo sapiens
cattcaaaagctccatgtttgt

SEQ ID NO: 7194581 - DNA, 22 bp, Homo sapiens
cattcaaagcaggaaaggcctt

SEQ ID NO: 7194582 - DNA, 22 bp, Homo sapiens
cattcaaaggcatgtcctattt

SEQ ID NO: 7194583 - DNA, 22 bp, Homo sapiens
cattccaagtatatacatgata

SEQ ID NO: 7194584 - DNA, 18 bp, Homo sapiens
cattccaagttctacctc

SEQ ID NO: 7194585 - DNA, 22 bp, Homo sapiens
cattccaaggccaagtctaaga

SEQ ID NO: 7194586 - DNA, 19 bp, Homo sapiens
aggcagcacccagtccttg

SEQ ID NO: 7194587 - DNA, 22 bp, Homo sapiens
aggcagatattggggtgatgtg

SEQ ID NO: 7194588 - DNA, 19 bp, Homo sapiens
aggcagcacccagtccttg

SEQ ID NO: 7194589 - DNA, 22 bp, Homo sapiens
aggcagcagaaaacaaatggtt

SEQ ID NO: 7194590 - DNA, 19 bp, Homo sapiens
aggcagaggcttggctagc

SEQ ID NO: 7194591 - DNA, 19 bp, Homo sapiens
aggcagaggcttggctagc

SEQ ID NO: 7194592 - DNA, 19 bp, Homo sapiens
aggcagaggcttggctagc

SEQ ID NO: 7194593 - DNA, 22 bp, Homo sapiens
cattccctgtctcttcaatcct

SEQ ID NO: 7194594 - DNA, 22 bp, Homo sapiens
cattcccttggggagttcatgc

SEQ ID NO: 7194595 - DNA, 22 bp, Homo sapiens
cattccctgtctcttcaatcct

SEQ ID NO: 7194596 - DNA, 22 bp, Homo sapiens
cattcccttggggagttcatgc

SEQ ID NO: 7194597 - DNA, 22 bp, Homo sapiens
cattcccttggggagttcatgc

SEQ ID NO: 7194598 - DNA, 22 bp, Homo sapiens
cattaacactttggatttagac

SEQ ID NO: 7194599 - DNA, 22 bp, Homo sapiens
cattaacactttggatttagac

SEQ ID NO: 7194600 - DNA, 22 bp, Homo sapiens
catggctcggggacaggaggta

SEQ ID NO: 7194601 - DNA, 22 bp, Homo sapiens
catggccttgagtgactgcact

SEQ ID NO: 7194602 - DNA, 22 bp, Homo sapiens
catggcggtcaggatgtaggtg

SEQ ID NO: 7194603 - DNA, 22 bp, Homo sapiens
catggcctctctcctggaatgg

SEQ ID NO: 7194604 - DNA, 22 bp, Homo sapiens
catggcctgcctcctcctggtg

SEQ ID NO: 7194605 - DNA, 22 bp, Homo sapiens
catggcctgcctcctcctggtg

SEQ ID NO: 7194606 - DNA, 22 bp, Homo sapiens
catggccttcacctcccctgcc

SEQ ID NO: 7194607 - DNA, 22 bp, Homo sapiens
catggccctcttctggagcaat

SEQ ID NO: 7194608 - DNA, 22 bp, Homo sapiens
catggcctcaaaggactgcaga

SEQ ID NO: 7194609 - DNA, 20 bp, Homo sapiens
cattatggttgggcacagtg

SEQ ID NO: 7194610 - DNA, 20 bp, Homo sapiens
cattatggttgggcacagtg

SEQ ID NO: 7194611 - DNA, 22 bp, Homo sapiens
cattatggcagccaggatattg

SEQ ID NO: 7194612 - DNA, 22 bp, Homo sapiens
cattatggcagccaggatattg

SEQ ID NO: 7194613 - DNA, 22 bp, Homo sapiens
cattatggaagacagtgtggtg

SEQ ID NO: 7194614 - DNA, 22 bp, Homo sapiens
cattatggaagtgaagagctct

SEQ ID NO: 7194615 - DNA, 22 bp, Homo sapiens
cattatctgccattgacaccat

SEQ ID NO: 7194616 - DNA, 22 bp, Homo sapiens
cattatgaagcatcatcttatt

SEQ ID NO: 7194617 - DNA, 22 bp, Homo sapiens
cattatgaatggagtttgaggt

SEQ ID NO: 7194618 - DNA, 22 bp, Homo sapiens
cattatgtgagtgattaattca

SEQ ID NO: 7194619 - DNA, 22 bp, Homo sapiens
cattatgttcagtagcttaaaa

SEQ ID NO: 7194620 - DNA, 22 bp, Homo sapiens
cattatgttcagtagcttaaaa

SEQ ID NO: 7194621 - DNA, 22 bp, Homo sapiens
cattattgccagccatactgaa

SEQ ID NO: 7194622 - DNA, 22 bp, Homo sapiens
aggcagccagttcaggtttctt

SEQ ID NO: 7194623 - DNA, 22 bp, Homo sapiens
aggcagccagttcaggtttctt

SEQ ID NO: 7194624 - DNA, 22 bp, Homo sapiens
aggcagccatccaggaggctca

SEQ ID NO: 7194625 - DNA, 22 bp, Homo sapiens
aggcagccatccaggaggctca

SEQ ID NO: 7194626 - DNA, 21 bp, Homo sapiens
aggcagccagtcatgctccct

SEQ ID NO: 7194627 - DNA, 21 bp, Homo sapiens
aggcagccagtcatgctccct

SEQ ID NO: 7194628 - DNA, 21 bp, Homo sapiens
aggcagccagtcatgctccct

SEQ ID NO: 7194629 - DNA, 22 bp, Homo sapiens
aggcagccacatgagctcctga

SEQ ID NO: 7194630 - DNA, 22 bp, Homo sapiens
aggcagccacatgagctcctga

SEQ ID NO: 7194631 - DNA, 22 bp, Homo sapiens
aggcagccacatgagctcctga

SEQ ID NO: 7194632 - DNA, 22 bp, Homo sapiens
aggcagccagatggcagcctgc

SEQ ID NO: 7194633 - DNA, 22 bp, Homo sapiens
aggcagccagatggcagcctgc

SEQ ID NO: 7194634 - DNA, 22 bp, Homo sapiens
aggcagccagatggcagcctgc

SEQ ID NO: 7194635 - DNA, 22 bp, Homo sapiens
aggcagccagatggcagcctgc

SEQ ID NO: 7194636 - DNA, 22 bp, Homo sapiens
aggcagccaatcagaggctgac

SEQ ID NO: 7194637 - DNA, 22 bp, Homo sapiens
aggcagccaatcagaggctgac

SEQ ID NO: 7194638 - DNA, 22 bp, Homo sapiens
aggcagccaatcagaggctgac

SEQ ID NO: 7194639 - DNA, 22 bp, Homo sapiens
aggcagccaatcagaggctgac

SEQ ID NO: 7194640 - DNA, 22 bp, Homo sapiens
aggcagcatttgaatccaggtc

SEQ ID NO: 7194641 - DNA, 22 bp, Homo sapiens
aggcagcatttgaatccaggtc

SEQ ID NO: 7194642 - DNA, 22 bp, Homo sapiens
aggcagcatttctgcttatcca

SEQ ID NO: 7194643 - DNA, 22 bp, Homo sapiens
aggcagcatttgaatccaggtc

SEQ ID NO: 7194644 - DNA, 22 bp, Homo sapiens
aggcagcatttgaatccaggtc

SEQ ID NO: 7194645 - DNA, 22 bp, Homo sapiens
aggcagcatttgaatccaggtc

SEQ ID NO: 7194646 - DNA, 22 bp, Homo sapiens
aggcagcatttctgcttatcca

SEQ ID NO: 7194647 - DNA, 22 bp, Homo sapiens
aggcagcatttctgcttatcca

SEQ ID NO: 7194648 - DNA, 19 bp, Homo sapiens
aggcagcattctggggctt

SEQ ID NO: 7194649 - DNA, 19 bp, Homo sapiens
aggcagcattctggggctt

SEQ ID NO: 7194650 - DNA, 19 bp, Homo sapiens
aggcagcattctggggctt

SEQ ID NO: 7194651 - DNA, 22 bp, Homo sapiens
catttacatttaaggttaatat

SEQ ID NO: 7194652 - DNA, 22 bp, Homo sapiens
catttacatttaaggttaatat

SEQ ID NO: 7194653 - DNA, 22 bp, Homo sapiens
aggcagcagtcatgaggaaaga

SEQ ID NO: 7194654 - DNA, 21 bp, Homo sapiens
catttacatgacagattggtt

SEQ ID NO: 7194655 - DNA, 21 bp, Homo sapiens
catttacatgacagattggtt

SEQ ID NO: 7194656 - DNA, 22 bp, Homo sapiens
catttacatttaaggttaatat

SEQ ID NO: 7194657 - DNA, 22 bp, Homo sapiens
catttacatttaaggttaatat

SEQ ID NO: 7194658 - DNA, 22 bp, Homo sapiens
catttacatttaaggttaatat

SEQ ID NO: 7194659 - DNA, 18 bp, Homo sapiens
aggcagcagcatcttctc

SEQ ID NO: 7194660 - DNA, 22 bp, Homo sapiens
aggcagcagaggttgaggaaag

SEQ ID NO: 7194661 - DNA, 22 bp, Homo sapiens
aggcagcagccacaaggcctga

SEQ ID NO: 7194662 - DNA, 22 bp, Homo sapiens
aggcagcagccacaaggcctga

SEQ ID NO: 7194663 - DNA, 22 bp, Homo sapiens
aggcagcagcttgctggttgcc

SEQ ID NO: 7194664 - DNA, 22 bp, Homo sapiens
aggcagcagaggttgaggaaag

SEQ ID NO: 7194665 - DNA, 22 bp, Homo sapiens
aggcagcagaggttgaggaaag

SEQ ID NO: 7194666 - DNA, 22 bp, Homo sapiens
aggcagcagaggttgaggaaag

SEQ ID NO: 7194667 - DNA, 22 bp, Homo sapiens
aggcagcagactgttaatcaga

SEQ ID NO: 7194668 - DNA, 22 bp, Homo sapiens
aggcagcagactgttaatcaga

SEQ ID NO: 7194669 - DNA, 22 bp, Homo sapiens
aggcagcagaaaacaaatggtt

SEQ ID NO: 7194670 - DNA, 22 bp, Homo sapiens
aggcagcagaaaacaaatggtt

SEQ ID NO: 7194671 - DNA, 22 bp, Homo sapiens
catttacataacagtaacgctg

SEQ ID NO: 7194672 - DNA, 22 bp, Homo sapiens
catttacataacagtaacgctg

SEQ ID NO: 7194673 - DNA, 22 bp, Homo sapiens
catttacagtgagagtttttac

SEQ ID NO: 7194674 - DNA, 22 bp, Homo sapiens
catttacataacagtaacgctg

SEQ ID NO: 7194675 - DNA, 21 bp, Homo sapiens
catttacatgacagattggtt

SEQ ID NO: 7194676 - DNA, 21 bp, Homo sapiens
catttacatgacagattggtt

SEQ ID NO: 7194677 - DNA, 22 bp, Homo sapiens
catttacagcagactgatgaaa

SEQ ID NO: 7194678 - DNA, 22 bp, Homo sapiens
catttacagcagactgatgaaa

SEQ ID NO: 7194679 - DNA, 21 bp, Homo sapiens
aggcagcaggatccagggaca

SEQ ID NO: 7194680 - DNA, 21 bp, Homo sapiens
aggcagcaggatccagggaca

SEQ ID NO: 7194681 - DNA, 22 bp, Homo sapiens
catttacagtgagagtttttac

SEQ ID NO: 7194682 - DNA, 22 bp, Homo sapiens
catttacagtgagagtttttac

SEQ ID NO: 7194683 - DNA, 22 bp, Homo sapiens
catttacagtgagagtttttac

SEQ ID NO: 7194684 - DNA, 22 bp, Homo sapiens
catggccaggcccagggcccag

SEQ ID NO: 7194685 - DNA, 22 bp, Homo sapiens
catggccaggcccagggcccag

SEQ ID NO: 7194686 - DNA, 22 bp, Homo sapiens
aggcacaggcctcagcacccag

SEQ ID NO: 7194687 - DNA, 22 bp, Homo sapiens
catggccaggccaagagagtac

SEQ ID NO: 7194688 - DNA, 22 bp, Homo sapiens
aggcacaggcctcagcacccag

SEQ ID NO: 7194689 - DNA, 22 bp, Homo sapiens
aggcacaggaggtggtaagaag

SEQ ID NO: 7194690 - DNA, 22 bp, Homo sapiens
aggcacaggaggtggtaagaag

SEQ ID NO: 7194691 - DNA, 22 bp, Homo sapiens
aggcacaggaggtggtaagaag

SEQ ID NO: 7194692 - DNA, 22 bp, Homo sapiens
aggcacaggcctcagcacccag

SEQ ID NO: 7194693 - DNA, 22 bp, Homo sapiens
aggcacaggcctcagcacccag

SEQ ID NO: 7194694 - DNA, 22 bp, Homo sapiens
aggcacaggcctcagcacccag

SEQ ID NO: 7194695 - DNA, 22 bp, Homo sapiens
aggcacaggaggtggtaagaag

SEQ ID NO: 7194696 - DNA, 22 bp, Homo sapiens
aggcacaggaggtggtaagaag

SEQ ID NO: 7194697 - DNA, 22 bp, Homo sapiens
aggcacaggaggtggtaagaag

SEQ ID NO: 7194698 - DNA, 22 bp, Homo sapiens
aggcacaggaatgtcatccagt

SEQ ID NO: 7194699 - DNA, 22 bp, Homo sapiens
aggcacaggaatgtcatccagt

SEQ ID NO: 7194700 - DNA, 22 bp, Homo sapiens
aggcacaggaatgtcatccagt

SEQ ID NO: 7194701 - DNA, 22 bp, Homo sapiens
aggcacaggaacaggaaaagag

SEQ ID NO: 7194702 - DNA, 22 bp, Homo sapiens
aggcacaggaacaggaaaagag

SEQ ID NO: 7194703 - DNA, 22 bp, Homo sapiens
aggcacaggaacaggaaaagag

SEQ ID NO: 7194704 - DNA, 22 bp, Homo sapiens
aggcacaggaacaggaaaagag

SEQ ID NO: 7194705 - DNA, 22 bp, Homo sapiens
aggcacagcctcccttcacatg

SEQ ID NO: 7194706 - DNA, 22 bp, Homo sapiens
aggcacagcctcccttcacatg

SEQ ID NO: 7194707 - DNA, 22 bp, Homo sapiens
aggcacagcctcccttcacatg

SEQ ID NO: 7194708 - DNA, 22 bp, Homo sapiens
aggcacagcctcccttcacatg

SEQ ID NO: 7194709 - DNA, 22 bp, Homo sapiens
aggcacagcctcccttcacatg

SEQ ID NO: 7194710 - DNA, 22 bp, Homo sapiens
catgcctgtatttctgatctat

SEQ ID NO: 7194711 - DNA, 18 bp, Homo sapiens
catgccttcattcttcat

SEQ ID NO: 7194712 - DNA, 18 bp, Homo sapiens
catgccttcattcttcat

SEQ ID NO: 7194713 - DNA, 22 bp, Homo sapiens
catgcctgtatttctgatctat

SEQ ID NO: 7194714 - DNA, 21 bp, Homo sapiens
aggcaattcgaagttgcagac

SEQ ID NO: 7194715 - DNA, 22 bp, Homo sapiens
aggcaattgtttgtgtaatagg

SEQ ID NO: 7194716 - DNA, 22 bp, Homo sapiens
aggcacaaaagcagggtgacca

SEQ ID NO: 7194717 - DNA, 22 bp, Homo sapiens
aggcacaaaagcagggtgacca

SEQ ID NO: 7194718 - DNA, 22 bp, Homo sapiens
aggcacaaagacagaaaagcac

SEQ ID NO: 7194719 - DNA, 22 bp, Homo sapiens
aggcacagcctcccccaactcc

SEQ ID NO: 7194720 - DNA, 22 bp, Homo sapiens
aggcacagcctcccccaactcc

SEQ ID NO: 7194721 - DNA, 22 bp, Homo sapiens
aggcacagcctcccccaactcc

SEQ ID NO: 7194722 - DNA, 22 bp, Homo sapiens
aggcacagcctcccccaactcc

SEQ ID NO: 7194723 - DNA, 22 bp, Homo sapiens
catgccagggcttgctgcctgg

SEQ ID NO: 7194724 - DNA, 22 bp, Homo sapiens
catgccagggcttgctgcctgg

SEQ ID NO: 7194725 - DNA, 22 bp, Homo sapiens
catgccagggcttgctgcctgg

SEQ ID NO: 7194726 - DNA, 22 bp, Homo sapiens
catgccagttttgagatgcacc

SEQ ID NO: 7194727 - DNA, 23 bp, Homo sapiens
catgccagtttgtgcaggcagat

SEQ ID NO: 7194728 - DNA, 22 bp, Homo sapiens
catgccagttttgagatgcacc

SEQ ID NO: 7194729 - DNA, 23 bp, Homo sapiens
catgccagtttgtgcaggcagat

SEQ ID NO: 7194730 - DNA, 22 bp, Homo sapiens
catgccattccctgatcctaac

SEQ ID NO: 7194731 - DNA, 20 bp, Homo sapiens
catgccatgtctactgaggc

SEQ ID NO: 7194732 - DNA, 20 bp, Homo sapiens
catgccatgtctactgaggc

SEQ ID NO: 7194733 - DNA, 22 bp, Homo sapiens
catgccattaacattagctagc

SEQ ID NO: 7194734 - DNA, 22 bp, Homo sapiens
catgcccagagctccgggcgcc

SEQ ID NO: 7194735 - DNA, 22 bp, Homo sapiens
catgcccagagctccgggcgcc

SEQ ID NO: 7194736 - DNA, 17 bp, Homo sapiens
catgccccaggcttagc

SEQ ID NO: 7194737 - DNA, 20 bp, Homo sapiens
catgcctgctggtatctggc

SEQ ID NO: 7194738 - DNA, 20 bp, Homo sapiens
catgcctgctggtatctggc

SEQ ID NO: 7194739 - DNA, 22 bp, Homo sapiens
catgcctgtaatcccagctctt

SEQ ID NO: 7194740 - DNA, 22 bp, Homo sapiens
catgccaggattaggacccagc

SEQ ID NO: 7194741 - DNA, 22 bp, Homo sapiens
catgcaggcctatggagcagtg

SEQ ID NO: 7194742 - DNA, 22 bp, Homo sapiens
catgccagggcttgctgcctgg

SEQ ID NO: 7194743 - DNA, 22 bp, Homo sapiens
catgcaggcctatggagcagtg

SEQ ID NO: 7194744 - DNA, 22 bp, Homo sapiens
catgcaggcctatggagcagtg

SEQ ID NO: 7194745 - DNA, 21 bp, Homo sapiens
catgcaggatttaacctagaa

SEQ ID NO: 7194746 - DNA, 22 bp, Homo sapiens
catgcaggaggaaaaagcagct

SEQ ID NO: 7194747 - DNA, 22 bp, Homo sapiens
catgcagatgtcatgaggcatg

SEQ ID NO: 7194748 - DNA, 22 bp, Homo sapiens
catgcagatatttttattgtgg

SEQ ID NO: 7194749 - DNA, 22 bp, Homo sapiens
catgcactttgatggagagcgt

SEQ ID NO: 7194750 - DNA, 22 bp, Homo sapiens
catgcactttgatggagagcgt

SEQ ID NO: 7194751 - DNA, 22 bp, Homo sapiens
catgcagaggtgccacgaggct

SEQ ID NO: 7194752 - DNA, 22 bp, Homo sapiens
catgcagatttgctgagataat

SEQ ID NO: 7194753 - DNA, 22 bp, Homo sapiens
catgcagcagaataatgactat

SEQ ID NO: 7194754 - DNA, 22 bp, Homo sapiens
catgcagcaggatctcattccc

SEQ ID NO: 7194755 - DNA, 22 bp, Homo sapiens
catgagtgagtatctcaagata

SEQ ID NO: 7194756 - DNA, 22 bp, Homo sapiens
aggaggtgttgatagaaggttt

SEQ ID NO: 7194757 - DNA, 22 bp, Homo sapiens
catgcacactgcaacaaggact

SEQ ID NO: 7194758 - DNA, 22 bp, Homo sapiens
catgcacagagcttggtcattg

SEQ ID NO: 7194759 - DNA, 22 bp, Homo sapiens
catgcacagagcttggtcattg

SEQ ID NO: 7194760 - DNA, 22 bp, Homo sapiens
catgcacagagcttggtcattg

SEQ ID NO: 7194761 - DNA, 20 bp, Homo sapiens
catgcacagccatagcgcta

SEQ ID NO: 7194762 - DNA, 22 bp, Homo sapiens
catgcacagtgatatctgaaga

SEQ ID NO: 7194763 - DNA, 22 bp, Homo sapiens
catgcacatgcaatagtgcttt

SEQ ID NO: 7194764 - DNA, 22 bp, Homo sapiens
catgcacatgtggctatgtaat

SEQ ID NO: 7194765 - DNA, 22 bp, Homo sapiens
catgcacatgtggctatgtaat

SEQ ID NO: 7194766 - DNA, 22 bp, Homo sapiens
catgcacatgtggctatgtaat

SEQ ID NO: 7194767 - DNA, 22 bp, Homo sapiens
catgcactctttgagaaggatg

SEQ ID NO: 7194768 - DNA, 22 bp, Homo sapiens
catgcactgatgcaaggtctgc

SEQ ID NO: 7194769 - DNA, 22 bp, Homo sapiens
catgcacttacctgaaattcaa

SEQ ID NO: 7194770 - DNA, 22 bp, Homo sapiens
catgcacttacctgaaattcaa

SEQ ID NO: 7194771 - DNA, 22 bp, Homo sapiens
catgcacttacctgaaattcaa

SEQ ID NO: 7194772 - DNA, 22 bp, Homo sapiens
aggaggtgtagatttcctgtca

SEQ ID NO: 7194773 - DNA, 22 bp, Homo sapiens
aggaggtgtagatttcctgtca

SEQ ID NO: 7194774 - DNA, 22 bp, Homo sapiens
aggaggtgtagatttcctgtca

SEQ ID NO: 7194775 - DNA, 22 bp, Homo sapiens
aggaggtgttgatagaaggttt

SEQ ID NO: 7194776 - DNA, 22 bp, Homo sapiens
aggaggtggctgaacttgaggg

SEQ ID NO: 7194777 - DNA, 22 bp, Homo sapiens
aggaggtggctgaacttgaggg

SEQ ID NO: 7194778 - DNA, 22 bp, Homo sapiens
aggaggtggctgaacttgaggg

SEQ ID NO: 7194779 - DNA, 22 bp, Homo sapiens
aggaggtggctgaacttgaggg

SEQ ID NO: 7194780 - DNA, 22 bp, Homo sapiens
aggaggtggctgaacttgaggg

SEQ ID NO: 7194781 - DNA, 22 bp, Homo sapiens
aggaggtggcctgagcgtgccc

SEQ ID NO: 7194782 - DNA, 22 bp, Homo sapiens
aggaggtggcctgagcgtgccc

SEQ ID NO: 7194783 - DNA, 22 bp, Homo sapiens
aggaggtggcctgagcgtgccc

SEQ ID NO: 7194784 - DNA, 22 bp, Homo sapiens
aggaggtggcctgagcgtgccc

SEQ ID NO: 7194785 - DNA, 22 bp, Homo sapiens
aggaggtggcctgagcgtgccc

SEQ ID NO: 7194786 - DNA, 22 bp, Homo sapiens
aggaggtggcaactgtcgacag

SEQ ID NO: 7194787 - DNA, 22 bp, Homo sapiens
aggaggtggcaactgtcgacag

SEQ ID NO: 7194788 - DNA, 22 bp, Homo sapiens
aggaggtggcaactgtcgacag

SEQ ID NO: 7194789 - DNA, 22 bp, Homo sapiens
aggaggtgctgtttgtcctgga

SEQ ID NO: 7194790 - DNA, 22 bp, Homo sapiens
aggaggtgctgtttgtcctgga

SEQ ID NO: 7194791 - DNA, 22 bp, Homo sapiens
aggaggtgctgtttgtcctgga

SEQ ID NO: 7194792 - DNA, 22 bp, Homo sapiens
aggaggtgctagagaagatgtt

SEQ ID NO: 7194793 - DNA, 22 bp, Homo sapiens
aggaggtgctgtttgtcctgga

SEQ ID NO: 7194794 - DNA, 22 bp, Homo sapiens
aggaggtgctgtttgtcctgga

SEQ ID NO: 7194795 - DNA, 22 bp, Homo sapiens
aggaggtgctagagaagatgtt

SEQ ID NO: 7194796 - DNA, 22 bp, Homo sapiens
aggaggtgctagagaagatgtt

SEQ ID NO: 7194797 - DNA, 22 bp, Homo sapiens
aggaggtgctagagaagatgtt

SEQ ID NO: 7194798 - DNA, 22 bp, Homo sapiens
catgaaatgttagaattagaca

SEQ ID NO: 7194799 - DNA, 22 bp, Homo sapiens
catgaaatgttagaattagaca

SEQ ID NO: 7194800 - DNA, 22 bp, Homo sapiens
catgaaatgttagaattagaca

SEQ ID NO: 7194801 - DNA, 22 bp, Homo sapiens
catgaaatgttagaattagaca

SEQ ID NO: 7194802 - DNA, 22 bp, Homo sapiens
catgaaatgttagaattagaca

SEQ ID NO: 7194803 - DNA, 22 bp, Homo sapiens
catgaaattcagcaggtgagta

SEQ ID NO: 7194804 - DNA, 22 bp, Homo sapiens
catgaaattcagcaggtgagta

SEQ ID NO: 7194805 - DNA, 22 bp, Homo sapiens
catgaaattgctcctttggtgc

SEQ ID NO: 7194806 - DNA, 22 bp, Homo sapiens
catgaaattgctcctttggtgc

SEQ ID NO: 7194807 - DNA, 22 bp, Homo sapiens
aggaggtgcgtggtgatcccct

SEQ ID NO: 7194808 - DNA, 22 bp, Homo sapiens
aggaggtgcgtggtgatcccct

SEQ ID NO: 7194809 - DNA, 22 bp, Homo sapiens
aggaggtgctagagaagatgtt

SEQ ID NO: 7194810 - DNA, 22 bp, Homo sapiens
aggaggtgctagagaagatgtt

SEQ ID NO: 7194811 - DNA, 22 bp, Homo sapiens
aggaggtgctagagaagatgtt

SEQ ID NO: 7194812 - DNA, 22 bp, Homo sapiens
catgaaatctgagtatgtttcc

SEQ ID NO: 7194813 - DNA, 22 bp, Homo sapiens
catgaaatgatatttgggtggg

SEQ ID NO: 7194814 - DNA, 22 bp, Homo sapiens
catgaaatctgagtatgtttcc

SEQ ID NO: 7194815 - DNA, 22 bp, Homo sapiens
catgaaatcacaagctgaggac

SEQ ID NO: 7194816 - DNA, 22 bp, Homo sapiens
catgaaatattagtaactgttt

SEQ ID NO: 7194817 - DNA, 22 bp, Homo sapiens
catgaaatcacaagctgaggac

SEQ ID NO: 7194818 - DNA, 22 bp, Homo sapiens
catgaaatctgagtatgtttcc

SEQ ID NO: 7194819 - DNA, 22 bp, Homo sapiens
catgaaatgatatttgggtggg

SEQ ID NO: 7194820 - DNA, 22 bp, Homo sapiens
catgaaatggccaaccttcggc

SEQ ID NO: 7194821 - DNA, 22 bp, Homo sapiens
catgaaatggccaaccttcggc

SEQ ID NO: 7194822 - DNA, 22 bp, Homo sapiens
catgaaatgtgttaatctcttg

SEQ ID NO: 7194823 - DNA, 22 bp, Homo sapiens
catgaaatgtgttaatctcttg

SEQ ID NO: 7194824 - DNA, 22 bp, Homo sapiens
catgaaatgtgttaatctcttg

SEQ ID NO: 7194825 - DNA, 22 bp, Homo sapiens
catgaaatgtgttaatctcttg

SEQ ID NO: 7194826 - DNA, 22 bp, Homo sapiens
catgaaatgtgttaatctcttg

SEQ ID NO: 7194827 - DNA, 22 bp, Homo sapiens
catgaaatattagtaactgttt

SEQ ID NO: 7194828 - DNA, 22 bp, Homo sapiens
catgaaatattagtaactgttt

SEQ ID NO: 7194829 - DNA, 22 bp, Homo sapiens
catgaaatatgctacctgtctt

SEQ ID NO: 7194830 - DNA, 22 bp, Homo sapiens
catgaaatatgctacctgtctt

SEQ ID NO: 7194831 - DNA, 22 bp, Homo sapiens
catgaaagcaggaatggtttta

SEQ ID NO: 7194832 - DNA, 22 bp, Homo sapiens
catgaaaatgtcaagttctgct

SEQ ID NO: 7194833 - DNA, 22 bp, Homo sapiens
catgaaaatgtcaagttctgct

SEQ ID NO: 7194834 - DNA, 22 bp, Homo sapiens
catgaaacttccaaagctgacc

SEQ ID NO: 7194835 - DNA, 22 bp, Homo sapiens
catgaaagcaggaatggtttta

SEQ ID NO: 7194836 - DNA, 22 bp, Homo sapiens
catctttaaaatgggaacaaca

SEQ ID NO: 7194837 - DNA, 22 bp, Homo sapiens
catgaaaatgtcaagttctgct

SEQ ID NO: 7194838 - DNA, 22 bp, Homo sapiens
catgaaaatgtcaagttctgct

SEQ ID NO: 7194839 - DNA, 17 bp, Homo sapiens
catctttaaaatcctga

SEQ ID NO: 7194840 - DNA, 22 bp, Homo sapiens
aggaggcactcactctcagggt

SEQ ID NO: 7194841 - DNA, 22 bp, Homo sapiens
aggaggcactcactctcagggt

SEQ ID NO: 7194842 - DNA, 22 bp, Homo sapiens
aggaggcactcactctcagggt

SEQ ID NO: 7194843 - DNA, 22 bp, Homo sapiens
aggaggcactcactctcagggt

SEQ ID NO: 7194844 - DNA, 22 bp, Homo sapiens
aggaggcactcactctcagggt

SEQ ID NO: 7194845 - DNA, 22 bp, Homo sapiens
aggactttgattttgtaagatc

SEQ ID NO: 7194846 - DNA, 22 bp, Homo sapiens
aggagaaaacagtgttttgcct

SEQ ID NO: 7194847 - DNA, 21 bp, Homo sapiens
aggagaaacacaggtcagccc

SEQ ID NO: 7194848 - DNA, 22 bp, Homo sapiens
aggacaggattccttgccttgc

SEQ ID NO: 7194849 - DNA, 21 bp, Homo sapiens
aggacaggaactggctgaata

SEQ ID NO: 7194850 - DNA, 21 bp, Homo sapiens
aggacaggaactggctgaata

SEQ ID NO: 7194851 - DNA, 21 bp, Homo sapiens
aggacaggaactggctgaata

SEQ ID NO: 7194852 - DNA, 22 bp, Homo sapiens
aggagaaagactggacagccaa

SEQ ID NO: 7194853 - DNA, 22 bp, Homo sapiens
aggagaaagactggacagccaa

SEQ ID NO: 7194854 - DNA, 22 bp, Homo sapiens
aggagaaagactggacagccaa

SEQ ID NO: 7194855 - DNA, 22 bp, Homo sapiens
aggagaaagactggacagccaa

SEQ ID NO: 7194856 - DNA, 22 bp, Homo sapiens
aggagaaagactggacagccaa

SEQ ID NO: 7194857 - DNA, 18 bp, Homo sapiens
aggagaaagggaccaggg

SEQ ID NO: 7194858 - DNA, 18 bp, Homo sapiens
aggagaaagggaccaggg

SEQ ID NO: 7194859 - DNA, 18 bp, Homo sapiens
aggagaaagggaccaggg

SEQ ID NO: 7194860 - DNA, 22 bp, Homo sapiens
aggagaaatccatcgagaatgg

SEQ ID NO: 7194861 - DNA, 20 bp, Homo sapiens
aggagaaattcgggacacct

SEQ ID NO: 7194862 - DNA, 20 bp, Homo sapiens
aggagaaattcgggacacct

SEQ ID NO: 7194863 - DNA, 20 bp, Homo sapiens
aggagaaattcgggacacct

SEQ ID NO: 7194864 - DNA, 20 bp, Homo sapiens
aggagaaattcgggacacct

SEQ ID NO: 7194865 - DNA, 20 bp, Homo sapiens
aggagaaattcgggacacct

SEQ ID NO: 7194866 - DNA, 20 bp, Homo sapiens
aggagaaattcgggacacct

SEQ ID NO: 7194867 - DNA, 21 bp, Homo sapiens
aggacaggaactggctgaata

SEQ ID NO: 7194868 - DNA, 21 bp, Homo sapiens
aggacaggaactggctgaata

SEQ ID NO: 7194869 - DNA, 21 bp, Homo sapiens
aggacaggaactggctgaata

SEQ ID NO: 7194870 - DNA, 21 bp, Homo sapiens
aggacaggaactggctgaata

SEQ ID NO: 7194871 - DNA, 21 bp, Homo sapiens
aggacaggaactggctgaata

SEQ ID NO: 7194872 - DNA, 21 bp, Homo sapiens
aggacaggaactggctgaata

SEQ ID NO: 7194873 - DNA, 22 bp, Homo sapiens
aggacagcccttgagagcacat

SEQ ID NO: 7194874 - DNA, 22 bp, Homo sapiens
aggacagcccttgagagcacat

SEQ ID NO: 7194875 - DNA, 22 bp, Homo sapiens
aggacagcccttgagagcacat

SEQ ID NO: 7194876 - DNA, 22 bp, Homo sapiens
aggacagcatatgggaaccagt

SEQ ID NO: 7194877 - DNA, 22 bp, Homo sapiens
aggacagcagttggtgaggttc

SEQ ID NO: 7194878 - DNA, 22 bp, Homo sapiens
aggacagcatatgggaaccagt

SEQ ID NO: 7194879 - DNA, 22 bp, Homo sapiens
aggacagcatatgggaaccagt

SEQ ID NO: 7194880 - DNA, 22 bp, Homo sapiens
aggacagcattttcagcatctc

SEQ ID NO: 7194881 - DNA, 22 bp, Homo sapiens
aggacagcagtgctggcacttg

SEQ ID NO: 7194882 - DNA, 22 bp, Homo sapiens
aggacagcagttggtgaggttc

SEQ ID NO: 7194883 - DNA, 22 bp, Homo sapiens
aggacagcccccaacagcaaca

SEQ ID NO: 7194884 - DNA, 22 bp, Homo sapiens
aggacagcccccaacagcaaca

SEQ ID NO: 7194885 - DNA, 22 bp, Homo sapiens
aggacagcccttgagagcacat

SEQ ID NO: 7194886 - DNA, 22 bp, Homo sapiens
aggacagcccttgagagcacat

SEQ ID NO: 7194887 - DNA, 22 bp, Homo sapiens
aggacagcattttcagcatctc

SEQ ID NO: 7194888 - DNA, 22 bp, Homo sapiens
aggacagcattttcagcatctc

SEQ ID NO: 7194889 - DNA, 22 bp, Homo sapiens
aggacagcattttcagcatctc

SEQ ID NO: 7194890 - DNA, 22 bp, Homo sapiens
aggacagcccccaacagcaaca

SEQ ID NO: 7194891 - DNA, 22 bp, Homo sapiens
aggagaagccaagttgtgagca

SEQ ID NO: 7194892 - DNA, 23 bp, Homo sapiens
aggagaagagatttccacatgca

SEQ ID NO: 7194893 - DNA, 23 bp, Homo sapiens
aggagaagagatttccacatgca

SEQ ID NO: 7194894 - DNA, 23 bp, Homo sapiens
aggagaagagatttccacatgca

SEQ ID NO: 7194895 - DNA, 23 bp, Homo sapiens
aggagaagagatttccacatgca

SEQ ID NO: 7194896 - DNA, 19 bp, Homo sapiens
aggagaagactctctcccc

SEQ ID NO: 7194897 - DNA, 19 bp, Homo sapiens
aggagaagactctctcccc

SEQ ID NO: 7194898 - DNA, 23 bp, Homo sapiens
aggagaagagatttccacatgca

SEQ ID NO: 7194899 - DNA, 23 bp, Homo sapiens
aggagaagagatttccacatgca

SEQ ID NO: 7194900 - DNA, 23 bp, Homo sapiens
aggagaagagatttccacatgca

SEQ ID NO: 7194901 - DNA, 22 bp, Homo sapiens
aggagaagccaagttgtgagca

SEQ ID NO: 7194902 - DNA, 22 bp, Homo sapiens
aggagaagccaagttgtgagca

SEQ ID NO: 7194903 - DNA, 22 bp, Homo sapiens
cagtctctctccttgcaggcgt

SEQ ID NO: 7194904 - DNA, 22 bp, Homo sapiens
cagtctctctccttgcaggcgt

SEQ ID NO: 7194905 - DNA, 22 bp, Homo sapiens
cagtctctctgaagtattaaga

SEQ ID NO: 7194906 - DNA, 22 bp, Homo sapiens
cagtctctgccacttctaagct

SEQ ID NO: 7194907 - DNA, 22 bp, Homo sapiens
cagtctctcttgtagtgcagct

SEQ ID NO: 7194908 - DNA, 22 bp, Homo sapiens
cagtctctgtcatctcatggga

SEQ ID NO: 7194909 - DNA, 22 bp, Homo sapiens
cagtctctgtcatctcatggga

SEQ ID NO: 7194910 - DNA, 22 bp, Homo sapiens
cagtctctgtcatctcatggga

SEQ ID NO: 7194911 - DNA, 22 bp, Homo sapiens
cagtctctgtcatctcatggga

SEQ ID NO: 7194912 - DNA, 22 bp, Homo sapiens
cagtctctgtgccagatcctgg

SEQ ID NO: 7194913 - DNA, 22 bp, Homo sapiens
cagtctctgtgccagatcctgg

SEQ ID NO: 7194914 - DNA, 22 bp, Homo sapiens
cagtctctggtgagttgacagt

SEQ ID NO: 7194915 - DNA, 22 bp, Homo sapiens
cagtctctgggaaagaggacag

SEQ ID NO: 7194916 - DNA, 22 bp, Homo sapiens
cagtctctgggaaagaggacag

SEQ ID NO: 7194917 - DNA, 22 bp, Homo sapiens
cagtctctggcagctgctggcc

SEQ ID NO: 7194918 - DNA, 22 bp, Homo sapiens
cagtctctgccacttctaagct

SEQ ID NO: 7194919 - DNA, 22 bp, Homo sapiens
cagtctctggcagctgctggcc

SEQ ID NO: 7194920 - DNA, 22 bp, Homo sapiens
cagtctcttgcttcattagttg

SEQ ID NO: 7194921 - DNA, 22 bp, Homo sapiens
cagtctctttatccaccaagcc

SEQ ID NO: 7194922 - DNA, 22 bp, Homo sapiens
cagtctctttatccaccaagcc

SEQ ID NO: 7194923 - DNA, 22 bp, Homo sapiens
cagtctcttttcagctccatcc

SEQ ID NO: 7194924 - DNA, 22 bp, Homo sapiens
cagtctcttttcagctccatcc

SEQ ID NO: 7194925 - DNA, 22 bp, Homo sapiens
cagtctcttttcagctccatcc

SEQ ID NO: 7194926 - DNA, 22 bp, Homo sapiens
aggagacactgagacttcacca

SEQ ID NO: 7194927 - DNA, 22 bp, Homo sapiens
aggagacactgagacttcacca

SEQ ID NO: 7194928 - DNA, 22 bp, Homo sapiens
aggagacactgagacttcacca

SEQ ID NO: 7194929 - DNA, 22 bp, Homo sapiens
cagtctcttttcagctccatcc

SEQ ID NO: 7194930 - DNA, 22 bp, Homo sapiens
cagtctcttttcagctccatcc

SEQ ID NO: 7194931 - DNA, 22 bp, Homo sapiens
cagtctcttttcagctccatcc

SEQ ID NO: 7194932 - DNA, 22 bp, Homo sapiens
aggaaggactgcagcatttggt

SEQ ID NO: 7194933 - DNA, 22 bp, Homo sapiens
aggaaggactgcagcatttggt

SEQ ID NO: 7194934 - DNA, 22 bp, Homo sapiens
aggaaggactgcagcatttggt

SEQ ID NO: 7194935 - DNA, 22 bp, Homo sapiens
aggaaggactccatggtccgtc

SEQ ID NO: 7194936 - DNA, 22 bp, Homo sapiens
aggaaggaagagacaccatttg

SEQ ID NO: 7194937 - DNA, 20 bp, Homo sapiens
aggaaggaagtttgcatgga

SEQ ID NO: 7194938 - DNA, 20 bp, Homo sapiens
aggaaggaagtttgcatgga

SEQ ID NO: 7194939 - DNA, 19 bp, Homo sapiens
aggaaggaacctgagtctg

SEQ ID NO: 7194940 - DNA, 22 bp, Homo sapiens
aggaaggaagagacaccatttg

SEQ ID NO: 7194941 - DNA, 19 bp, Homo sapiens
aggaaggaacctgagtctg

SEQ ID NO: 7194942 - DNA, 19 bp, Homo sapiens
aggaaggaacctgagtctg

SEQ ID NO: 7194943 - DNA, 22 bp, Homo sapiens
aggaagctttatgaccagctaa

SEQ ID NO: 7194944 - DNA, 22 bp, Homo sapiens
aggaagctttatgaccagctaa

SEQ ID NO: 7194945 - DNA, 22 bp, Homo sapiens
aggaagctgggaaactgacatt

SEQ ID NO: 7194946 - DNA, 22 bp, Homo sapiens
aggaagctgggaaactgacatt

SEQ ID NO: 7194947 - DNA, 22 bp, Homo sapiens
aggaagctgggaaactgacatt

SEQ ID NO: 7194948 - DNA, 22 bp, Homo sapiens
aggaagctgggaaactgacatt

SEQ ID NO: 7194949 - DNA, 22 bp, Homo sapiens
aggaagctgctaagaaacaatg

SEQ ID NO: 7194950 - DNA, 22 bp, Homo sapiens
aggaagctgcctgggatgggaa

SEQ ID NO: 7194951 - DNA, 22 bp, Homo sapiens
aggaagctgctggagtagtgtg

SEQ ID NO: 7194952 - DNA, 20 bp, Homo sapiens
aggaagctgagatgtagagg

SEQ ID NO: 7194953 - DNA, 21 bp, Homo sapiens
aggaagctgcccagatagtag

SEQ ID NO: 7194954 - DNA, 22 bp, Homo sapiens
aggaagctgcctgggatgggaa

SEQ ID NO: 7194955 - DNA, 22 bp, Homo sapiens
aggaagctggtgtgaggatgaa

SEQ ID NO: 7194956 - DNA, 22 bp, Homo sapiens
aggaagctggtgtgaggatgaa

SEQ ID NO: 7194957 - DNA, 22 bp, Homo sapiens
aggaagctggtgtgaggatgaa

SEQ ID NO: 7194958 - DNA, 22 bp, Homo sapiens
aggaagctggttacgaagggat

SEQ ID NO: 7194959 - DNA, 22 bp, Homo sapiens
aggaagcttagatttccagatc

SEQ ID NO: 7194960 - DNA, 22 bp, Homo sapiens
aggaaggactgcagcatttggt

SEQ ID NO: 7194961 - DNA, 22 bp, Homo sapiens
cagtccatatgccataattctt

SEQ ID NO: 7194962 - DNA, 22 bp, Homo sapiens
cagtccagtgatttttccagtt

SEQ ID NO: 7194963 - DNA, 18 bp, Homo sapiens
cagtcccaaaccttagga

SEQ ID NO: 7194964 - DNA, 22 bp, Homo sapiens
cagtcctctgcaacaccccttc

SEQ ID NO: 7194965 - DNA, 22 bp, Homo sapiens
cagtcctgaatactggacggtg

SEQ ID NO: 7194966 - DNA, 22 bp, Homo sapiens
cagtcctgagccaatcatgatg

SEQ ID NO: 7194967 - DNA, 22 bp, Homo sapiens
cagtcctgagccaatcatgatg

SEQ ID NO: 7194968 - DNA, 22 bp, Homo sapiens
cagtcctgagctcctgggctga

SEQ ID NO: 7194969 - DNA, 22 bp, Homo sapiens
cagtcctgagctcctgggctga

SEQ ID NO: 7194970 - DNA, 21 bp, Homo sapiens
cagtcctgcaaataattcttt

SEQ ID NO: 7194971 - DNA, 20 bp, Homo sapiens
cagtcctgcaggcgggagaa

SEQ ID NO: 7194972 - DNA, 22 bp, Homo sapiens
cagtcctgcccaggctgacaga

SEQ ID NO: 7194973 - DNA, 22 bp, Homo sapiens
cagtcctgcccaggctgacaga

SEQ ID NO: 7194974 - DNA, 22 bp, Homo sapiens
cagtcctgcccaggctgacaga

SEQ ID NO: 7194975 - DNA, 22 bp, Homo sapiens
cagtcctgcccaggctgacaga

SEQ ID NO: 7194976 - DNA, 21 bp, Homo sapiens
aggacagcaggagcatttatt

SEQ ID NO: 7194977 - DNA, 21 bp, Homo sapiens
aggacagcaggagcatttatt

SEQ ID NO: 7194978 - DNA, 20 bp, Homo sapiens
aggacagcagctgccacttg

SEQ ID NO: 7194979 - DNA, 22 bp, Homo sapiens
aggacagcagccattggcagtc

SEQ ID NO: 7194980 - DNA, 22 bp, Homo sapiens
aggacagcagccattggcagtc

SEQ ID NO: 7194981 - DNA, 22 bp, Homo sapiens
aggacagcagccattggcagtc

SEQ ID NO: 7194982 - DNA, 22 bp, Homo sapiens
aggacagcaaccgttattcaca

SEQ ID NO: 7194983 - DNA, 22 bp, Homo sapiens
cagtcctgggcacagccctggg

SEQ ID NO: 7194984 - DNA, 22 bp, Homo sapiens
cagtcctgggcacagccctggg

SEQ ID NO: 7194985 - DNA, 22 bp, Homo sapiens
cagtcctgggcacagccctggg

SEQ ID NO: 7194986 - DNA, 22 bp, Homo sapiens
cagtcctgcccaggctgacaga

SEQ ID NO: 7194987 - DNA, 22 bp, Homo sapiens
cagtcctgctagtgtgaaaagc

SEQ ID NO: 7194988 - DNA, 22 bp, Homo sapiens
cagtcctgctagtgtgaaaagc

SEQ ID NO: 7194989 - DNA, 22 bp, Homo sapiens
cagtcctgggagacttacccag

SEQ ID NO: 7194990 - DNA, 22 bp, Homo sapiens
cagtcctgggcacagccctggg

SEQ ID NO: 7194991 - DNA, 22 bp, Homo sapiens
aggaggaggtaagaaaagcata

SEQ ID NO: 7194992 - DNA, 22 bp, Homo sapiens
aggaggaggtaagaaaagcata

SEQ ID NO: 7194993 - DNA, 22 bp, Homo sapiens
aggaggaggtgggacacagtga

SEQ ID NO: 7194994 - DNA, 22 bp, Homo sapiens
aggaggaggtgggacacagtga

SEQ ID NO: 7194995 - DNA, 22 bp, Homo sapiens
aggaggaggtgggacacagtga

SEQ ID NO: 7194996 - DNA, 22 bp, Homo sapiens
aggaggaggtgggacacagtga

SEQ ID NO: 7194997 - DNA, 22 bp, Homo sapiens
aggaggataagttagttgggta

SEQ ID NO: 7194998 - DNA, 17 bp, Homo sapiens
aggaggatcagagagta

SEQ ID NO: 7194999 - DNA, 17 bp, Homo sapiens
aggaggatcagagagta

SEQ ID NO: 7195000 - DNA, 22 bp, Homo sapiens
aggaggcaaaggtctctgataa

SEQ ID NO: 7195001 - DNA, 22 bp, Homo sapiens
aggaggcaaaggtctctgataa

SEQ ID NO: 7195002 - DNA, 20 bp, Homo sapiens
aggaggcaatgtagataagc

SEQ ID NO: 7195003 - DNA, 20 bp, Homo sapiens
aggaggcaatgtagataagc

SEQ ID NO: 7195004 - DNA, 20 bp, Homo sapiens
aggaggcaatgtagataagc

SEQ ID NO: 7195005 - DNA, 20 bp, Homo sapiens
aggaggcaatgtagataagc

SEQ ID NO: 7195006 - DNA, 22 bp, Homo sapiens
aggaggcaactgagatttagaa

SEQ ID NO: 7195007 - DNA, 22 bp, Homo sapiens
aggaggcaactgagatttagaa

SEQ ID NO: 7195008 - DNA, 22 bp, Homo sapiens
aggaggcaactgagatttagaa

SEQ ID NO: 7195009 - DNA, 22 bp, Homo sapiens
aggaggcaactgagatttagaa

SEQ ID NO: 7195010 - DNA, 22 bp, Homo sapiens
aggaggcaactgagatttagaa

SEQ ID NO: 7195011 - DNA, 22 bp, Homo sapiens
aggaggaatacaatccagcagc

SEQ ID NO: 7195012 - DNA, 22 bp, Homo sapiens
aggaggaatacaatccagcagc

SEQ ID NO: 7195013 - DNA, 22 bp, Homo sapiens
aggaggaattgacacagaagcc

SEQ ID NO: 7195014 - DNA, 22 bp, Homo sapiens
aggaggaattgacacagaagcc

SEQ ID NO: 7195015 - DNA, 22 bp, Homo sapiens
aggaggactctctgagccagcc

SEQ ID NO: 7195016 - DNA, 22 bp, Homo sapiens
aggaggaattgacacagaagcc

SEQ ID NO: 7195017 - DNA, 22 bp, Homo sapiens
aggaggaattgacacagaagcc

SEQ ID NO: 7195018 - DNA, 22 bp, Homo sapiens
aggaggaattgacacagaagcc

SEQ ID NO: 7195019 - DNA, 21 bp, Homo sapiens
aggaggagagcttggcctacc

SEQ ID NO: 7195020 - DNA, 22 bp, Homo sapiens
aggaggaggctggagtacaccc

SEQ ID NO: 7195021 - DNA, 22 bp, Homo sapiens
aggaggagcagctttttgtctc

SEQ ID NO: 7195022 - DNA, 22 bp, Homo sapiens
aggaggaggctggagtacaccc

SEQ ID NO: 7195023 - DNA, 22 bp, Homo sapiens
aggaggaggctggagtacaccc

SEQ ID NO: 7195024 - DNA, 20 bp, Homo sapiens
aggagctgaattagagggtt

SEQ ID NO: 7195025 - DNA, 20 bp, Homo sapiens
aggagctgaattagagggtt

SEQ ID NO: 7195026 - DNA, 20 bp, Homo sapiens
aggagctgaattagagggtt

SEQ ID NO: 7195027 - DNA, 20 bp, Homo sapiens
aggagctgaattagagggtt

SEQ ID NO: 7195028 - DNA, 20 bp, Homo sapiens
aggagctgaattagagggtt

SEQ ID NO: 7195029 - DNA, 20 bp, Homo sapiens
aggagctgaattagagggtt

SEQ ID NO: 7195030 - DNA, 20 bp, Homo sapiens
aggagctgaattagagggtt

SEQ ID NO: 7195031 - DNA, 20 bp, Homo sapiens
aggagctgaattagagggtt

SEQ ID NO: 7195032 - DNA, 20 bp, Homo sapiens
aggagctctgtgctgggaag

SEQ ID NO: 7195033 - DNA, 22 bp, Homo sapiens
aggagctgaaacttctcatatg

SEQ ID NO: 7195034 - DNA, 22 bp, Homo sapiens
aggagctgaagtctctgcactc

SEQ ID NO: 7195035 - DNA, 22 bp, Homo sapiens
aggagctgaagtctctgcactc

SEQ ID NO: 7195036 - DNA, 22 bp, Homo sapiens
aggagctgagtcagcccgacag

SEQ ID NO: 7195037 - DNA, 22 bp, Homo sapiens
aggagctgagggagcgcccttg

SEQ ID NO: 7195038 - DNA, 22 bp, Homo sapiens
aggagctgagggagcgcccttg

SEQ ID NO: 7195039 - DNA, 22 bp, Homo sapiens
aggagctgataaaagggggtca

SEQ ID NO: 7195040 - DNA, 22 bp, Homo sapiens
aggagctgataaaagggggtca

SEQ ID NO: 7195041 - DNA, 22 bp, Homo sapiens
aggagctgataaaagggggtca

SEQ ID NO: 7195042 - DNA, 22 bp, Homo sapiens
aggaggaaggcttcattaggtt

SEQ ID NO: 7195043 - DNA, 22 bp, Homo sapiens
aggaggaaggcttcattaggtt

SEQ ID NO: 7195044 - DNA, 22 bp, Homo sapiens
aggaggaagggaagacaagtaa

SEQ ID NO: 7195045 - DNA, 22 bp, Homo sapiens
aggaggaagggaagacaagtaa

SEQ ID NO: 7195046 - DNA, 22 bp, Homo sapiens
aggaggaagggaagacaagtaa

SEQ ID NO: 7195047 - DNA, 22 bp, Homo sapiens
aggaggaatacaatccagcagc

SEQ ID NO: 7195048 - DNA, 22 bp, Homo sapiens
aggagctgataaaagggggtca

SEQ ID NO: 7195049 - DNA, 22 bp, Homo sapiens
aggagctgatagtctatggaga

SEQ ID NO: 7195050 - DNA, 22 bp, Homo sapiens
aggagctgatagtctatggaga

SEQ ID NO: 7195051 - DNA, 22 bp, Homo sapiens
aggagctgatagtctatggaga

SEQ ID NO: 7195052 - DNA, 22 bp, Homo sapiens
aggagctgatagtctatggaga

SEQ ID NO: 7195053 - DNA, 22 bp, Homo sapiens
aggagctgtgaatgggaggggt

SEQ ID NO: 7195054 - DNA, 22 bp, Homo sapiens
aggagctgtgaatgggaggggt

SEQ ID NO: 7195055 - DNA, 21 bp, Homo sapiens
aggagctgtgtgcttcctttc

SEQ ID NO: 7195056 - DNA, 22 bp, Homo sapiens
aggagaggctctaactctgtgt

SEQ ID NO: 7195057 - DNA, 22 bp, Homo sapiens
aggagaggctctaactctgtgt

SEQ ID NO: 7195058 - DNA, 22 bp, Homo sapiens
aggagaggctctaactctgtgt

SEQ ID NO: 7195059 - DNA, 22 bp, Homo sapiens
aggagaggcatcaagaaaatcg

SEQ ID NO: 7195060 - DNA, 22 bp, Homo sapiens
aggagaggcatcaagaaaatcg

SEQ ID NO: 7195061 - DNA, 22 bp, Homo sapiens
aggagaggctctaactctgtgt

SEQ ID NO: 7195062 - DNA, 22 bp, Homo sapiens
aggagaggggtaggattaattt

SEQ ID NO: 7195063 - DNA, 22 bp, Homo sapiens
aggagagggtggcattaagttt

SEQ ID NO: 7195064 - DNA, 22 bp, Homo sapiens
aggagagcaggccagccgtccc

SEQ ID NO: 7195065 - DNA, 22 bp, Homo sapiens
aggagagctggtgtctggaatc

SEQ ID NO: 7195066 - DNA, 22 bp, Homo sapiens
aggagagctggtgtctggaatc

SEQ ID NO: 7195067 - DNA, 22 bp, Homo sapiens
aggagaggcatcaagaaaatcg

SEQ ID NO: 7195068 - DNA, 22 bp, Homo sapiens
aggagaggcatcaagaaaatcg

SEQ ID NO: 7195069 - DNA, 22 bp, Homo sapiens
aggagaggcatcaagaaaatcg

SEQ ID NO: 7195070 - DNA, 22 bp, Homo sapiens
aggagaggcatcaagaaaatcg

SEQ ID NO: 7195071 - DNA, 22 bp, Homo sapiens
aggagaggcatcaagaaaatcg

SEQ ID NO: 7195072 - DNA, 22 bp, Homo sapiens
aggagaggcatcaagaaaatcg

SEQ ID NO: 7195073 - DNA, 22 bp, Homo sapiens
aggagaggcatcaagaaaatcg

SEQ ID NO: 7195074 - DNA, 22 bp, Homo sapiens
aggagagaggttttaaatgggg

SEQ ID NO: 7195075 - DNA, 22 bp, Homo sapiens
aggagagagctgagctttgctg

SEQ ID NO: 7195076 - DNA, 22 bp, Homo sapiens
aggagagagctgagctttgctg

SEQ ID NO: 7195077 - DNA, 22 bp, Homo sapiens
aggagagaggttttaaatgggg

SEQ ID NO: 7195078 - DNA, 22 bp, Homo sapiens
aggagagaattactgggtgtca

SEQ ID NO: 7195079 - DNA, 22 bp, Homo sapiens
aggagagagaacacttgggtcc

SEQ ID NO: 7195080 - DNA, 22 bp, Homo sapiens
aggagagagctgagctttgctg

SEQ ID NO: 7195081 - DNA, 22 bp, Homo sapiens
aggagagaattactgggtgtca

SEQ ID NO: 7195082 - DNA, 22 bp, Homo sapiens
aggagagaatgttccaggcttg

SEQ ID NO: 7195083 - DNA, 22 bp, Homo sapiens
aggagagaatgttccaggcttg

SEQ ID NO: 7195084 - DNA, 22 bp, Homo sapiens
aggagagaatgttccaggcttg

SEQ ID NO: 7195085 - DNA, 18 bp, Homo sapiens
aggagcctttgcactgga

SEQ ID NO: 7195086 - DNA, 19 bp, Homo sapiens
aggagccttgagcagtgag

SEQ ID NO: 7195087 - DNA, 18 bp, Homo sapiens
aggagcctttgcactgga

SEQ ID NO: 7195088 - DNA, 22 bp, Homo sapiens
aggagcggatgtgtcctgccag

SEQ ID NO: 7195089 - DNA, 22 bp, Homo sapiens
aggagcgtctgtctgtgtctct

SEQ ID NO: 7195090 - DNA, 22 bp, Homo sapiens
aggagcgtctgtctgtgtctct

SEQ ID NO: 7195091 - DNA, 22 bp, Homo sapiens
aggagctcaaagatgccaggag

SEQ ID NO: 7195092 - DNA, 22 bp, Homo sapiens
aggagctcagccattcatttga

SEQ ID NO: 7195093 - DNA, 22 bp, Homo sapiens
aggagctcagcctgcagggagc

SEQ ID NO: 7195094 - DNA, 22 bp, Homo sapiens
aggagctcagcctgcagggagc

SEQ ID NO: 7195095 - DNA, 22 bp, Homo sapiens
aggagctcagccattcatttga

SEQ ID NO: 7195096 - DNA, 22 bp, Homo sapiens
aggagctcagcctgcagggagc

SEQ ID NO: 7195097 - DNA, 22 bp, Homo sapiens
aggagctcagctaagttggaga

SEQ ID NO: 7195098 - DNA, 22 bp, Homo sapiens
aggagctcagctaagttggaga

SEQ ID NO: 7195099 - DNA, 22 bp, Homo sapiens
aggagctcattgaagtggatga

SEQ ID NO: 7195100 - DNA, 22 bp, Homo sapiens
aggagctcccgtgaggagacca

SEQ ID NO: 7195101 - DNA, 22 bp, Homo sapiens
aggagctcccgtgaggagacca

SEQ ID NO: 7195102 - DNA, 21 bp, Homo sapiens
aggagctctccaaggacaaag

SEQ ID NO: 7195103 - DNA, 21 bp, Homo sapiens
aggagctctccaaggacaaag

SEQ ID NO: 7195104 - DNA, 22 bp, Homo sapiens
aggagcctggctggcccacagg

SEQ ID NO: 7195105 - DNA, 22 bp, Homo sapiens
aggagagttcacactggtcaga

SEQ ID NO: 7195106 - DNA, 22 bp, Homo sapiens
aggagatcagcctccctgcaac

SEQ ID NO: 7195107 - DNA, 22 bp, Homo sapiens
aggagccatgagcaggaggcaa

SEQ ID NO: 7195108 - DNA, 22 bp, Homo sapiens
aggagagggtggcattaagttt

SEQ ID NO: 7195109 - DNA, 22 bp, Homo sapiens
aggagagggtggcattaagttt

SEQ ID NO: 7195110 - DNA, 22 bp, Homo sapiens
aggagaggtctcccttccccag

SEQ ID NO: 7195111 - DNA, 22 bp, Homo sapiens
aggagaggtctcccttccccag

SEQ ID NO: 7195112 - DNA, 22 bp, Homo sapiens
aggagaggtctcccttccccag

SEQ ID NO: 7195113 - DNA, 22 bp, Homo sapiens
aggagagtaccattgggccgca

SEQ ID NO: 7195114 - DNA, 22 bp, Homo sapiens
aggagagtaccattgggccgca

SEQ ID NO: 7195115 - DNA, 22 bp, Homo sapiens
aggagagtcttgagtcactggt

SEQ ID NO: 7195116 - DNA, 22 bp, Homo sapiens
aggagagtcttgagtcactggt

SEQ ID NO: 7195117 - DNA, 22 bp, Homo sapiens
aggagagttcacactggtcaga

SEQ ID NO: 7195118 - DNA, 22 bp, Homo sapiens
aggagagttcacactggtcaga

SEQ ID NO: 7195119 - DNA, 18 bp, Homo sapiens
atggctcaggaatggctt

SEQ ID NO: 7195120 - DNA, 18 bp, Homo sapiens
atggctcaggaatggctt

SEQ ID NO: 7195121 - DNA, 18 bp, Homo sapiens
atggctcaggaatggctt

SEQ ID NO: 7195122 - DNA, 21 bp, Homo sapiens
atggctcaggccatcaatgga

SEQ ID NO: 7195123 - DNA, 22 bp, Homo sapiens
atggcagcctgagcagaggaat

SEQ ID NO: 7195124 - DNA, 22 bp, Homo sapiens
atggctcagcgcctttctgtgg

SEQ ID NO: 7195125 - DNA, 22 bp, Homo sapiens
atggcagccagtgttggaggaa

SEQ ID NO: 7195126 - DNA, 22 bp, Homo sapiens
atggcagcccacgatggcaatg

SEQ ID NO: 7195127 - DNA, 19 bp, Homo sapiens
atggcagcagcagctctcc

SEQ ID NO: 7195128 - DNA, 22 bp, Homo sapiens
atggcagcagtttggagtcttt

SEQ ID NO: 7195129 - DNA, 22 bp, Homo sapiens
atggcagcatgggattggtaga

SEQ ID NO: 7195130 - DNA, 22 bp, Homo sapiens
atggcagcatgggattggtaga

SEQ ID NO: 7195131 - DNA, 22 bp, Homo sapiens
atggctgggtcaccatcagggt

SEQ ID NO: 7195132 - DNA, 22 bp, Homo sapiens
atggctgggtcaccatcagggt

SEQ ID NO: 7195133 - DNA, 22 bp, Homo sapiens
atggctgggtcaccatcagggt

SEQ ID NO: 7195134 - DNA, 22 bp, Homo sapiens
atggctgggcttttagtcagat

SEQ ID NO: 7195135 - DNA, 22 bp, Homo sapiens
atggctgggaggagagtatgat

SEQ ID NO: 7195136 - DNA, 22 bp, Homo sapiens
atggctgggatggggtagagaa

SEQ ID NO: 7195137 - DNA, 22 bp, Homo sapiens
atggctgggatggggtagagaa

SEQ ID NO: 7195138 - DNA, 22 bp, Homo sapiens
atggctgggatttcctttgcgt

SEQ ID NO: 7195139 - DNA, 22 bp, Homo sapiens
atggctgggttcttctataggt

SEQ ID NO: 7195140 - DNA, 22 bp, Homo sapiens
atggctggtagtgaattaatct

SEQ ID NO: 7195141 - DNA, 22 bp, Homo sapiens
atggctggtgatactggagtga

SEQ ID NO: 7195142 - DNA, 22 bp, Homo sapiens
atggctggtctcccatggaaaa

SEQ ID NO: 7195143 - DNA, 21 bp, Homo sapiens
atggctggtggctcagcctcc

SEQ ID NO: 7195144 - DNA, 21 bp, Homo sapiens
atggctggtggctcagcctcc

SEQ ID NO: 7195145 - DNA, 21 bp, Homo sapiens
atggctggtggctcagcctcc

SEQ ID NO: 7195146 - DNA, 22 bp, Homo sapiens
atggcagatggctggagcaggt

SEQ ID NO: 7195147 - DNA, 22 bp, Homo sapiens
atggcagatggctggagcaggt

SEQ ID NO: 7195148 - DNA, 22 bp, Homo sapiens
atggataatggtgatagttgca

SEQ ID NO: 7195149 - DNA, 22 bp, Homo sapiens
atggcagagggattgaacagct

SEQ ID NO: 7195150 - DNA, 22 bp, Homo sapiens
atggataagtcaaagagtatcc

SEQ ID NO: 7195151 - DNA, 22 bp, Homo sapiens
atggataatggtgatagttgca

SEQ ID NO: 7195152 - DNA, 22 bp, Homo sapiens
atggataagaacaaatatctga

SEQ ID NO: 7195153 - DNA, 22 bp, Homo sapiens
atggataagtcaaagagtatcc

SEQ ID NO: 7195154 - DNA, 22 bp, Homo sapiens
atggataagaacaaatatctga

SEQ ID NO: 7195155 - DNA, 22 bp, Homo sapiens
atggataacccagttcatttct

SEQ ID NO: 7195156 - DNA, 22 bp, Homo sapiens
atggagttctgccagcgctgct

SEQ ID NO: 7195157 - DNA, 22 bp, Homo sapiens
atggagttctgccagcgctgct

SEQ ID NO: 7195158 - DNA, 22 bp, Homo sapiens
atggagttctttaaattcacag

SEQ ID NO: 7195159 - DNA, 22 bp, Homo sapiens
atggataacccagttcatttct

SEQ ID NO: 7195160 - DNA, 22 bp, Homo sapiens
atggagtgggccaattttagtg

SEQ ID NO: 7195161 - DNA, 22 bp, Homo sapiens
atggagtgcctgtggcagtggg

SEQ ID NO: 7195162 - DNA, 22 bp, Homo sapiens
atggagtgctgttgatcaaggt

SEQ ID NO: 7195163 - DNA, 22 bp, Homo sapiens
atggagtgctgttgatcaaggt

SEQ ID NO: 7195164 - DNA, 22 bp, Homo sapiens
atggagtggtacttacttggct

SEQ ID NO: 7195165 - DNA, 22 bp, Homo sapiens
atggagtgtcaccttcctggtt

SEQ ID NO: 7195166 - DNA, 22 bp, Homo sapiens
atggagttctgccagcgctgct

SEQ ID NO: 7195167 - DNA, 22 bp, Homo sapiens
atggagttctgccagcgctgct

SEQ ID NO: 7195168 - DNA, 22 bp, Homo sapiens
atggacagtactgagtggacta

SEQ ID NO: 7195169 - DNA, 22 bp, Homo sapiens
atggacagtgctgcttcagagg

SEQ ID NO: 7195170 - DNA, 22 bp, Homo sapiens
atggacagtgctgcttcagagg

SEQ ID NO: 7195171 - DNA, 22 bp, Homo sapiens
atggaggtgccaggtgtgaggg

SEQ ID NO: 7195172 - DNA, 22 bp, Homo sapiens
atggaggtggaagaatgagtta

SEQ ID NO: 7195173 - DNA, 22 bp, Homo sapiens
atggaggtggaagaatgagtta

SEQ ID NO: 7195174 - DNA, 20 bp, Homo sapiens
atggaggtggatgtgactgc

SEQ ID NO: 7195175 - DNA, 21 bp, Homo sapiens
atggagtcaggggaatgggcc

SEQ ID NO: 7195176 - DNA, 22 bp, Homo sapiens
atggagtgcctgtggcagtggg

SEQ ID NO: 7195177 - DNA, 22 bp, Homo sapiens
agactattacctaaaagataca

SEQ ID NO: 7195178 - DNA, 22 bp, Homo sapiens
agactcaagactgcagaagacg

SEQ ID NO: 7195179 - DNA, 16 bp, Homo sapiens
agactcagtgcacttt

SEQ ID NO: 7195180 - DNA, 20 bp, Homo sapiens
agactcagtttctatgctct

SEQ ID NO: 7195181 - DNA, 22 bp, Homo sapiens
agactcatgacacttcctatga

SEQ ID NO: 7195182 - DNA, 22 bp, Homo sapiens
agactacaggagaaactcactc

SEQ ID NO: 7195183 - DNA, 22 bp, Homo sapiens
agactacatatgccacatgaag

SEQ ID NO: 7195184 - DNA, 22 bp, Homo sapiens
agactacatatgccacatgaag

SEQ ID NO: 7195185 - DNA, 22 bp, Homo sapiens
agactacattatgacagcattt

SEQ ID NO: 7195186 - DNA, 22 bp, Homo sapiens
agactcctcggaccaatcagcg

SEQ ID NO: 7195187 - DNA, 22 bp, Homo sapiens
agactctgaggagccctgagac

SEQ ID NO: 7195188 - DNA, 22 bp, Homo sapiens
agactctgataagcaactcttg

SEQ ID NO: 7195189 - DNA, 22 bp, Homo sapiens
atggacagtactgagtggacta

SEQ ID NO: 7195190 - DNA, 22 bp, Homo sapiens
agacggattacctgaggtcagg

SEQ ID NO: 7195191 - DNA, 22 bp, Homo sapiens
agacggattacctgaggtcagg

SEQ ID NO: 7195192 - DNA, 22 bp, Homo sapiens
agacgcggtggtgcatgcctgt

SEQ ID NO: 7195193 - DNA, 22 bp, Homo sapiens
agacgctattttgaggggtcta

SEQ ID NO: 7195194 - DNA, 22 bp, Homo sapiens
agacgctattttgaggggtcta

SEQ ID NO: 7195195 - DNA, 22 bp, Homo sapiens
agacgctattttgaggggtcta

SEQ ID NO: 7195196 - DNA, 22 bp, Homo sapiens
agacggctggcagtgagcggct

SEQ ID NO: 7195197 - DNA, 22 bp, Homo sapiens
agactaaaagaaggaagctacc

SEQ ID NO: 7195198 - DNA, 22 bp, Homo sapiens
atggaaatccaagtcaccgtag

SEQ ID NO: 7195199 - DNA, 22 bp, Homo sapiens
atggaaatcaggttcatccaag

SEQ ID NO: 7195200 - DNA, 22 bp, Homo sapiens
atggaaatcaggttcatccaag

SEQ ID NO: 7195201 - DNA, 22 bp, Homo sapiens
atggaaatatctttagagctta

SEQ ID NO: 7195202 - DNA, 22 bp, Homo sapiens
atgcaggggcagcagagcctgg

SEQ ID NO: 7195203 - DNA, 22 bp, Homo sapiens
atgcaggggcagcagagcctgg

SEQ ID NO: 7195204 - DNA, 22 bp, Homo sapiens
atgcaggggccgcctggccagg

SEQ ID NO: 7195205 - DNA, 22 bp, Homo sapiens
atgcaggggccgcctggccagg

SEQ ID NO: 7195206 - DNA, 22 bp, Homo sapiens
atgcagggaggtaagaggtgcc

SEQ ID NO: 7195207 - DNA, 22 bp, Homo sapiens
atgcagggattaaatgactgcc

SEQ ID NO: 7195208 - DNA, 22 bp, Homo sapiens
atgcagggattaaatgactgcc

SEQ ID NO: 7195209 - DNA, 22 bp, Homo sapiens
atgcagggattaaatgactgcc

SEQ ID NO: 7195210 - DNA, 22 bp, Homo sapiens
atgcagggcagagtacgttagc

SEQ ID NO: 7195211 - DNA, 22 bp, Homo sapiens
atgcaggggcagcagagcctgg

SEQ ID NO: 7195212 - DNA, 22 bp, Homo sapiens
atgcaggggcagcagagcctgg

SEQ ID NO: 7195213 - DNA, 22 bp, Homo sapiens
atgcaggggctgtgttttgggt

SEQ ID NO: 7195214 - DNA, 22 bp, Homo sapiens
atgcagggtctccgtgtgacga

SEQ ID NO: 7195215 - DNA, 22 bp, Homo sapiens
atgcagggtctccgtgtgacga

SEQ ID NO: 7195216 - DNA, 23 bp, Homo sapiens
atgcagggttacagggctgactt

SEQ ID NO: 7195217 - DNA, 23 bp, Homo sapiens
atgcagggttacagggctgactt

SEQ ID NO: 7195218 - DNA, 22 bp, Homo sapiens
atgcagggttatttcaaaaata

SEQ ID NO: 7195219 - DNA, 22 bp, Homo sapiens
atgcagggttctgggctagaga

SEQ ID NO: 7195220 - DNA, 22 bp, Homo sapiens
atgcagggttctgggctagaga

SEQ ID NO: 7195221 - DNA, 22 bp, Homo sapiens
atgcagggttctgggctagaga

SEQ ID NO: 7195222 - DNA, 22 bp, Homo sapiens
atgcttggatgctgccatggga

SEQ ID NO: 7195223 - DNA, 19 bp, Homo sapiens
atggaaaatgccagactga

SEQ ID NO: 7195224 - DNA, 19 bp, Homo sapiens
atggaaaatgccagactga

SEQ ID NO: 7195225 - DNA, 22 bp, Homo sapiens
atggaaagccagtgttccatca

SEQ ID NO: 7195226 - DNA, 22 bp, Homo sapiens
atggaaagctaagccatttacc

SEQ ID NO: 7195227 - DNA, 22 bp, Homo sapiens
atggaaaggctgtggaaactta

SEQ ID NO: 7195228 - DNA, 22 bp, Homo sapiens
atggaaaggctgtggaaactta

SEQ ID NO: 7195229 - DNA, 22 bp, Homo sapiens
atggaaagggaagcaaggaaca

SEQ ID NO: 7195230 - DNA, 22 bp, Homo sapiens
atggaaagggaagcaaggaaca

SEQ ID NO: 7195231 - DNA, 22 bp, Homo sapiens
atggaaagggaagcaaggaaca

SEQ ID NO: 7195232 - DNA, 22 bp, Homo sapiens
atggaaagggaagcaaggaaca

SEQ ID NO: 7195233 - DNA, 22 bp, Homo sapiens
atggaaagtgcatggaagtcat

SEQ ID NO: 7195234 - DNA, 22 bp, Homo sapiens
atggaaagtgcatggaagtcat

SEQ ID NO: 7195235 - DNA, 22 bp, Homo sapiens
atggaaatacacaagaggtttc

SEQ ID NO: 7195236 - DNA, 22 bp, Homo sapiens
atggaaatacacaagaggtttc

SEQ ID NO: 7195237 - DNA, 23 bp, Homo sapiens
atggaaatagcatgtgtcattta

SEQ ID NO: 7195238 - DNA, 23 bp, Homo sapiens
atggaaatagcatgtgtcattta

SEQ ID NO: 7195239 - DNA, 22 bp, Homo sapiens
atgggaggcaggctcagaaccg

SEQ ID NO: 7195240 - DNA, 22 bp, Homo sapiens
atgggaggcagcagagcccagc

SEQ ID NO: 7195241 - DNA, 22 bp, Homo sapiens
atgggaggcagcagagcccagc

SEQ ID NO: 7195242 - DNA, 22 bp, Homo sapiens
atgggaggcaggctcagaaccg

SEQ ID NO: 7195243 - DNA, 22 bp, Homo sapiens
atgggaggcaggctcagaaccg

SEQ ID NO: 7195244 - DNA, 22 bp, Homo sapiens
atgggaggcagcagagcccagc

SEQ ID NO: 7195245 - DNA, 22 bp, Homo sapiens
atgggaggcagcagagcccagc

SEQ ID NO: 7195246 - DNA, 22 bp, Homo sapiens
atgggaggcaaagatcgcagaa

SEQ ID NO: 7195247 - DNA, 22 bp, Homo sapiens
atgggaggcaaagatcgcagaa

SEQ ID NO: 7195248 - DNA, 22 bp, Homo sapiens
atgggaggcaaagatcgcagaa

SEQ ID NO: 7195249 - DNA, 22 bp, Homo sapiens
atgggaggcaaagatcgcagaa

SEQ ID NO: 7195250 - DNA, 22 bp, Homo sapiens
atgggaggcaaagatcgcagaa

SEQ ID NO: 7195251 - DNA, 22 bp, Homo sapiens
atgggaggcagacactaagttc

SEQ ID NO: 7195252 - DNA, 22 bp, Homo sapiens
atgggaggcagacactaagttc

SEQ ID NO: 7195253 - DNA, 22 bp, Homo sapiens
atgggaggcagacactaagttc

SEQ ID NO: 7195254 - DNA, 22 bp, Homo sapiens
atgggaggatgctcgggtgctc

SEQ ID NO: 7195255 - DNA, 22 bp, Homo sapiens
atgggaggcaaagatcgcagaa

SEQ ID NO: 7195256 - DNA, 22 bp, Homo sapiens
atgggaggatcacttgaggcca

SEQ ID NO: 7195257 - DNA, 22 bp, Homo sapiens
atgggaggatgctcgggtgctc

SEQ ID NO: 7195258 - DNA, 22 bp, Homo sapiens
atgggaggatcacttgaggcca

SEQ ID NO: 7195259 - DNA, 22 bp, Homo sapiens
atgggaggatcacttgaggcca

SEQ ID NO: 7195260 - DNA, 22 bp, Homo sapiens
atgggaggatcacttgaggcca

SEQ ID NO: 7195261 - DNA, 22 bp, Homo sapiens
atgggaggaaggaggcccttga

SEQ ID NO: 7195262 - DNA, 22 bp, Homo sapiens
atgggaggaaggaggcccttga

SEQ ID NO: 7195263 - DNA, 22 bp, Homo sapiens
atggctgtgttgttcctctgaa

SEQ ID NO: 7195264 - DNA, 22 bp, Homo sapiens
atggctgtgttgttcctctgaa

SEQ ID NO: 7195265 - DNA, 22 bp, Homo sapiens
atggctgtagtcatctgaaggc

SEQ ID NO: 7195266 - DNA, 22 bp, Homo sapiens
atggctgtagtcatctgaaggc

SEQ ID NO: 7195267 - DNA, 22 bp, Homo sapiens
atggctgtcacgccactgtgag

SEQ ID NO: 7195268 - DNA, 22 bp, Homo sapiens
atggctgtcacgccactgtgag

SEQ ID NO: 7195269 - DNA, 22 bp, Homo sapiens
atggctgtccagtttctagaga

SEQ ID NO: 7195270 - DNA, 22 bp, Homo sapiens
atggctgtgagacaaagagctg

SEQ ID NO: 7195271 - DNA, 22 bp, Homo sapiens
atggctgtgagcaggcagcttc

SEQ ID NO: 7195272 - DNA, 22 bp, Homo sapiens
atggctgtgagcaggcagcttc

SEQ ID NO: 7195273 - DNA, 22 bp, Homo sapiens
atggctgtgagcaggcagcttc

SEQ ID NO: 7195274 - DNA, 22 bp, Homo sapiens
atggctgtgcagagattgggaa

SEQ ID NO: 7195275 - DNA, 22 bp, Homo sapiens
atggctgtggtatcagacgcag

SEQ ID NO: 7195276 - DNA, 22 bp, Homo sapiens
atggctgtgtgactgagttcta

SEQ ID NO: 7195277 - DNA, 22 bp, Homo sapiens
atggctgtgtgcttctccccat

SEQ ID NO: 7195278 - DNA, 20 bp, Homo sapiens
atgtaaaagacagggagtag

SEQ ID NO: 7195279 - DNA, 20 bp, Homo sapiens
atgtaaaagacagggagtag

SEQ ID NO: 7195280 - DNA, 22 bp, Homo sapiens
atggttttgtcctctttggttc

SEQ ID NO: 7195281 - DNA, 22 bp, Homo sapiens
atgggtggagggtgacacggat

SEQ ID NO: 7195282 - DNA, 22 bp, Homo sapiens
atgggtggccccgtgtgcagtc

SEQ ID NO: 7195283 - DNA, 22 bp, Homo sapiens
atgggtggccccgtgtgcagtc

SEQ ID NO: 7195284 - DNA, 22 bp, Homo sapiens
atgggtggccccgtgtgcagtc

SEQ ID NO: 7195285 - DNA, 22 bp, Homo sapiens
atgtaaactttaccagctctga

SEQ ID NO: 7195286 - DNA, 22 bp, Homo sapiens
atgtaaaggcagactttaattt

SEQ ID NO: 7195287 - DNA, 22 bp, Homo sapiens
atgtaaagggcatggtattggg

SEQ ID NO: 7195288 - DNA, 22 bp, Homo sapiens
atgtaaagtaatctgtcgatca

SEQ ID NO: 7195289 - DNA, 22 bp, Homo sapiens
atgtaaactcacattttcttca

SEQ ID NO: 7195290 - DNA, 23 bp, Homo sapiens
atgtaaacttcagagtcattgcc

SEQ ID NO: 7195291 - DNA, 22 bp, Homo sapiens
atgtacacacaagtttgcacgc

SEQ ID NO: 7195292 - DNA, 22 bp, Homo sapiens
atgtacacacaagtttgcacgc

SEQ ID NO: 7195293 - DNA, 22 bp, Homo sapiens
atgtacacacaagtttgcacgc

SEQ ID NO: 7195294 - DNA, 22 bp, Homo sapiens
atgtacactttggaagagtcac

SEQ ID NO: 7195295 - DNA, 22 bp, Homo sapiens
atgtaaacaaggttattgtcca

SEQ ID NO: 7195296 - DNA, 20 bp, Homo sapiens
atgtaaaattataaggctga

SEQ ID NO: 7195297 - DNA, 20 bp, Homo sapiens
atgtaaaattataaggctga

SEQ ID NO: 7195298 - DNA, 22 bp, Homo sapiens
atgtaaaagattattttcctgt

SEQ ID NO: 7195299 - DNA, 22 bp, Homo sapiens
atgtaaaagattattttcctgt

SEQ ID NO: 7195300 - DNA, 22 bp, Homo sapiens
atgtacataaaatgtataatga

SEQ ID NO: 7195301 - DNA, 22 bp, Homo sapiens
atgtacataaaatgtataatga

SEQ ID NO: 7195302 - DNA, 22 bp, Homo sapiens
atgtacataaaatgtataatga

SEQ ID NO: 7195303 - DNA, 22 bp, Homo sapiens
atgtacataaaatgtataatga

SEQ ID NO: 7195304 - DNA, 22 bp, Homo sapiens
atgtacagtttctagactcaaa

SEQ ID NO: 7195305 - DNA, 22 bp, Homo sapiens
atgtacagtttctagactcaaa

SEQ ID NO: 7195306 - DNA, 22 bp, Homo sapiens
atgtacagtttctagactcaaa

SEQ ID NO: 7195307 - DNA, 22 bp, Homo sapiens
atgtacagtttctagactcaaa

SEQ ID NO: 7195308 - DNA, 22 bp, Homo sapiens
atgtacagtggaaactaacaaa

SEQ ID NO: 7195309 - DNA, 22 bp, Homo sapiens
atgtacagccacttcacagtta

SEQ ID NO: 7195310 - DNA, 22 bp, Homo sapiens
atgtacagccacttcacagtta

SEQ ID NO: 7195311 - DNA, 22 bp, Homo sapiens
atgtacagccacttcacagtta

SEQ ID NO: 7195312 - DNA, 22 bp, Homo sapiens
atgtacaggatggtgctcatct

SEQ ID NO: 7195313 - DNA, 22 bp, Homo sapiens
atgtacaggatggtgctcatct

SEQ ID NO: 7195314 - DNA, 22 bp, Homo sapiens
atgtacaggtcttggcaaaggg

SEQ ID NO: 7195315 - DNA, 22 bp, Homo sapiens
atgtacagtgataagagggcag

SEQ ID NO: 7195316 - DNA, 22 bp, Homo sapiens
atgtacagtggaaactaacaaa

SEQ ID NO: 7195317 - DNA, 22 bp, Homo sapiens
atgtcaaatcagttttatcaga

SEQ ID NO: 7195318 - DNA, 22 bp, Homo sapiens
atgtacatactgcattttcaaa

SEQ ID NO: 7195319 - DNA, 22 bp, Homo sapiens
atgtacatactgcattttcaaa

SEQ ID NO: 7195320 - DNA, 23 bp, Homo sapiens
atgtccaaagggattcgtctgat

SEQ ID NO: 7195321 - DNA, 22 bp, Homo sapiens
atgtcaaatgctgcaaactcat

SEQ ID NO: 7195322 - DNA, 22 bp, Homo sapiens
atgtccaagtcacagattttca

SEQ ID NO: 7195323 - DNA, 22 bp, Homo sapiens
atgtccaatttcagagtctcat

SEQ ID NO: 7195324 - DNA, 22 bp, Homo sapiens
atgtccaatttctgaggctgct

SEQ ID NO: 7195325 - DNA, 22 bp, Homo sapiens
atgtccaatttctgaggctgct

SEQ ID NO: 7195326 - DNA, 22 bp, Homo sapiens
atgtccagagaacatttgcttt

SEQ ID NO: 7195327 - DNA, 22 bp, Homo sapiens
atgtccagagtaaagcacattc

SEQ ID NO: 7195328 - DNA, 22 bp, Homo sapiens
atgtccagagtaaagcacattc

SEQ ID NO: 7195329 - DNA, 22 bp, Homo sapiens
atgtccagagtaaagcacattc

SEQ ID NO: 7195330 - DNA, 22 bp, Homo sapiens
atgtccagccaaccactggatt

SEQ ID NO: 7195331 - DNA, 22 bp, Homo sapiens
atgtccagccaaccactggatt

SEQ ID NO: 7195332 - DNA, 22 bp, Homo sapiens
atgtccagctcatgatactatc

SEQ ID NO: 7195333 - DNA, 22 bp, Homo sapiens
atgtccagctcatgatactatc

SEQ ID NO: 7195334 - DNA, 22 bp, Homo sapiens
atgtccagggcacacagcagtg

SEQ ID NO: 7195335 - DNA, 22 bp, Homo sapiens
atgtccagggcacacagcagtg

SEQ ID NO: 7195336 - DNA, 22 bp, Homo sapiens
atgtccagtacttctaaatggt

SEQ ID NO: 7195337 - DNA, 22 bp, Homo sapiens
atgtcccaagatacagctagag

SEQ ID NO: 7195338 - DNA, 19 bp, Homo sapiens
atgtcccaccgcccctgag

SEQ ID NO: 7195339 - DNA, 22 bp, Homo sapiens
atgtctgtacgagttacaatgg

SEQ ID NO: 7195340 - DNA, 22 bp, Homo sapiens
atgtctgtatgtggagaggggt

SEQ ID NO: 7195341 - DNA, 22 bp, Homo sapiens
atgtctgtcatcttccaggaag

SEQ ID NO: 7195342 - DNA, 22 bp, Homo sapiens
atgtctgtccaaccctgcaggg

SEQ ID NO: 7195343 - DNA, 22 bp, Homo sapiens
atgtctgtcccctagccctgat

SEQ ID NO: 7195344 - DNA, 22 bp, Homo sapiens
atgtctgtctatagccatgaga

SEQ ID NO: 7195345 - DNA, 22 bp, Homo sapiens
atgtctgtctttgtactccaca

SEQ ID NO: 7195346 - DNA, 18 bp, Homo sapiens
atgtctgtgcactggata

SEQ ID NO: 7195347 - DNA, 22 bp, Homo sapiens
atgtctgtggcaattgttgatg

SEQ ID NO: 7195348 - DNA, 22 bp, Homo sapiens
atgtctgtggcattatatgttt

SEQ ID NO: 7195349 - DNA, 22 bp, Homo sapiens
atgtctgtgtgatcttggataa

SEQ ID NO: 7195350 - DNA, 22 bp, Homo sapiens
atgtctgtgttatctgtagaat

SEQ ID NO: 7195351 - DNA, 22 bp, Homo sapiens
atgtctgttaatcgaccctaat

SEQ ID NO: 7195352 - DNA, 22 bp, Homo sapiens
atgtctgttcattattaactgc

SEQ ID NO: 7195353 - DNA, 22 bp, Homo sapiens
atgtctgttcattattaactgc

SEQ ID NO: 7195354 - DNA, 21 bp, Homo sapiens
atgtctgttctgattggtgcg

SEQ ID NO: 7195355 - DNA, 21 bp, Homo sapiens
atgtctgttctttctggcagg

SEQ ID NO: 7195356 - DNA, 19 bp, Homo sapiens
atgtctgttgaatttcata

SEQ ID NO: 7195357 - DNA, 19 bp, Homo sapiens
atgtctgttgaatttcata

SEQ ID NO: 7195358 - DNA, 22 bp, Homo sapiens
atgtctgtttatccttcaagat

SEQ ID NO: 7195359 - DNA, 22 bp, Homo sapiens
atgtctgtttgctgagcccggc

SEQ ID NO: 7195360 - DNA, 22 bp, Homo sapiens
atgtctgttttcatatcagata

SEQ ID NO: 7195361 - DNA, 22 bp, Homo sapiens
atcttggggaatcctctgtgta

SEQ ID NO: 7195362 - DNA, 22 bp, Homo sapiens
atcttgggccacaatgagccga

SEQ ID NO: 7195363 - DNA, 22 bp, Homo sapiens
atcttgggcccctgtaagatgg

SEQ ID NO: 7195364 - DNA, 22 bp, Homo sapiens
atcttggggactgtctcttgta

SEQ ID NO: 7195365 - DNA, 22 bp, Homo sapiens
atcttggggatagcctaactca

SEQ ID NO: 7195366 - DNA, 22 bp, Homo sapiens
atcttatgttgtattcaaaatc

SEQ ID NO: 7195367 - DNA, 22 bp, Homo sapiens
atcttatgagacccataaagat

SEQ ID NO: 7195368 - DNA, 22 bp, Homo sapiens
atcttatgagacccataaagat

SEQ ID NO: 7195369 - DNA, 22 bp, Homo sapiens
atcttattgctgttgccagata

SEQ ID NO: 7195370 - DNA, 20 bp, Homo sapiens
atcttgggattgagattgcc

SEQ ID NO: 7195371 - DNA, 23 bp, Homo sapiens
agaagcaatgctttttttcctct

SEQ ID NO: 7195372 - DNA, 18 bp, Homo sapiens
agaagcacaagatgtctt

SEQ ID NO: 7195373 - DNA, 22 bp, Homo sapiens
agaagcaaggtctgtcagtata

SEQ ID NO: 7195374 - DNA, 22 bp, Homo sapiens
agaagcaaggtctgtcagtata

SEQ ID NO: 7195375 - DNA, 18 bp, Homo sapiens
agaagcacaagatgtctt

SEQ ID NO: 7195376 - DNA, 22 bp, Homo sapiens
agaagcacaccagtagacaggg

SEQ ID NO: 7195377 - DNA, 22 bp, Homo sapiens
agaagcacaccagtagacaggg

SEQ ID NO: 7195378 - DNA, 22 bp, Homo sapiens
agaagcacaccagtagacaggg

SEQ ID NO: 7195379 - DNA, 22 bp, Homo sapiens
atctttagcattactttattca

SEQ ID NO: 7195380 - DNA, 22 bp, Homo sapiens
atcttgttctcccttgttctta

SEQ ID NO: 7195381 - DNA, 22 bp, Homo sapiens
atctttaaagacatgtgaactt

SEQ ID NO: 7195382 - DNA, 22 bp, Homo sapiens
atctttaaagacatgtgaactt

SEQ ID NO: 7195383 - DNA, 22 bp, Homo sapiens
atctttacagtgtaagtgcaga

SEQ ID NO: 7195384 - DNA, 22 bp, Homo sapiens
agaagatgttgcagttgatgcg

SEQ ID NO: 7195385 - DNA, 22 bp, Homo sapiens
agaagatgttgcagttgatgcg

SEQ ID NO: 7195386 - DNA, 22 bp, Homo sapiens
agaagattatgaattagagcag

SEQ ID NO: 7195387 - DNA, 22 bp, Homo sapiens
agaagattattagagactttgt

SEQ ID NO: 7195388 - DNA, 22 bp, Homo sapiens
agaagatgactttggagttgga

SEQ ID NO: 7195389 - DNA, 22 bp, Homo sapiens
agaagatgtcactgcagacagc

SEQ ID NO: 7195390 - DNA, 22 bp, Homo sapiens
agaagatgtcactgcagacagc

SEQ ID NO: 7195391 - DNA, 22 bp, Homo sapiens
agaagagtagtaacagaaatta

SEQ ID NO: 7195392 - DNA, 22 bp, Homo sapiens
agaagagtagtaacagaaatta

SEQ ID NO: 7195393 - DNA, 22 bp, Homo sapiens
agaagagcctggggaccatggc

SEQ ID NO: 7195394 - DNA, 22 bp, Homo sapiens
agaagagcctggggaccatggc

SEQ ID NO: 7195395 - DNA, 22 bp, Homo sapiens
agaagagccctttaagggggaa

SEQ ID NO: 7195396 - DNA, 20 bp, Homo sapiens
agaagaggatacaaccaggc

SEQ ID NO: 7195397 - DNA, 20 bp, Homo sapiens
agaagaggatacaaccaggc

SEQ ID NO: 7195398 - DNA, 22 bp, Homo sapiens
agaagagaactgccaaacactt

SEQ ID NO: 7195399 - DNA, 21 bp, Homo sapiens
agaagagaagcaggaccctct

SEQ ID NO: 7195400 - DNA, 21 bp, Homo sapiens
agaagagaagcaggaccctct

SEQ ID NO: 7195401 - DNA, 22 bp, Homo sapiens
agaagagagtcctaccccatac

SEQ ID NO: 7195402 - DNA, 22 bp, Homo sapiens
agaagagccactgttgacggca

SEQ ID NO: 7195403 - DNA, 22 bp, Homo sapiens
agaagagaactgccaaacactt

SEQ ID NO: 7195404 - DNA, 22 bp, Homo sapiens
agaagagaaatagtgccactgt

SEQ ID NO: 7195405 - DNA, 22 bp, Homo sapiens
agaagagaactgccaaacactt

SEQ ID NO: 7195406 - DNA, 22 bp, Homo sapiens
agaagagaactgccaaacactt

SEQ ID NO: 7195407 - DNA, 22 bp, Homo sapiens
agaagacagagtctacattcta

SEQ ID NO: 7195408 - DNA, 22 bp, Homo sapiens
agaagacagagtctacattcta

SEQ ID NO: 7195409 - DNA, 22 bp, Homo sapiens
agaagaatttctctcatgattt

SEQ ID NO: 7195410 - DNA, 22 bp, Homo sapiens
agaagaaatgtgaaggccactg

SEQ ID NO: 7195411 - DNA, 22 bp, Homo sapiens
agaagaaatgtgaaggccactg

SEQ ID NO: 7195412 - DNA, 22 bp, Homo sapiens
agaagaaatgtgaaggccactg

SEQ ID NO: 7195413 - DNA, 22 bp, Homo sapiens
agaagaaatgtgaaggccactg

SEQ ID NO: 7195414 - DNA, 22 bp, Homo sapiens
agaagaaatgtgaaggccactg

SEQ ID NO: 7195415 - DNA, 22 bp, Homo sapiens
agaagaatacttgatgttcatg

SEQ ID NO: 7195416 - DNA, 22 bp, Homo sapiens
agaagaatacttgatgttcatg

SEQ ID NO: 7195417 - DNA, 22 bp, Homo sapiens
agaagaacttagctttctatct

SEQ ID NO: 7195418 - DNA, 22 bp, Homo sapiens
agaatacagtatgcaaaaagat

SEQ ID NO: 7195419 - DNA, 22 bp, Homo sapiens
agaatacagtatgcaaaaagat

SEQ ID NO: 7195420 - DNA, 22 bp, Homo sapiens
agaatacagtatgcaaaaagat

SEQ ID NO: 7195421 - DNA, 22 bp, Homo sapiens
agaatacaattgttcagtaata

SEQ ID NO: 7195422 - DNA, 22 bp, Homo sapiens
agaatacaattgttcagtaata

SEQ ID NO: 7195423 - DNA, 22 bp, Homo sapiens
agaatacaattgttcagtaata

SEQ ID NO: 7195424 - DNA, 22 bp, Homo sapiens
agaatacaattgttcagtaata

SEQ ID NO: 7195425 - DNA, 22 bp, Homo sapiens
agaatacaattgttcagtaata

SEQ ID NO: 7195426 - DNA, 22 bp, Homo sapiens
agaatacaattgttcagtaata

SEQ ID NO: 7195427 - DNA, 19 bp, Homo sapiens
agaaggctcctgttggaga

SEQ ID NO: 7195428 - DNA, 22 bp, Homo sapiens
agaaggctgagactgggatgaa

SEQ ID NO: 7195429 - DNA, 22 bp, Homo sapiens
agaaggctggccatggtgccct

SEQ ID NO: 7195430 - DNA, 22 bp, Homo sapiens
agaagtttggtccttttcaagg

SEQ ID NO: 7195431 - DNA, 21 bp, Homo sapiens
atctttattacgcagagaaga

SEQ ID NO: 7195432 - DNA, 22 bp, Homo sapiens
agaaggcatcagaagtgtgtag

SEQ ID NO: 7195433 - DNA, 22 bp, Homo sapiens
atctttatatatctcctctgaa

SEQ ID NO: 7195434 - DNA, 20 bp, Homo sapiens
agaaggcattcctcattctt

SEQ ID NO: 7195435 - DNA, 20 bp, Homo sapiens
agaaggcattcctcattctt

SEQ ID NO: 7195436 - DNA, 21 bp, Homo sapiens
atctttattacgcagagaaga

SEQ ID NO: 7195437 - DNA, 22 bp, Homo sapiens
agaaggccagaaaattccttta

SEQ ID NO: 7195438 - DNA, 22 bp, Homo sapiens
agaaggccatgtcttggtactt

SEQ ID NO: 7195439 - DNA, 22 bp, Homo sapiens
agaaggcctagagtaagacatt

SEQ ID NO: 7195440 - DNA, 22 bp, Homo sapiens
agaaggctcactaagagtgact

SEQ ID NO: 7195441 - DNA, 22 bp, Homo sapiens
agaatagaattctcatagaatt

SEQ ID NO: 7195442 - DNA, 22 bp, Homo sapiens
agaatagaattctcatagaatt

SEQ ID NO: 7195443 - DNA, 22 bp, Homo sapiens
agaatactaggcttcagaaagg

SEQ ID NO: 7195444 - DNA, 22 bp, Homo sapiens
agaatactaggcttcagaaagg

SEQ ID NO: 7195445 - DNA, 22 bp, Homo sapiens
agaatactaggcttcagaaagg

SEQ ID NO: 7195446 - DNA, 22 bp, Homo sapiens
agaatactaggcttcagaaagg

SEQ ID NO: 7195447 - DNA, 22 bp, Homo sapiens
agaatagagaaaaaggttattt

SEQ ID NO: 7195448 - DNA, 22 bp, Homo sapiens
agaatagagaaaaaggttattt

SEQ ID NO: 7195449 - DNA, 22 bp, Homo sapiens
agaatagagaaaaaggttattt

SEQ ID NO: 7195450 - DNA, 22 bp, Homo sapiens
agaatagtggcaatgactgcac

SEQ ID NO: 7195451 - DNA, 22 bp, Homo sapiens
agaatagttttacttttctatg

SEQ ID NO: 7195452 - DNA, 22 bp, Homo sapiens
agaatacatcaatctattttct

SEQ ID NO: 7195453 - DNA, 22 bp, Homo sapiens
agaatacatcaatctattttct

SEQ ID NO: 7195454 - DNA, 22 bp, Homo sapiens
agaatacatcaatctattttct

SEQ ID NO: 7195455 - DNA, 22 bp, Homo sapiens
agaatacatcaatctattttct

SEQ ID NO: 7195456 - DNA, 22 bp, Homo sapiens
agaatacatctagtgctgcatg

SEQ ID NO: 7195457 - DNA, 22 bp, Homo sapiens
agaatacatctagtgctgcatg

SEQ ID NO: 7195458 - DNA, 22 bp, Homo sapiens
agaatacagtatgcaaaaagat

SEQ ID NO: 7195459 - DNA, 22 bp, Homo sapiens
agaatacagtatgcaaaaagat

SEQ ID NO: 7195460 - DNA, 22 bp, Homo sapiens
agaatacagttcagtaatggat

SEQ ID NO: 7195461 - DNA, 22 bp, Homo sapiens
atctttgtcactctactgtcta

SEQ ID NO: 7195462 - DNA, 20 bp, Homo sapiens
atctttgtctctgtagttgt

SEQ ID NO: 7195463 - DNA, 22 bp, Homo sapiens
atctttgtcactctactgtcta

SEQ ID NO: 7195464 - DNA, 22 bp, Homo sapiens
atctttgtgaatctcaacttgg

SEQ ID NO: 7195465 - DNA, 22 bp, Homo sapiens
atctttgtgctaatgtagttct

SEQ ID NO: 7195466 - DNA, 22 bp, Homo sapiens
atctttgtgaatctcaacttgg

SEQ ID NO: 7195467 - DNA, 22 bp, Homo sapiens
agaatgtagtcttggagattta

SEQ ID NO: 7195468 - DNA, 22 bp, Homo sapiens
agaatgtagtcttggagattta

SEQ ID NO: 7195469 - DNA, 22 bp, Homo sapiens
agaatgggggctacaggccaca

SEQ ID NO: 7195470 - DNA, 22 bp, Homo sapiens
agaatgtaagaatgcaaagatt

SEQ ID NO: 7195471 - DNA, 22 bp, Homo sapiens
agaatgcttgtacctttgtttt

SEQ ID NO: 7195472 - DNA, 22 bp, Homo sapiens
agaatgcattttgtgtagctat

SEQ ID NO: 7195473 - DNA, 22 bp, Homo sapiens
agaatgctccagagctgaaaga

SEQ ID NO: 7195474 - DNA, 22 bp, Homo sapiens
agaatgctcttcaaaatctagc

SEQ ID NO: 7195475 - DNA, 22 bp, Homo sapiens
agaatgtgaagattttgaatta

SEQ ID NO: 7195476 - DNA, 22 bp, Homo sapiens
agaatgtgaagattttgaatta

SEQ ID NO: 7195477 - DNA, 22 bp, Homo sapiens
agaatgtgggcacgtatgttct

SEQ ID NO: 7195478 - DNA, 22 bp, Homo sapiens
agaatgtgggcacgtatgttct

SEQ ID NO: 7195479 - DNA, 22 bp, Homo sapiens
agaatgtgggggaaaagagtgt

SEQ ID NO: 7195480 - DNA, 22 bp, Homo sapiens
agaatgtgtgattgaagctctt

SEQ ID NO: 7195481 - DNA, 22 bp, Homo sapiens
agaatgtgtgcaagcaagtgtg

SEQ ID NO: 7195482 - DNA, 22 bp, Homo sapiens
agaatgtgttattagagaagga

SEQ ID NO: 7195483 - DNA, 22 bp, Homo sapiens
agaatgtgttattagagaagga

SEQ ID NO: 7195484 - DNA, 22 bp, Homo sapiens
agaatgtgttattagagaagga

SEQ ID NO: 7195485 - DNA, 22 bp, Homo sapiens
agaatgtgttttaacatgggaa

SEQ ID NO: 7195486 - DNA, 22 bp, Homo sapiens
agaatgtgttttaacatgggaa

SEQ ID NO: 7195487 - DNA, 22 bp, Homo sapiens
agaatgttgatagcacctattt

SEQ ID NO: 7195488 - DNA, 22 bp, Homo sapiens
agaatgttgatagcacctattt

SEQ ID NO: 7195489 - DNA, 22 bp, Homo sapiens
agaatgttttcatgagaatgaa

SEQ ID NO: 7195490 - DNA, 21 bp, Homo sapiens
agaattaaattggatttgtgt

SEQ ID NO: 7195491 - DNA, 22 bp, Homo sapiens
agaatgataatgccatgatgga

SEQ ID NO: 7195492 - DNA, 22 bp, Homo sapiens
agaatgataatgccatgatgga

SEQ ID NO: 7195493 - DNA, 22 bp, Homo sapiens
agaatgaattaatcaactggaa

SEQ ID NO: 7195494 - DNA, 22 bp, Homo sapiens
agaatgaattaatcaactggaa

SEQ ID NO: 7195495 - DNA, 22 bp, Homo sapiens
agaatgataatgccatgatgga

SEQ ID NO: 7195496 - DNA, 22 bp, Homo sapiens
agaatgatactctatgccaaat

SEQ ID NO: 7195497 - DNA, 22 bp, Homo sapiens
agaatgatactctatgccaaat

SEQ ID NO: 7195498 - DNA, 22 bp, Homo sapiens
agaatgatagctagtatttact

SEQ ID NO: 7195499 - DNA, 22 bp, Homo sapiens
agaatgatagctagtatttact

SEQ ID NO: 7195500 - DNA, 22 bp, Homo sapiens
agaatgatagctagtatttact

SEQ ID NO: 7195501 - DNA, 22 bp, Homo sapiens
agaatgatcctgttcagtcggt

SEQ ID NO: 7195502 - DNA, 22 bp, Homo sapiens
agaatgattttggacaatatgg

SEQ ID NO: 7195503 - DNA, 22 bp, Homo sapiens
agaatgaattaatcaactggaa

SEQ ID NO: 7195504 - DNA, 22 bp, Homo sapiens
agaatctttctgaatgactgtg

SEQ ID NO: 7195505 - DNA, 22 bp, Homo sapiens
agaatgattttggacaatatgg

SEQ ID NO: 7195506 - DNA, 17 bp, Homo sapiens
agaatgcaaagcaggct

SEQ ID NO: 7195507 - DNA, 17 bp, Homo sapiens
agaatgcaaagcaggct

SEQ ID NO: 7195508 - DNA, 17 bp, Homo sapiens
agaatgcaaagcaggct

SEQ ID NO: 7195509 - DNA, 17 bp, Homo sapiens
agaatgcaaagcaggct

SEQ ID NO: 7195510 - DNA, 22 bp, Homo sapiens
agaatgcaaatgatcccacaca

SEQ ID NO: 7195511 - DNA, 22 bp, Homo sapiens
agaatgcagtttgaaataaggt

SEQ ID NO: 7195512 - DNA, 22 bp, Homo sapiens
agaatgcatctaaaagcagaga

SEQ ID NO: 7195513 - DNA, 22 bp, Homo sapiens
agaatgcatctaaaagcagaga

SEQ ID NO: 7195514 - DNA, 22 bp, Homo sapiens
agaattacataaatacatgaat

SEQ ID NO: 7195515 - DNA, 22 bp, Homo sapiens
agaattacataaatacatgaat

SEQ ID NO: 7195516 - DNA, 22 bp, Homo sapiens
agaattagtcacaattatagga

SEQ ID NO: 7195517 - DNA, 18 bp, Homo sapiens
agaattattcttgtcctc

SEQ ID NO: 7195518 - DNA, 22 bp, Homo sapiens
agaattcagaatgcatttctaa

SEQ ID NO: 7195519 - DNA, 22 bp, Homo sapiens
agaattctccacgctcagggtc

SEQ ID NO: 7195520 - DNA, 22 bp, Homo sapiens
agacaatatgtatattaagaat

SEQ ID NO: 7195521 - DNA, 19 bp, Homo sapiens
agacacacttacgtggaat

SEQ ID NO: 7195522 - DNA, 19 bp, Homo sapiens
agacacacttgatatgtgt

SEQ ID NO: 7195523 - DNA, 19 bp, Homo sapiens
agacacacttgatatgtgt

SEQ ID NO: 7195524 - DNA, 19 bp, Homo sapiens
agacacacttgatatgtgt

SEQ ID NO: 7195525 - DNA, 22 bp, Homo sapiens
agacacagaacacaaaagcata

SEQ ID NO: 7195526 - DNA, 22 bp, Homo sapiens
agacacagaagttgctgttggg

SEQ ID NO: 7195527 - DNA, 22 bp, Homo sapiens
agacacagaagttgctgttggg

SEQ ID NO: 7195528 - DNA, 22 bp, Homo sapiens
agacacagaagttgctgttggg

SEQ ID NO: 7195529 - DNA, 22 bp, Homo sapiens
agacacagaagttgctgttggg

SEQ ID NO: 7195530 - DNA, 22 bp, Homo sapiens
agacacagaagttgctgttggg

SEQ ID NO: 7195531 - DNA, 22 bp, Homo sapiens
agacacagatggtacctgagcc

SEQ ID NO: 7195532 - DNA, 22 bp, Homo sapiens
agacacagatggtacctgagcc

SEQ ID NO: 7195533 - DNA, 22 bp, Homo sapiens
agacacagatggtacctgagcc

SEQ ID NO: 7195534 - DNA, 22 bp, Homo sapiens
agacacagattttggaaaagat

SEQ ID NO: 7195535 - DNA, 22 bp, Homo sapiens
agacacagcaataactactgtt

SEQ ID NO: 7195536 - DNA, 22 bp, Homo sapiens
agacacagcaataactactgtt

SEQ ID NO: 7195537 - DNA, 22 bp, Homo sapiens
agacacagcaataactactgtt

SEQ ID NO: 7195538 - DNA, 22 bp, Homo sapiens
agacacagcagtgcctgcctca

SEQ ID NO: 7195539 - DNA, 22 bp, Homo sapiens
atgcaggagttcgaggctgtat

SEQ ID NO: 7195540 - DNA, 22 bp, Homo sapiens
agacagtgcaagaagagcaggc

SEQ ID NO: 7195541 - DNA, 22 bp, Homo sapiens
agacagtgcaagaagagcaggc

SEQ ID NO: 7195542 - DNA, 22 bp, Homo sapiens
agacagtgcaagaagagcaggc

SEQ ID NO: 7195543 - DNA, 22 bp, Homo sapiens
agacagtgcaagaagagcaggc

SEQ ID NO: 7195544 - DNA, 22 bp, Homo sapiens
agacagtgcaagaagagcaggc

SEQ ID NO: 7195545 - DNA, 22 bp, Homo sapiens
atgcaggcagacactgtgggca

SEQ ID NO: 7195546 - DNA, 21 bp, Homo sapiens
atgcaggctgctcagaagcaa

SEQ ID NO: 7195547 - DNA, 21 bp, Homo sapiens
atgcaggctgctcagaagcaa

SEQ ID NO: 7195548 - DNA, 22 bp, Homo sapiens
atgcagggaaaagagatattat

SEQ ID NO: 7195549 - DNA, 22 bp, Homo sapiens
atgcagggacctttgctttggt

SEQ ID NO: 7195550 - DNA, 22 bp, Homo sapiens
atgcagggacctttgctttggt

SEQ ID NO: 7195551 - DNA, 22 bp, Homo sapiens
atgcagggaggtaagaggtgcc

SEQ ID NO: 7195552 - DNA, 22 bp, Homo sapiens
atgcagggaggtaagaggtgcc

SEQ ID NO: 7195553 - DNA, 22 bp, Homo sapiens
atgcagggaggtaagaggtgcc

SEQ ID NO: 7195554 - DNA, 22 bp, Homo sapiens
atgcagggaggtaagaggtgcc

SEQ ID NO: 7195555 - DNA, 22 bp, Homo sapiens
agacagtgatggacaggcagac

SEQ ID NO: 7195556 - DNA, 22 bp, Homo sapiens
agacagtgatggacaggcagac

SEQ ID NO: 7195557 - DNA, 22 bp, Homo sapiens
agacagtgatggacaggcagac

SEQ ID NO: 7195558 - DNA, 22 bp, Homo sapiens
agacagtgatggacaggcagac

SEQ ID NO: 7195559 - DNA, 22 bp, Homo sapiens
agacagtgatggacaggcagac

SEQ ID NO: 7195560 - DNA, 22 bp, Homo sapiens
agacagtgatgtaagcaggagt

SEQ ID NO: 7195561 - DNA, 22 bp, Homo sapiens
agacagtgatgtaagcaggagt

SEQ ID NO: 7195562 - DNA, 17 bp, Homo sapiens
agacagtgagtgccttg

SEQ ID NO: 7195563 - DNA, 17 bp, Homo sapiens
agacagtgagtgccttg

SEQ ID NO: 7195564 - DNA, 22 bp, Homo sapiens
agacagtgagaatgagttgaaa

SEQ ID NO: 7195565 - DNA, 22 bp, Homo sapiens
agacagtgaggcagagcttccg

SEQ ID NO: 7195566 - DNA, 22 bp, Homo sapiens
agacagtaataaaataggtaag

SEQ ID NO: 7195567 - DNA, 17 bp, Homo sapiens
agacaggttatagttga

SEQ ID NO: 7195568 - DNA, 21 bp, Homo sapiens
agacagtaactcttctactcc

SEQ ID NO: 7195569 - DNA, 22 bp, Homo sapiens
agacagtatgatatatgaatac

SEQ ID NO: 7195570 - DNA, 22 bp, Homo sapiens
agacagtatgatatatgaatac

SEQ ID NO: 7195571 - DNA, 22 bp, Homo sapiens
agacagtgacttagtgaccaga

SEQ ID NO: 7195572 - DNA, 22 bp, Homo sapiens
agacaggtagcaggacagatat

SEQ ID NO: 7195573 - DNA, 22 bp, Homo sapiens
agacaggtagcaggacagatat

SEQ ID NO: 7195574 - DNA, 21 bp, Homo sapiens
agacaggtcagggagaggtga

SEQ ID NO: 7195575 - DNA, 21 bp, Homo sapiens
agacaggtcagggagaggtga

SEQ ID NO: 7195576 - DNA, 21 bp, Homo sapiens
agacaggtcagggagaggtga

SEQ ID NO: 7195577 - DNA, 22 bp, Homo sapiens
agacaggtgctcgcccaagtcc

SEQ ID NO: 7195578 - DNA, 22 bp, Homo sapiens
agacaggtgttttacaacttcg

SEQ ID NO: 7195579 - DNA, 22 bp, Homo sapiens
agacaggtgctcgcccaagtcc

SEQ ID NO: 7195580 - DNA, 22 bp, Homo sapiens
agacacagctgcaggaggtggg

SEQ ID NO: 7195581 - DNA, 22 bp, Homo sapiens
agacacagctgcaggaggtggg

SEQ ID NO: 7195582 - DNA, 22 bp, Homo sapiens
agacacagctgcaggaggtggg

SEQ ID NO: 7195583 - DNA, 22 bp, Homo sapiens
agacacagctgcaggaggtggg

SEQ ID NO: 7195584 - DNA, 22 bp, Homo sapiens
agacacaggattctgcatttct

SEQ ID NO: 7195585 - DNA, 21 bp, Homo sapiens
agacacaggggttgctggggt

SEQ ID NO: 7195586 - DNA, 21 bp, Homo sapiens
agacacaggggttgctggggt

SEQ ID NO: 7195587 - DNA, 21 bp, Homo sapiens
agacacaggggttgctggggt

SEQ ID NO: 7195588 - DNA, 22 bp, Homo sapiens
agacacaggtgtaatttctgct

SEQ ID NO: 7195589 - DNA, 22 bp, Homo sapiens
agacacaggtgtaatttctgct

SEQ ID NO: 7195590 - DNA, 22 bp, Homo sapiens
agacacagtataagcacaacaa

SEQ ID NO: 7195591 - DNA, 22 bp, Homo sapiens
agacacagtctgtctggaggag

SEQ ID NO: 7195592 - DNA, 22 bp, Homo sapiens
agacacagtctgtctggaggag

SEQ ID NO: 7195593 - DNA, 22 bp, Homo sapiens
agacacagtctgtctggaggag

SEQ ID NO: 7195594 - DNA, 22 bp, Homo sapiens
agacacagtctgtctggaggag

SEQ ID NO: 7195595 - DNA, 22 bp, Homo sapiens
agacaggcagcagatggagtgt

SEQ ID NO: 7195596 - DNA, 22 bp, Homo sapiens
agacaggcagcagatggagtgt

SEQ ID NO: 7195597 - DNA, 22 bp, Homo sapiens
agacaggcatgaggctggattg

SEQ ID NO: 7195598 - DNA, 19 bp, Homo sapiens
agacacatcacatttctcc

SEQ ID NO: 7195599 - DNA, 22 bp, Homo sapiens
agacaggcagaggctgcagagg

SEQ ID NO: 7195600 - DNA, 23 bp, Homo sapiens
agacacataggagcagctattgg

SEQ ID NO: 7195601 - DNA, 22 bp, Homo sapiens
agacacataggaccacactgtg

SEQ ID NO: 7195602 - DNA, 22 bp, Homo sapiens
agacacataggaccacactgtg

SEQ ID NO: 7195603 - DNA, 22 bp, Homo sapiens
agacacataggaccacactgtg

SEQ ID NO: 7195604 - DNA, 22 bp, Homo sapiens
agacacagtgagtttctttccc

SEQ ID NO: 7195605 - DNA, 22 bp, Homo sapiens
agacacagtgctgggtgctgag

SEQ ID NO: 7195606 - DNA, 22 bp, Homo sapiens
agacacagtgttgaaggctagt

SEQ ID NO: 7195607 - DNA, 22 bp, Homo sapiens
agacacagtttgggatgggttg

SEQ ID NO: 7195608 - DNA, 22 bp, Homo sapiens
agacacagtttgggatgggttg

SEQ ID NO: 7195609 - DNA, 22 bp, Homo sapiens
agacacagtttgggatgggttg

SEQ ID NO: 7195610 - DNA, 22 bp, Homo sapiens
agacacagtttgggatgggttg

SEQ ID NO: 7195611 - DNA, 22 bp, Homo sapiens
attcagagtctgcacaacagca

SEQ ID NO: 7195612 - DNA, 22 bp, Homo sapiens
attcacagtttcctcatattct

SEQ ID NO: 7195613 - DNA, 22 bp, Homo sapiens
attcacagtttcctcatattct

SEQ ID NO: 7195614 - DNA, 22 bp, Homo sapiens
attcacagttcattagctgtaa

SEQ ID NO: 7195615 - DNA, 22 bp, Homo sapiens
attcacagttcattagctgtaa

SEQ ID NO: 7195616 - DNA, 22 bp, Homo sapiens
attcacagtttcctcatattct

SEQ ID NO: 7195617 - DNA, 22 bp, Homo sapiens
attcacagttactgctgaacca

SEQ ID NO: 7195618 - DNA, 22 bp, Homo sapiens
attcacagttactgctgaacca

SEQ ID NO: 7195619 - DNA, 22 bp, Homo sapiens
attcacagtatggacgaaatga

SEQ ID NO: 7195620 - DNA, 22 bp, Homo sapiens
attcacagttcattagctgtaa

SEQ ID NO: 7195621 - DNA, 22 bp, Homo sapiens
attcacagttcattagctgtaa

SEQ ID NO: 7195622 - DNA, 22 bp, Homo sapiens
attcacagttactgctgaacca

SEQ ID NO: 7195623 - DNA, 22 bp, Homo sapiens
attcacagttactgctgaacca

SEQ ID NO: 7195624 - DNA, 22 bp, Homo sapiens
attcacagggggagaagggtat

SEQ ID NO: 7195625 - DNA, 22 bp, Homo sapiens
attcacagggggagaagggtat

SEQ ID NO: 7195626 - DNA, 22 bp, Homo sapiens
attcacagggggagaagggtat

SEQ ID NO: 7195627 - DNA, 21 bp, Homo sapiens
attcacaggtatcctctccct

SEQ ID NO: 7195628 - DNA, 21 bp, Homo sapiens
attcacaggtatcctctccct

SEQ ID NO: 7195629 - DNA, 22 bp, Homo sapiens
attcacagtatggacgaaatga

SEQ ID NO: 7195630 - DNA, 22 bp, Homo sapiens
attcacagtatggacgaaatga

SEQ ID NO: 7195631 - DNA, 22 bp, Homo sapiens
attcacagggacaatgggagag

SEQ ID NO: 7195632 - DNA, 20 bp, Homo sapiens
attcacaggcacaaaaccct

SEQ ID NO: 7195633 - DNA, 22 bp, Homo sapiens
attcacagggacaatgggagag

SEQ ID NO: 7195634 - DNA, 22 bp, Homo sapiens
attcacagggacaatgggagag

SEQ ID NO: 7195635 - DNA, 22 bp, Homo sapiens
attcacagggacaatgggagag

SEQ ID NO: 7195636 - DNA, 22 bp, Homo sapiens
attcacagggctttccgcatgg

SEQ ID NO: 7195637 - DNA, 22 bp, Homo sapiens
attcacagggctttccgcatgg

SEQ ID NO: 7195638 - DNA, 22 bp, Homo sapiens
attcagcataatcagtagcttg

SEQ ID NO: 7195639 - DNA, 22 bp, Homo sapiens
attcagcagttcctgcttcagt

SEQ ID NO: 7195640 - DNA, 22 bp, Homo sapiens
attcagcagttcctgcttcagt

SEQ ID NO: 7195641 - DNA, 22 bp, Homo sapiens
attcagcagttcctgcttcagt

SEQ ID NO: 7195642 - DNA, 22 bp, Homo sapiens
attcagcacatctttgtacagc

SEQ ID NO: 7195643 - DNA, 22 bp, Homo sapiens
attcagcacatctttgtacagc

SEQ ID NO: 7195644 - DNA, 22 bp, Homo sapiens
attcagcataatcagtagcttg

SEQ ID NO: 7195645 - DNA, 22 bp, Homo sapiens
attcagcatgcaattaggtaat

SEQ ID NO: 7195646 - DNA, 22 bp, Homo sapiens
attcagcattcattatgcgcca

SEQ ID NO: 7195647 - DNA, 22 bp, Homo sapiens
attcagcattcatttccaactt

SEQ ID NO: 7195648 - DNA, 22 bp, Homo sapiens
attcagcattcatttccaactt

SEQ ID NO: 7195649 - DNA, 19 bp, Homo sapiens
attcagcattctgcacttc

SEQ ID NO: 7195650 - DNA, 19 bp, Homo sapiens
attcagcattctgcacttc

SEQ ID NO: 7195651 - DNA, 22 bp, Homo sapiens
attcagatcatatttatagctt

SEQ ID NO: 7195652 - DNA, 22 bp, Homo sapiens
attcagattcctaggtttcatt

SEQ ID NO: 7195653 - DNA, 22 bp, Homo sapiens
attcagattggtttaagctagt

SEQ ID NO: 7195654 - DNA, 22 bp, Homo sapiens
attcagattggtttaagctagt

SEQ ID NO: 7195655 - DNA, 22 bp, Homo sapiens
attcagcaaacatttattatct

SEQ ID NO: 7195656 - DNA, 22 bp, Homo sapiens
attcagcaaacatttattgtgt

SEQ ID NO: 7195657 - DNA, 22 bp, Homo sapiens
attcagcaagctatgggacagg

SEQ ID NO: 7195658 - DNA, 22 bp, Homo sapiens
attcagcaagctatgggacagg

SEQ ID NO: 7195659 - DNA, 22 bp, Homo sapiens
attcagcaagctatgggacagg

SEQ ID NO: 7195660 - DNA, 22 bp, Homo sapiens
attcagcacaatttggccaata

SEQ ID NO: 7195661 - DNA, 22 bp, Homo sapiens
attcagcacatctttgtacagc

SEQ ID NO: 7195662 - DNA, 22 bp, Homo sapiens
attcagcacatctttgtacagc

SEQ ID NO: 7195663 - DNA, 22 bp, Homo sapiens
attcagcacatctttgtacagc

SEQ ID NO: 7195664 - DNA, 22 bp, Homo sapiens
attatagagggttacagttaat

SEQ ID NO: 7195665 - DNA, 22 bp, Homo sapiens
attcaaagcccagtaaacattg

SEQ ID NO: 7195666 - DNA, 22 bp, Homo sapiens
attcaaagcccagtaaacattg

SEQ ID NO: 7195667 - DNA, 22 bp, Homo sapiens
attcaaagcccagtaaacattg

SEQ ID NO: 7195668 - DNA, 22 bp, Homo sapiens
attcacaattagaagtagataa

SEQ ID NO: 7195669 - DNA, 22 bp, Homo sapiens
attcaaagtaataaccagaact

SEQ ID NO: 7195670 - DNA, 22 bp, Homo sapiens
attcacaattagaagtagataa

SEQ ID NO: 7195671 - DNA, 22 bp, Homo sapiens
attcacaattagaagtagataa

SEQ ID NO: 7195672 - DNA, 22 bp, Homo sapiens
attcacaattagaagtagataa

SEQ ID NO: 7195673 - DNA, 22 bp, Homo sapiens
attcacagaatagttttaccag

SEQ ID NO: 7195674 - DNA, 22 bp, Homo sapiens
attcacagagtggttagtggta

SEQ ID NO: 7195675 - DNA, 22 bp, Homo sapiens
attcacagagtggttagtggta

SEQ ID NO: 7195676 - DNA, 22 bp, Homo sapiens
attcacagagtggttagtggta

SEQ ID NO: 7195677 - DNA, 20 bp, Homo sapiens
attcacaggcacaaaaccct

SEQ ID NO: 7195678 - DNA, 22 bp, Homo sapiens
attcacagaatagttttaccag

SEQ ID NO: 7195679 - DNA, 22 bp, Homo sapiens
attcacagaatagttttaccag

SEQ ID NO: 7195680 - DNA, 22 bp, Homo sapiens
attcacacatactcatgtgtga

SEQ ID NO: 7195681 - DNA, 22 bp, Homo sapiens
attcacactgtatacacaggat

SEQ ID NO: 7195682 - DNA, 22 bp, Homo sapiens
attataaagaacatgtgtgtgg

SEQ ID NO: 7195683 - DNA, 22 bp, Homo sapiens
attataaagaacatgtgtgtgg

SEQ ID NO: 7195684 - DNA, 22 bp, Homo sapiens
attataaagaacatgtgtgtgg

SEQ ID NO: 7195685 - DNA, 22 bp, Homo sapiens
attataaacctttgagggtggg

SEQ ID NO: 7195686 - DNA, 22 bp, Homo sapiens
attataaacctttgagggtggg

SEQ ID NO: 7195687 - DNA, 22 bp, Homo sapiens
attataaatattttctaggggt

SEQ ID NO: 7195688 - DNA, 22 bp, Homo sapiens
attataaatattttctaggggt

SEQ ID NO: 7195689 - DNA, 22 bp, Homo sapiens
attataaatattttctaggggt

SEQ ID NO: 7195690 - DNA, 22 bp, Homo sapiens
attataaatattttctaggggt

SEQ ID NO: 7195691 - DNA, 22 bp, Homo sapiens
attatacattttgtgtagagat

SEQ ID NO: 7195692 - DNA, 22 bp, Homo sapiens
attctgtaattgaactgtgttg

SEQ ID NO: 7195693 - DNA, 22 bp, Homo sapiens
attctgtagggcttgctgacac

SEQ ID NO: 7195694 - DNA, 22 bp, Homo sapiens
attctgtatggaaaagcactat

SEQ ID NO: 7195695 - DNA, 22 bp, Homo sapiens
attctgtatggaaaagcactat

SEQ ID NO: 7195696 - DNA, 22 bp, Homo sapiens
attctggggctggttattttga

SEQ ID NO: 7195697 - DNA, 22 bp, Homo sapiens
attctggggctggttattttga

SEQ ID NO: 7195698 - DNA, 22 bp, Homo sapiens
attctgtatggggaaactagag

SEQ ID NO: 7195699 - DNA, 22 bp, Homo sapiens
attctgtatggggaaactagag

SEQ ID NO: 7195700 - DNA, 22 bp, Homo sapiens
attctgtatttctaataagatc

SEQ ID NO: 7195701 - DNA, 22 bp, Homo sapiens
attctgtatttctaataagatc

SEQ ID NO: 7195702 - DNA, 22 bp, Homo sapiens
attctgtatttctaataagatc

SEQ ID NO: 7195703 - DNA, 22 bp, Homo sapiens
attctgtatttggatataaggg

SEQ ID NO: 7195704 - DNA, 22 bp, Homo sapiens
attctgtcagatcttactggat

SEQ ID NO: 7195705 - DNA, 21 bp, Homo sapiens
agagggagagtggcccttcca

SEQ ID NO: 7195706 - DNA, 21 bp, Homo sapiens
agagggagagtggcccttcca

SEQ ID NO: 7195707 - DNA, 21 bp, Homo sapiens
agagggagagtggcccttcca

SEQ ID NO: 7195708 - DNA, 22 bp, Homo sapiens
attctggattatcagtccacca

SEQ ID NO: 7195709 - DNA, 22 bp, Homo sapiens
attctggattatcagtccacca

SEQ ID NO: 7195710 - DNA, 22 bp, Homo sapiens
attctggatattacttatctat

SEQ ID NO: 7195711 - DNA, 22 bp, Homo sapiens
attctggacaatgagaaactgg

SEQ ID NO: 7195712 - DNA, 22 bp, Homo sapiens
attctggacaatgagaaactgg

SEQ ID NO: 7195713 - DNA, 22 bp, Homo sapiens
attctggacaaggcaagctcct

SEQ ID NO: 7195714 - DNA, 22 bp, Homo sapiens
attctggattatcagtccacca

SEQ ID NO: 7195715 - DNA, 22 bp, Homo sapiens
attctggccttggctctgtcac

SEQ ID NO: 7195716 - DNA, 22 bp, Homo sapiens
attctggacaaggcaagctcct

SEQ ID NO: 7195717 - DNA, 22 bp, Homo sapiens
attctggacaaggcaagctcct

SEQ ID NO: 7195718 - DNA, 22 bp, Homo sapiens
attctctgtggtgatgctggtg

SEQ ID NO: 7195719 - DNA, 22 bp, Homo sapiens
attctctgttcaaggatggtga

SEQ ID NO: 7195720 - DNA, 22 bp, Homo sapiens
attcagcttcaatgtcttcacc

SEQ ID NO: 7195721 - DNA, 22 bp, Homo sapiens
attcagctgatggtatttaaat

SEQ ID NO: 7195722 - DNA, 22 bp, Homo sapiens
attcagcattggcaccatggat

SEQ ID NO: 7195723 - DNA, 22 bp, Homo sapiens
agagggatggccccgtaactca

SEQ ID NO: 7195724 - DNA, 22 bp, Homo sapiens
agagggcaagtgtagtccagta

SEQ ID NO: 7195725 - DNA, 22 bp, Homo sapiens
agagggcaagtgtagtccagta

SEQ ID NO: 7195726 - DNA, 22 bp, Homo sapiens
agagggataatatgtattgtaa

SEQ ID NO: 7195727 - DNA, 22 bp, Homo sapiens
agagggagtgaaatggaataga

SEQ ID NO: 7195728 - DNA, 22 bp, Homo sapiens
agagggagtgaaatggaataga

SEQ ID NO: 7195729 - DNA, 23 bp, Homo sapiens
agagggagatgtttttctcaaga

SEQ ID NO: 7195730 - DNA, 23 bp, Homo sapiens
agagggagatgtttttctcaaga

SEQ ID NO: 7195731 - DNA, 22 bp, Homo sapiens
agagggagcccagtcatagctg

SEQ ID NO: 7195732 - DNA, 22 bp, Homo sapiens
agagggagcccagtcatagctg

SEQ ID NO: 7195733 - DNA, 22 bp, Homo sapiens
agagggagcccagtcatagctg

SEQ ID NO: 7195734 - DNA, 22 bp, Homo sapiens
agagggagcccagtcatagctg

SEQ ID NO: 7195735 - DNA, 22 bp, Homo sapiens
agagggagctttatttttctgt

SEQ ID NO: 7195736 - DNA, 22 bp, Homo sapiens
agagggagctttatttttctgt

SEQ ID NO: 7195737 - DNA, 22 bp, Homo sapiens
agagggagtgaaatggaataga

SEQ ID NO: 7195738 - DNA, 22 bp, Homo sapiens
agagggagtgaaatggaataga

SEQ ID NO: 7195739 - DNA, 22 bp, Homo sapiens
agaggggctcatatcctgtcat

SEQ ID NO: 7195740 - DNA, 22 bp, Homo sapiens
agaggggctcatatcctgtcat

SEQ ID NO: 7195741 - DNA, 22 bp, Homo sapiens
agaggggctcaagcagtggtct

SEQ ID NO: 7195742 - DNA, 22 bp, Homo sapiens
agaggggctcaagcagtggtct

SEQ ID NO: 7195743 - DNA, 22 bp, Homo sapiens
agagggtatgagtggggctaaa

SEQ ID NO: 7195744 - DNA, 22 bp, Homo sapiens
agagggtatgagtggggctaaa

SEQ ID NO: 7195745 - DNA, 22 bp, Homo sapiens
agagggtcaaccaggagcgtca

SEQ ID NO: 7195746 - DNA, 22 bp, Homo sapiens
agagggtcaaccaggagcgtca

SEQ ID NO: 7195747 - DNA, 23 bp, Homo sapiens
agagggtgcaacatggggatcta

SEQ ID NO: 7195748 - DNA, 23 bp, Homo sapiens
agagggtgcaacatggggatcta

SEQ ID NO: 7195749 - DNA, 22 bp, Homo sapiens
agagggtgctggagagacattg

SEQ ID NO: 7195750 - DNA, 23 bp, Homo sapiens
agagggtgcaacatggggatcta

SEQ ID NO: 7195751 - DNA, 22 bp, Homo sapiens
agagggtgctggagagacattg

SEQ ID NO: 7195752 - DNA, 22 bp, Homo sapiens
agagggtgggcacgtgatggat

SEQ ID NO: 7195753 - DNA, 22 bp, Homo sapiens
atgttttaaatatgtgtgtaaa

SEQ ID NO: 7195754 - DNA, 22 bp, Homo sapiens
atgttttaaatatgtgtgtaaa

SEQ ID NO: 7195755 - DNA, 22 bp, Homo sapiens
atgttttaaatatgtgtgtaaa

SEQ ID NO: 7195756 - DNA, 22 bp, Homo sapiens
atgtttgttgatcatttatgaa

SEQ ID NO: 7195757 - DNA, 22 bp, Homo sapiens
atgtttgttgatcatttatgaa

SEQ ID NO: 7195758 - DNA, 22 bp, Homo sapiens
atgtttgttgatcatttatgaa

SEQ ID NO: 7195759 - DNA, 22 bp, Homo sapiens
atgtttgttgaatgaagaaagg

SEQ ID NO: 7195760 - DNA, 22 bp, Homo sapiens
atgtttgttgaatgaagaaagg

SEQ ID NO: 7195761 - DNA, 22 bp, Homo sapiens
atgtttgtgtttcccattcagg

SEQ ID NO: 7195762 - DNA, 22 bp, Homo sapiens
atgtttgtgtttcccattcagg

SEQ ID NO: 7195763 - DNA, 22 bp, Homo sapiens
atgtttgtgtttgctatgcggt

SEQ ID NO: 7195764 - DNA, 22 bp, Homo sapiens
atgtttgtgtttgctatgcggt

SEQ ID NO: 7195765 - DNA, 22 bp, Homo sapiens
atgtttgttgaacatctactgc

SEQ ID NO: 7195766 - DNA, 22 bp, Homo sapiens
atgtttgttgaacatctactgc

SEQ ID NO: 7195767 - DNA, 22 bp, Homo sapiens
atgtttgtaggtaagtgacact

SEQ ID NO: 7195768 - DNA, 22 bp, Homo sapiens
atgtttgtaggtaagtgacact

SEQ ID NO: 7195769 - DNA, 22 bp, Homo sapiens
atgtttgtcaggattgtaatta

SEQ ID NO: 7195770 - DNA, 22 bp, Homo sapiens
atgtttgtcaggattgtaatta

SEQ ID NO: 7195771 - DNA, 22 bp, Homo sapiens
atgtttgtcaggattgtaatta

SEQ ID NO: 7195772 - DNA, 22 bp, Homo sapiens
atgtttgtccctgacatcctct

SEQ ID NO: 7195773 - DNA, 22 bp, Homo sapiens
atgtttgtccctgacatcctct

SEQ ID NO: 7195774 - DNA, 22 bp, Homo sapiens
atgtttgtgggataaacaaatg

SEQ ID NO: 7195775 - DNA, 22 bp, Homo sapiens
atgtttgtgggataaacaaatg

SEQ ID NO: 7195776 - DNA, 22 bp, Homo sapiens
atgtttgtgttacactctgcag

SEQ ID NO: 7195777 - DNA, 22 bp, Homo sapiens
atgtttgtgttacactctgcag

SEQ ID NO: 7195778 - DNA, 22 bp, Homo sapiens
attaaagctatccagtcatgaa

SEQ ID NO: 7195779 - DNA, 22 bp, Homo sapiens
attaaagacagcagatggatgg

SEQ ID NO: 7195780 - DNA, 22 bp, Homo sapiens
attaaagtgaagttctcagatg

SEQ ID NO: 7195781 - DNA, 22 bp, Homo sapiens
attaaagctatccagtcatgaa

SEQ ID NO: 7195782 - DNA, 22 bp, Homo sapiens
attaaagtgaagttctcagatg

SEQ ID NO: 7195783 - DNA, 22 bp, Homo sapiens
attaaagaaacccagcatgtga

SEQ ID NO: 7195784 - DNA, 22 bp, Homo sapiens
attaaacaatgtaaagttcttg

SEQ ID NO: 7195785 - DNA, 22 bp, Homo sapiens
attaaacaatgtaaagttcttg

SEQ ID NO: 7195786 - DNA, 22 bp, Homo sapiens
atgttttaccctttgcacaaac

SEQ ID NO: 7195787 - DNA, 22 bp, Homo sapiens
atgttttaccctttgcacaaac

SEQ ID NO: 7195788 - DNA, 22 bp, Homo sapiens
atgttttaccctttgcacaaac

SEQ ID NO: 7195789 - DNA, 22 bp, Homo sapiens
attaaacaatgtaaagttcttg

SEQ ID NO: 7195790 - DNA, 22 bp, Homo sapiens
attaaaccccagttctcttact

SEQ ID NO: 7195791 - DNA, 22 bp, Homo sapiens
attaaactgagcaaattaacat

SEQ ID NO: 7195792 - DNA, 22 bp, Homo sapiens
attaaactgagcaaattaacat

SEQ ID NO: 7195793 - DNA, 22 bp, Homo sapiens
attaaatactgcaggctaagca

SEQ ID NO: 7195794 - DNA, 22 bp, Homo sapiens
attaaagtgaagttctcagatg

SEQ ID NO: 7195795 - DNA, 22 bp, Homo sapiens
attaaagttgaaattgaactga

SEQ ID NO: 7195796 - DNA, 22 bp, Homo sapiens
attaaagttgaaattgaactga

SEQ ID NO: 7195797 - DNA, 22 bp, Homo sapiens
attaaagttgaaattgaactga

SEQ ID NO: 7195798 - DNA, 22 bp, Homo sapiens
attaaatactgcaggctaagca

SEQ ID NO: 7195799 - DNA, 22 bp, Homo sapiens
attaaatactgcaggctaagca

SEQ ID NO: 7195800 - DNA, 22 bp, Homo sapiens
attacagtaggattggaaagga

SEQ ID NO: 7195801 - DNA, 22 bp, Homo sapiens
attacagtgccacctcgtggtc

SEQ ID NO: 7195802 - DNA, 22 bp, Homo sapiens
attagatgtgtttaagtagaga

SEQ ID NO: 7195803 - DNA, 22 bp, Homo sapiens
attagatgtgtttaagtagaga

SEQ ID NO: 7195804 - DNA, 22 bp, Homo sapiens
attagattgtaaatgttttcac

SEQ ID NO: 7195805 - DNA, 22 bp, Homo sapiens
attagattgtaaatgttttcac

SEQ ID NO: 7195806 - DNA, 22 bp, Homo sapiens
attagattgtaaatgttttcac

SEQ ID NO: 7195807 - DNA, 22 bp, Homo sapiens
attagcaaaacaacttttctat

SEQ ID NO: 7195808 - DNA, 22 bp, Homo sapiens
attagcaaattctaattcacta

SEQ ID NO: 7195809 - DNA, 22 bp, Homo sapiens
attagcaaattctaattcacta

SEQ ID NO: 7195810 - DNA, 22 bp, Homo sapiens
attagcaaattctaattcacta

SEQ ID NO: 7195811 - DNA, 22 bp, Homo sapiens
attagcaacatggtgaatatgt

SEQ ID NO: 7195812 - DNA, 22 bp, Homo sapiens
attagcaactcttatgtaagca

SEQ ID NO: 7195813 - DNA, 22 bp, Homo sapiens
attagcaagttttccagctaat

SEQ ID NO: 7195814 - DNA, 22 bp, Homo sapiens
attagcaagttgttatcctttg

SEQ ID NO: 7195815 - DNA, 22 bp, Homo sapiens
attagcaaggttcatgagaaga

SEQ ID NO: 7195816 - DNA, 22 bp, Homo sapiens
attagcaactgtcttgaaaaca

SEQ ID NO: 7195817 - DNA, 22 bp, Homo sapiens
attagcaaggcagcatcaggca

SEQ ID NO: 7195818 - DNA, 22 bp, Homo sapiens
attagcaaggcagcatcaggca

SEQ ID NO: 7195819 - DNA, 21 bp, Homo sapiens
attagcaaggggaggcctcag

SEQ ID NO: 7195820 - DNA, 22 bp, Homo sapiens
attagcatattaaatagtcatt

SEQ ID NO: 7195821 - DNA, 22 bp, Homo sapiens
attagcatgccaagcttttaga

SEQ ID NO: 7195822 - DNA, 22 bp, Homo sapiens
attagcataagtgttcggtgca

SEQ ID NO: 7195823 - DNA, 22 bp, Homo sapiens
attagcatattaaatagtcatt

SEQ ID NO: 7195824 - DNA, 22 bp, Homo sapiens
attagcaatctgaaaattgcgg

SEQ ID NO: 7195825 - DNA, 22 bp, Homo sapiens
attagcaatctgcaatggctgt

SEQ ID NO: 7195826 - DNA, 22 bp, Homo sapiens
attagcaatggtggtattagga

SEQ ID NO: 7195827 - DNA, 22 bp, Homo sapiens
attagcaatcacgcagtcattt

SEQ ID NO: 7195828 - DNA, 22 bp, Homo sapiens
attagcaattgccctgtgcaat

SEQ ID NO: 7195829 - DNA, 22 bp, Homo sapiens
attagcaattgtgcatctagta

SEQ ID NO: 7195830 - DNA, 22 bp, Homo sapiens
attagcaattgtttcattgatc

SEQ ID NO: 7195831 - DNA, 22 bp, Homo sapiens
attagcatgccaagcttttaga

SEQ ID NO: 7195832 - DNA, 22 bp, Homo sapiens
attagcatgccaagcttttaga

SEQ ID NO: 7195833 - DNA, 19 bp, Homo sapiens
attagcatgcttgaggatg

SEQ ID NO: 7195834 - DNA, 22 bp, Homo sapiens
attagcattgctactctcaaga

SEQ ID NO: 7195835 - DNA, 22 bp, Homo sapiens
attagcctccttgtctcatgcg

SEQ ID NO: 7195836 - DNA, 22 bp, Homo sapiens
attagcctgctctttagtgaaa

SEQ ID NO: 7195837 - DNA, 22 bp, Homo sapiens
attagcctgttgcattttcact

SEQ ID NO: 7195838 - DNA, 22 bp, Homo sapiens
attagccttaataatttagaag

SEQ ID NO: 7195839 - DNA, 22 bp, Homo sapiens
attagccttggtaagtctttca

SEQ ID NO: 7195840 - DNA, 22 bp, Homo sapiens
attagctaggaaattttgtgtc

SEQ ID NO: 7195841 - DNA, 22 bp, Homo sapiens
attagctatatgctatgtgcca

SEQ ID NO: 7195842 - DNA, 20 bp, Homo sapiens
attagctcaggtgaggtcat

SEQ ID NO: 7195843 - DNA, 22 bp, Homo sapiens
attagctgacctctaaggagcc

SEQ ID NO: 7195844 - DNA, 22 bp, Homo sapiens
attagctgttgtgaaaggggtg

SEQ ID NO: 7195845 - DNA, 22 bp, Homo sapiens
atgtgtgtacacacgtgactct

SEQ ID NO: 7195846 - DNA, 22 bp, Homo sapiens
atgtgtgtacacacgtgactct

SEQ ID NO: 7195847 - DNA, 22 bp, Homo sapiens
atgttaaagatggtgggaaatt

SEQ ID NO: 7195848 - DNA, 22 bp, Homo sapiens
atgttaaataatcccttaaagc

SEQ ID NO: 7195849 - DNA, 22 bp, Homo sapiens
atgttaaataatcccttaaagc

SEQ ID NO: 7195850 - DNA, 22 bp, Homo sapiens
atgtgtgtaaacaagtataatt

SEQ ID NO: 7195851 - DNA, 22 bp, Homo sapiens
atgtgtgtaaacaagtataatt

SEQ ID NO: 7195852 - DNA, 22 bp, Homo sapiens
atgtgtgtacacacgtgactct

SEQ ID NO: 7195853 - DNA, 22 bp, Homo sapiens
atgtgtgtacacacgtgactct

SEQ ID NO: 7195854 - DNA, 22 bp, Homo sapiens
atgtgtgtacacacgtgactct

SEQ ID NO: 7195855 - DNA, 21 bp, Homo sapiens
atgtgtgctagaggactactg

SEQ ID NO: 7195856 - DNA, 22 bp, Homo sapiens
atgtgtgctcttgagccttcac

SEQ ID NO: 7195857 - DNA, 23 bp, Homo sapiens
atgtgtgggaggtcagagagcca

SEQ ID NO: 7195858 - DNA, 23 bp, Homo sapiens
atgtgtgggaggtcagagagcca

SEQ ID NO: 7195859 - DNA, 23 bp, Homo sapiens
atgtgtgggaggtcagagagcca

SEQ ID NO: 7195860 - DNA, 23 bp, Homo sapiens
atgtgtgggaggtcagagagcca

SEQ ID NO: 7195861 - DNA, 22 bp, Homo sapiens
atgtgtgtaaacaagtataatt

SEQ ID NO: 7195862 - DNA, 22 bp, Homo sapiens
atgtgtgtaaacaagtataatt

SEQ ID NO: 7195863 - DNA, 22 bp, Homo sapiens
atgtgtgtaaacaagtataatt

SEQ ID NO: 7195864 - DNA, 22 bp, Homo sapiens
atgtgtgtaaacaagtataatt

SEQ ID NO: 7195865 - DNA, 22 bp, Homo sapiens
atgtgtgtaaacaagtataatt

SEQ ID NO: 7195866 - DNA, 22 bp, Homo sapiens
atgtgtatccatctgtctattt

SEQ ID NO: 7195867 - DNA, 22 bp, Homo sapiens
atgtgtatccatctgtctattt

SEQ ID NO: 7195868 - DNA, 22 bp, Homo sapiens
atgtgtctttcaaggtatagaa

SEQ ID NO: 7195869 - DNA, 22 bp, Homo sapiens
atgtgtctttcaaggtatagaa

SEQ ID NO: 7195870 - DNA, 18 bp, Homo sapiens
atgtgtctttcttgtttg

SEQ ID NO: 7195871 - DNA, 18 bp, Homo sapiens
atgtgtctttcttgtttg

SEQ ID NO: 7195872 - DNA, 22 bp, Homo sapiens
atgtgtctttgagactctgcta

SEQ ID NO: 7195873 - DNA, 22 bp, Homo sapiens
atgtgtctttgagactctgcta

SEQ ID NO: 7195874 - DNA, 22 bp, Homo sapiens
atgtgtgcaatgctattttggc

SEQ ID NO: 7195875 - DNA, 22 bp, Homo sapiens
atgtgtgcatattctgccacct

SEQ ID NO: 7195876 - DNA, 22 bp, Homo sapiens
atgtgtgcatcaatgatagatc

SEQ ID NO: 7195877 - DNA, 22 bp, Homo sapiens
atgtgtgcatgttagagagagt

SEQ ID NO: 7195878 - DNA, 22 bp, Homo sapiens
atgtgtgcatgttagagagagt

SEQ ID NO: 7195879 - DNA, 22 bp, Homo sapiens
atgtgtgccccttttactcttt

SEQ ID NO: 7195880 - DNA, 22 bp, Homo sapiens
atgtgtgcctgagtgatggact

SEQ ID NO: 7195881 - DNA, 22 bp, Homo sapiens
atgtgtgcgggaaggaaagtga

SEQ ID NO: 7195882 - DNA, 22 bp, Homo sapiens
atgtgtgctacaggtgtgggaa

SEQ ID NO: 7195883 - DNA, 22 bp, Homo sapiens
atgttaaatggtttattattaa

SEQ ID NO: 7195884 - DNA, 23 bp, Homo sapiens
atgttaagaaggtagttaggata

SEQ ID NO: 7195885 - DNA, 22 bp, Homo sapiens
atgttaagaatgcagacaaatg

SEQ ID NO: 7195886 - DNA, 22 bp, Homo sapiens
atgttaagaatgcagacaaatg

SEQ ID NO: 7195887 - DNA, 23 bp, Homo sapiens
atgttaagtgaaataggccagga

SEQ ID NO: 7195888 - DNA, 22 bp, Homo sapiens
atgttaagtttagcaggctagg

SEQ ID NO: 7195889 - DNA, 17 bp, Homo sapiens
atgttaatttcacattt

SEQ ID NO: 7195890 - DNA, 17 bp, Homo sapiens
atgttaatttcacattt

SEQ ID NO: 7195891 - DNA, 17 bp, Homo sapiens
atgttaatttcacattt

SEQ ID NO: 7195892 - DNA, 22 bp, Homo sapiens
atgttaagttactgaaatgaga

SEQ ID NO: 7195893 - DNA, 22 bp, Homo sapiens
atgttacaaatcctacaggtag

SEQ ID NO: 7195894 - DNA, 22 bp, Homo sapiens
atgttacaaccctgaggagccg

SEQ ID NO: 7195895 - DNA, 22 bp, Homo sapiens
atgttacaatccaacaaaatta

SEQ ID NO: 7195896 - DNA, 22 bp, Homo sapiens
atgttacaatccaacaaaatta

SEQ ID NO: 7195897 - DNA, 22 bp, Homo sapiens
atgttaaatggtttattattaa

SEQ ID NO: 7195898 - DNA, 22 bp, Homo sapiens
atgttaaatggtttattattaa

SEQ ID NO: 7195899 - DNA, 22 bp, Homo sapiens
atgttaaatggtttattattaa

SEQ ID NO: 7195900 - DNA, 22 bp, Homo sapiens
atgttaaatggtttattattaa

SEQ ID NO: 7195901 - DNA, 22 bp, Homo sapiens
atgttaaatagccatttgtttg

SEQ ID NO: 7195902 - DNA, 20 bp, Homo sapiens
atgttaaatagcatttagag

SEQ ID NO: 7195903 - DNA, 22 bp, Homo sapiens
atgttaaatagccatttgtttg

SEQ ID NO: 7195904 - DNA, 22 bp, Homo sapiens
atgttaaatagccatttgtttg

SEQ ID NO: 7195905 - DNA, 22 bp, Homo sapiens
atgttaaataatcccttaaagc

SEQ ID NO: 7195906 - DNA, 20 bp, Homo sapiens
atgttaaatagcatttagag

SEQ ID NO: 7195907 - DNA, 20 bp, Homo sapiens
atgttaaatagcatttagag

SEQ ID NO: 7195908 - DNA, 20 bp, Homo sapiens
atgttaaatagcatttagag

SEQ ID NO: 7195909 - DNA, 22 bp, Homo sapiens
atgtttatgttgggctatattt

SEQ ID NO: 7195910 - DNA, 22 bp, Homo sapiens
atgttacaatccaacaaaatta

SEQ ID NO: 7195911 - DNA, 22 bp, Homo sapiens
atgttacacataggcataaatg

SEQ ID NO: 7195912 - DNA, 22 bp, Homo sapiens
atgttacaattcaaaatgctgc

SEQ ID NO: 7195913 - DNA, 22 bp, Homo sapiens
atgtttgactgagtttggcaga

SEQ ID NO: 7195914 - DNA, 23 bp, Homo sapiens
atgtttgcagtaacccatcctgg

SEQ ID NO: 7195915 - DNA, 23 bp, Homo sapiens
atgtttgcagtaacccatcctgg

SEQ ID NO: 7195916 - DNA, 22 bp, Homo sapiens
atgtttgcattcttattatcgt

SEQ ID NO: 7195917 - DNA, 22 bp, Homo sapiens
atgtttgctattgttctagtgg

SEQ ID NO: 7195918 - DNA, 19 bp, Homo sapiens
atgtttgcttgagtaataa

SEQ ID NO: 7195919 - DNA, 22 bp, Homo sapiens
atttattgaacactgactatgt

SEQ ID NO: 7195920 - DNA, 22 bp, Homo sapiens
atttattgaacactgactatgt

SEQ ID NO: 7195921 - DNA, 22 bp, Homo sapiens
atttattgaacactgactatgt

SEQ ID NO: 7195922 - DNA, 22 bp, Homo sapiens
atttattgaacactgactatgt

SEQ ID NO: 7195923 - DNA, 22 bp, Homo sapiens
atttattgaacactgactatgt

SEQ ID NO: 7195924 - DNA, 22 bp, Homo sapiens
atttattgaacactgactatgt

SEQ ID NO: 7195925 - DNA, 22 bp, Homo sapiens
atttattgaacactgactatgt

SEQ ID NO: 7195926 - DNA, 22 bp, Homo sapiens
atttattattgtggttacttct

SEQ ID NO: 7195927 - DNA, 22 bp, Homo sapiens
atttattattgtggttacttct

SEQ ID NO: 7195928 - DNA, 22 bp, Homo sapiens
atttattattgtggttacttct

SEQ ID NO: 7195929 - DNA, 22 bp, Homo sapiens
atttattattgtggttacttct

SEQ ID NO: 7195930 - DNA, 22 bp, Homo sapiens
atttattattgtggttacttct

SEQ ID NO: 7195931 - DNA, 22 bp, Homo sapiens
atttattattgtggttacttct

SEQ ID NO: 7195932 - DNA, 22 bp, Homo sapiens
atttattattgtggttacttct

SEQ ID NO: 7195933 - DNA, 22 bp, Homo sapiens
atttattattgtggttacttct

SEQ ID NO: 7195934 - DNA, 22 bp, Homo sapiens
atttattattgtggttacttct

SEQ ID NO: 7195935 - DNA, 22 bp, Homo sapiens
atttagtttaggaaaagtaggt

SEQ ID NO: 7195936 - DNA, 22 bp, Homo sapiens
atttagtttaggaaaagtaggt

SEQ ID NO: 7195937 - DNA, 22 bp, Homo sapiens
atttattatgggatttggctca

SEQ ID NO: 7195938 - DNA, 22 bp, Homo sapiens
atttattatgggatttggctca

SEQ ID NO: 7195939 - DNA, 22 bp, Homo sapiens
atttattatgggatttggctca

SEQ ID NO: 7195940 - DNA, 22 bp, Homo sapiens
atttattatgggatttggctca

SEQ ID NO: 7195941 - DNA, 22 bp, Homo sapiens
atttagtgaccagcactagaaa

SEQ ID NO: 7195942 - DNA, 22 bp, Homo sapiens
atttagtgaccagcactagaaa

SEQ ID NO: 7195943 - DNA, 22 bp, Homo sapiens
atttagtgtatcaatgtgatat

SEQ ID NO: 7195944 - DNA, 22 bp, Homo sapiens
atttagtgtattctaatatgtg

SEQ ID NO: 7195945 - DNA, 22 bp, Homo sapiens
atttagtgtgtattgctattat

SEQ ID NO: 7195946 - DNA, 17 bp, Homo sapiens
atttagcaagtagacag

SEQ ID NO: 7195947 - DNA, 22 bp, Homo sapiens
atttagcacctccatctcaaca

SEQ ID NO: 7195948 - DNA, 22 bp, Homo sapiens
atttagcttacctcgttactga

SEQ ID NO: 7195949 - DNA, 22 bp, Homo sapiens
atttagtaagtacttgttgaat

SEQ ID NO: 7195950 - DNA, 22 bp, Homo sapiens
atttagtaagtacttgttgaat

SEQ ID NO: 7195951 - DNA, 22 bp, Homo sapiens
atttagtgaaacccataaagca

SEQ ID NO: 7195952 - DNA, 22 bp, Homo sapiens
atttagtgaaacccataaagca

SEQ ID NO: 7195953 - DNA, 22 bp, Homo sapiens
agagtgggacacgggcgctgtc

SEQ ID NO: 7195954 - DNA, 22 bp, Homo sapiens
agagtgggacacgggcgctgtc

SEQ ID NO: 7195955 - DNA, 22 bp, Homo sapiens
agagtgggacacgggcgctgtc

SEQ ID NO: 7195956 - DNA, 22 bp, Homo sapiens
agagtgggcaggagcctcgact

SEQ ID NO: 7195957 - DNA, 22 bp, Homo sapiens
agagtgggcaggagcctcgact

SEQ ID NO: 7195958 - DNA, 22 bp, Homo sapiens
agagtgggacacgggcgctgtc

SEQ ID NO: 7195959 - DNA, 22 bp, Homo sapiens
agagtgggcaggagcctcgact

SEQ ID NO: 7195960 - DNA, 22 bp, Homo sapiens
agagtgggacacgggcgctgtc

SEQ ID NO: 7195961 - DNA, 22 bp, Homo sapiens
agagtgggcctagctgtaaaag

SEQ ID NO: 7195962 - DNA, 22 bp, Homo sapiens
agagtgggcctctgagtcccag

SEQ ID NO: 7195963 - DNA, 22 bp, Homo sapiens
agagtgggcaggagcctcgact

SEQ ID NO: 7195964 - DNA, 22 bp, Homo sapiens
agagtgggcctctgagtcccag

SEQ ID NO: 7195965 - DNA, 22 bp, Homo sapiens
agagtgggcctctgagtcccag

SEQ ID NO: 7195966 - DNA, 22 bp, Homo sapiens
agagtgggcctctgagtcccag

SEQ ID NO: 7195967 - DNA, 22 bp, Homo sapiens
agagtggggacagggcctgtcc

SEQ ID NO: 7195968 - DNA, 22 bp, Homo sapiens
agagtggggaaggtgttgagaa

SEQ ID NO: 7195969 - DNA, 22 bp, Homo sapiens
agagtggggaaggtgttgagaa

SEQ ID NO: 7195970 - DNA, 22 bp, Homo sapiens
agagtggggaaggtgttgagaa

SEQ ID NO: 7195971 - DNA, 22 bp, Homo sapiens
agagtggggaaggtgttgagaa

SEQ ID NO: 7195972 - DNA, 22 bp, Homo sapiens
atttagacttcccagcactgtg

SEQ ID NO: 7195973 - DNA, 22 bp, Homo sapiens
atttagaagttggagggcaaga

SEQ ID NO: 7195974 - DNA, 22 bp, Homo sapiens
agagtggggacagggcctgtcc

SEQ ID NO: 7195975 - DNA, 22 bp, Homo sapiens
agagtggggacagggcctgtcc

SEQ ID NO: 7195976 - DNA, 23 bp, Homo sapiens
atttacaggttaaatgaaatcag

SEQ ID NO: 7195977 - DNA, 23 bp, Homo sapiens
atttacaggttaaatgaaatcag

SEQ ID NO: 7195978 - DNA, 23 bp, Homo sapiens
atttacaggttaaatgaaatcag

SEQ ID NO: 7195979 - DNA, 23 bp, Homo sapiens
atttacaggttaaatgaaatcag

SEQ ID NO: 7195980 - DNA, 23 bp, Homo sapiens
atttacaggttaaatgaaatcag

SEQ ID NO: 7195981 - DNA, 22 bp, Homo sapiens
atttagcaaaaaatgatgaagc

SEQ ID NO: 7195982 - DNA, 22 bp, Homo sapiens
atttagcaagagtacaaaataa

SEQ ID NO: 7195983 - DNA, 22 bp, Homo sapiens
atttagcaaaaaatgatgaagc

SEQ ID NO: 7195984 - DNA, 22 bp, Homo sapiens
atttagagaataagacataaat

SEQ ID NO: 7195985 - DNA, 22 bp, Homo sapiens
atttagagaataagacataaat

SEQ ID NO: 7195986 - DNA, 22 bp, Homo sapiens
atttagagtgaaacattatgca

SEQ ID NO: 7195987 - DNA, 22 bp, Homo sapiens
atttagagtgttcactctgagc

SEQ ID NO: 7195988 - DNA, 22 bp, Homo sapiens
atttagcaagcaggcaaattca

SEQ ID NO: 7195989 - DNA, 22 bp, Homo sapiens
atttagcaagagtacaaaataa

SEQ ID NO: 7195990 - DNA, 22 bp, Homo sapiens
atttagcaagagtacaaaataa

SEQ ID NO: 7195991 - DNA, 22 bp, Homo sapiens
atttagcaagagtacaaaataa

SEQ ID NO: 7195992 - DNA, 22 bp, Homo sapiens
atttaagaggctgctagagtat

SEQ ID NO: 7195993 - DNA, 22 bp, Homo sapiens
atttaagattgcgtattcatgt

SEQ ID NO: 7195994 - DNA, 22 bp, Homo sapiens
atttaagattgcgtattcatgt

SEQ ID NO: 7195995 - DNA, 22 bp, Homo sapiens
atttaagattgcgtattcatgt

SEQ ID NO: 7195996 - DNA, 22 bp, Homo sapiens
atttaaccccgatgtctccaaa

SEQ ID NO: 7195997 - DNA, 22 bp, Homo sapiens
atttaactttcagcccctcttc

SEQ ID NO: 7195998 - DNA, 22 bp, Homo sapiens
atttaaattttctgatggagag

SEQ ID NO: 7195999 - DNA, 22 bp, Homo sapiens
atttaacaagacagagaactgg

SEQ ID NO: 7196000 - DNA, 22 bp, Homo sapiens
atttaacaagacagagaactgg

SEQ ID NO: 7196001 - DNA, 22 bp, Homo sapiens
attgttaataactattacattg

SEQ ID NO: 7196002 - DNA, 18 bp, Homo sapiens
attgttaatagagtactt

SEQ ID NO: 7196003 - DNA, 18 bp, Homo sapiens
atttaatgaactgaaagc

SEQ ID NO: 7196004 - DNA, 22 bp, Homo sapiens
atttaataccacttggtgcttt

SEQ ID NO: 7196005 - DNA, 18 bp, Homo sapiens
atttaatgaactgaaagc

SEQ ID NO: 7196006 - DNA, 18 bp, Homo sapiens
atttaatgaactgaaagc

SEQ ID NO: 7196007 - DNA, 18 bp, Homo sapiens
atttaatgaactgaaagc

SEQ ID NO: 7196008 - DNA, 22 bp, Homo sapiens
atttaatgaggctgggggtgga

SEQ ID NO: 7196009 - DNA, 23 bp, Homo sapiens
atttaatgctgagttgaatgtta

SEQ ID NO: 7196010 - DNA, 22 bp, Homo sapiens
atttaagggatttggagaccaa

SEQ ID NO: 7196011 - DNA, 22 bp, Homo sapiens
atttaagggatttggagaccaa

SEQ ID NO: 7196012 - DNA, 22 bp, Homo sapiens
atttaataccacttggtgcttt

SEQ ID NO: 7196013 - DNA, 23 bp, Homo sapiens
atttaatgctgagttgaatgtta

SEQ ID NO: 7196014 - DNA, 23 bp, Homo sapiens
atttaatgctgagttgaatgtta

SEQ ID NO: 7196015 - DNA, 22 bp, Homo sapiens
atttaatgggtagacattgtta

SEQ ID NO: 7196016 - DNA, 23 bp, Homo sapiens
atttaatgctgagttgaatgtta

SEQ ID NO: 7196017 - DNA, 22 bp, Homo sapiens
atttaatgggtagacattgtta

SEQ ID NO: 7196018 - DNA, 22 bp, Homo sapiens
agagtggcctggcctggggcat

SEQ ID NO: 7196019 - DNA, 22 bp, Homo sapiens
agagtggcttctttgacatgct

SEQ ID NO: 7196020 - DNA, 22 bp, Homo sapiens
attcttcatacctactgaggtt

SEQ ID NO: 7196021 - DNA, 22 bp, Homo sapiens
agaggtatgtgtcagtgcttat

SEQ ID NO: 7196022 - DNA, 22 bp, Homo sapiens
attcttcatacagacaagtcct

SEQ ID NO: 7196023 - DNA, 22 bp, Homo sapiens
agaggtatatattctccatatt

SEQ ID NO: 7196024 - DNA, 22 bp, Homo sapiens
agaggtagaggttgcagtgagc

SEQ ID NO: 7196025 - DNA, 22 bp, Homo sapiens
agaggtagaggttgcagtgagc

SEQ ID NO: 7196026 - DNA, 22 bp, Homo sapiens
agaggtagaggttgcagtgagc

SEQ ID NO: 7196027 - DNA, 22 bp, Homo sapiens
agagggtgggcacgtgatggat

SEQ ID NO: 7196028 - DNA, 22 bp, Homo sapiens
agagggtgggcacgtgatggat

SEQ ID NO: 7196029 - DNA, 22 bp, Homo sapiens
agagggtgggcacgtgatggat

SEQ ID NO: 7196030 - DNA, 22 bp, Homo sapiens
agagggtgggcacgtgatggat

SEQ ID NO: 7196031 - DNA, 22 bp, Homo sapiens
agagggtggtgaggcctggttc

SEQ ID NO: 7196032 - DNA, 22 bp, Homo sapiens
agagggtggtgaggcctggttc

SEQ ID NO: 7196033 - DNA, 22 bp, Homo sapiens
agagggtggtgaggcctggttc

SEQ ID NO: 7196034 - DNA, 22 bp, Homo sapiens
agagggtggtgaggcctggttc

SEQ ID NO: 7196035 - DNA, 22 bp, Homo sapiens
agagggtggtgaggcctggttc

SEQ ID NO: 7196036 - DNA, 22 bp, Homo sapiens
agagggtggtgaggcctggttc

SEQ ID NO: 7196037 - DNA, 22 bp, Homo sapiens
agaggtagaaaataatggagag

SEQ ID NO: 7196038 - DNA, 22 bp, Homo sapiens
agaggtagaaaataatggagag

SEQ ID NO: 7196039 - DNA, 23 bp, Homo sapiens
attcttcattatcttctagaaaa

SEQ ID NO: 7196040 - DNA, 23 bp, Homo sapiens
attcttcattatcttctagaaaa

SEQ ID NO: 7196041 - DNA, 23 bp, Homo sapiens
attcttcattatcttctagaaaa

SEQ ID NO: 7196042 - DNA, 22 bp, Homo sapiens
attcttcattgttgattcatgt

SEQ ID NO: 7196043 - DNA, 19 bp, Homo sapiens
attcttctcaaatatccat

SEQ ID NO: 7196044 - DNA, 19 bp, Homo sapiens
attcttctcaaatatccat

SEQ ID NO: 7196045 - DNA, 22 bp, Homo sapiens
attcttcctcatcaatctgtag

SEQ ID NO: 7196046 - DNA, 22 bp, Homo sapiens
attcttcatttactgttacttg

SEQ ID NO: 7196047 - DNA, 22 bp, Homo sapiens
agcaaacagtgtgctaagaaat

SEQ ID NO: 7196048 - DNA, 22 bp, Homo sapiens
agcaaacagtgtgctaagaaat

SEQ ID NO: 7196049 - DNA, 22 bp, Homo sapiens
agcaaacagtgtgctaagaaat

SEQ ID NO: 7196050 - DNA, 20 bp, Homo sapiens
agcaaaatgcaagattttca

SEQ ID NO: 7196051 - DNA, 22 bp, Homo sapiens
agcaaaataaggtaatttattg

SEQ ID NO: 7196052 - DNA, 22 bp, Homo sapiens
atttgctttaaggtataaaagg

SEQ ID NO: 7196053 - DNA, 22 bp, Homo sapiens
atttgctttcaggtataaaagg

SEQ ID NO: 7196054 - DNA, 22 bp, Homo sapiens
agatttcacatgctgctctatt

SEQ ID NO: 7196055 - DNA, 16 bp, Homo sapiens
agcaaaagtaggtgtt

SEQ ID NO: 7196056 - DNA, 17 bp, Homo sapiens
agcaaaagtatcaaagc

SEQ ID NO: 7196057 - DNA, 17 bp, Homo sapiens
agcaaaagtatcaaagc

SEQ ID NO: 7196058 - DNA, 22 bp, Homo sapiens
agcaaaataaggtaatttattg

SEQ ID NO: 7196059 - DNA, 22 bp, Homo sapiens
agcaaaataaggtaatttattg

SEQ ID NO: 7196060 - DNA, 22 bp, Homo sapiens
atttgcttgtaaatgtatgcct

SEQ ID NO: 7196061 - DNA, 22 bp, Homo sapiens
atttgcttgtaaatgtatgcct

SEQ ID NO: 7196062 - DNA, 19 bp, Homo sapiens
atttgcttgtctgctctgc

SEQ ID NO: 7196063 - DNA, 22 bp, Homo sapiens
atttgcttctgtgaaatcaagt

SEQ ID NO: 7196064 - DNA, 22 bp, Homo sapiens
atttgcttcttgcttccagcac

SEQ ID NO: 7196065 - DNA, 22 bp, Homo sapiens
atttgcttgactatggcttgca

SEQ ID NO: 7196066 - DNA, 22 bp, Homo sapiens
atttgcttcatagatctgtgga

SEQ ID NO: 7196067 - DNA, 22 bp, Homo sapiens
atttgcttcatagatctgtgga

SEQ ID NO: 7196068 - DNA, 22 bp, Homo sapiens
atttgcttatctccacagttgt

SEQ ID NO: 7196069 - DNA, 22 bp, Homo sapiens
atttgcttcctaatactcatat

SEQ ID NO: 7196070 - DNA, 20 bp, Homo sapiens
atttgcttaccttgtttcta

SEQ ID NO: 7196071 - DNA, 22 bp, Homo sapiens
atttgctggtgaatgtatagct

SEQ ID NO: 7196072 - DNA, 22 bp, Homo sapiens
agatgtggaacactagactgct

SEQ ID NO: 7196073 - DNA, 22 bp, Homo sapiens
agatgtggaaagaagttagaag

SEQ ID NO: 7196074 - DNA, 22 bp, Homo sapiens
agatgtggatcctagggtagaa

SEQ ID NO: 7196075 - DNA, 22 bp, Homo sapiens
agatgtggatcctagggtagaa

SEQ ID NO: 7196076 - DNA, 22 bp, Homo sapiens
atttgctgatcatctagctaat

SEQ ID NO: 7196077 - DNA, 22 bp, Homo sapiens
agatgtctcactcagttctcat

SEQ ID NO: 7196078 - DNA, 22 bp, Homo sapiens
agatgtctgtaattctaagcat

SEQ ID NO: 7196079 - DNA, 23 bp, Homo sapiens
agatgtcttagaaactgaagctg

SEQ ID NO: 7196080 - DNA, 22 bp, Homo sapiens
agatgtgaatgaattctgctgg

SEQ ID NO: 7196081 - DNA, 22 bp, Homo sapiens
agatgtgcctccaaggggtgca

SEQ ID NO: 7196082 - DNA, 22 bp, Homo sapiens
atttcattgaagttaattcttc

SEQ ID NO: 7196083 - DNA, 22 bp, Homo sapiens
atttcattgaagttaattcttc

SEQ ID NO: 7196084 - DNA, 22 bp, Homo sapiens
atttcattgaagttaattcttc

SEQ ID NO: 7196085 - DNA, 22 bp, Homo sapiens
agatgacaaatcaggggacggg

SEQ ID NO: 7196086 - DNA, 22 bp, Homo sapiens
atttcattgaagttaattcttc

SEQ ID NO: 7196087 - DNA, 22 bp, Homo sapiens
agatgaagatgccactaagacc

SEQ ID NO: 7196088 - DNA, 22 bp, Homo sapiens
agatgaagcctgtacttagtct

SEQ ID NO: 7196089 - DNA, 22 bp, Homo sapiens
agatgaagactcaggagcaggt

SEQ ID NO: 7196090 - DNA, 22 bp, Homo sapiens
agatgaagactcaggagcaggt

SEQ ID NO: 7196091 - DNA, 22 bp, Homo sapiens
agatgaagatatctgcaggggc

SEQ ID NO: 7196092 - DNA, 23 bp, Homo sapiens
agatgaaagcttcccatcacagt

SEQ ID NO: 7196093 - DNA, 23 bp, Homo sapiens
agatgaaagcttcccatcacagt

SEQ ID NO: 7196094 - DNA, 22 bp, Homo sapiens
agatgaaatttgtgttgagttg

SEQ ID NO: 7196095 - DNA, 22 bp, Homo sapiens
agatgaaaagataagcagcaat

SEQ ID NO: 7196096 - DNA, 22 bp, Homo sapiens
agatgaaaagataagcagcaat

SEQ ID NO: 7196097 - DNA, 22 bp, Homo sapiens
agatgaaaatacgtgactttaa

SEQ ID NO: 7196098 - DNA, 22 bp, Homo sapiens
agatgaaaatacgtgactttaa

SEQ ID NO: 7196099 - DNA, 22 bp, Homo sapiens
atttattgaagcttattacgtt

SEQ ID NO: 7196100 - DNA, 22 bp, Homo sapiens
atttattgaagcttattacgtt

SEQ ID NO: 7196101 - DNA, 22 bp, Homo sapiens
atttattgaagcttattacgtt

SEQ ID NO: 7196102 - DNA, 22 bp, Homo sapiens
atttattgaagcttattacgtt

SEQ ID NO: 7196103 - DNA, 22 bp, Homo sapiens
agatccagggttggatttgcat

SEQ ID NO: 7196104 - DNA, 21 bp, Homo sapiens
agatccagtgccataaggccc

SEQ ID NO: 7196105 - DNA, 22 bp, Homo sapiens
agatgaaagatttttatagaga

SEQ ID NO: 7196106 - DNA, 22 bp, Homo sapiens
agatgaaagatttttatagaga

SEQ ID NO: 7196107 - DNA, 22 bp, Homo sapiens
agatgaaaatacgtgactttaa

SEQ ID NO: 7196108 - DNA, 22 bp, Homo sapiens
agatgaaagatttttatagaga

SEQ ID NO: 7196109 - DNA, 18 bp, Homo sapiens
agatgaaagcaaatgaca

SEQ ID NO: 7196110 - DNA, 18 bp, Homo sapiens
agatgaaagcaaatgaca

SEQ ID NO: 7196111 - DNA, 18 bp, Homo sapiens
agatgaaagcaaatgaca

SEQ ID NO: 7196112 - DNA, 22 bp, Homo sapiens
atttccaccggctcaggaagtt

SEQ ID NO: 7196113 - DNA, 22 bp, Homo sapiens
atttccaccatctctctgggcc

SEQ ID NO: 7196114 - DNA, 22 bp, Homo sapiens
atttccacataagggaaataag

SEQ ID NO: 7196115 - DNA, 21 bp, Homo sapiens
atttccacataatcataagac

SEQ ID NO: 7196116 - DNA, 21 bp, Homo sapiens
atttccacataatcataagac

SEQ ID NO: 7196117 - DNA, 22 bp, Homo sapiens
atttccaccggctcaggaagtt

SEQ ID NO: 7196118 - DNA, 22 bp, Homo sapiens
atttccacataagggaaataag

SEQ ID NO: 7196119 - DNA, 22 bp, Homo sapiens
atttccaatctctgcatatggg

SEQ ID NO: 7196120 - DNA, 22 bp, Homo sapiens
atttccaaggtaattttgagta

SEQ ID NO: 7196121 - DNA, 22 bp, Homo sapiens
atttccaaggtaattttgagta

SEQ ID NO: 7196122 - DNA, 21 bp, Homo sapiens
atttccaagggtacctaagat

SEQ ID NO: 7196123 - DNA, 19 bp, Homo sapiens
atttccaagaattggagag

SEQ ID NO: 7196124 - DNA, 22 bp, Homo sapiens
atttcattgaagttaattcttc

SEQ ID NO: 7196125 - DNA, 22 bp, Homo sapiens
atttccaaaaccacttattgcc

SEQ ID NO: 7196126 - DNA, 22 bp, Homo sapiens
atttccaactacccctccattt

SEQ ID NO: 7196127 - DNA, 22 bp, Homo sapiens
agatggtgatagagctgggatt

SEQ ID NO: 7196128 - DNA, 20 bp, Homo sapiens
agatggtgaaggccagggag

SEQ ID NO: 7196129 - DNA, 20 bp, Homo sapiens
agatggtgaaggccagggag

SEQ ID NO: 7196130 - DNA, 19 bp, Homo sapiens
agatggggaagagtgtgag

SEQ ID NO: 7196131 - DNA, 22 bp, Homo sapiens
agatgggcgccctggactgagg

SEQ ID NO: 7196132 - DNA, 22 bp, Homo sapiens
agatgggcgcgctgctctgatg

SEQ ID NO: 7196133 - DNA, 22 bp, Homo sapiens
agatggtaatcacatttatctg

SEQ ID NO: 7196134 - DNA, 22 bp, Homo sapiens
agatggtagactatggaacgta

SEQ ID NO: 7196135 - DNA, 22 bp, Homo sapiens
agatggtaggtggcaggactga

SEQ ID NO: 7196136 - DNA, 20 bp, Homo sapiens
agatggtgggctggaacacc

SEQ ID NO: 7196137 - DNA, 22 bp, Homo sapiens
agatggtgtttccccaggtgga

SEQ ID NO: 7196138 - DNA, 22 bp, Homo sapiens
agatggtgtttccccaggtgga

SEQ ID NO: 7196139 - DNA, 22 bp, Homo sapiens
agatggttatcttttctttgta

SEQ ID NO: 7196140 - DNA, 22 bp, Homo sapiens
agatggttcagaattataaaga

SEQ ID NO: 7196141 - DNA, 22 bp, Homo sapiens
agatggttcagaattataaaga

SEQ ID NO: 7196142 - DNA, 22 bp, Homo sapiens
agatggttctcagaaactcaac

SEQ ID NO: 7196143 - DNA, 22 bp, Homo sapiens
agatggttggtccataggccta

SEQ ID NO: 7196144 - DNA, 22 bp, Homo sapiens
agatggttgtcgcaaatgaatg

SEQ ID NO: 7196145 - DNA, 22 bp, Homo sapiens
agatggttttgtctttatgatt

SEQ ID NO: 7196146 - DNA, 22 bp, Homo sapiens
agatgtaagaccttcatgaggg

SEQ ID NO: 7196147 - DNA, 22 bp, Homo sapiens
agatggttttgtctttatgatt

SEQ ID NO: 7196148 - DNA, 22 bp, Homo sapiens
caactcatgtccaactttcttt

SEQ ID NO: 7196149 - DNA, 22 bp, Homo sapiens
caactcaggcacctcatataag

SEQ ID NO: 7196150 - DNA, 22 bp, Homo sapiens
agcagacaattgcctggatgga

SEQ ID NO: 7196151 - DNA, 22 bp, Homo sapiens
agcagacaccaggagtaaagaa

SEQ ID NO: 7196152 - DNA, 22 bp, Homo sapiens
agcagacaccaggagtaaagaa

SEQ ID NO: 7196153 - DNA, 22 bp, Homo sapiens
agcagacaccaggagtaaagaa

SEQ ID NO: 7196154 - DNA, 22 bp, Homo sapiens
agcagacaccaggagtaaagaa

SEQ ID NO: 7196155 - DNA, 18 bp, Homo sapiens
agcagaattctagggttc

SEQ ID NO: 7196156 - DNA, 22 bp, Homo sapiens
agcagaattgaatatcgggttc

SEQ ID NO: 7196157 - DNA, 22 bp, Homo sapiens
agcagacaattgcctggatgga

SEQ ID NO: 7196158 - DNA, 22 bp, Homo sapiens
agcagacaattgcctggatgga

SEQ ID NO: 7196159 - DNA, 22 bp, Homo sapiens
agcagacaacccagatgaccca

SEQ ID NO: 7196160 - DNA, 22 bp, Homo sapiens
agcagaatgcttaaagctagtg

SEQ ID NO: 7196161 - DNA, 22 bp, Homo sapiens
agcagaatggggctgggaatag

SEQ ID NO: 7196162 - DNA, 22 bp, Homo sapiens
agcagaatgtgtgtgacaagta

SEQ ID NO: 7196163 - DNA, 22 bp, Homo sapiens
caactgtcacagctgatctgtt

SEQ ID NO: 7196164 - DNA, 22 bp, Homo sapiens
caacttatctaatgttgggata

SEQ ID NO: 7196165 - DNA, 22 bp, Homo sapiens
caacttattaagaatgggcctg

SEQ ID NO: 7196166 - DNA, 22 bp, Homo sapiens
caacttattttcagtgggcctg

SEQ ID NO: 7196167 - DNA, 22 bp, Homo sapiens
caactgctgacaccatcactcc

SEQ ID NO: 7196168 - DNA, 22 bp, Homo sapiens
caactgccatacagctccatgg

SEQ ID NO: 7196169 - DNA, 22 bp, Homo sapiens
caactggtaatctccacggtca

SEQ ID NO: 7196170 - DNA, 22 bp, Homo sapiens
caactggtggtcaaccttctgt

SEQ ID NO: 7196171 - DNA, 22 bp, Homo sapiens
caactgggataaagagctaaag

SEQ ID NO: 7196172 - DNA, 22 bp, Homo sapiens
caactgaactgatatcaactat

SEQ ID NO: 7196173 - DNA, 22 bp, Homo sapiens
caactgcacaccaagcttgtgt

SEQ ID NO: 7196174 - DNA, 22 bp, Homo sapiens
caactccctgtggggtactggg

SEQ ID NO: 7196175 - DNA, 22 bp, Homo sapiens
caactgaaaagattctacgcag

SEQ ID NO: 7196176 - DNA, 22 bp, Homo sapiens
agcagcaaggaacagaatggac

SEQ ID NO: 7196177 - DNA, 22 bp, Homo sapiens
agcagcaaggaacagaatggac

SEQ ID NO: 7196178 - DNA, 22 bp, Homo sapiens
agcagcaaggaacagaatggac

SEQ ID NO: 7196179 - DNA, 22 bp, Homo sapiens
agcagagtgtgaaggcagggct

SEQ ID NO: 7196180 - DNA, 22 bp, Homo sapiens
agcagagtgtgaaggcagggct

SEQ ID NO: 7196181 - DNA, 22 bp, Homo sapiens
caacttcactgtgcctctagtt

SEQ ID NO: 7196182 - DNA, 22 bp, Homo sapiens
caacttcttggcttcctaatgg

SEQ ID NO: 7196183 - DNA, 22 bp, Homo sapiens
agcagagtgccccatcacaagg

SEQ ID NO: 7196184 - DNA, 22 bp, Homo sapiens
agcagagtgccccatcacaagg

SEQ ID NO: 7196185 - DNA, 21 bp, Homo sapiens
agcagagtgctttgactttgt

SEQ ID NO: 7196186 - DNA, 22 bp, Homo sapiens
agcagagtgccccatcacaagg

SEQ ID NO: 7196187 - DNA, 22 bp, Homo sapiens
agcagcaataataaagtaatac

SEQ ID NO: 7196188 - DNA, 22 bp, Homo sapiens
agcagcaatggaaagcaacaca

SEQ ID NO: 7196189 - DNA, 22 bp, Homo sapiens
agcagcaatggaaagcaacaca

SEQ ID NO: 7196190 - DNA, 22 bp, Homo sapiens
agcagcaattttcactgtcaat

SEQ ID NO: 7196191 - DNA, 22 bp, Homo sapiens
agcagcaattttcactgtcaat

SEQ ID NO: 7196192 - DNA, 22 bp, Homo sapiens
agcagcacacgggagaaagaca

SEQ ID NO: 7196193 - DNA, 22 bp, Homo sapiens
agcagcacacgggagaaagaca

SEQ ID NO: 7196194 - DNA, 19 bp, Homo sapiens
agcagcagaagtgtgcctt

SEQ ID NO: 7196195 - DNA, 19 bp, Homo sapiens
agcagcagaagtgtgcctt

SEQ ID NO: 7196196 - DNA, 22 bp, Homo sapiens
caaggcaggaagcctgtcttat

SEQ ID NO: 7196197 - DNA, 22 bp, Homo sapiens
caaggcaggcagttcacttgag

SEQ ID NO: 7196198 - DNA, 22 bp, Homo sapiens
caaggcaggcagttcacttgag

SEQ ID NO: 7196199 - DNA, 22 bp, Homo sapiens
agcagcagaagggagacccagg

SEQ ID NO: 7196200 - DNA, 22 bp, Homo sapiens
agcagcagaaagttgatggcag

SEQ ID NO: 7196201 - DNA, 22 bp, Homo sapiens
agcagcagaagggagacccagg

SEQ ID NO: 7196202 - DNA, 22 bp, Homo sapiens
agcagcagaagggagacccagg

SEQ ID NO: 7196203 - DNA, 22 bp, Homo sapiens
agcagcagaagggagacccagg

SEQ ID NO: 7196204 - DNA, 22 bp, Homo sapiens
agcagcagaaagttgatggcag

SEQ ID NO: 7196205 - DNA, 22 bp, Homo sapiens
agcagcacgagtccacaaatcc

SEQ ID NO: 7196206 - DNA, 22 bp, Homo sapiens
agcagcagaaagttgatggcag

SEQ ID NO: 7196207 - DNA, 22 bp, Homo sapiens
agcagcacccagagccatgtct

SEQ ID NO: 7196208 - DNA, 22 bp, Homo sapiens
agcagcacccagagccatgtct

SEQ ID NO: 7196209 - DNA, 22 bp, Homo sapiens
agcagcacctgtcctcgctgct

SEQ ID NO: 7196210 - DNA, 22 bp, Homo sapiens
caatgaaaatttaagttgcagc

SEQ ID NO: 7196211 - DNA, 22 bp, Homo sapiens
caatgaaaatttaagttgcagc

SEQ ID NO: 7196212 - DNA, 22 bp, Homo sapiens
caatgaaaatttaagttgcagc

SEQ ID NO: 7196213 - DNA, 22 bp, Homo sapiens
caatgaaaatgaggactcctgt

SEQ ID NO: 7196214 - DNA, 22 bp, Homo sapiens
caatcttagagagattctttta

SEQ ID NO: 7196215 - DNA, 22 bp, Homo sapiens
caatcttagagagattctttta

SEQ ID NO: 7196216 - DNA, 22 bp, Homo sapiens
caatcttagtggcttacaaaga

SEQ ID NO: 7196217 - DNA, 22 bp, Homo sapiens
caatctgttagaaatgcagaca

SEQ ID NO: 7196218 - DNA, 22 bp, Homo sapiens
caatcttacttttgaaaagtga

SEQ ID NO: 7196219 - DNA, 20 bp, Homo sapiens
agcagcattgttctagagca

SEQ ID NO: 7196220 - DNA, 20 bp, Homo sapiens
agcagcattgttctagagca

SEQ ID NO: 7196221 - DNA, 20 bp, Homo sapiens
agcagcattgttctagagca

SEQ ID NO: 7196222 - DNA, 22 bp, Homo sapiens
agcagcatttaaggatccaagt

SEQ ID NO: 7196223 - DNA, 22 bp, Homo sapiens
agcagcatttaagtttcttcta

SEQ ID NO: 7196224 - DNA, 22 bp, Homo sapiens
agcagcatttaagtttcttcta

SEQ ID NO: 7196225 - DNA, 22 bp, Homo sapiens
agcagcatcttctaagtaaggc

SEQ ID NO: 7196226 - DNA, 22 bp, Homo sapiens
agcagcatcttctaagtaaggc

SEQ ID NO: 7196227 - DNA, 22 bp, Homo sapiens
agcagcatcttctgttctccgc

SEQ ID NO: 7196228 - DNA, 22 bp, Homo sapiens
agcagcatcttctgttctccgc

SEQ ID NO: 7196229 - DNA, 22 bp, Homo sapiens
agcagcatgatgacagagtctc

SEQ ID NO: 7196230 - DNA, 22 bp, Homo sapiens
agcagcatgatgacagagtctc

SEQ ID NO: 7196231 - DNA, 22 bp, Homo sapiens
agcagcatggagaaaccgttca

SEQ ID NO: 7196232 - DNA, 22 bp, Homo sapiens
agcagcatggatgggcctcagc

SEQ ID NO: 7196233 - DNA, 22 bp, Homo sapiens
agcagcatggctgactaaagac

SEQ ID NO: 7196234 - DNA, 22 bp, Homo sapiens
agcagcatggctgactaaagac

SEQ ID NO: 7196235 - DNA, 22 bp, Homo sapiens
agcagcatggctgactaaagac

SEQ ID NO: 7196236 - DNA, 22 bp, Homo sapiens
agcagcatgtatgagggtgaac

SEQ ID NO: 7196237 - DNA, 22 bp, Homo sapiens
agcagcatgtatgagggtgaac

SEQ ID NO: 7196238 - DNA, 22 bp, Homo sapiens
agcagcatgttcattacattat

SEQ ID NO: 7196239 - DNA, 22 bp, Homo sapiens
agcagcatgttgggatgtgaaa

SEQ ID NO: 7196240 - DNA, 22 bp, Homo sapiens
agcagcattaagggaactgcag

SEQ ID NO: 7196241 - DNA, 22 bp, Homo sapiens
agcagcattaagggaactgcag

SEQ ID NO: 7196242 - DNA, 22 bp, Homo sapiens
agcagcattaagggaactgcag

SEQ ID NO: 7196243 - DNA, 22 bp, Homo sapiens
agcagcattatgatatatctta

SEQ ID NO: 7196244 - DNA, 22 bp, Homo sapiens
agcagcattatgatatatctta

SEQ ID NO: 7196245 - DNA, 22 bp, Homo sapiens
agcagcattatgatatatctta

SEQ ID NO: 7196246 - DNA, 22 bp, Homo sapiens
agcagcattcctggcttctatc

SEQ ID NO: 7196247 - DNA, 22 bp, Homo sapiens
agcagcattcctggcttctatc

SEQ ID NO: 7196248 - DNA, 22 bp, Homo sapiens
agcagcattctctggtatgggg

SEQ ID NO: 7196249 - DNA, 22 bp, Homo sapiens
agcagcattctctggtatgggg

SEQ ID NO: 7196250 - DNA, 22 bp, Homo sapiens
caaggcagttccccagagggct

SEQ ID NO: 7196251 - DNA, 22 bp, Homo sapiens
caaggcagttccccagagggct

SEQ ID NO: 7196252 - DNA, 22 bp, Homo sapiens
caaggcagtgggctaggaacct

SEQ ID NO: 7196253 - DNA, 22 bp, Homo sapiens
caaggcagttccccagagggct

SEQ ID NO: 7196254 - DNA, 22 bp, Homo sapiens
caaggcagttccccagagggct

SEQ ID NO: 7196255 - DNA, 22 bp, Homo sapiens
caaggcagtccctactccctgc

SEQ ID NO: 7196256 - DNA, 22 bp, Homo sapiens
caaggcagtccctactccctgc

SEQ ID NO: 7196257 - DNA, 22 bp, Homo sapiens
caaggcagtgggctaggaacct

SEQ ID NO: 7196258 - DNA, 22 bp, Homo sapiens
caaggcagtgggctaggaacct

SEQ ID NO: 7196259 - DNA, 22 bp, Homo sapiens
caaggcagtgggctaggaacct

SEQ ID NO: 7196260 - DNA, 22 bp, Homo sapiens
caaggcaggtctgaggaggttg

SEQ ID NO: 7196261 - DNA, 22 bp, Homo sapiens
caaggcagtccctactccctgc

SEQ ID NO: 7196262 - DNA, 22 bp, Homo sapiens
caaggcagtccctactccctgc

SEQ ID NO: 7196263 - DNA, 22 bp, Homo sapiens
caaggcaggtctgaggaggttg

SEQ ID NO: 7196264 - DNA, 22 bp, Homo sapiens
caaggcaggtctgaggaggttg

SEQ ID NO: 7196265 - DNA, 22 bp, Homo sapiens
caaggcaggtctgaggaggttg

SEQ ID NO: 7196266 - DNA, 22 bp, Homo sapiens
caaggcaggtctgaggaggttg

SEQ ID NO: 7196267 - DNA, 22 bp, Homo sapiens
caaggcaggtctgaggaggttg

SEQ ID NO: 7196268 - DNA, 22 bp, Homo sapiens
caaggcaggtctgaggaggttg

SEQ ID NO: 7196269 - DNA, 22 bp, Homo sapiens
caaggcaggccagtttcaaggc

SEQ ID NO: 7196270 - DNA, 22 bp, Homo sapiens
caaggcaggccagtttcaaggc

SEQ ID NO: 7196271 - DNA, 22 bp, Homo sapiens
caaggcagttccccagagggct

SEQ ID NO: 7196272 - DNA, 22 bp, Homo sapiens
caaggcatactcctttctcagc

SEQ ID NO: 7196273 - DNA, 22 bp, Homo sapiens
caaggcatgaaaggagtgagtg

SEQ ID NO: 7196274 - DNA, 22 bp, Homo sapiens
caaggcatgcaatgtcttcagg

SEQ ID NO: 7196275 - DNA, 22 bp, Homo sapiens
caaggcatgcaatgtcttcagg

SEQ ID NO: 7196276 - DNA, 22 bp, Homo sapiens
agcagcagggtgtaattgggca

SEQ ID NO: 7196277 - DNA, 22 bp, Homo sapiens
agcagcaggtgacctcgatgcc

SEQ ID NO: 7196278 - DNA, 22 bp, Homo sapiens
agcagcaggtgacctcgatgcc

SEQ ID NO: 7196279 - DNA, 22 bp, Homo sapiens
agcagcatagaagctgggagga

SEQ ID NO: 7196280 - DNA, 22 bp, Homo sapiens
agcagcatagatgctatccgag

SEQ ID NO: 7196281 - DNA, 22 bp, Homo sapiens
agcagcatagatgctatccgag

SEQ ID NO: 7196282 - DNA, 22 bp, Homo sapiens
agcagcatatcagagaaagtca

SEQ ID NO: 7196283 - DNA, 22 bp, Homo sapiens
agcagcatatcagagaaagtca

SEQ ID NO: 7196284 - DNA, 22 bp, Homo sapiens
agcagcatatcagagaaagtca

SEQ ID NO: 7196285 - DNA, 22 bp, Homo sapiens
agcagcatatcagagaaagtca

SEQ ID NO: 7196286 - DNA, 22 bp, Homo sapiens
agcagcatatcagagaaagtca

SEQ ID NO: 7196287 - DNA, 22 bp, Homo sapiens
agcagcatattgtgtcttcata

SEQ ID NO: 7196288 - DNA, 22 bp, Homo sapiens
agcagcatattgtgtcttcata

SEQ ID NO: 7196289 - DNA, 22 bp, Homo sapiens
agcagcatcaaccctcccgtgt

SEQ ID NO: 7196290 - DNA, 21 bp, Homo sapiens
agcagcatcagcctcacctga

SEQ ID NO: 7196291 - DNA, 22 bp, Homo sapiens
agcagcatccccggcctccacc

SEQ ID NO: 7196292 - DNA, 22 bp, Homo sapiens
agcagcatctcttattgcagtg

SEQ ID NO: 7196293 - DNA, 22 bp, Homo sapiens
agcagcatctcttattgcagtg

SEQ ID NO: 7196294 - DNA, 22 bp, Homo sapiens
agcagcatctcttattgcagtg

SEQ ID NO: 7196295 - DNA, 22 bp, Homo sapiens
agcagcatctggttctgatgtg

SEQ ID NO: 7196296 - DNA, 22 bp, Homo sapiens
agcagaagaggtcttgttgctg

SEQ ID NO: 7196297 - DNA, 22 bp, Homo sapiens
agcagaagaaagccacatgact

SEQ ID NO: 7196298 - DNA, 22 bp, Homo sapiens
agcagaagaaagccacatgact

SEQ ID NO: 7196299 - DNA, 22 bp, Homo sapiens
agcagaagaaagccacatgact

SEQ ID NO: 7196300 - DNA, 17 bp, Homo sapiens
agcagaagtcagaggga

SEQ ID NO: 7196301 - DNA, 17 bp, Homo sapiens
agcagaagtcagaggga

SEQ ID NO: 7196302 - DNA, 17 bp, Homo sapiens
agcagaagtcagaggga

SEQ ID NO: 7196303 - DNA, 17 bp, Homo sapiens
agcagaagtcagaggga

SEQ ID NO: 7196304 - DNA, 17 bp, Homo sapiens
agcagaagtcagaggga

SEQ ID NO: 7196305 - DNA, 22 bp, Homo sapiens
agcagaagtgccttagcaatca

SEQ ID NO: 7196306 - DNA, 22 bp, Homo sapiens
agcagaagtgccttagcaatca

SEQ ID NO: 7196307 - DNA, 22 bp, Homo sapiens
agcagaagtgccttagcaatca

SEQ ID NO: 7196308 - DNA, 22 bp, Homo sapiens
agcagaagtgccttagcaatca

SEQ ID NO: 7196309 - DNA, 22 bp, Homo sapiens
caaattaatgtgtctcaaaata

SEQ ID NO: 7196310 - DNA, 22 bp, Homo sapiens
caaattaatgtgtctcaaaata

SEQ ID NO: 7196311 - DNA, 22 bp, Homo sapiens
caaatgttttttagtataagta

SEQ ID NO: 7196312 - DNA, 22 bp, Homo sapiens
caaattaatgtgtctcaaaata

SEQ ID NO: 7196313 - DNA, 22 bp, Homo sapiens
agcactgttatgggatgactta

SEQ ID NO: 7196314 - DNA, 22 bp, Homo sapiens
agcacttaactgacagtactat

SEQ ID NO: 7196315 - DNA, 22 bp, Homo sapiens
caaatgttaagacaggatcaag

SEQ ID NO: 7196316 - DNA, 22 bp, Homo sapiens
caaatgttagtgcccatccctc

SEQ ID NO: 7196317 - DNA, 22 bp, Homo sapiens
caaatgttattcattcttgttt

SEQ ID NO: 7196318 - DNA, 22 bp, Homo sapiens
caaatgttattcattcttgttt

SEQ ID NO: 7196319 - DNA, 22 bp, Homo sapiens
caaatgttattcattcttgttt

SEQ ID NO: 7196320 - DNA, 22 bp, Homo sapiens
caaatgttgactaagagggttt

SEQ ID NO: 7196321 - DNA, 22 bp, Homo sapiens
caaatgttgctgtaatgtttgt

SEQ ID NO: 7196322 - DNA, 22 bp, Homo sapiens
caaatgttgctgtaatgtttgt

SEQ ID NO: 7196323 - DNA, 22 bp, Homo sapiens
caaatgtttcttatctattgtt

SEQ ID NO: 7196324 - DNA, 22 bp, Homo sapiens
caaatgtttcttatctattgtt

SEQ ID NO: 7196325 - DNA, 22 bp, Homo sapiens
caaatgtttcttgaacaccaac

SEQ ID NO: 7196326 - DNA, 22 bp, Homo sapiens
caaatgtttcttgaacaccaac

SEQ ID NO: 7196327 - DNA, 22 bp, Homo sapiens
caaatgtttcttgaacaccaac

SEQ ID NO: 7196328 - DNA, 22 bp, Homo sapiens
caaatgtttgcatcacagggca

SEQ ID NO: 7196329 - DNA, 22 bp, Homo sapiens
caaatgtttggtggcattttgt

SEQ ID NO: 7196330 - DNA, 22 bp, Homo sapiens
caaatgtttggtggcattttgt

SEQ ID NO: 7196331 - DNA, 22 bp, Homo sapiens
caaatgtttttattctacaaca

SEQ ID NO: 7196332 - DNA, 22 bp, Homo sapiens
caaatgtttttattctacaaca

SEQ ID NO: 7196333 - DNA, 22 bp, Homo sapiens
caaatgtttttattctacaaca

SEQ ID NO: 7196334 - DNA, 22 bp, Homo sapiens
caaatgttttttagtataagta

SEQ ID NO: 7196335 - DNA, 22 bp, Homo sapiens
caaatgatccttgcaagctgtg

SEQ ID NO: 7196336 - DNA, 22 bp, Homo sapiens
caaatgatccttgcaagctgtg

SEQ ID NO: 7196337 - DNA, 22 bp, Homo sapiens
caaatgatccttgcaagctgtg

SEQ ID NO: 7196338 - DNA, 22 bp, Homo sapiens
caaatgatagagccgattatca

SEQ ID NO: 7196339 - DNA, 22 bp, Homo sapiens
caaatgatagagccgattatca

SEQ ID NO: 7196340 - DNA, 22 bp, Homo sapiens
caaatgatactgtttttagtct

SEQ ID NO: 7196341 - DNA, 22 bp, Homo sapiens
caaatgatactgtttttagtct

SEQ ID NO: 7196342 - DNA, 22 bp, Homo sapiens
caaatgatactgtttttagtct

SEQ ID NO: 7196343 - DNA, 22 bp, Homo sapiens
caaatgatacctattactaggc

SEQ ID NO: 7196344 - DNA, 22 bp, Homo sapiens
caaatattccaggtacatccct

SEQ ID NO: 7196345 - DNA, 22 bp, Homo sapiens
agcacagctggaaaataaatca

SEQ ID NO: 7196346 - DNA, 22 bp, Homo sapiens
agcacagcaccatcctggtacc

SEQ ID NO: 7196347 - DNA, 22 bp, Homo sapiens
agcacagcaccatcctggtacc

SEQ ID NO: 7196348 - DNA, 22 bp, Homo sapiens
agcacagcagcgtctaaccgat

SEQ ID NO: 7196349 - DNA, 22 bp, Homo sapiens
agcacagcagcgtctaaccgat

SEQ ID NO: 7196350 - DNA, 21 bp, Homo sapiens
agcacagcatatccaatgtca

SEQ ID NO: 7196351 - DNA, 21 bp, Homo sapiens
agcacagcatatccaatgtca

SEQ ID NO: 7196352 - DNA, 22 bp, Homo sapiens
agcacagccagctttattggcc

SEQ ID NO: 7196353 - DNA, 22 bp, Homo sapiens
agcacagccagctttattggcc

SEQ ID NO: 7196354 - DNA, 22 bp, Homo sapiens
agcacagcctctggtttctgac

SEQ ID NO: 7196355 - DNA, 22 bp, Homo sapiens
agcacagcctctggtttctgac

SEQ ID NO: 7196356 - DNA, 22 bp, Homo sapiens
agcacagcctctggtttctgac

SEQ ID NO: 7196357 - DNA, 20 bp, Homo sapiens
agcacagcgcggtgttcctt

SEQ ID NO: 7196358 - DNA, 20 bp, Homo sapiens
agcacagcgcggtgttcctt

SEQ ID NO: 7196359 - DNA, 22 bp, Homo sapiens
agcacagctgctgaatgataca

SEQ ID NO: 7196360 - DNA, 22 bp, Homo sapiens
agcacagctgctgaatgataca

SEQ ID NO: 7196361 - DNA, 22 bp, Homo sapiens
agcacagctgctgaatgataca

SEQ ID NO: 7196362 - DNA, 22 bp, Homo sapiens
agcacagctggaaaataaatca

SEQ ID NO: 7196363 - DNA, 22 bp, Homo sapiens
agcacagctggaaaataaatca

SEQ ID NO: 7196364 - DNA, 22 bp, Homo sapiens
agcacagctgttcaacaggaat

SEQ ID NO: 7196365 - DNA, 22 bp, Homo sapiens
agcacagctgttcaacaggaat

SEQ ID NO: 7196366 - DNA, 22 bp, Homo sapiens
agcacagctgttcaacaggaat

SEQ ID NO: 7196367 - DNA, 22 bp, Homo sapiens
agcacagcttagcacctggcac

SEQ ID NO: 7196368 - DNA, 22 bp, Homo sapiens
agcacagcttagcacctggcac

SEQ ID NO: 7196369 - DNA, 22 bp, Homo sapiens
caaatgatgcatggctagtgag

SEQ ID NO: 7196370 - DNA, 22 bp, Homo sapiens
caaatgatgcatggctagtgag

SEQ ID NO: 7196371 - DNA, 22 bp, Homo sapiens
caaatgcaaaatataaccctgt

SEQ ID NO: 7196372 - DNA, 22 bp, Homo sapiens
caaatgcaggtcagcaggtgtc

SEQ ID NO: 7196373 - DNA, 22 bp, Homo sapiens
caaatgcaggtcagcaggtgtc

SEQ ID NO: 7196374 - DNA, 22 bp, Homo sapiens
caaatgcaggtcataacctgag

SEQ ID NO: 7196375 - DNA, 22 bp, Homo sapiens
caaatgcaggtcagcaggtgtc

SEQ ID NO: 7196376 - DNA, 22 bp, Homo sapiens
caaatgcatagaaagatgaaac

SEQ ID NO: 7196377 - DNA, 22 bp, Homo sapiens
caaatgcatagaaagatgaaac

SEQ ID NO: 7196378 - DNA, 22 bp, Homo sapiens
caaatgcagtccctttgttgct

SEQ ID NO: 7196379 - DNA, 22 bp, Homo sapiens
caaatgcagtccctttgttgct

SEQ ID NO: 7196380 - DNA, 22 bp, Homo sapiens
caaatgcatagaaagatgaaac

SEQ ID NO: 7196381 - DNA, 22 bp, Homo sapiens
caaatgcatagaaagatgaaac

SEQ ID NO: 7196382 - DNA, 22 bp, Homo sapiens
caaatgttaaatgtgttaagac

SEQ ID NO: 7196383 - DNA, 22 bp, Homo sapiens
caaatgttaagacaggatcaag

SEQ ID NO: 7196384 - DNA, 23 bp, Homo sapiens
agcacagactagaaaggtctttc

SEQ ID NO: 7196385 - DNA, 19 bp, Homo sapiens
agcacagacaagaccagca

SEQ ID NO: 7196386 - DNA, 23 bp, Homo sapiens
agcacagactagaaaggtctttc

SEQ ID NO: 7196387 - DNA, 23 bp, Homo sapiens
agcacagactagaaaggtctttc

SEQ ID NO: 7196388 - DNA, 22 bp, Homo sapiens
agcacagactggtcccaggtct

SEQ ID NO: 7196389 - DNA, 22 bp, Homo sapiens
agcacagactggtcccaggtct

SEQ ID NO: 7196390 - DNA, 22 bp, Homo sapiens
agcacagagaaactaagacatt

SEQ ID NO: 7196391 - DNA, 22 bp, Homo sapiens
agcacagagaaactaagacatt

SEQ ID NO: 7196392 - DNA, 22 bp, Homo sapiens
agcacagagaaactaagacatt

SEQ ID NO: 7196393 - DNA, 22 bp, Homo sapiens
agcacagagaaactaagacatt

SEQ ID NO: 7196394 - DNA, 22 bp, Homo sapiens
agcacagagaaactaagacatt

SEQ ID NO: 7196395 - DNA, 22 bp, Homo sapiens
attttctgtaactatttctata

SEQ ID NO: 7196396 - DNA, 22 bp, Homo sapiens
agcaatttttgattttcagtgt

SEQ ID NO: 7196397 - DNA, 22 bp, Homo sapiens
agcacaaaaacattcccagagt

SEQ ID NO: 7196398 - DNA, 22 bp, Homo sapiens
attttctgagtccagaatttac

SEQ ID NO: 7196399 - DNA, 22 bp, Homo sapiens
attttctgagtccagaatttac

SEQ ID NO: 7196400 - DNA, 22 bp, Homo sapiens
attttctgagtccagaatttac

SEQ ID NO: 7196401 - DNA, 22 bp, Homo sapiens
attttctgtaaaaaggcactaa

SEQ ID NO: 7196402 - DNA, 22 bp, Homo sapiens
attttctgtaactatttctata

SEQ ID NO: 7196403 - DNA, 22 bp, Homo sapiens
attttctgtaactatttctata

SEQ ID NO: 7196404 - DNA, 22 bp, Homo sapiens
attttctgtaactatttctata

SEQ ID NO: 7196405 - DNA, 22 bp, Homo sapiens
attttctatgttgtaattgtta

SEQ ID NO: 7196406 - DNA, 22 bp, Homo sapiens
attttctatgttgtaattgtta

SEQ ID NO: 7196407 - DNA, 22 bp, Homo sapiens
attttctatgttgtaattgtta

SEQ ID NO: 7196408 - DNA, 22 bp, Homo sapiens
attttctatgttgtaattgtta

SEQ ID NO: 7196409 - DNA, 22 bp, Homo sapiens
attttctatgttgtaattgtta

SEQ ID NO: 7196410 - DNA, 21 bp, Homo sapiens
attttctctggatgatggtca

SEQ ID NO: 7196411 - DNA, 22 bp, Homo sapiens
attttctctttgtatatgctag

SEQ ID NO: 7196412 - DNA, 22 bp, Homo sapiens
attttctctttgtatatgctag

SEQ ID NO: 7196413 - DNA, 22 bp, Homo sapiens
attttctctcaaaccttaaaat

SEQ ID NO: 7196414 - DNA, 22 bp, Homo sapiens
attttctctcaaaccttaaaat

SEQ ID NO: 7196415 - DNA, 22 bp, Homo sapiens
attttctctcaaaccttaaaat

SEQ ID NO: 7196416 - DNA, 22 bp, Homo sapiens
attttctcacaatcctatgggg

SEQ ID NO: 7196417 - DNA, 22 bp, Homo sapiens
attttctcacaatcctatgggg

SEQ ID NO: 7196418 - DNA, 22 bp, Homo sapiens
attttctcacaatgcagaagga

SEQ ID NO: 7196419 - DNA, 22 bp, Homo sapiens
attttctcacaatgcagaagga

SEQ ID NO: 7196420 - DNA, 22 bp, Homo sapiens
agcacagagattatttacaaga

SEQ ID NO: 7196421 - DNA, 22 bp, Homo sapiens
agcacagagattatttacaaga

SEQ ID NO: 7196422 - DNA, 19 bp, Homo sapiens
agcacagagagtctatagc

SEQ ID NO: 7196423 - DNA, 22 bp, Homo sapiens
agcacagagctaggagtggagg

SEQ ID NO: 7196424 - DNA, 22 bp, Homo sapiens
agcacagagaaactaagacatt

SEQ ID NO: 7196425 - DNA, 22 bp, Homo sapiens
agcacagagaagatttcaatta

SEQ ID NO: 7196426 - DNA, 22 bp, Homo sapiens
agcacagagaagatttcaatta

SEQ ID NO: 7196427 - DNA, 22 bp, Homo sapiens
agcacagagagctctaggtaaa

SEQ ID NO: 7196428 - DNA, 22 bp, Homo sapiens
agcacagagagctctaggtaaa

SEQ ID NO: 7196429 - DNA, 19 bp, Homo sapiens
agcacagagagtctatagc

SEQ ID NO: 7196430 - DNA, 19 bp, Homo sapiens
agcacagagagtctatagc

SEQ ID NO: 7196431 - DNA, 22 bp, Homo sapiens
agcacagagctcggggaatgga

SEQ ID NO: 7196432 - DNA, 22 bp, Homo sapiens
agcacagagctcggggaatgga

SEQ ID NO: 7196433 - DNA, 22 bp, Homo sapiens
agcacagaggtggaagtgtata

SEQ ID NO: 7196434 - DNA, 22 bp, Homo sapiens
agcacagaggtggaagtgtata

SEQ ID NO: 7196435 - DNA, 22 bp, Homo sapiens
agcacagagttgcagagagcgt

SEQ ID NO: 7196436 - DNA, 22 bp, Homo sapiens
agcacagagttgcagagagcgt

SEQ ID NO: 7196437 - DNA, 22 bp, Homo sapiens
agcacagagttgcagagagcgt

SEQ ID NO: 7196438 - DNA, 22 bp, Homo sapiens
agcacagagttgcagagagcgt

SEQ ID NO: 7196439 - DNA, 22 bp, Homo sapiens
agcacagagttgcagagagcgt

SEQ ID NO: 7196440 - DNA, 22 bp, Homo sapiens
agcacagagttgcagagagcgt

SEQ ID NO: 7196441 - DNA, 22 bp, Homo sapiens
agcacagagttgcagagagcgt

SEQ ID NO: 7196442 - DNA, 22 bp, Homo sapiens
agcacagatgtgagtggaggct

SEQ ID NO: 7196443 - DNA, 22 bp, Homo sapiens
agcacagatgtgagtggaggct

SEQ ID NO: 7196444 - DNA, 22 bp, Homo sapiens
agcacagatgtgagtggaggct

SEQ ID NO: 7196445 - DNA, 22 bp, Homo sapiens
agcacagattctgaagagtcct

SEQ ID NO: 7196446 - DNA, 22 bp, Homo sapiens
agcacagattctgaagagtcct

SEQ ID NO: 7196447 - DNA, 22 bp, Homo sapiens
agcacagatttgtcaacataga

SEQ ID NO: 7196448 - DNA, 22 bp, Homo sapiens
agcacagatttgtcaacataga

SEQ ID NO: 7196449 - DNA, 22 bp, Homo sapiens
agcacagcaagtgggttattaa

SEQ ID NO: 7196450 - DNA, 22 bp, Homo sapiens
agcacagcaagtgggttattaa

SEQ ID NO: 7196451 - DNA, 22 bp, Homo sapiens
agcacagagttgctcactgccg

SEQ ID NO: 7196452 - DNA, 22 bp, Homo sapiens
agcacagataacatggagtgga

SEQ ID NO: 7196453 - DNA, 22 bp, Homo sapiens
agcacagataacatggagtgga

SEQ ID NO: 7196454 - DNA, 22 bp, Homo sapiens
agcacagataacatggagtgga

SEQ ID NO: 7196455 - DNA, 22 bp, Homo sapiens
agcacagatgcatgatcaccag

SEQ ID NO: 7196456 - DNA, 22 bp, Homo sapiens
agcacagatggatgtattcatt

SEQ ID NO: 7196457 - DNA, 22 bp, Homo sapiens
agcacagatggatgtattcatt

SEQ ID NO: 7196458 - DNA, 22 bp, Homo sapiens
agcacagatgtactttgagggg

SEQ ID NO: 7196459 - DNA, 22 bp, Homo sapiens
agcacagatgtactttgagggg

SEQ ID NO: 7196460 - DNA, 22 bp, Homo sapiens
agcagctgtttgttgaattggt

SEQ ID NO: 7196461 - DNA, 22 bp, Homo sapiens
agcagctgttagaaacaggaag

SEQ ID NO: 7196462 - DNA, 22 bp, Homo sapiens
agcagctgtttgttgaattggt

SEQ ID NO: 7196463 - DNA, 19 bp, Homo sapiens
agcagcttaattttgtagc

SEQ ID NO: 7196464 - DNA, 22 bp, Homo sapiens
agcagcttacatgtggcctatc

SEQ ID NO: 7196465 - DNA, 22 bp, Homo sapiens
agcagcttagggaattctccct

SEQ ID NO: 7196466 - DNA, 22 bp, Homo sapiens
agcagcttagggaattctccct

SEQ ID NO: 7196467 - DNA, 22 bp, Homo sapiens
agcagcttatcttggagaggca

SEQ ID NO: 7196468 - DNA, 22 bp, Homo sapiens
agcagctgtggggacaagggta

SEQ ID NO: 7196469 - DNA, 22 bp, Homo sapiens
agcagctgtggggacaagggta

SEQ ID NO: 7196470 - DNA, 22 bp, Homo sapiens
agcagctgtggggacaagggta

SEQ ID NO: 7196471 - DNA, 23 bp, Homo sapiens
agcagctgtggtttaccttagta

SEQ ID NO: 7196472 - DNA, 23 bp, Homo sapiens
agcagctgtggtttaccttagta

SEQ ID NO: 7196473 - DNA, 20 bp, Homo sapiens
agcagctgtgttttcatcct

SEQ ID NO: 7196474 - DNA, 22 bp, Homo sapiens
agcagctgttagaaacaggaag

SEQ ID NO: 7196475 - DNA, 22 bp, Homo sapiens
agcagctgttagaaacaggaag

SEQ ID NO: 7196476 - DNA, 22 bp, Homo sapiens
cacaggaagctgactgctggca

SEQ ID NO: 7196477 - DNA, 22 bp, Homo sapiens
cacaggaagctgactgctggca

SEQ ID NO: 7196478 - DNA, 22 bp, Homo sapiens
cacaggaagctgactgctggca

SEQ ID NO: 7196479 - DNA, 22 bp, Homo sapiens
agcagcttctttcactcctgga

SEQ ID NO: 7196480 - DNA, 22 bp, Homo sapiens
cacaggaagcaagcctggggcc

SEQ ID NO: 7196481 - DNA, 22 bp, Homo sapiens
cacaggaagctgactgctggca

SEQ ID NO: 7196482 - DNA, 22 bp, Homo sapiens
agcagcttcaattttctaagtg

SEQ ID NO: 7196483 - DNA, 22 bp, Homo sapiens
agcagcttcagaggcgggcgca

SEQ ID NO: 7196484 - DNA, 22 bp, Homo sapiens
agcagcttcagaggcgggcgca

SEQ ID NO: 7196485 - DNA, 22 bp, Homo sapiens
agcagcttcctgctcttcgcct

SEQ ID NO: 7196486 - DNA, 22 bp, Homo sapiens
agcagcttcctgtttgcaggca

SEQ ID NO: 7196487 - DNA, 22 bp, Homo sapiens
agcagcttctattttcttggtt

SEQ ID NO: 7196488 - DNA, 22 bp, Homo sapiens
cacaggaaggccttctcacaat

SEQ ID NO: 7196489 - DNA, 22 bp, Homo sapiens
cacaggagccctgaggcctccc

SEQ ID NO: 7196490 - DNA, 22 bp, Homo sapiens
cacaggagctgtggggcagtgt

SEQ ID NO: 7196491 - DNA, 22 bp, Homo sapiens
cacaggagctgtggggcagtgt

SEQ ID NO: 7196492 - DNA, 22 bp, Homo sapiens
cacaggagctgtggggcagtgt

SEQ ID NO: 7196493 - DNA, 18 bp, Homo sapiens
agcagctgtgccacactg

SEQ ID NO: 7196494 - DNA, 22 bp, Homo sapiens
agcagctgtgggcaatatgtaa

SEQ ID NO: 7196495 - DNA, 22 bp, Homo sapiens
agcagctgtcccttaacatcag

SEQ ID NO: 7196496 - DNA, 18 bp, Homo sapiens
agcagctgtgccacactg

SEQ ID NO: 7196497 - DNA, 18 bp, Homo sapiens
agcagctgtcagaatgcc

SEQ ID NO: 7196498 - DNA, 18 bp, Homo sapiens
agcagctgtcagaatgcc

SEQ ID NO: 7196499 - DNA, 18 bp, Homo sapiens
agcagctgtcagaatgcc

SEQ ID NO: 7196500 - DNA, 22 bp, Homo sapiens
caatgaacacagcaatttcata

SEQ ID NO: 7196501 - DNA, 22 bp, Homo sapiens
caatgacactctgcacagtgct

SEQ ID NO: 7196502 - DNA, 22 bp, Homo sapiens
caatgataatggctgtatttat

SEQ ID NO: 7196503 - DNA, 22 bp, Homo sapiens
caatgacatggataatcatatt

SEQ ID NO: 7196504 - DNA, 22 bp, Homo sapiens
caatgacatggataatcatatt

SEQ ID NO: 7196505 - DNA, 22 bp, Homo sapiens
caatgataatggctgtatttat

SEQ ID NO: 7196506 - DNA, 21 bp, Homo sapiens
agcagctgggcaacatggagg

SEQ ID NO: 7196507 - DNA, 22 bp, Homo sapiens
agcagctgggctcagagctggg

SEQ ID NO: 7196508 - DNA, 22 bp, Homo sapiens
agcagctgggctcagagctggg

SEQ ID NO: 7196509 - DNA, 22 bp, Homo sapiens
agcagctgggctcagagctggg

SEQ ID NO: 7196510 - DNA, 22 bp, Homo sapiens
agcagctgggctcagagctggg

SEQ ID NO: 7196511 - DNA, 22 bp, Homo sapiens
agcagctgtactttcatctgtt

SEQ ID NO: 7196512 - DNA, 22 bp, Homo sapiens
agcagctgtactttcatctgtt

SEQ ID NO: 7196513 - DNA, 22 bp, Homo sapiens
agcagctgtactttcatctgtt

SEQ ID NO: 7196514 - DNA, 22 bp, Homo sapiens
agcagctgtactttcatctgtt

SEQ ID NO: 7196515 - DNA, 19 bp, Homo sapiens
agcagctgtagatagacac

SEQ ID NO: 7196516 - DNA, 19 bp, Homo sapiens
agcagctgtagatagacac

SEQ ID NO: 7196517 - DNA, 22 bp, Homo sapiens
cacagtatgatctaaagtaagt

SEQ ID NO: 7196518 - DNA, 22 bp, Homo sapiens
cacagtatgatctaaagtaagt

SEQ ID NO: 7196519 - DNA, 22 bp, Homo sapiens
cacagtatcttttgagtaagca

SEQ ID NO: 7196520 - DNA, 22 bp, Homo sapiens
cacagtacttaattctctaaat

SEQ ID NO: 7196521 - DNA, 22 bp, Homo sapiens
cacagtacgcacccgatacatg

SEQ ID NO: 7196522 - DNA, 22 bp, Homo sapiens
cacagtactgctttgggatgtg

SEQ ID NO: 7196523 - DNA, 22 bp, Homo sapiens
cacagtacttaattctctaaat

SEQ ID NO: 7196524 - DNA, 22 bp, Homo sapiens
cacagggctaaatgaagggttg

SEQ ID NO: 7196525 - DNA, 22 bp, Homo sapiens
cacagggctaaatgaagggttg

SEQ ID NO: 7196526 - DNA, 22 bp, Homo sapiens
cacagggctttgatggctgagt

SEQ ID NO: 7196527 - DNA, 22 bp, Homo sapiens
cacagggcttctcatggggtgc

SEQ ID NO: 7196528 - DNA, 19 bp, Homo sapiens
cacagggcaggtctcatgt

SEQ ID NO: 7196529 - DNA, 19 bp, Homo sapiens
cacagggcaggtctcatgt

SEQ ID NO: 7196530 - DNA, 22 bp, Homo sapiens
cacagggcaggtactctcagag

SEQ ID NO: 7196531 - DNA, 23 bp, Homo sapiens
cacaggctgcgcataagcttctc

SEQ ID NO: 7196532 - DNA, 22 bp, Homo sapiens
cacagggcagtgattgtccaca

SEQ ID NO: 7196533 - DNA, 22 bp, Homo sapiens
cacagggcagtgctgcccactc

SEQ ID NO: 7196534 - DNA, 22 bp, Homo sapiens
cacagggccactttcccagtaa

SEQ ID NO: 7196535 - DNA, 22 bp, Homo sapiens
cacagggccactttcccagtaa

SEQ ID NO: 7196536 - DNA, 22 bp, Homo sapiens
cacagggccactttcccagtaa

SEQ ID NO: 7196537 - DNA, 22 bp, Homo sapiens
cacagggcctggggcagctgct

SEQ ID NO: 7196538 - DNA, 22 bp, Homo sapiens
cacagggcctggggcagctgct

SEQ ID NO: 7196539 - DNA, 22 bp, Homo sapiens
cacagggcctggggcagctgct

SEQ ID NO: 7196540 - DNA, 22 bp, Homo sapiens
cacagggccttgtgtgactgca

SEQ ID NO: 7196541 - DNA, 22 bp, Homo sapiens
cacagggccttgtgtgactgca

SEQ ID NO: 7196542 - DNA, 22 bp, Homo sapiens
cacaggctgcccgcagctggga

SEQ ID NO: 7196543 - DNA, 22 bp, Homo sapiens
agcaggagcatttccatgattc

SEQ ID NO: 7196544 - DNA, 22 bp, Homo sapiens
agcaggagatggggcgtgatgt

SEQ ID NO: 7196545 - DNA, 22 bp, Homo sapiens
agcaggagatggggcgtgatgt

SEQ ID NO: 7196546 - DNA, 22 bp, Homo sapiens
agcaggagatggggcgtgatgt

SEQ ID NO: 7196547 - DNA, 22 bp, Homo sapiens
agcaggagagcagtgcgtggtc

SEQ ID NO: 7196548 - DNA, 22 bp, Homo sapiens
agcaggagagcagtgcgtggtc

SEQ ID NO: 7196549 - DNA, 22 bp, Homo sapiens
agcaggagacatgggggtggtg

SEQ ID NO: 7196550 - DNA, 22 bp, Homo sapiens
agcaggagacatgggggtggtg

SEQ ID NO: 7196551 - DNA, 22 bp, Homo sapiens
agcaggagacatgggggtggtg

SEQ ID NO: 7196552 - DNA, 22 bp, Homo sapiens
agcaggagaacactgtggctct

SEQ ID NO: 7196553 - DNA, 22 bp, Homo sapiens
cacaggaggcaatggtaagatt

SEQ ID NO: 7196554 - DNA, 22 bp, Homo sapiens
cacaggagggagcgggcagcca

SEQ ID NO: 7196555 - DNA, 22 bp, Homo sapiens
cacaggagggagcgggcagcca

SEQ ID NO: 7196556 - DNA, 22 bp, Homo sapiens
cacaggaggcaatggtaagatt

SEQ ID NO: 7196557 - DNA, 22 bp, Homo sapiens
cacaggaggcaatggtaagatt

SEQ ID NO: 7196558 - DNA, 22 bp, Homo sapiens
cacaggaggaggtgcccgggcc

SEQ ID NO: 7196559 - DNA, 22 bp, Homo sapiens
cacaggaggaggtgcccgggcc

SEQ ID NO: 7196560 - DNA, 22 bp, Homo sapiens
cacaggaggaggccagagcgta

SEQ ID NO: 7196561 - DNA, 22 bp, Homo sapiens
cacaggaggaggccagagcgta

SEQ ID NO: 7196562 - DNA, 22 bp, Homo sapiens
cacaggaggaggccagagcgta

SEQ ID NO: 7196563 - DNA, 22 bp, Homo sapiens
cacaggaggaggccagagcgta

SEQ ID NO: 7196564 - DNA, 22 bp, Homo sapiens
cacaggaggaggccagagcgta

SEQ ID NO: 7196565 - DNA, 22 bp, Homo sapiens
agcaggagaacactgtggctct

SEQ ID NO: 7196566 - DNA, 22 bp, Homo sapiens
agcaggagaacactgtggctct

SEQ ID NO: 7196567 - DNA, 22 bp, Homo sapiens
cacaggaggttaggaagtggtc

SEQ ID NO: 7196568 - DNA, 22 bp, Homo sapiens
agcaggagaacactgtggctct

SEQ ID NO: 7196569 - DNA, 22 bp, Homo sapiens
agcaggagaacactgtggctct

SEQ ID NO: 7196570 - DNA, 22 bp, Homo sapiens
cacaggagggagcgggcagcca

SEQ ID NO: 7196571 - DNA, 22 bp, Homo sapiens
cacaggagggagcgggcagcca

SEQ ID NO: 7196572 - DNA, 22 bp, Homo sapiens
agcaggtgatcgcgtgtgctcc

SEQ ID NO: 7196573 - DNA, 22 bp, Homo sapiens
agcaggtgatgtgagtctggaa

SEQ ID NO: 7196574 - DNA, 22 bp, Homo sapiens
agcaggtgatgtgagtctggaa

SEQ ID NO: 7196575 - DNA, 22 bp, Homo sapiens
agcaggtgatgtgagtctggaa

SEQ ID NO: 7196576 - DNA, 22 bp, Homo sapiens
agcaggtgatgtgagtctggaa

SEQ ID NO: 7196577 - DNA, 22 bp, Homo sapiens
agcaggtgatgtgagtctggaa

SEQ ID NO: 7196578 - DNA, 22 bp, Homo sapiens
agcaggtgcatggcgagcgcgg

SEQ ID NO: 7196579 - DNA, 22 bp, Homo sapiens
agcaggtgcatggcgagcgcgg

SEQ ID NO: 7196580 - DNA, 22 bp, Homo sapiens
agcaggtgatgtgagtctggaa

SEQ ID NO: 7196581 - DNA, 22 bp, Homo sapiens
agcaggtgccaggtgtacccgc

SEQ ID NO: 7196582 - DNA, 23 bp, Homo sapiens
agcaggtaggttgaaattttcct

SEQ ID NO: 7196583 - DNA, 22 bp, Homo sapiens
cacatgaacatgctggaaaagc

SEQ ID NO: 7196584 - DNA, 22 bp, Homo sapiens
cacatcttccagagtagctaaa

SEQ ID NO: 7196585 - DNA, 22 bp, Homo sapiens
cacatgaacatgctggaaaagc

SEQ ID NO: 7196586 - DNA, 22 bp, Homo sapiens
cacatctgacttccagtgcagg

SEQ ID NO: 7196587 - DNA, 22 bp, Homo sapiens
cacatctgacttccagtgcagg

SEQ ID NO: 7196588 - DNA, 22 bp, Homo sapiens
cacatctgcgctctgcctcata

SEQ ID NO: 7196589 - DNA, 22 bp, Homo sapiens
cacatctgcgctctgcctcata

SEQ ID NO: 7196590 - DNA, 22 bp, Homo sapiens
cacatctgctctgggcagcact

SEQ ID NO: 7196591 - DNA, 22 bp, Homo sapiens
cacatctgggttctcttcttca

SEQ ID NO: 7196592 - DNA, 16 bp, Homo sapiens
cacatatatttatatg

SEQ ID NO: 7196593 - DNA, 19 bp, Homo sapiens
cacatcagcagggctgtgg

SEQ ID NO: 7196594 - DNA, 22 bp, Homo sapiens
cacatcaggtagacctacagag

SEQ ID NO: 7196595 - DNA, 22 bp, Homo sapiens
cacatcatagagactcaatcca

SEQ ID NO: 7196596 - DNA, 22 bp, Homo sapiens
cacatccctggagttacccagt

SEQ ID NO: 7196597 - DNA, 22 bp, Homo sapiens
cacatctactgaatgagcagtg

SEQ ID NO: 7196598 - DNA, 22 bp, Homo sapiens
cacatctactgatattccagga

SEQ ID NO: 7196599 - DNA, 22 bp, Homo sapiens
cacatctactgatattccagga

SEQ ID NO: 7196600 - DNA, 22 bp, Homo sapiens
cacatctatggagacagagagt

SEQ ID NO: 7196601 - DNA, 22 bp, Homo sapiens
agcagggcctgagtgacctaac

SEQ ID NO: 7196602 - DNA, 22 bp, Homo sapiens
agcagggcctggcactcctggg

SEQ ID NO: 7196603 - DNA, 22 bp, Homo sapiens
agcagggcctgagtgacctaac

SEQ ID NO: 7196604 - DNA, 22 bp, Homo sapiens
agcagggcctggcactcctggg

SEQ ID NO: 7196605 - DNA, 22 bp, Homo sapiens
agcagggcctggcactcctggg

SEQ ID NO: 7196606 - DNA, 22 bp, Homo sapiens
agcagggcctggcactcctggg

SEQ ID NO: 7196607 - DNA, 22 bp, Homo sapiens
agcagggcctggcactcctggg

SEQ ID NO: 7196608 - DNA, 22 bp, Homo sapiens
agcagggctcacattagtggat

SEQ ID NO: 7196609 - DNA, 22 bp, Homo sapiens
agcagggctcacattagtggat

SEQ ID NO: 7196610 - DNA, 22 bp, Homo sapiens
agcagggcctggcactcctggg

SEQ ID NO: 7196611 - DNA, 16 bp, Homo sapiens
agcagggcgggaagga

SEQ ID NO: 7196612 - DNA, 16 bp, Homo sapiens
agcagggcgggaagga

SEQ ID NO: 7196613 - DNA, 16 bp, Homo sapiens
agcagggcgggaagga

SEQ ID NO: 7196614 - DNA, 16 bp, Homo sapiens
agcagggcgggaagga

SEQ ID NO: 7196615 - DNA, 22 bp, Homo sapiens
agcagggctccatttcactgcc

SEQ ID NO: 7196616 - DNA, 22 bp, Homo sapiens
agcagggctccatttcactgcc

SEQ ID NO: 7196617 - DNA, 22 bp, Homo sapiens
agcagggctccatttcactgcc

SEQ ID NO: 7196618 - DNA, 22 bp, Homo sapiens
agcagggctcacattagtggat

SEQ ID NO: 7196619 - DNA, 22 bp, Homo sapiens
agcagggctcacattagtggat

SEQ ID NO: 7196620 - DNA, 22 bp, Homo sapiens
agcagggctccatttcactgcc

SEQ ID NO: 7196621 - DNA, 22 bp, Homo sapiens
agcagggctcctgaaagccgcg

SEQ ID NO: 7196622 - DNA, 22 bp, Homo sapiens
agcagggctcctgaaagccgcg

SEQ ID NO: 7196623 - DNA, 22 bp, Homo sapiens
agcagggctctgccatgggccc

SEQ ID NO: 7196624 - DNA, 22 bp, Homo sapiens
agcagggctctgccatgggccc

SEQ ID NO: 7196625 - DNA, 22 bp, Homo sapiens
agcagggctctgccatgggccc

SEQ ID NO: 7196626 - DNA, 22 bp, Homo sapiens
agcagggctcctgaaagccgcg

SEQ ID NO: 7196627 - DNA, 22 bp, Homo sapiens
agcagggctctgccatgggccc

SEQ ID NO: 7196628 - DNA, 22 bp, Homo sapiens
cacagtcacatatctatgtgtg

SEQ ID NO: 7196629 - DNA, 22 bp, Homo sapiens
cacagtcacatatctatgtgtg

SEQ ID NO: 7196630 - DNA, 23 bp, Homo sapiens
cacagtcatttactttgccatca

SEQ ID NO: 7196631 - DNA, 22 bp, Homo sapiens
cacagtatttgtttttctgagt

SEQ ID NO: 7196632 - DNA, 22 bp, Homo sapiens
cacagtcacatatctatgtgtg

SEQ ID NO: 7196633 - DNA, 22 bp, Homo sapiens
agcagggcagtgcttcagctct

SEQ ID NO: 7196634 - DNA, 22 bp, Homo sapiens
agcagggcagtgcttcagctct

SEQ ID NO: 7196635 - DNA, 22 bp, Homo sapiens
cacagtcccattcgagagtaat

SEQ ID NO: 7196636 - DNA, 22 bp, Homo sapiens
cacagtccagactcctggagtt

SEQ ID NO: 7196637 - DNA, 22 bp, Homo sapiens
agcagggcagtgcttcagctct

SEQ ID NO: 7196638 - DNA, 22 bp, Homo sapiens
agcagggcctgagtgacctaac

SEQ ID NO: 7196639 - DNA, 22 bp, Homo sapiens
agcagggcctgagtgacctaac

SEQ ID NO: 7196640 - DNA, 22 bp, Homo sapiens
caccagggcagcagcctagtct

SEQ ID NO: 7196641 - DNA, 22 bp, Homo sapiens
caccagggacaatgctaggggt

SEQ ID NO: 7196642 - DNA, 22 bp, Homo sapiens
caccagggacaatgctaggggt

SEQ ID NO: 7196643 - DNA, 22 bp, Homo sapiens
caccagggacaatgctaggggt

SEQ ID NO: 7196644 - DNA, 22 bp, Homo sapiens
caccagggacaatgctaggggt

SEQ ID NO: 7196645 - DNA, 22 bp, Homo sapiens
caccagggacaatgctaggggt

SEQ ID NO: 7196646 - DNA, 22 bp, Homo sapiens
caccaggctggagtgcagtggc

SEQ ID NO: 7196647 - DNA, 22 bp, Homo sapiens
caccaggctggagtgcagtggc

SEQ ID NO: 7196648 - DNA, 22 bp, Homo sapiens
agcaggtggacagaggaagaaa

SEQ ID NO: 7196649 - DNA, 22 bp, Homo sapiens
agcaggtggacagaggaagaaa

SEQ ID NO: 7196650 - DNA, 22 bp, Homo sapiens
agcaggtggacagaggaagaaa

SEQ ID NO: 7196651 - DNA, 21 bp, Homo sapiens
agcaggtgctgttggaggaaa

SEQ ID NO: 7196652 - DNA, 21 bp, Homo sapiens
agcaggtgctgttggaggaaa

SEQ ID NO: 7196653 - DNA, 21 bp, Homo sapiens
agcaggtgctgttggaggaaa

SEQ ID NO: 7196654 - DNA, 18 bp, Homo sapiens
agcaggtgctgtttcttt

SEQ ID NO: 7196655 - DNA, 22 bp, Homo sapiens
agcaggtggaaaattcttatca

SEQ ID NO: 7196656 - DNA, 21 bp, Homo sapiens
agcaggtgctgttggaggaaa

SEQ ID NO: 7196657 - DNA, 22 bp, Homo sapiens
agcaggtgcgttacttcactct

SEQ ID NO: 7196658 - DNA, 22 bp, Homo sapiens
agcaggtgccaggtgtacccgc

SEQ ID NO: 7196659 - DNA, 22 bp, Homo sapiens
agcaggtgccaggtgtacccgc

SEQ ID NO: 7196660 - DNA, 22 bp, Homo sapiens
caccaggtgctggaggacatca

SEQ ID NO: 7196661 - DNA, 22 bp, Homo sapiens
caccagggctctgagctctgaa

SEQ ID NO: 7196662 - DNA, 22 bp, Homo sapiens
caccaggggcagagaccaaagt

SEQ ID NO: 7196663 - DNA, 22 bp, Homo sapiens
caccagggctctgagctctgaa

SEQ ID NO: 7196664 - DNA, 22 bp, Homo sapiens
caccagggccccaggctgtgcc

SEQ ID NO: 7196665 - DNA, 22 bp, Homo sapiens
caccagggccccaggctgtgcc

SEQ ID NO: 7196666 - DNA, 22 bp, Homo sapiens
agcagttgtagtcatggaaaat

SEQ ID NO: 7196667 - DNA, 22 bp, Homo sapiens
agcagtttatcctcataatgga

SEQ ID NO: 7196668 - DNA, 22 bp, Homo sapiens
caccaggtggaaatgtcacagc

SEQ ID NO: 7196669 - DNA, 22 bp, Homo sapiens
caccaggtgctggaggacatca

SEQ ID NO: 7196670 - DNA, 22 bp, Homo sapiens
agcataaactcagggacacaca

SEQ ID NO: 7196671 - DNA, 22 bp, Homo sapiens
agcataaactcagggacacaca

SEQ ID NO: 7196672 - DNA, 22 bp, Homo sapiens
agcataaaggacatttgtcact

SEQ ID NO: 7196673 - DNA, 22 bp, Homo sapiens
agcataaaggacatttgtcact

SEQ ID NO: 7196674 - DNA, 22 bp, Homo sapiens
agcataaaggcactagaaagag

SEQ ID NO: 7196675 - DNA, 22 bp, Homo sapiens
agcagtttggaaaatactagaa

SEQ ID NO: 7196676 - DNA, 22 bp, Homo sapiens
agcagtttggcccgagcagttc

SEQ ID NO: 7196677 - DNA, 20 bp, Homo sapiens
agcagtttcctaactcagct

SEQ ID NO: 7196678 - DNA, 22 bp, Homo sapiens
agcagtttctcttgtatcttca

SEQ ID NO: 7196679 - DNA, 22 bp, Homo sapiens
cactctgggggctgccgctgcc

SEQ ID NO: 7196680 - DNA, 22 bp, Homo sapiens
cactctgggggctgccgctgcc

SEQ ID NO: 7196681 - DNA, 22 bp, Homo sapiens
cactctgggggctgccgctgcc

SEQ ID NO: 7196682 - DNA, 22 bp, Homo sapiens
cactctgggctcttgtttcaga

SEQ ID NO: 7196683 - DNA, 22 bp, Homo sapiens
cactctggggatgcaaggagag

SEQ ID NO: 7196684 - DNA, 22 bp, Homo sapiens
cactctgcaggccaaaccaaag

SEQ ID NO: 7196685 - DNA, 22 bp, Homo sapiens
cactctgcctgatgttacatgg

SEQ ID NO: 7196686 - DNA, 22 bp, Homo sapiens
cactctgatggtttctgttcaa

SEQ ID NO: 7196687 - DNA, 22 bp, Homo sapiens
cactctgattccacaaggctcc

SEQ ID NO: 7196688 - DNA, 20 bp, Homo sapiens
cactctgagggagtccatgt

SEQ ID NO: 7196689 - DNA, 22 bp, Homo sapiens
agcataagttggtacagccact

SEQ ID NO: 7196690 - DNA, 22 bp, Homo sapiens
agcataagttggtacagccact

SEQ ID NO: 7196691 - DNA, 22 bp, Homo sapiens
agcataagttggtacagccact

SEQ ID NO: 7196692 - DNA, 22 bp, Homo sapiens
agcataacacccgacactcagg

SEQ ID NO: 7196693 - DNA, 22 bp, Homo sapiens
agcataagttggtacagccact

SEQ ID NO: 7196694 - DNA, 22 bp, Homo sapiens
agcataagttggtacagccact

SEQ ID NO: 7196695 - DNA, 22 bp, Homo sapiens
cactctgagcccaagcaggctg

SEQ ID NO: 7196696 - DNA, 22 bp, Homo sapiens
cactctgagcccaagcaggctg

SEQ ID NO: 7196697 - DNA, 22 bp, Homo sapiens
agccttttggagttattctggg

SEQ ID NO: 7196698 - DNA, 22 bp, Homo sapiens
cagcaggaccattgaggcatca

SEQ ID NO: 7196699 - DNA, 22 bp, Homo sapiens
cagcaggaccattgaggcatca

SEQ ID NO: 7196700 - DNA, 22 bp, Homo sapiens
cagcaggacccaggaatcctgc

SEQ ID NO: 7196701 - DNA, 22 bp, Homo sapiens
cagcaggacgtccaagtgctat

SEQ ID NO: 7196702 - DNA, 22 bp, Homo sapiens
cagcaggacgtccaagtgctat

SEQ ID NO: 7196703 - DNA, 22 bp, Homo sapiens
cagcaggacgtccaagtgctat

SEQ ID NO: 7196704 - DNA, 22 bp, Homo sapiens
cagcaggagcagtcagactcct

SEQ ID NO: 7196705 - DNA, 22 bp, Homo sapiens
cagcaggaggcatggcttccct

SEQ ID NO: 7196706 - DNA, 23 bp, Homo sapiens
cagcaggagggtgcctgggctgc

SEQ ID NO: 7196707 - DNA, 23 bp, Homo sapiens
cagcaggagggtgcctgggctgc

SEQ ID NO: 7196708 - DNA, 23 bp, Homo sapiens
cagcaggagggtgcctgggctgc

SEQ ID NO: 7196709 - DNA, 23 bp, Homo sapiens
cagcaggagggtgcctgggctgc

SEQ ID NO: 7196710 - DNA, 22 bp, Homo sapiens
cagcaggagcagtcagactcct

SEQ ID NO: 7196711 - DNA, 22 bp, Homo sapiens
cagcaggaggcatggcttccct

SEQ ID NO: 7196712 - DNA, 22 bp, Homo sapiens
cagcaggaggcatggcttccct

SEQ ID NO: 7196713 - DNA, 22 bp, Homo sapiens
agccttcccttagagaatgagc

SEQ ID NO: 7196714 - DNA, 22 bp, Homo sapiens
agccttctaggatgtcatctgc

SEQ ID NO: 7196715 - DNA, 22 bp, Homo sapiens
agccttctctgaaattctgttt

SEQ ID NO: 7196716 - DNA, 22 bp, Homo sapiens
agccttctctgattctcctagt

SEQ ID NO: 7196717 - DNA, 22 bp, Homo sapiens
agccttgaacactgactgaagg

SEQ ID NO: 7196718 - DNA, 22 bp, Homo sapiens
agccttgaatgcgctgcattgg

SEQ ID NO: 7196719 - DNA, 22 bp, Homo sapiens
agccttgaaccaattgtttagc

SEQ ID NO: 7196720 - DNA, 22 bp, Homo sapiens
agccttgagcagttcacttggt

SEQ ID NO: 7196721 - DNA, 22 bp, Homo sapiens
agccttgagttcaagtgctggc

SEQ ID NO: 7196722 - DNA, 22 bp, Homo sapiens
agccttgcagaataatttgaag

SEQ ID NO: 7196723 - DNA, 23 bp, Homo sapiens
agccttggaggttgaggctgcag

SEQ ID NO: 7196724 - DNA, 23 bp, Homo sapiens
agccttggaggttgaggctgcag

SEQ ID NO: 7196725 - DNA, 22 bp, Homo sapiens
agccttggccgtaaggtatgct

SEQ ID NO: 7196726 - DNA, 22 bp, Homo sapiens
agccttgggcaatttggacact

SEQ ID NO: 7196727 - DNA, 22 bp, Homo sapiens
agccttggtcccgcgtcagcca

SEQ ID NO: 7196728 - DNA, 22 bp, Homo sapiens
agcctttaacacttcacattga

SEQ ID NO: 7196729 - DNA, 22 bp, Homo sapiens
cagccagagaaagggcactgcc

SEQ ID NO: 7196730 - DNA, 22 bp, Homo sapiens
cagccagagaaagggcactgcc

SEQ ID NO: 7196731 - DNA, 22 bp, Homo sapiens
agctcagaagggaggaaatgag

SEQ ID NO: 7196732 - DNA, 22 bp, Homo sapiens
cagccagaacctaggatgagct

SEQ ID NO: 7196733 - DNA, 22 bp, Homo sapiens
agctcagaagcctatgcatagt

SEQ ID NO: 7196734 - DNA, 22 bp, Homo sapiens
agctcagaactgcagacatgtg

SEQ ID NO: 7196735 - DNA, 22 bp, Homo sapiens
agctcagaactgcagacatgtg

SEQ ID NO: 7196736 - DNA, 22 bp, Homo sapiens
agctcagaactgcagacatgtg

SEQ ID NO: 7196737 - DNA, 22 bp, Homo sapiens
agctcagaagcctatgcatagt

SEQ ID NO: 7196738 - DNA, 22 bp, Homo sapiens
agctcagaagcctatgcatagt

SEQ ID NO: 7196739 - DNA, 22 bp, Homo sapiens
agctcagaactgcagacatgtg

SEQ ID NO: 7196740 - DNA, 22 bp, Homo sapiens
agctcagaacctcctcatccca

SEQ ID NO: 7196741 - DNA, 22 bp, Homo sapiens
agctcagaacctcctcatccca

SEQ ID NO: 7196742 - DNA, 22 bp, Homo sapiens
agctcagaacctcctcatccca

SEQ ID NO: 7196743 - DNA, 22 bp, Homo sapiens
agctcagaaatgccagtaggta

SEQ ID NO: 7196744 - DNA, 22 bp, Homo sapiens
agctcagaacctcctcatccca

SEQ ID NO: 7196745 - DNA, 22 bp, Homo sapiens
agctcacagcctagcactgtga

SEQ ID NO: 7196746 - DNA, 22 bp, Homo sapiens
agctcacagcctagcactgtga

SEQ ID NO: 7196747 - DNA, 22 bp, Homo sapiens
agctcacagtgtccttcctcaa

SEQ ID NO: 7196748 - DNA, 22 bp, Homo sapiens
agctcacattctcatcagatgt

SEQ ID NO: 7196749 - DNA, 23 bp, Homo sapiens
cagcaggagggtgcctgggctgc

SEQ ID NO: 7196750 - DNA, 22 bp, Homo sapiens
cagcaggaggtgagatgtgacc

SEQ ID NO: 7196751 - DNA, 22 bp, Homo sapiens
cagcaggaggtgagatgtgacc

SEQ ID NO: 7196752 - DNA, 22 bp, Homo sapiens
cagcaggaggtgagatgtgacc

SEQ ID NO: 7196753 - DNA, 22 bp, Homo sapiens
cagcaggaggtgagatgtgacc

SEQ ID NO: 7196754 - DNA, 22 bp, Homo sapiens
cagcaggaggtgagtagcaggt

SEQ ID NO: 7196755 - DNA, 22 bp, Homo sapiens
cagcaggaggtgagtagcaggt

SEQ ID NO: 7196756 - DNA, 22 bp, Homo sapiens
cagcaggaggtgagtagcaggt

SEQ ID NO: 7196757 - DNA, 22 bp, Homo sapiens
cagcaggaggtgagtagcaggt

SEQ ID NO: 7196758 - DNA, 22 bp, Homo sapiens
cagcaggaggtgagtagcaggt

SEQ ID NO: 7196759 - DNA, 22 bp, Homo sapiens
cagcaggataggtttctttgga

SEQ ID NO: 7196760 - DNA, 22 bp, Homo sapiens
agctcaagttttcaaatattat

SEQ ID NO: 7196761 - DNA, 22 bp, Homo sapiens
agctcaagttttcaaatattat

SEQ ID NO: 7196762 - DNA, 22 bp, Homo sapiens
agctcaatgcaacctccgcctc

SEQ ID NO: 7196763 - DNA, 22 bp, Homo sapiens
agctcaatgcaacctccgcctc

SEQ ID NO: 7196764 - DNA, 22 bp, Homo sapiens
agctcacaagactccctcccct

SEQ ID NO: 7196765 - DNA, 22 bp, Homo sapiens
agctcacagcctagcactgtga

SEQ ID NO: 7196766 - DNA, 22 bp, Homo sapiens
cagccagatcagggcaggggtt

SEQ ID NO: 7196767 - DNA, 22 bp, Homo sapiens
cagccagatcagggcaggggtt

SEQ ID NO: 7196768 - DNA, 22 bp, Homo sapiens
cagccagatcagggcaggggtt

SEQ ID NO: 7196769 - DNA, 22 bp, Homo sapiens
cagccagatcaaactcagatgt

SEQ ID NO: 7196770 - DNA, 22 bp, Homo sapiens
cagccagatcagggcaggggtt

SEQ ID NO: 7196771 - DNA, 22 bp, Homo sapiens
cagccagcctctcaaccatgca

SEQ ID NO: 7196772 - DNA, 22 bp, Homo sapiens
cagccagctgaatgtaccatga

SEQ ID NO: 7196773 - DNA, 22 bp, Homo sapiens
cagccagcctctcaaccatgca

SEQ ID NO: 7196774 - DNA, 22 bp, Homo sapiens
cagccagctcaggaaggatttt

SEQ ID NO: 7196775 - DNA, 22 bp, Homo sapiens
cagccagctcaggaaggatttt

SEQ ID NO: 7196776 - DNA, 22 bp, Homo sapiens
cagccagaggctgcgaggggcc

SEQ ID NO: 7196777 - DNA, 22 bp, Homo sapiens
cagccagagaggaaggaatgca

SEQ ID NO: 7196778 - DNA, 22 bp, Homo sapiens
cagccagagaggaaggaatgca

SEQ ID NO: 7196779 - DNA, 22 bp, Homo sapiens
cagccagagaggaaggaatgca

SEQ ID NO: 7196780 - DNA, 22 bp, Homo sapiens
cagccagaggctgcgaggggcc

SEQ ID NO: 7196781 - DNA, 22 bp, Homo sapiens
cagccagaggctgcgaggggcc

SEQ ID NO: 7196782 - DNA, 22 bp, Homo sapiens
cagccagaggctgcgaggggcc

SEQ ID NO: 7196783 - DNA, 22 bp, Homo sapiens
cagccagaggggccagagtcgg

SEQ ID NO: 7196784 - DNA, 22 bp, Homo sapiens
cagccagaggggccagagtcgg

SEQ ID NO: 7196785 - DNA, 22 bp, Homo sapiens
cagccagatcaaactcagatgt

SEQ ID NO: 7196786 - DNA, 22 bp, Homo sapiens
cagccagctggcactgtgagta

SEQ ID NO: 7196787 - DNA, 22 bp, Homo sapiens
agctccagggaaagagtggatc

SEQ ID NO: 7196788 - DNA, 23 bp, Homo sapiens
agctccagggaacaggcagtagg

SEQ ID NO: 7196789 - DNA, 22 bp, Homo sapiens
agctcccaggcagtcatgagga

SEQ ID NO: 7196790 - DNA, 22 bp, Homo sapiens
agctcccagtctcctctccatg

SEQ ID NO: 7196791 - DNA, 22 bp, Homo sapiens
agctcccagtctcctctccatg

SEQ ID NO: 7196792 - DNA, 22 bp, Homo sapiens
agctcccagtctcctctccatg

SEQ ID NO: 7196793 - DNA, 22 bp, Homo sapiens
agctcccagtctcctctccatg

SEQ ID NO: 7196794 - DNA, 22 bp, Homo sapiens
agctcccattatcttctgaaac

SEQ ID NO: 7196795 - DNA, 22 bp, Homo sapiens
agctccctgagatgccacagca

SEQ ID NO: 7196796 - DNA, 22 bp, Homo sapiens
agctccctgagatgccacagca

SEQ ID NO: 7196797 - DNA, 22 bp, Homo sapiens
cagccctgggtccctgccctgg

SEQ ID NO: 7196798 - DNA, 22 bp, Homo sapiens
cagccctgggtccctgccctgg

SEQ ID NO: 7196799 - DNA, 22 bp, Homo sapiens
cagccctgggagttggggccga

SEQ ID NO: 7196800 - DNA, 22 bp, Homo sapiens
cagccctgggagttggggccga

SEQ ID NO: 7196801 - DNA, 22 bp, Homo sapiens
cagccctgggtccctgccctgg

SEQ ID NO: 7196802 - DNA, 22 bp, Homo sapiens
cagccctgggtccctgccctgg

SEQ ID NO: 7196803 - DNA, 22 bp, Homo sapiens
cagccctgggatcttagtgcct

SEQ ID NO: 7196804 - DNA, 22 bp, Homo sapiens
cagccctggctagggcgagggc

SEQ ID NO: 7196805 - DNA, 22 bp, Homo sapiens
cagccctgggagttggggccga

SEQ ID NO: 7196806 - DNA, 22 bp, Homo sapiens
cagccctgggagttggggccga

SEQ ID NO: 7196807 - DNA, 22 bp, Homo sapiens
cagccctggctagggcgagggc

SEQ ID NO: 7196808 - DNA, 22 bp, Homo sapiens
cagccctgggagttggggccga

SEQ ID NO: 7196809 - DNA, 22 bp, Homo sapiens
cagccctggcgcccccagatct

SEQ ID NO: 7196810 - DNA, 22 bp, Homo sapiens
cagccctggcgcccccagatct

SEQ ID NO: 7196811 - DNA, 22 bp, Homo sapiens
cagccctggcgcccccagatct

SEQ ID NO: 7196812 - DNA, 22 bp, Homo sapiens
cagccctggctagggcgagggc

SEQ ID NO: 7196813 - DNA, 22 bp, Homo sapiens
cagccctggctagggcgagggc

SEQ ID NO: 7196814 - DNA, 22 bp, Homo sapiens
cagccctggctagggcgagggc

SEQ ID NO: 7196815 - DNA, 22 bp, Homo sapiens
agctcctctagatctgccactt

SEQ ID NO: 7196816 - DNA, 20 bp, Homo sapiens
agctcctctgcccattcttc

SEQ ID NO: 7196817 - DNA, 20 bp, Homo sapiens
agctcctctgcccattcttc

SEQ ID NO: 7196818 - DNA, 22 bp, Homo sapiens
cagccctggccccaggtggtct

SEQ ID NO: 7196819 - DNA, 22 bp, Homo sapiens
cagccctggcctcttcgctttc

SEQ ID NO: 7196820 - DNA, 20 bp, Homo sapiens
agctcctcatcactggaggt

SEQ ID NO: 7196821 - DNA, 22 bp, Homo sapiens
agctcctcctgagtgtctggga

SEQ ID NO: 7196822 - DNA, 22 bp, Homo sapiens
agctcctatgagaaatatctgt

SEQ ID NO: 7196823 - DNA, 22 bp, Homo sapiens
agctcctatgagaaatatctgt

SEQ ID NO: 7196824 - DNA, 20 bp, Homo sapiens
agctcctcatcactggaggt

SEQ ID NO: 7196825 - DNA, 22 bp, Homo sapiens
agctccctgcacgaccctgccc

SEQ ID NO: 7196826 - DNA, 22 bp, Homo sapiens
agctccctgcacgaccctgccc

SEQ ID NO: 7196827 - DNA, 21 bp, Homo sapiens
agctccctgtttcctcactct

SEQ ID NO: 7196828 - DNA, 21 bp, Homo sapiens
agctccctgtttcctcactct

SEQ ID NO: 7196829 - DNA, 21 bp, Homo sapiens
agctccctgtttcctcactct

SEQ ID NO: 7196830 - DNA, 21 bp, Homo sapiens
agctccctgtttcctcactct

SEQ ID NO: 7196831 - DNA, 21 bp, Homo sapiens
agctccctgtttcctcactct

SEQ ID NO: 7196832 - DNA, 21 bp, Homo sapiens
agctccctgtttcctcactct

SEQ ID NO: 7196833 - DNA, 22 bp, Homo sapiens
agcctcagggctctgcgcagac

SEQ ID NO: 7196834 - DNA, 23 bp, Homo sapiens
agcctcagccggtggcagaagtg

SEQ ID NO: 7196835 - DNA, 23 bp, Homo sapiens
agcctcagccggtggcagaagtg

SEQ ID NO: 7196836 - DNA, 22 bp, Homo sapiens
agcctcagggctctgcgcagac

SEQ ID NO: 7196837 - DNA, 22 bp, Homo sapiens
agcctcagggctctgcgcagac

SEQ ID NO: 7196838 - DNA, 22 bp, Homo sapiens
agcctcagggctctgcgcagac

SEQ ID NO: 7196839 - DNA, 22 bp, Homo sapiens
agcctcagggctctgcgcagac

SEQ ID NO: 7196840 - DNA, 22 bp, Homo sapiens
agcctcagcacgcagctctgtg

SEQ ID NO: 7196841 - DNA, 23 bp, Homo sapiens
agcctcagccggtggcagaagtg

SEQ ID NO: 7196842 - DNA, 23 bp, Homo sapiens
agcctcagccggtggcagaagtg

SEQ ID NO: 7196843 - DNA, 22 bp, Homo sapiens
cagcacagtacaaggcacggat

SEQ ID NO: 7196844 - DNA, 22 bp, Homo sapiens
cagcacagggcttgagaggtgt

SEQ ID NO: 7196845 - DNA, 22 bp, Homo sapiens
cagcacaggtcagttttttaag

SEQ ID NO: 7196846 - DNA, 22 bp, Homo sapiens
cagcacaggtcagttttttaag

SEQ ID NO: 7196847 - DNA, 22 bp, Homo sapiens
cagcacagggcttgagaggtgt

SEQ ID NO: 7196848 - DNA, 22 bp, Homo sapiens
cagcacagggcttgagaggtgt

SEQ ID NO: 7196849 - DNA, 22 bp, Homo sapiens
cagcacagtacaaggcacggat

SEQ ID NO: 7196850 - DNA, 22 bp, Homo sapiens
cagcacagtacaaggcacggat

SEQ ID NO: 7196851 - DNA, 22 bp, Homo sapiens
cagcacagtacaaggcacggat

SEQ ID NO: 7196852 - DNA, 22 bp, Homo sapiens
cagcacagtacaaggcacggat

SEQ ID NO: 7196853 - DNA, 22 bp, Homo sapiens
cagcacagtacaaggcacggat

SEQ ID NO: 7196854 - DNA, 22 bp, Homo sapiens
cagcacagtacaaggcacggat

SEQ ID NO: 7196855 - DNA, 22 bp, Homo sapiens
cagcacagtacaaggcacggat

SEQ ID NO: 7196856 - DNA, 22 bp, Homo sapiens
agcctcagcacgcagctctgtg

SEQ ID NO: 7196857 - DNA, 22 bp, Homo sapiens
agcctcagcacgcagctctgtg

SEQ ID NO: 7196858 - DNA, 22 bp, Homo sapiens
agcctcagcacgcagctctgtg

SEQ ID NO: 7196859 - DNA, 22 bp, Homo sapiens
cagcacagggacaatagcagat

SEQ ID NO: 7196860 - DNA, 22 bp, Homo sapiens
cagcacagggacaatagcagat

SEQ ID NO: 7196861 - DNA, 22 bp, Homo sapiens
cagcacagggcttgagaggtgt

SEQ ID NO: 7196862 - DNA, 22 bp, Homo sapiens
cagcacagggcttgagaggtgt

SEQ ID NO: 7196863 - DNA, 22 bp, Homo sapiens
cagcacagggcttgagaggtgt

SEQ ID NO: 7196864 - DNA, 22 bp, Homo sapiens
cagcacaggcccctctctccca

SEQ ID NO: 7196865 - DNA, 22 bp, Homo sapiens
cagcacaggcccctctctccca

SEQ ID NO: 7196866 - DNA, 22 bp, Homo sapiens
cagcacaggcccctctctccca

SEQ ID NO: 7196867 - DNA, 22 bp, Homo sapiens
cagcacaggcctgtctttgtct

SEQ ID NO: 7196868 - DNA, 22 bp, Homo sapiens
cagcacaggcctgtctttgtct

SEQ ID NO: 7196869 - DNA, 22 bp, Homo sapiens
cagcacagggacaatagcagat

SEQ ID NO: 7196870 - DNA, 22 bp, Homo sapiens
cagcacagggacaatagcagat

SEQ ID NO: 7196871 - DNA, 22 bp, Homo sapiens
cagcacaggaatatggtggaca

SEQ ID NO: 7196872 - DNA, 22 bp, Homo sapiens
cagcacaggaatatggtggaca

SEQ ID NO: 7196873 - DNA, 22 bp, Homo sapiens
cagcacaggaatatggtggaca

SEQ ID NO: 7196874 - DNA, 22 bp, Homo sapiens
cagcacaggaagtgggccttca

SEQ ID NO: 7196875 - DNA, 22 bp, Homo sapiens
cagcacaggaatatggtggaca

SEQ ID NO: 7196876 - DNA, 22 bp, Homo sapiens
cagcacaggcaggggaactata

SEQ ID NO: 7196877 - DNA, 22 bp, Homo sapiens
cagcacaggcaggggaactata

SEQ ID NO: 7196878 - DNA, 22 bp, Homo sapiens
cagcacaggcaggggaactata

SEQ ID NO: 7196879 - DNA, 22 bp, Homo sapiens
cagcacagctgaggggctgtct

SEQ ID NO: 7196880 - DNA, 22 bp, Homo sapiens
cagcacagctgaggggctgtct

SEQ ID NO: 7196881 - DNA, 22 bp, Homo sapiens
cagcacagctgaggggctgtct

SEQ ID NO: 7196882 - DNA, 22 bp, Homo sapiens
cagcacagctggctctggaagc

SEQ ID NO: 7196883 - DNA, 22 bp, Homo sapiens
cagcacagctggctctggaagc

SEQ ID NO: 7196884 - DNA, 22 bp, Homo sapiens
cagcacaggaagtgggccttca

SEQ ID NO: 7196885 - DNA, 22 bp, Homo sapiens
cagcacaggaagtgggccttca

SEQ ID NO: 7196886 - DNA, 22 bp, Homo sapiens
cagcacaggaagtgggccttca

SEQ ID NO: 7196887 - DNA, 22 bp, Homo sapiens
cagaggctaagagtgtccaaag

SEQ ID NO: 7196888 - DNA, 22 bp, Homo sapiens
cagaggcctttctacagtgata

SEQ ID NO: 7196889 - DNA, 22 bp, Homo sapiens
agccctccatctgtgctcaggc

SEQ ID NO: 7196890 - DNA, 22 bp, Homo sapiens
agccctccatctgtgctcaggc

SEQ ID NO: 7196891 - DNA, 22 bp, Homo sapiens
cagaggctaagatgagtgggtg

SEQ ID NO: 7196892 - DNA, 22 bp, Homo sapiens
cagaggctaagatgagtgggtg

SEQ ID NO: 7196893 - DNA, 22 bp, Homo sapiens
cagaggctaagggtagcttggg

SEQ ID NO: 7196894 - DNA, 22 bp, Homo sapiens
cagaggctagactgtgcttcct

SEQ ID NO: 7196895 - DNA, 22 bp, Homo sapiens
cagaggctagactgtgcttcct

SEQ ID NO: 7196896 - DNA, 22 bp, Homo sapiens
cagaggctcaccagcctttcac

SEQ ID NO: 7196897 - DNA, 22 bp, Homo sapiens
cagaggctcaccagcctttcac

SEQ ID NO: 7196898 - DNA, 22 bp, Homo sapiens
cagaggctcagatggccctggc

SEQ ID NO: 7196899 - DNA, 22 bp, Homo sapiens
cagaggctcttcctcactgccc

SEQ ID NO: 7196900 - DNA, 22 bp, Homo sapiens
cagaggctcttcctcactgccc

SEQ ID NO: 7196901 - DNA, 22 bp, Homo sapiens
cagaggctcttcctcactgccc

SEQ ID NO: 7196902 - DNA, 22 bp, Homo sapiens
cagcaagaatcagacaacctca

SEQ ID NO: 7196903 - DNA, 19 bp, Homo sapiens
cagcaagaatgaaggcata

SEQ ID NO: 7196904 - DNA, 19 bp, Homo sapiens
cagcaagaatgaaggcata

SEQ ID NO: 7196905 - DNA, 20 bp, Homo sapiens
cagcacagagcttggctcta

SEQ ID NO: 7196906 - DNA, 20 bp, Homo sapiens
cagcacagagcttggctcta

SEQ ID NO: 7196907 - DNA, 20 bp, Homo sapiens
cagcacagagcttggctcta

SEQ ID NO: 7196908 - DNA, 22 bp, Homo sapiens
cagcacacagtgactcgcacct

SEQ ID NO: 7196909 - DNA, 22 bp, Homo sapiens
cagcacagagtattttattgat

SEQ ID NO: 7196910 - DNA, 22 bp, Homo sapiens
cagcacagagtattttattgat

SEQ ID NO: 7196911 - DNA, 22 bp, Homo sapiens
cagcacagcacagcggtgactc

SEQ ID NO: 7196912 - DNA, 22 bp, Homo sapiens
cagcacagcacagcggtgactc

SEQ ID NO: 7196913 - DNA, 22 bp, Homo sapiens
cagcacagcacagcggtgactc

SEQ ID NO: 7196914 - DNA, 22 bp, Homo sapiens
cagcacagcacagcggtgactc

SEQ ID NO: 7196915 - DNA, 22 bp, Homo sapiens
cagcacagcacagcggtgactc

SEQ ID NO: 7196916 - DNA, 22 bp, Homo sapiens
cagcacagctgaggggctgtct

SEQ ID NO: 7196917 - DNA, 22 bp, Homo sapiens
cagcacagctgaggggctgtct

SEQ ID NO: 7196918 - DNA, 22 bp, Homo sapiens
cagcacagctgaggggctgtct

SEQ ID NO: 7196919 - DNA, 22 bp, Homo sapiens
cagcacagctgaggggctgtct

SEQ ID NO: 7196920 - DNA, 22 bp, Homo sapiens
agcctgtctgtctccaaagctg

SEQ ID NO: 7196921 - DNA, 22 bp, Homo sapiens
cagcagcattgctctggattcc

SEQ ID NO: 7196922 - DNA, 22 bp, Homo sapiens
cagcagcattgctctggattcc

SEQ ID NO: 7196923 - DNA, 22 bp, Homo sapiens
cagcagcattgctctggattcc

SEQ ID NO: 7196924 - DNA, 22 bp, Homo sapiens
agccttcagtaaatccactgtg

SEQ ID NO: 7196925 - DNA, 22 bp, Homo sapiens
agccttccacccagatcccctt

SEQ ID NO: 7196926 - DNA, 22 bp, Homo sapiens
agccttccaggtagatggcaca

SEQ ID NO: 7196927 - DNA, 22 bp, Homo sapiens
agccttccaggtagatggcaca

SEQ ID NO: 7196928 - DNA, 22 bp, Homo sapiens
cagcagcagtgttctagaatct

SEQ ID NO: 7196929 - DNA, 22 bp, Homo sapiens
cagcagcagtgttctagaatct

SEQ ID NO: 7196930 - DNA, 22 bp, Homo sapiens
cagcagcagtgttctagaatct

SEQ ID NO: 7196931 - DNA, 22 bp, Homo sapiens
cagcagcatcaggtctgtggtt

SEQ ID NO: 7196932 - DNA, 22 bp, Homo sapiens
cagcagcatcaggtctgtggtt

SEQ ID NO: 7196933 - DNA, 22 bp, Homo sapiens
cagcagcatcaggtctgtggtt

SEQ ID NO: 7196934 - DNA, 22 bp, Homo sapiens
cagcagcatcaggtctgtggtt

SEQ ID NO: 7196935 - DNA, 22 bp, Homo sapiens
cagcagcatgaattcgagccac

SEQ ID NO: 7196936 - DNA, 22 bp, Homo sapiens
cagcagcatgaattcgagccac

SEQ ID NO: 7196937 - DNA, 22 bp, Homo sapiens
cagcagcatgaattcgagccac

SEQ ID NO: 7196938 - DNA, 22 bp, Homo sapiens
cagcagaggttttgctccatga

SEQ ID NO: 7196939 - DNA, 22 bp, Homo sapiens
cagcagaggttttgctccatga

SEQ ID NO: 7196940 - DNA, 22 bp, Homo sapiens
cagcagaggttttgctccatga

SEQ ID NO: 7196941 - DNA, 22 bp, Homo sapiens
cagcagaggttttgctccatga

SEQ ID NO: 7196942 - DNA, 22 bp, Homo sapiens
cagcagaggttttgctccatga

SEQ ID NO: 7196943 - DNA, 21 bp, Homo sapiens
cagcagagtaatgcattcgta

SEQ ID NO: 7196944 - DNA, 21 bp, Homo sapiens
cagcagagtaatgcattcgta

SEQ ID NO: 7196945 - DNA, 22 bp, Homo sapiens
cagcagcagccccaggaaggtt

SEQ ID NO: 7196946 - DNA, 22 bp, Homo sapiens
cagcagcagcttagtggtcccc

SEQ ID NO: 7196947 - DNA, 22 bp, Homo sapiens
cagcagcagcttagtggtcccc

SEQ ID NO: 7196948 - DNA, 22 bp, Homo sapiens
cagcagcagcttagtggtcccc

SEQ ID NO: 7196949 - DNA, 22 bp, Homo sapiens
cagcagcagcttagtggtcccc

SEQ ID NO: 7196950 - DNA, 22 bp, Homo sapiens
cagcagcagcttagtggtcccc

SEQ ID NO: 7196951 - DNA, 22 bp, Homo sapiens
cagcagcaggcgcacggccgtc

SEQ ID NO: 7196952 - DNA, 22 bp, Homo sapiens
cagcagcaggcgcacggccgtc

SEQ ID NO: 7196953 - DNA, 22 bp, Homo sapiens
cagcagcagtggctgcagaaca

SEQ ID NO: 7196954 - DNA, 22 bp, Homo sapiens
cagcagcagtggctgcagaaca

SEQ ID NO: 7196955 - DNA, 22 bp, Homo sapiens
cagcagcagtggctgcagaaca

SEQ ID NO: 7196956 - DNA, 22 bp, Homo sapiens
cagcagcagtggctgcagaaca

SEQ ID NO: 7196957 - DNA, 22 bp, Homo sapiens
cagcagcagtggctgcagaaca

SEQ ID NO: 7196958 - DNA, 22 bp, Homo sapiens
cagcagcagtggctgcagaaca

SEQ ID NO: 7196959 - DNA, 22 bp, Homo sapiens
cagcagagcttattaactaaaa

SEQ ID NO: 7196960 - DNA, 22 bp, Homo sapiens
cagcagagcttattaactaaaa

SEQ ID NO: 7196961 - DNA, 20 bp, Homo sapiens
cagcagaaatggggtgggaa

SEQ ID NO: 7196962 - DNA, 20 bp, Homo sapiens
cagcagaaatggggtgggaa

SEQ ID NO: 7196963 - DNA, 22 bp, Homo sapiens
agcctccatctcccatctgtga

SEQ ID NO: 7196964 - DNA, 22 bp, Homo sapiens
agcctcagtgtcaccatctacc

SEQ ID NO: 7196965 - DNA, 22 bp, Homo sapiens
agcctcagtgtcaccatctacc

SEQ ID NO: 7196966 - DNA, 22 bp, Homo sapiens
agcctcagtgtcaccatctacc

SEQ ID NO: 7196967 - DNA, 22 bp, Homo sapiens
agcctcagtgtcaccatctacc

SEQ ID NO: 7196968 - DNA, 22 bp, Homo sapiens
agcctcagtttcaggcctcctc

SEQ ID NO: 7196969 - DNA, 22 bp, Homo sapiens
agcctcagtttcaggcctcctc

SEQ ID NO: 7196970 - DNA, 22 bp, Homo sapiens
agcctccacagatgcaaagggc

SEQ ID NO: 7196971 - DNA, 22 bp, Homo sapiens
agcctccacagatgcaaagggc

SEQ ID NO: 7196972 - DNA, 22 bp, Homo sapiens
agcctccatcccatgcacaaag

SEQ ID NO: 7196973 - DNA, 22 bp, Homo sapiens
cagcagaggttggaacagttct

SEQ ID NO: 7196974 - DNA, 22 bp, Homo sapiens
cagcagaggttggaacagttct

SEQ ID NO: 7196975 - DNA, 22 bp, Homo sapiens
cagcagaggttggaacagttct

SEQ ID NO: 7196976 - DNA, 22 bp, Homo sapiens
cagcagaggtggttcacattgt

SEQ ID NO: 7196977 - DNA, 22 bp, Homo sapiens
cagcagaggtggttcacattgt

SEQ ID NO: 7196978 - DNA, 22 bp, Homo sapiens
cagcagaggtggttcacattgt

SEQ ID NO: 7196979 - DNA, 22 bp, Homo sapiens
cagcagagggagccattgaaat

SEQ ID NO: 7196980 - DNA, 22 bp, Homo sapiens
cagcagagggagccattgaaat

SEQ ID NO: 7196981 - DNA, 22 bp, Homo sapiens
cagcagaggaaagcaaatctaa

SEQ ID NO: 7196982 - DNA, 22 bp, Homo sapiens
cagcagaggaaagcaaatctaa

SEQ ID NO: 7196983 - DNA, 22 bp, Homo sapiens
cagcagaggcacgtctgtgaat

SEQ ID NO: 7196984 - DNA, 22 bp, Homo sapiens
cagcagaggcacgtctgtgaat

SEQ ID NO: 7196985 - DNA, 22 bp, Homo sapiens
cagcagaggaaagcaaatctaa

SEQ ID NO: 7196986 - DNA, 22 bp, Homo sapiens
cagcagagggagccattgaaat

SEQ ID NO: 7196987 - DNA, 22 bp, Homo sapiens
cagcagagggagccattgaaat

SEQ ID NO: 7196988 - DNA, 22 bp, Homo sapiens
cagcagaggcacgtctgtgaat

SEQ ID NO: 7196989 - DNA, 22 bp, Homo sapiens
cagaagcagtgagagatgtgca

SEQ ID NO: 7196990 - DNA, 22 bp, Homo sapiens
cagaagagatgaaatagtatta

SEQ ID NO: 7196991 - DNA, 22 bp, Homo sapiens
cagaagagatgaaatagtatta

SEQ ID NO: 7196992 - DNA, 22 bp, Homo sapiens
cagaagagatgaaatagtatta

SEQ ID NO: 7196993 - DNA, 22 bp, Homo sapiens
cagaagactgcagggaagggac

SEQ ID NO: 7196994 - DNA, 22 bp, Homo sapiens
cagaagagatgaaatagtatta

SEQ ID NO: 7196995 - DNA, 22 bp, Homo sapiens
cagaagacgcctgggtgctgta

SEQ ID NO: 7196996 - DNA, 22 bp, Homo sapiens
cagaagactgcagggaagggac

SEQ ID NO: 7196997 - DNA, 22 bp, Homo sapiens
cagaagaatggtgtctgagctc

SEQ ID NO: 7196998 - DNA, 22 bp, Homo sapiens
cagaagaatggtgtctgagctc

SEQ ID NO: 7196999 - DNA, 22 bp, Homo sapiens
cagaagacagagcacttctctt

SEQ ID NO: 7197000 - DNA, 23 bp, Homo sapiens
cagaagacagtctcaagacaagg

SEQ ID NO: 7197001 - DNA, 22 bp, Homo sapiens
cagaactgggctcgctctggtt

SEQ ID NO: 7197002 - DNA, 22 bp, Homo sapiens
cagaactgttataacagctgtt

SEQ ID NO: 7197003 - DNA, 22 bp, Homo sapiens
cagaagaaagtggggagacaag

SEQ ID NO: 7197004 - DNA, 22 bp, Homo sapiens
cagaagaaatcattatctggac

SEQ ID NO: 7197005 - DNA, 22 bp, Homo sapiens
cagaagcattccagcaaatagt

SEQ ID NO: 7197006 - DNA, 22 bp, Homo sapiens
cagaagcagtgagagatgtgca

SEQ ID NO: 7197007 - DNA, 22 bp, Homo sapiens
cagaagcattgactccttgctc

SEQ ID NO: 7197008 - DNA, 22 bp, Homo sapiens
cagaagcctaaatagtgcacca

SEQ ID NO: 7197009 - DNA, 22 bp, Homo sapiens
cagaagcctgcctcagatgcac

SEQ ID NO: 7197010 - DNA, 22 bp, Homo sapiens
cagaagcctgcctcagatgcac

SEQ ID NO: 7197011 - DNA, 22 bp, Homo sapiens
cagaagctagcaggaaagtttt

SEQ ID NO: 7197012 - DNA, 22 bp, Homo sapiens
cagaagctgaggagtgaggcaa

SEQ ID NO: 7197013 - DNA, 22 bp, Homo sapiens
cagaagctgaggagtgaggcaa

SEQ ID NO: 7197014 - DNA, 19 bp, Homo sapiens
cagaagctgcagtcggata

SEQ ID NO: 7197015 - DNA, 19 bp, Homo sapiens
cagaagctgcagtcggata

SEQ ID NO: 7197016 - DNA, 22 bp, Homo sapiens
cagaagctgcagtgatctggga

SEQ ID NO: 7197017 - DNA, 22 bp, Homo sapiens
cagaagctgcagtgatctggga

SEQ ID NO: 7197018 - DNA, 22 bp, Homo sapiens
agccaggatggtctcgatcggc

SEQ ID NO: 7197019 - DNA, 22 bp, Homo sapiens
agccaggatggtctcgatcggc

SEQ ID NO: 7197020 - DNA, 22 bp, Homo sapiens
agccaggatggtctcgatcggc

SEQ ID NO: 7197021 - DNA, 22 bp, Homo sapiens
agccaggacatctctagctgct

SEQ ID NO: 7197022 - DNA, 22 bp, Homo sapiens
agccaggacatctctagctgct

SEQ ID NO: 7197023 - DNA, 22 bp, Homo sapiens
agccaggacgttgctcagctcc

SEQ ID NO: 7197024 - DNA, 22 bp, Homo sapiens
agccaggacgttgctcagctcc

SEQ ID NO: 7197025 - DNA, 22 bp, Homo sapiens
agccaggacgttgctcagctcc

SEQ ID NO: 7197026 - DNA, 22 bp, Homo sapiens
agccaggatcacccggggctgt

SEQ ID NO: 7197027 - DNA, 17 bp, Homo sapiens
cagaaggaagcatggca

SEQ ID NO: 7197028 - DNA, 22 bp, Homo sapiens
cagaaggagcgctaaggtccca

SEQ ID NO: 7197029 - DNA, 21 bp, Homo sapiens
agccagctatcacacagcatt

SEQ ID NO: 7197030 - DNA, 22 bp, Homo sapiens
agccagctccctcccctgcagg

SEQ ID NO: 7197031 - DNA, 22 bp, Homo sapiens
agccagctccctcccctgcagg

SEQ ID NO: 7197032 - DNA, 22 bp, Homo sapiens
agccaggacatctctagctgct

SEQ ID NO: 7197033 - DNA, 22 bp, Homo sapiens
cagacagaaggctccttgaggt

SEQ ID NO: 7197034 - DNA, 22 bp, Homo sapiens
cagacagacagccgtggccacc

SEQ ID NO: 7197035 - DNA, 22 bp, Homo sapiens
cagacagacagccgtggccacc

SEQ ID NO: 7197036 - DNA, 22 bp, Homo sapiens
cagacagacagccgtggccacc

SEQ ID NO: 7197037 - DNA, 22 bp, Homo sapiens
agccaggcagggctctcgctct

SEQ ID NO: 7197038 - DNA, 22 bp, Homo sapiens
agccaggcagactctctttctt

SEQ ID NO: 7197039 - DNA, 22 bp, Homo sapiens
agccaggcagggctctcgctct

SEQ ID NO: 7197040 - DNA, 22 bp, Homo sapiens
agccaggcagggctctcgctct

SEQ ID NO: 7197041 - DNA, 22 bp, Homo sapiens
agccaggcagggctctcgctct

SEQ ID NO: 7197042 - DNA, 22 bp, Homo sapiens
cagacagaaggctccttgaggt

SEQ ID NO: 7197043 - DNA, 22 bp, Homo sapiens
agccaggcagactctctttctt

SEQ ID NO: 7197044 - DNA, 21 bp, Homo sapiens
agccaggcaagcacccccact

SEQ ID NO: 7197045 - DNA, 22 bp, Homo sapiens
agccaggcagactctctttctt

SEQ ID NO: 7197046 - DNA, 22 bp, Homo sapiens
agccaggcagactctctttctt

SEQ ID NO: 7197047 - DNA, 22 bp, Homo sapiens
agccaggattggctgagcctta

SEQ ID NO: 7197048 - DNA, 21 bp, Homo sapiens
agccaggcaagcacccccact

SEQ ID NO: 7197049 - DNA, 21 bp, Homo sapiens
agccaggcaagcacccccact

SEQ ID NO: 7197050 - DNA, 21 bp, Homo sapiens
agccaggcaagcacccccact

SEQ ID NO: 7197051 - DNA, 21 bp, Homo sapiens
agccaggcaagcacccccact

SEQ ID NO: 7197052 - DNA, 22 bp, Homo sapiens
agccaggattggctgagcctta

SEQ ID NO: 7197053 - DNA, 22 bp, Homo sapiens
agccaggatggtctcgatcggc

SEQ ID NO: 7197054 - DNA, 22 bp, Homo sapiens
agccaggattggctgagcctta

SEQ ID NO: 7197055 - DNA, 22 bp, Homo sapiens
agccaggattggctgagcctta

SEQ ID NO: 7197056 - DNA, 23 bp, Homo sapiens
cagaaatctgaaatctagaaatg

SEQ ID NO: 7197057 - DNA, 22 bp, Homo sapiens
agccacagctccttggtggaga

SEQ ID NO: 7197058 - DNA, 22 bp, Homo sapiens
agccacaggaaacagagacagc

SEQ ID NO: 7197059 - DNA, 23 bp, Homo sapiens
cagaaatctgaaatctagaaatg

SEQ ID NO: 7197060 - DNA, 22 bp, Homo sapiens
cagaaatgacaaagtaagagga

SEQ ID NO: 7197061 - DNA, 22 bp, Homo sapiens
cagaaatgacaaagtaagagga

SEQ ID NO: 7197062 - DNA, 23 bp, Homo sapiens
cagaaatgacagtaagcaccctg

SEQ ID NO: 7197063 - DNA, 23 bp, Homo sapiens
cagaaatgacagtaagcaccctg

SEQ ID NO: 7197064 - DNA, 22 bp, Homo sapiens
agccacagcgaacctctcttcc

SEQ ID NO: 7197065 - DNA, 22 bp, Homo sapiens
agccacagctccttggtggaga

SEQ ID NO: 7197066 - DNA, 22 bp, Homo sapiens
agccacagctccttggtggaga

SEQ ID NO: 7197067 - DNA, 22 bp, Homo sapiens
agccacagctccttggtggaga

SEQ ID NO: 7197068 - DNA, 22 bp, Homo sapiens
cagaacctgtgaatgtgttatc

SEQ ID NO: 7197069 - DNA, 22 bp, Homo sapiens
cagaactgggcagggagcagag

SEQ ID NO: 7197070 - DNA, 22 bp, Homo sapiens
cagaactgggcagggagcagag

SEQ ID NO: 7197071 - DNA, 22 bp, Homo sapiens
cagaaccaggaactgatggaga

SEQ ID NO: 7197072 - DNA, 22 bp, Homo sapiens
cagaacctgagagcacaatcct

SEQ ID NO: 7197073 - DNA, 22 bp, Homo sapiens
agccacagcacattgtaagaaa

SEQ ID NO: 7197074 - DNA, 22 bp, Homo sapiens
agccacagcaacaagtgcaatt

SEQ ID NO: 7197075 - DNA, 22 bp, Homo sapiens
agccacagcaacaagtgcaatt

SEQ ID NO: 7197076 - DNA, 22 bp, Homo sapiens
agccacagcacattgtaagaaa

SEQ ID NO: 7197077 - DNA, 22 bp, Homo sapiens
agccacagcctgacttaactgt

SEQ ID NO: 7197078 - DNA, 22 bp, Homo sapiens
agccacagcccacaggactctt

SEQ ID NO: 7197079 - DNA, 22 bp, Homo sapiens
agccacagcctgacttaactgt

SEQ ID NO: 7197080 - DNA, 22 bp, Homo sapiens
agccacagcccacaggactctt

SEQ ID NO: 7197081 - DNA, 22 bp, Homo sapiens
agccacagcatgtgtgtatgta

SEQ ID NO: 7197082 - DNA, 22 bp, Homo sapiens
agccacagcatgtgtgtatgta

SEQ ID NO: 7197083 - DNA, 23 bp, Homo sapiens
agccacagccagagctatctcca

SEQ ID NO: 7197084 - DNA, 23 bp, Homo sapiens
agccacagccagagctatctcca

SEQ ID NO: 7197085 - DNA, 22 bp, Homo sapiens
agccacagcccacaggactctt

SEQ ID NO: 7197086 - DNA, 22 bp, Homo sapiens
agccacagcccacaggactctt

SEQ ID NO: 7197087 - DNA, 22 bp, Homo sapiens
agccacagagcaggagaccttt

SEQ ID NO: 7197088 - DNA, 22 bp, Homo sapiens
agccacagaggttgatgtggtt

SEQ ID NO: 7197089 - DNA, 22 bp, Homo sapiens
agccacagaggttgatgtggtt

SEQ ID NO: 7197090 - DNA, 22 bp, Homo sapiens
agccacagagcaggagaccttt

SEQ ID NO: 7197091 - DNA, 22 bp, Homo sapiens
agccacagagcaggagaccttt

SEQ ID NO: 7197092 - DNA, 19 bp, Homo sapiens
agccacagaacttgcagga

SEQ ID NO: 7197093 - DNA, 22 bp, Homo sapiens
agccacagagagggagctgcaa

SEQ ID NO: 7197094 - DNA, 22 bp, Homo sapiens
agccacagagagggagctgcaa

SEQ ID NO: 7197095 - DNA, 19 bp, Homo sapiens
agccacagaacttgcagga

SEQ ID NO: 7197096 - DNA, 22 bp, Homo sapiens
agccacacttgccaggggaagg

SEQ ID NO: 7197097 - DNA, 22 bp, Homo sapiens
agccacacttgccaggggaagg

SEQ ID NO: 7197098 - DNA, 19 bp, Homo sapiens
agccacagaacttgcagga

SEQ ID NO: 7197099 - DNA, 19 bp, Homo sapiens
agccacagaacttgcagga

SEQ ID NO: 7197100 - DNA, 19 bp, Homo sapiens
agccacagaacttgcagga

SEQ ID NO: 7197101 - DNA, 22 bp, Homo sapiens
cactgaaatcgaaaaatgtagg

SEQ ID NO: 7197102 - DNA, 22 bp, Homo sapiens
cactgaaatcgaaaaatgtagg

SEQ ID NO: 7197103 - DNA, 22 bp, Homo sapiens
cactgaaatattaatatcttat

SEQ ID NO: 7197104 - DNA, 22 bp, Homo sapiens
cactgaaaggcaatgctgacag

SEQ ID NO: 7197105 - DNA, 22 bp, Homo sapiens
cactgaaaggaaaccagagcat

SEQ ID NO: 7197106 - DNA, 22 bp, Homo sapiens
cactctggttctgaacaggatc

SEQ ID NO: 7197107 - DNA, 22 bp, Homo sapiens
cactctgtgattgcagcattcc

SEQ ID NO: 7197108 - DNA, 22 bp, Homo sapiens
cactctgtgattgcagcattcc

SEQ ID NO: 7197109 - DNA, 22 bp, Homo sapiens
agccacacctgtcctgccagct

SEQ ID NO: 7197110 - DNA, 22 bp, Homo sapiens
agccacacctgtcctgccagct

SEQ ID NO: 7197111 - DNA, 22 bp, Homo sapiens
agccacacctgtcctgccagct

SEQ ID NO: 7197112 - DNA, 22 bp, Homo sapiens
agccacacctgtcctgccagct

SEQ ID NO: 7197113 - DNA, 22 bp, Homo sapiens
agccacacagcttaatgacaga

SEQ ID NO: 7197114 - DNA, 22 bp, Homo sapiens
agccacacagcttaatgacaga

SEQ ID NO: 7197115 - DNA, 22 bp, Homo sapiens
agccacacagcttaatgacaga

SEQ ID NO: 7197116 - DNA, 22 bp, Homo sapiens
agccacaaaggcttgcctcgga

SEQ ID NO: 7197117 - DNA, 22 bp, Homo sapiens
agccaaggacacggagcctcct

SEQ ID NO: 7197118 - DNA, 21 bp, Homo sapiens
agccaagccttgggagccagg

SEQ ID NO: 7197119 - DNA, 21 bp, Homo sapiens
agccaagccttgggagccagg

SEQ ID NO: 7197120 - DNA, 22 bp, Homo sapiens
agccaagctgatctcctgctga

SEQ ID NO: 7197121 - DNA, 22 bp, Homo sapiens
agccaagctgatctcctgctga

SEQ ID NO: 7197122 - DNA, 22 bp, Homo sapiens
cagacagcgagcggaggggctt

SEQ ID NO: 7197123 - DNA, 22 bp, Homo sapiens
cagacagcgagcggaggggctt

SEQ ID NO: 7197124 - DNA, 23 bp, Homo sapiens
agccaggggatcttgggccctgg

SEQ ID NO: 7197125 - DNA, 23 bp, Homo sapiens
agccaggggatcttgggccctgg

SEQ ID NO: 7197126 - DNA, 23 bp, Homo sapiens
agccaggggatcttgggccctgg

SEQ ID NO: 7197127 - DNA, 22 bp, Homo sapiens
cagacagagtcttcccatcagt

SEQ ID NO: 7197128 - DNA, 22 bp, Homo sapiens
cagacagagtcttcccatcagt

SEQ ID NO: 7197129 - DNA, 17 bp, Homo sapiens
cagacagatatcctggg

SEQ ID NO: 7197130 - DNA, 22 bp, Homo sapiens
cagacagcaaatctgcttgcat

SEQ ID NO: 7197131 - DNA, 22 bp, Homo sapiens
cagacagcaaatctgcttgcat

SEQ ID NO: 7197132 - DNA, 22 bp, Homo sapiens
cagacagacctgcaagggcaca

SEQ ID NO: 7197133 - DNA, 22 bp, Homo sapiens
cagacagacagccgtggccacc

SEQ ID NO: 7197134 - DNA, 22 bp, Homo sapiens
cagacagacctgcaagggcaca

SEQ ID NO: 7197135 - DNA, 22 bp, Homo sapiens
cagacagacctgcaagggcaca

SEQ ID NO: 7197136 - DNA, 22 bp, Homo sapiens
cagacagacctgcaagggcaca

SEQ ID NO: 7197137 - DNA, 22 bp, Homo sapiens
cagacagacctgcaagggcaca

SEQ ID NO: 7197138 - DNA, 16 bp, Homo sapiens
cagacagagaacaggg

SEQ ID NO: 7197139 - DNA, 22 bp, Homo sapiens
cagacagagctcacaagtcttt

SEQ ID NO: 7197140 - DNA, 22 bp, Homo sapiens
cagacagagctcacaagtcttt

SEQ ID NO: 7197141 - DNA, 22 bp, Homo sapiens
cagacagaggctgtatgagggc

SEQ ID NO: 7197142 - DNA, 22 bp, Homo sapiens
cagacagaggctgtatgagggc

SEQ ID NO: 7197143 - DNA, 22 bp, Homo sapiens
agccagggttagaagatagtca

SEQ ID NO: 7197144 - DNA, 22 bp, Homo sapiens
agccagggttagaagatagtca

SEQ ID NO: 7197145 - DNA, 22 bp, Homo sapiens
agccagggttagaagatagtca

SEQ ID NO: 7197146 - DNA, 22 bp, Homo sapiens
agccaggggattcatcagggac

SEQ ID NO: 7197147 - DNA, 22 bp, Homo sapiens
agccaggggattcatcagggac

SEQ ID NO: 7197148 - DNA, 22 bp, Homo sapiens
agccaggggattcatcagggac

SEQ ID NO: 7197149 - DNA, 20 bp, Homo sapiens
agccagggttctggatgcac

SEQ ID NO: 7197150 - DNA, 20 bp, Homo sapiens
agccagggttctggatgcac

SEQ ID NO: 7197151 - DNA, 20 bp, Homo sapiens
agccagggttctggatgcac

SEQ ID NO: 7197152 - DNA, 20 bp, Homo sapiens
agccagggttctggatgcac

SEQ ID NO: 7197153 - DNA, 17 bp, Homo sapiens
agccaggtacaagtcca

SEQ ID NO: 7197154 - DNA, 22 bp, Homo sapiens
agccaggtactcttgtgaccat

SEQ ID NO: 7197155 - DNA, 22 bp, Homo sapiens
agccaggtgcagtggcacacac

SEQ ID NO: 7197156 - DNA, 22 bp, Homo sapiens
agccaggtgcagtggcacacac

SEQ ID NO: 7197157 - DNA, 22 bp, Homo sapiens
agccaggttgggccttttcttt

SEQ ID NO: 7197158 - DNA, 22 bp, Homo sapiens
cagagagggcggccctggcttc

SEQ ID NO: 7197159 - DNA, 22 bp, Homo sapiens
cagagagggcggccctggcttc

SEQ ID NO: 7197160 - DNA, 22 bp, Homo sapiens
cagagagggcggccctggcttc

SEQ ID NO: 7197161 - DNA, 22 bp, Homo sapiens
cagagataccattgctaaaatt

SEQ ID NO: 7197162 - DNA, 22 bp, Homo sapiens
cagagataccattgctaaaatt

SEQ ID NO: 7197163 - DNA, 22 bp, Homo sapiens
cagagatggggccagctgctcc

SEQ ID NO: 7197164 - DNA, 22 bp, Homo sapiens
cagagatggggccagctgctcc

SEQ ID NO: 7197165 - DNA, 22 bp, Homo sapiens
cagagatggggccagctgctcc

SEQ ID NO: 7197166 - DNA, 22 bp, Homo sapiens
cagagatgggtcgcagagatgg

SEQ ID NO: 7197167 - DNA, 22 bp, Homo sapiens
cagagatgggtcgcagagatgg

SEQ ID NO: 7197168 - DNA, 22 bp, Homo sapiens
cagagatgggtcgcagagatgg

SEQ ID NO: 7197169 - DNA, 22 bp, Homo sapiens
cagagattattataactaatta

SEQ ID NO: 7197170 - DNA, 22 bp, Homo sapiens
cagagatttttatgcacaccaa

SEQ ID NO: 7197171 - DNA, 22 bp, Homo sapiens
cagagcaacaccctttacatcg

SEQ ID NO: 7197172 - DNA, 22 bp, Homo sapiens
cagagagggagcagtagtctct

SEQ ID NO: 7197173 - DNA, 22 bp, Homo sapiens
cagagagggagcagtagtctct

SEQ ID NO: 7197174 - DNA, 22 bp, Homo sapiens
cagagagggagcagtagtctct

SEQ ID NO: 7197175 - DNA, 22 bp, Homo sapiens
cagagagggcggccctggcttc

SEQ ID NO: 7197176 - DNA, 22 bp, Homo sapiens
cagagagggagcagtagtctct

SEQ ID NO: 7197177 - DNA, 22 bp, Homo sapiens
agccagtgatgaagactctgga

SEQ ID NO: 7197178 - DNA, 22 bp, Homo sapiens
agccagtgcaacagcagtgaag

SEQ ID NO: 7197179 - DNA, 19 bp, Homo sapiens
agccagtgagcctctgggt

SEQ ID NO: 7197180 - DNA, 22 bp, Homo sapiens
agccagtgacatacgattggga

SEQ ID NO: 7197181 - DNA, 19 bp, Homo sapiens
agccagtgagcctctgggt

SEQ ID NO: 7197182 - DNA, 21 bp, Homo sapiens
agccagtctgccagagaagcc

SEQ ID NO: 7197183 - DNA, 22 bp, Homo sapiens
agccagtacagggatgtgttca

SEQ ID NO: 7197184 - DNA, 22 bp, Homo sapiens
agccagtactgtgcaaggataa

SEQ ID NO: 7197185 - DNA, 22 bp, Homo sapiens
agccagtagatcgggaggatgt

SEQ ID NO: 7197186 - DNA, 22 bp, Homo sapiens
agccagtatcactctgtgttct

SEQ ID NO: 7197187 - DNA, 21 bp, Homo sapiens
agccagtcattatgagcggga

SEQ ID NO: 7197188 - DNA, 22 bp, Homo sapiens
agccagtcggggccatgctggg

SEQ ID NO: 7197189 - DNA, 21 bp, Homo sapiens
agccagtctcagtactgtact

SEQ ID NO: 7197190 - DNA, 22 bp, Homo sapiens
agccccttccagttctcagatc

SEQ ID NO: 7197191 - DNA, 22 bp, Homo sapiens
agccccttccagttctcagatc

SEQ ID NO: 7197192 - DNA, 22 bp, Homo sapiens
agccccttccagttctcagatc

SEQ ID NO: 7197193 - DNA, 22 bp, Homo sapiens
agccccttctgtctccaggatc

SEQ ID NO: 7197194 - DNA, 19 bp, Homo sapiens
agcccccagacagcaggcc

SEQ ID NO: 7197195 - DNA, 23 bp, Homo sapiens
cagagctggctcagagctgcctg

SEQ ID NO: 7197196 - DNA, 23 bp, Homo sapiens
cagagctggctcagagctgcctg

SEQ ID NO: 7197197 - DNA, 22 bp, Homo sapiens
cagagctggcggtgagaagaca

SEQ ID NO: 7197198 - DNA, 22 bp, Homo sapiens
cagagctggcggtgagaagaca

SEQ ID NO: 7197199 - DNA, 22 bp, Homo sapiens
cagagctggcggtgagaagaca

SEQ ID NO: 7197200 - DNA, 22 bp, Homo sapiens
cagagctggcggtgagaagaca

SEQ ID NO: 7197201 - DNA, 22 bp, Homo sapiens
cagagctggcggtgagaagaca

SEQ ID NO: 7197202 - DNA, 22 bp, Homo sapiens
cagagctggcggtgagaagaca

SEQ ID NO: 7197203 - DNA, 22 bp, Homo sapiens
cagagctggagggaaccctggc

SEQ ID NO: 7197204 - DNA, 22 bp, Homo sapiens
agcccggcttccccggttgcta

SEQ ID NO: 7197205 - DNA, 22 bp, Homo sapiens
agcccggcttccccggttgcta

SEQ ID NO: 7197206 - DNA, 22 bp, Homo sapiens
agccccttgtgggcgcacagca

SEQ ID NO: 7197207 - DNA, 22 bp, Homo sapiens
agccccttgtgggcgcacagca

SEQ ID NO: 7197208 - DNA, 22 bp, Homo sapiens
agcccgcatctcgctaaagata

SEQ ID NO: 7197209 - DNA, 22 bp, Homo sapiens
agcccgcatctcgctaaagata

SEQ ID NO: 7197210 - DNA, 22 bp, Homo sapiens
agccccttgctgccctctagag

SEQ ID NO: 7197211 - DNA, 22 bp, Homo sapiens
agccccttgctgccctctagag

SEQ ID NO: 7197212 - DNA, 22 bp, Homo sapiens
agccccttgctgccctctagag

SEQ ID NO: 7197213 - DNA, 22 bp, Homo sapiens
agccccttggaacacagggctg

SEQ ID NO: 7197214 - DNA, 22 bp, Homo sapiens
agccccttggaacacagggctg

SEQ ID NO: 7197215 - DNA, 19 bp, Homo sapiens
agccccttggtactgtcct

SEQ ID NO: 7197216 - DNA, 22 bp, Homo sapiens
agccctcatggaacagctccta

SEQ ID NO: 7197217 - DNA, 22 bp, Homo sapiens
agccctcatggaacagctccta

SEQ ID NO: 7197218 - DNA, 22 bp, Homo sapiens
agccctcatggaacagctccta

SEQ ID NO: 7197219 - DNA, 22 bp, Homo sapiens
agccctcaggctttgctgggcc

SEQ ID NO: 7197220 - DNA, 22 bp, Homo sapiens
agccctcaggctttgctgggcc

SEQ ID NO: 7197221 - DNA, 22 bp, Homo sapiens
agcccggcttccccggttgcta

SEQ ID NO: 7197222 - DNA, 22 bp, Homo sapiens
agccctaaattatctttatttt

SEQ ID NO: 7197223 - DNA, 22 bp, Homo sapiens
agccctagagaaccagcctgtg

SEQ ID NO: 7197224 - DNA, 22 bp, Homo sapiens
agccctagagaaccagcctgtg

SEQ ID NO: 7197225 - DNA, 22 bp, Homo sapiens
agccctagagctggaggtcagt

SEQ ID NO: 7197226 - DNA, 22 bp, Homo sapiens
cagagctgcttcccagtttgtg

SEQ ID NO: 7197227 - DNA, 22 bp, Homo sapiens
cagagctggagaagtggattta

SEQ ID NO: 7197228 - DNA, 22 bp, Homo sapiens
cagagctggagcttgaatggag

SEQ ID NO: 7197229 - DNA, 22 bp, Homo sapiens
cagagctggagcttgaatggag

SEQ ID NO: 7197230 - DNA, 22 bp, Homo sapiens
cagagctggagcttgaatggag

SEQ ID NO: 7197231 - DNA, 22 bp, Homo sapiens
cagagctggagggaaccctggc

SEQ ID NO: 7197232 - DNA, 22 bp, Homo sapiens
agcccaggagtttgaggctgtg

SEQ ID NO: 7197233 - DNA, 22 bp, Homo sapiens
agcccaggagtttgaggctgtg

SEQ ID NO: 7197234 - DNA, 22 bp, Homo sapiens
agcccaggagtttgaggctgtg

SEQ ID NO: 7197235 - DNA, 22 bp, Homo sapiens
agcccaggagtttgaggctgtg

SEQ ID NO: 7197236 - DNA, 22 bp, Homo sapiens
agcccaggagtttgaggctgtg

SEQ ID NO: 7197237 - DNA, 22 bp, Homo sapiens
agcccagccggattcccagttc

SEQ ID NO: 7197238 - DNA, 22 bp, Homo sapiens
agcccagcctgattctacaccc

SEQ ID NO: 7197239 - DNA, 22 bp, Homo sapiens
agcccaggaagttgaggcttgc

SEQ ID NO: 7197240 - DNA, 22 bp, Homo sapiens
agcccaggaagttgaggcttgc

SEQ ID NO: 7197241 - DNA, 22 bp, Homo sapiens
agcccaggaagttgaggcttgc

SEQ ID NO: 7197242 - DNA, 22 bp, Homo sapiens
agcccaggaagttgaggcttgc

SEQ ID NO: 7197243 - DNA, 22 bp, Homo sapiens
agcccaggaagttgaggcttgc

SEQ ID NO: 7197244 - DNA, 22 bp, Homo sapiens
agcccaggaagttgaggcttgc

SEQ ID NO: 7197245 - DNA, 22 bp, Homo sapiens
agcccaggaatctgcatcttga

SEQ ID NO: 7197246 - DNA, 22 bp, Homo sapiens
agcccaggaatctgcatcttga

SEQ ID NO: 7197247 - DNA, 22 bp, Homo sapiens
agcccaggaatctgcatcttga

SEQ ID NO: 7197248 - DNA, 22 bp, Homo sapiens
agcccaggagcctttggagggt

SEQ ID NO: 7197249 - DNA, 22 bp, Homo sapiens
agcccaggagcctttggagggt

SEQ ID NO: 7197250 - DNA, 22 bp, Homo sapiens
agcccaggagcctttggagggt

SEQ ID NO: 7197251 - DNA, 22 bp, Homo sapiens
agcccaggagcctttggagggt

SEQ ID NO: 7197252 - DNA, 22 bp, Homo sapiens
agcccaggagcctttggagggt

SEQ ID NO: 7197253 - DNA, 22 bp, Homo sapiens
agcccaggagcctttggagggt

SEQ ID NO: 7197254 - DNA, 22 bp, Homo sapiens
agcccaggaggtggaggttgca

SEQ ID NO: 7197255 - DNA, 22 bp, Homo sapiens
agcccaggaggtggaggttgca

SEQ ID NO: 7197256 - DNA, 22 bp, Homo sapiens
agcccaggaggtggaggttgca

SEQ ID NO: 7197257 - DNA, 22 bp, Homo sapiens
agcccaggaggtggaggttgca

SEQ ID NO: 7197258 - DNA, 22 bp, Homo sapiens
agcccaggaggtggaggttgca

SEQ ID NO: 7197259 - DNA, 22 bp, Homo sapiens
agcccaggagtccttaaggacc

SEQ ID NO: 7197260 - DNA, 22 bp, Homo sapiens
agcccaggagtccttaaggacc

SEQ ID NO: 7197261 - DNA, 23 bp, Homo sapiens
acgggagggctgtttgcttggtg

SEQ ID NO: 7197262 - DNA, 22 bp, Homo sapiens
accttccaggaatctgccagat

SEQ ID NO: 7197263 - DNA, 22 bp, Homo sapiens
acgggccttctcttcaggcgag

SEQ ID NO: 7197264 - DNA, 22 bp, Homo sapiens
accttcagacatcaactatctc

SEQ ID NO: 7197265 - DNA, 22 bp, Homo sapiens
accttcaggtgagcacacagat

SEQ ID NO: 7197266 - DNA, 20 bp, Homo sapiens
accttcaggaacttatcagc

SEQ ID NO: 7197267 - DNA, 22 bp, Homo sapiens
accttagctgttaaaactaagt

SEQ ID NO: 7197268 - DNA, 22 bp, Homo sapiens
accttatccacatcttgggaag

SEQ ID NO: 7197269 - DNA, 22 bp, Homo sapiens
accttattcttgcccttagatg

SEQ ID NO: 7197270 - DNA, 22 bp, Homo sapiens
accttatttggaaatataatta

SEQ ID NO: 7197271 - DNA, 22 bp, Homo sapiens
accttatttggaaatataatta

SEQ ID NO: 7197272 - DNA, 22 bp, Homo sapiens
accttatttggaaatataatta

SEQ ID NO: 7197273 - DNA, 22 bp, Homo sapiens
accttattttgaaatagattgt

SEQ ID NO: 7197274 - DNA, 22 bp, Homo sapiens
accttattttgaaatagattgt

SEQ ID NO: 7197275 - DNA, 22 bp, Homo sapiens
accttagaaaatcaaaattaga

SEQ ID NO: 7197276 - DNA, 22 bp, Homo sapiens
accttaaatgtgacatagtcta

SEQ ID NO: 7197277 - DNA, 22 bp, Homo sapiens
accttagctgttaaaactaagt

SEQ ID NO: 7197278 - DNA, 22 bp, Homo sapiens
accttaaaggccgaagtaaaga

SEQ ID NO: 7197279 - DNA, 22 bp, Homo sapiens
acctgtttacctgcacctgttt

SEQ ID NO: 7197280 - DNA, 22 bp, Homo sapiens
acctgtttagaaagcttatgag

SEQ ID NO: 7197281 - DNA, 22 bp, Homo sapiens
acctgtttctctctgagttact

SEQ ID NO: 7197282 - DNA, 22 bp, Homo sapiens
acctgtttctctctgagttact

SEQ ID NO: 7197283 - DNA, 22 bp, Homo sapiens
acctgtttgtgtccattagtga

SEQ ID NO: 7197284 - DNA, 22 bp, Homo sapiens
acctgtttgtgtttggactgca

SEQ ID NO: 7197285 - DNA, 22 bp, Homo sapiens
acctgttttagtctttaatcat

SEQ ID NO: 7197286 - DNA, 22 bp, Homo sapiens
acctgttttagtctttaatcat

SEQ ID NO: 7197287 - DNA, 22 bp, Homo sapiens
acctgttttcctatctagattg

SEQ ID NO: 7197288 - DNA, 22 bp, Homo sapiens
acgttaaacatttagcatagta

SEQ ID NO: 7197289 - DNA, 22 bp, Homo sapiens
acgtgtgtttaacaaacctgca

SEQ ID NO: 7197290 - DNA, 22 bp, Homo sapiens
acgtgtgtgacattgggaacgt

SEQ ID NO: 7197291 - DNA, 20 bp, Homo sapiens
acgtgtgtgtgcacgcgcgc

SEQ ID NO: 7197292 - DNA, 22 bp, Homo sapiens
acgtgtgttggtcagggggccc

SEQ ID NO: 7197293 - DNA, 22 bp, Homo sapiens
acgggccttctcttcaggcgag

SEQ ID NO: 7197294 - DNA, 22 bp, Homo sapiens
acgggctgggacggggaagctc

SEQ ID NO: 7197295 - DNA, 22 bp, Homo sapiens
acgggctgggacggggaagctc

SEQ ID NO: 7197296 - DNA, 22 bp, Homo sapiens
acgtggcggccgccgtgagcgg

SEQ ID NO: 7197297 - DNA, 22 bp, Homo sapiens
acgtgtgtatgagtgtacatat

SEQ ID NO: 7197298 - DNA, 22 bp, Homo sapiens
acgttatatctgaaaaaagtga

SEQ ID NO: 7197299 - DNA, 22 bp, Homo sapiens
actaaaaactactgccaatagc

SEQ ID NO: 7197300 - DNA, 22 bp, Homo sapiens
actaaaaactactgccaatagc

SEQ ID NO: 7197301 - DNA, 19 bp, Homo sapiens
actaaaaatgatgtttgag

SEQ ID NO: 7197302 - DNA, 19 bp, Homo sapiens
actaaaaatgatgtttgag

SEQ ID NO: 7197303 - DNA, 19 bp, Homo sapiens
actaaagcaataactattt

SEQ ID NO: 7197304 - DNA, 22 bp, Homo sapiens
actaaagatgtctaaatatatt

SEQ ID NO: 7197305 - DNA, 22 bp, Homo sapiens
actaaagatgtctaaatatatt

SEQ ID NO: 7197306 - DNA, 22 bp, Homo sapiens
actaaagatgtctaaatatatt

SEQ ID NO: 7197307 - DNA, 22 bp, Homo sapiens
actaaactgttcatcagcatct

SEQ ID NO: 7197308 - DNA, 22 bp, Homo sapiens
actaaagaagccaaagttttct

SEQ ID NO: 7197309 - DNA, 22 bp, Homo sapiens
actaaactgaagcatgaaaagg

SEQ ID NO: 7197310 - DNA, 22 bp, Homo sapiens
actaaaacagtggctagtagac

SEQ ID NO: 7197311 - DNA, 22 bp, Homo sapiens
actaaaacatagccagtcagtg

SEQ ID NO: 7197312 - DNA, 22 bp, Homo sapiens
actaaaacatagccagtcagtg

SEQ ID NO: 7197313 - DNA, 22 bp, Homo sapiens
actaaaacagtggctagtagac

SEQ ID NO: 7197314 - DNA, 22 bp, Homo sapiens
actcattaaataggatgatttt

SEQ ID NO: 7197315 - DNA, 22 bp, Homo sapiens
actcagtaaaaacaggcagcac

SEQ ID NO: 7197316 - DNA, 21 bp, Homo sapiens
actcagtaattccttggtgca

SEQ ID NO: 7197317 - DNA, 22 bp, Homo sapiens
actcatgttttctctagctgga

SEQ ID NO: 7197318 - DNA, 22 bp, Homo sapiens
actcattgggaaagtgctctct

SEQ ID NO: 7197319 - DNA, 22 bp, Homo sapiens
actcatttaaacatttactgaa

SEQ ID NO: 7197320 - DNA, 22 bp, Homo sapiens
actcagtacatctggagttggc

SEQ ID NO: 7197321 - DNA, 19 bp, Homo sapiens
actcagggaaaggagaatt

SEQ ID NO: 7197322 - DNA, 19 bp, Homo sapiens
actcagggaaaggagaatt

SEQ ID NO: 7197323 - DNA, 19 bp, Homo sapiens
actcagggaaaggagaatt

SEQ ID NO: 7197324 - DNA, 22 bp, Homo sapiens
actcacaggactctgcatatag

SEQ ID NO: 7197325 - DNA, 22 bp, Homo sapiens
actcacagcatgagcttggcag

SEQ ID NO: 7197326 - DNA, 22 bp, Homo sapiens
actcacagcatgagcttggcag

SEQ ID NO: 7197327 - DNA, 22 bp, Homo sapiens
actcacagcagactatgaggga

SEQ ID NO: 7197328 - DNA, 22 bp, Homo sapiens
actcacagcagactatgaggga

SEQ ID NO: 7197329 - DNA, 22 bp, Homo sapiens
actcacagaataggcatgatgg

SEQ ID NO: 7197330 - DNA, 22 bp, Homo sapiens
actcacagactgcaggtttatt

SEQ ID NO: 7197331 - DNA, 18 bp, Homo sapiens
actcacagcagaagaagg

SEQ ID NO: 7197332 - DNA, 23 bp, Homo sapiens
actcacaaagcaggatcatgttg

SEQ ID NO: 7197333 - DNA, 23 bp, Homo sapiens
actcacaaagcaggatcatgttg

SEQ ID NO: 7197334 - DNA, 22 bp, Homo sapiens
actcacaagtgatgtgaatggc

SEQ ID NO: 7197335 - DNA, 23 bp, Homo sapiens
actcacaaagcaggatcatgttg

SEQ ID NO: 7197336 - DNA, 23 bp, Homo sapiens
actcacaaagcaggatcatgttg

SEQ ID NO: 7197337 - DNA, 23 bp, Homo sapiens
actcacaaagcaggatcatgttg

SEQ ID NO: 7197338 - DNA, 21 bp, Homo sapiens
actcaagtggagatgccaggt

SEQ ID NO: 7197339 - DNA, 21 bp, Homo sapiens
actcaagtggagatgccaggt

SEQ ID NO: 7197340 - DNA, 22 bp, Homo sapiens
actcaagtggccttgatggctt

SEQ ID NO: 7197341 - DNA, 21 bp, Homo sapiens
actcaagtgggcatgcgcaga

SEQ ID NO: 7197342 - DNA, 23 bp, Homo sapiens
actcacaaagcaggatcatgttg

SEQ ID NO: 7197343 - DNA, 22 bp, Homo sapiens
actcaagtcataggcttctttc

SEQ ID NO: 7197344 - DNA, 22 bp, Homo sapiens
actcaagtagatattaacaaaa

SEQ ID NO: 7197345 - DNA, 19 bp, Homo sapiens
actcaagtctaatgaaatc

SEQ ID NO: 7197346 - DNA, 22 bp, Homo sapiens
actcaagagctggctggttcct

SEQ ID NO: 7197347 - DNA, 20 bp, Homo sapiens
actcaaatcacctgcctcaa

SEQ ID NO: 7197348 - DNA, 23 bp, Homo sapiens
actcaaatttcgcttggagttca

SEQ ID NO: 7197349 - DNA, 22 bp, Homo sapiens
actcaaatttgtcaactgaagc

SEQ ID NO: 7197350 - DNA, 22 bp, Homo sapiens
actcaacagggaacaagatcag

SEQ ID NO: 7197351 - DNA, 22 bp, Homo sapiens
actattcaagtgctcattcaga

SEQ ID NO: 7197352 - DNA, 22 bp, Homo sapiens
actattcacctttcatgcagga

SEQ ID NO: 7197353 - DNA, 22 bp, Homo sapiens
actattcaggctccatctggta

SEQ ID NO: 7197354 - DNA, 22 bp, Homo sapiens
actattgcaatacgtgtcagca

SEQ ID NO: 7197355 - DNA, 22 bp, Homo sapiens
actattgtgtagtagaagcatc

SEQ ID NO: 7197356 - DNA, 22 bp, Homo sapiens
actatttctagatgctctgata

SEQ ID NO: 7197357 - DNA, 22 bp, Homo sapiens
actatttctagatgctctgata

SEQ ID NO: 7197358 - DNA, 22 bp, Homo sapiens
actcaaaagaccagagagctga

SEQ ID NO: 7197359 - DNA, 23 bp, Homo sapiens
actcaaaatttggcatttgagga

SEQ ID NO: 7197360 - DNA, 22 bp, Homo sapiens
actcaaatagcaacggtgagaa

SEQ ID NO: 7197361 - DNA, 22 bp, Homo sapiens
actcaaatagctgcccctagtg

SEQ ID NO: 7197362 - DNA, 22 bp, Homo sapiens
actaaatacacacatttgttca

SEQ ID NO: 7197363 - DNA, 22 bp, Homo sapiens
actaaatagcctctggtagttg

SEQ ID NO: 7197364 - DNA, 22 bp, Homo sapiens
actaaatacacacatttgttca

SEQ ID NO: 7197365 - DNA, 22 bp, Homo sapiens
actaaatagttttgacagaaca

SEQ ID NO: 7197366 - DNA, 22 bp, Homo sapiens
actaaatagttttgacagaaca

SEQ ID NO: 7197367 - DNA, 22 bp, Homo sapiens
actaaagttcacggtcagcttt

SEQ ID NO: 7197368 - DNA, 22 bp, Homo sapiens
actaaatagttttgacagaaca

SEQ ID NO: 7197369 - DNA, 22 bp, Homo sapiens
actagtgtccttatataagagg

SEQ ID NO: 7197370 - DNA, 22 bp, Homo sapiens
actatactgtctcttatagata

SEQ ID NO: 7197371 - DNA, 22 bp, Homo sapiens
actatacattgaatgttaaggt

SEQ ID NO: 7197372 - DNA, 22 bp, Homo sapiens
actagtgtccttatataagagg

SEQ ID NO: 7197373 - DNA, 22 bp, Homo sapiens
actattagcatatcatgaatgg

SEQ ID NO: 7197374 - DNA, 21 bp, Homo sapiens
actatgtcatttaagtcactg

SEQ ID NO: 7197375 - DNA, 18 bp, Homo sapiens
actatgctgaataaatgg

SEQ ID NO: 7197376 - DNA, 18 bp, Homo sapiens
actatgctgaataaatgg

SEQ ID NO: 7197377 - DNA, 18 bp, Homo sapiens
actatgctgaataaatgg

SEQ ID NO: 7197378 - DNA, 22 bp, Homo sapiens
actatgaatagccagatagtga

SEQ ID NO: 7197379 - DNA, 22 bp, Homo sapiens
actatgaaagtataatattgaa

SEQ ID NO: 7197380 - DNA, 22 bp, Homo sapiens
actatgaatccacattgatttt

SEQ ID NO: 7197381 - DNA, 19 bp, Homo sapiens
actatgcatttatttgttt

SEQ ID NO: 7197382 - DNA, 22 bp, Homo sapiens
actatatacacattatcttgtt

SEQ ID NO: 7197383 - DNA, 22 bp, Homo sapiens
actatagatgctggcgaggctg

SEQ ID NO: 7197384 - DNA, 22 bp, Homo sapiens
actatagctcgggttataatgt

SEQ ID NO: 7197385 - DNA, 22 bp, Homo sapiens
actatatgtgaaggtagaattt

SEQ ID NO: 7197386 - DNA, 22 bp, Homo sapiens
actatctcttttgtctgcagct

SEQ ID NO: 7197387 - DNA, 22 bp, Homo sapiens
actatatacacattatcttgtt

SEQ ID NO: 7197388 - DNA, 22 bp, Homo sapiens
aggtactaccagggattttcag

SEQ ID NO: 7197389 - DNA, 22 bp, Homo sapiens
aggtacatttgataaaaatagc

SEQ ID NO: 7197390 - DNA, 21 bp, Homo sapiens
aggtaccaaaagcctgcatga

SEQ ID NO: 7197391 - DNA, 22 bp, Homo sapiens
aggtacatgaagcttgtgttgg

SEQ ID NO: 7197392 - DNA, 22 bp, Homo sapiens
aggtacatctatggggatagaa

SEQ ID NO: 7197393 - DNA, 22 bp, Homo sapiens
aggtacataatgatggtgatga

SEQ ID NO: 7197394 - DNA, 22 bp, Homo sapiens
aggtacataggaaagtggagct

SEQ ID NO: 7197395 - DNA, 22 bp, Homo sapiens
aggtacatggggtgtgtgcacg

SEQ ID NO: 7197396 - DNA, 22 bp, Homo sapiens
aggtacatggggtgtgtgcacg

SEQ ID NO: 7197397 - DNA, 22 bp, Homo sapiens
aggtacatggggtgtgtgcacg

SEQ ID NO: 7197398 - DNA, 22 bp, Homo sapiens
aggtagaggcctccaggcagca

SEQ ID NO: 7197399 - DNA, 22 bp, Homo sapiens
aggtagaggcctccaggcagca

SEQ ID NO: 7197400 - DNA, 22 bp, Homo sapiens
aggtagaggcctccaggcagca

SEQ ID NO: 7197401 - DNA, 22 bp, Homo sapiens
aggtagcagcctagcagggact

SEQ ID NO: 7197402 - DNA, 22 bp, Homo sapiens
aggtagcatattccagacttgt

SEQ ID NO: 7197403 - DNA, 22 bp, Homo sapiens
aggtactgaaaaaatgtttgca

SEQ ID NO: 7197404 - DNA, 22 bp, Homo sapiens
aggtagaagagcaaggaataac

SEQ ID NO: 7197405 - DNA, 22 bp, Homo sapiens
aggtagaaggaccagaatttat

SEQ ID NO: 7197406 - DNA, 22 bp, Homo sapiens
aggtagaggcctccaggcagca

SEQ ID NO: 7197407 - DNA, 22 bp, Homo sapiens
aggtagaggcctccaggcagca

SEQ ID NO: 7197408 - DNA, 22 bp, Homo sapiens
aggtagctatccagacgctgaa

SEQ ID NO: 7197409 - DNA, 23 bp, Homo sapiens
acctggctgctcaacctgcaggg

SEQ ID NO: 7197410 - DNA, 23 bp, Homo sapiens
acctggctgctcaacctgcaggg

SEQ ID NO: 7197411 - DNA, 23 bp, Homo sapiens
acctggctgctcaacctgcaggg

SEQ ID NO: 7197412 - DNA, 23 bp, Homo sapiens
acctggctgctcaacctgcaggg

SEQ ID NO: 7197413 - DNA, 22 bp, Homo sapiens
acctggctggttgtgattccca

SEQ ID NO: 7197414 - DNA, 22 bp, Homo sapiens
acctggctggttgtgattccca

SEQ ID NO: 7197415 - DNA, 22 bp, Homo sapiens
acctgtctataaaagtgaatac

SEQ ID NO: 7197416 - DNA, 22 bp, Homo sapiens
acctgtcagtgctgcaggctct

SEQ ID NO: 7197417 - DNA, 22 bp, Homo sapiens
acctgtctgcatgatctaaaac

SEQ ID NO: 7197418 - DNA, 23 bp, Homo sapiens
acctgtctgcctcccaccatcaa

SEQ ID NO: 7197419 - DNA, 23 bp, Homo sapiens
acctgtctgcctcccaccatcaa

SEQ ID NO: 7197420 - DNA, 22 bp, Homo sapiens
acctgtctgggctacatttgca

SEQ ID NO: 7197421 - DNA, 22 bp, Homo sapiens
acctgtgcaaagactggtcagg

SEQ ID NO: 7197422 - DNA, 22 bp, Homo sapiens
acctggacacctgctgtcatct

SEQ ID NO: 7197423 - DNA, 22 bp, Homo sapiens
acctggacacctgctgtcatct

SEQ ID NO: 7197424 - DNA, 22 bp, Homo sapiens
acctggacacctgctgtcatct

SEQ ID NO: 7197425 - DNA, 22 bp, Homo sapiens
acctggaagtgggtgctatggc

SEQ ID NO: 7197426 - DNA, 18 bp, Homo sapiens
acctggaattgatagaca

SEQ ID NO: 7197427 - DNA, 22 bp, Homo sapiens
acctggacacctgctgtcatct

SEQ ID NO: 7197428 - DNA, 22 bp, Homo sapiens
acctggacacctgctgtcatct

SEQ ID NO: 7197429 - DNA, 22 bp, Homo sapiens
acctggacacctgctgtcatct

SEQ ID NO: 7197430 - DNA, 22 bp, Homo sapiens
acctggacctgccacctatgag

SEQ ID NO: 7197431 - DNA, 22 bp, Homo sapiens
acctggagaaagcctctccctg

SEQ ID NO: 7197432 - DNA, 22 bp, Homo sapiens
acctggagaaagcctctccctg

SEQ ID NO: 7197433 - DNA, 20 bp, Homo sapiens
acctggagacagcactctgg

SEQ ID NO: 7197434 - DNA, 20 bp, Homo sapiens
acctggagacagcactctgg

SEQ ID NO: 7197435 - DNA, 20 bp, Homo sapiens
acctggagacagcactctgg

SEQ ID NO: 7197436 - DNA, 17 bp, Homo sapiens
acctggagaccaagtcc

SEQ ID NO: 7197437 - DNA, 17 bp, Homo sapiens
acctggagaccaagtcc

SEQ ID NO: 7197438 - DNA, 20 bp, Homo sapiens
acctggagagattattacca

SEQ ID NO: 7197439 - DNA, 20 bp, Homo sapiens
acctggagagattattacca

SEQ ID NO: 7197440 - DNA, 22 bp, Homo sapiens
acctggagatccatggtgtcga

SEQ ID NO: 7197441 - DNA, 22 bp, Homo sapiens
acctggagatccatggtgtcga

SEQ ID NO: 7197442 - DNA, 22 bp, Homo sapiens
acctggagatccatggtgtcga

SEQ ID NO: 7197443 - DNA, 22 bp, Homo sapiens
acctggagcttccaactcaact

SEQ ID NO: 7197444 - DNA, 22 bp, Homo sapiens
acctggagcttccaactcaact

SEQ ID NO: 7197445 - DNA, 22 bp, Homo sapiens
aggtacagtagacagacagtta

SEQ ID NO: 7197446 - DNA, 22 bp, Homo sapiens
aggtacagtagacagacagtta

SEQ ID NO: 7197447 - DNA, 22 bp, Homo sapiens
aggtacagtagacagacagtta

SEQ ID NO: 7197448 - DNA, 22 bp, Homo sapiens
acctgctcaactggcttctcgc

SEQ ID NO: 7197449 - DNA, 22 bp, Homo sapiens
acctgccttctcaaggacatga

SEQ ID NO: 7197450 - DNA, 22 bp, Homo sapiens
acctgctcaactggcttctcgc

SEQ ID NO: 7197451 - DNA, 18 bp, Homo sapiens
acctgctgagtctaagca

SEQ ID NO: 7197452 - DNA, 22 bp, Homo sapiens
acctgcttgagccagtatgaga

SEQ ID NO: 7197453 - DNA, 22 bp, Homo sapiens
acctgcttgagccagtatgaga

SEQ ID NO: 7197454 - DNA, 22 bp, Homo sapiens
acctgcccggggacattccttt

SEQ ID NO: 7197455 - DNA, 18 bp, Homo sapiens
acctgcctgttcttctct

SEQ ID NO: 7197456 - DNA, 22 bp, Homo sapiens
acctgcccatgaaaatggggag

SEQ ID NO: 7197457 - DNA, 22 bp, Homo sapiens
acctgcccagactcagatccta

SEQ ID NO: 7197458 - DNA, 22 bp, Homo sapiens
acctgcccacttcccatgacat

SEQ ID NO: 7197459 - DNA, 22 bp, Homo sapiens
acctgcccacacttccttccca

SEQ ID NO: 7197460 - DNA, 22 bp, Homo sapiens
acctgcccacatatatatgtat

SEQ ID NO: 7197461 - DNA, 22 bp, Homo sapiens
acctcccttgctaaagactgtg

SEQ ID NO: 7197462 - DNA, 22 bp, Homo sapiens
acctccctggccttctgattcc

SEQ ID NO: 7197463 - DNA, 22 bp, Homo sapiens
acctccctgggttatcggggca

SEQ ID NO: 7197464 - DNA, 22 bp, Homo sapiens
acctccctgcctcttggcgtca

SEQ ID NO: 7197465 - DNA, 22 bp, Homo sapiens
agggctggtatgtccatgaaag

SEQ ID NO: 7197466 - DNA, 22 bp, Homo sapiens
accctcagagtaggcactgctg

SEQ ID NO: 7197467 - DNA, 22 bp, Homo sapiens
accctcagagtaggcactgctg

SEQ ID NO: 7197468 - DNA, 22 bp, Homo sapiens
accctcagctggagattgaatt

SEQ ID NO: 7197469 - DNA, 22 bp, Homo sapiens
accctcagcttcttggattaat

SEQ ID NO: 7197470 - DNA, 22 bp, Homo sapiens
accctcaggcagaatgtattct

SEQ ID NO: 7197471 - DNA, 22 bp, Homo sapiens
agggctggtatgtccatgaaag

SEQ ID NO: 7197472 - DNA, 22 bp, Homo sapiens
agggctggtatgtccatgaaag

SEQ ID NO: 7197473 - DNA, 22 bp, Homo sapiens
agggctggtatgtccatgaaag

SEQ ID NO: 7197474 - DNA, 22 bp, Homo sapiens
agggctgtttttggcacctggg

SEQ ID NO: 7197475 - DNA, 22 bp, Homo sapiens
agggcttgacaagggctggagc

SEQ ID NO: 7197476 - DNA, 22 bp, Homo sapiens
agggcttgacaagggctggagc

SEQ ID NO: 7197477 - DNA, 22 bp, Homo sapiens
agggcttgcagaaatgagaaat

SEQ ID NO: 7197478 - DNA, 22 bp, Homo sapiens
agggctgtgtccctaggggagc

SEQ ID NO: 7197479 - DNA, 22 bp, Homo sapiens
agggctgtgtttgcaccctctg

SEQ ID NO: 7197480 - DNA, 22 bp, Homo sapiens
agggctgtcagactgaggaggc

SEQ ID NO: 7197481 - DNA, 22 bp, Homo sapiens
agggctgtcagactgaggaggc

SEQ ID NO: 7197482 - DNA, 22 bp, Homo sapiens
agggcttgtagggtggctgtag

SEQ ID NO: 7197483 - DNA, 22 bp, Homo sapiens
agggcttgtagggtggctgtag

SEQ ID NO: 7197484 - DNA, 22 bp, Homo sapiens
agggcttgtggtcgtggctgtg

SEQ ID NO: 7197485 - DNA, 22 bp, Homo sapiens
agggcttgttaacatagagatt

SEQ ID NO: 7197486 - DNA, 22 bp, Homo sapiens
agggtgcgttctatgagaatct

SEQ ID NO: 7197487 - DNA, 22 bp, Homo sapiens
agggtgggctagactcttcccc

SEQ ID NO: 7197488 - DNA, 22 bp, Homo sapiens
agggtgggctagactcttcccc

SEQ ID NO: 7197489 - DNA, 22 bp, Homo sapiens
agggtgggctagactcttcccc

SEQ ID NO: 7197490 - DNA, 22 bp, Homo sapiens
agggtgggctagactcttcccc

SEQ ID NO: 7197491 - DNA, 22 bp, Homo sapiens
agggtgggctagactcttcccc

SEQ ID NO: 7197492 - DNA, 20 bp, Homo sapiens
agggtggggacgttctgact

SEQ ID NO: 7197493 - DNA, 20 bp, Homo sapiens
agggtggggacgttctgact

SEQ ID NO: 7197494 - DNA, 20 bp, Homo sapiens
agggtggggacgttctgact

SEQ ID NO: 7197495 - DNA, 20 bp, Homo sapiens
agggtggggacgttctgact

SEQ ID NO: 7197496 - DNA, 20 bp, Homo sapiens
agggtggggacgttctgact

SEQ ID NO: 7197497 - DNA, 22 bp, Homo sapiens
acctcccctcaccaatctggtt

SEQ ID NO: 7197498 - DNA, 22 bp, Homo sapiens
acctcccctgactcgaaaccca

SEQ ID NO: 7197499 - DNA, 22 bp, Homo sapiens
acctccctaacccttttggctc

SEQ ID NO: 7197500 - DNA, 22 bp, Homo sapiens
acctccctaagggtccagctta

SEQ ID NO: 7197501 - DNA, 22 bp, Homo sapiens
acctccctccatctggacacta

SEQ ID NO: 7197502 - DNA, 21 bp, Homo sapiens
acctccctcgagcaaccagca

SEQ ID NO: 7197503 - DNA, 21 bp, Homo sapiens
acctccctcgagcaaccagca

SEQ ID NO: 7197504 - DNA, 22 bp, Homo sapiens
acctccctcgccgtccactctg

SEQ ID NO: 7197505 - DNA, 22 bp, Homo sapiens
acctccctcgccgtccactctg

SEQ ID NO: 7197506 - DNA, 22 bp, Homo sapiens
acctccctcgccgtccactctg

SEQ ID NO: 7197507 - DNA, 20 bp, Homo sapiens
acctccctctgtgggtggga

SEQ ID NO: 7197508 - DNA, 20 bp, Homo sapiens
acctccctctgtgggtggga

SEQ ID NO: 7197509 - DNA, 22 bp, Homo sapiens
acctccccgggagcagcctcct

SEQ ID NO: 7197510 - DNA, 22 bp, Homo sapiens
acctccccgggagcagcctcct

SEQ ID NO: 7197511 - DNA, 22 bp, Homo sapiens
acctcccctcaccaatctggtt

SEQ ID NO: 7197512 - DNA, 22 bp, Homo sapiens
acctcccctcaccaatctggtt

SEQ ID NO: 7197513 - DNA, 22 bp, Homo sapiens
acctccccattaggtcacccac

SEQ ID NO: 7197514 - DNA, 18 bp, Homo sapiens
acctccccattttctgaa

SEQ ID NO: 7197515 - DNA, 20 bp, Homo sapiens
agggtgtgggccttagccat

SEQ ID NO: 7197516 - DNA, 20 bp, Homo sapiens
agggtgtgggccttagccat

SEQ ID NO: 7197517 - DNA, 22 bp, Homo sapiens
agggtgtgttctcctatgagaa

SEQ ID NO: 7197518 - DNA, 22 bp, Homo sapiens
agggtgtgctgttgggtctttc

SEQ ID NO: 7197519 - DNA, 22 bp, Homo sapiens
agggtgtgctgttgggtctttc

SEQ ID NO: 7197520 - DNA, 22 bp, Homo sapiens
agggtgtcagccacggaatggg

SEQ ID NO: 7197521 - DNA, 22 bp, Homo sapiens
agggtgtgctgttgggtctttc

SEQ ID NO: 7197522 - DNA, 20 bp, Homo sapiens
agggtgtgggccttagccat

SEQ ID NO: 7197523 - DNA, 20 bp, Homo sapiens
agggtgtgggccttagccat

SEQ ID NO: 7197524 - DNA, 22 bp, Homo sapiens
acctcccagctctgagcttggg

SEQ ID NO: 7197525 - DNA, 22 bp, Homo sapiens
agggtgtgttctcctatgagaa

SEQ ID NO: 7197526 - DNA, 22 bp, Homo sapiens
acctccccacatggtagtgagt

SEQ ID NO: 7197527 - DNA, 22 bp, Homo sapiens
acctccccacatggtagtgagt

SEQ ID NO: 7197528 - DNA, 22 bp, Homo sapiens
agggtgtcagccacggaatggg

SEQ ID NO: 7197529 - DNA, 22 bp, Homo sapiens
agggtggttcttttagtggaag

SEQ ID NO: 7197530 - DNA, 22 bp, Homo sapiens
agggtggttcttttagtggaag

SEQ ID NO: 7197531 - DNA, 22 bp, Homo sapiens
agggtggtggcgatgaggacat

SEQ ID NO: 7197532 - DNA, 22 bp, Homo sapiens
agggtggtggcgatgaggacat

SEQ ID NO: 7197533 - DNA, 22 bp, Homo sapiens
agggtggggtgctacatcttta

SEQ ID NO: 7197534 - DNA, 22 bp, Homo sapiens
agggtggggtgctacatcttta

SEQ ID NO: 7197535 - DNA, 22 bp, Homo sapiens
agggtggggtgctacatcttta

SEQ ID NO: 7197536 - DNA, 22 bp, Homo sapiens
agggtggggtgctacatcttta

SEQ ID NO: 7197537 - DNA, 22 bp, Homo sapiens
agggtggtatttaacaactgga

SEQ ID NO: 7197538 - DNA, 20 bp, Homo sapiens
agggtggggacgttctgact

SEQ ID NO: 7197539 - DNA, 20 bp, Homo sapiens
agggtggggacgttctgact

SEQ ID NO: 7197540 - DNA, 20 bp, Homo sapiens
agggtggggacgttctgact

SEQ ID NO: 7197541 - DNA, 20 bp, Homo sapiens
agggtggggacgttctgact

SEQ ID NO: 7197542 - DNA, 22 bp, Homo sapiens
agggtggggtgctacatcttta

SEQ ID NO: 7197543 - DNA, 20 bp, Homo sapiens
agggtggggacgttctgact

SEQ ID NO: 7197544 - DNA, 22 bp, Homo sapiens
agggtggggtgctacatcttta

SEQ ID NO: 7197545 - DNA, 22 bp, Homo sapiens
agtggctgatgtaggcagtggg

SEQ ID NO: 7197546 - DNA, 22 bp, Homo sapiens
agtggctgatgtaggcagtggg

SEQ ID NO: 7197547 - DNA, 22 bp, Homo sapiens
agtggctgatgtaggcagtggg

SEQ ID NO: 7197548 - DNA, 22 bp, Homo sapiens
agtggctgagtgactgtgactc

SEQ ID NO: 7197549 - DNA, 22 bp, Homo sapiens
agtggctgagtgactgtgactc

SEQ ID NO: 7197550 - DNA, 22 bp, Homo sapiens
actgctttaaaaaagcaagctt

SEQ ID NO: 7197551 - DNA, 22 bp, Homo sapiens
actgctttaaaaaagcaagctt

SEQ ID NO: 7197552 - DNA, 22 bp, Homo sapiens
actgctttagacctagagctct

SEQ ID NO: 7197553 - DNA, 22 bp, Homo sapiens
actgctttagacctagagctct

SEQ ID NO: 7197554 - DNA, 22 bp, Homo sapiens
actgcttacccggcctgacttc

SEQ ID NO: 7197555 - DNA, 22 bp, Homo sapiens
actgctgtgatctgatgtaatt

SEQ ID NO: 7197556 - DNA, 22 bp, Homo sapiens
actgcttcctgagaaatcaaca

SEQ ID NO: 7197557 - DNA, 22 bp, Homo sapiens
actgcttctccaatgaattaga

SEQ ID NO: 7197558 - DNA, 22 bp, Homo sapiens
actgctgattttaggactgtta

SEQ ID NO: 7197559 - DNA, 22 bp, Homo sapiens
actgctgatttagctttgtggg

SEQ ID NO: 7197560 - DNA, 22 bp, Homo sapiens
actgctgattattgaagtagag

SEQ ID NO: 7197561 - DNA, 22 bp, Homo sapiens
actgctgattatgaaagtgaca

SEQ ID NO: 7197562 - DNA, 22 bp, Homo sapiens
actgctgatataagaaaagatt

SEQ ID NO: 7197563 - DNA, 22 bp, Homo sapiens
actgctggaaacccagaatggt

SEQ ID NO: 7197564 - DNA, 22 bp, Homo sapiens
actgctggggctcattcatctc

SEQ ID NO: 7197565 - DNA, 22 bp, Homo sapiens
actgctgtgatctgatgtaatt

SEQ ID NO: 7197566 - DNA, 22 bp, Homo sapiens
actgctgagcacacaagagtgt

SEQ ID NO: 7197567 - DNA, 22 bp, Homo sapiens
actgctgagcacacaagagtgt

SEQ ID NO: 7197568 - DNA, 22 bp, Homo sapiens
actgctgagagcaatcccaaac

SEQ ID NO: 7197569 - DNA, 22 bp, Homo sapiens
actgctctgttttcatatgttt

SEQ ID NO: 7197570 - DNA, 22 bp, Homo sapiens
actgctgactaaacagctccat

SEQ ID NO: 7197571 - DNA, 22 bp, Homo sapiens
actgctgagagcaatcccaaac

SEQ ID NO: 7197572 - DNA, 22 bp, Homo sapiens
actgctgacctcaggtcatcct

SEQ ID NO: 7197573 - DNA, 22 bp, Homo sapiens
actgctgacctcaggtcatcct

SEQ ID NO: 7197574 - DNA, 22 bp, Homo sapiens
actgctccaccctggggcccag

SEQ ID NO: 7197575 - DNA, 22 bp, Homo sapiens
actgctcaaggatctggtaggg

SEQ ID NO: 7197576 - DNA, 22 bp, Homo sapiens
actgctcaaggatctggtaggg

SEQ ID NO: 7197577 - DNA, 22 bp, Homo sapiens
actgctccaccctggggcccag

SEQ ID NO: 7197578 - DNA, 22 bp, Homo sapiens
actgctctctttgcaggggcta

SEQ ID NO: 7197579 - DNA, 22 bp, Homo sapiens
actggcagccacaactggcagg

SEQ ID NO: 7197580 - DNA, 22 bp, Homo sapiens
actggcagcagcagcccttggg

SEQ ID NO: 7197581 - DNA, 22 bp, Homo sapiens
actggcagcagcagcccttggg

SEQ ID NO: 7197582 - DNA, 22 bp, Homo sapiens
actggcagccacaactggcagg

SEQ ID NO: 7197583 - DNA, 22 bp, Homo sapiens
actggcagaggatagcactaat

SEQ ID NO: 7197584 - DNA, 22 bp, Homo sapiens
actggcagaggatagcactaat

SEQ ID NO: 7197585 - DNA, 22 bp, Homo sapiens
actggcagaggatagcactaat

SEQ ID NO: 7197586 - DNA, 22 bp, Homo sapiens
actggcagagggaaaaccattc

SEQ ID NO: 7197587 - DNA, 22 bp, Homo sapiens
actggcagaggttggacaccat

SEQ ID NO: 7197588 - DNA, 22 bp, Homo sapiens
actggcagagaccctgatggcc

SEQ ID NO: 7197589 - DNA, 22 bp, Homo sapiens
actggcagaattgaatagttgt

SEQ ID NO: 7197590 - DNA, 22 bp, Homo sapiens
actggcagagaccctgatggcc

SEQ ID NO: 7197591 - DNA, 22 bp, Homo sapiens
actggcagagaccctgatggcc

SEQ ID NO: 7197592 - DNA, 22 bp, Homo sapiens
actggcaaaatagtatattcct

SEQ ID NO: 7197593 - DNA, 22 bp, Homo sapiens
actggcaatagcaaatgcttgg

SEQ ID NO: 7197594 - DNA, 22 bp, Homo sapiens
actggcactatgttggagaaat

SEQ ID NO: 7197595 - DNA, 22 bp, Homo sapiens
actggcagaacgtgatgcgggt

SEQ ID NO: 7197596 - DNA, 22 bp, Homo sapiens
actggcagaactggtgattgtc

SEQ ID NO: 7197597 - DNA, 22 bp, Homo sapiens
agtggctgctggagtggagatg

SEQ ID NO: 7197598 - DNA, 22 bp, Homo sapiens
agtggctgctgactttaataca

SEQ ID NO: 7197599 - DNA, 22 bp, Homo sapiens
agtggctgctggagtggagatg

SEQ ID NO: 7197600 - DNA, 22 bp, Homo sapiens
agtggctgccaagagcaatgct

SEQ ID NO: 7197601 - DNA, 22 bp, Homo sapiens
agtggctggaattgcaggtgcg

SEQ ID NO: 7197602 - DNA, 22 bp, Homo sapiens
agtggctggaattgcaggtgcg

SEQ ID NO: 7197603 - DNA, 22 bp, Homo sapiens
actggacagaggaaatatggag

SEQ ID NO: 7197604 - DNA, 22 bp, Homo sapiens
actggacagaggaaatatggag

SEQ ID NO: 7197605 - DNA, 22 bp, Homo sapiens
actgcctgtgcactggtctttt

SEQ ID NO: 7197606 - DNA, 23 bp, Homo sapiens
actgcctgtgccgatctctctca

SEQ ID NO: 7197607 - DNA, 23 bp, Homo sapiens
actgcctgtgccgatctctctca

SEQ ID NO: 7197608 - DNA, 21 bp, Homo sapiens
actgcctgtctccatagtcta

SEQ ID NO: 7197609 - DNA, 22 bp, Homo sapiens
actgcacagaattatggttggt

SEQ ID NO: 7197610 - DNA, 22 bp, Homo sapiens
actgcacagaattatggttggt

SEQ ID NO: 7197611 - DNA, 22 bp, Homo sapiens
actgcacagaagaaactatcaa

SEQ ID NO: 7197612 - DNA, 22 bp, Homo sapiens
actgcacacttagcatctggga

SEQ ID NO: 7197613 - DNA, 22 bp, Homo sapiens
actgcacagaagaaactatcaa

SEQ ID NO: 7197614 - DNA, 22 bp, Homo sapiens
actgcaacctccgcctgccagg

SEQ ID NO: 7197615 - DNA, 22 bp, Homo sapiens
actgcacaaggcctggacacac

SEQ ID NO: 7197616 - DNA, 22 bp, Homo sapiens
actgcacacatgtttaagtgga

SEQ ID NO: 7197617 - DNA, 22 bp, Homo sapiens
actgcaacctccacctcctggg

SEQ ID NO: 7197618 - DNA, 22 bp, Homo sapiens
actgcaacctccacctcctggg

SEQ ID NO: 7197619 - DNA, 22 bp, Homo sapiens
actgcaacacctcctgggttca

SEQ ID NO: 7197620 - DNA, 22 bp, Homo sapiens
actgcaacctccacctcctggg

SEQ ID NO: 7197621 - DNA, 22 bp, Homo sapiens
actgcaacctccacctcctggg

SEQ ID NO: 7197622 - DNA, 22 bp, Homo sapiens
actgcaacctccacctcctggg

SEQ ID NO: 7197623 - DNA, 22 bp, Homo sapiens
actgcaaagggaagccctttct

SEQ ID NO: 7197624 - DNA, 20 bp, Homo sapiens
actgcaaagtactctttcag

SEQ ID NO: 7197625 - DNA, 22 bp, Homo sapiens
actgcaaagccagatattatca

SEQ ID NO: 7197626 - DNA, 21 bp, Homo sapiens
actgcaaacagcagagactga

SEQ ID NO: 7197627 - DNA, 22 bp, Homo sapiens
actgcaaaaatgggtgcattca

SEQ ID NO: 7197628 - DNA, 22 bp, Homo sapiens
actgatttcagggatgagaaga

SEQ ID NO: 7197629 - DNA, 22 bp, Homo sapiens
actgaagtgaaggcaatctttt

SEQ ID NO: 7197630 - DNA, 22 bp, Homo sapiens
actgaagtgtaggtgttttcct

SEQ ID NO: 7197631 - DNA, 19 bp, Homo sapiens
actgaagttacccaaatgg

SEQ ID NO: 7197632 - DNA, 22 bp, Homo sapiens
actgaagtagtcattgtcatta

SEQ ID NO: 7197633 - DNA, 22 bp, Homo sapiens
actgaagttcatacaacagact

SEQ ID NO: 7197634 - DNA, 22 bp, Homo sapiens
actgaataaggtgaatgctctg

SEQ ID NO: 7197635 - DNA, 22 bp, Homo sapiens
actgaataatggtctgtgatct

SEQ ID NO: 7197636 - DNA, 22 bp, Homo sapiens
actgaatagaaatgctcatagg

SEQ ID NO: 7197637 - DNA, 22 bp, Homo sapiens
actgaataatggtctgtgatct

SEQ ID NO: 7197638 - DNA, 22 bp, Homo sapiens
actgaatagcccttctgtctcc

SEQ ID NO: 7197639 - DNA, 22 bp, Homo sapiens
actgaatagtgctgcattgtac

SEQ ID NO: 7197640 - DNA, 22 bp, Homo sapiens
actgaatagtgctgcattgtac

SEQ ID NO: 7197641 - DNA, 22 bp, Homo sapiens
actgaatatattccattgcatg

SEQ ID NO: 7197642 - DNA, 22 bp, Homo sapiens
actgagggtgcacaggcaggca

SEQ ID NO: 7197643 - DNA, 22 bp, Homo sapiens
actgagggtgcacaggcaggca

SEQ ID NO: 7197644 - DNA, 22 bp, Homo sapiens
actgagggtgcacaggcaggca

SEQ ID NO: 7197645 - DNA, 22 bp, Homo sapiens
actgatggcccaccttggtctc

SEQ ID NO: 7197646 - DNA, 22 bp, Homo sapiens
actgatggatagtcaagatact

SEQ ID NO: 7197647 - DNA, 22 bp, Homo sapiens
actgatgagagttagtgctagt

SEQ ID NO: 7197648 - DNA, 22 bp, Homo sapiens
actgatgagtaggcagacaagg

SEQ ID NO: 7197649 - DNA, 22 bp, Homo sapiens
actgatgaaaactaataaatta

SEQ ID NO: 7197650 - DNA, 22 bp, Homo sapiens
actgatgaaaggtaagactcca

SEQ ID NO: 7197651 - DNA, 22 bp, Homo sapiens
actgatcacatagatatattcc

SEQ ID NO: 7197652 - DNA, 22 bp, Homo sapiens
actgatgaaaactaataaatta

SEQ ID NO: 7197653 - DNA, 22 bp, Homo sapiens
actgatcacatagatatattcc

SEQ ID NO: 7197654 - DNA, 22 bp, Homo sapiens
actgattacacgagttctgact

SEQ ID NO: 7197655 - DNA, 23 bp, Homo sapiens
actgattaacatgtgtgatattc

SEQ ID NO: 7197656 - DNA, 22 bp, Homo sapiens
actgatgttaaccctctcttct

SEQ ID NO: 7197657 - DNA, 22 bp, Homo sapiens
actgatgtctggggcagagtct

SEQ ID NO: 7197658 - DNA, 22 bp, Homo sapiens
actgatgtgatttcaaattcca

SEQ ID NO: 7197659 - DNA, 22 bp, Homo sapiens
actgatttcagggatgagaaga

SEQ ID NO: 7197660 - DNA, 22 bp, Homo sapiens
actgatttcagggatgagaaga

SEQ ID NO: 7197661 - DNA, 22 bp, Homo sapiens
actgattacacgagttctgact

SEQ ID NO: 7197662 - DNA, 22 bp, Homo sapiens
actgattcaagttatgcatctt

SEQ ID NO: 7197663 - DNA, 22 bp, Homo sapiens
actgattgcattcatagggttt

SEQ ID NO: 7197664 - DNA, 22 bp, Homo sapiens
actccaggcatctgcttctgct

SEQ ID NO: 7197665 - DNA, 22 bp, Homo sapiens
actccaggcatctgcttctgct

SEQ ID NO: 7197666 - DNA, 22 bp, Homo sapiens
actccagggaggtgagtgtgcg

SEQ ID NO: 7197667 - DNA, 22 bp, Homo sapiens
actccagggaggtgagtgtgcg

SEQ ID NO: 7197668 - DNA, 22 bp, Homo sapiens
actccagggaggtgagtgtgcg

SEQ ID NO: 7197669 - DNA, 22 bp, Homo sapiens
actccagggaggtgagtgtgcg

SEQ ID NO: 7197670 - DNA, 22 bp, Homo sapiens
actccagggaggtgagtgtgcg

SEQ ID NO: 7197671 - DNA, 19 bp, Homo sapiens
actccagggatgacagaag

SEQ ID NO: 7197672 - DNA, 19 bp, Homo sapiens
actccagggatgacagaag

SEQ ID NO: 7197673 - DNA, 19 bp, Homo sapiens
actccagggatgacagaag

SEQ ID NO: 7197674 - DNA, 22 bp, Homo sapiens
actccagggctccaccccagat

SEQ ID NO: 7197675 - DNA, 22 bp, Homo sapiens
actccagggctccaccccagat

SEQ ID NO: 7197676 - DNA, 22 bp, Homo sapiens
actccagacacagacactatga

SEQ ID NO: 7197677 - DNA, 22 bp, Homo sapiens
actccagagctcacatgtctaa

SEQ ID NO: 7197678 - DNA, 22 bp, Homo sapiens
actccagagctcacatgtctaa

SEQ ID NO: 7197679 - DNA, 22 bp, Homo sapiens
actccagaggcagctgtgctga

SEQ ID NO: 7197680 - DNA, 22 bp, Homo sapiens
actccagaggcagctgtgctga

SEQ ID NO: 7197681 - DNA, 22 bp, Homo sapiens
actccagatgataagggacagt

SEQ ID NO: 7197682 - DNA, 22 bp, Homo sapiens
actccaggaaacttaggggaaa

SEQ ID NO: 7197683 - DNA, 22 bp, Homo sapiens
actccaggaaacttaggggaaa

SEQ ID NO: 7197684 - DNA, 22 bp, Homo sapiens
actccaggatgtagaatcagag

SEQ ID NO: 7197685 - DNA, 22 bp, Homo sapiens
actccaggatgtagaatcagag

SEQ ID NO: 7197686 - DNA, 22 bp, Homo sapiens
actccaggatgtagaatcagag

SEQ ID NO: 7197687 - DNA, 22 bp, Homo sapiens
actccaggcatctgcttctgct

SEQ ID NO: 7197688 - DNA, 22 bp, Homo sapiens
actccaggcatctgcttctgct

SEQ ID NO: 7197689 - DNA, 22 bp, Homo sapiens
actccaaggccacatgcattcc

SEQ ID NO: 7197690 - DNA, 22 bp, Homo sapiens
actccacaccacgggggccgcc

SEQ ID NO: 7197691 - DNA, 22 bp, Homo sapiens
actccacaccacgggggccgcc

SEQ ID NO: 7197692 - DNA, 22 bp, Homo sapiens
actccacaccacgggggccgcc

SEQ ID NO: 7197693 - DNA, 22 bp, Homo sapiens
actccacaccacgggggccgcc

SEQ ID NO: 7197694 - DNA, 22 bp, Homo sapiens
actccacatttgaacacagttc

SEQ ID NO: 7197695 - DNA, 22 bp, Homo sapiens
actccacaccacgggggccgcc

SEQ ID NO: 7197696 - DNA, 22 bp, Homo sapiens
actccacatttgaacacagttc

SEQ ID NO: 7197697 - DNA, 22 bp, Homo sapiens
actccacatttgaacacagttc

SEQ ID NO: 7197698 - DNA, 22 bp, Homo sapiens
actccacatttgaacacagttc

SEQ ID NO: 7197699 - DNA, 22 bp, Homo sapiens
actcatttgacactttaaactg

SEQ ID NO: 7197700 - DNA, 22 bp, Homo sapiens
actcatttgcatgatgtgctat

SEQ ID NO: 7197701 - DNA, 22 bp, Homo sapiens
actcatttgcatgatgtgctat

SEQ ID NO: 7197702 - DNA, 22 bp, Homo sapiens
actcatttaaacatttactgaa

SEQ ID NO: 7197703 - DNA, 22 bp, Homo sapiens
actcatttgacactttaaactg

SEQ ID NO: 7197704 - DNA, 22 bp, Homo sapiens
actcatttgacactttaaactg

SEQ ID NO: 7197705 - DNA, 22 bp, Homo sapiens
actcattttataacactgtagt

SEQ ID NO: 7197706 - DNA, 22 bp, Homo sapiens
actcattttataacactgtagt

SEQ ID NO: 7197707 - DNA, 22 bp, Homo sapiens
actcatttttactgcaattgag

SEQ ID NO: 7197708 - DNA, 22 bp, Homo sapiens
actcatttttactgcaattgag

SEQ ID NO: 7197709 - DNA, 22 bp, Homo sapiens
actccaaaacctgcggcttggt

SEQ ID NO: 7197710 - DNA, 21 bp, Homo sapiens
actccaaacaagttaagctgt

SEQ ID NO: 7197711 - DNA, 22 bp, Homo sapiens
agtcgcagacatggtccccttt

SEQ ID NO: 7197712 - DNA, 22 bp, Homo sapiens
agtctacaaagggaagcccttt

SEQ ID NO: 7197713 - DNA, 22 bp, Homo sapiens
agtctacaacgcaagcaacatg

SEQ ID NO: 7197714 - DNA, 22 bp, Homo sapiens
agtctacaagaactccagtgca

SEQ ID NO: 7197715 - DNA, 22 bp, Homo sapiens
agtctctcttgggtgtggtttg

SEQ ID NO: 7197716 - DNA, 19 bp, Homo sapiens
agtctctgaggcctaagtt

SEQ ID NO: 7197717 - DNA, 19 bp, Homo sapiens
agtctctgaggcctaagtt

SEQ ID NO: 7197718 - DNA, 22 bp, Homo sapiens
agtctctgaggttcagatgcct

SEQ ID NO: 7197719 - DNA, 19 bp, Homo sapiens
agtctctgaggcctaagtt

SEQ ID NO: 7197720 - DNA, 22 bp, Homo sapiens
agtctctgaggttcagatgcct

SEQ ID NO: 7197721 - DNA, 22 bp, Homo sapiens
actccaggggttgctatttaca

SEQ ID NO: 7197722 - DNA, 22 bp, Homo sapiens
actccagggcttctatgatggt

SEQ ID NO: 7197723 - DNA, 22 bp, Homo sapiens
actccagggctgaacgaggccc

SEQ ID NO: 7197724 - DNA, 22 bp, Homo sapiens
actccagggctgaacgaggccc

SEQ ID NO: 7197725 - DNA, 22 bp, Homo sapiens
actccagggctccatcccttgt

SEQ ID NO: 7197726 - DNA, 22 bp, Homo sapiens
actccagggctccaccccagat

SEQ ID NO: 7197727 - DNA, 22 bp, Homo sapiens
actccagggctccatcccttgt

SEQ ID NO: 7197728 - DNA, 22 bp, Homo sapiens
agtctctgccagcttgtcctct

SEQ ID NO: 7197729 - DNA, 22 bp, Homo sapiens
agtctctgccagcttgtcctct

SEQ ID NO: 7197730 - DNA, 22 bp, Homo sapiens
agtctctgcatgatgcagcaca

SEQ ID NO: 7197731 - DNA, 22 bp, Homo sapiens
agtctctgcatgcctgctgtgc

SEQ ID NO: 7197732 - DNA, 22 bp, Homo sapiens
agtctctgcatgatgcagcaca

SEQ ID NO: 7197733 - DNA, 22 bp, Homo sapiens
agtctctggggaggagtggaaa

SEQ ID NO: 7197734 - DNA, 20 bp, Homo sapiens
agtctctgtagtgcctgaga

SEQ ID NO: 7197735 - DNA, 20 bp, Homo sapiens
agtctctgtagtgcctgaga

SEQ ID NO: 7197736 - DNA, 22 bp, Homo sapiens
agtctctgtcgtagatcagcgt

SEQ ID NO: 7197737 - DNA, 22 bp, Homo sapiens
agtctctgtgagctcccaatgg

SEQ ID NO: 7197738 - DNA, 22 bp, Homo sapiens
agtctctgttccagggcttcag

SEQ ID NO: 7197739 - DNA, 22 bp, Homo sapiens
agtctctgttccagggcttcag

SEQ ID NO: 7197740 - DNA, 22 bp, Homo sapiens
agtctcttaaagacagtgttga

SEQ ID NO: 7197741 - DNA, 22 bp, Homo sapiens
agtctgggtggctgagctacag

SEQ ID NO: 7197742 - DNA, 22 bp, Homo sapiens
agtctggggtctggtagaacga

SEQ ID NO: 7197743 - DNA, 22 bp, Homo sapiens
agtctgggtgtgaatgaacttg

SEQ ID NO: 7197744 - DNA, 22 bp, Homo sapiens
agtctgggtgtgaatgaacttg

SEQ ID NO: 7197745 - DNA, 22 bp, Homo sapiens
agtctggtagaggaagaggcct

SEQ ID NO: 7197746 - DNA, 22 bp, Homo sapiens
agtctgggctgtctgcaggagt

SEQ ID NO: 7197747 - DNA, 22 bp, Homo sapiens
agtctgggctgtctgcaggagt

SEQ ID NO: 7197748 - DNA, 21 bp, Homo sapiens
agtctggggaagggatcccag

SEQ ID NO: 7197749 - DNA, 21 bp, Homo sapiens
agtctggggaagggatcccag

SEQ ID NO: 7197750 - DNA, 22 bp, Homo sapiens
agtctgggcatttaggatgttg

SEQ ID NO: 7197751 - DNA, 22 bp, Homo sapiens
agtctgggcatttaggatgttg

SEQ ID NO: 7197752 - DNA, 22 bp, Homo sapiens
agtctgggctgtctgcaggagt

SEQ ID NO: 7197753 - DNA, 22 bp, Homo sapiens
agtctgggagggatgccagtgt

SEQ ID NO: 7197754 - DNA, 22 bp, Homo sapiens
agtctgggcatttaggatgttg

SEQ ID NO: 7197755 - DNA, 22 bp, Homo sapiens
agtctgggaggcttataaacag

SEQ ID NO: 7197756 - DNA, 22 bp, Homo sapiens
agtctgggagggatgccagtgt

SEQ ID NO: 7197757 - DNA, 22 bp, Homo sapiens
agtctgggagaaggtgagatta

SEQ ID NO: 7197758 - DNA, 22 bp, Homo sapiens
agtctgggaggcttataaacag

SEQ ID NO: 7197759 - DNA, 22 bp, Homo sapiens
agtctgggagaaggtgagatta

SEQ ID NO: 7197760 - DNA, 22 bp, Homo sapiens
agtctgggagaaggtgagatta

SEQ ID NO: 7197761 - DNA, 17 bp, Homo sapiens
agtctgggacctgcgtg

SEQ ID NO: 7197762 - DNA, 22 bp, Homo sapiens
agtctggctttttgatgagctt

SEQ ID NO: 7197763 - DNA, 20 bp, Homo sapiens
agtctggcatgatgcaggca

SEQ ID NO: 7197764 - DNA, 20 bp, Homo sapiens
agtctggcacctattcctgt

SEQ ID NO: 7197765 - DNA, 22 bp, Homo sapiens
agtctgggaactgggaacgttt

SEQ ID NO: 7197766 - DNA, 22 bp, Homo sapiens
agtctgggaactgggaacgttt

SEQ ID NO: 7197767 - DNA, 17 bp, Homo sapiens
agtctgggacctgcgtg

SEQ ID NO: 7197768 - DNA, 22 bp, Homo sapiens
agtctcttcctcatgcatatgt

SEQ ID NO: 7197769 - DNA, 22 bp, Homo sapiens
agtctcttcctcatgcatatgt

SEQ ID NO: 7197770 - DNA, 22 bp, Homo sapiens
agtctcttaattttttctaagt

SEQ ID NO: 7197771 - DNA, 22 bp, Homo sapiens
agtctggatttagaggtgggcc

SEQ ID NO: 7197772 - DNA, 22 bp, Homo sapiens
agtctggatttagaggtgggcc

SEQ ID NO: 7197773 - DNA, 22 bp, Homo sapiens
agtctggattttctacccttct

SEQ ID NO: 7197774 - DNA, 22 bp, Homo sapiens
actgaaatgaaatctatcatct

SEQ ID NO: 7197775 - DNA, 22 bp, Homo sapiens
actgaacaccatttataacatt

SEQ ID NO: 7197776 - DNA, 22 bp, Homo sapiens
actgaacacttttgaaagatta

SEQ ID NO: 7197777 - DNA, 22 bp, Homo sapiens
actgaacagcctgaggagtcac

SEQ ID NO: 7197778 - DNA, 22 bp, Homo sapiens
actgaaacactgagtgaattgt

SEQ ID NO: 7197779 - DNA, 22 bp, Homo sapiens
actgaaacatatatttgagttt

SEQ ID NO: 7197780 - DNA, 22 bp, Homo sapiens
actgaaaatgaattagaaacag

SEQ ID NO: 7197781 - DNA, 23 bp, Homo sapiens
actgaagatgtcttagtggccct

SEQ ID NO: 7197782 - DNA, 22 bp, Homo sapiens
actgaagcttgggtggaactta

SEQ ID NO: 7197783 - DNA, 22 bp, Homo sapiens
actgaaggaaacttttgtgttt

SEQ ID NO: 7197784 - DNA, 22 bp, Homo sapiens
actgaaggaagcgggcaggggt

SEQ ID NO: 7197785 - DNA, 22 bp, Homo sapiens
actgaaggctttcccaaggtca

SEQ ID NO: 7197786 - DNA, 22 bp, Homo sapiens
actgaagggtaatgtgggagcc

SEQ ID NO: 7197787 - DNA, 22 bp, Homo sapiens
actgaaggtctcagcaaggatg

SEQ ID NO: 7197788 - DNA, 22 bp, Homo sapiens
actgaagagaagcattttctgc

SEQ ID NO: 7197789 - DNA, 18 bp, Homo sapiens
actgaagatgcaagacct

SEQ ID NO: 7197790 - DNA, 22 bp, Homo sapiens
actgaagaacgcatcagtggtt

SEQ ID NO: 7197791 - DNA, 22 bp, Homo sapiens
actgaacttggtgaatgccaca

SEQ ID NO: 7197792 - DNA, 21 bp, Homo sapiens
actgaacttgtgttctagagg

SEQ ID NO: 7197793 - DNA, 22 bp, Homo sapiens
actgaacatatgcaagaccatt

SEQ ID NO: 7197794 - DNA, 22 bp, Homo sapiens
actgtgtggaccactctgaggc

SEQ ID NO: 7197795 - DNA, 22 bp, Homo sapiens
actgtgtgggccgctcactggg

SEQ ID NO: 7197796 - DNA, 22 bp, Homo sapiens
actgtgtgggccgctcactggg

SEQ ID NO: 7197797 - DNA, 22 bp, Homo sapiens
actgtgtgtttgtctagcacag

SEQ ID NO: 7197798 - DNA, 22 bp, Homo sapiens
actgtgttcaattaaaaagctt

SEQ ID NO: 7197799 - DNA, 22 bp, Homo sapiens
actgtgttcacacttacaaatg

SEQ ID NO: 7197800 - DNA, 22 bp, Homo sapiens
actgtgtttcacctgagtatgg

SEQ ID NO: 7197801 - DNA, 22 bp, Homo sapiens
actgttaacggtatgatgctcg

SEQ ID NO: 7197802 - DNA, 21 bp, Homo sapiens
actgttaagacgtagctgggg

SEQ ID NO: 7197803 - DNA, 22 bp, Homo sapiens
actgttaagtatgaagtaaggc

SEQ ID NO: 7197804 - DNA, 22 bp, Homo sapiens
actgttaagtatgaagtaaggc

SEQ ID NO: 7197805 - DNA, 22 bp, Homo sapiens
actgttaattcaatcaacaggt

SEQ ID NO: 7197806 - DNA, 22 bp, Homo sapiens
actgttaagtatgaagtaaggc

SEQ ID NO: 7197807 - DNA, 22 bp, Homo sapiens
actgtgtgaggctgggtgagtc

SEQ ID NO: 7197808 - DNA, 22 bp, Homo sapiens
actgtgtgaggctgggtgagtc

SEQ ID NO: 7197809 - DNA, 22 bp, Homo sapiens
actgtgtggaaatttgtgaggg

SEQ ID NO: 7197810 - DNA, 22 bp, Homo sapiens
actgtgtggaaatttgtgaggg

SEQ ID NO: 7197811 - DNA, 19 bp, Homo sapiens
actgtgtggaagtgtgatt

SEQ ID NO: 7197812 - DNA, 19 bp, Homo sapiens
actgtgtggaagtgtgatt

SEQ ID NO: 7197813 - DNA, 22 bp, Homo sapiens
actgtgtgactgttattactgt

SEQ ID NO: 7197814 - DNA, 22 bp, Homo sapiens
actgtgtgaaacatcaatgtgt

SEQ ID NO: 7197815 - DNA, 18 bp, Homo sapiens
actgtgtgaattagctcc

SEQ ID NO: 7197816 - DNA, 22 bp, Homo sapiens
actgtgtctcacagtggtacca

SEQ ID NO: 7197817 - DNA, 22 bp, Homo sapiens
actgtgtctcattcatcattgt

SEQ ID NO: 7197818 - DNA, 22 bp, Homo sapiens
actgtgtgaaacatcaatgtgt

SEQ ID NO: 7197819 - DNA, 22 bp, Homo sapiens
actgtgtcattgatcagaaaca

SEQ ID NO: 7197820 - DNA, 22 bp, Homo sapiens
actgtgtcattgatcagaaaca

SEQ ID NO: 7197821 - DNA, 22 bp, Homo sapiens
actgtgtcctatttccttgaca

SEQ ID NO: 7197822 - DNA, 22 bp, Homo sapiens
actgtgtcctcatgtggcagaa

SEQ ID NO: 7197823 - DNA, 22 bp, Homo sapiens
actgtgtcctcatgtggcagaa

SEQ ID NO: 7197824 - DNA, 22 bp, Homo sapiens
actgtgtctagcaccacgtgtc

SEQ ID NO: 7197825 - DNA, 22 bp, Homo sapiens
acttagaattaaatatttttgg

SEQ ID NO: 7197826 - DNA, 22 bp, Homo sapiens
acttatttcttggatgatcctg

SEQ ID NO: 7197827 - DNA, 22 bp, Homo sapiens
acttattttgattcctcggggg

SEQ ID NO: 7197828 - DNA, 22 bp, Homo sapiens
acttagaattaaatatttttgg

SEQ ID NO: 7197829 - DNA, 22 bp, Homo sapiens
actgttatgggtgtcagcttaa

SEQ ID NO: 7197830 - DNA, 22 bp, Homo sapiens
actgttatgggtgtcagcttaa

SEQ ID NO: 7197831 - DNA, 22 bp, Homo sapiens
actgttatgatttacacagtcc

SEQ ID NO: 7197832 - DNA, 22 bp, Homo sapiens
actgttatgatttacacagtcc

SEQ ID NO: 7197833 - DNA, 22 bp, Homo sapiens
actgttatgatttacacagtcc

SEQ ID NO: 7197834 - DNA, 22 bp, Homo sapiens
actgttatagttcacttttccc

SEQ ID NO: 7197835 - DNA, 18 bp, Homo sapiens
actgttatctgataaggc

SEQ ID NO: 7197836 - DNA, 19 bp, Homo sapiens
acttcaaatcttagagaaa

SEQ ID NO: 7197837 - DNA, 19 bp, Homo sapiens
acttcaaatcttagagaaa

SEQ ID NO: 7197838 - DNA, 19 bp, Homo sapiens
acttcaaatcttagagaaa

SEQ ID NO: 7197839 - DNA, 22 bp, Homo sapiens
acttcagagactttatggtcca

SEQ ID NO: 7197840 - DNA, 22 bp, Homo sapiens
acttcagagactttatggtcca

SEQ ID NO: 7197841 - DNA, 19 bp, Homo sapiens
acttcagcagggttcctgt

SEQ ID NO: 7197842 - DNA, 22 bp, Homo sapiens
acttcagaaaatgttgaatgtt

SEQ ID NO: 7197843 - DNA, 22 bp, Homo sapiens
acttcagagaaagagggaattc

SEQ ID NO: 7197844 - DNA, 22 bp, Homo sapiens
acttcacagatatttatttggt

SEQ ID NO: 7197845 - DNA, 22 bp, Homo sapiens
acttcacaggttttcataaaac

SEQ ID NO: 7197846 - DNA, 22 bp, Homo sapiens
acttcacagaaattttatgagg

SEQ ID NO: 7197847 - DNA, 22 bp, Homo sapiens
acttcacagatatttatttggt

SEQ ID NO: 7197848 - DNA, 22 bp, Homo sapiens
acttcaaattttcagaagaaat

SEQ ID NO: 7197849 - DNA, 17 bp, Homo sapiens
acttcaagttcagtgac

SEQ ID NO: 7197850 - DNA, 22 bp, Homo sapiens
acttcacaaagagatcatctaa

SEQ ID NO: 7197851 - DNA, 22 bp, Homo sapiens
acttcacaaagagatcatctaa

SEQ ID NO: 7197852 - DNA, 22 bp, Homo sapiens
acttcacaactgtacatggcag

SEQ ID NO: 7197853 - DNA, 22 bp, Homo sapiens
acttcacaactgtacatggcag

SEQ ID NO: 7197854 - DNA, 22 bp, Homo sapiens
acttcacacagcaaatttatct

SEQ ID NO: 7197855 - DNA, 22 bp, Homo sapiens
acttcacagaaattttatgagg

SEQ ID NO: 7197856 - DNA, 22 bp, Homo sapiens
acttcagtaggtgatatgtgca

SEQ ID NO: 7197857 - DNA, 22 bp, Homo sapiens
acttcagccaagaaaactcagt

SEQ ID NO: 7197858 - DNA, 22 bp, Homo sapiens
acttcagcccagaggaagggat

SEQ ID NO: 7197859 - DNA, 22 bp, Homo sapiens
acttcagtaggtgatatgtgca

SEQ ID NO: 7197860 - DNA, 22 bp, Homo sapiens
acttcagtgtggtataaaacgt

SEQ ID NO: 7197861 - DNA, 23 bp, Homo sapiens
acttcatggcactgtcttagagg

SEQ ID NO: 7197862 - DNA, 22 bp, Homo sapiens
acttcatgaactaagggatcgg

SEQ ID NO: 7197863 - DNA, 22 bp, Homo sapiens
acttcatgttgtttacaactta

SEQ ID NO: 7197864 - DNA, 22 bp, Homo sapiens
acttcattcattttcacgaatg

SEQ ID NO: 7197865 - DNA, 22 bp, Homo sapiens
acttcattgctaagaacaaggt

SEQ ID NO: 7197866 - DNA, 22 bp, Homo sapiens
acttcattgtaatattatagca

SEQ ID NO: 7197867 - DNA, 22 bp, Homo sapiens
acttcattgtaatattatagca

SEQ ID NO: 7197868 - DNA, 22 bp, Homo sapiens
acttcatttcatttgcacagtg

SEQ ID NO: 7197869 - DNA, 22 bp, Homo sapiens
acttccaaagaagtgattacag

SEQ ID NO: 7197870 - DNA, 22 bp, Homo sapiens
acttccaaagaagtgattacag

SEQ ID NO: 7197871 - DNA, 22 bp, Homo sapiens
acttgcatatatccctccacat

SEQ ID NO: 7197872 - DNA, 22 bp, Homo sapiens
acttgcatcttagagactcacc

SEQ ID NO: 7197873 - DNA, 22 bp, Homo sapiens
acttgcatgatattcaacagag

SEQ ID NO: 7197874 - DNA, 22 bp, Homo sapiens
acttgcatgatcctgagagtat

SEQ ID NO: 7197875 - DNA, 22 bp, Homo sapiens
acttgcatgatcctgagagtat

SEQ ID NO: 7197876 - DNA, 22 bp, Homo sapiens
acttctttcacaatgtttctag

SEQ ID NO: 7197877 - DNA, 22 bp, Homo sapiens
acttcttttcaaatcatgcaaa

SEQ ID NO: 7197878 - DNA, 22 bp, Homo sapiens
acttcttttcaaatcatgcaaa

SEQ ID NO: 7197879 - DNA, 22 bp, Homo sapiens
acttgatttttataataaatgg

SEQ ID NO: 7197880 - DNA, 22 bp, Homo sapiens
acttccaagtttattcatgtga

SEQ ID NO: 7197881 - DNA, 22 bp, Homo sapiens
acttccagaacaggtacatttt

SEQ ID NO: 7197882 - DNA, 22 bp, Homo sapiens
acttccagacctgtgcttgctc

SEQ ID NO: 7197883 - DNA, 22 bp, Homo sapiens
acttgccataaatgaaaatact

SEQ ID NO: 7197884 - DNA, 22 bp, Homo sapiens
acttgccccagaattgctgctg

SEQ ID NO: 7197885 - DNA, 22 bp, Homo sapiens
acttgcatttaaatattgaata

SEQ ID NO: 7197886 - DNA, 22 bp, Homo sapiens
acttgcatttaaatattgaata

SEQ ID NO: 7197887 - DNA, 22 bp, Homo sapiens
acttgcatttcaggcacttgtg

SEQ ID NO: 7197888 - DNA, 22 bp, Homo sapiens
acttgcatttcaggcacttgtg

SEQ ID NO: 7197889 - DNA, 22 bp, Homo sapiens
acttgccagctaaagcctggtg

SEQ ID NO: 7197890 - DNA, 22 bp, Homo sapiens
acttgcatgtgtaaatcttcct

SEQ ID NO: 7197891 - DNA, 22 bp, Homo sapiens
acttgcatgtgtaaatcttcct

SEQ ID NO: 7197892 - DNA, 22 bp, Homo sapiens
acttgcatgttatttttatagg

SEQ ID NO: 7197893 - DNA, 22 bp, Homo sapiens
acttgcatgttatttttatagg

SEQ ID NO: 7197894 - DNA, 22 bp, Homo sapiens
acttgcattatatttatcacaa

SEQ ID NO: 7197895 - DNA, 22 bp, Homo sapiens
acttgcatgattaatttggtga

SEQ ID NO: 7197896 - DNA, 22 bp, Homo sapiens
acttgcatgattaatttggtga

SEQ ID NO: 7197897 - DNA, 22 bp, Homo sapiens
acttgcatgattttatgttgat

SEQ ID NO: 7197898 - DNA, 22 bp, Homo sapiens
acttgcatgctatttgttgaac

SEQ ID NO: 7197899 - DNA, 22 bp, Homo sapiens
acttgcatgctatttgttgaac

SEQ ID NO: 7197900 - DNA, 22 bp, Homo sapiens
acttgcatgtcaggaaattaac

SEQ ID NO: 7197901 - DNA, 22 bp, Homo sapiens
acttgcatgtcaggaaattaac

SEQ ID NO: 7197902 - DNA, 22 bp, Homo sapiens
acttgctcaatgcttgaagcca

SEQ ID NO: 7197903 - DNA, 22 bp, Homo sapiens
acttgctggtggcatttacagt

SEQ ID NO: 7197904 - DNA, 22 bp, Homo sapiens
acttgctggtggcatttacagt

SEQ ID NO: 7197905 - DNA, 22 bp, Homo sapiens
acttgctggctccttgcttcta

SEQ ID NO: 7197906 - DNA, 20 bp, Homo sapiens
acttgctgggctttgttacc

SEQ ID NO: 7197907 - DNA, 22 bp, Homo sapiens
acttgcttgggccatctcgctt

SEQ ID NO: 7197908 - DNA, 22 bp, Homo sapiens
acttgctcaatgcttgaagcca

SEQ ID NO: 7197909 - DNA, 22 bp, Homo sapiens
acttgcctaaggtcatgcaact

SEQ ID NO: 7197910 - DNA, 22 bp, Homo sapiens
acttgcctccatattttattgc

SEQ ID NO: 7197911 - DNA, 22 bp, Homo sapiens
acttggaaccgaggacctttat

SEQ ID NO: 7197912 - DNA, 20 bp, Homo sapiens
acttggaactcatttttctt

SEQ ID NO: 7197913 - DNA, 20 bp, Homo sapiens
acttggaactcatttttctt

SEQ ID NO: 7197914 - DNA, 22 bp, Homo sapiens
acttggaaaattcaaaatggca

SEQ ID NO: 7197915 - DNA, 22 bp, Homo sapiens
acttggaaagatgcaacacagt

SEQ ID NO: 7197916 - DNA, 21 bp, Homo sapiens
acttggcagaacgcagaaggc

SEQ ID NO: 7197917 - DNA, 22 bp, Homo sapiens
acttggcaagtatctataaagt

SEQ ID NO: 7197918 - DNA, 22 bp, Homo sapiens
acttggcaggtcaggggatatt

SEQ ID NO: 7197919 - DNA, 22 bp, Homo sapiens
acttggcaggtcaggggatatt

SEQ ID NO: 7197920 - DNA, 22 bp, Homo sapiens
acttggagagcattgctgggga

SEQ ID NO: 7197921 - DNA, 23 bp, Homo sapiens
acttggaagcagtgaacaacttt

SEQ ID NO: 7197922 - DNA, 22 bp, Homo sapiens
acttggaatattgcgtttttgc

SEQ ID NO: 7197923 - DNA, 22 bp, Homo sapiens
acttggaatctgtttccctaga

SEQ ID NO: 7197924 - DNA, 22 bp, Homo sapiens
acttgggaaaggaagaattgca

SEQ ID NO: 7197925 - DNA, 22 bp, Homo sapiens
acttgggaaaggaagaattgca

SEQ ID NO: 7197926 - DNA, 22 bp, Homo sapiens
acttggctttaggcatccacat

SEQ ID NO: 7197927 - DNA, 22 bp, Homo sapiens
acttggctttaggcatccacat

SEQ ID NO: 7197928 - DNA, 22 bp, Homo sapiens
acttggctttagtagtaactga

SEQ ID NO: 7197929 - DNA, 21 bp, Homo sapiens
acttggctttgttagaactag

SEQ ID NO: 7197930 - DNA, 22 bp, Homo sapiens
acttggcttttccatctctgca

SEQ ID NO: 7197931 - DNA, 21 bp, Homo sapiens
acttggccaggcccccacctg

SEQ ID NO: 7197932 - DNA, 22 bp, Homo sapiens
acttggccttatttccacagaa

SEQ ID NO: 7197933 - DNA, 22 bp, Homo sapiens
acttggctagagccaggaggct

SEQ ID NO: 7197934 - DNA, 22 bp, Homo sapiens
acttggctagtgatgcagggtg

SEQ ID NO: 7197935 - DNA, 22 bp, Homo sapiens
acttggctagtgatgcagggtg

SEQ ID NO: 7197936 - DNA, 22 bp, Homo sapiens
acttggctattttcattcatca

SEQ ID NO: 7197937 - DNA, 22 bp, Homo sapiens
acttggctattttcattcatca

SEQ ID NO: 7197938 - DNA, 22 bp, Homo sapiens
acttggctcagataccatgccc

SEQ ID NO: 7197939 - DNA, 22 bp, Homo sapiens
acttggctcagataccatgccc

SEQ ID NO: 7197940 - DNA, 22 bp, Homo sapiens
acttggctgcagagaacgtgtg

SEQ ID NO: 7197941 - DNA, 22 bp, Homo sapiens
acttggctgggagagttgaaga

SEQ ID NO: 7197942 - DNA, 22 bp, Homo sapiens
acttggcttaaagtagtgatcg

SEQ ID NO: 7197943 - DNA, 22 bp, Homo sapiens
acttggcttcaaggttaaggtc

SEQ ID NO: 7197944 - DNA, 22 bp, Homo sapiens
agtttatgtaaaattagtaatg

SEQ ID NO: 7197945 - DNA, 22 bp, Homo sapiens
actgtaaaacaggtttcatcat

SEQ ID NO: 7197946 - DNA, 22 bp, Homo sapiens
actgtaaaactgctttggaaac

SEQ ID NO: 7197947 - DNA, 22 bp, Homo sapiens
actggtttttctcatgaaaatg

SEQ ID NO: 7197948 - DNA, 17 bp, Homo sapiens
actggttttggcagcat

SEQ ID NO: 7197949 - DNA, 22 bp, Homo sapiens
actgtaaagaagtaagtatggg

SEQ ID NO: 7197950 - DNA, 22 bp, Homo sapiens
actgtaaagaagtaagtatggg

SEQ ID NO: 7197951 - DNA, 22 bp, Homo sapiens
actgtaaagaagtaagtatggg

SEQ ID NO: 7197952 - DNA, 22 bp, Homo sapiens
actgtaaagagaactgtgggct

SEQ ID NO: 7197953 - DNA, 22 bp, Homo sapiens
actgtaaaatgagatatgtata

SEQ ID NO: 7197954 - DNA, 22 bp, Homo sapiens
actgtaaaatgagatatgtata

SEQ ID NO: 7197955 - DNA, 22 bp, Homo sapiens
actgtaaaactgctttggaaac

SEQ ID NO: 7197956 - DNA, 22 bp, Homo sapiens
actgtaaaagaaggtctttgca

SEQ ID NO: 7197957 - DNA, 22 bp, Homo sapiens
agtttacatgacgtgtatttca

SEQ ID NO: 7197958 - DNA, 22 bp, Homo sapiens
agtttacatgacgtgtatttca

SEQ ID NO: 7197959 - DNA, 22 bp, Homo sapiens
agtttacatgacgtgtatttca

SEQ ID NO: 7197960 - DNA, 22 bp, Homo sapiens
agtttacatcttcaatctcatt

SEQ ID NO: 7197961 - DNA, 22 bp, Homo sapiens
agtttacatcttcaatctcatt

SEQ ID NO: 7197962 - DNA, 22 bp, Homo sapiens
agtttacataaaaaggcagagg

SEQ ID NO: 7197963 - DNA, 22 bp, Homo sapiens
agtttacataaaaaggcagagg

SEQ ID NO: 7197964 - DNA, 22 bp, Homo sapiens
agtttacatatttgtcggagtc

SEQ ID NO: 7197965 - DNA, 22 bp, Homo sapiens
agtttatagcccagattcatgg

SEQ ID NO: 7197966 - DNA, 22 bp, Homo sapiens
agtttataaaacattgcgtggc

SEQ ID NO: 7197967 - DNA, 22 bp, Homo sapiens
agtttataaaacattgcgtggc

SEQ ID NO: 7197968 - DNA, 22 bp, Homo sapiens
agtttataaaacattgcgtggc

SEQ ID NO: 7197969 - DNA, 22 bp, Homo sapiens
agtttatagcccagattcatgg

SEQ ID NO: 7197970 - DNA, 22 bp, Homo sapiens
actggcagtggcagcagaaaga

SEQ ID NO: 7197971 - DNA, 22 bp, Homo sapiens
actggcagtggcagcagaaaga

SEQ ID NO: 7197972 - DNA, 22 bp, Homo sapiens
actggcagtagagggagcgcat

SEQ ID NO: 7197973 - DNA, 22 bp, Homo sapiens
actggcagtagagggagcgcat

SEQ ID NO: 7197974 - DNA, 19 bp, Homo sapiens
actggcagggctgcggtgg

SEQ ID NO: 7197975 - DNA, 19 bp, Homo sapiens
actggcagggctgcggtgg

SEQ ID NO: 7197976 - DNA, 19 bp, Homo sapiens
actggcagggctgcggtgg

SEQ ID NO: 7197977 - DNA, 22 bp, Homo sapiens
actggcagggggagccccgaga

SEQ ID NO: 7197978 - DNA, 22 bp, Homo sapiens
actggcaggtccatcgcccttt

SEQ ID NO: 7197979 - DNA, 22 bp, Homo sapiens
actggcagtagagggagcgcat

SEQ ID NO: 7197980 - DNA, 22 bp, Homo sapiens
actggcagtagagggagcgcat

SEQ ID NO: 7197981 - DNA, 22 bp, Homo sapiens
actggcaggctgctggccggcg

SEQ ID NO: 7197982 - DNA, 22 bp, Homo sapiens
actggcagctgtaggatgcatg

SEQ ID NO: 7197983 - DNA, 19 bp, Homo sapiens
actggcagctgtagtctgt

SEQ ID NO: 7197984 - DNA, 22 bp, Homo sapiens
actggcaggctgctggccggcg

SEQ ID NO: 7197985 - DNA, 20 bp, Homo sapiens
actggcagcctgcctgctgt

SEQ ID NO: 7197986 - DNA, 20 bp, Homo sapiens
actggcagcctgcctgctgt

SEQ ID NO: 7197987 - DNA, 22 bp, Homo sapiens
actggcagctgtaggatgcatg

SEQ ID NO: 7197988 - DNA, 22 bp, Homo sapiens
agttgccttcccccagagccaa

SEQ ID NO: 7197989 - DNA, 22 bp, Homo sapiens
actggcagtttgagaatgcatt

SEQ ID NO: 7197990 - DNA, 22 bp, Homo sapiens
actggcagtttgagaatgcatt

SEQ ID NO: 7197991 - DNA, 19 bp, Homo sapiens
actggcagtttctgcatgg

SEQ ID NO: 7197992 - DNA, 22 bp, Homo sapiens
actggcagtgtcgtttacatga

SEQ ID NO: 7197993 - DNA, 22 bp, Homo sapiens
agtttacacttttgattcttat

SEQ ID NO: 7197994 - DNA, 22 bp, Homo sapiens
agtttacacttttgattcttat

SEQ ID NO: 7197995 - DNA, 22 bp, Homo sapiens
agtttacacttttgattcttat

SEQ ID NO: 7197996 - DNA, 22 bp, Homo sapiens
agtttacactatgaaaagacta

SEQ ID NO: 7197997 - DNA, 22 bp, Homo sapiens
agtttacactatgaaaagacta

SEQ ID NO: 7197998 - DNA, 22 bp, Homo sapiens
agtttacagatgtagtaggggt

SEQ ID NO: 7197999 - DNA, 22 bp, Homo sapiens
agtttacagatgtagtaggggt

SEQ ID NO: 7198000 - DNA, 22 bp, Homo sapiens
agtttacagatgctacaggagc

SEQ ID NO: 7198001 - DNA, 22 bp, Homo sapiens
agtttacagatgctacaggagc

SEQ ID NO: 7198002 - DNA, 22 bp, Homo sapiens
agtttacagatgctacaggagc

SEQ ID NO: 7198003 - DNA, 22 bp, Homo sapiens
actgtgctatctactgaattat

SEQ ID NO: 7198004 - DNA, 22 bp, Homo sapiens
actgtggggttcctggtacttg

SEQ ID NO: 7198005 - DNA, 22 bp, Homo sapiens
agtttctaacatatagcattgg

SEQ ID NO: 7198006 - DNA, 22 bp, Homo sapiens
agtttcctcatgttaatatgga

SEQ ID NO: 7198007 - DNA, 22 bp, Homo sapiens
actgtggggttcctggtacttg

SEQ ID NO: 7198008 - DNA, 22 bp, Homo sapiens
actgtgggtcccagctgtgtct

SEQ ID NO: 7198009 - DNA, 21 bp, Homo sapiens
actgtgggtctgaccacctgg

SEQ ID NO: 7198010 - DNA, 22 bp, Homo sapiens
actgtgggtgagggcaaatcaa

SEQ ID NO: 7198011 - DNA, 22 bp, Homo sapiens
actgtgggtgagggcaaatcaa

SEQ ID NO: 7198012 - DNA, 22 bp, Homo sapiens
actgtggttacctcttgtctta

SEQ ID NO: 7198013 - DNA, 20 bp, Homo sapiens
actgtgtaaacatgattcat

SEQ ID NO: 7198014 - DNA, 22 bp, Homo sapiens
actgtgtcattgaacatggaaa

SEQ ID NO: 7198015 - DNA, 22 bp, Homo sapiens
agtttccaaaaggagacaggga

SEQ ID NO: 7198016 - DNA, 22 bp, Homo sapiens
agtttccactggagacactgtg

SEQ ID NO: 7198017 - DNA, 22 bp, Homo sapiens
agtttccagcacagggcaagct

SEQ ID NO: 7198018 - DNA, 22 bp, Homo sapiens
agtttccactggagacactgtg

SEQ ID NO: 7198019 - DNA, 22 bp, Homo sapiens
agtttccatcccacacttgctt

SEQ ID NO: 7198020 - DNA, 22 bp, Homo sapiens
agtttcctcatctgtaaaatga

SEQ ID NO: 7198021 - DNA, 21 bp, Homo sapiens
agtttcctcatctgcatagga

SEQ ID NO: 7198022 - DNA, 21 bp, Homo sapiens
agtttcctcatctgcatagga

SEQ ID NO: 7198023 - DNA, 22 bp, Homo sapiens
actgtaaaggtttgtagcccag

SEQ ID NO: 7198024 - DNA, 22 bp, Homo sapiens
actgtaaaggtgattagaagtt

SEQ ID NO: 7198025 - DNA, 22 bp, Homo sapiens
actgtaaagttacgatcaagtt

SEQ ID NO: 7198026 - DNA, 22 bp, Homo sapiens
actgtaaattacataagaacag

SEQ ID NO: 7198027 - DNA, 22 bp, Homo sapiens
actgtctggaggcagagaggga

SEQ ID NO: 7198028 - DNA, 22 bp, Homo sapiens
actgtctggaggcagagaggga

SEQ ID NO: 7198029 - DNA, 22 bp, Homo sapiens
actgtctggatggaagccagcg

SEQ ID NO: 7198030 - DNA, 20 bp, Homo sapiens
actgtctggggacctcatta

SEQ ID NO: 7198031 - DNA, 22 bp, Homo sapiens
actgtctgtctcccaattatgc

SEQ ID NO: 7198032 - DNA, 22 bp, Homo sapiens
actgtctgtgccagatgctggg

SEQ ID NO: 7198033 - DNA, 22 bp, Homo sapiens
actgtcttcaaatgaatatatt

SEQ ID NO: 7198034 - DNA, 22 bp, Homo sapiens
actgtcttcaaatgaatatatt

SEQ ID NO: 7198035 - DNA, 22 bp, Homo sapiens
actgtcttcaaatgaatatatt

SEQ ID NO: 7198036 - DNA, 20 bp, Homo sapiens
actgtgaatgctgaattagc

SEQ ID NO: 7198037 - DNA, 22 bp, Homo sapiens
actgtgaatcactactagtaga

SEQ ID NO: 7198038 - DNA, 22 bp, Homo sapiens
actgtgaacggactgaagccca

SEQ ID NO: 7198039 - DNA, 22 bp, Homo sapiens
actgtgaacggactgaagccca

SEQ ID NO: 7198040 - DNA, 22 bp, Homo sapiens
actgtgaacggactgaagccca

SEQ ID NO: 7198041 - DNA, 22 bp, Homo sapiens
actgtcttcatatctgtgtctc

SEQ ID NO: 7198042 - DNA, 22 bp, Homo sapiens
actgtcttccaggtctggaggt

SEQ ID NO: 7198043 - DNA, 22 bp, Homo sapiens
actgtcttccaggtctggaggt

SEQ ID NO: 7198044 - DNA, 22 bp, Homo sapiens
actgtcttcatatctgtgtctc

SEQ ID NO: 7198045 - DNA, 22 bp, Homo sapiens
actgtcttgctatgagctccca

SEQ ID NO: 7198046 - DNA, 22 bp, Homo sapiens
actgtcttgtgttaaagaacca

SEQ ID NO: 7198047 - DNA, 22 bp, Homo sapiens
actgtcttgtgttaaagaacca

SEQ ID NO: 7198048 - DNA, 22 bp, Homo sapiens
actgtcttgttccaagactaaa

SEQ ID NO: 7198049 - DNA, 22 bp, Homo sapiens
actgtcttgttccaagactaaa

SEQ ID NO: 7198050 - DNA, 22 bp, Homo sapiens
actgtctttattagaatcttat

SEQ ID NO: 7198051 - DNA, 22 bp, Homo sapiens
actgtctttgagctggaggagg

SEQ ID NO: 7198052 - DNA, 17 bp, Homo sapiens
actgtcttttacaccct

SEQ ID NO: 7198053 - DNA, 22 bp, Homo sapiens
acttggtgtattagctctcact

SEQ ID NO: 7198054 - DNA, 22 bp, Homo sapiens
acttggttgatgtcataaggtt

SEQ ID NO: 7198055 - DNA, 22 bp, Homo sapiens
acttggttctaactagtgtata

SEQ ID NO: 7198056 - DNA, 22 bp, Homo sapiens
atagttgtgtggggattctggt

SEQ ID NO: 7198057 - DNA, 22 bp, Homo sapiens
atagtttaaggaactatgcgat

SEQ ID NO: 7198058 - DNA, 22 bp, Homo sapiens
atagtttaaggaactatgcgat

SEQ ID NO: 7198059 - DNA, 22 bp, Homo sapiens
atataatagtttcataaaggct

SEQ ID NO: 7198060 - DNA, 22 bp, Homo sapiens
atataatagtttcataaaggct

SEQ ID NO: 7198061 - DNA, 22 bp, Homo sapiens
atagtttaccttccagatggct

SEQ ID NO: 7198062 - DNA, 22 bp, Homo sapiens
acttgggtcacatgacctacct

SEQ ID NO: 7198063 - DNA, 21 bp, Homo sapiens
acttggtccacattagtcatt

SEQ ID NO: 7198064 - DNA, 22 bp, Homo sapiens
acttggtggaacgtgtatttta

SEQ ID NO: 7198065 - DNA, 22 bp, Homo sapiens
acttgggagggtgtgggcagct

SEQ ID NO: 7198066 - DNA, 22 bp, Homo sapiens
acttgggatggtggccagagcg

SEQ ID NO: 7198067 - DNA, 22 bp, Homo sapiens
acttgggatttcagatgctgtg

SEQ ID NO: 7198068 - DNA, 22 bp, Homo sapiens
atataatttttggttagctcaa

SEQ ID NO: 7198069 - DNA, 22 bp, Homo sapiens
atataatttttggttagctcaa

SEQ ID NO: 7198070 - DNA, 22 bp, Homo sapiens
atatacaaagggcaacctcgct

SEQ ID NO: 7198071 - DNA, 22 bp, Homo sapiens
atatacaaagggcaacctcgct

SEQ ID NO: 7198072 - DNA, 22 bp, Homo sapiens
atatacacagagcttatggtga

SEQ ID NO: 7198073 - DNA, 22 bp, Homo sapiens
atatacacatctttttaaatat

SEQ ID NO: 7198074 - DNA, 22 bp, Homo sapiens
atataattaatttagctgcctc

SEQ ID NO: 7198075 - DNA, 22 bp, Homo sapiens
atataattaatttagctgcctc

SEQ ID NO: 7198076 - DNA, 22 bp, Homo sapiens
atataattaatttagctgcctc

SEQ ID NO: 7198077 - DNA, 22 bp, Homo sapiens
atataattctcaggtttgacta

SEQ ID NO: 7198078 - DNA, 22 bp, Homo sapiens
atataattctcaggtttgacta

SEQ ID NO: 7198079 - DNA, 22 bp, Homo sapiens
atataattgttctgaagtgttt

SEQ ID NO: 7198080 - DNA, 22 bp, Homo sapiens
atataattgttctgaagtgttt

SEQ ID NO: 7198081 - DNA, 22 bp, Homo sapiens
atataattgttctgaagtgttt

SEQ ID NO: 7198082 - DNA, 22 bp, Homo sapiens
atataatttagaaggggaaaca

SEQ ID NO: 7198083 - DNA, 22 bp, Homo sapiens
atataatttagaaggggaaaca

SEQ ID NO: 7198084 - DNA, 21 bp, Homo sapiens
actttgggaggtgtgaggggc

SEQ ID NO: 7198085 - DNA, 22 bp, Homo sapiens
actttgggcacagtgaggccag

SEQ ID NO: 7198086 - DNA, 21 bp, Homo sapiens
actttgggcactttcctgccc

SEQ ID NO: 7198087 - DNA, 21 bp, Homo sapiens
actttgggcactttcctgccc

SEQ ID NO: 7198088 - DNA, 22 bp, Homo sapiens
atatacacatgtgtatacattt

SEQ ID NO: 7198089 - DNA, 22 bp, Homo sapiens
atatacacatgtgtatacattt

SEQ ID NO: 7198090 - DNA, 22 bp, Homo sapiens
actttggggatctacggctgga

SEQ ID NO: 7198091 - DNA, 20 bp, Homo sapiens
actttggggtctttctcaga

SEQ ID NO: 7198092 - DNA, 20 bp, Homo sapiens
actttggggtctttctcaga

SEQ ID NO: 7198093 - DNA, 22 bp, Homo sapiens
actttgggtaagccaggtgcta

SEQ ID NO: 7198094 - DNA, 22 bp, Homo sapiens
actttggggatctacggctgga

SEQ ID NO: 7198095 - DNA, 22 bp, Homo sapiens
actttggggaacttttctcctc

SEQ ID NO: 7198096 - DNA, 21 bp, Homo sapiens
actttgggcactttcctgccc

SEQ ID NO: 7198097 - DNA, 22 bp, Homo sapiens
actttggggaacttttctcctc

SEQ ID NO: 7198098 - DNA, 22 bp, Homo sapiens
actttgggtaagccaggtgcta

SEQ ID NO: 7198099 - DNA, 22 bp, Homo sapiens
actttgggtaagttgattaatc

SEQ ID NO: 7198100 - DNA, 22 bp, Homo sapiens
actttggtcccatgtgtgtaaa

SEQ ID NO: 7198101 - DNA, 22 bp, Homo sapiens
actttggtcccatgtgtgtaaa

SEQ ID NO: 7198102 - DNA, 17 bp, Homo sapiens
actttggtcctgtgctc

SEQ ID NO: 7198103 - DNA, 22 bp, Homo sapiens
actttggtctctgcccctggtg

SEQ ID NO: 7198104 - DNA, 22 bp, Homo sapiens
actttggtcttagaggaggaat

SEQ ID NO: 7198105 - DNA, 22 bp, Homo sapiens
actttggtcttagaggaggaat

SEQ ID NO: 7198106 - DNA, 22 bp, Homo sapiens
actttggtgaatcagttttgtt

SEQ ID NO: 7198107 - DNA, 22 bp, Homo sapiens
actttggtgatacagatacggc

SEQ ID NO: 7198108 - DNA, 22 bp, Homo sapiens
actttggtgatacagatacggc

SEQ ID NO: 7198109 - DNA, 19 bp, Homo sapiens
actttggtgattagaggga

SEQ ID NO: 7198110 - DNA, 19 bp, Homo sapiens
actttggtgattagaggga

SEQ ID NO: 7198111 - DNA, 22 bp, Homo sapiens
actttgtaggaaaaagtcacaa

SEQ ID NO: 7198112 - DNA, 22 bp, Homo sapiens
actttgtaggtttcagtgaaac

SEQ ID NO: 7198113 - DNA, 22 bp, Homo sapiens
actttggtgcgaagtcacttta

SEQ ID NO: 7198114 - DNA, 22 bp, Homo sapiens
actttggtgcgaagtcacttta

SEQ ID NO: 7198115 - DNA, 22 bp, Homo sapiens
actttggttataggagccaaaa

SEQ ID NO: 7198116 - DNA, 20 bp, Homo sapiens
actttggttattgggaccat

SEQ ID NO: 7198117 - DNA, 20 bp, Homo sapiens
actttggttattgggaccat

SEQ ID NO: 7198118 - DNA, 22 bp, Homo sapiens
actttggttcacagctgttcat

SEQ ID NO: 7198119 - DNA, 22 bp, Homo sapiens
actttggttcacagctgttcat

SEQ ID NO: 7198120 - DNA, 22 bp, Homo sapiens
actttggtttccctgttcgtaa

SEQ ID NO: 7198121 - DNA, 22 bp, Homo sapiens
atatattggtgtcagaaagagt

SEQ ID NO: 7198122 - DNA, 22 bp, Homo sapiens
atatattgtatctttcatgggg

SEQ ID NO: 7198123 - DNA, 22 bp, Homo sapiens
atatatttactctcctgttgca

SEQ ID NO: 7198124 - DNA, 22 bp, Homo sapiens
atatataacctggataaggctt

SEQ ID NO: 7198125 - DNA, 22 bp, Homo sapiens
actttgtataagacaataaaga

SEQ ID NO: 7198126 - DNA, 22 bp, Homo sapiens
atatataacctggataaggctt

SEQ ID NO: 7198127 - DNA, 22 bp, Homo sapiens
atatatttgagaatattcatga

SEQ ID NO: 7198128 - DNA, 22 bp, Homo sapiens
atatatttgagaatattcatga

SEQ ID NO: 7198129 - DNA, 22 bp, Homo sapiens
atatatttgagaatattcatga

SEQ ID NO: 7198130 - DNA, 22 bp, Homo sapiens
atatatttgagaatattcatga

SEQ ID NO: 7198131 - DNA, 22 bp, Homo sapiens
atatatttactctcctgttgca

SEQ ID NO: 7198132 - DNA, 22 bp, Homo sapiens
atatatttactctcctgttgca

SEQ ID NO: 7198133 - DNA, 22 bp, Homo sapiens
atatatttactctcctgttgca

SEQ ID NO: 7198134 - DNA, 22 bp, Homo sapiens
atatatttgagaatattcatga

SEQ ID NO: 7198135 - DNA, 22 bp, Homo sapiens
atatatttgagaatattcatga

SEQ ID NO: 7198136 - DNA, 22 bp, Homo sapiens
atatatttgagaatattcatga

SEQ ID NO: 7198137 - DNA, 22 bp, Homo sapiens
atatatttgagaatattcatga

SEQ ID NO: 7198138 - DNA, 22 bp, Homo sapiens
atatattttgaatagcctctgt

SEQ ID NO: 7198139 - DNA, 22 bp, Homo sapiens
atatattttgaatagcctctgt

SEQ ID NO: 7198140 - DNA, 22 bp, Homo sapiens
atatattttgaatagcctctgt

SEQ ID NO: 7198141 - DNA, 22 bp, Homo sapiens
atatattttgaatagcctctgt

SEQ ID NO: 7198142 - DNA, 19 bp, Homo sapiens
atatccttgagaaagggaa

SEQ ID NO: 7198143 - DNA, 22 bp, Homo sapiens
atatccttgagacgtggctact

SEQ ID NO: 7198144 - DNA, 22 bp, Homo sapiens
atatccatattacaagcagaaa

SEQ ID NO: 7198145 - DNA, 22 bp, Homo sapiens
atatccatagtaaaagtcatta

SEQ ID NO: 7198146 - DNA, 22 bp, Homo sapiens
atatattttgaatagcctctgt

SEQ ID NO: 7198147 - DNA, 18 bp, Homo sapiens
atatctgtgggatggaga

SEQ ID NO: 7198148 - DNA, 22 bp, Homo sapiens
atatctcattaccttgctgttc

SEQ ID NO: 7198149 - DNA, 22 bp, Homo sapiens
atatctcaatacagctgtttta

SEQ ID NO: 7198150 - DNA, 22 bp, Homo sapiens
atatctcaatacagctgtttta

SEQ ID NO: 7198151 - DNA, 22 bp, Homo sapiens
atatctgtggagggcttacaaa

SEQ ID NO: 7198152 - DNA, 22 bp, Homo sapiens
atatctgtggagggcttacaaa

SEQ ID NO: 7198153 - DNA, 22 bp, Homo sapiens
atatcctttactgtgtcacaga

SEQ ID NO: 7198154 - DNA, 22 bp, Homo sapiens
atatcctttactgtgtcacaga

SEQ ID NO: 7198155 - DNA, 22 bp, Homo sapiens
agaaacagaaccaggtgtcatt

SEQ ID NO: 7198156 - DNA, 22 bp, Homo sapiens
agaaacagaagggaaagctttt

SEQ ID NO: 7198157 - DNA, 22 bp, Homo sapiens
agaaacagaagggaaagctttt

SEQ ID NO: 7198158 - DNA, 22 bp, Homo sapiens
agaaacaaggtgtaggttgacc

SEQ ID NO: 7198159 - DNA, 22 bp, Homo sapiens
agaaacagaaccaggtgtcatt

SEQ ID NO: 7198160 - DNA, 22 bp, Homo sapiens
agaaacaacttgtttctcttgc

SEQ ID NO: 7198161 - DNA, 22 bp, Homo sapiens
agaaacaacttgtttctcttgc

SEQ ID NO: 7198162 - DNA, 22 bp, Homo sapiens
agaaacaaggtgtaggttgacc

SEQ ID NO: 7198163 - DNA, 22 bp, Homo sapiens
agaaacaaggtgtaggttgacc

SEQ ID NO: 7198164 - DNA, 22 bp, Homo sapiens
agaaaatttaaagagacacaca

SEQ ID NO: 7198165 - DNA, 22 bp, Homo sapiens
agaaaatttattcatgttagtt

SEQ ID NO: 7198166 - DNA, 22 bp, Homo sapiens
agaaaatttattcatgttagtt

SEQ ID NO: 7198167 - DNA, 22 bp, Homo sapiens
agaaaatttattcatgttagtt

SEQ ID NO: 7198168 - DNA, 22 bp, Homo sapiens
agaaacaacttgtttctcttgc

SEQ ID NO: 7198169 - DNA, 22 bp, Homo sapiens
atatgaaaagaagtcaccattg

SEQ ID NO: 7198170 - DNA, 22 bp, Homo sapiens
atatgaaaagaagtcaccattg

SEQ ID NO: 7198171 - DNA, 22 bp, Homo sapiens
atatgaaaagaagtcaccattg

SEQ ID NO: 7198172 - DNA, 22 bp, Homo sapiens
atatgaaaagaagtcaccattg

SEQ ID NO: 7198173 - DNA, 22 bp, Homo sapiens
atatgaaaatgttttagctgta

SEQ ID NO: 7198174 - DNA, 22 bp, Homo sapiens
atatgaaagtaagcatgtgtgt

SEQ ID NO: 7198175 - DNA, 22 bp, Homo sapiens
atatgaaagtaagcatgtgtgt

SEQ ID NO: 7198176 - DNA, 22 bp, Homo sapiens
agaaaataatttcttggctggt

SEQ ID NO: 7198177 - DNA, 22 bp, Homo sapiens
agaaaatttaaagagacacaca

SEQ ID NO: 7198178 - DNA, 22 bp, Homo sapiens
atcacatttatagtggcacgca

SEQ ID NO: 7198179 - DNA, 21 bp, Homo sapiens
atcaccagcagaagctgcaga

SEQ ID NO: 7198180 - DNA, 22 bp, Homo sapiens
atcaccactacaaacatcattg

SEQ ID NO: 7198181 - DNA, 22 bp, Homo sapiens
atcacattgttagcatagactg

SEQ ID NO: 7198182 - DNA, 22 bp, Homo sapiens
atcacattgttagcatagactg

SEQ ID NO: 7198183 - DNA, 22 bp, Homo sapiens
atcacattgttagcatagactg

SEQ ID NO: 7198184 - DNA, 22 bp, Homo sapiens
atcacatttatagtggcacgca

SEQ ID NO: 7198185 - DNA, 22 bp, Homo sapiens
atcaccagtaagttttcagttt

SEQ ID NO: 7198186 - DNA, 22 bp, Homo sapiens
atcaccaggcaaaatgtcagag

SEQ ID NO: 7198187 - DNA, 22 bp, Homo sapiens
atcaccactacaaacatcattg

SEQ ID NO: 7198188 - DNA, 22 bp, Homo sapiens
atcactgagcttcagtgctggc

SEQ ID NO: 7198189 - DNA, 22 bp, Homo sapiens
atcactatgcttatgtggcaca

SEQ ID NO: 7198190 - DNA, 22 bp, Homo sapiens
atcactatgggcattatattta

SEQ ID NO: 7198191 - DNA, 22 bp, Homo sapiens
atcaccttgcgcagcacggctt

SEQ ID NO: 7198192 - DNA, 22 bp, Homo sapiens
atcacgtcatggtttgatctgg

SEQ ID NO: 7198193 - DNA, 22 bp, Homo sapiens
atcacctgggagcatattaaat

SEQ ID NO: 7198194 - DNA, 22 bp, Homo sapiens
atcacccaagctggagtgcagt

SEQ ID NO: 7198195 - DNA, 22 bp, Homo sapiens
atcacccaggctggagtgcagt

SEQ ID NO: 7198196 - DNA, 22 bp, Homo sapiens
atcacctgatggtgaacaaggg

SEQ ID NO: 7198197 - DNA, 22 bp, Homo sapiens
atcacctgcacaaatgtgttcc

SEQ ID NO: 7198198 - DNA, 22 bp, Homo sapiens
atcacctggaggtgatcacttg

SEQ ID NO: 7198199 - DNA, 22 bp, Homo sapiens
atcactgtggcccaaaacctca

SEQ ID NO: 7198200 - DNA, 22 bp, Homo sapiens
atcactgttatctagaagcaca

SEQ ID NO: 7198201 - DNA, 22 bp, Homo sapiens
atcactgttatctagaagcaca

SEQ ID NO: 7198202 - DNA, 22 bp, Homo sapiens
atcagagctgtgattcccactc

SEQ ID NO: 7198203 - DNA, 22 bp, Homo sapiens
atcagaggaaattaactctctc

SEQ ID NO: 7198204 - DNA, 22 bp, Homo sapiens
atcagaggaagacgacggaatg

SEQ ID NO: 7198205 - DNA, 22 bp, Homo sapiens
atcagaggacctagttgggcag

SEQ ID NO: 7198206 - DNA, 22 bp, Homo sapiens
atcactgtggaaaactgtatgg

SEQ ID NO: 7198207 - DNA, 22 bp, Homo sapiens
atcactgtggcccaaaacctca

SEQ ID NO: 7198208 - DNA, 20 bp, Homo sapiens
atcactggagaaggaaacct

SEQ ID NO: 7198209 - DNA, 20 bp, Homo sapiens
atcactggagaaggaaacct

SEQ ID NO: 7198210 - DNA, 20 bp, Homo sapiens
atcactggagaaggaaacct

SEQ ID NO: 7198211 - DNA, 22 bp, Homo sapiens
atcactgggcttctaatcactg

SEQ ID NO: 7198212 - DNA, 20 bp, Homo sapiens
atcagaggatagggaagtgg

SEQ ID NO: 7198213 - DNA, 22 bp, Homo sapiens
atcagagggtgagatggagaaa

SEQ ID NO: 7198214 - DNA, 22 bp, Homo sapiens
atcagaggtactttccattttt

SEQ ID NO: 7198215 - DNA, 22 bp, Homo sapiens
atcagaggtgagggagagcccc

SEQ ID NO: 7198216 - DNA, 22 bp, Homo sapiens
atcagaggtgagggagagcccc

SEQ ID NO: 7198217 - DNA, 22 bp, Homo sapiens
atcagaggtggaactggggact

SEQ ID NO: 7198218 - DNA, 22 bp, Homo sapiens
atcagaggtgttgaaacatgac

SEQ ID NO: 7198219 - DNA, 22 bp, Homo sapiens
atcagaggttatgtggagggga

SEQ ID NO: 7198220 - DNA, 22 bp, Homo sapiens
atcagaggttatgtggagggga

SEQ ID NO: 7198221 - DNA, 22 bp, Homo sapiens
atcagagtagttgttgcccaga

SEQ ID NO: 7198222 - DNA, 22 bp, Homo sapiens
atcagagtgtaagttctttcct

SEQ ID NO: 7198223 - DNA, 22 bp, Homo sapiens
atcagatatttaagttatcaac

SEQ ID NO: 7198224 - DNA, 22 bp, Homo sapiens
atcagatatttaagttatcaac

SEQ ID NO: 7198225 - DNA, 21 bp, Homo sapiens
atcacattggctgttattatt

SEQ ID NO: 7198226 - DNA, 22 bp, Homo sapiens
atcacattgccagtgattaccc

SEQ ID NO: 7198227 - DNA, 21 bp, Homo sapiens
atcacattggctgttattatt

SEQ ID NO: 7198228 - DNA, 21 bp, Homo sapiens
atcacattggctgttattatt

SEQ ID NO: 7198229 - DNA, 22 bp, Homo sapiens
atcacaaaggctgcttcatgat

SEQ ID NO: 7198230 - DNA, 22 bp, Homo sapiens
atcacaaaggctgcttcatgat

SEQ ID NO: 7198231 - DNA, 22 bp, Homo sapiens
atcacattgccagtgattaccc

SEQ ID NO: 7198232 - DNA, 22 bp, Homo sapiens
agaaacatttagattatatgtc

SEQ ID NO: 7198233 - DNA, 22 bp, Homo sapiens
agaaacatttagattatatgtc

SEQ ID NO: 7198234 - DNA, 22 bp, Homo sapiens
atcacaaaggctgcttcatgat

SEQ ID NO: 7198235 - DNA, 22 bp, Homo sapiens
atcacaaaggctgcttcatgat

SEQ ID NO: 7198236 - DNA, 22 bp, Homo sapiens
agaaacatcgcttagtcctcat

SEQ ID NO: 7198237 - DNA, 22 bp, Homo sapiens
agaaacatcttggcaactggaa

SEQ ID NO: 7198238 - DNA, 22 bp, Homo sapiens
agaaacatcttggcaactggaa

SEQ ID NO: 7198239 - DNA, 21 bp, Homo sapiens
agaaacatgatcaaaggaacc

SEQ ID NO: 7198240 - DNA, 21 bp, Homo sapiens
agaaacatgatcaaaggaacc

SEQ ID NO: 7198241 - DNA, 22 bp, Homo sapiens
agaaacatttagattatatgtc

SEQ ID NO: 7198242 - DNA, 22 bp, Homo sapiens
agaaacatttagattatatgtc

SEQ ID NO: 7198243 - DNA, 22 bp, Homo sapiens
agaaacagcattagcatcaatt

SEQ ID NO: 7198244 - DNA, 22 bp, Homo sapiens
agaaacatattcagtgagtaat

SEQ ID NO: 7198245 - DNA, 22 bp, Homo sapiens
agaaacatattcagtgagtaat

SEQ ID NO: 7198246 - DNA, 22 bp, Homo sapiens
agaaacatattcagtgagtaat

SEQ ID NO: 7198247 - DNA, 22 bp, Homo sapiens
agaaacatcattggaacacaag

SEQ ID NO: 7198248 - DNA, 22 bp, Homo sapiens
agaaacatcattggaacacaag

SEQ ID NO: 7198249 - DNA, 22 bp, Homo sapiens
agaaacatcattggaacacaag

SEQ ID NO: 7198250 - DNA, 22 bp, Homo sapiens
agaaacatcctgctttccattt

SEQ ID NO: 7198251 - DNA, 20 bp, Homo sapiens
agaaacagcacaattctgtt

SEQ ID NO: 7198252 - DNA, 22 bp, Homo sapiens
agaaacagcattagcatcaatt

SEQ ID NO: 7198253 - DNA, 22 bp, Homo sapiens
agaaacagcattagcatcaatt

SEQ ID NO: 7198254 - DNA, 22 bp, Homo sapiens
agaaacagcattagcatcaatt

SEQ ID NO: 7198255 - DNA, 22 bp, Homo sapiens
agaaacagcattagcatcaatt

SEQ ID NO: 7198256 - DNA, 20 bp, Homo sapiens
agaaacagcacaattctgtt

SEQ ID NO: 7198257 - DNA, 22 bp, Homo sapiens
agaaacagaagggaaagctttt

SEQ ID NO: 7198258 - DNA, 22 bp, Homo sapiens
agaaacagaagggaaagctttt

SEQ ID NO: 7198259 - DNA, 22 bp, Homo sapiens
atccagagacccaaggacagaa

SEQ ID NO: 7198260 - DNA, 16 bp, Homo sapiens
atccagacagcacagg

SEQ ID NO: 7198261 - DNA, 22 bp, Homo sapiens
atccagacagtctggtgccaga

SEQ ID NO: 7198262 - DNA, 22 bp, Homo sapiens
atccagagacccaaggacagaa

SEQ ID NO: 7198263 - DNA, 22 bp, Homo sapiens
atccagagacccaaggacagaa

SEQ ID NO: 7198264 - DNA, 22 bp, Homo sapiens
atccacttgccactgtatagtt

SEQ ID NO: 7198265 - DNA, 22 bp, Homo sapiens
atccacttggctggttgttcta

SEQ ID NO: 7198266 - DNA, 22 bp, Homo sapiens
atccagaatgtcttgctggaga

SEQ ID NO: 7198267 - DNA, 22 bp, Homo sapiens
atcatttggggaattgtggaca

SEQ ID NO: 7198268 - DNA, 22 bp, Homo sapiens
atcatttggggaattgtggaca

SEQ ID NO: 7198269 - DNA, 22 bp, Homo sapiens
atcatttgcctcaagtgaaagt

SEQ ID NO: 7198270 - DNA, 22 bp, Homo sapiens
atcatttgcctcaagtgaaagt

SEQ ID NO: 7198271 - DNA, 22 bp, Homo sapiens
atcatttccctttagatcacaa

SEQ ID NO: 7198272 - DNA, 22 bp, Homo sapiens
atcatttccctttagatcacaa

SEQ ID NO: 7198273 - DNA, 22 bp, Homo sapiens
atcatttccctttagatcacaa

SEQ ID NO: 7198274 - DNA, 22 bp, Homo sapiens
atcatttgtgcatagtaacaga

SEQ ID NO: 7198275 - DNA, 22 bp, Homo sapiens
atccactctaagatctgtggtg

SEQ ID NO: 7198276 - DNA, 22 bp, Homo sapiens
atccactctcccattcatgcat

SEQ ID NO: 7198277 - DNA, 22 bp, Homo sapiens
atccacttcactggaatgtagg

SEQ ID NO: 7198278 - DNA, 22 bp, Homo sapiens
atccagaggcactgccctttgt

SEQ ID NO: 7198279 - DNA, 22 bp, Homo sapiens
atccagagggtagcaggattag

SEQ ID NO: 7198280 - DNA, 22 bp, Homo sapiens
atccagagggtagcaggattag

SEQ ID NO: 7198281 - DNA, 22 bp, Homo sapiens
atccagagtaatacagaatgca

SEQ ID NO: 7198282 - DNA, 22 bp, Homo sapiens
atccagagactggggctgggat

SEQ ID NO: 7198283 - DNA, 22 bp, Homo sapiens
atccagagaggttaggtgacat

SEQ ID NO: 7198284 - DNA, 22 bp, Homo sapiens
atccagagtggccttctttcca

SEQ ID NO: 7198285 - DNA, 22 bp, Homo sapiens
atccagagtgtaattctccatg

SEQ ID NO: 7198286 - DNA, 22 bp, Homo sapiens
atccagagttatatccaagcag

SEQ ID NO: 7198287 - DNA, 22 bp, Homo sapiens
atccagagttgctgtatatctt

SEQ ID NO: 7198288 - DNA, 22 bp, Homo sapiens
agaacctttctttagaaattca

SEQ ID NO: 7198289 - DNA, 22 bp, Homo sapiens
agaagaaatgaggccgttctgc

SEQ ID NO: 7198290 - DNA, 22 bp, Homo sapiens
agaagaaatgaggccgttctgc

SEQ ID NO: 7198291 - DNA, 22 bp, Homo sapiens
agaagaaatgtgaaggccactg

SEQ ID NO: 7198292 - DNA, 22 bp, Homo sapiens
atccagcacttgttcatgtgaa

SEQ ID NO: 7198293 - DNA, 22 bp, Homo sapiens
atcattctgatggtcaatgcta

SEQ ID NO: 7198294 - DNA, 20 bp, Homo sapiens
atcatctttacaatgtcagt

SEQ ID NO: 7198295 - DNA, 20 bp, Homo sapiens
atcatctttacaatgtcagt

SEQ ID NO: 7198296 - DNA, 22 bp, Homo sapiens
atcagcaagtcctgttaattct

SEQ ID NO: 7198297 - DNA, 19 bp, Homo sapiens
atcagcaaggtaggatgtg

SEQ ID NO: 7198298 - DNA, 22 bp, Homo sapiens
atcagcaaggcaatcactgcag

SEQ ID NO: 7198299 - DNA, 22 bp, Homo sapiens
atcagcaaaaatgccttcagaa

SEQ ID NO: 7198300 - DNA, 21 bp, Homo sapiens
atcagcaaatgcctgtctccc

SEQ ID NO: 7198301 - DNA, 20 bp, Homo sapiens
atcagcaactgccactcagt

SEQ ID NO: 7198302 - DNA, 20 bp, Homo sapiens
atcagcaactgccactcagt

SEQ ID NO: 7198303 - DNA, 20 bp, Homo sapiens
atcagcaactgccactcagt

SEQ ID NO: 7198304 - DNA, 22 bp, Homo sapiens
atcagcaagactaggggaatac

SEQ ID NO: 7198305 - DNA, 22 bp, Homo sapiens
atcagcaagatgtaatttctat

SEQ ID NO: 7198306 - DNA, 22 bp, Homo sapiens
atcagcaagatgtaatttctat

SEQ ID NO: 7198307 - DNA, 22 bp, Homo sapiens
atcagcaagattgtgtcttgta

SEQ ID NO: 7198308 - DNA, 22 bp, Homo sapiens
atcagcaagcatggttaggtgt

SEQ ID NO: 7198309 - DNA, 22 bp, Homo sapiens
atcagcaagcatttattgagtg

SEQ ID NO: 7198310 - DNA, 22 bp, Homo sapiens
atcatttacaaactcagcattg

SEQ ID NO: 7198311 - DNA, 22 bp, Homo sapiens
atcatttacaaactcagcattg

SEQ ID NO: 7198312 - DNA, 22 bp, Homo sapiens
atcatttacaatgaaagcctga

SEQ ID NO: 7198313 - DNA, 22 bp, Homo sapiens
atcatttaaaacaagtctctat

SEQ ID NO: 7198314 - DNA, 22 bp, Homo sapiens
atcatttacaaactcagcattg

SEQ ID NO: 7198315 - DNA, 22 bp, Homo sapiens
atcatttacaaactcagcattg

SEQ ID NO: 7198316 - DNA, 22 bp, Homo sapiens
atcatttacaaactcagcattg

SEQ ID NO: 7198317 - DNA, 22 bp, Homo sapiens
atcatttagtggggcattggaa

SEQ ID NO: 7198318 - DNA, 22 bp, Homo sapiens
atcatttatgccccaattagat

SEQ ID NO: 7198319 - DNA, 22 bp, Homo sapiens
atcatttatgccccaattagat

SEQ ID NO: 7198320 - DNA, 22 bp, Homo sapiens
atcatttatgccccaattagat

SEQ ID NO: 7198321 - DNA, 22 bp, Homo sapiens
atcattggaggcactgtgcagt

SEQ ID NO: 7198322 - DNA, 22 bp, Homo sapiens
atcattgagtaaaatgaataca

SEQ ID NO: 7198323 - DNA, 19 bp, Homo sapiens
atcattgatcttcacccct

SEQ ID NO: 7198324 - DNA, 21 bp, Homo sapiens
atcattgcagagcacattaaa

SEQ ID NO: 7198325 - DNA, 22 bp, Homo sapiens
atcattgtaaataatgctgcca

SEQ ID NO: 7198326 - DNA, 22 bp, Homo sapiens
atcatttaaaacaagtctctat

SEQ ID NO: 7198327 - DNA, 22 bp, Homo sapiens
atcatttaaaacaagtctctat

SEQ ID NO: 7198328 - DNA, 22 bp, Homo sapiens
atcatttaaaacaagtctctat

SEQ ID NO: 7198329 - DNA, 22 bp, Homo sapiens
atcatttaaaacaagtctctat

SEQ ID NO: 7198330 - DNA, 22 bp, Homo sapiens
atcattgaaatgtagtttcatc

SEQ ID NO: 7198331 - DNA, 22 bp, Homo sapiens
atcattgaatataagtgctatt

SEQ ID NO: 7198332 - DNA, 22 bp, Homo sapiens
atcattgaatataagtgctatt

SEQ ID NO: 7198333 - DNA, 22 bp, Homo sapiens
atcattgaatataagtgctatt

SEQ ID NO: 7198334 - DNA, 22 bp, Homo sapiens
atcattgaattgctttgttctt

SEQ ID NO: 7198335 - DNA, 22 bp, Homo sapiens
atcattgagattttttacaact

SEQ ID NO: 7198336 - DNA, 22 bp, Homo sapiens
atcattgagattttttacaact

SEQ ID NO: 7198337 - DNA, 22 bp, Homo sapiens
aggcgcctgcgggatccttgcc

SEQ ID NO: 7198338 - DNA, 22 bp, Homo sapiens
aggcgcctgcgggatccttgcc

SEQ ID NO: 7198339 - DNA, 22 bp, Homo sapiens
aggcgcctgcgggatccttgcc

SEQ ID NO: 7198340 - DNA, 22 bp, Homo sapiens
aggcgctgagtaggcaaggagg

SEQ ID NO: 7198341 - DNA, 22 bp, Homo sapiens
aggcgcagacatacagggtctg

SEQ ID NO: 7198342 - DNA, 22 bp, Homo sapiens
aggcgcagcacgtgagagttgg

SEQ ID NO: 7198343 - DNA, 22 bp, Homo sapiens
aggcgcagcacgtgagagttgg

SEQ ID NO: 7198344 - DNA, 22 bp, Homo sapiens
aggcgcagggtttggacccagg

SEQ ID NO: 7198345 - DNA, 22 bp, Homo sapiens
aggctagctaatgagtactgtg

SEQ ID NO: 7198346 - DNA, 22 bp, Homo sapiens
aggctagctgtttcagggctag

SEQ ID NO: 7198347 - DNA, 22 bp, Homo sapiens
aggctagctgtttcagggctag

SEQ ID NO: 7198348 - DNA, 22 bp, Homo sapiens
aggctagctgtttcagggctag

SEQ ID NO: 7198349 - DNA, 22 bp, Homo sapiens
aggctagctttggctcagtaaa

SEQ ID NO: 7198350 - DNA, 22 bp, Homo sapiens
aggcctttgtacaataatcata

SEQ ID NO: 7198351 - DNA, 17 bp, Homo sapiens
aggcgagaggaacatag

SEQ ID NO: 7198352 - DNA, 22 bp, Homo sapiens
aggcgagaggcttgggctagta

SEQ ID NO: 7198353 - DNA, 22 bp, Homo sapiens
aggcgcagaaggccaggggcct

SEQ ID NO: 7198354 - DNA, 22 bp, Homo sapiens
aggcgcagaaggccaggggcct

SEQ ID NO: 7198355 - DNA, 22 bp, Homo sapiens
aggcgcagaaggccaggggcct

SEQ ID NO: 7198356 - DNA, 22 bp, Homo sapiens
aggcgcagaaggccaggggcct

SEQ ID NO: 7198357 - DNA, 22 bp, Homo sapiens
aggcgcagacatacagggtctg

SEQ ID NO: 7198358 - DNA, 22 bp, Homo sapiens
aggcgcagacatacagggtctg

SEQ ID NO: 7198359 - DNA, 22 bp, Homo sapiens
aggccttggaagccagggagcc

SEQ ID NO: 7198360 - DNA, 22 bp, Homo sapiens
aggccttgccaatgagagaact

SEQ ID NO: 7198361 - DNA, 22 bp, Homo sapiens
aggccttgccaatgagagaact

SEQ ID NO: 7198362 - DNA, 22 bp, Homo sapiens
aggccttcctcggagacaggga

SEQ ID NO: 7198363 - DNA, 22 bp, Homo sapiens
aggccttatctccaaatacagt

SEQ ID NO: 7198364 - DNA, 22 bp, Homo sapiens
aggccttgaaccttgctgggtg

SEQ ID NO: 7198365 - DNA, 22 bp, Homo sapiens
aggccttgccaatgagagaact

SEQ ID NO: 7198366 - DNA, 22 bp, Homo sapiens
aggccttggaagccagggagcc

SEQ ID NO: 7198367 - DNA, 22 bp, Homo sapiens
aggccttggaagccagggagcc

SEQ ID NO: 7198368 - DNA, 22 bp, Homo sapiens
aggccttggaagccagggagcc

SEQ ID NO: 7198369 - DNA, 22 bp, Homo sapiens
aggccttggcagaggccaggct

SEQ ID NO: 7198370 - DNA, 22 bp, Homo sapiens
aggccttggcagaggccaggct

SEQ ID NO: 7198371 - DNA, 22 bp, Homo sapiens
aggccttgggagcagtgtttgt

SEQ ID NO: 7198372 - DNA, 18 bp, Homo sapiens
aggccttgggtagcctga

SEQ ID NO: 7198373 - DNA, 22 bp, Homo sapiens
aggccttgtgagaagcagagaa

SEQ ID NO: 7198374 - DNA, 22 bp, Homo sapiens
aggccttgtgagaagcagagaa

SEQ ID NO: 7198375 - DNA, 22 bp, Homo sapiens
aggccttgtgagaagcagagaa

SEQ ID NO: 7198376 - DNA, 22 bp, Homo sapiens
aggcctgttccaggcccctttt

SEQ ID NO: 7198377 - DNA, 22 bp, Homo sapiens
aggccttaagaacaaaactatt

SEQ ID NO: 7198378 - DNA, 22 bp, Homo sapiens
acatttaaccctcaggtttctg

SEQ ID NO: 7198379 - DNA, 22 bp, Homo sapiens
acatttaatgatcctactgtga

SEQ ID NO: 7198380 - DNA, 22 bp, Homo sapiens
acatttaaccaaactgtttaat

SEQ ID NO: 7198381 - DNA, 21 bp, Homo sapiens
acattgtgtatgcgagagttt

SEQ ID NO: 7198382 - DNA, 22 bp, Homo sapiens
acattgtgacagttttggagaa

SEQ ID NO: 7198383 - DNA, 21 bp, Homo sapiens
acattgtgacatgcagggtgc

SEQ ID NO: 7198384 - DNA, 22 bp, Homo sapiens
acattgtgcctgtgatattaca

SEQ ID NO: 7198385 - DNA, 22 bp, Homo sapiens
acattgtgcctgtgatattaca

SEQ ID NO: 7198386 - DNA, 22 bp, Homo sapiens
acatttaaccaaactgtttaat

SEQ ID NO: 7198387 - DNA, 22 bp, Homo sapiens
acatttaaccaaactgtttaat

SEQ ID NO: 7198388 - DNA, 22 bp, Homo sapiens
aggctagggccatggctggtga

SEQ ID NO: 7198389 - DNA, 22 bp, Homo sapiens
aggctaggccttgccctggaac

SEQ ID NO: 7198390 - DNA, 22 bp, Homo sapiens
aggctaggggcagtgccagcat

SEQ ID NO: 7198391 - DNA, 22 bp, Homo sapiens
aggctatgacagactcagcctg

SEQ ID NO: 7198392 - DNA, 22 bp, Homo sapiens
aggctgagtgctcccctagatg

SEQ ID NO: 7198393 - DNA, 22 bp, Homo sapiens
aggctgaggggcgagggaccct

SEQ ID NO: 7198394 - DNA, 22 bp, Homo sapiens
aggctgagtgctcccctagatg

SEQ ID NO: 7198395 - DNA, 22 bp, Homo sapiens
aggctgagggctcctgagggca

SEQ ID NO: 7198396 - DNA, 20 bp, Homo sapiens
aggctgagttctatgcactt

SEQ ID NO: 7198397 - DNA, 20 bp, Homo sapiens
aggctgagttctatgcactt

SEQ ID NO: 7198398 - DNA, 22 bp, Homo sapiens
aggctgagtttctcattctcgc

SEQ ID NO: 7198399 - DNA, 22 bp, Homo sapiens
aggctgatgctggctgaggctg

SEQ ID NO: 7198400 - DNA, 22 bp, Homo sapiens
aggctgagtttctcattctcgc

SEQ ID NO: 7198401 - DNA, 22 bp, Homo sapiens
aggctgcaaagtgcttgggtgc

SEQ ID NO: 7198402 - DNA, 22 bp, Homo sapiens
aggctgcaaagtgcttgggtgc

SEQ ID NO: 7198403 - DNA, 19 bp, Homo sapiens
aggctgcaaggtggtgggc

SEQ ID NO: 7198404 - DNA, 19 bp, Homo sapiens
aggctgcaaggtggtgggc

SEQ ID NO: 7198405 - DNA, 18 bp, Homo sapiens
aggctgcactgtcttaaa

SEQ ID NO: 7198406 - DNA, 22 bp, Homo sapiens
aggctgagggctcctgagggca

SEQ ID NO: 7198407 - DNA, 22 bp, Homo sapiens
aggctgagggctcctgagggca

SEQ ID NO: 7198408 - DNA, 22 bp, Homo sapiens
aggctgagggctcctgagggca

SEQ ID NO: 7198409 - DNA, 22 bp, Homo sapiens
aggctgaggctttccttggaga

SEQ ID NO: 7198410 - DNA, 22 bp, Homo sapiens
aggctgaggctttccttggaga

SEQ ID NO: 7198411 - DNA, 22 bp, Homo sapiens
aggctgaggctttccttggaga

SEQ ID NO: 7198412 - DNA, 22 bp, Homo sapiens
aggctgagggctcctgagggca

SEQ ID NO: 7198413 - DNA, 22 bp, Homo sapiens
aggctgagggctcctgagggca

SEQ ID NO: 7198414 - DNA, 22 bp, Homo sapiens
aggctgaggctggcagctccag

SEQ ID NO: 7198415 - DNA, 22 bp, Homo sapiens
aggctgaggatccctgtgttct

SEQ ID NO: 7198416 - DNA, 22 bp, Homo sapiens
acatttcactgttcacagcagg

SEQ ID NO: 7198417 - DNA, 22 bp, Homo sapiens
acatttatataactcactagga

SEQ ID NO: 7198418 - DNA, 22 bp, Homo sapiens
acatttatataactcactagga

SEQ ID NO: 7198419 - DNA, 22 bp, Homo sapiens
acatttatataactcactagga

SEQ ID NO: 7198420 - DNA, 22 bp, Homo sapiens
acatttatataactcactagga

SEQ ID NO: 7198421 - DNA, 18 bp, Homo sapiens
acatttaggagagtcaat

SEQ ID NO: 7198422 - DNA, 22 bp, Homo sapiens
acatttaggatgttttgagaga

SEQ ID NO: 7198423 - DNA, 22 bp, Homo sapiens
acatttagctgtacaatctatg

SEQ ID NO: 7198424 - DNA, 22 bp, Homo sapiens
acatttagagttctttactcca

SEQ ID NO: 7198425 - DNA, 19 bp, Homo sapiens
acatttagaatgtacttgc

SEQ ID NO: 7198426 - DNA, 19 bp, Homo sapiens
acatttagaatgtacttgc

SEQ ID NO: 7198427 - DNA, 22 bp, Homo sapiens
acatttacattttctctggcct

SEQ ID NO: 7198428 - DNA, 22 bp, Homo sapiens
acatttacctagttaagtcaat

SEQ ID NO: 7198429 - DNA, 22 bp, Homo sapiens
acatttacagtgctagacaatc

SEQ ID NO: 7198430 - DNA, 22 bp, Homo sapiens
acatttacagtgctagacaatc

SEQ ID NO: 7198431 - DNA, 22 bp, Homo sapiens
acatttatataactcactagga

SEQ ID NO: 7198432 - DNA, 22 bp, Homo sapiens
acatttatataactcactagga

SEQ ID NO: 7198433 - DNA, 22 bp, Homo sapiens
acatttatataactcactagga

SEQ ID NO: 7198434 - DNA, 22 bp, Homo sapiens
acatttatataactcactagga

SEQ ID NO: 7198435 - DNA, 22 bp, Homo sapiens
acatttatatttagtggggaat

SEQ ID NO: 7198436 - DNA, 22 bp, Homo sapiens
acatttatatttagtggggaat

SEQ ID NO: 7198437 - DNA, 22 bp, Homo sapiens
acatttatatttagtggggaat

SEQ ID NO: 7198438 - DNA, 22 bp, Homo sapiens
acatttattactcaggttgttg

SEQ ID NO: 7198439 - DNA, 22 bp, Homo sapiens
acatttattactcaggttgttg

SEQ ID NO: 7198440 - DNA, 22 bp, Homo sapiens
acatttattactcaggttgttg

SEQ ID NO: 7198441 - DNA, 22 bp, Homo sapiens
acatttattactcaggttgttg

SEQ ID NO: 7198442 - DNA, 22 bp, Homo sapiens
acatttattactcaggttgttg

SEQ ID NO: 7198443 - DNA, 22 bp, Homo sapiens
acatttattttcagctgggaaa

SEQ ID NO: 7198444 - DNA, 22 bp, Homo sapiens
acatttattttcagctgggaaa

SEQ ID NO: 7198445 - DNA, 22 bp, Homo sapiens
acatttattttcagctgggaaa

SEQ ID NO: 7198446 - DNA, 22 bp, Homo sapiens
acatttattttcagctgggaaa

SEQ ID NO: 7198447 - DNA, 22 bp, Homo sapiens
acatttattttcagctgggaaa

SEQ ID NO: 7198448 - DNA, 22 bp, Homo sapiens
acatttattttggcacggcaca

SEQ ID NO: 7198449 - DNA, 22 bp, Homo sapiens
acatttattttggcacggcaca

SEQ ID NO: 7198450 - DNA, 22 bp, Homo sapiens
acatttattttggcacggcaca

SEQ ID NO: 7198451 - DNA, 23 bp, Homo sapiens
acatttcaatactgagggtctga

SEQ ID NO: 7198452 - DNA, 23 bp, Homo sapiens
acatttcaatactgagggtctga

SEQ ID NO: 7198453 - DNA, 23 bp, Homo sapiens
acatttcaatactgagggtctga

SEQ ID NO: 7198454 - DNA, 23 bp, Homo sapiens
acatttcaatactgagggtctga

SEQ ID NO: 7198455 - DNA, 22 bp, Homo sapiens
aggcaggggagctggaagggta

SEQ ID NO: 7198456 - DNA, 22 bp, Homo sapiens
aggcaggggagctggaagggta

SEQ ID NO: 7198457 - DNA, 22 bp, Homo sapiens
aggcaggggagctggaagggta

SEQ ID NO: 7198458 - DNA, 22 bp, Homo sapiens
aggcaggggagctggaagggta

SEQ ID NO: 7198459 - DNA, 22 bp, Homo sapiens
aggcaggggagctggaagggta

SEQ ID NO: 7198460 - DNA, 22 bp, Homo sapiens
aggcagggctgggattagactc

SEQ ID NO: 7198461 - DNA, 22 bp, Homo sapiens
aggcagggctgggattagactc

SEQ ID NO: 7198462 - DNA, 22 bp, Homo sapiens
aggcagggctcatttcttaggc

SEQ ID NO: 7198463 - DNA, 22 bp, Homo sapiens
aggcagggctgggattagactc

SEQ ID NO: 7198464 - DNA, 22 bp, Homo sapiens
aggcagggctgggattagactc

SEQ ID NO: 7198465 - DNA, 22 bp, Homo sapiens
aggcagggctgggattagactc

SEQ ID NO: 7198466 - DNA, 22 bp, Homo sapiens
acatgagaagctgcaacatgac

SEQ ID NO: 7198467 - DNA, 22 bp, Homo sapiens
acatgagacaattgttgatgtt

SEQ ID NO: 7198468 - DNA, 21 bp, Homo sapiens
acatgagacacacatatatgt

SEQ ID NO: 7198469 - DNA, 21 bp, Homo sapiens
acatgagacacacatatatgt

SEQ ID NO: 7198470 - DNA, 22 bp, Homo sapiens
acatgagactgggtttgtaggg

SEQ ID NO: 7198471 - DNA, 22 bp, Homo sapiens
acatgagagaaaagtattctga

SEQ ID NO: 7198472 - DNA, 22 bp, Homo sapiens
acatgaaagttattctgagttg

SEQ ID NO: 7198473 - DNA, 22 bp, Homo sapiens
aggcaggggagctggaagggta

SEQ ID NO: 7198474 - DNA, 22 bp, Homo sapiens
aggcaggggagctggaagggta

SEQ ID NO: 7198475 - DNA, 22 bp, Homo sapiens
aggcaggggagctggaagggta

SEQ ID NO: 7198476 - DNA, 22 bp, Homo sapiens
aggcaggggagctggaagggta

SEQ ID NO: 7198477 - DNA, 22 bp, Homo sapiens
aggcaggcagggctcactgtct

SEQ ID NO: 7198478 - DNA, 22 bp, Homo sapiens
aggcaggcagggctcactgtct

SEQ ID NO: 7198479 - DNA, 17 bp, Homo sapiens
aggcaggcagagcggga

SEQ ID NO: 7198480 - DNA, 22 bp, Homo sapiens
aggcaggcagctgtcaccactc

SEQ ID NO: 7198481 - DNA, 22 bp, Homo sapiens
aggcaggcagctgtcaccactc

SEQ ID NO: 7198482 - DNA, 22 bp, Homo sapiens
aggcaggcagctgtcaccactc

SEQ ID NO: 7198483 - DNA, 17 bp, Homo sapiens
aggcaggcagagcggga

SEQ ID NO: 7198484 - DNA, 17 bp, Homo sapiens
aggcaggcagagcggga

SEQ ID NO: 7198485 - DNA, 17 bp, Homo sapiens
aggcaggcagagcggga

SEQ ID NO: 7198486 - DNA, 17 bp, Homo sapiens
aggcaggcagagcggga

SEQ ID NO: 7198487 - DNA, 17 bp, Homo sapiens
aggcaggcagagcggga

SEQ ID NO: 7198488 - DNA, 22 bp, Homo sapiens
aggcaggcactccggaagtgtc

SEQ ID NO: 7198489 - DNA, 22 bp, Homo sapiens
aggcagggctcatttcttaggc

SEQ ID NO: 7198490 - DNA, 22 bp, Homo sapiens
aggcagggctcatttcttaggc

SEQ ID NO: 7198491 - DNA, 22 bp, Homo sapiens
aggcagggctcatttcttaggc

SEQ ID NO: 7198492 - DNA, 22 bp, Homo sapiens
aggcagggctcatttcttaggc

SEQ ID NO: 7198493 - DNA, 22 bp, Homo sapiens
aggcagggctcatttcttaggc

SEQ ID NO: 7198494 - DNA, 22 bp, Homo sapiens
aggcagggaccagttgttttct

SEQ ID NO: 7198495 - DNA, 23 bp, Homo sapiens
aggcaggcagttcagctgttgtt

SEQ ID NO: 7198496 - DNA, 23 bp, Homo sapiens
aggcaggcagttcagctgttgtt

SEQ ID NO: 7198497 - DNA, 23 bp, Homo sapiens
aggcaggcagttcagctgttgtt

SEQ ID NO: 7198498 - DNA, 22 bp, Homo sapiens
aggcaggctggtctgaagagtg

SEQ ID NO: 7198499 - DNA, 22 bp, Homo sapiens
aggcaggctggtctgaagagtg

SEQ ID NO: 7198500 - DNA, 22 bp, Homo sapiens
aggcagggaccagttgttttct

SEQ ID NO: 7198501 - DNA, 22 bp, Homo sapiens
aggcagggaccagttgttttct

SEQ ID NO: 7198502 - DNA, 22 bp, Homo sapiens
aggcagggaccagttgttttct

SEQ ID NO: 7198503 - DNA, 22 bp, Homo sapiens
acatgagaaagcaggttagcaa

SEQ ID NO: 7198504 - DNA, 22 bp, Homo sapiens
acatgagaggctgtggagtaca

SEQ ID NO: 7198505 - DNA, 16 bp, Homo sapiens
acatgagataatgcta

SEQ ID NO: 7198506 - DNA, 22 bp, Homo sapiens
acatgagatcacaaagataaat

SEQ ID NO: 7198507 - DNA, 22 bp, Homo sapiens
acatgagattagctcacccact

SEQ ID NO: 7198508 - DNA, 22 bp, Homo sapiens
acatgagatggtggggatccct

SEQ ID NO: 7198509 - DNA, 22 bp, Homo sapiens
acatgagatttgggtggtgata

SEQ ID NO: 7198510 - DNA, 22 bp, Homo sapiens
acatgaggaactcaggagtcac

SEQ ID NO: 7198511 - DNA, 22 bp, Homo sapiens
acatgaggtgctataggtctac

SEQ ID NO: 7198512 - DNA, 22 bp, Homo sapiens
acatgatatatgggaaatgctt

SEQ ID NO: 7198513 - DNA, 22 bp, Homo sapiens
acatgatcttatgtagaagatc

SEQ ID NO: 7198514 - DNA, 22 bp, Homo sapiens
acatgatttgcatgatttgtaa

SEQ ID NO: 7198515 - DNA, 22 bp, Homo sapiens
acatgatttttaaagagataat

SEQ ID NO: 7198516 - DNA, 23 bp, Homo sapiens
acatgcaaaaatcacagtctcct

SEQ ID NO: 7198517 - DNA, 22 bp, Homo sapiens
acatgcaaagccacaggacccg

SEQ ID NO: 7198518 - DNA, 22 bp, Homo sapiens
acatgcaaagggatgcaattat

SEQ ID NO: 7198519 - DNA, 22 bp, Homo sapiens
acatgcaaatgtgcatgcatgt

SEQ ID NO: 7198520 - DNA, 22 bp, Homo sapiens
acatgcaaatgtgcatgcatgt

SEQ ID NO: 7198521 - DNA, 22 bp, Homo sapiens
acatgcaaatgtgcatgcatgt

SEQ ID NO: 7198522 - DNA, 22 bp, Homo sapiens
acatgcaacaaagtacctgcaa

SEQ ID NO: 7198523 - DNA, 22 bp, Homo sapiens
acatgcaagcccctgaacacat

SEQ ID NO: 7198524 - DNA, 19 bp, Homo sapiens
acatgcaaggcacctgcag

SEQ ID NO: 7198525 - DNA, 22 bp, Homo sapiens
acatgcacacctatatacatgt

SEQ ID NO: 7198526 - DNA, 22 bp, Homo sapiens
acatgcacacctatatacatgt

SEQ ID NO: 7198527 - DNA, 22 bp, Homo sapiens
acatgcacacgattcagtctgg

SEQ ID NO: 7198528 - DNA, 22 bp, Homo sapiens
acatgcacacgattcagtctgg

SEQ ID NO: 7198529 - DNA, 22 bp, Homo sapiens
acatgcacccagggcattgctt

SEQ ID NO: 7198530 - DNA, 22 bp, Homo sapiens
aggcctgcctggagcctggctg

SEQ ID NO: 7198531 - DNA, 19 bp, Homo sapiens
acatggcatcccaggaggt

SEQ ID NO: 7198532 - DNA, 19 bp, Homo sapiens
acatggcatcccaggaggt

SEQ ID NO: 7198533 - DNA, 19 bp, Homo sapiens
acatggcatcccaggaggt

SEQ ID NO: 7198534 - DNA, 22 bp, Homo sapiens
acatggcattcactcccacagg

SEQ ID NO: 7198535 - DNA, 20 bp, Homo sapiens
acatggcattcccacgtggt

SEQ ID NO: 7198536 - DNA, 22 bp, Homo sapiens
acatggcacccagatctcaaaa

SEQ ID NO: 7198537 - DNA, 22 bp, Homo sapiens
acatggcagctgatgattggaa

SEQ ID NO: 7198538 - DNA, 22 bp, Homo sapiens
acatggcaggaatcatgtgttt

SEQ ID NO: 7198539 - DNA, 22 bp, Homo sapiens
acatggcaggaatcatgtgttt

SEQ ID NO: 7198540 - DNA, 17 bp, Homo sapiens
acatggcagttcacgct

SEQ ID NO: 7198541 - DNA, 19 bp, Homo sapiens
acatggcatcccaggaggt

SEQ ID NO: 7198542 - DNA, 22 bp, Homo sapiens
acatggagactctaccagaaaa

SEQ ID NO: 7198543 - DNA, 21 bp, Homo sapiens
acatggatataggactgaatt

SEQ ID NO: 7198544 - DNA, 22 bp, Homo sapiens
acatggattgttttaaaagatg

SEQ ID NO: 7198545 - DNA, 22 bp, Homo sapiens
acatggcaaaaccccgtttcta

SEQ ID NO: 7198546 - DNA, 22 bp, Homo sapiens
acatggatgaattgtctagtgg

SEQ ID NO: 7198547 - DNA, 22 bp, Homo sapiens
acatggcaaaagggactttaca

SEQ ID NO: 7198548 - DNA, 22 bp, Homo sapiens
acatggcaaaagggactttaca

SEQ ID NO: 7198549 - DNA, 22 bp, Homo sapiens
acatggcacccagatctcaaaa

SEQ ID NO: 7198550 - DNA, 22 bp, Homo sapiens
acatggagaccagatggaagta

SEQ ID NO: 7198551 - DNA, 22 bp, Homo sapiens
acatggagactctaccagaaaa

SEQ ID NO: 7198552 - DNA, 22 bp, Homo sapiens
acatggagctcaaacatgagtg

SEQ ID NO: 7198553 - DNA, 22 bp, Homo sapiens
acatggaatgtgtactaagtta

SEQ ID NO: 7198554 - DNA, 21 bp, Homo sapiens
acatggactgtgaatggggac

SEQ ID NO: 7198555 - DNA, 22 bp, Homo sapiens
acatggaagcaaagttctattt

SEQ ID NO: 7198556 - DNA, 20 bp, Homo sapiens
acatggaaggtcaaactatc

SEQ ID NO: 7198557 - DNA, 20 bp, Homo sapiens
acatggaaggtcaaactatc

SEQ ID NO: 7198558 - DNA, 22 bp, Homo sapiens
acatggaatgtgtactaagtta

SEQ ID NO: 7198559 - DNA, 22 bp, Homo sapiens
acatggaaagtactccacaatt

SEQ ID NO: 7198560 - DNA, 22 bp, Homo sapiens
acatggaagataaaaatactca

SEQ ID NO: 7198561 - DNA, 22 bp, Homo sapiens
acatggaagataaaaatactca

SEQ ID NO: 7198562 - DNA, 22 bp, Homo sapiens
acatggaagataaaaatactca

SEQ ID NO: 7198563 - DNA, 22 bp, Homo sapiens
aggcccttcttggtggctcagg

SEQ ID NO: 7198564 - DNA, 22 bp, Homo sapiens
aggcccttcttggtggctcagg

SEQ ID NO: 7198565 - DNA, 22 bp, Homo sapiens
aggcccttggactcatgctcga

SEQ ID NO: 7198566 - DNA, 22 bp, Homo sapiens
aggcccttggactcatgctcga

SEQ ID NO: 7198567 - DNA, 22 bp, Homo sapiens
aggccctgttatgagccactgt

SEQ ID NO: 7198568 - DNA, 22 bp, Homo sapiens
aggccctgttgtagcattttgg

SEQ ID NO: 7198569 - DNA, 22 bp, Homo sapiens
aggcccttggactcatgctcga

SEQ ID NO: 7198570 - DNA, 22 bp, Homo sapiens
aggcccttggagtagaggctga

SEQ ID NO: 7198571 - DNA, 22 bp, Homo sapiens
aggcccttggagtagaggctga

SEQ ID NO: 7198572 - DNA, 22 bp, Homo sapiens
aggccgaagtggatgggcatct

SEQ ID NO: 7198573 - DNA, 22 bp, Homo sapiens
acatggaaaactaactgctttt

SEQ ID NO: 7198574 - DNA, 22 bp, Homo sapiens
acatggaaaactaactgctttt

SEQ ID NO: 7198575 - DNA, 22 bp, Homo sapiens
aggccctgttatgagccactgt

SEQ ID NO: 7198576 - DNA, 22 bp, Homo sapiens
aggccctgttatgagccactgt

SEQ ID NO: 7198577 - DNA, 20 bp, Homo sapiens
aggccctgtgcatcttgttt

SEQ ID NO: 7198578 - DNA, 20 bp, Homo sapiens
aggccctgtgcatcttgttt

SEQ ID NO: 7198579 - DNA, 22 bp, Homo sapiens
aggccctgttatgagccactgt

SEQ ID NO: 7198580 - DNA, 22 bp, Homo sapiens
aggccctgttatgagccactgt

SEQ ID NO: 7198581 - DNA, 22 bp, Homo sapiens
aggccctgttatgagccactgt

SEQ ID NO: 7198582 - DNA, 22 bp, Homo sapiens
aggccctgttatgagccactgt

SEQ ID NO: 7198583 - DNA, 22 bp, Homo sapiens
aggccctgtccatggtgctgaa

SEQ ID NO: 7198584 - DNA, 22 bp, Homo sapiens
aggccctgtccatggtgctgaa

SEQ ID NO: 7198585 - DNA, 22 bp, Homo sapiens
aggccctgtccatggtgctgaa

SEQ ID NO: 7198586 - DNA, 22 bp, Homo sapiens
aggccctgtccatggtgctgaa

SEQ ID NO: 7198587 - DNA, 22 bp, Homo sapiens
aggccctgtccatggtgctgaa

SEQ ID NO: 7198588 - DNA, 22 bp, Homo sapiens
aggccctgtccatggtgctgaa

SEQ ID NO: 7198589 - DNA, 22 bp, Homo sapiens
aggccctggtcaggtctggctg

SEQ ID NO: 7198590 - DNA, 22 bp, Homo sapiens
aggccctggtcaggtctggctg

SEQ ID NO: 7198591 - DNA, 22 bp, Homo sapiens
aggccctggtcaggtctggctg

SEQ ID NO: 7198592 - DNA, 22 bp, Homo sapiens
aggccctggtcaggtctggctg

SEQ ID NO: 7198593 - DNA, 22 bp, Homo sapiens
aggccctgcccagagctcctcg

SEQ ID NO: 7198594 - DNA, 22 bp, Homo sapiens
aggccctgcccagagctcctcg

SEQ ID NO: 7198595 - DNA, 22 bp, Homo sapiens
aggccctgcccagagctcctcg

SEQ ID NO: 7198596 - DNA, 22 bp, Homo sapiens
aggccctgcccagagctcctcg

SEQ ID NO: 7198597 - DNA, 22 bp, Homo sapiens
aggccctgtaaggtgtggagat

SEQ ID NO: 7198598 - DNA, 22 bp, Homo sapiens
aggccctgtaaggtgtggagat

SEQ ID NO: 7198599 - DNA, 22 bp, Homo sapiens
aggccctgtaaggtgtggagat

SEQ ID NO: 7198600 - DNA, 22 bp, Homo sapiens
aggccctgtaaggtgtggagat

SEQ ID NO: 7198601 - DNA, 22 bp, Homo sapiens
aggccctgtaaggtgtggagat

SEQ ID NO: 7198602 - DNA, 22 bp, Homo sapiens
acatgcaggaaaatgcacagat

SEQ ID NO: 7198603 - DNA, 22 bp, Homo sapiens
acatgcagaattcttagagagc

SEQ ID NO: 7198604 - DNA, 22 bp, Homo sapiens
acatgcagaattcttagagagc

SEQ ID NO: 7198605 - DNA, 22 bp, Homo sapiens
acatgcagaattcttagagagc

SEQ ID NO: 7198606 - DNA, 22 bp, Homo sapiens
acatgcagaattcttagagagc

SEQ ID NO: 7198607 - DNA, 22 bp, Homo sapiens
acatgcacggcaccatcttctg

SEQ ID NO: 7198608 - DNA, 22 bp, Homo sapiens
acatgcaggtgatctggtcaat

SEQ ID NO: 7198609 - DNA, 22 bp, Homo sapiens
acatgcagtgaggatcttagaa

SEQ ID NO: 7198610 - DNA, 22 bp, Homo sapiens
acatgcagtgagtagttctcca

SEQ ID NO: 7198611 - DNA, 22 bp, Homo sapiens
acatgcagtgagtagttctcca

SEQ ID NO: 7198612 - DNA, 20 bp, Homo sapiens
acatgcagtggtcatttcag

SEQ ID NO: 7198613 - DNA, 20 bp, Homo sapiens
acatgcagtggtcatttcag

SEQ ID NO: 7198614 - DNA, 22 bp, Homo sapiens
acatgcataaactacttcttat

SEQ ID NO: 7198615 - DNA, 22 bp, Homo sapiens
acatgcataaactacttcttat

SEQ ID NO: 7198616 - DNA, 22 bp, Homo sapiens
acatgcataaactacttcttat

SEQ ID NO: 7198617 - DNA, 22 bp, Homo sapiens
acatgcataagcctagccatca

SEQ ID NO: 7198618 - DNA, 20 bp, Homo sapiens
aggccctgccagggacggag

SEQ ID NO: 7198619 - DNA, 20 bp, Homo sapiens
aggccctgccagggacggag

SEQ ID NO: 7198620 - DNA, 20 bp, Homo sapiens
aggccctgccagggacggag

SEQ ID NO: 7198621 - DNA, 22 bp, Homo sapiens
agggcctggttctgtgtaggga

SEQ ID NO: 7198622 - DNA, 22 bp, Homo sapiens
agggcctggtgacctgggtcct

SEQ ID NO: 7198623 - DNA, 22 bp, Homo sapiens
agggcctggttctgtgtaggga

SEQ ID NO: 7198624 - DNA, 22 bp, Homo sapiens
accccaggaagtggaggtcatg

SEQ ID NO: 7198625 - DNA, 22 bp, Homo sapiens
accccaggaagtggaggtcatg

SEQ ID NO: 7198626 - DNA, 22 bp, Homo sapiens
accccaggaagtggaggtcatg

SEQ ID NO: 7198627 - DNA, 22 bp, Homo sapiens
acccgatgttggtgctctagta

SEQ ID NO: 7198628 - DNA, 22 bp, Homo sapiens
agggcctggtgacctgggtcct

SEQ ID NO: 7198629 - DNA, 22 bp, Homo sapiens
agggcctggtgacctgggtcct

SEQ ID NO: 7198630 - DNA, 22 bp, Homo sapiens
agggcctggtgacctgggtcct

SEQ ID NO: 7198631 - DNA, 22 bp, Homo sapiens
agggcctggggtagcttactgc

SEQ ID NO: 7198632 - DNA, 22 bp, Homo sapiens
acccgggaggcaggagtcatag

SEQ ID NO: 7198633 - DNA, 22 bp, Homo sapiens
acccgccgcacgtccaggctga

SEQ ID NO: 7198634 - DNA, 22 bp, Homo sapiens
acccgggaggcaggagtcatag

SEQ ID NO: 7198635 - DNA, 22 bp, Homo sapiens
accctaataatcacagactagt

SEQ ID NO: 7198636 - DNA, 22 bp, Homo sapiens
accctactaaatgtggtatgtc

SEQ ID NO: 7198637 - DNA, 22 bp, Homo sapiens
accctagacattgaactagggt

SEQ ID NO: 7198638 - DNA, 22 bp, Homo sapiens
accctcaacaaattcactctat

SEQ ID NO: 7198639 - DNA, 22 bp, Homo sapiens
accctcaacaaattcactctat

SEQ ID NO: 7198640 - DNA, 22 bp, Homo sapiens
accctcaacaaattcactctat

SEQ ID NO: 7198641 - DNA, 22 bp, Homo sapiens
accctcaacaaattcactctat

SEQ ID NO: 7198642 - DNA, 22 bp, Homo sapiens
accctagttggttgtagaagga

SEQ ID NO: 7198643 - DNA, 22 bp, Homo sapiens
accctcaacaaattcactctat

SEQ ID NO: 7198644 - DNA, 22 bp, Homo sapiens
accctcaagatggaagcagttt

SEQ ID NO: 7198645 - DNA, 16 bp, Homo sapiens
accctcagaaactgct

SEQ ID NO: 7198646 - DNA, 22 bp, Homo sapiens
accctcagacagctgtggccag

SEQ ID NO: 7198647 - DNA, 22 bp, Homo sapiens
accctcagacagctgtggccag

SEQ ID NO: 7198648 - DNA, 22 bp, Homo sapiens
accctcagacagctgtggccag

SEQ ID NO: 7198649 - DNA, 22 bp, Homo sapiens
accctcagacatattccatcat

SEQ ID NO: 7198650 - DNA, 22 bp, Homo sapiens
agggcctgggccagcacccttt

SEQ ID NO: 7198651 - DNA, 22 bp, Homo sapiens
agggcctgggaagaggaaccct

SEQ ID NO: 7198652 - DNA, 22 bp, Homo sapiens
acccaggctggagtgcagtgac

SEQ ID NO: 7198653 - DNA, 22 bp, Homo sapiens
acccaggctggagtgcagtagc

SEQ ID NO: 7198654 - DNA, 22 bp, Homo sapiens
agggcctgggaagaggaaccct

SEQ ID NO: 7198655 - DNA, 17 bp, Homo sapiens
acccaggctctatcttg

SEQ ID NO: 7198656 - DNA, 22 bp, Homo sapiens
acccaggctgcttctcagtggc

SEQ ID NO: 7198657 - DNA, 22 bp, Homo sapiens
acccaggctgcttctcagtggc

SEQ ID NO: 7198658 - DNA, 22 bp, Homo sapiens
acccaggctagggtgcagtggc

SEQ ID NO: 7198659 - DNA, 18 bp, Homo sapiens
acccaggctcatggtcct

SEQ ID NO: 7198660 - DNA, 18 bp, Homo sapiens
acccaggctcatggtcct

SEQ ID NO: 7198661 - DNA, 17 bp, Homo sapiens
acccaggctctatcttg

SEQ ID NO: 7198662 - DNA, 22 bp, Homo sapiens
acccaggctagagtgcagtggt

SEQ ID NO: 7198663 - DNA, 22 bp, Homo sapiens
acccaggcgggagtgcagtgtc

SEQ ID NO: 7198664 - DNA, 22 bp, Homo sapiens
acccaggcctgagagacaggag

SEQ ID NO: 7198665 - DNA, 22 bp, Homo sapiens
acccaaagcaatattcatcagt

SEQ ID NO: 7198666 - DNA, 22 bp, Homo sapiens
accatttgactctctaaggata

SEQ ID NO: 7198667 - DNA, 22 bp, Homo sapiens
accatttactcccattggaagt

SEQ ID NO: 7198668 - DNA, 22 bp, Homo sapiens
accatttactcccattggaagt

SEQ ID NO: 7198669 - DNA, 22 bp, Homo sapiens
accatttagtaagtatacctgg

SEQ ID NO: 7198670 - DNA, 22 bp, Homo sapiens
accatttatcaagcacctgtga

SEQ ID NO: 7198671 - DNA, 22 bp, Homo sapiens
accatttatcaagcacctgtga

SEQ ID NO: 7198672 - DNA, 22 bp, Homo sapiens
acccacacatctctaattcagt

SEQ ID NO: 7198673 - DNA, 22 bp, Homo sapiens
acccacacctccgtatatcact

SEQ ID NO: 7198674 - DNA, 22 bp, Homo sapiens
agggcagtgggaaagcctgctc

SEQ ID NO: 7198675 - DNA, 20 bp, Homo sapiens
agggcagcttgaggagccgg

SEQ ID NO: 7198676 - DNA, 20 bp, Homo sapiens
agggcagcttgaggagccgg

SEQ ID NO: 7198677 - DNA, 20 bp, Homo sapiens
agggcagcttgaggagccgg

SEQ ID NO: 7198678 - DNA, 20 bp, Homo sapiens
agggcagcttgaggagccgg

SEQ ID NO: 7198679 - DNA, 20 bp, Homo sapiens
agggcagcttgaggagccgg

SEQ ID NO: 7198680 - DNA, 22 bp, Homo sapiens
agggcagcttccatagtctggc

SEQ ID NO: 7198681 - DNA, 20 bp, Homo sapiens
agggcagcttgaggagccgg

SEQ ID NO: 7198682 - DNA, 20 bp, Homo sapiens
agggcagcttgaggagccgg

SEQ ID NO: 7198683 - DNA, 22 bp, Homo sapiens
acccacagaacctgtgacaaca

SEQ ID NO: 7198684 - DNA, 23 bp, Homo sapiens
agggcatgaagcagaggacgtgg

SEQ ID NO: 7198685 - DNA, 22 bp, Homo sapiens
agggcatgaaatgggcagaagc

SEQ ID NO: 7198686 - DNA, 22 bp, Homo sapiens
agggcatgaaatgggcagaagc

SEQ ID NO: 7198687 - DNA, 22 bp, Homo sapiens
agggcatgaaatgggcagaagc

SEQ ID NO: 7198688 - DNA, 22 bp, Homo sapiens
agggcatctagttccctctctt

SEQ ID NO: 7198689 - DNA, 22 bp, Homo sapiens
agggcatctagttccctctctt

SEQ ID NO: 7198690 - DNA, 22 bp, Homo sapiens
agggcatctctaacagtctcct

SEQ ID NO: 7198691 - DNA, 22 bp, Homo sapiens
agggcatctctaacagtctcct

SEQ ID NO: 7198692 - DNA, 22 bp, Homo sapiens
agggcagtgtggtgggactgac

SEQ ID NO: 7198693 - DNA, 22 bp, Homo sapiens
agggcagttcaacttcatagtg

SEQ ID NO: 7198694 - DNA, 22 bp, Homo sapiens
agggcagttcagccacaggctc

SEQ ID NO: 7198695 - DNA, 22 bp, Homo sapiens
agggcagttcagccacaggctc

SEQ ID NO: 7198696 - DNA, 22 bp, Homo sapiens
agggcagttcagccacaggctc

SEQ ID NO: 7198697 - DNA, 22 bp, Homo sapiens
agggcatctagttccctctctt

SEQ ID NO: 7198698 - DNA, 23 bp, Homo sapiens
agggcatgaagcagaggacgtgg

SEQ ID NO: 7198699 - DNA, 23 bp, Homo sapiens
agggcatgaagcagaggacgtgg

SEQ ID NO: 7198700 - DNA, 23 bp, Homo sapiens
agggcatgaagcagaggacgtgg

SEQ ID NO: 7198701 - DNA, 22 bp, Homo sapiens
agggcatgaagcagtggacagc

SEQ ID NO: 7198702 - DNA, 22 bp, Homo sapiens
agggcatgaagcagtggacagc

SEQ ID NO: 7198703 - DNA, 22 bp, Homo sapiens
acccaggagcaggctgggcagt

SEQ ID NO: 7198704 - DNA, 22 bp, Homo sapiens
acccaggagcaggctgggcagt

SEQ ID NO: 7198705 - DNA, 22 bp, Homo sapiens
acccaggagcaggctgggcagt

SEQ ID NO: 7198706 - DNA, 22 bp, Homo sapiens
acccaggagcaggctgggcagt

SEQ ID NO: 7198707 - DNA, 22 bp, Homo sapiens
acccaggcctgagagacaggag

SEQ ID NO: 7198708 - DNA, 22 bp, Homo sapiens
accattgatataactcagtctc

SEQ ID NO: 7198709 - DNA, 22 bp, Homo sapiens
accattgcactctagcctgggc

SEQ ID NO: 7198710 - DNA, 22 bp, Homo sapiens
accattgccccctagtgtctgt

SEQ ID NO: 7198711 - DNA, 22 bp, Homo sapiens
accatttaaggaaaatgtatca

SEQ ID NO: 7198712 - DNA, 22 bp, Homo sapiens
accatttaaaattgatgccttc

SEQ ID NO: 7198713 - DNA, 22 bp, Homo sapiens
accatttaaggaaaatgtatca

SEQ ID NO: 7198714 - DNA, 22 bp, Homo sapiens
accatttaaggaaaatgtatca

SEQ ID NO: 7198715 - DNA, 22 bp, Homo sapiens
accatttaataagtatttccat

SEQ ID NO: 7198716 - DNA, 22 bp, Homo sapiens
accatgttggccaagctggtct

SEQ ID NO: 7198717 - DNA, 20 bp, Homo sapiens
accattaatgtaagctttgt

SEQ ID NO: 7198718 - DNA, 22 bp, Homo sapiens
agggagctatttcagggttatt

SEQ ID NO: 7198719 - DNA, 22 bp, Homo sapiens
agggagctcacagtccagtaga

SEQ ID NO: 7198720 - DNA, 22 bp, Homo sapiens
agggagctcacagtccagtaga

SEQ ID NO: 7198721 - DNA, 22 bp, Homo sapiens
agggagctcacagtccagtaga

SEQ ID NO: 7198722 - DNA, 22 bp, Homo sapiens
agggagctcagttggaagcggt

SEQ ID NO: 7198723 - DNA, 22 bp, Homo sapiens
agggagctcgatgcctgagtgt

SEQ ID NO: 7198724 - DNA, 22 bp, Homo sapiens
agggagctcgatgcctgagtgt

SEQ ID NO: 7198725 - DNA, 22 bp, Homo sapiens
agggagctcgatgcctgagtgt

SEQ ID NO: 7198726 - DNA, 22 bp, Homo sapiens
agggagctcgatgcctgagtgt

SEQ ID NO: 7198727 - DNA, 22 bp, Homo sapiens
agggagctcgatgcctgagtgt

SEQ ID NO: 7198728 - DNA, 22 bp, Homo sapiens
agggagctctaagtagagggac

SEQ ID NO: 7198729 - DNA, 22 bp, Homo sapiens
agggagctctaagtagagggac

SEQ ID NO: 7198730 - DNA, 22 bp, Homo sapiens
agggagctctaagtagagggac

SEQ ID NO: 7198731 - DNA, 22 bp, Homo sapiens
agggagctctaagtagagggac

SEQ ID NO: 7198732 - DNA, 22 bp, Homo sapiens
agggagctctgggggcacacgg

SEQ ID NO: 7198733 - DNA, 22 bp, Homo sapiens
agggagctctgggggcacacgg

SEQ ID NO: 7198734 - DNA, 22 bp, Homo sapiens
agggagctctgggggcacacgg

SEQ ID NO: 7198735 - DNA, 22 bp, Homo sapiens
agggagctctgggggcacacgg

SEQ ID NO: 7198736 - DNA, 22 bp, Homo sapiens
agggagctctgggggcacacgg

SEQ ID NO: 7198737 - DNA, 22 bp, Homo sapiens
agggagctctttggtcttgccg

SEQ ID NO: 7198738 - DNA, 22 bp, Homo sapiens
agggagctctttggtcttgccg

SEQ ID NO: 7198739 - DNA, 22 bp, Homo sapiens
agggagctgactggctgccatt

SEQ ID NO: 7198740 - DNA, 22 bp, Homo sapiens
accatcagtactggatgctgac

SEQ ID NO: 7198741 - DNA, 22 bp, Homo sapiens
aggctgcagaacagtcaggtgc

SEQ ID NO: 7198742 - DNA, 22 bp, Homo sapiens
aggctgcagaacagtcaggtgc

SEQ ID NO: 7198743 - DNA, 22 bp, Homo sapiens
acatttgtgcaacgtatccaca

SEQ ID NO: 7198744 - DNA, 22 bp, Homo sapiens
acatttttactgggcatctgca

SEQ ID NO: 7198745 - DNA, 22 bp, Homo sapiens
accaaaaagatatgttgaagcc

SEQ ID NO: 7198746 - DNA, 22 bp, Homo sapiens
accaaaaattgtggggctgaat

SEQ ID NO: 7198747 - DNA, 22 bp, Homo sapiens
accaaaaagatatgttgaagcc

SEQ ID NO: 7198748 - DNA, 22 bp, Homo sapiens
acatttttgggttgatgtctga

SEQ ID NO: 7198749 - DNA, 21 bp, Homo sapiens
accaaaacctatactttctgt

SEQ ID NO: 7198750 - DNA, 21 bp, Homo sapiens
accaaaacctatactttctgt

SEQ ID NO: 7198751 - DNA, 21 bp, Homo sapiens
accaaaacctatactttctgt

SEQ ID NO: 7198752 - DNA, 22 bp, Homo sapiens
accaaaacctgctactaaagga

SEQ ID NO: 7198753 - DNA, 22 bp, Homo sapiens
accaaaacctgctactaaagga

SEQ ID NO: 7198754 - DNA, 22 bp, Homo sapiens
accaaaacctgctactaaagga

SEQ ID NO: 7198755 - DNA, 22 bp, Homo sapiens
accaaacaaaattgtgcactgt

SEQ ID NO: 7198756 - DNA, 22 bp, Homo sapiens
accaaacaaaattgtgcactgt

SEQ ID NO: 7198757 - DNA, 19 bp, Homo sapiens
accaaacagtggacggagc

SEQ ID NO: 7198758 - DNA, 22 bp, Homo sapiens
accaaacttctgggctcctttg

SEQ ID NO: 7198759 - DNA, 22 bp, Homo sapiens
accaaagcgagtgatatgtcat

SEQ ID NO: 7198760 - DNA, 19 bp, Homo sapiens
accaaaggagtggggtata

SEQ ID NO: 7198761 - DNA, 19 bp, Homo sapiens
accaaaggagtggggtata

SEQ ID NO: 7198762 - DNA, 22 bp, Homo sapiens
accaaagcgagtgatatgtcat

SEQ ID NO: 7198763 - DNA, 22 bp, Homo sapiens
aggctggagtgtgcagtggcgc

SEQ ID NO: 7198764 - DNA, 22 bp, Homo sapiens
agggaagaatcactgggatgtt

SEQ ID NO: 7198765 - DNA, 22 bp, Homo sapiens
agggaagagcttgcaagaaacc

SEQ ID NO: 7198766 - DNA, 22 bp, Homo sapiens
agggaagagcttgcaagaaacc

SEQ ID NO: 7198767 - DNA, 22 bp, Homo sapiens
agggaagagcttgcaagaaacc

SEQ ID NO: 7198768 - DNA, 22 bp, Homo sapiens
agggaagagcttgcaagaaacc

SEQ ID NO: 7198769 - DNA, 22 bp, Homo sapiens
agggaagagcttgcaagaaacc

SEQ ID NO: 7198770 - DNA, 22 bp, Homo sapiens
agggaagaggaccagagtctct

SEQ ID NO: 7198771 - DNA, 22 bp, Homo sapiens
agggaagaggaccagagtctct

SEQ ID NO: 7198772 - DNA, 22 bp, Homo sapiens
agggaagaggaccagagtctct

SEQ ID NO: 7198773 - DNA, 22 bp, Homo sapiens
agggaagaatcactgggatgtt

SEQ ID NO: 7198774 - DNA, 22 bp, Homo sapiens
agggaagaatcactgggatgtt

SEQ ID NO: 7198775 - DNA, 22 bp, Homo sapiens
agggaagaatcactgggatgtt

SEQ ID NO: 7198776 - DNA, 22 bp, Homo sapiens
aggctggcagccacctcagcag

SEQ ID NO: 7198777 - DNA, 22 bp, Homo sapiens
aggctggcagccacctcagcag

SEQ ID NO: 7198778 - DNA, 22 bp, Homo sapiens
aggctggcagccacctcagcag

SEQ ID NO: 7198779 - DNA, 20 bp, Homo sapiens
aggctggcactcctggccag

SEQ ID NO: 7198780 - DNA, 20 bp, Homo sapiens
aggctggcactcctggccag

SEQ ID NO: 7198781 - DNA, 22 bp, Homo sapiens
aggctggcagccacctcagcag

SEQ ID NO: 7198782 - DNA, 20 bp, Homo sapiens
aggctggcactcctggccag

SEQ ID NO: 7198783 - DNA, 20 bp, Homo sapiens
aggctggcactcctggccag

SEQ ID NO: 7198784 - DNA, 22 bp, Homo sapiens
aggctggcaaggcagatgtgtg

SEQ ID NO: 7198785 - DNA, 22 bp, Homo sapiens
aggctggcaaggcagatgtgtg

SEQ ID NO: 7198786 - DNA, 22 bp, Homo sapiens
aggctggagtgtgcagtggcgc

SEQ ID NO: 7198787 - DNA, 22 bp, Homo sapiens
aggctggagtgtgcagtggcgc

SEQ ID NO: 7198788 - DNA, 22 bp, Homo sapiens
aggctggagtgtgcagtggcgc

SEQ ID NO: 7198789 - DNA, 22 bp, Homo sapiens
aggctggatttatggggacttc

SEQ ID NO: 7198790 - DNA, 22 bp, Homo sapiens
aggctggatttatggggacttc

SEQ ID NO: 7198791 - DNA, 22 bp, Homo sapiens
aggctggatctctgttgccttc

SEQ ID NO: 7198792 - DNA, 22 bp, Homo sapiens
aggctggatctctgttgccttc

SEQ ID NO: 7198793 - DNA, 19 bp, Homo sapiens
aggctggatgcccatctta

SEQ ID NO: 7198794 - DNA, 22 bp, Homo sapiens
agggaagccaagccttagagaa

SEQ ID NO: 7198795 - DNA, 22 bp, Homo sapiens
agggaagccccgaggaggcacc

SEQ ID NO: 7198796 - DNA, 22 bp, Homo sapiens
agggaagccccgaggaggcacc

SEQ ID NO: 7198797 - DNA, 22 bp, Homo sapiens
agggaagccctggctgagaccc

SEQ ID NO: 7198798 - DNA, 22 bp, Homo sapiens
agggaagcttgttactgagaag

SEQ ID NO: 7198799 - DNA, 22 bp, Homo sapiens
agggaatgtagcaagatgccaa

SEQ ID NO: 7198800 - DNA, 22 bp, Homo sapiens
agggaagaggaccagagtctct

SEQ ID NO: 7198801 - DNA, 22 bp, Homo sapiens
agggaagaggaccagagtctct

SEQ ID NO: 7198802 - DNA, 22 bp, Homo sapiens
agggacagatgaatgactgagt

SEQ ID NO: 7198803 - DNA, 22 bp, Homo sapiens
agggacagatgaatgactgagt

SEQ ID NO: 7198804 - DNA, 22 bp, Homo sapiens
agggacagatgaatgactgagt

SEQ ID NO: 7198805 - DNA, 22 bp, Homo sapiens
agggacagatgaatgactgagt

SEQ ID NO: 7198806 - DNA, 22 bp, Homo sapiens
agggacactgatgagaaattct

SEQ ID NO: 7198807 - DNA, 22 bp, Homo sapiens
agggacacttgctttcaggccc

SEQ ID NO: 7198808 - DNA, 22 bp, Homo sapiens
agggacacttgctttcaggccc

SEQ ID NO: 7198809 - DNA, 22 bp, Homo sapiens
agggacagatgaatgactgagt

SEQ ID NO: 7198810 - DNA, 22 bp, Homo sapiens
agggacagatgaatgactgagt

SEQ ID NO: 7198811 - DNA, 22 bp, Homo sapiens
agggacagatgaatgactgagt

SEQ ID NO: 7198812 - DNA, 17 bp, Homo sapiens
agggacagcagtttagg

SEQ ID NO: 7198813 - DNA, 17 bp, Homo sapiens
agggacagcagtttagg

SEQ ID NO: 7198814 - DNA, 17 bp, Homo sapiens
agggacagcagtttagg

SEQ ID NO: 7198815 - DNA, 17 bp, Homo sapiens
agggacagcagtttagg

SEQ ID NO: 7198816 - DNA, 22 bp, Homo sapiens
agggacacgaggtcctgctggg

SEQ ID NO: 7198817 - DNA, 22 bp, Homo sapiens
agggacacgaggtcctgctggg

SEQ ID NO: 7198818 - DNA, 22 bp, Homo sapiens
agggacacatgtgattatttat

SEQ ID NO: 7198819 - DNA, 22 bp, Homo sapiens
agggacacgaggtcctgctggg

SEQ ID NO: 7198820 - DNA, 21 bp, Homo sapiens
agggacacacaggatggggct

SEQ ID NO: 7198821 - DNA, 20 bp, Homo sapiens
agggacacaatatttctgtg

SEQ ID NO: 7198822 - DNA, 21 bp, Homo sapiens
agggacacacaggatggggct

SEQ ID NO: 7198823 - DNA, 22 bp, Homo sapiens
agggacacactccagtgttatt

SEQ ID NO: 7198824 - DNA, 22 bp, Homo sapiens
agggaattcactggaacgccct

SEQ ID NO: 7198825 - DNA, 22 bp, Homo sapiens
agggacagtatccatctcacag

SEQ ID NO: 7198826 - DNA, 22 bp, Homo sapiens
agggacagtatccatctcacag

SEQ ID NO: 7198827 - DNA, 22 bp, Homo sapiens
agggacagtatccatctcacag

SEQ ID NO: 7198828 - DNA, 22 bp, Homo sapiens
accaggagttgggggtgggacc

SEQ ID NO: 7198829 - DNA, 22 bp, Homo sapiens
accaggagttgggggtgggacc

SEQ ID NO: 7198830 - DNA, 22 bp, Homo sapiens
accaggcccaccgcatgctcct

SEQ ID NO: 7198831 - DNA, 23 bp, Homo sapiens
accaggagttgtctcaggaaaca

SEQ ID NO: 7198832 - DNA, 22 bp, Homo sapiens
accaggagttttgaccaggggc

SEQ ID NO: 7198833 - DNA, 22 bp, Homo sapiens
accaggcccaccgcatgctcct

SEQ ID NO: 7198834 - DNA, 22 bp, Homo sapiens
accaggcccaccgcatgctcct

SEQ ID NO: 7198835 - DNA, 22 bp, Homo sapiens
accaggcccaccgcatgctcct

SEQ ID NO: 7198836 - DNA, 22 bp, Homo sapiens
accaggcccatgtggattacta

SEQ ID NO: 7198837 - DNA, 22 bp, Homo sapiens
accaggcccgctgctatggtgg

SEQ ID NO: 7198838 - DNA, 22 bp, Homo sapiens
accaggcccgctgctatggtgg

SEQ ID NO: 7198839 - DNA, 20 bp, Homo sapiens
accaggccccgggccctgca

SEQ ID NO: 7198840 - DNA, 22 bp, Homo sapiens
accaggcccgctgctatggtgg

SEQ ID NO: 7198841 - DNA, 20 bp, Homo sapiens
accaggcccggtgtctcctc

SEQ ID NO: 7198842 - DNA, 22 bp, Homo sapiens
accaggcccgctgctatggtgg

SEQ ID NO: 7198843 - DNA, 20 bp, Homo sapiens
accaggcccggtgtctcctc

SEQ ID NO: 7198844 - DNA, 20 bp, Homo sapiens
accaggccccgggccctgca

SEQ ID NO: 7198845 - DNA, 22 bp, Homo sapiens
accaggcccatgtggattacta

SEQ ID NO: 7198846 - DNA, 20 bp, Homo sapiens
accaggccccgggccctgca

SEQ ID NO: 7198847 - DNA, 22 bp, Homo sapiens
accaggcccatgtggattacta

SEQ ID NO: 7198848 - DNA, 20 bp, Homo sapiens
accaggccccgggccctgca

SEQ ID NO: 7198849 - DNA, 20 bp, Homo sapiens
accaggccccgggccctgca

SEQ ID NO: 7198850 - DNA, 19 bp, Homo sapiens
accaggcctcagaggccct

SEQ ID NO: 7198851 - DNA, 23 bp, Homo sapiens
agggagctaaaaggctggagcag

SEQ ID NO: 7198852 - DNA, 23 bp, Homo sapiens
agggagctaaaaggctggagcag

SEQ ID NO: 7198853 - DNA, 23 bp, Homo sapiens
agggagctaaaaggctggagcag

SEQ ID NO: 7198854 - DNA, 23 bp, Homo sapiens
agggagctaaaaggctggagcag

SEQ ID NO: 7198855 - DNA, 23 bp, Homo sapiens
agggagctaaaaggctggagcag

SEQ ID NO: 7198856 - DNA, 23 bp, Homo sapiens
agggagctaaaaggctggagcag

SEQ ID NO: 7198857 - DNA, 23 bp, Homo sapiens
agggagctaaaaggctggagcag

SEQ ID NO: 7198858 - DNA, 22 bp, Homo sapiens
agggagctaggatcctgaaggt

SEQ ID NO: 7198859 - DNA, 22 bp, Homo sapiens
agggagctaggatcctgaaggt

SEQ ID NO: 7198860 - DNA, 22 bp, Homo sapiens
agggagctattgtgttactttg

SEQ ID NO: 7198861 - DNA, 21 bp, Homo sapiens
agggagctatttatagtaagc

SEQ ID NO: 7198862 - DNA, 22 bp, Homo sapiens
accaggccctccagctgcgtgg

SEQ ID NO: 7198863 - DNA, 22 bp, Homo sapiens
accaggccctccagctgcgtgg

SEQ ID NO: 7198864 - DNA, 20 bp, Homo sapiens
accaggcccggtgtctcctc

SEQ ID NO: 7198865 - DNA, 20 bp, Homo sapiens
accaggcccggtgtctcctc

SEQ ID NO: 7198866 - DNA, 22 bp, Homo sapiens
accaggccctccagctgcgtgg

SEQ ID NO: 7198867 - DNA, 22 bp, Homo sapiens
accaggccctccagctgcgtgg

SEQ ID NO: 7198868 - DNA, 22 bp, Homo sapiens
accaggcctagcaagtacatta

SEQ ID NO: 7198869 - DNA, 22 bp, Homo sapiens
accaggcctagcaagtacatta

SEQ ID NO: 7198870 - DNA, 19 bp, Homo sapiens
accaggcctcagaggccct

SEQ ID NO: 7198871 - DNA, 22 bp, Homo sapiens
accaggcctagcaagtacatta

SEQ ID NO: 7198872 - DNA, 19 bp, Homo sapiens
accaggcctcagaggccct

SEQ ID NO: 7198873 - DNA, 19 bp, Homo sapiens
accaggcctcagaggccct

SEQ ID NO: 7198874 - DNA, 22 bp, Homo sapiens
accaggcctagcaagtacatta

SEQ ID NO: 7198875 - DNA, 22 bp, Homo sapiens
accaggcctagcaagtacatta

SEQ ID NO: 7198876 - DNA, 22 bp, Homo sapiens
accaggcctagcaagtacatta

SEQ ID NO: 7198877 - DNA, 22 bp, Homo sapiens
agctttatgggagcttagataa

SEQ ID NO: 7198878 - DNA, 22 bp, Homo sapiens
agctttatgggagcttagataa

SEQ ID NO: 7198879 - DNA, 22 bp, Homo sapiens
acaggctgcccgctccccacct

SEQ ID NO: 7198880 - DNA, 22 bp, Homo sapiens
acaggctctggggcaggatggc

SEQ ID NO: 7198881 - DNA, 22 bp, Homo sapiens
acaggctctggggcaggatggc

SEQ ID NO: 7198882 - DNA, 22 bp, Homo sapiens
acaggctctggggcaggatggc

SEQ ID NO: 7198883 - DNA, 22 bp, Homo sapiens
acaggctgccacttgcatccaa

SEQ ID NO: 7198884 - DNA, 22 bp, Homo sapiens
acaggctgctgagccatttgct

SEQ ID NO: 7198885 - DNA, 22 bp, Homo sapiens
acaggctgctgagccatttgct

SEQ ID NO: 7198886 - DNA, 22 bp, Homo sapiens
acaggctgcctaccaagtatca

SEQ ID NO: 7198887 - DNA, 22 bp, Homo sapiens
acaggctgctgagccatttgct

SEQ ID NO: 7198888 - DNA, 22 bp, Homo sapiens
acaggctgcccgctccccacct

SEQ ID NO: 7198889 - DNA, 22 bp, Homo sapiens
acaggctgcctaccaagtatca

SEQ ID NO: 7198890 - DNA, 22 bp, Homo sapiens
acaggctggtggtcctggccat

SEQ ID NO: 7198891 - DNA, 22 bp, Homo sapiens
acaggctggtggtcctggccat

SEQ ID NO: 7198892 - DNA, 22 bp, Homo sapiens
acaggctggtggtcctggccat

SEQ ID NO: 7198893 - DNA, 22 bp, Homo sapiens
acaggctgggcgcttcctgcgg

SEQ ID NO: 7198894 - DNA, 22 bp, Homo sapiens
acaggctgggcgcttcctgcgg

SEQ ID NO: 7198895 - DNA, 22 bp, Homo sapiens
acaggctgggcgcttcctgcgg

SEQ ID NO: 7198896 - DNA, 22 bp, Homo sapiens
acaggctggaggaggaccaaga

SEQ ID NO: 7198897 - DNA, 22 bp, Homo sapiens
acaggctggaggaggaccaaga

SEQ ID NO: 7198898 - DNA, 22 bp, Homo sapiens
acaggctgggcgcttcctgcgg

SEQ ID NO: 7198899 - DNA, 22 bp, Homo sapiens
acaggctgggcgcttcctgcgg

SEQ ID NO: 7198900 - DNA, 22 bp, Homo sapiens
acaggctgctgggctccgtgct

SEQ ID NO: 7198901 - DNA, 22 bp, Homo sapiens
acaggctgctgggctccgtgct

SEQ ID NO: 7198902 - DNA, 22 bp, Homo sapiens
acaggctgctgggctccgtgct

SEQ ID NO: 7198903 - DNA, 22 bp, Homo sapiens
acaggctgctgggctccgtgct

SEQ ID NO: 7198904 - DNA, 22 bp, Homo sapiens
acaggctgctgggctccgtgct

SEQ ID NO: 7198905 - DNA, 22 bp, Homo sapiens
aggaatgatagtaaaagagaat

SEQ ID NO: 7198906 - DNA, 22 bp, Homo sapiens
aggaatgacttgtagctctgag

SEQ ID NO: 7198907 - DNA, 22 bp, Homo sapiens
aggaatgacttgtagctctgag

SEQ ID NO: 7198908 - DNA, 22 bp, Homo sapiens
aggaagggctgtttctccaaga

SEQ ID NO: 7198909 - DNA, 22 bp, Homo sapiens
acaggctgttggggtccagggt

SEQ ID NO: 7198910 - DNA, 22 bp, Homo sapiens
aggaagggctgtttctccaaga

SEQ ID NO: 7198911 - DNA, 22 bp, Homo sapiens
aggaagggctgtttctccaaga

SEQ ID NO: 7198912 - DNA, 22 bp, Homo sapiens
acaggctgttggggtccagggt

SEQ ID NO: 7198913 - DNA, 18 bp, Homo sapiens
acaggctgtgggaatggt

SEQ ID NO: 7198914 - DNA, 18 bp, Homo sapiens
acaggctgtgggaatggt

SEQ ID NO: 7198915 - DNA, 22 bp, Homo sapiens
acaggctgtacttctaatcatc

SEQ ID NO: 7198916 - DNA, 22 bp, Homo sapiens
acaggctggtttgtaaaagatg

SEQ ID NO: 7198917 - DNA, 22 bp, Homo sapiens
acaggctggtttgtaaaagatg

SEQ ID NO: 7198918 - DNA, 23 bp, Homo sapiens
aggaatggctagaagtgtgaccc

SEQ ID NO: 7198919 - DNA, 22 bp, Homo sapiens
aggaatggtgctcagcagaaat

SEQ ID NO: 7198920 - DNA, 22 bp, Homo sapiens
aggaatggtgctcagcagaaat

SEQ ID NO: 7198921 - DNA, 22 bp, Homo sapiens
aggaatggttatggggatagta

SEQ ID NO: 7198922 - DNA, 19 bp, Homo sapiens
aggaatggaattaattctg

SEQ ID NO: 7198923 - DNA, 21 bp, Homo sapiens
aggaatgctgaggctcacttt

SEQ ID NO: 7198924 - DNA, 19 bp, Homo sapiens
aggaatggaattaattctg

SEQ ID NO: 7198925 - DNA, 19 bp, Homo sapiens
aggaatggaattaattctg

SEQ ID NO: 7198926 - DNA, 19 bp, Homo sapiens
aggaatggaattaattctg

SEQ ID NO: 7198927 - DNA, 19 bp, Homo sapiens
aggaatggaattaattctg

SEQ ID NO: 7198928 - DNA, 22 bp, Homo sapiens
aggaatgtaaatctagatttta

SEQ ID NO: 7198929 - DNA, 22 bp, Homo sapiens
aggaatgtaaatctagatttta

SEQ ID NO: 7198930 - DNA, 22 bp, Homo sapiens
aggaatgtaaatctagatttta

SEQ ID NO: 7198931 - DNA, 22 bp, Homo sapiens
aggaatgtaacaggagtaaaaa

SEQ ID NO: 7198932 - DNA, 22 bp, Homo sapiens
aggaatgtaacaggagtaaaaa

SEQ ID NO: 7198933 - DNA, 22 bp, Homo sapiens
aggaatgtaacaggagtaaaaa

SEQ ID NO: 7198934 - DNA, 22 bp, Homo sapiens
aggaatgtaacaggagtaaaaa

SEQ ID NO: 7198935 - DNA, 22 bp, Homo sapiens
aggaatgtaatagtgtggctca

SEQ ID NO: 7198936 - DNA, 22 bp, Homo sapiens
aggaatgtaatagtgtggctca

SEQ ID NO: 7198937 - DNA, 22 bp, Homo sapiens
aggaatgtaatagtgtggctca

SEQ ID NO: 7198938 - DNA, 22 bp, Homo sapiens
aggaatgtagtttgagtagaaa

SEQ ID NO: 7198939 - DNA, 22 bp, Homo sapiens
aggaatgtagtttgagtagaaa

SEQ ID NO: 7198940 - DNA, 22 bp, Homo sapiens
aggaatgtagtttgagtagaaa

SEQ ID NO: 7198941 - DNA, 22 bp, Homo sapiens
aggaatgtattattccttctgg

SEQ ID NO: 7198942 - DNA, 22 bp, Homo sapiens
aggaatgtattattccttctgg

SEQ ID NO: 7198943 - DNA, 22 bp, Homo sapiens
aggaatgtattattccttctgg

SEQ ID NO: 7198944 - DNA, 22 bp, Homo sapiens
aggaatgtattgacctgttgca

SEQ ID NO: 7198945 - DNA, 22 bp, Homo sapiens
aggaatgtattgacctgttgca

SEQ ID NO: 7198946 - DNA, 22 bp, Homo sapiens
aggaatgtattgacctgttgca

SEQ ID NO: 7198947 - DNA, 22 bp, Homo sapiens
aggaatgtcaagtagatgtgcg

SEQ ID NO: 7198948 - DNA, 22 bp, Homo sapiens
aggaatgtcaagtagatgtgcg

SEQ ID NO: 7198949 - DNA, 22 bp, Homo sapiens
aggaatgtcaagtagatgtgcg

SEQ ID NO: 7198950 - DNA, 22 bp, Homo sapiens
aggaatgtcatagaataatcat

SEQ ID NO: 7198951 - DNA, 22 bp, Homo sapiens
aggaatgtcatagaataatcat

SEQ ID NO: 7198952 - DNA, 22 bp, Homo sapiens
aggaatgtcatagaataatcat

SEQ ID NO: 7198953 - DNA, 14 bp, Homo sapiens
aggaatgtcctagg

SEQ ID NO: 7198954 - DNA, 14 bp, Homo sapiens
aggaatgtcctagg

SEQ ID NO: 7198955 - DNA, 22 bp, Homo sapiens
agctttatcccttgcccatcga

SEQ ID NO: 7198956 - DNA, 22 bp, Homo sapiens
agctttatcccttgcccatcga

SEQ ID NO: 7198957 - DNA, 22 bp, Homo sapiens
agctttatcttcacctgggaat

SEQ ID NO: 7198958 - DNA, 22 bp, Homo sapiens
agctttatcttcacctgggaat

SEQ ID NO: 7198959 - DNA, 22 bp, Homo sapiens
agctttatcttcacctgggaat

SEQ ID NO: 7198960 - DNA, 22 bp, Homo sapiens
agctttatgcttcctacaagct

SEQ ID NO: 7198961 - DNA, 22 bp, Homo sapiens
agctttatgaggagaccttagt

SEQ ID NO: 7198962 - DNA, 22 bp, Homo sapiens
agctttatgaggagaccttagt

SEQ ID NO: 7198963 - DNA, 22 bp, Homo sapiens
agctttatgcttcctacaagct

SEQ ID NO: 7198964 - DNA, 22 bp, Homo sapiens
agctttatgcttcctacaagct

SEQ ID NO: 7198965 - DNA, 22 bp, Homo sapiens
agctttatcacaatattggcta

SEQ ID NO: 7198966 - DNA, 22 bp, Homo sapiens
agctttatcacaatattggcta

SEQ ID NO: 7198967 - DNA, 22 bp, Homo sapiens
agctttatcacaatattggcta

SEQ ID NO: 7198968 - DNA, 22 bp, Homo sapiens
agctttatcagaggagtctcta

SEQ ID NO: 7198969 - DNA, 22 bp, Homo sapiens
agctttatcagaggagtctcta

SEQ ID NO: 7198970 - DNA, 22 bp, Homo sapiens
acaggcctggaaaggaaggagt

SEQ ID NO: 7198971 - DNA, 22 bp, Homo sapiens
acaggcctggaaaggaaggagt

SEQ ID NO: 7198972 - DNA, 22 bp, Homo sapiens
acaggcctgggttcaaatttgg

SEQ ID NO: 7198973 - DNA, 22 bp, Homo sapiens
acaggcctggtgctgctgacag

SEQ ID NO: 7198974 - DNA, 22 bp, Homo sapiens
acaggcccagctcttcaccaga

SEQ ID NO: 7198975 - DNA, 22 bp, Homo sapiens
acaggcctacgaagtcaggtgc

SEQ ID NO: 7198976 - DNA, 22 bp, Homo sapiens
acaggcctagctaatgctttcc

SEQ ID NO: 7198977 - DNA, 22 bp, Homo sapiens
acaggcctagctaatgctttcc

SEQ ID NO: 7198978 - DNA, 22 bp, Homo sapiens
acaggcctagggtcaatttcct

SEQ ID NO: 7198979 - DNA, 22 bp, Homo sapiens
acaggcctcaaatagggtgcct

SEQ ID NO: 7198980 - DNA, 22 bp, Homo sapiens
acaggcctatgttccattgcag

SEQ ID NO: 7198981 - DNA, 22 bp, Homo sapiens
acaggcctcaaatagggtgcct

SEQ ID NO: 7198982 - DNA, 22 bp, Homo sapiens
acaggcctcaaatagggtgcct

SEQ ID NO: 7198983 - DNA, 22 bp, Homo sapiens
acaggcctcaaatagggtgcct

SEQ ID NO: 7198984 - DNA, 22 bp, Homo sapiens
acaggcctcaagacacccaggt

SEQ ID NO: 7198985 - DNA, 18 bp, Homo sapiens
acaggcctcagtcctgca

SEQ ID NO: 7198986 - DNA, 18 bp, Homo sapiens
acaggcctcagtcctgca

SEQ ID NO: 7198987 - DNA, 22 bp, Homo sapiens
acaggcctcccatccggagccc

SEQ ID NO: 7198988 - DNA, 22 bp, Homo sapiens
acaggcctcccatccggagccc

SEQ ID NO: 7198989 - DNA, 22 bp, Homo sapiens
acaggcctgacacacagagggc

SEQ ID NO: 7198990 - DNA, 22 bp, Homo sapiens
acaggcctgacacacagagggc

SEQ ID NO: 7198991 - DNA, 22 bp, Homo sapiens
acaggcctgacacacagagggc

SEQ ID NO: 7198992 - DNA, 22 bp, Homo sapiens
acaggcctgagattttgcattt

SEQ ID NO: 7198993 - DNA, 22 bp, Homo sapiens
acaggcctgagattttgcattt

SEQ ID NO: 7198994 - DNA, 22 bp, Homo sapiens
acaggcctgatgttatcctatt

SEQ ID NO: 7198995 - DNA, 17 bp, Homo sapiens
acaggcctgcttgcact

SEQ ID NO: 7198996 - DNA, 17 bp, Homo sapiens
acaggcctgcttgcact

SEQ ID NO: 7198997 - DNA, 22 bp, Homo sapiens
acaggcctggaaaggaaggagt

SEQ ID NO: 7198998 - DNA, 22 bp, Homo sapiens
acaggcccagctcttcaccaga

SEQ ID NO: 7198999 - DNA, 22 bp, Homo sapiens
acaggcctacgaagtcaggtgc

SEQ ID NO: 7199000 - DNA, 22 bp, Homo sapiens
acaggccataaaggcaggccct

SEQ ID NO: 7199001 - DNA, 22 bp, Homo sapiens
acaggccagcctggggtaaggt

SEQ ID NO: 7199002 - DNA, 22 bp, Homo sapiens
acaggccataaaggcaggccct

SEQ ID NO: 7199003 - DNA, 22 bp, Homo sapiens
acaggccataaaggcaggccct

SEQ ID NO: 7199004 - DNA, 22 bp, Homo sapiens
acaggcaggtaatttacatatt

SEQ ID NO: 7199005 - DNA, 22 bp, Homo sapiens
acagcttcgaggatctcatccc

SEQ ID NO: 7199006 - DNA, 22 bp, Homo sapiens
acagcttcgaggatctcatccc

SEQ ID NO: 7199007 - DNA, 23 bp, Homo sapiens
acagcttcctggcatggagaacc

SEQ ID NO: 7199008 - DNA, 22 bp, Homo sapiens
acagctgtggggactcttgccc

SEQ ID NO: 7199009 - DNA, 22 bp, Homo sapiens
acagctgtgttttataatcagc

SEQ ID NO: 7199010 - DNA, 22 bp, Homo sapiens
acagcttagccagtcaagctct

SEQ ID NO: 7199011 - DNA, 22 bp, Homo sapiens
acagcttcacccattatccctg

SEQ ID NO: 7199012 - DNA, 23 bp, Homo sapiens
acagcttcctactttgctgctgc

SEQ ID NO: 7199013 - DNA, 22 bp, Homo sapiens
agctgggtccctctgctgatgg

SEQ ID NO: 7199014 - DNA, 22 bp, Homo sapiens
agctgggtcttgggccaggaga

SEQ ID NO: 7199015 - DNA, 22 bp, Homo sapiens
agctgggtgaaggcagatggct

SEQ ID NO: 7199016 - DNA, 22 bp, Homo sapiens
agctgggtgaaggcagatggct

SEQ ID NO: 7199017 - DNA, 22 bp, Homo sapiens
acagctgtattcaagttgcaag

SEQ ID NO: 7199018 - DNA, 22 bp, Homo sapiens
acagctgtgaagcaagcactct

SEQ ID NO: 7199019 - DNA, 22 bp, Homo sapiens
acagctgtgaagcaagcactct

SEQ ID NO: 7199020 - DNA, 22 bp, Homo sapiens
acagctgtgacttagagaagtt

SEQ ID NO: 7199021 - DNA, 22 bp, Homo sapiens
acagctgtgggctctgcatata

SEQ ID NO: 7199022 - DNA, 22 bp, Homo sapiens
agctgggggttggataagggta

SEQ ID NO: 7199023 - DNA, 22 bp, Homo sapiens
agctgggggttggataagggta

SEQ ID NO: 7199024 - DNA, 22 bp, Homo sapiens
agctgggggtagtgagaaataa

SEQ ID NO: 7199025 - DNA, 22 bp, Homo sapiens
agctgggggtagtgagaaataa

SEQ ID NO: 7199026 - DNA, 22 bp, Homo sapiens
agctggggctgtggttgtgatt

SEQ ID NO: 7199027 - DNA, 22 bp, Homo sapiens
agctggggctgtggttgtgatt

SEQ ID NO: 7199028 - DNA, 22 bp, Homo sapiens
agctggggctgtggttgtgatt

SEQ ID NO: 7199029 - DNA, 22 bp, Homo sapiens
agctggggctgtggttgtgatt

SEQ ID NO: 7199030 - DNA, 22 bp, Homo sapiens
agctggggctgcagagaacagg

SEQ ID NO: 7199031 - DNA, 22 bp, Homo sapiens
agctggggctgtggttgtgatt

SEQ ID NO: 7199032 - DNA, 22 bp, Homo sapiens
agctggggctgcagagaacagg

SEQ ID NO: 7199033 - DNA, 22 bp, Homo sapiens
agctggggttgcacacattttg

SEQ ID NO: 7199034 - DNA, 22 bp, Homo sapiens
agctgggggttggataagggta

SEQ ID NO: 7199035 - DNA, 22 bp, Homo sapiens
agctgggggttggataagggta

SEQ ID NO: 7199036 - DNA, 22 bp, Homo sapiens
agctggggttgcacacattttg

SEQ ID NO: 7199037 - DNA, 22 bp, Homo sapiens
agctgggtacacgttgtcacaa

SEQ ID NO: 7199038 - DNA, 22 bp, Homo sapiens
agctgggtacagcctgtgccta

SEQ ID NO: 7199039 - DNA, 22 bp, Homo sapiens
agctgggtacagcctgtgccta

SEQ ID NO: 7199040 - DNA, 22 bp, Homo sapiens
agctgggtactgatgtcttcag

SEQ ID NO: 7199041 - DNA, 22 bp, Homo sapiens
agctgggtactgatgtcttcag

SEQ ID NO: 7199042 - DNA, 22 bp, Homo sapiens
agctgggtcaataggaaatgta

SEQ ID NO: 7199043 - DNA, 22 bp, Homo sapiens
agctgggtccctctgctgatgg

SEQ ID NO: 7199044 - DNA, 23 bp, Homo sapiens
acagctgcacctggccgcctggc

SEQ ID NO: 7199045 - DNA, 23 bp, Homo sapiens
acagctgcacctggccgcctggc

SEQ ID NO: 7199046 - DNA, 23 bp, Homo sapiens
acagctgcacctggccgcctggc

SEQ ID NO: 7199047 - DNA, 22 bp, Homo sapiens
acagctgattggatcaaggaca

SEQ ID NO: 7199048 - DNA, 22 bp, Homo sapiens
acagctgcaaattgttagagga

SEQ ID NO: 7199049 - DNA, 22 bp, Homo sapiens
acagctgcacactgaacttggt

SEQ ID NO: 7199050 - DNA, 23 bp, Homo sapiens
acagctgcacctggccgcctggc

SEQ ID NO: 7199051 - DNA, 22 bp, Homo sapiens
acagctgcacttgaagcaggtt

SEQ ID NO: 7199052 - DNA, 22 bp, Homo sapiens
acagctgcatgatggtccagat

SEQ ID NO: 7199053 - DNA, 22 bp, Homo sapiens
acagctgcattcttaacaggaa

SEQ ID NO: 7199054 - DNA, 20 bp, Homo sapiens
agctgggcaattatgactat

SEQ ID NO: 7199055 - DNA, 20 bp, Homo sapiens
agctgggcaattatgactat

SEQ ID NO: 7199056 - DNA, 20 bp, Homo sapiens
agctgggcaattatgactat

SEQ ID NO: 7199057 - DNA, 22 bp, Homo sapiens
acagctgccaagacagagcagg

SEQ ID NO: 7199058 - DNA, 23 bp, Homo sapiens
agctgggcaaggatccgggctcc

SEQ ID NO: 7199059 - DNA, 23 bp, Homo sapiens
agctgggcaaggatccgggctcc

SEQ ID NO: 7199060 - DNA, 23 bp, Homo sapiens
agctgggcaaggatccgggctcc

SEQ ID NO: 7199061 - DNA, 22 bp, Homo sapiens
agctggggctgcagagaacagg

SEQ ID NO: 7199062 - DNA, 22 bp, Homo sapiens
agctggggctgcagagaacagg

SEQ ID NO: 7199063 - DNA, 22 bp, Homo sapiens
agctggggctgcagagaacagg

SEQ ID NO: 7199064 - DNA, 19 bp, Homo sapiens
agctggggcggtgtgtgtt

SEQ ID NO: 7199065 - DNA, 22 bp, Homo sapiens
acagctcatttgtaaaacggag

SEQ ID NO: 7199066 - DNA, 22 bp, Homo sapiens
acagctcatttgtaaaacggag

SEQ ID NO: 7199067 - DNA, 22 bp, Homo sapiens
acagctcctaacaaaggctctc

SEQ ID NO: 7199068 - DNA, 22 bp, Homo sapiens
acagctcagacatcactgctct

SEQ ID NO: 7199069 - DNA, 22 bp, Homo sapiens
acagctcactcacagggctagt

SEQ ID NO: 7199070 - DNA, 22 bp, Homo sapiens
acagctcagacatcactgctct

SEQ ID NO: 7199071 - DNA, 22 bp, Homo sapiens
acagctcactcacagggctagt

SEQ ID NO: 7199072 - DNA, 22 bp, Homo sapiens
acagctcagacatcactgctct

SEQ ID NO: 7199073 - DNA, 22 bp, Homo sapiens
acagctatgacagatggataat

SEQ ID NO: 7199074 - DNA, 22 bp, Homo sapiens
acagctatagacgatgtataga

SEQ ID NO: 7199075 - DNA, 22 bp, Homo sapiens
acagcgagaatgtaaggagccc

SEQ ID NO: 7199076 - DNA, 22 bp, Homo sapiens
acagcgagaatgtaaggagccc

SEQ ID NO: 7199077 - DNA, 22 bp, Homo sapiens
acagcgggaatgtggtaggtgg

SEQ ID NO: 7199078 - DNA, 22 bp, Homo sapiens
acagctacatcaaactcagaag

SEQ ID NO: 7199079 - DNA, 22 bp, Homo sapiens
acagctacatcaaactcagaag

SEQ ID NO: 7199080 - DNA, 22 bp, Homo sapiens
acagctacatggaatttcattt

SEQ ID NO: 7199081 - DNA, 22 bp, Homo sapiens
acagctactctgcagataaatc

SEQ ID NO: 7199082 - DNA, 22 bp, Homo sapiens
acagctcttaggcagaaccaac

SEQ ID NO: 7199083 - DNA, 22 bp, Homo sapiens
acagctcttaggcagaaccaac

SEQ ID NO: 7199084 - DNA, 22 bp, Homo sapiens
acagctcttaggcagaaccaac

SEQ ID NO: 7199085 - DNA, 22 bp, Homo sapiens
acagctctggtcctttagagag

SEQ ID NO: 7199086 - DNA, 22 bp, Homo sapiens
acagctctgtgtattgtcatct

SEQ ID NO: 7199087 - DNA, 22 bp, Homo sapiens
acagctctgttgccagatctgc

SEQ ID NO: 7199088 - DNA, 22 bp, Homo sapiens
acagctctgttgccagatctgc

SEQ ID NO: 7199089 - DNA, 22 bp, Homo sapiens
acagctcttcttcaagcctggc

SEQ ID NO: 7199090 - DNA, 22 bp, Homo sapiens
acagctgaaaccagggatctgg

SEQ ID NO: 7199091 - DNA, 22 bp, Homo sapiens
acagctgaacaagatagtgtca

SEQ ID NO: 7199092 - DNA, 22 bp, Homo sapiens
acagctgacattggcagctatt

SEQ ID NO: 7199093 - DNA, 22 bp, Homo sapiens
acagctgacattggcagctatt

SEQ ID NO: 7199094 - DNA, 22 bp, Homo sapiens
acagctgatagttacctctgtc

SEQ ID NO: 7199095 - DNA, 22 bp, Homo sapiens
acagctgatcattttgaagaat

SEQ ID NO: 7199096 - DNA, 22 bp, Homo sapiens
acagctgattggatcaaggaca

SEQ ID NO: 7199097 - DNA, 22 bp, Homo sapiens
acagctgattggatcaaggaca

SEQ ID NO: 7199098 - DNA, 22 bp, Homo sapiens
acagctgattggatcaaggaca

SEQ ID NO: 7199099 - DNA, 22 bp, Homo sapiens
acagctcctactgaagccatgt

SEQ ID NO: 7199100 - DNA, 22 bp, Homo sapiens
acagctcctaacaaaggctctc

SEQ ID NO: 7199101 - DNA, 22 bp, Homo sapiens
acagctcctactgaagccatgt

SEQ ID NO: 7199102 - DNA, 22 bp, Homo sapiens
acagctcctactgaagccatgt

SEQ ID NO: 7199103 - DNA, 22 bp, Homo sapiens
acagctcctggggctttaatgg

SEQ ID NO: 7199104 - DNA, 22 bp, Homo sapiens
acagctctccctcagagaaatg

SEQ ID NO: 7199105 - DNA, 22 bp, Homo sapiens
acagctctgagatattactatt

SEQ ID NO: 7199106 - DNA, 22 bp, Homo sapiens
acagctctgagatattactatt

SEQ ID NO: 7199107 - DNA, 22 bp, Homo sapiens
acagctctgcattttgggttaa

SEQ ID NO: 7199108 - DNA, 22 bp, Homo sapiens
acagctctgcattttgggttaa

SEQ ID NO: 7199109 - DNA, 22 bp, Homo sapiens
acagctctgggtgcaggaggtg

SEQ ID NO: 7199110 - DNA, 22 bp, Homo sapiens
acagctctgggtgcaggaggtg

SEQ ID NO: 7199111 - DNA, 22 bp, Homo sapiens
agctgctagttcctgttctcac

SEQ ID NO: 7199112 - DNA, 22 bp, Homo sapiens
agctgctactgctctgccagag

SEQ ID NO: 7199113 - DNA, 22 bp, Homo sapiens
agctgctactgctctgccagag

SEQ ID NO: 7199114 - DNA, 21 bp, Homo sapiens
agctgcctttagagagaacca

SEQ ID NO: 7199115 - DNA, 22 bp, Homo sapiens
agctgccttccctctcattagg

SEQ ID NO: 7199116 - DNA, 17 bp, Homo sapiens
agctgccttgcttgagc

SEQ ID NO: 7199117 - DNA, 17 bp, Homo sapiens
agctgccttgcttgagc

SEQ ID NO: 7199118 - DNA, 22 bp, Homo sapiens
agctgctatgaacattcacata

SEQ ID NO: 7199119 - DNA, 22 bp, Homo sapiens
agctgctatgacaacaccagcc

SEQ ID NO: 7199120 - DNA, 22 bp, Homo sapiens
agctgctatgagaaaggcactg

SEQ ID NO: 7199121 - DNA, 22 bp, Homo sapiens
agctgctatgagaaaggcactg

SEQ ID NO: 7199122 - DNA, 22 bp, Homo sapiens
agctgctcacagggattcatgc

SEQ ID NO: 7199123 - DNA, 22 bp, Homo sapiens
agctgctcacagggattcatgc

SEQ ID NO: 7199124 - DNA, 22 bp, Homo sapiens
acagcctgctgcctgcttcttg

SEQ ID NO: 7199125 - DNA, 22 bp, Homo sapiens
acagcctgctgcctgcttcttg

SEQ ID NO: 7199126 - DNA, 22 bp, Homo sapiens
acagcctgctgcctgcttcttg

SEQ ID NO: 7199127 - DNA, 23 bp, Homo sapiens
acagccttctggggcttctgggc

SEQ ID NO: 7199128 - DNA, 22 bp, Homo sapiens
acagccttgggttctctggggg

SEQ ID NO: 7199129 - DNA, 22 bp, Homo sapiens
acagccttgggttctctggggg

SEQ ID NO: 7199130 - DNA, 22 bp, Homo sapiens
acagccttgggttctctggggg

SEQ ID NO: 7199131 - DNA, 20 bp, Homo sapiens
agctgccttcattttctaga

SEQ ID NO: 7199132 - DNA, 20 bp, Homo sapiens
agctgccttcattttctaga

SEQ ID NO: 7199133 - DNA, 20 bp, Homo sapiens
agctgccttcattttctaga

SEQ ID NO: 7199134 - DNA, 22 bp, Homo sapiens
agctgccttatggagtatgaaa

SEQ ID NO: 7199135 - DNA, 19 bp, Homo sapiens
agctgcctgtgcgcgcccg

SEQ ID NO: 7199136 - DNA, 22 bp, Homo sapiens
agctgcctgtgctgggagccca

SEQ ID NO: 7199137 - DNA, 22 bp, Homo sapiens
agctgcctgtgtagaaccatct

SEQ ID NO: 7199138 - DNA, 22 bp, Homo sapiens
agctgcccccagggctgtgctt

SEQ ID NO: 7199139 - DNA, 22 bp, Homo sapiens
agctgccccatgagaggcaggt

SEQ ID NO: 7199140 - DNA, 22 bp, Homo sapiens
agctgccccatgagaggcaggt

SEQ ID NO: 7199141 - DNA, 22 bp, Homo sapiens
agctgccccatgagaggcaggt

SEQ ID NO: 7199142 - DNA, 22 bp, Homo sapiens
agctgcctgggcttgtacacct

SEQ ID NO: 7199143 - DNA, 22 bp, Homo sapiens
agctgcctgtaaaatgtgtgat

SEQ ID NO: 7199144 - DNA, 22 bp, Homo sapiens
agctgcctgtcctaggccatca

SEQ ID NO: 7199145 - DNA, 22 bp, Homo sapiens
agctgcctgtcctaggccatca

SEQ ID NO: 7199146 - DNA, 22 bp, Homo sapiens
agctgcccagctaggaagaagg

SEQ ID NO: 7199147 - DNA, 22 bp, Homo sapiens
agctgcccaggttcattgggcc

SEQ ID NO: 7199148 - DNA, 22 bp, Homo sapiens
agctgcccagataggaggaggc

SEQ ID NO: 7199149 - DNA, 21 bp, Homo sapiens
agctgcccagagtagggaagg

SEQ ID NO: 7199150 - DNA, 22 bp, Homo sapiens
agctgcccaatcctgcagggcg

SEQ ID NO: 7199151 - DNA, 22 bp, Homo sapiens
agctgcccaatcctgcagggcg

SEQ ID NO: 7199152 - DNA, 22 bp, Homo sapiens
agctgcccagataggaggaggc

SEQ ID NO: 7199153 - DNA, 22 bp, Homo sapiens
agctgcccaatcctgcagggcg

SEQ ID NO: 7199154 - DNA, 22 bp, Homo sapiens
agctgcccaaggtcacagagct

SEQ ID NO: 7199155 - DNA, 22 bp, Homo sapiens
agctgccaggcccctgagaacc

SEQ ID NO: 7199156 - DNA, 22 bp, Homo sapiens
agctgccagggactgggcatgg

SEQ ID NO: 7199157 - DNA, 17 bp, Homo sapiens
agctgccagggagtgtg

SEQ ID NO: 7199158 - DNA, 22 bp, Homo sapiens
agctgccatcagcctttggatg

SEQ ID NO: 7199159 - DNA, 22 bp, Homo sapiens
agctgccatccgaggtgtcaga

SEQ ID NO: 7199160 - DNA, 22 bp, Homo sapiens
agctgccatccgaggtgtcaga

SEQ ID NO: 7199161 - DNA, 22 bp, Homo sapiens
agctgccatctgaagaactgca

SEQ ID NO: 7199162 - DNA, 22 bp, Homo sapiens
acagcacaggagttgaatgggc

SEQ ID NO: 7199163 - DNA, 23 bp, Homo sapiens
acagcacccatgtcatctggctc

SEQ ID NO: 7199164 - DNA, 22 bp, Homo sapiens
acagcactggtcccgcaagcct

SEQ ID NO: 7199165 - DNA, 22 bp, Homo sapiens
acagcactggtcccgcaagcct

SEQ ID NO: 7199166 - DNA, 22 bp, Homo sapiens
acagcacttattcagcacagtg

SEQ ID NO: 7199167 - DNA, 22 bp, Homo sapiens
acagcacttattcagcacagtg

SEQ ID NO: 7199168 - DNA, 22 bp, Homo sapiens
acagcacttgggttttcctgtt

SEQ ID NO: 7199169 - DNA, 22 bp, Homo sapiens
acagcacttgggttttcctgtt

SEQ ID NO: 7199170 - DNA, 22 bp, Homo sapiens
acagcactttacttctcagtga

SEQ ID NO: 7199171 - DNA, 22 bp, Homo sapiens
acagcagaataatgagtaatag

SEQ ID NO: 7199172 - DNA, 22 bp, Homo sapiens
acagcagaataatgagtaatag

SEQ ID NO: 7199173 - DNA, 22 bp, Homo sapiens
acagcagacacaggcacgctgt

SEQ ID NO: 7199174 - DNA, 22 bp, Homo sapiens
acagcagacacaggcacgctgt

SEQ ID NO: 7199175 - DNA, 22 bp, Homo sapiens
acagcagacacaggcacgctgt

SEQ ID NO: 7199176 - DNA, 22 bp, Homo sapiens
acagcagacacaggcacgctgt

SEQ ID NO: 7199177 - DNA, 21 bp, Homo sapiens
acagcagacaggcttaggacc

SEQ ID NO: 7199178 - DNA, 22 bp, Homo sapiens
acagcagacagtcggcttcctg

SEQ ID NO: 7199179 - DNA, 22 bp, Homo sapiens
acagcagacagtcggcttcctg

SEQ ID NO: 7199180 - DNA, 22 bp, Homo sapiens
acagcagacattgggtgattga

SEQ ID NO: 7199181 - DNA, 22 bp, Homo sapiens
agctgcaggcccatgctcagtc

SEQ ID NO: 7199182 - DNA, 22 bp, Homo sapiens
acagcagaccactactagtagg

SEQ ID NO: 7199183 - DNA, 22 bp, Homo sapiens
agctgccagcaagtttcaaaca

SEQ ID NO: 7199184 - DNA, 22 bp, Homo sapiens
agctgccagcatcccggaaggg

SEQ ID NO: 7199185 - DNA, 22 bp, Homo sapiens
agctgccagcatcccggaaggg

SEQ ID NO: 7199186 - DNA, 22 bp, Homo sapiens
agctgccagcatcccggaaggg

SEQ ID NO: 7199187 - DNA, 22 bp, Homo sapiens
acaggtgtaatttgcccgaggt

SEQ ID NO: 7199188 - DNA, 22 bp, Homo sapiens
aggagctggagtccaggcaagt

SEQ ID NO: 7199189 - DNA, 22 bp, Homo sapiens
aggagctggccactaggatgca

SEQ ID NO: 7199190 - DNA, 22 bp, Homo sapiens
acaggtggtctttgctcctttt

SEQ ID NO: 7199191 - DNA, 22 bp, Homo sapiens
acaggtggtctttgctcctttt

SEQ ID NO: 7199192 - DNA, 22 bp, Homo sapiens
acaggtgtaaaacccaggatgg

SEQ ID NO: 7199193 - DNA, 22 bp, Homo sapiens
acaggtgtaaaacccaggatgg

SEQ ID NO: 7199194 - DNA, 21 bp, Homo sapiens
aggagctgtgttagctggtcg

SEQ ID NO: 7199195 - DNA, 21 bp, Homo sapiens
aggagctgtgttagctggtcg

SEQ ID NO: 7199196 - DNA, 21 bp, Homo sapiens
aggagctgtgttagctggtcg

SEQ ID NO: 7199197 - DNA, 22 bp, Homo sapiens
acaggtggtaaaatggactgtc

SEQ ID NO: 7199198 - DNA, 22 bp, Homo sapiens
acaggtggtagagtggaaagag

SEQ ID NO: 7199199 - DNA, 22 bp, Homo sapiens
acaggtggtagagtggaaagag

SEQ ID NO: 7199200 - DNA, 22 bp, Homo sapiens
acaggtggtaaaatggactgtc

SEQ ID NO: 7199201 - DNA, 22 bp, Homo sapiens
acaggtggtaaaatggactgtc

SEQ ID NO: 7199202 - DNA, 22 bp, Homo sapiens
acaggtgggcttaagagtcggc

SEQ ID NO: 7199203 - DNA, 22 bp, Homo sapiens
acaggtgggcttaagagtcggc

SEQ ID NO: 7199204 - DNA, 22 bp, Homo sapiens
acaggtgggcttaagagtcggc

SEQ ID NO: 7199205 - DNA, 22 bp, Homo sapiens
acaggtggggaggctgaggttc

SEQ ID NO: 7199206 - DNA, 22 bp, Homo sapiens
acaggtggggaggctgaggttc

SEQ ID NO: 7199207 - DNA, 22 bp, Homo sapiens
acaggtggggcacttggagcct

SEQ ID NO: 7199208 - DNA, 22 bp, Homo sapiens
acaggtggggcacttggagcct

SEQ ID NO: 7199209 - DNA, 22 bp, Homo sapiens
acaggtggcttattggctgatt

SEQ ID NO: 7199210 - DNA, 22 bp, Homo sapiens
acaggtggcttattggctgatt

SEQ ID NO: 7199211 - DNA, 22 bp, Homo sapiens
acaggtggcttattggctgatt

SEQ ID NO: 7199212 - DNA, 22 bp, Homo sapiens
acaggtggcttattggctgatt

SEQ ID NO: 7199213 - DNA, 22 bp, Homo sapiens
acaggtgggcttaagagtcggc

SEQ ID NO: 7199214 - DNA, 22 bp, Homo sapiens
acaggtgggcttaagagtcggc

SEQ ID NO: 7199215 - DNA, 22 bp, Homo sapiens
acaggtggcttattggctgatt

SEQ ID NO: 7199216 - DNA, 22 bp, Homo sapiens
acaggtggcttccattttctaa

SEQ ID NO: 7199217 - DNA, 22 bp, Homo sapiens
acaggtggccccgagggagtgg

SEQ ID NO: 7199218 - DNA, 22 bp, Homo sapiens
acaggtggcttattggctgatt

SEQ ID NO: 7199219 - DNA, 22 bp, Homo sapiens
acaggtggcataggcagtttga

SEQ ID NO: 7199220 - DNA, 22 bp, Homo sapiens
acaggtggccccgagggagtgg

SEQ ID NO: 7199221 - DNA, 22 bp, Homo sapiens
acaggtggccccgagggagtgg

SEQ ID NO: 7199222 - DNA, 22 bp, Homo sapiens
acagggagtctgaggggatagt

SEQ ID NO: 7199223 - DNA, 22 bp, Homo sapiens
acagggagtctgaggggatagt

SEQ ID NO: 7199224 - DNA, 22 bp, Homo sapiens
acagggagtctgaggggatagt

SEQ ID NO: 7199225 - DNA, 22 bp, Homo sapiens
acagggagtctgaggggatagt

SEQ ID NO: 7199226 - DNA, 22 bp, Homo sapiens
acagggagtgcaattcatattg

SEQ ID NO: 7199227 - DNA, 18 bp, Homo sapiens
acagggagggcgctgggg

SEQ ID NO: 7199228 - DNA, 18 bp, Homo sapiens
acagggatggggtaagtg

SEQ ID NO: 7199229 - DNA, 22 bp, Homo sapiens
acagggattatgactgacagcc

SEQ ID NO: 7199230 - DNA, 22 bp, Homo sapiens
acagggcaacctctgggagact

SEQ ID NO: 7199231 - DNA, 22 bp, Homo sapiens
acagggcaacctctgggagact

SEQ ID NO: 7199232 - DNA, 22 bp, Homo sapiens
acagggcaacctctgggagact

SEQ ID NO: 7199233 - DNA, 22 bp, Homo sapiens
acagggcaacctctgggagact

SEQ ID NO: 7199234 - DNA, 22 bp, Homo sapiens
acagggcaacctctgggagact

SEQ ID NO: 7199235 - DNA, 22 bp, Homo sapiens
acagggcaacctctgggagact

SEQ ID NO: 7199236 - DNA, 22 bp, Homo sapiens
acagggcacctgaggtaggaag

SEQ ID NO: 7199237 - DNA, 22 bp, Homo sapiens
acagggcacctgaggtaggaag

SEQ ID NO: 7199238 - DNA, 22 bp, Homo sapiens
acaggtggacacagcagcagtc

SEQ ID NO: 7199239 - DNA, 22 bp, Homo sapiens
acaggtggacacagcagcagtc

SEQ ID NO: 7199240 - DNA, 22 bp, Homo sapiens
acaggtggaggctttaggaggt

SEQ ID NO: 7199241 - DNA, 22 bp, Homo sapiens
acaggtggaggctttaggaggt

SEQ ID NO: 7199242 - DNA, 22 bp, Homo sapiens
acaggtggagtggttagcaggc

SEQ ID NO: 7199243 - DNA, 22 bp, Homo sapiens
acaggtggagtggttagcaggc

SEQ ID NO: 7199244 - DNA, 22 bp, Homo sapiens
acaggtggcactgctgttactc

SEQ ID NO: 7199245 - DNA, 22 bp, Homo sapiens
acaggtggcactgctgttactc

SEQ ID NO: 7199246 - DNA, 22 bp, Homo sapiens
acaggtggcagaagcatttact

SEQ ID NO: 7199247 - DNA, 22 bp, Homo sapiens
acaggtggcagaagcatttact

SEQ ID NO: 7199248 - DNA, 22 bp, Homo sapiens
acaggtggcataggcagtttga

SEQ ID NO: 7199249 - DNA, 22 bp, Homo sapiens
acaggtggccccgagggagtgg

SEQ ID NO: 7199250 - DNA, 22 bp, Homo sapiens
acaggtggccccgagggagtgg

SEQ ID NO: 7199251 - DNA, 22 bp, Homo sapiens
acagggcacctgaggtaggaag

SEQ ID NO: 7199252 - DNA, 22 bp, Homo sapiens
acagggcacctgaggtaggaag

SEQ ID NO: 7199253 - DNA, 22 bp, Homo sapiens
acagggtggggatggtgagctt

SEQ ID NO: 7199254 - DNA, 22 bp, Homo sapiens
acagggtggggatggtgagctt

SEQ ID NO: 7199255 - DNA, 22 bp, Homo sapiens
acagggttgaagagcataaagt

SEQ ID NO: 7199256 - DNA, 22 bp, Homo sapiens
acagggttgtggccttaaaggc

SEQ ID NO: 7199257 - DNA, 22 bp, Homo sapiens
acagggttgtggccttaaaggc

SEQ ID NO: 7199258 - DNA, 22 bp, Homo sapiens
acaggtgcatgctaccatgtct

SEQ ID NO: 7199259 - DNA, 22 bp, Homo sapiens
acaggtggaaacatggtgttgg

SEQ ID NO: 7199260 - DNA, 22 bp, Homo sapiens
acaggtggacacagcagcagtc

SEQ ID NO: 7199261 - DNA, 22 bp, Homo sapiens
acaggtggacacagcagcagtc

SEQ ID NO: 7199262 - DNA, 22 bp, Homo sapiens
acaggtggacacagcagcagtc

SEQ ID NO: 7199263 - DNA, 22 bp, Homo sapiens
acaggtggaaacatggtgttgg

SEQ ID NO: 7199264 - DNA, 22 bp, Homo sapiens
acaggtggacacagcagcagtc

SEQ ID NO: 7199265 - DNA, 22 bp, Homo sapiens
acaggtggacacagcagcagtc

SEQ ID NO: 7199266 - DNA, 22 bp, Homo sapiens
acagtgaggacagggactgtgt

SEQ ID NO: 7199267 - DNA, 22 bp, Homo sapiens
aggagtggaattactgggttct

SEQ ID NO: 7199268 - DNA, 22 bp, Homo sapiens
aggagtggaattactgggttct

SEQ ID NO: 7199269 - DNA, 22 bp, Homo sapiens
aggagtggaattactgggttct

SEQ ID NO: 7199270 - DNA, 22 bp, Homo sapiens
aggagtggaattactgggttct

SEQ ID NO: 7199271 - DNA, 22 bp, Homo sapiens
aggagtgcaaatagtccagaga

SEQ ID NO: 7199272 - DNA, 22 bp, Homo sapiens
aggagtgagtgtcctcagcaga

SEQ ID NO: 7199273 - DNA, 22 bp, Homo sapiens
aggagtgccttttcatgagtgt

SEQ ID NO: 7199274 - DNA, 22 bp, Homo sapiens
aggagtgctgcaagttgacaga

SEQ ID NO: 7199275 - DNA, 22 bp, Homo sapiens
aggagtgagtgtcctcagcaga

SEQ ID NO: 7199276 - DNA, 22 bp, Homo sapiens
aggagtgagctttggggtcaga

SEQ ID NO: 7199277 - DNA, 22 bp, Homo sapiens
aggagtcattgagaggggtcct

SEQ ID NO: 7199278 - DNA, 20 bp, Homo sapiens
aggagtccctgtgctctctc

SEQ ID NO: 7199279 - DNA, 20 bp, Homo sapiens
aggagtccctgtgctctctc

SEQ ID NO: 7199280 - DNA, 22 bp, Homo sapiens
aggagtcagattgtttgaatgt

SEQ ID NO: 7199281 - DNA, 22 bp, Homo sapiens
aggagtcaggaccaaatggaaa

SEQ ID NO: 7199282 - DNA, 22 bp, Homo sapiens
aggagtcataaatgtgaacaaa

SEQ ID NO: 7199283 - DNA, 22 bp, Homo sapiens
aggagtcataaatgtgaacaaa

SEQ ID NO: 7199284 - DNA, 22 bp, Homo sapiens
aggagtcactcagggcttcatc

SEQ ID NO: 7199285 - DNA, 22 bp, Homo sapiens
aggagtcagatatgggaaagtt

SEQ ID NO: 7199286 - DNA, 22 bp, Homo sapiens
aggagggtgatccgggctggtc

SEQ ID NO: 7199287 - DNA, 22 bp, Homo sapiens
aggagggtgatccgggctggtc

SEQ ID NO: 7199288 - DNA, 22 bp, Homo sapiens
acagtacaaaacccaccagagg

SEQ ID NO: 7199289 - DNA, 22 bp, Homo sapiens
acagtacaagcaatgcattttt

SEQ ID NO: 7199290 - DNA, 22 bp, Homo sapiens
acagtacaagcaatgcattttt

SEQ ID NO: 7199291 - DNA, 22 bp, Homo sapiens
acagtacaagcatgatacataa

SEQ ID NO: 7199292 - DNA, 22 bp, Homo sapiens
acagtacaagcatgatacataa

SEQ ID NO: 7199293 - DNA, 22 bp, Homo sapiens
acagtacaagcatgatacataa

SEQ ID NO: 7199294 - DNA, 22 bp, Homo sapiens
acagtacaagcatgatacataa

SEQ ID NO: 7199295 - DNA, 22 bp, Homo sapiens
aggagggtcatgttgaagtgta

SEQ ID NO: 7199296 - DNA, 22 bp, Homo sapiens
aggagggtgatccgggctggtc

SEQ ID NO: 7199297 - DNA, 22 bp, Homo sapiens
aggagggtgatccgggctggtc

SEQ ID NO: 7199298 - DNA, 21 bp, Homo sapiens
aggaggaacccgtggctgggc

SEQ ID NO: 7199299 - DNA, 23 bp, Homo sapiens
aggaggaaaagttatctgctgag

SEQ ID NO: 7199300 - DNA, 20 bp, Homo sapiens
aggaggaaaaaatgacgagc

SEQ ID NO: 7199301 - DNA, 22 bp, Homo sapiens
aggaggaaaaaggccacagcaa

SEQ ID NO: 7199302 - DNA, 23 bp, Homo sapiens
aggaggaaaagttatctgctgag

SEQ ID NO: 7199303 - DNA, 23 bp, Homo sapiens
aggaggaaaagttatctgctgag

SEQ ID NO: 7199304 - DNA, 22 bp, Homo sapiens
aggaggaactcagaaagaaggt

SEQ ID NO: 7199305 - DNA, 20 bp, Homo sapiens
aggaggaagaaagcacactg

SEQ ID NO: 7199306 - DNA, 22 bp, Homo sapiens
acagtaaatcaacagaatatct

SEQ ID NO: 7199307 - DNA, 21 bp, Homo sapiens
aggaggaacccgtggctgggc

SEQ ID NO: 7199308 - DNA, 21 bp, Homo sapiens
aggaggaacccgtggctgggc

SEQ ID NO: 7199309 - DNA, 21 bp, Homo sapiens
aggaggaacccgtggctgggc

SEQ ID NO: 7199310 - DNA, 22 bp, Homo sapiens
aggaggaactcagaaagaaggt

SEQ ID NO: 7199311 - DNA, 22 bp, Homo sapiens
aggaggaactcagaaagaaggt

SEQ ID NO: 7199312 - DNA, 22 bp, Homo sapiens
acagtaatgcatacaagttagt

SEQ ID NO: 7199313 - DNA, 22 bp, Homo sapiens
acagtaattaaggtctgaaacg

SEQ ID NO: 7199314 - DNA, 22 bp, Homo sapiens
acagtaatctgggaacttgtta

SEQ ID NO: 7199315 - DNA, 22 bp, Homo sapiens
acagtaatgataaccagcattt

SEQ ID NO: 7199316 - DNA, 21 bp, Homo sapiens
acagtaaattccctgcaaaga

SEQ ID NO: 7199317 - DNA, 21 bp, Homo sapiens
acagtaaattccctgcaaaga

SEQ ID NO: 7199318 - DNA, 22 bp, Homo sapiens
acagtaacctctcctctgaagg

SEQ ID NO: 7199319 - DNA, 17 bp, Homo sapiens
acagtaactatgttatg

SEQ ID NO: 7199320 - DNA, 22 bp, Homo sapiens
acagtaagggtaaataagaaca

SEQ ID NO: 7199321 - DNA, 22 bp, Homo sapiens
acagtaagggtaaataagaaca

SEQ ID NO: 7199322 - DNA, 22 bp, Homo sapiens
acagtaataagtgttggtgagg

SEQ ID NO: 7199323 - DNA, 22 bp, Homo sapiens
aggcagcattcaggggtgatga

SEQ ID NO: 7199324 - DNA, 22 bp, Homo sapiens
aggcagcatgggccccagctcc

SEQ ID NO: 7199325 - DNA, 22 bp, Homo sapiens
aggcagcatgggccccagctcc

SEQ ID NO: 7199326 - DNA, 22 bp, Homo sapiens
aggcagcatgggcccagagtcc

SEQ ID NO: 7199327 - DNA, 19 bp, Homo sapiens
aggcagcattctggggctt

SEQ ID NO: 7199328 - DNA, 22 bp, Homo sapiens
acagtttgccctgacattctcc

SEQ ID NO: 7199329 - DNA, 22 bp, Homo sapiens
acagtttggttgctacagtaaa

SEQ ID NO: 7199330 - DNA, 17 bp, Homo sapiens
acagtttgtcattctaa

SEQ ID NO: 7199331 - DNA, 22 bp, Homo sapiens
aggcagcatgggcccagagtcc

SEQ ID NO: 7199332 - DNA, 22 bp, Homo sapiens
aggcagcatgctctgcttctac

SEQ ID NO: 7199333 - DNA, 22 bp, Homo sapiens
aggcagcatccagaggagaatg

SEQ ID NO: 7199334 - DNA, 22 bp, Homo sapiens
aggcagcatccagaggagaatg

SEQ ID NO: 7199335 - DNA, 22 bp, Homo sapiens
aggcagcatccagaggagaatg

SEQ ID NO: 7199336 - DNA, 22 bp, Homo sapiens
aggcagcatccagaggagaatg

SEQ ID NO: 7199337 - DNA, 22 bp, Homo sapiens
aggcagcatccagaggagaatg

SEQ ID NO: 7199338 - DNA, 22 bp, Homo sapiens
aggcagcagtgataagatagga

SEQ ID NO: 7199339 - DNA, 22 bp, Homo sapiens
aggcagcagtgataagatagga

SEQ ID NO: 7199340 - DNA, 22 bp, Homo sapiens
aggcagcaattgaaatcattgt

SEQ ID NO: 7199341 - DNA, 19 bp, Homo sapiens
aggcagcacccagtccttg

SEQ ID NO: 7199342 - DNA, 19 bp, Homo sapiens
aggcagcacccagtccttg

SEQ ID NO: 7199343 - DNA, 22 bp, Homo sapiens
aggcagcagtgataagatagga

SEQ ID NO: 7199344 - DNA, 22 bp, Homo sapiens
aggcaggcaagttcatatgagg

SEQ ID NO: 7199345 - DNA, 22 bp, Homo sapiens
aggcaggcaagttcatatgagg

SEQ ID NO: 7199346 - DNA, 22 bp, Homo sapiens
aggcaggcaaccacctgggaag

SEQ ID NO: 7199347 - DNA, 22 bp, Homo sapiens
aggcaggcaaccacctgggaag

SEQ ID NO: 7199348 - DNA, 22 bp, Homo sapiens
aggcaggcaagttcatatgagg

SEQ ID NO: 7199349 - DNA, 22 bp, Homo sapiens
aggcaggcactccggaagtgtc

SEQ ID NO: 7199350 - DNA, 22 bp, Homo sapiens
aggcaggcactccggaagtgtc

SEQ ID NO: 7199351 - DNA, 22 bp, Homo sapiens
aggcaggcacacttcctccagg

SEQ ID NO: 7199352 - DNA, 22 bp, Homo sapiens
aggcaggcactccggaagtgtc

SEQ ID NO: 7199353 - DNA, 22 bp, Homo sapiens
aggcaggattgctgacaacaat

SEQ ID NO: 7199354 - DNA, 22 bp, Homo sapiens
aggcaggattgctgacaacaat

SEQ ID NO: 7199355 - DNA, 22 bp, Homo sapiens
aggcaggattgctgacaacaat

SEQ ID NO: 7199356 - DNA, 22 bp, Homo sapiens
aggcaggattgctgacaacaat

SEQ ID NO: 7199357 - DNA, 22 bp, Homo sapiens
aggcaggattgctgacaacaat

SEQ ID NO: 7199358 - DNA, 22 bp, Homo sapiens
aggcaggcaaccacctgggaag

SEQ ID NO: 7199359 - DNA, 22 bp, Homo sapiens
aggcaggcaaccacctgggaag

SEQ ID NO: 7199360 - DNA, 22 bp, Homo sapiens
aggcaggcaaccacctgggaag

SEQ ID NO: 7199361 - DNA, 22 bp, Homo sapiens
aggcaggcaaccacctgggaag

SEQ ID NO: 7199362 - DNA, 22 bp, Homo sapiens
aggcagctggaggcagagacta

SEQ ID NO: 7199363 - DNA, 22 bp, Homo sapiens
aggcagctggcaaattctagag

SEQ ID NO: 7199364 - DNA, 21 bp, Homo sapiens
aggcaggattcaaacacagag

SEQ ID NO: 7199365 - DNA, 22 bp, Homo sapiens
acataaatagattattgggagg

SEQ ID NO: 7199366 - DNA, 22 bp, Homo sapiens
acataaatagattattgggagg

SEQ ID NO: 7199367 - DNA, 22 bp, Homo sapiens
acataaaggtgactaacatctt

SEQ ID NO: 7199368 - DNA, 21 bp, Homo sapiens
acagttttaaggagcacatgg

SEQ ID NO: 7199369 - DNA, 21 bp, Homo sapiens
acagttttaaggagcacatgg

SEQ ID NO: 7199370 - DNA, 22 bp, Homo sapiens
acagtttgttccttttcattgc

SEQ ID NO: 7199371 - DNA, 22 bp, Homo sapiens
acagtttgttccttttcattgc

SEQ ID NO: 7199372 - DNA, 22 bp, Homo sapiens
acagttaccacttagcagttac

SEQ ID NO: 7199373 - DNA, 22 bp, Homo sapiens
acagttaataagtagtaagtca

SEQ ID NO: 7199374 - DNA, 22 bp, Homo sapiens
acagttaataagtagtaagtca

SEQ ID NO: 7199375 - DNA, 22 bp, Homo sapiens
acagttaatatgtgacagaact

SEQ ID NO: 7199376 - DNA, 22 bp, Homo sapiens
acagttaatcaaatggcatatg

SEQ ID NO: 7199377 - DNA, 22 bp, Homo sapiens
acagttatttactgcataaact

SEQ ID NO: 7199378 - DNA, 22 bp, Homo sapiens
acagttattctttatgcaacca

SEQ ID NO: 7199379 - DNA, 22 bp, Homo sapiens
acagttatctttgaaatagaga

SEQ ID NO: 7199380 - DNA, 22 bp, Homo sapiens
acagttatctttgaaatagaga

SEQ ID NO: 7199381 - DNA, 23 bp, Homo sapiens
acagttatagctgtgaataacat

SEQ ID NO: 7199382 - DNA, 23 bp, Homo sapiens
acagttatagctgtgaataacat

SEQ ID NO: 7199383 - DNA, 22 bp, Homo sapiens
acagttcaagtcttagacaaca

SEQ ID NO: 7199384 - DNA, 22 bp, Homo sapiens
acagttcaagtcttagacaaca

SEQ ID NO: 7199385 - DNA, 22 bp, Homo sapiens
acagttcaagtcttagacaaca

SEQ ID NO: 7199386 - DNA, 22 bp, Homo sapiens
acagtgatgagccggctgaggc

SEQ ID NO: 7199387 - DNA, 22 bp, Homo sapiens
acagtgatgggggtgcaggaag

SEQ ID NO: 7199388 - DNA, 22 bp, Homo sapiens
acagtgaggacagggactgtgt

SEQ ID NO: 7199389 - DNA, 22 bp, Homo sapiens
acagtgataaaatttcacatgt

SEQ ID NO: 7199390 - DNA, 22 bp, Homo sapiens
acagtgataaaatttcacatgt

SEQ ID NO: 7199391 - DNA, 22 bp, Homo sapiens
acagtgatcagttactgtctgt

SEQ ID NO: 7199392 - DNA, 22 bp, Homo sapiens
acagtgattctgcaaaccatat

SEQ ID NO: 7199393 - DNA, 22 bp, Homo sapiens
acagtgattggggtatctgcag

SEQ ID NO: 7199394 - DNA, 22 bp, Homo sapiens
acagtgattggggtatctgcag

SEQ ID NO: 7199395 - DNA, 18 bp, Homo sapiens
acagtgattgttctatgc

SEQ ID NO: 7199396 - DNA, 22 bp, Homo sapiens
acagtgatttcatccttctggg

SEQ ID NO: 7199397 - DNA, 22 bp, Homo sapiens
acagtgattttttcgagcagaa

SEQ ID NO: 7199398 - DNA, 22 bp, Homo sapiens
acagtgcaaaccctcgggaaag

SEQ ID NO: 7199399 - DNA, 22 bp, Homo sapiens
acagtgcaaaccctcgggaaag

SEQ ID NO: 7199400 - DNA, 20 bp, Homo sapiens
acagtgtttttgagtagagc

SEQ ID NO: 7199401 - DNA, 22 bp, Homo sapiens
acagttaagcagtatgatcaca

SEQ ID NO: 7199402 - DNA, 22 bp, Homo sapiens
acagttaagcagtatgatcaca

SEQ ID NO: 7199403 - DNA, 22 bp, Homo sapiens
acagtgttttgtctggcagggc

SEQ ID NO: 7199404 - DNA, 22 bp, Homo sapiens
acagtgttttcttaaggagaaa

SEQ ID NO: 7199405 - DNA, 22 bp, Homo sapiens
acagtgttttagaaaagcttga

SEQ ID NO: 7199406 - DNA, 22 bp, Homo sapiens
acagtgttctgctttttaatcc

SEQ ID NO: 7199407 - DNA, 22 bp, Homo sapiens
acagtgcagggcgggaagaagg

SEQ ID NO: 7199408 - DNA, 22 bp, Homo sapiens
acagtgcagggcgggaagaagg

SEQ ID NO: 7199409 - DNA, 22 bp, Homo sapiens
acagtgcacatcctgagtgatt

SEQ ID NO: 7199410 - DNA, 22 bp, Homo sapiens
acagtgcaaacttttgtctcct

SEQ ID NO: 7199411 - DNA, 22 bp, Homo sapiens
acagtgcaaataggactgtctt

SEQ ID NO: 7199412 - DNA, 22 bp, Homo sapiens
acagtgcaaataggactgtctt

SEQ ID NO: 7199413 - DNA, 22 bp, Homo sapiens
acagtgcacatcctgagtgatt

SEQ ID NO: 7199414 - DNA, 22 bp, Homo sapiens
acagtgcacatcctgagtgatt

SEQ ID NO: 7199415 - DNA, 22 bp, Homo sapiens
aaagagcccttccatgactctt

SEQ ID NO: 7199416 - DNA, 22 bp, Homo sapiens
aaagagccagggcattaggtga

SEQ ID NO: 7199417 - DNA, 18 bp, Homo sapiens
aaagagccacccagggcc

SEQ ID NO: 7199418 - DNA, 22 bp, Homo sapiens
aaagagccagctacctcagttt

SEQ ID NO: 7199419 - DNA, 22 bp, Homo sapiens
aaagagccgctgatgtcagccc

SEQ ID NO: 7199420 - DNA, 22 bp, Homo sapiens
aaagagcctatattcagctgca

SEQ ID NO: 7199421 - DNA, 22 bp, Homo sapiens
aaagagctaacattgccgagat

SEQ ID NO: 7199422 - DNA, 22 bp, Homo sapiens
aaagagctatacaaccatgtcc

SEQ ID NO: 7199423 - DNA, 22 bp, Homo sapiens
aaagagctatacaaccatgtcc

SEQ ID NO: 7199424 - DNA, 22 bp, Homo sapiens
aaaattgagagttatagatggt

SEQ ID NO: 7199425 - DNA, 22 bp, Homo sapiens
aaaattgaggccagtatgccat

SEQ ID NO: 7199426 - DNA, 22 bp, Homo sapiens
aaaattgaggccagtatgccat

SEQ ID NO: 7199427 - DNA, 22 bp, Homo sapiens
aaaattgagagttatagatggt

SEQ ID NO: 7199428 - DNA, 22 bp, Homo sapiens
aaaattgaggctcatgttaaat

SEQ ID NO: 7199429 - DNA, 22 bp, Homo sapiens
aaaattgaggctcatgttaaat

SEQ ID NO: 7199430 - DNA, 22 bp, Homo sapiens
aaaattgagagtcttgtgcaag

SEQ ID NO: 7199431 - DNA, 22 bp, Homo sapiens
aaaattgagagtcttgtgcaag

SEQ ID NO: 7199432 - DNA, 22 bp, Homo sapiens
aaaattgaagtgatcaggaact

SEQ ID NO: 7199433 - DNA, 22 bp, Homo sapiens
aaaattgaagtgatcaggaact

SEQ ID NO: 7199434 - DNA, 22 bp, Homo sapiens
aaaattctgtcattaaattgtg

SEQ ID NO: 7199435 - DNA, 22 bp, Homo sapiens
aaaatgtgatctacaaatgcaa

SEQ ID NO: 7199436 - DNA, 22 bp, Homo sapiens
aaaattctcttgatcttgacag

SEQ ID NO: 7199437 - DNA, 22 bp, Homo sapiens
aaaattctcttgatcttgacag

SEQ ID NO: 7199438 - DNA, 17 bp, Homo sapiens
aaaattctgtaaagagg

SEQ ID NO: 7199439 - DNA, 17 bp, Homo sapiens
aaaattctgtaaagagg

SEQ ID NO: 7199440 - DNA, 22 bp, Homo sapiens
aaacactaataacagtggctgg

SEQ ID NO: 7199441 - DNA, 22 bp, Homo sapiens
aaacaccagtcccagtatacac

SEQ ID NO: 7199442 - DNA, 22 bp, Homo sapiens
aaacaccagtcccagtatacac

SEQ ID NO: 7199443 - DNA, 22 bp, Homo sapiens
aaacaccagtcccagtatacac

SEQ ID NO: 7199444 - DNA, 22 bp, Homo sapiens
aaacacgtataatgtgacagag

SEQ ID NO: 7199445 - DNA, 22 bp, Homo sapiens
aaacaccaagagctagctatta

SEQ ID NO: 7199446 - DNA, 22 bp, Homo sapiens
aaacacattttaggaaaatcta

SEQ ID NO: 7199447 - DNA, 22 bp, Homo sapiens
aaacaccaagagctagctatta

SEQ ID NO: 7199448 - DNA, 22 bp, Homo sapiens
aaacacattttaggaaaatcta

SEQ ID NO: 7199449 - DNA, 22 bp, Homo sapiens
aaacacattagccctgtggaaa

SEQ ID NO: 7199450 - DNA, 22 bp, Homo sapiens
aaacacattttaggaaaatcta

SEQ ID NO: 7199451 - DNA, 22 bp, Homo sapiens
aaacacattttaggaaaatcta

SEQ ID NO: 7199452 - DNA, 22 bp, Homo sapiens
aaacacattttaggaaaatcta

SEQ ID NO: 7199453 - DNA, 22 bp, Homo sapiens
aaacacatcattcatgtcgtca

SEQ ID NO: 7199454 - DNA, 22 bp, Homo sapiens
aaacacattagccctgtggaaa

SEQ ID NO: 7199455 - DNA, 22 bp, Homo sapiens
aaacacattagccctgtggaaa

SEQ ID NO: 7199456 - DNA, 22 bp, Homo sapiens
aaagagctcacagtccactgga

SEQ ID NO: 7199457 - DNA, 22 bp, Homo sapiens
aaagagctcacagtccactgga

SEQ ID NO: 7199458 - DNA, 22 bp, Homo sapiens
aaagagctcttactctagtgta

SEQ ID NO: 7199459 - DNA, 22 bp, Homo sapiens
aaagagctcttactctagtgta

SEQ ID NO: 7199460 - DNA, 22 bp, Homo sapiens
aaagagctcttactctagtgta

SEQ ID NO: 7199461 - DNA, 22 bp, Homo sapiens
aaagagctcttactctagtgta

SEQ ID NO: 7199462 - DNA, 22 bp, Homo sapiens
aaagagctgagacctggtggag

SEQ ID NO: 7199463 - DNA, 22 bp, Homo sapiens
aaagagctgatagcatctgttt

SEQ ID NO: 7199464 - DNA, 22 bp, Homo sapiens
aaagagctggcatttatagtct

SEQ ID NO: 7199465 - DNA, 22 bp, Homo sapiens
aaagagctggcatttatagtct

SEQ ID NO: 7199466 - DNA, 22 bp, Homo sapiens
aaagagctgggacttaaagtgc

SEQ ID NO: 7199467 - DNA, 22 bp, Homo sapiens
aaagagctgggacttaaagtgc

SEQ ID NO: 7199468 - DNA, 22 bp, Homo sapiens
aaagagcttgcttgctttatat

SEQ ID NO: 7199469 - DNA, 22 bp, Homo sapiens
aaagagcttgcttgctttatat

SEQ ID NO: 7199470 - DNA, 17 bp, Homo sapiens
aaagagcttggagtgtt

SEQ ID NO: 7199471 - DNA, 22 bp, Homo sapiens
aaacacaagaggcagggtacag

SEQ ID NO: 7199472 - DNA, 22 bp, Homo sapiens
aaacacaagaggcagggtacag

SEQ ID NO: 7199473 - DNA, 22 bp, Homo sapiens
aaacacaagatggcctcttctg

SEQ ID NO: 7199474 - DNA, 22 bp, Homo sapiens
aaactggattaccaggctggtg

SEQ ID NO: 7199475 - DNA, 22 bp, Homo sapiens
aaactgggattcttcacaaggt

SEQ ID NO: 7199476 - DNA, 17 bp, Homo sapiens
aaactggggtcaggagc

SEQ ID NO: 7199477 - DNA, 22 bp, Homo sapiens
aaactggtaataaaatggatta

SEQ ID NO: 7199478 - DNA, 22 bp, Homo sapiens
aaactgggttgtggtcagtggt

SEQ ID NO: 7199479 - DNA, 22 bp, Homo sapiens
aaactgggttgtggtcagtggt

SEQ ID NO: 7199480 - DNA, 22 bp, Homo sapiens
aaactggtaatcggcaagtgag

SEQ ID NO: 7199481 - DNA, 22 bp, Homo sapiens
aaactggtaatcggcaagtgag

SEQ ID NO: 7199482 - DNA, 22 bp, Homo sapiens
aaactggtattcaaatgtttgg

SEQ ID NO: 7199483 - DNA, 22 bp, Homo sapiens
aaactggtagcaatttaagggt

SEQ ID NO: 7199484 - DNA, 22 bp, Homo sapiens
aaaatgtgatctacaaatgcaa

SEQ ID NO: 7199485 - DNA, 22 bp, Homo sapiens
aaactgcatgaagctgatttta

SEQ ID NO: 7199486 - DNA, 22 bp, Homo sapiens
aaactgcactttattttgtcaa

SEQ ID NO: 7199487 - DNA, 22 bp, Homo sapiens
aaactgcacatgaggctggtgc

SEQ ID NO: 7199488 - DNA, 22 bp, Homo sapiens
aaactgcagagccatggttcaa

SEQ ID NO: 7199489 - DNA, 22 bp, Homo sapiens
aaactgcacaagggtgcatagc

SEQ ID NO: 7199490 - DNA, 22 bp, Homo sapiens
aaactgcacacgatgtgcctga

SEQ ID NO: 7199491 - DNA, 22 bp, Homo sapiens
aaaatatgtataactcttctgc

SEQ ID NO: 7199492 - DNA, 22 bp, Homo sapiens
aaaatatgtataactcttctgc

SEQ ID NO: 7199493 - DNA, 20 bp, Homo sapiens
aaaatatgtataactcttct

SEQ ID NO: 7199494 - DNA, 22 bp, Homo sapiens
aaaatatgtataactcttctgc

SEQ ID NO: 7199495 - DNA, 22 bp, Homo sapiens
aaaatattttagggccaggaga

SEQ ID NO: 7199496 - DNA, 22 bp, Homo sapiens
aaaatattttagggccaggaga

SEQ ID NO: 7199497 - DNA, 22 bp, Homo sapiens
aaaatatggggtgagcccagag

SEQ ID NO: 7199498 - DNA, 20 bp, Homo sapiens
aaaatatgtataactcttct

SEQ ID NO: 7199499 - DNA, 22 bp, Homo sapiens
aaaatactgtggagtgttgaaa

SEQ ID NO: 7199500 - DNA, 22 bp, Homo sapiens
aaaatactgtggagtgttgaaa

SEQ ID NO: 7199501 - DNA, 22 bp, Homo sapiens
aaaatatgaagttgtcagtatg

SEQ ID NO: 7199502 - DNA, 22 bp, Homo sapiens
aaaatatgaagttgtcagtatg

SEQ ID NO: 7199503 - DNA, 22 bp, Homo sapiens
aaacagtagaagtgtattttat

SEQ ID NO: 7199504 - DNA, 22 bp, Homo sapiens
aaacagtattatcaatatattt

SEQ ID NO: 7199505 - DNA, 22 bp, Homo sapiens
aaacagtattatcaatatattt

SEQ ID NO: 7199506 - DNA, 22 bp, Homo sapiens
aaacagtaagttctagtattat

SEQ ID NO: 7199507 - DNA, 22 bp, Homo sapiens
aaacagtaagttctagtattat

SEQ ID NO: 7199508 - DNA, 22 bp, Homo sapiens
aaacaggcacatagtaacattt

SEQ ID NO: 7199509 - DNA, 22 bp, Homo sapiens
aaacaggcgcttactaagaaaa

SEQ ID NO: 7199510 - DNA, 22 bp, Homo sapiens
aaacaggcttatattttgctct

SEQ ID NO: 7199511 - DNA, 22 bp, Homo sapiens
aaacaggcttccattagagcaa

SEQ ID NO: 7199512 - DNA, 22 bp, Homo sapiens
aaacaggcttgcaacatgtttt

SEQ ID NO: 7199513 - DNA, 22 bp, Homo sapiens
aaacaggtagccctagccttct

SEQ ID NO: 7199514 - DNA, 22 bp, Homo sapiens
aaacaggtctgaaaatagctac

SEQ ID NO: 7199515 - DNA, 22 bp, Homo sapiens
aaaaggaggtcactttattcct

SEQ ID NO: 7199516 - DNA, 22 bp, Homo sapiens
aaaaggaggtcactttattcct

SEQ ID NO: 7199517 - DNA, 21 bp, Homo sapiens
aaaaggaggcaggtgaacagc

SEQ ID NO: 7199518 - DNA, 22 bp, Homo sapiens
aaaaggaggtcactttattcct

SEQ ID NO: 7199519 - DNA, 22 bp, Homo sapiens
aaaaatacttcacttctgggtg

SEQ ID NO: 7199520 - DNA, 22 bp, Homo sapiens
aaaaagtttcaactgccaactc

SEQ ID NO: 7199521 - DNA, 18 bp, Homo sapiens
aaaaagtgctcaggccta

SEQ ID NO: 7199522 - DNA, 22 bp, Homo sapiens
aaaaatacttcacttctgggtg

SEQ ID NO: 7199523 - DNA, 22 bp, Homo sapiens
aaaaatacttcacttctgggtg

SEQ ID NO: 7199524 - DNA, 22 bp, Homo sapiens
aaaaagtcatattcttgttcct

SEQ ID NO: 7199525 - DNA, 22 bp, Homo sapiens
aaaaagtctgcaaaggaggttg

SEQ ID NO: 7199526 - DNA, 22 bp, Homo sapiens
aaaaagcttaaatgagcagttc

SEQ ID NO: 7199527 - DNA, 21 bp, Homo sapiens
aaaaagctggggcatgcatgc

SEQ ID NO: 7199528 - DNA, 21 bp, Homo sapiens
aaaaagctggggcatgcatgc

SEQ ID NO: 7199529 - DNA, 21 bp, Homo sapiens
aaaaagctggggcatgcatgc

SEQ ID NO: 7199530 - DNA, 22 bp, Homo sapiens
aaaaagatgtcctgaagtttag

SEQ ID NO: 7199531 - DNA, 22 bp, Homo sapiens
aaaaagggatttgtgatccagg

SEQ ID NO: 7199532 - DNA, 22 bp, Homo sapiens
aaaaaggttgatccagattagg

SEQ ID NO: 7199533 - DNA, 22 bp, Homo sapiens
aaaaagcttaaatgagcagttc

SEQ ID NO: 7199534 - DNA, 22 bp, Homo sapiens
aaaaaggctaagcatcttgtgc

SEQ ID NO: 7199535 - DNA, 22 bp, Homo sapiens
aaaaagggatttgtgatccagg

SEQ ID NO: 7199536 - DNA, 22 bp, Homo sapiens
aaaaagtattggccatggttga

SEQ ID NO: 7199537 - DNA, 22 bp, Homo sapiens
aaaaagtattggccatggttga

SEQ ID NO: 7199538 - DNA, 22 bp, Homo sapiens
aaaaggctagctagtaacagaa

SEQ ID NO: 7199539 - DNA, 22 bp, Homo sapiens
aaaaggctcttcaaaatggaag

SEQ ID NO: 7199540 - DNA, 22 bp, Homo sapiens
aaaaggctaattaagttttgga

SEQ ID NO: 7199541 - DNA, 22 bp, Homo sapiens
aaaaggctaatccagagcaact

SEQ ID NO: 7199542 - DNA, 22 bp, Homo sapiens
aaaaggcattttgtcaaccata

SEQ ID NO: 7199543 - DNA, 22 bp, Homo sapiens
aaaaggcatggaggttgatagt

SEQ ID NO: 7199544 - DNA, 22 bp, Homo sapiens
aaaaggatgttttcatgaaaca

SEQ ID NO: 7199545 - DNA, 22 bp, Homo sapiens
aaaaggatgttttcatgaaaca

SEQ ID NO: 7199546 - DNA, 22 bp, Homo sapiens
aaaaggcagtgcaagagagggt

SEQ ID NO: 7199547 - DNA, 22 bp, Homo sapiens
aaaaggcagtgcaagagagggt

SEQ ID NO: 7199548 - DNA, 22 bp, Homo sapiens
aaaaggcagtgcaagagagggt

SEQ ID NO: 7199549 - DNA, 22 bp, Homo sapiens
aaaaggcagtgcaagagagggt

SEQ ID NO: 7199550 - DNA, 22 bp, Homo sapiens
aaaaggcagtgcaagagagggt

SEQ ID NO: 7199551 - DNA, 22 bp, Homo sapiens
aaaaggcatggaggttgatagt

SEQ ID NO: 7199552 - DNA, 22 bp, Homo sapiens
aaaaggcatggaggttgatagt

SEQ ID NO: 7199553 - DNA, 22 bp, Homo sapiens
aaaaggcatggaggttgatagt

SEQ ID NO: 7199554 - DNA, 22 bp, Homo sapiens
aaaaggcatggaggttgatagt

SEQ ID NO: 7199555 - DNA, 22 bp, Homo sapiens
aaaactgaaatacgatccaatg

SEQ ID NO: 7199556 - DNA, 22 bp, Homo sapiens
aaaactgaaatacgatccaatg

SEQ ID NO: 7199557 - DNA, 22 bp, Homo sapiens
aaaactcaaacattttggcata

SEQ ID NO: 7199558 - DNA, 22 bp, Homo sapiens
aaaactctgcagttagtttcta

SEQ ID NO: 7199559 - DNA, 22 bp, Homo sapiens
aaaactaaatacgctttgcctc

SEQ ID NO: 7199560 - DNA, 22 bp, Homo sapiens
aaaactaaatacgctttgcctc

SEQ ID NO: 7199561 - DNA, 22 bp, Homo sapiens
aaaactacatttgacattttgt

SEQ ID NO: 7199562 - DNA, 22 bp, Homo sapiens
aaaacctaagccagtagctccc

SEQ ID NO: 7199563 - DNA, 22 bp, Homo sapiens
aaaacctcagttctgctcttaa

SEQ ID NO: 7199564 - DNA, 22 bp, Homo sapiens
aaaacctgattgaattctattt

SEQ ID NO: 7199565 - DNA, 22 bp, Homo sapiens
aaaaccttcaggtttggagttt

SEQ ID NO: 7199566 - DNA, 22 bp, Homo sapiens
aaaaccttcaggtttggagttt

SEQ ID NO: 7199567 - DNA, 22 bp, Homo sapiens
aaaaccttctagactttatatt

SEQ ID NO: 7199568 - DNA, 22 bp, Homo sapiens
aaaacataaactgacagcccat

SEQ ID NO: 7199569 - DNA, 22 bp, Homo sapiens
aaaacataaactgacagcccat

SEQ ID NO: 7199570 - DNA, 22 bp, Homo sapiens
aaaaccaggcttgctgtgctcg

SEQ ID NO: 7199571 - DNA, 22 bp, Homo sapiens
aaaaccaggtagcaaaggagac

SEQ ID NO: 7199572 - DNA, 22 bp, Homo sapiens
aaaaccaggtagcaaaggagac

SEQ ID NO: 7199573 - DNA, 22 bp, Homo sapiens
aaaaccatgtatctatttcctt

SEQ ID NO: 7199574 - DNA, 22 bp, Homo sapiens
aaacagctttcagaatctctca

SEQ ID NO: 7199575 - DNA, 22 bp, Homo sapiens
aaacagcttgtttcaggaaagt

SEQ ID NO: 7199576 - DNA, 22 bp, Homo sapiens
aaacagcttgtttcaggaaagt

SEQ ID NO: 7199577 - DNA, 22 bp, Homo sapiens
aaaagtaattgtggttttggcc

SEQ ID NO: 7199578 - DNA, 22 bp, Homo sapiens
aaaagtaattgcagttttgtca

SEQ ID NO: 7199579 - DNA, 22 bp, Homo sapiens
aaaagtaattgcagttttgtca

SEQ ID NO: 7199580 - DNA, 22 bp, Homo sapiens
aaaagtaattgcagttttgcca

SEQ ID NO: 7199581 - DNA, 22 bp, Homo sapiens
aaaagtaattgcaattttgtag

SEQ ID NO: 7199582 - DNA, 22 bp, Homo sapiens
aaaagtaattgatgcaatcgta

SEQ ID NO: 7199583 - DNA, 22 bp, Homo sapiens
aaaagtaattgcaattttgtag

SEQ ID NO: 7199584 - DNA, 22 bp, Homo sapiens
aaaagtaattgatgcaatcgta

SEQ ID NO: 7199585 - DNA, 22 bp, Homo sapiens
aaaaggttttgagtacaaatat

SEQ ID NO: 7199586 - DNA, 22 bp, Homo sapiens
aaaaggttttgagtacaaatat

SEQ ID NO: 7199587 - DNA, 22 bp, Homo sapiens
aaaaggttttgagtacaaatat

SEQ ID NO: 7199588 - DNA, 22 bp, Homo sapiens
aaaaggtagttgccaaataagg

SEQ ID NO: 7199589 - DNA, 22 bp, Homo sapiens
aaaaggtagattctccttctat

SEQ ID NO: 7199590 - DNA, 22 bp, Homo sapiens
aaaaggtagttgccaaataagg

SEQ ID NO: 7199591 - DNA, 22 bp, Homo sapiens
aaaaggaggacatggttacaga

SEQ ID NO: 7199592 - DNA, 19 bp, Homo sapiens
aaaaggagagatcagagtt

SEQ ID NO: 7199593 - DNA, 22 bp, Homo sapiens
aaaactgaaccttgagatcttt

SEQ ID NO: 7199594 - DNA, 22 bp, Homo sapiens
aaaactgaggtttcctgaagaa

SEQ ID NO: 7199595 - DNA, 22 bp, Homo sapiens
aaaactgaggtttcctgaagaa

SEQ ID NO: 7199596 - DNA, 22 bp, Homo sapiens
aaaactttcagggatacagaaa

SEQ ID NO: 7199597 - DNA, 22 bp, Homo sapiens
aaaagaacctagctcctcagtc

SEQ ID NO: 7199598 - DNA, 22 bp, Homo sapiens
aaaatgttcaagcatgctggtt

SEQ ID NO: 7199599 - DNA, 22 bp, Homo sapiens
aaaatgttcaagcatgctggtt

SEQ ID NO: 7199600 - DNA, 18 bp, Homo sapiens
aaaatgttcccccattaa

SEQ ID NO: 7199601 - DNA, 21 bp, Homo sapiens
aaaatgtttccttgttggtta

SEQ ID NO: 7199602 - DNA, 22 bp, Homo sapiens
aaaattaagtgtctgggaagcc

SEQ ID NO: 7199603 - DNA, 22 bp, Homo sapiens
aaaattaagtgtctgggaagcc

SEQ ID NO: 7199604 - DNA, 22 bp, Homo sapiens
aaaattaagtgtctgggaagcc

SEQ ID NO: 7199605 - DNA, 22 bp, Homo sapiens
aaaattattcatggcttttgga

SEQ ID NO: 7199606 - DNA, 22 bp, Homo sapiens
aaaattcatagaactgtacgct

SEQ ID NO: 7199607 - DNA, 22 bp, Homo sapiens
aaaattcatagaactgtacgct

SEQ ID NO: 7199608 - DNA, 22 bp, Homo sapiens
aaaattcatagaactgtacgct

SEQ ID NO: 7199609 - DNA, 22 bp, Homo sapiens
aaaattcatagaactgtacgct

SEQ ID NO: 7199610 - DNA, 22 bp, Homo sapiens
aaaattcatagaactgtacgct

SEQ ID NO: 7199611 - DNA, 22 bp, Homo sapiens
aaaattcatggcttgggaaaag

SEQ ID NO: 7199612 - DNA, 22 bp, Homo sapiens
aaaattcatggcttgggaaaag

SEQ ID NO: 7199613 - DNA, 22 bp, Homo sapiens
aaaattcatggcttgggaaaag

SEQ ID NO: 7199614 - DNA, 22 bp, Homo sapiens
aaaattcatggcttgggaaaag

SEQ ID NO: 7199615 - DNA, 22 bp, Homo sapiens
aaaattcatggcttgggaaaag

SEQ ID NO: 7199616 - DNA, 22 bp, Homo sapiens
aaaattcatggcttgggaaaag

SEQ ID NO: 7199617 - DNA, 22 bp, Homo sapiens
aaaattcatggcttgggaaaag

SEQ ID NO: 7199618 - DNA, 22 bp, Homo sapiens
aaaattcatggcttgggaaaag

SEQ ID NO: 7199619 - DNA, 22 bp, Homo sapiens
aaaattaagtgtctgggaagcc

SEQ ID NO: 7199620 - DNA, 22 bp, Homo sapiens
aaaattaagtgtctgggaagcc

SEQ ID NO: 7199621 - DNA, 22 bp, Homo sapiens
aaagaacagatgtgtggtgcat

SEQ ID NO: 7199622 - DNA, 22 bp, Homo sapiens
aaagaacagatgtgtggtgcat

SEQ ID NO: 7199623 - DNA, 22 bp, Homo sapiens
aaagaacagatgtgtggtgcat

SEQ ID NO: 7199624 - DNA, 21 bp, Homo sapiens
aaagaacaggcagatgttctt

SEQ ID NO: 7199625 - DNA, 21 bp, Homo sapiens
aaagaacaggcagatgttctt

SEQ ID NO: 7199626 - DNA, 21 bp, Homo sapiens
aaagaacaggcagatgttctt

SEQ ID NO: 7199627 - DNA, 22 bp, Homo sapiens
aaagaacaatgtggaatctcct

SEQ ID NO: 7199628 - DNA, 22 bp, Homo sapiens
aaagaacaaattagctgtttta

SEQ ID NO: 7199629 - DNA, 22 bp, Homo sapiens
aaagactaagaagagtattatt

SEQ ID NO: 7199630 - DNA, 22 bp, Homo sapiens
aaagactaagaagagtattatt

SEQ ID NO: 7199631 - DNA, 22 bp, Homo sapiens
aaagactacacgggaaagagct

SEQ ID NO: 7199632 - DNA, 22 bp, Homo sapiens
aaagactagcatttatatgtac

SEQ ID NO: 7199633 - DNA, 22 bp, Homo sapiens
aaagactagcatttatatgtac

SEQ ID NO: 7199634 - DNA, 22 bp, Homo sapiens
aaagactcaattgttccctaat

SEQ ID NO: 7199635 - DNA, 22 bp, Homo sapiens
aaagactcactttcagctctgg

SEQ ID NO: 7199636 - DNA, 22 bp, Homo sapiens
aaagactcttaactccctagcg

SEQ ID NO: 7199637 - DNA, 23 bp, Homo sapiens
aaagactgaggaaagtctctgtc

SEQ ID NO: 7199638 - DNA, 22 bp, Homo sapiens
aaagactttcacctagcaaaga

SEQ ID NO: 7199639 - DNA, 22 bp, Homo sapiens
aaagactttcacctagcaaaga

SEQ ID NO: 7199640 - DNA, 22 bp, Homo sapiens
aaagactttcacctagcaaaga

SEQ ID NO: 7199641 - DNA, 22 bp, Homo sapiens
aaagacttgggtgaagtaattt

SEQ ID NO: 7199642 - DNA, 22 bp, Homo sapiens
aaagacttggcttatgatttgc

SEQ ID NO: 7199643 - DNA, 22 bp, Homo sapiens
aaagacttgggagcagtatgct

SEQ ID NO: 7199644 - DNA, 22 bp, Homo sapiens
aaagactgcaaaaacgcacaga

SEQ ID NO: 7199645 - DNA, 23 bp, Homo sapiens
aaagactgctgagaattttagga

SEQ ID NO: 7199646 - DNA, 22 bp, Homo sapiens
aaagactggtgtgttacatata

SEQ ID NO: 7199647 - DNA, 22 bp, Homo sapiens
aaagagacaccaaagactctag

SEQ ID NO: 7199648 - DNA, 22 bp, Homo sapiens
aaagagatgtgccaaatagcct

SEQ ID NO: 7199649 - DNA, 22 bp, Homo sapiens
aaagagatgtgccaaatagcct

SEQ ID NO: 7199650 - DNA, 22 bp, Homo sapiens
aaagagatgtgccaaatagcct

SEQ ID NO: 7199651 - DNA, 22 bp, Homo sapiens
aaagagcaagctgagatttgaa

SEQ ID NO: 7199652 - DNA, 22 bp, Homo sapiens
aaagagcaagctgagatttgaa

SEQ ID NO: 7199653 - DNA, 22 bp, Homo sapiens
aaagagcaagggctttgaggct

SEQ ID NO: 7199654 - DNA, 22 bp, Homo sapiens
aaagagcaagggctttgaggct

SEQ ID NO: 7199655 - DNA, 22 bp, Homo sapiens
aaagagcaccctcaatgtctga

SEQ ID NO: 7199656 - DNA, 22 bp, Homo sapiens
aaagagcaccctcaatgtctga

SEQ ID NO: 7199657 - DNA, 22 bp, Homo sapiens
aaagatgtgtaagaaataaaca

SEQ ID NO: 7199658 - DNA, 22 bp, Homo sapiens
aaagatgttatgaaataactat

SEQ ID NO: 7199659 - DNA, 22 bp, Homo sapiens
aaagatgttatgaaataactat

SEQ ID NO: 7199660 - DNA, 22 bp, Homo sapiens
aaagatgttatgaaataactat

SEQ ID NO: 7199661 - DNA, 23 bp, Homo sapiens
aaagatgttcccaaagttcacgt

SEQ ID NO: 7199662 - DNA, 21 bp, Homo sapiens
aaagatgtttcatctgagaaa

SEQ ID NO: 7199663 - DNA, 21 bp, Homo sapiens
aaagatgtttcatctgagaaa

SEQ ID NO: 7199664 - DNA, 21 bp, Homo sapiens
aaagatgtttcatctgagaaa

SEQ ID NO: 7199665 - DNA, 22 bp, Homo sapiens
aaagagaaaaagatcccggctc

SEQ ID NO: 7199666 - DNA, 22 bp, Homo sapiens
aaagagaaaaagatcccggctc

SEQ ID NO: 7199667 - DNA, 22 bp, Homo sapiens
aaagagaaaatgatctgtacat

SEQ ID NO: 7199668 - DNA, 22 bp, Homo sapiens
aaagagaaacttagaagcctga

SEQ ID NO: 7199669 - DNA, 22 bp, Homo sapiens
aaagagaaacttagaagcctga

SEQ ID NO: 7199670 - DNA, 22 bp, Homo sapiens
aaagagaaacttagaagcctga

SEQ ID NO: 7199671 - DNA, 22 bp, Homo sapiens
aaagagaaacttagaagcctga

SEQ ID NO: 7199672 - DNA, 22 bp, Homo sapiens
aaagagaaacttagaagcctga

SEQ ID NO: 7199673 - DNA, 22 bp, Homo sapiens
aaagagaaacttagaagcctga

SEQ ID NO: 7199674 - DNA, 22 bp, Homo sapiens
aaagagaaacttagaagcctga

SEQ ID NO: 7199675 - DNA, 22 bp, Homo sapiens
aaagagaaacttagaagcctga

SEQ ID NO: 7199676 - DNA, 22 bp, Homo sapiens
aaagagaacttttacccaagaa

SEQ ID NO: 7199677 - DNA, 22 bp, Homo sapiens
aaagagaacttttacccaagaa

SEQ ID NO: 7199678 - DNA, 22 bp, Homo sapiens
aaagagaacttttacccaagaa

SEQ ID NO: 7199679 - DNA, 22 bp, Homo sapiens
aaagagaacttttacccaagaa

SEQ ID NO: 7199680 - DNA, 22 bp, Homo sapiens
aaagagaacttttacccaagaa

SEQ ID NO: 7199681 - DNA, 20 bp, Homo sapiens
aaagagaagcctcaccttgt

SEQ ID NO: 7199682 - DNA, 20 bp, Homo sapiens
aaagagaagcctcaccttgt

SEQ ID NO: 7199683 - DNA, 20 bp, Homo sapiens
aaagagaagcctcaccttgt

SEQ ID NO: 7199684 - DNA, 21 bp, Homo sapiens
aaagagacaaatggcatatac

SEQ ID NO: 7199685 - DNA, 22 bp, Homo sapiens
aaatagttgtttggatcaataa

SEQ ID NO: 7199686 - DNA, 22 bp, Homo sapiens
aaatagtttagctctcatttca

SEQ ID NO: 7199687 - DNA, 22 bp, Homo sapiens
aaatagttgtttggatcaataa

SEQ ID NO: 7199688 - DNA, 22 bp, Homo sapiens
aaatagtttagctctcatttca

SEQ ID NO: 7199689 - DNA, 22 bp, Homo sapiens
aaacttcattttcaactgcaaa

SEQ ID NO: 7199690 - DNA, 22 bp, Homo sapiens
aaatataatttctgcctcaata

SEQ ID NO: 7199691 - DNA, 22 bp, Homo sapiens
aaacttctctccctactttgtg

SEQ ID NO: 7199692 - DNA, 22 bp, Homo sapiens
aaacttctctccctactttgtg

SEQ ID NO: 7199693 - DNA, 22 bp, Homo sapiens
aaacttttcctgctcttgtcct

SEQ ID NO: 7199694 - DNA, 22 bp, Homo sapiens
aaacttttcctgctcttgtcct

SEQ ID NO: 7199695 - DNA, 22 bp, Homo sapiens
aaacttttcctgctcttgtcct

SEQ ID NO: 7199696 - DNA, 22 bp, Homo sapiens
aaacttctggctacaagcaata

SEQ ID NO: 7199697 - DNA, 22 bp, Homo sapiens
aaacttctggctacaagcaata

SEQ ID NO: 7199698 - DNA, 22 bp, Homo sapiens
aaacttctggctacaagcaata

SEQ ID NO: 7199699 - DNA, 22 bp, Homo sapiens
aaactttggtatgtagcaaaac

SEQ ID NO: 7199700 - DNA, 22 bp, Homo sapiens
aaatagttacttctgctgtctt

SEQ ID NO: 7199701 - DNA, 22 bp, Homo sapiens
aaatagttacttctgctgtctt

SEQ ID NO: 7199702 - DNA, 22 bp, Homo sapiens
aaatagttagccctgcatatat

SEQ ID NO: 7199703 - DNA, 22 bp, Homo sapiens
aaactgtgaagcaagtacaagg

SEQ ID NO: 7199704 - DNA, 20 bp, Homo sapiens
aaactgtctgtcagtatcta

SEQ ID NO: 7199705 - DNA, 22 bp, Homo sapiens
aaatagttcagccacggtgact

SEQ ID NO: 7199706 - DNA, 22 bp, Homo sapiens
aaatagttcagccacggtgact

SEQ ID NO: 7199707 - DNA, 22 bp, Homo sapiens
aaatagttcagccacggtgact

SEQ ID NO: 7199708 - DNA, 22 bp, Homo sapiens
aaatagttcagcttgtaaaccc

SEQ ID NO: 7199709 - DNA, 22 bp, Homo sapiens
aaatagttcagccacggtgact

SEQ ID NO: 7199710 - DNA, 22 bp, Homo sapiens
aaatagttagccctgcatatat

SEQ ID NO: 7199711 - DNA, 22 bp, Homo sapiens
aaatagttagccctgcatatat

SEQ ID NO: 7199712 - DNA, 22 bp, Homo sapiens
aaatagttcagcttgtaaaccc

SEQ ID NO: 7199713 - DNA, 22 bp, Homo sapiens
aaatagttgtttggatcaataa

SEQ ID NO: 7199714 - DNA, 22 bp, Homo sapiens
aaatagttgtttggatcaataa

SEQ ID NO: 7199715 - DNA, 22 bp, Homo sapiens
aaatagttgtttggatcaataa

SEQ ID NO: 7199716 - DNA, 22 bp, Homo sapiens
aaagaacaaattagctgtttta

SEQ ID NO: 7199717 - DNA, 22 bp, Homo sapiens
aaagaacaaatgatatatggtt

SEQ ID NO: 7199718 - DNA, 22 bp, Homo sapiens
aaagaacaaatgatatatggtt

SEQ ID NO: 7199719 - DNA, 22 bp, Homo sapiens
aaagaaatagatggcatttaaa

SEQ ID NO: 7199720 - DNA, 21 bp, Homo sapiens
aaagaaatctcccattggtag

SEQ ID NO: 7199721 - DNA, 21 bp, Homo sapiens
aaagaaatctcccattggtag

SEQ ID NO: 7199722 - DNA, 21 bp, Homo sapiens
aaagaaatctcccattggtag

SEQ ID NO: 7199723 - DNA, 21 bp, Homo sapiens
aaagaaatctcccattggtag

SEQ ID NO: 7199724 - DNA, 21 bp, Homo sapiens
aaagaaatctcccattggtag

SEQ ID NO: 7199725 - DNA, 22 bp, Homo sapiens
aaagaaatacctttctcagctt

SEQ ID NO: 7199726 - DNA, 22 bp, Homo sapiens
aaagaaatacctttctcagctt

SEQ ID NO: 7199727 - DNA, 22 bp, Homo sapiens
aaagaaatacctttctcagctt

SEQ ID NO: 7199728 - DNA, 22 bp, Homo sapiens
aaagaaatagatggcatttaaa

SEQ ID NO: 7199729 - DNA, 22 bp, Homo sapiens
aaagaaatagatggcatttaaa

SEQ ID NO: 7199730 - DNA, 22 bp, Homo sapiens
aaagaaatagatggcatttaaa

SEQ ID NO: 7199731 - DNA, 22 bp, Homo sapiens
aaagaaatagatggcatttaaa

SEQ ID NO: 7199732 - DNA, 22 bp, Homo sapiens
aaagaaatagatggcatttaaa

SEQ ID NO: 7199733 - DNA, 22 bp, Homo sapiens
aaagaaatagatggcatttaaa

SEQ ID NO: 7199734 - DNA, 22 bp, Homo sapiens
aaagaaacctatcagccacatg

SEQ ID NO: 7199735 - DNA, 22 bp, Homo sapiens
aaagaaacctatcagccacatg

SEQ ID NO: 7199736 - DNA, 22 bp, Homo sapiens
aaagaaacctatcagccacatg

SEQ ID NO: 7199737 - DNA, 22 bp, Homo sapiens
aaagaaacctatcagccacatg

SEQ ID NO: 7199738 - DNA, 22 bp, Homo sapiens
aaagaaatacctttctcagctt

SEQ ID NO: 7199739 - DNA, 22 bp, Homo sapiens
aaagaaatacctttctcagctt

SEQ ID NO: 7199740 - DNA, 22 bp, Homo sapiens
aaagaaatacctttctcagctt

SEQ ID NO: 7199741 - DNA, 22 bp, Homo sapiens
aaagaaatacctttctcagctt

SEQ ID NO: 7199742 - DNA, 22 bp, Homo sapiens
aaacttttttaggttcataggc

SEQ ID NO: 7199743 - DNA, 22 bp, Homo sapiens
aaacttttttaggttcataggc

SEQ ID NO: 7199744 - DNA, 22 bp, Homo sapiens
aaactttttcttaggtatgtct

SEQ ID NO: 7199745 - DNA, 22 bp, Homo sapiens
aaacttttttaggttcataggc

SEQ ID NO: 7199746 - DNA, 22 bp, Homo sapiens
aaacttttttaggttcataggc

SEQ ID NO: 7199747 - DNA, 22 bp, Homo sapiens
aaacttttttaggttcataggc

SEQ ID NO: 7199748 - DNA, 22 bp, Homo sapiens
aaactttttattctaatgtcta

SEQ ID NO: 7199749 - DNA, 22 bp, Homo sapiens
aaactttttcttaggtatgtct

SEQ ID NO: 7199750 - DNA, 22 bp, Homo sapiens
aaacagctacttctgtataatg

SEQ ID NO: 7199751 - DNA, 22 bp, Homo sapiens
aaacagctaatggccaggaata

SEQ ID NO: 7199752 - DNA, 22 bp, Homo sapiens
aaacagctaatggccaggaata

SEQ ID NO: 7199753 - DNA, 22 bp, Homo sapiens
aaacagctacttctgtataatg

SEQ ID NO: 7199754 - DNA, 22 bp, Homo sapiens
aaacagctaagtacattcaagg

SEQ ID NO: 7199755 - DNA, 22 bp, Homo sapiens
aaacagctaagtacattcaagg

SEQ ID NO: 7199756 - DNA, 22 bp, Homo sapiens
aaacagctaagtacattcaagg

SEQ ID NO: 7199757 - DNA, 22 bp, Homo sapiens
aaacagctaagtacattcaagg

SEQ ID NO: 7199758 - DNA, 20 bp, Homo sapiens
aaacagctaaaccagctctc

SEQ ID NO: 7199759 - DNA, 22 bp, Homo sapiens
aaacagctaagtacattcaagg

SEQ ID NO: 7199760 - DNA, 22 bp, Homo sapiens
aaacagcaggaacatcttgcca

SEQ ID NO: 7199761 - DNA, 22 bp, Homo sapiens
aaacagcaggaacatcttgcca

SEQ ID NO: 7199762 - DNA, 22 bp, Homo sapiens
aaacagcaggaacatcttgcca

SEQ ID NO: 7199763 - DNA, 22 bp, Homo sapiens
aaacagcaggaacatcttgcca

SEQ ID NO: 7199764 - DNA, 22 bp, Homo sapiens
aaacagcaatggagaagccagg

SEQ ID NO: 7199765 - DNA, 22 bp, Homo sapiens
aaacagcaatggagaagccagg

SEQ ID NO: 7199766 - DNA, 22 bp, Homo sapiens
aaacagcaatggagaagccagg

SEQ ID NO: 7199767 - DNA, 22 bp, Homo sapiens
aaacagctgggaggtagaggcg

SEQ ID NO: 7199768 - DNA, 22 bp, Homo sapiens
aaacagctgcagtacacggcct

SEQ ID NO: 7199769 - DNA, 22 bp, Homo sapiens
aaacagctgggaggtagaggcg

SEQ ID NO: 7199770 - DNA, 22 bp, Homo sapiens
aaacagctgggaggtagaggcg

SEQ ID NO: 7199771 - DNA, 22 bp, Homo sapiens
aaacagctgggaggtagaggcg

SEQ ID NO: 7199772 - DNA, 22 bp, Homo sapiens
aaacagctgcagtacacggcct

SEQ ID NO: 7199773 - DNA, 22 bp, Homo sapiens
aaacagctgcagtacacggcct

SEQ ID NO: 7199774 - DNA, 22 bp, Homo sapiens
aaacagctgcactgctgatgtc

SEQ ID NO: 7199775 - DNA, 22 bp, Homo sapiens
aaacagctgcactgctgatgtc

SEQ ID NO: 7199776 - DNA, 22 bp, Homo sapiens
aaacagctccttagtttccatc

SEQ ID NO: 7199777 - DNA, 22 bp, Homo sapiens
aaacagctccttagtttccatc

SEQ ID NO: 7199778 - DNA, 22 bp, Homo sapiens
aaacagctcaagaagttactct

SEQ ID NO: 7199779 - DNA, 22 bp, Homo sapiens
aaacagctcaagaagttactct

SEQ ID NO: 7199780 - DNA, 22 bp, Homo sapiens
aaacagctccttagtttccatc

SEQ ID NO: 7199781 - DNA, 22 bp, Homo sapiens
aaacagctcaagaagttactct

SEQ ID NO: 7199782 - DNA, 22 bp, Homo sapiens
aaacagctcaagaagttactct

SEQ ID NO: 7199783 - DNA, 22 bp, Homo sapiens
aaacagctcaagaagttactct

SEQ ID NO: 7199784 - DNA, 22 bp, Homo sapiens
aaacagctgtcattgttttaaa

SEQ ID NO: 7199785 - DNA, 22 bp, Homo sapiens
aaacagctggtctcaaatgttc

SEQ ID NO: 7199786 - DNA, 22 bp, Homo sapiens
aaacagctgtcattgttttaaa

SEQ ID NO: 7199787 - DNA, 22 bp, Homo sapiens
aaacatctcaaagaggtatttg

SEQ ID NO: 7199788 - DNA, 21 bp, Homo sapiens
aaacatctctgcttttgtgtc

SEQ ID NO: 7199789 - DNA, 21 bp, Homo sapiens
aaacatctctgcttttgtgtc

SEQ ID NO: 7199790 - DNA, 21 bp, Homo sapiens
aaacatctctgcttttgtgtc

SEQ ID NO: 7199791 - DNA, 22 bp, Homo sapiens
aaacatgatgcctgtactaaga

SEQ ID NO: 7199792 - DNA, 22 bp, Homo sapiens
aaacatgatgtcatatatgcca

SEQ ID NO: 7199793 - DNA, 22 bp, Homo sapiens
aaacatgatgtcatatatgcca

SEQ ID NO: 7199794 - DNA, 22 bp, Homo sapiens
aaacatgatgtcatatatgcca

SEQ ID NO: 7199795 - DNA, 22 bp, Homo sapiens
aaagccagctctgagctgcacc

SEQ ID NO: 7199796 - DNA, 22 bp, Homo sapiens
aaagccagcaaggtgagtttca

SEQ ID NO: 7199797 - DNA, 22 bp, Homo sapiens
aaagccagctctgagctgcacc

SEQ ID NO: 7199798 - DNA, 22 bp, Homo sapiens
aaagccagcaaggtgagtttca

SEQ ID NO: 7199799 - DNA, 22 bp, Homo sapiens
aaagccagagtgtgttagagac

SEQ ID NO: 7199800 - DNA, 22 bp, Homo sapiens
aaagccagagcaagctgtcaca

SEQ ID NO: 7199801 - DNA, 22 bp, Homo sapiens
aaagccagagcaagctgtcaca

SEQ ID NO: 7199802 - DNA, 20 bp, Homo sapiens
aaagccactggcaagagact

SEQ ID NO: 7199803 - DNA, 22 bp, Homo sapiens
aaacactgatggatatttttcc

SEQ ID NO: 7199804 - DNA, 22 bp, Homo sapiens
aaagccactgcatgtgtagtat

SEQ ID NO: 7199805 - DNA, 22 bp, Homo sapiens
aaacactgatggatatttttcc

SEQ ID NO: 7199806 - DNA, 20 bp, Homo sapiens
aaagccactggcaagagact

SEQ ID NO: 7199807 - DNA, 22 bp, Homo sapiens
aaacactgaaaattttggtcat

SEQ ID NO: 7199808 - DNA, 22 bp, Homo sapiens
aaacactgaaaattttggtcat

SEQ ID NO: 7199809 - DNA, 22 bp, Homo sapiens
aaacactgaagacctatctggt

SEQ ID NO: 7199810 - DNA, 22 bp, Homo sapiens
aaagccagggacagtgtgcatg

SEQ ID NO: 7199811 - DNA, 22 bp, Homo sapiens
aaacactgtgggacatcttact

SEQ ID NO: 7199812 - DNA, 22 bp, Homo sapiens
aaagccaggctggcctggggtt

SEQ ID NO: 7199813 - DNA, 22 bp, Homo sapiens
aaagccaggcagccaagccagt

SEQ ID NO: 7199814 - DNA, 22 bp, Homo sapiens
aaacagagtttggtaaatagcc

SEQ ID NO: 7199815 - DNA, 22 bp, Homo sapiens
aaacagagtttggtaaatagcc

SEQ ID NO: 7199816 - DNA, 22 bp, Homo sapiens
aaacagagtttggtaaatagcc

SEQ ID NO: 7199817 - DNA, 22 bp, Homo sapiens
aaacagagtttggtaaatagcc

SEQ ID NO: 7199818 - DNA, 22 bp, Homo sapiens
aaacagataagggacaatttca

SEQ ID NO: 7199819 - DNA, 22 bp, Homo sapiens
aaacagataatgctataaatgg

SEQ ID NO: 7199820 - DNA, 22 bp, Homo sapiens
aaacagataatgctataaatgg

SEQ ID NO: 7199821 - DNA, 22 bp, Homo sapiens
aaacatgctggatttagaatat

SEQ ID NO: 7199822 - DNA, 22 bp, Homo sapiens
aaacatgctatgttttggataa

SEQ ID NO: 7199823 - DNA, 22 bp, Homo sapiens
aaacatgctatgttttggataa

SEQ ID NO: 7199824 - DNA, 22 bp, Homo sapiens
aaacatgctggatttagaatat

SEQ ID NO: 7199825 - DNA, 22 bp, Homo sapiens
aaacatgctggatttagaatat

SEQ ID NO: 7199826 - DNA, 22 bp, Homo sapiens
aaacatgggcttcctgatgcga

SEQ ID NO: 7199827 - DNA, 23 bp, Homo sapiens
aaacatgcagcacatgaatgcta

SEQ ID NO: 7199828 - DNA, 22 bp, Homo sapiens
aaacatgcattcaagaaaatct

SEQ ID NO: 7199829 - DNA, 22 bp, Homo sapiens
aaacatgcattcaagaaaatct

SEQ ID NO: 7199830 - DNA, 22 bp, Homo sapiens
aaacatgtttagaaagcagctg

SEQ ID NO: 7199831 - DNA, 22 bp, Homo sapiens
aaacatgtagtgcatgaggatc

SEQ ID NO: 7199832 - DNA, 22 bp, Homo sapiens
aaacatgtagtgcatgaggatc

SEQ ID NO: 7199833 - DNA, 22 bp, Homo sapiens
aaacatgtaagttcagatcacc

SEQ ID NO: 7199834 - DNA, 22 bp, Homo sapiens
aaacatgtaattctgcttaaga

SEQ ID NO: 7199835 - DNA, 20 bp, Homo sapiens
aaacattcatgtacaagtga

SEQ ID NO: 7199836 - DNA, 20 bp, Homo sapiens
aaacattcatgtacaagtga

SEQ ID NO: 7199837 - DNA, 22 bp, Homo sapiens
aaacattccatttctatgtaag

SEQ ID NO: 7199838 - DNA, 22 bp, Homo sapiens
aaacattccatttctatgtaag

SEQ ID NO: 7199839 - DNA, 22 bp, Homo sapiens
aaacattccatttctatgtaag

SEQ ID NO: 7199840 - DNA, 22 bp, Homo sapiens
aaacattagacaccatatgctc

SEQ ID NO: 7199841 - DNA, 22 bp, Homo sapiens
aaacattagacaccatatgctc

SEQ ID NO: 7199842 - DNA, 22 bp, Homo sapiens
aaacattcacatttgctagtaa

SEQ ID NO: 7199843 - DNA, 22 bp, Homo sapiens
aaacattgtaattttagcatgg

SEQ ID NO: 7199844 - DNA, 22 bp, Homo sapiens
aaacattgtaattttagcatgg

SEQ ID NO: 7199845 - DNA, 22 bp, Homo sapiens
aaacattgatgggaagtttaat

SEQ ID NO: 7199846 - DNA, 22 bp, Homo sapiens
aaacattgatgggaagtttaat

SEQ ID NO: 7199847 - DNA, 22 bp, Homo sapiens
aaacattgctaaataatgctgc

SEQ ID NO: 7199848 - DNA, 22 bp, Homo sapiens
aaacattgctaaataatgctgc

SEQ ID NO: 7199849 - DNA, 22 bp, Homo sapiens
aaacattgagcacttgctattt

SEQ ID NO: 7199850 - DNA, 22 bp, Homo sapiens
aaacattgagcacttgctattt

SEQ ID NO: 7199851 - DNA, 22 bp, Homo sapiens
aaacattccctaatgtgtccgt

SEQ ID NO: 7199852 - DNA, 22 bp, Homo sapiens
aaacattgacctcatcctggca

SEQ ID NO: 7199853 - DNA, 22 bp, Homo sapiens
aaactgcaatgacaggtaggag

SEQ ID NO: 7199854 - DNA, 22 bp, Homo sapiens
aaactgcaatgacaggtaggag

SEQ ID NO: 7199855 - DNA, 22 bp, Homo sapiens
aaactgtaaatactagtaagtg

SEQ ID NO: 7199856 - DNA, 22 bp, Homo sapiens
aaactgtaagagaataaactac

SEQ ID NO: 7199857 - DNA, 22 bp, Homo sapiens
aaactgtatgttgagatgacag

SEQ ID NO: 7199858 - DNA, 22 bp, Homo sapiens
aaactgtattccatcctcatca

SEQ ID NO: 7199859 - DNA, 22 bp, Homo sapiens
aaactgtcacctaatgtatttt

SEQ ID NO: 7199860 - DNA, 22 bp, Homo sapiens
aaactgtcacctaatgtatttt

SEQ ID NO: 7199861 - DNA, 22 bp, Homo sapiens
aaactgtaagagaataaactac

SEQ ID NO: 7199862 - DNA, 22 bp, Homo sapiens
aaactgtaagagaataaactac

SEQ ID NO: 7199863 - DNA, 22 bp, Homo sapiens
aaactgtaagtgcctcaaggtc

SEQ ID NO: 7199864 - DNA, 22 bp, Homo sapiens
aaactgtaagtgcctcaaggtc

SEQ ID NO: 7199865 - DNA, 22 bp, Homo sapiens
aaactgtaatgcaggatcaaga

SEQ ID NO: 7199866 - DNA, 22 bp, Homo sapiens
aaactgtatagggaaaagtaga

SEQ ID NO: 7199867 - DNA, 22 bp, Homo sapiens
aagagggcagcacaggtgggtc

SEQ ID NO: 7199868 - DNA, 22 bp, Homo sapiens
aagagggctgcaatcttattgc

SEQ ID NO: 7199869 - DNA, 22 bp, Homo sapiens
aagagggctgcaatcttattgc

SEQ ID NO: 7199870 - DNA, 22 bp, Homo sapiens
aagagggctgcaatcttattgc

SEQ ID NO: 7199871 - DNA, 22 bp, Homo sapiens
aagagggctgcaatcttattgc

SEQ ID NO: 7199872 - DNA, 22 bp, Homo sapiens
aagagggctgcaatcttattgc

SEQ ID NO: 7199873 - DNA, 22 bp, Homo sapiens
aagagggctgcaatcttattgc

SEQ ID NO: 7199874 - DNA, 22 bp, Homo sapiens
aagagggaggtgcgggtgcaga

SEQ ID NO: 7199875 - DNA, 22 bp, Homo sapiens
aagagggcagcacaggtgggtc

SEQ ID NO: 7199876 - DNA, 22 bp, Homo sapiens
aagagggaggtgcgggtgcaga

SEQ ID NO: 7199877 - DNA, 22 bp, Homo sapiens
aagagggaagtcacctggaggt

SEQ ID NO: 7199878 - DNA, 22 bp, Homo sapiens
aagagggagggcaaaggcactg

SEQ ID NO: 7199879 - DNA, 22 bp, Homo sapiens
aagagggagggcaaaggcactg

SEQ ID NO: 7199880 - DNA, 22 bp, Homo sapiens
aagaggaggatgctttacagct

SEQ ID NO: 7199881 - DNA, 18 bp, Homo sapiens
aagaggaggagcaggttg

SEQ ID NO: 7199882 - DNA, 22 bp, Homo sapiens
aagaggaggatgctttacagct

SEQ ID NO: 7199883 - DNA, 22 bp, Homo sapiens
aagaggaggatgctttacagct

SEQ ID NO: 7199884 - DNA, 22 bp, Homo sapiens
aaagtttgaatgatatattagt

SEQ ID NO: 7199885 - DNA, 23 bp, Homo sapiens
aaagtttgaagcaacagtagttg

SEQ ID NO: 7199886 - DNA, 22 bp, Homo sapiens
aaagtttccaagttacaccatt

SEQ ID NO: 7199887 - DNA, 22 bp, Homo sapiens
aaagtttggattagcagttaga

SEQ ID NO: 7199888 - DNA, 22 bp, Homo sapiens
aaagttttagaactaggaagca

SEQ ID NO: 7199889 - DNA, 22 bp, Homo sapiens
aaagttttagaactaggaagca

SEQ ID NO: 7199890 - DNA, 22 bp, Homo sapiens
aaagttttagctgtccagttcc

SEQ ID NO: 7199891 - DNA, 22 bp, Homo sapiens
aagaggggtggtctgtgaggat

SEQ ID NO: 7199892 - DNA, 22 bp, Homo sapiens
aagaggggtggtctgtgaggat

SEQ ID NO: 7199893 - DNA, 22 bp, Homo sapiens
aagaggtagcagtcacaaaaga

SEQ ID NO: 7199894 - DNA, 22 bp, Homo sapiens
aagaggtaatgactgcttgagt

SEQ ID NO: 7199895 - DNA, 17 bp, Homo sapiens
aagaggtaactgtacta

SEQ ID NO: 7199896 - DNA, 22 bp, Homo sapiens
aagaggtaatgactgcttgagt

SEQ ID NO: 7199897 - DNA, 22 bp, Homo sapiens
aagaggtaaccatagcaaccac

SEQ ID NO: 7199898 - DNA, 22 bp, Homo sapiens
aagaggggtgtgtgtcaaccca

SEQ ID NO: 7199899 - DNA, 22 bp, Homo sapiens
aagaggtaaccatagcaaccac

SEQ ID NO: 7199900 - DNA, 17 bp, Homo sapiens
aagaggtaactgtacta

SEQ ID NO: 7199901 - DNA, 22 bp, Homo sapiens
aaatacatttacagtcgtggct

SEQ ID NO: 7199902 - DNA, 22 bp, Homo sapiens
aaatacatttacagtcgtggct

SEQ ID NO: 7199903 - DNA, 22 bp, Homo sapiens
aaatactgctgctattcctttt

SEQ ID NO: 7199904 - DNA, 19 bp, Homo sapiens
aaatactgaagttgttcat

SEQ ID NO: 7199905 - DNA, 22 bp, Homo sapiens
aaatactcatcccaggaactgg

SEQ ID NO: 7199906 - DNA, 22 bp, Homo sapiens
aaatactggcaagtgctaattc

SEQ ID NO: 7199907 - DNA, 22 bp, Homo sapiens
aaatactggcaagtgctaattc

SEQ ID NO: 7199908 - DNA, 21 bp, Homo sapiens
aaatactgggcagtgacttga

SEQ ID NO: 7199909 - DNA, 22 bp, Homo sapiens
aaatactgggctcaaaagggtt

SEQ ID NO: 7199910 - DNA, 22 bp, Homo sapiens
aaatactggttttggagatgct

SEQ ID NO: 7199911 - DNA, 22 bp, Homo sapiens
aagataaactcttgatttctga

SEQ ID NO: 7199912 - DNA, 22 bp, Homo sapiens
aagataacaggaggagtttgta

SEQ ID NO: 7199913 - DNA, 22 bp, Homo sapiens
aagatatattcgacgtgaatga

SEQ ID NO: 7199914 - DNA, 22 bp, Homo sapiens
aagatatattcgacgtgaatga

SEQ ID NO: 7199915 - DNA, 22 bp, Homo sapiens
aagatatattttggtgatttca

SEQ ID NO: 7199916 - DNA, 22 bp, Homo sapiens
aagatatattttggtgatttca

SEQ ID NO: 7199917 - DNA, 22 bp, Homo sapiens
aagatatattttggtgatttca

SEQ ID NO: 7199918 - DNA, 22 bp, Homo sapiens
aagacgcaccctttgagggcac

SEQ ID NO: 7199919 - DNA, 22 bp, Homo sapiens
aagactaaatgtgttctaaagt

SEQ ID NO: 7199920 - DNA, 22 bp, Homo sapiens
aagacctgccagcctcatcctg

SEQ ID NO: 7199921 - DNA, 22 bp, Homo sapiens
aagaccttgtctaaacatgtag

SEQ ID NO: 7199922 - DNA, 22 bp, Homo sapiens
aagactataccatcttagttac

SEQ ID NO: 7199923 - DNA, 22 bp, Homo sapiens
aagactataccatcttagttac

SEQ ID NO: 7199924 - DNA, 22 bp, Homo sapiens
aagaccctatactcagtgaccc

SEQ ID NO: 7199925 - DNA, 22 bp, Homo sapiens
aagacctctgaggtagaagttc

SEQ ID NO: 7199926 - DNA, 22 bp, Homo sapiens
aagacctctggagggcaatgtc

SEQ ID NO: 7199927 - DNA, 22 bp, Homo sapiens
aagacctctggagggcaatgtc

SEQ ID NO: 7199928 - DNA, 22 bp, Homo sapiens
aagacctgcacagtttaccatt

SEQ ID NO: 7199929 - DNA, 22 bp, Homo sapiens
aagacctgcagtttctctacct

SEQ ID NO: 7199930 - DNA, 22 bp, Homo sapiens
aagacctgcatgcggactaaca

SEQ ID NO: 7199931 - DNA, 22 bp, Homo sapiens
aagaccctatactcagtgaccc

SEQ ID NO: 7199932 - DNA, 17 bp, Homo sapiens
aagaccctagtctaccc

SEQ ID NO: 7199933 - DNA, 17 bp, Homo sapiens
aagaccctagtctaccc

SEQ ID NO: 7199934 - DNA, 22 bp, Homo sapiens
aagaccctacccctggagagga

SEQ ID NO: 7199935 - DNA, 22 bp, Homo sapiens
aagacagatgcaacctgctagc

SEQ ID NO: 7199936 - DNA, 22 bp, Homo sapiens
aagacagatgcaacctgctagc

SEQ ID NO: 7199937 - DNA, 22 bp, Homo sapiens
aagactgatgtccagtcccatg

SEQ ID NO: 7199938 - DNA, 22 bp, Homo sapiens
aagactgtatgagacaatataa

SEQ ID NO: 7199939 - DNA, 22 bp, Homo sapiens
aagactgtctgggacaagatga

SEQ ID NO: 7199940 - DNA, 22 bp, Homo sapiens
aagactctgtatcatgagggag

SEQ ID NO: 7199941 - DNA, 22 bp, Homo sapiens
aagactctatctttagagatca

SEQ ID NO: 7199942 - DNA, 22 bp, Homo sapiens
aaagtttacagtgcacatgggt

SEQ ID NO: 7199943 - DNA, 22 bp, Homo sapiens
aagactgtcttttctgagtgac

SEQ ID NO: 7199944 - DNA, 22 bp, Homo sapiens
aaagttgttgttcacaggttat

SEQ ID NO: 7199945 - DNA, 22 bp, Homo sapiens
aaagttgtttcctaaggtctaa

SEQ ID NO: 7199946 - DNA, 22 bp, Homo sapiens
aaagtgattatgctgtcaaaga

SEQ ID NO: 7199947 - DNA, 22 bp, Homo sapiens
aaagtgatgccaggagtctggt

SEQ ID NO: 7199948 - DNA, 22 bp, Homo sapiens
aaagtgaggacttgagtactgt

SEQ ID NO: 7199949 - DNA, 19 bp, Homo sapiens
aaagtgaatgctgttttct

SEQ ID NO: 7199950 - DNA, 22 bp, Homo sapiens
aaagtgaatgtatcccgtaagt

SEQ ID NO: 7199951 - DNA, 22 bp, Homo sapiens
aaagtgaattgatttaagggga

SEQ ID NO: 7199952 - DNA, 22 bp, Homo sapiens
aaagtgaattgatttaagggga

SEQ ID NO: 7199953 - DNA, 22 bp, Homo sapiens
aaagtgacaaccagcaggactt

SEQ ID NO: 7199954 - DNA, 22 bp, Homo sapiens
aaagtgacaaccagcaggactt

SEQ ID NO: 7199955 - DNA, 22 bp, Homo sapiens
aaagtgactgccagtgctgggc

SEQ ID NO: 7199956 - DNA, 22 bp, Homo sapiens
aagaacatggtaggataacaaa

SEQ ID NO: 7199957 - DNA, 22 bp, Homo sapiens
aagaacatggtaggataacaaa

SEQ ID NO: 7199958 - DNA, 22 bp, Homo sapiens
aagaacatgatggccatgtgca

SEQ ID NO: 7199959 - DNA, 22 bp, Homo sapiens
aagaacatgctataattatctt

SEQ ID NO: 7199960 - DNA, 19 bp, Homo sapiens
aaagtgattttttctggca

SEQ ID NO: 7199961 - DNA, 22 bp, Homo sapiens
aaagtgcaatcagttagaccat

SEQ ID NO: 7199962 - DNA, 20 bp, Homo sapiens
aaagtgcacagatacagctc

SEQ ID NO: 7199963 - DNA, 22 bp, Homo sapiens
aaagtgcactagaatccagatt

SEQ ID NO: 7199964 - DNA, 22 bp, Homo sapiens
aaagtgcactagaatccagatt

SEQ ID NO: 7199965 - DNA, 22 bp, Homo sapiens
aaagtgcactctcagtgctgct

SEQ ID NO: 7199966 - DNA, 22 bp, Homo sapiens
aaagtgcactctcagtgctgct

SEQ ID NO: 7199967 - DNA, 22 bp, Homo sapiens
aaagtgcactctcagtgctgct

SEQ ID NO: 7199968 - DNA, 22 bp, Homo sapiens
aaagtgcagaactgttctcact

SEQ ID NO: 7199969 - DNA, 22 bp, Homo sapiens
aaagtgcagctgaaaacatcct

SEQ ID NO: 7199970 - DNA, 22 bp, Homo sapiens
aagacagagggaagcaatgatg

SEQ ID NO: 7199971 - DNA, 22 bp, Homo sapiens
aagacagagggaagcaatgatg

SEQ ID NO: 7199972 - DNA, 22 bp, Homo sapiens
aagccggctgggccgaggctgc

SEQ ID NO: 7199973 - DNA, 22 bp, Homo sapiens
aagcctaaatgatgctattatg

SEQ ID NO: 7199974 - DNA, 21 bp, Homo sapiens
aagcctcaagcagaagacaga

SEQ ID NO: 7199975 - DNA, 22 bp, Homo sapiens
aagcccttggcgcacaccgggc

SEQ ID NO: 7199976 - DNA, 22 bp, Homo sapiens
aagcccttttcaagatacaaca

SEQ ID NO: 7199977 - DNA, 22 bp, Homo sapiens
aagccctgttctttctctcacc

SEQ ID NO: 7199978 - DNA, 21 bp, Homo sapiens
aagcccttgaaatagatatat

SEQ ID NO: 7199979 - DNA, 22 bp, Homo sapiens
aagcccttggcgcacaccgggc

SEQ ID NO: 7199980 - DNA, 22 bp, Homo sapiens
aagcccttggcgcacaccgggc

SEQ ID NO: 7199981 - DNA, 22 bp, Homo sapiens
aagcccttggcgcacaccgggc

SEQ ID NO: 7199982 - DNA, 22 bp, Homo sapiens
aagccctgtccggggggaagaa

SEQ ID NO: 7199983 - DNA, 22 bp, Homo sapiens
aagccctgttaggcactgggga

SEQ ID NO: 7199984 - DNA, 22 bp, Homo sapiens
aagccctgttctttctctcacc

SEQ ID NO: 7199985 - DNA, 22 bp, Homo sapiens
aagccctgttctttctctcacc

SEQ ID NO: 7199986 - DNA, 22 bp, Homo sapiens
aagccctgtaaattgcccttaa

SEQ ID NO: 7199987 - DNA, 22 bp, Homo sapiens
aagccctgtcaccctgacttca

SEQ ID NO: 7199988 - DNA, 22 bp, Homo sapiens
aagccctgtcaccctgacttca

SEQ ID NO: 7199989 - DNA, 22 bp, Homo sapiens
aaatgcatggtaaatgattgcc

SEQ ID NO: 7199990 - DNA, 22 bp, Homo sapiens
aaatgcatggctgttttaaagc

SEQ ID NO: 7199991 - DNA, 22 bp, Homo sapiens
aaatgcatggctgttttaaagc

SEQ ID NO: 7199992 - DNA, 22 bp, Homo sapiens
aaatgcatggctgttttaaagc

SEQ ID NO: 7199993 - DNA, 22 bp, Homo sapiens
aaatgcatgtagaataatagag

SEQ ID NO: 7199994 - DNA, 22 bp, Homo sapiens
aaatgcatgtatgtaatatgct

SEQ ID NO: 7199995 - DNA, 22 bp, Homo sapiens
aagcctgctttgttccacagca

SEQ ID NO: 7199996 - DNA, 22 bp, Homo sapiens
aagcctggactatcgcgtgtgc

SEQ ID NO: 7199997 - DNA, 22 bp, Homo sapiens
aagcctggcacattggagtctg

SEQ ID NO: 7199998 - DNA, 22 bp, Homo sapiens
aagcctggcacattggagtctg

SEQ ID NO: 7199999 - DNA, 22 bp, Homo sapiens
aagcctctggggcctcatctgt

SEQ ID NO: 7200000 - DNA, 22 bp, Homo sapiens
aagcctcaccttttagaagcta

SEQ ID NO: 7200001 - DNA, 22 bp, Homo sapiens
aagcctcaccttttagaagcta

SEQ ID NO: 7200002 - DNA, 22 bp, Homo sapiens
aagcctccttattaaaggatat

SEQ ID NO: 7200003 - DNA, 22 bp, Homo sapiens
aagcctccttattaaaggatat

SEQ ID NO: 7200004 - DNA, 22 bp, Homo sapiens
aaatctctgaacttaataatgc

SEQ ID NO: 7200005 - DNA, 22 bp, Homo sapiens
aaatctcagtgttctaagcatt

SEQ ID NO: 7200006 - DNA, 22 bp, Homo sapiens
aaatctcagtgttctaagcatt

SEQ ID NO: 7200007 - DNA, 22 bp, Homo sapiens
aaatctcagcccttattttaga

SEQ ID NO: 7200008 - DNA, 22 bp, Homo sapiens
aaatctcaggcctctatttact

SEQ ID NO: 7200009 - DNA, 22 bp, Homo sapiens
aaatctcaggcctctatttact

SEQ ID NO: 7200010 - DNA, 22 bp, Homo sapiens
aaatctcactgtagtcaaagtg

SEQ ID NO: 7200011 - DNA, 22 bp, Homo sapiens
aaatctcagcccttattttaga

SEQ ID NO: 7200012 - DNA, 22 bp, Homo sapiens
aaatctcagcccttattttaga

SEQ ID NO: 7200013 - DNA, 22 bp, Homo sapiens
aagcaggcatgggaggccatcc

SEQ ID NO: 7200014 - DNA, 22 bp, Homo sapiens
aagcaggcattccagagacaat

SEQ ID NO: 7200015 - DNA, 22 bp, Homo sapiens
aagcaggcattccagagacaat

SEQ ID NO: 7200016 - DNA, 22 bp, Homo sapiens
aagcaggccctgggccagggga

SEQ ID NO: 7200017 - DNA, 22 bp, Homo sapiens
aaatctcaatttgaattgtagc

SEQ ID NO: 7200018 - DNA, 22 bp, Homo sapiens
aagcaggcgagggcctggagca

SEQ ID NO: 7200019 - DNA, 22 bp, Homo sapiens
aaatctgagaaatattgtccag

SEQ ID NO: 7200020 - DNA, 22 bp, Homo sapiens
aaatctctggtcacagaactta

SEQ ID NO: 7200021 - DNA, 22 bp, Homo sapiens
aaatctctgaacttaataatgc

SEQ ID NO: 7200022 - DNA, 22 bp, Homo sapiens
aaatctctgcaggcaaatgtga

SEQ ID NO: 7200023 - DNA, 22 bp, Homo sapiens
aaatctctgcaggcaaatgtga

SEQ ID NO: 7200024 - DNA, 22 bp, Homo sapiens
aaatctctggcagaaataaact

SEQ ID NO: 7200025 - DNA, 22 bp, Homo sapiens
aaatctctggcagaaataaact

SEQ ID NO: 7200026 - DNA, 22 bp, Homo sapiens
aaatctctggtcacagaactta

SEQ ID NO: 7200027 - DNA, 22 bp, Homo sapiens
aaatctttccctttactatcca

SEQ ID NO: 7200028 - DNA, 22 bp, Homo sapiens
aaatctttccctttactatcca

SEQ ID NO: 7200029 - DNA, 22 bp, Homo sapiens
aaatctttccctttactatcca

SEQ ID NO: 7200030 - DNA, 22 bp, Homo sapiens
aagcccagatgggagcatttca

SEQ ID NO: 7200031 - DNA, 22 bp, Homo sapiens
aagcccagatgggagcatttca

SEQ ID NO: 7200032 - DNA, 22 bp, Homo sapiens
aagcccagatgggagcatttca

SEQ ID NO: 7200033 - DNA, 22 bp, Homo sapiens
aagcccagatgtgagaactgag

SEQ ID NO: 7200034 - DNA, 22 bp, Homo sapiens
aagatcataatatttatctcat

SEQ ID NO: 7200035 - DNA, 22 bp, Homo sapiens
aagatcataatatttatctcat

SEQ ID NO: 7200036 - DNA, 22 bp, Homo sapiens
aagatcatggtttatctgggag

SEQ ID NO: 7200037 - DNA, 22 bp, Homo sapiens
aagatccatgagggcagagatt

SEQ ID NO: 7200038 - DNA, 22 bp, Homo sapiens
aagatccatgagggcagagatt

SEQ ID NO: 7200039 - DNA, 23 bp, Homo sapiens
aagatccattcaaattatgtatc

SEQ ID NO: 7200040 - DNA, 22 bp, Homo sapiens
aagatcctgcttttgcttctgt

SEQ ID NO: 7200041 - DNA, 22 bp, Homo sapiens
aagatgttgcattagaatacct

SEQ ID NO: 7200042 - DNA, 22 bp, Homo sapiens
aagatgttgcattagaatacct

SEQ ID NO: 7200043 - DNA, 22 bp, Homo sapiens
aagatgttgcattagaatacct

SEQ ID NO: 7200044 - DNA, 22 bp, Homo sapiens
aagatgttgggtgcctccggaa

SEQ ID NO: 7200045 - DNA, 22 bp, Homo sapiens
aagatgttgtcgttagtgatga

SEQ ID NO: 7200046 - DNA, 22 bp, Homo sapiens
aagatgttgtcgttagtgatga

SEQ ID NO: 7200047 - DNA, 18 bp, Homo sapiens
aagatgtttaatgggaag

SEQ ID NO: 7200048 - DNA, 22 bp, Homo sapiens
aagatgtttagatttatacaat

SEQ ID NO: 7200049 - DNA, 22 bp, Homo sapiens
aagatgtttagatttatacaat

SEQ ID NO: 7200050 - DNA, 22 bp, Homo sapiens
aagatgtttaggtaaaaagttt

SEQ ID NO: 7200051 - DNA, 22 bp, Homo sapiens
aagatgttttaatatttcgagg

SEQ ID NO: 7200052 - DNA, 22 bp, Homo sapiens
aagattaaaggggagacaagct

SEQ ID NO: 7200053 - DNA, 22 bp, Homo sapiens
aagattaaaggggagacaagct

SEQ ID NO: 7200054 - DNA, 22 bp, Homo sapiens
aagatcaccttgacatgaaaag

SEQ ID NO: 7200055 - DNA, 22 bp, Homo sapiens
aagatcagaactttatacagga

SEQ ID NO: 7200056 - DNA, 22 bp, Homo sapiens
aagatcaggcgtggaaaacact

SEQ ID NO: 7200057 - DNA, 22 bp, Homo sapiens
aagatcaagatttaggttgagg

SEQ ID NO: 7200058 - DNA, 22 bp, Homo sapiens
aagatcaagatttaggttgagg

SEQ ID NO: 7200059 - DNA, 22 bp, Homo sapiens
aagatcaatgttcattaagatg

SEQ ID NO: 7200060 - DNA, 22 bp, Homo sapiens
aagatcaccaagtaacagtctg

SEQ ID NO: 7200061 - DNA, 18 bp, Homo sapiens
aagatcacaaaatagctg

SEQ ID NO: 7200062 - DNA, 22 bp, Homo sapiens
aagatattttagaacattcact

SEQ ID NO: 7200063 - DNA, 22 bp, Homo sapiens
aagatcaagatcagagaacagc

SEQ ID NO: 7200064 - DNA, 19 bp, Homo sapiens
aagatatgctagcccagag

SEQ ID NO: 7200065 - DNA, 22 bp, Homo sapiens
aagatattcaaagatttattag

SEQ ID NO: 7200066 - DNA, 22 bp, Homo sapiens
aagatattcaaagatttattag

SEQ ID NO: 7200067 - DNA, 22 bp, Homo sapiens
aagatatattttggtgatttca

SEQ ID NO: 7200068 - DNA, 22 bp, Homo sapiens
aagatatgaggtcacctgctgg

SEQ ID NO: 7200069 - DNA, 22 bp, Homo sapiens
aagattatggcagataacaatt

SEQ ID NO: 7200070 - DNA, 22 bp, Homo sapiens
aagattatttaagacaggaacc

SEQ ID NO: 7200071 - DNA, 22 bp, Homo sapiens
aagattatggcagataacaatt

SEQ ID NO: 7200072 - DNA, 22 bp, Homo sapiens
aagattagacaggattatgcat

SEQ ID NO: 7200073 - DNA, 22 bp, Homo sapiens
aagattcagttgatgtgttcca

SEQ ID NO: 7200074 - DNA, 22 bp, Homo sapiens
aagattctagaggaacttctta

SEQ ID NO: 7200075 - DNA, 22 bp, Homo sapiens
aagcagcatatgacagcatcca

SEQ ID NO: 7200076 - DNA, 22 bp, Homo sapiens
aagcagcatatgacagcatcca

SEQ ID NO: 7200077 - DNA, 22 bp, Homo sapiens
aagcagcatatgacagcatcca

SEQ ID NO: 7200078 - DNA, 22 bp, Homo sapiens
aagcagcatcctgggcagacct

SEQ ID NO: 7200079 - DNA, 22 bp, Homo sapiens
aagcagcatcctgggcagacct

SEQ ID NO: 7200080 - DNA, 22 bp, Homo sapiens
aagcaggagagcctgggcgagc

SEQ ID NO: 7200081 - DNA, 22 bp, Homo sapiens
aagcaggcatcttggaggtcaa

SEQ ID NO: 7200082 - DNA, 22 bp, Homo sapiens
aagcaggcatcttggaggtcaa

SEQ ID NO: 7200083 - DNA, 22 bp, Homo sapiens
aagcaggcatcttggaggtcaa

SEQ ID NO: 7200084 - DNA, 22 bp, Homo sapiens
aagcaggcatcttggaggtcaa

SEQ ID NO: 7200085 - DNA, 22 bp, Homo sapiens
aagcaggcatgggaggccatcc

SEQ ID NO: 7200086 - DNA, 22 bp, Homo sapiens
aagcaggcatgggaggccatcc

SEQ ID NO: 7200087 - DNA, 22 bp, Homo sapiens
aagcaggcatgggaggccatcc

SEQ ID NO: 7200088 - DNA, 22 bp, Homo sapiens
aagcaggatggatctagtgttc

SEQ ID NO: 7200089 - DNA, 22 bp, Homo sapiens
aagcaggatggatctagtgttc

SEQ ID NO: 7200090 - DNA, 22 bp, Homo sapiens
aagcaggcaaggttgtggggca

SEQ ID NO: 7200091 - DNA, 22 bp, Homo sapiens
aagcaggcagggtggagagttt

SEQ ID NO: 7200092 - DNA, 22 bp, Homo sapiens
aagcaggagatgcaggaatgta

SEQ ID NO: 7200093 - DNA, 22 bp, Homo sapiens
aagcaggagatgcaggaatgta

SEQ ID NO: 7200094 - DNA, 22 bp, Homo sapiens
aagcaggagatgcaggaatgta

SEQ ID NO: 7200095 - DNA, 22 bp, Homo sapiens
aagcaggagatgggtgcttttc

SEQ ID NO: 7200096 - DNA, 22 bp, Homo sapiens
aaagatttgagttctgcttata

SEQ ID NO: 7200097 - DNA, 22 bp, Homo sapiens
aaagcaaacagaaccccaagct

SEQ ID NO: 7200098 - DNA, 22 bp, Homo sapiens
aaagatttgaaattaggcatca

SEQ ID NO: 7200099 - DNA, 22 bp, Homo sapiens
aaagatttgagttctgcttata

SEQ ID NO: 7200100 - DNA, 22 bp, Homo sapiens
aaagatttcagaagcctgtgcc

SEQ ID NO: 7200101 - DNA, 22 bp, Homo sapiens
aaagatttgaaattaggcatca

SEQ ID NO: 7200102 - DNA, 22 bp, Homo sapiens
aaagatttaagaataatttgtg

SEQ ID NO: 7200103 - DNA, 22 bp, Homo sapiens
aaagatttaagaataatttgtg

SEQ ID NO: 7200104 - DNA, 22 bp, Homo sapiens
aaagattatggcattgaaatac

SEQ ID NO: 7200105 - DNA, 22 bp, Homo sapiens
aaagattatggaacacacatga

SEQ ID NO: 7200106 - DNA, 22 bp, Homo sapiens
aaagattatggcattgaaatac

SEQ ID NO: 7200107 - DNA, 22 bp, Homo sapiens
aaagattatggcattgaaatac

SEQ ID NO: 7200108 - DNA, 22 bp, Homo sapiens
aaagattaaggtattgttagct

SEQ ID NO: 7200109 - DNA, 22 bp, Homo sapiens
aaagattagataagatagattt

SEQ ID NO: 7200110 - DNA, 22 bp, Homo sapiens
aaagattagataagatagattt

SEQ ID NO: 7200111 - DNA, 22 bp, Homo sapiens
aaagattaggcggcaactgggc

SEQ ID NO: 7200112 - DNA, 22 bp, Homo sapiens
aaagatgttttataagttatgg

SEQ ID NO: 7200113 - DNA, 22 bp, Homo sapiens
aaagatgttttataagttatgg

SEQ ID NO: 7200114 - DNA, 22 bp, Homo sapiens
aaagattaaatcaaattggtca

SEQ ID NO: 7200115 - DNA, 21 bp, Homo sapiens
aaagatgtttcttttcctcac

SEQ ID NO: 7200116 - DNA, 22 bp, Homo sapiens
aaagatgttttacatagcacct

SEQ ID NO: 7200117 - DNA, 22 bp, Homo sapiens
aaagatgttttataagttatgg

SEQ ID NO: 7200118 - DNA, 22 bp, Homo sapiens
aacactgtcttatacttcaatg

SEQ ID NO: 7200119 - DNA, 22 bp, Homo sapiens
aacactgtcttatacttcaatg

SEQ ID NO: 7200120 - DNA, 22 bp, Homo sapiens
aacactgtcagcctttgatgga

SEQ ID NO: 7200121 - DNA, 22 bp, Homo sapiens
aacactgtcagcctttgatgga

SEQ ID NO: 7200122 - DNA, 22 bp, Homo sapiens
aacactgtcagcctttgatgga

SEQ ID NO: 7200123 - DNA, 22 bp, Homo sapiens
aacacattttgcctaggcaata

SEQ ID NO: 7200124 - DNA, 22 bp, Homo sapiens
aacacattttgcctaggcaata

SEQ ID NO: 7200125 - DNA, 23 bp, Homo sapiens
aacaccaaggctcagagagataa

SEQ ID NO: 7200126 - DNA, 22 bp, Homo sapiens
aaagcaaacagaaccccaagct

SEQ ID NO: 7200127 - DNA, 22 bp, Homo sapiens
aaagcaagatgcatccgtcaag

SEQ ID NO: 7200128 - DNA, 23 bp, Homo sapiens
aaagcaaggaattggcaacagag

SEQ ID NO: 7200129 - DNA, 23 bp, Homo sapiens
aaagcaaggaattggcaacagag

SEQ ID NO: 7200130 - DNA, 23 bp, Homo sapiens
aaagcaaggaattggcaacagag

SEQ ID NO: 7200131 - DNA, 23 bp, Homo sapiens
aaagcaaggaattggcaacagag

SEQ ID NO: 7200132 - DNA, 23 bp, Homo sapiens
aaagcaaggaattggcaacagag

SEQ ID NO: 7200133 - DNA, 23 bp, Homo sapiens
aaagcaaggaattggcaacagag

SEQ ID NO: 7200134 - DNA, 23 bp, Homo sapiens
aaagcaaggaattggcaacagag

SEQ ID NO: 7200135 - DNA, 22 bp, Homo sapiens
aaagcaagtctctacaaagtac

SEQ ID NO: 7200136 - DNA, 22 bp, Homo sapiens
aaagcaagtctctacaaagtac

SEQ ID NO: 7200137 - DNA, 22 bp, Homo sapiens
aaagcaagtctctacaaagtac

SEQ ID NO: 7200138 - DNA, 22 bp, Homo sapiens
aacactgtggtcttttcagtaa

SEQ ID NO: 7200139 - DNA, 22 bp, Homo sapiens
aacactgtggtcttttcagtaa

SEQ ID NO: 7200140 - DNA, 20 bp, Homo sapiens
aacactgtgcgtggtaggtg

SEQ ID NO: 7200141 - DNA, 20 bp, Homo sapiens
aacactgtgcgtggtaggtg

SEQ ID NO: 7200142 - DNA, 22 bp, Homo sapiens
aacactgtgctccccaggctgt

SEQ ID NO: 7200143 - DNA, 22 bp, Homo sapiens
aacactgtgcccaccctagtcc

SEQ ID NO: 7200144 - DNA, 22 bp, Homo sapiens
aacactgtgaggtaatgaccta

SEQ ID NO: 7200145 - DNA, 22 bp, Homo sapiens
aacactgtgcagtgtaatgctg

SEQ ID NO: 7200146 - DNA, 22 bp, Homo sapiens
aacacttctcatcactgcaagc

SEQ ID NO: 7200147 - DNA, 22 bp, Homo sapiens
aacacttgaatgtgtagcagct

SEQ ID NO: 7200148 - DNA, 22 bp, Homo sapiens
aacactgtggtcttttcagtaa

SEQ ID NO: 7200149 - DNA, 22 bp, Homo sapiens
aacactgtggtcttttcagtaa

SEQ ID NO: 7200150 - DNA, 22 bp, Homo sapiens
aacacttaaggagagatcaaat

SEQ ID NO: 7200151 - DNA, 22 bp, Homo sapiens
aaagcagagcagggcacttatg

SEQ ID NO: 7200152 - DNA, 22 bp, Homo sapiens
aaagcagagatcatggcttgta

SEQ ID NO: 7200153 - DNA, 22 bp, Homo sapiens
aaagcagactgatttgcatcac

SEQ ID NO: 7200154 - DNA, 22 bp, Homo sapiens
aaagcagaactgagagagctgg

SEQ ID NO: 7200155 - DNA, 22 bp, Homo sapiens
aaagcagaactgagagagctgg

SEQ ID NO: 7200156 - DNA, 22 bp, Homo sapiens
aaagcactttgagactgacagg

SEQ ID NO: 7200157 - DNA, 22 bp, Homo sapiens
aaagcactttgagactgacagg

SEQ ID NO: 7200158 - DNA, 22 bp, Homo sapiens
aaagcactttgagactgacagg

SEQ ID NO: 7200159 - DNA, 22 bp, Homo sapiens
aaagcactctatcctttgtaga

SEQ ID NO: 7200160 - DNA, 22 bp, Homo sapiens
aaagcactcgttagtatttctg

SEQ ID NO: 7200161 - DNA, 22 bp, Homo sapiens
aaagcactcgttagtatttctg

SEQ ID NO: 7200162 - DNA, 22 bp, Homo sapiens
aaagcacttcaggagcagtttg

SEQ ID NO: 7200163 - DNA, 22 bp, Homo sapiens
aaagcacttcaggagcagtttg

SEQ ID NO: 7200164 - DNA, 22 bp, Homo sapiens
aaagcacttgaaatctggcagt

SEQ ID NO: 7200165 - DNA, 23 bp, Homo sapiens
aacacttgcatgaacagctacac

SEQ ID NO: 7200166 - DNA, 22 bp, Homo sapiens
aacacttggagggagagtggga

SEQ ID NO: 7200167 - DNA, 22 bp, Homo sapiens
aacactttccgtaggtttagta

SEQ ID NO: 7200168 - DNA, 21 bp, Homo sapiens
aacacttgggttagtgggaga

SEQ ID NO: 7200169 - DNA, 22 bp, Homo sapiens
aacactttcctgcctttctgat

SEQ ID NO: 7200170 - DNA, 22 bp, Homo sapiens
aacactttcctgcctttctgat

SEQ ID NO: 7200171 - DNA, 19 bp, Homo sapiens
aaagcagaggagcatctga

SEQ ID NO: 7200172 - DNA, 19 bp, Homo sapiens
aaagcagaggagcatctga

SEQ ID NO: 7200173 - DNA, 22 bp, Homo sapiens
aaagcagaggttgcagtgagct

SEQ ID NO: 7200174 - DNA, 22 bp, Homo sapiens
aaagcagattctgatgcagtag

SEQ ID NO: 7200175 - DNA, 22 bp, Homo sapiens
aaagcagcaaatacttttgcac

SEQ ID NO: 7200176 - DNA, 22 bp, Homo sapiens
aacagtgagaaggtggacagga

SEQ ID NO: 7200177 - DNA, 22 bp, Homo sapiens
aacagtgaggtgaatatgctcc

SEQ ID NO: 7200178 - DNA, 22 bp, Homo sapiens
aacagtgaggtgaatatgctcc

SEQ ID NO: 7200179 - DNA, 22 bp, Homo sapiens
aacagtgaggtgaatatgctcc

SEQ ID NO: 7200180 - DNA, 22 bp, Homo sapiens
aacagtgagttgatgactgaat

SEQ ID NO: 7200181 - DNA, 22 bp, Homo sapiens
aacagtgatatcaagacagaca

SEQ ID NO: 7200182 - DNA, 22 bp, Homo sapiens
aacataagggagcttcaaaact

SEQ ID NO: 7200183 - DNA, 22 bp, Homo sapiens
aacatacagtgagcagtggact

SEQ ID NO: 7200184 - DNA, 22 bp, Homo sapiens
aacatacatatttcagtgtcca

SEQ ID NO: 7200185 - DNA, 22 bp, Homo sapiens
aacatacatatttcagtgtcca

SEQ ID NO: 7200186 - DNA, 22 bp, Homo sapiens
aacatacatatttcagtgtcca

SEQ ID NO: 7200187 - DNA, 22 bp, Homo sapiens
aacatacatatttcagtgtcca

SEQ ID NO: 7200188 - DNA, 22 bp, Homo sapiens
aacataatgtggccaaagtcac

SEQ ID NO: 7200189 - DNA, 22 bp, Homo sapiens
aacatacagtgagcagtggact

SEQ ID NO: 7200190 - DNA, 23 bp, Homo sapiens
aacatactgtttaatattcacag

SEQ ID NO: 7200191 - DNA, 22 bp, Homo sapiens
aacatacttatactaaataatg

SEQ ID NO: 7200192 - DNA, 22 bp, Homo sapiens
aacatacttatactaaataatg

SEQ ID NO: 7200193 - DNA, 22 bp, Homo sapiens
aacatagaagatggttaattgt

SEQ ID NO: 7200194 - DNA, 22 bp, Homo sapiens
aacatagaatggctccagagct

SEQ ID NO: 7200195 - DNA, 22 bp, Homo sapiens
aacatagaattgttatattttc

SEQ ID NO: 7200196 - DNA, 22 bp, Homo sapiens
aacatagaatggctccagagct

SEQ ID NO: 7200197 - DNA, 22 bp, Homo sapiens
aacatagaattgttatattttc

SEQ ID NO: 7200198 - DNA, 22 bp, Homo sapiens
aaagccattacaaaatttcata

SEQ ID NO: 7200199 - DNA, 22 bp, Homo sapiens
aaagccattacaaaatttcata

SEQ ID NO: 7200200 - DNA, 22 bp, Homo sapiens
aaagccattacaaaatttcata

SEQ ID NO: 7200201 - DNA, 22 bp, Homo sapiens
aaagccattgaactgtacttta

SEQ ID NO: 7200202 - DNA, 22 bp, Homo sapiens
aaagcccccctgatctgagatg

SEQ ID NO: 7200203 - DNA, 22 bp, Homo sapiens
aaagcctcccaggttatgagta

SEQ ID NO: 7200204 - DNA, 18 bp, Homo sapiens
aaagccctgggtatgttt

SEQ ID NO: 7200205 - DNA, 22 bp, Homo sapiens
aaagcccatgtggaagtacagg

SEQ ID NO: 7200206 - DNA, 22 bp, Homo sapiens
aacatagaattgttatattttc

SEQ ID NO: 7200207 - DNA, 22 bp, Homo sapiens
aacatagaattgttatattttc

SEQ ID NO: 7200208 - DNA, 22 bp, Homo sapiens
aacatagacccagttcaacaaa

SEQ ID NO: 7200209 - DNA, 22 bp, Homo sapiens
aacatagagacaggaagtgctt

SEQ ID NO: 7200210 - DNA, 22 bp, Homo sapiens
aacatagctttactcaaatgac

SEQ ID NO: 7200211 - DNA, 22 bp, Homo sapiens
aacatataaactcttaagttca

SEQ ID NO: 7200212 - DNA, 22 bp, Homo sapiens
aacatataaactcttaagttca

SEQ ID NO: 7200213 - DNA, 22 bp, Homo sapiens
aacatataaactcttaagttca

SEQ ID NO: 7200214 - DNA, 22 bp, Homo sapiens
aacatataaactcttaagttca

SEQ ID NO: 7200215 - DNA, 22 bp, Homo sapiens
aacccagggtgaggggagtcta

SEQ ID NO: 7200216 - DNA, 22 bp, Homo sapiens
aacccaggaggcagaggctgca

SEQ ID NO: 7200217 - DNA, 22 bp, Homo sapiens
aacccaggaggcagatgttgtg

SEQ ID NO: 7200218 - DNA, 22 bp, Homo sapiens
aacccaggaggcggaggttgtg

SEQ ID NO: 7200219 - DNA, 22 bp, Homo sapiens
aacccaggaggtggaggttgtg

SEQ ID NO: 7200220 - DNA, 22 bp, Homo sapiens
aacccaggagttggaggctgtg

SEQ ID NO: 7200221 - DNA, 22 bp, Homo sapiens
aacccaggagttggaggctgtg

SEQ ID NO: 7200222 - DNA, 22 bp, Homo sapiens
aacccaggagttggaggctgtg

SEQ ID NO: 7200223 - DNA, 22 bp, Homo sapiens
aacccactctacctggctccat

SEQ ID NO: 7200224 - DNA, 22 bp, Homo sapiens
aacccaggacagagctttgtgg

SEQ ID NO: 7200225 - DNA, 22 bp, Homo sapiens
aacccaggagacggagtttgtg

SEQ ID NO: 7200226 - DNA, 22 bp, Homo sapiens
aacccaggagatggaggttgtg

SEQ ID NO: 7200227 - DNA, 22 bp, Homo sapiens
aacccaggagccggaggttgtg

SEQ ID NO: 7200228 - DNA, 22 bp, Homo sapiens
aacccaggaggcagaggctgca

SEQ ID NO: 7200229 - DNA, 22 bp, Homo sapiens
aacccaggaggcagaggctgca

SEQ ID NO: 7200230 - DNA, 22 bp, Homo sapiens
aaagcctgggttcctcactatc

SEQ ID NO: 7200231 - DNA, 22 bp, Homo sapiens
aaagcctgggttcctcactatc

SEQ ID NO: 7200232 - DNA, 22 bp, Homo sapiens
aaagcctgtctggtcatagcta

SEQ ID NO: 7200233 - DNA, 22 bp, Homo sapiens
aaagccttcaagtagatgtaag

SEQ ID NO: 7200234 - DNA, 22 bp, Homo sapiens
aaagccttcaagtagatgtaag

SEQ ID NO: 7200235 - DNA, 22 bp, Homo sapiens
aaagccttctgtctagcagata

SEQ ID NO: 7200236 - DNA, 22 bp, Homo sapiens
aaagccttcttcggtctgtgat

SEQ ID NO: 7200237 - DNA, 22 bp, Homo sapiens
aaagccttcttcggtctgtgat

SEQ ID NO: 7200238 - DNA, 22 bp, Homo sapiens
aaagccttgagatcctatagtt

SEQ ID NO: 7200239 - DNA, 22 bp, Homo sapiens
aaagccttgagatcctatagtt

SEQ ID NO: 7200240 - DNA, 22 bp, Homo sapiens
aaagccttgcccgtcactggga

SEQ ID NO: 7200241 - DNA, 22 bp, Homo sapiens
aaagccttgcccgtcactggga

SEQ ID NO: 7200242 - DNA, 22 bp, Homo sapiens
aaagccttgggatttgtgatca

SEQ ID NO: 7200243 - DNA, 22 bp, Homo sapiens
aaagccttgggatttgtgatca

SEQ ID NO: 7200244 - DNA, 22 bp, Homo sapiens
aaagccttgggatttgtgatca

SEQ ID NO: 7200245 - DNA, 22 bp, Homo sapiens
aaagccttggtcatctggttcc

SEQ ID NO: 7200246 - DNA, 22 bp, Homo sapiens
aaagccttggtcatctggttcc

SEQ ID NO: 7200247 - DNA, 22 bp, Homo sapiens
aaagccttttatgatcagttaa

SEQ ID NO: 7200248 - DNA, 22 bp, Homo sapiens
aaagccttttatgatcagttaa

SEQ ID NO: 7200249 - DNA, 22 bp, Homo sapiens
aaagccttttctgtttaacaca

SEQ ID NO: 7200250 - DNA, 22 bp, Homo sapiens
aacatttgtttcgttatgtgaa

SEQ ID NO: 7200251 - DNA, 22 bp, Homo sapiens
aacatttgtttggcttcaatta

SEQ ID NO: 7200252 - DNA, 22 bp, Homo sapiens
aacatttttaagaccaagtgct

SEQ ID NO: 7200253 - DNA, 16 bp, Homo sapiens
aacccacagctcccga

SEQ ID NO: 7200254 - DNA, 22 bp, Homo sapiens
aacccattaatccttgcaagca

SEQ ID NO: 7200255 - DNA, 22 bp, Homo sapiens
aaccccagtaccccaggatatg

SEQ ID NO: 7200256 - DNA, 22 bp, Homo sapiens
aaccccgctcaggctgggtgag

SEQ ID NO: 7200257 - DNA, 22 bp, Homo sapiens
aacccgagggccccaggctcgg

SEQ ID NO: 7200258 - DNA, 22 bp, Homo sapiens
aacccgagggccccaggctcgg

SEQ ID NO: 7200259 - DNA, 22 bp, Homo sapiens
aacccgagggccccaggctcgg

SEQ ID NO: 7200260 - DNA, 22 bp, Homo sapiens
aacccgggaggcagaggttgtg

SEQ ID NO: 7200261 - DNA, 22 bp, Homo sapiens
aacccgggaggcagaggttgtg

SEQ ID NO: 7200262 - DNA, 22 bp, Homo sapiens
aaaggcagagttgttggaggca

SEQ ID NO: 7200263 - DNA, 22 bp, Homo sapiens
aaaggcagagttgttggaggca

SEQ ID NO: 7200264 - DNA, 22 bp, Homo sapiens
aacccgggaggcagaggttgtg

SEQ ID NO: 7200265 - DNA, 18 bp, Homo sapiens
aaaggcagattactggga

SEQ ID NO: 7200266 - DNA, 22 bp, Homo sapiens
aaaggcaggactgcagcatagg

SEQ ID NO: 7200267 - DNA, 22 bp, Homo sapiens
aaaggcaggactgcagcatagg

SEQ ID NO: 7200268 - DNA, 22 bp, Homo sapiens
aaaggcaggactgcagcatagg

SEQ ID NO: 7200269 - DNA, 22 bp, Homo sapiens
aaaggcagtgtgatactgtggt

SEQ ID NO: 7200270 - DNA, 18 bp, Homo sapiens
aaaggcatatatagaagt

SEQ ID NO: 7200271 - DNA, 19 bp, Homo sapiens
aaaggcagtgggtggcgtg

SEQ ID NO: 7200272 - DNA, 19 bp, Homo sapiens
aaaggcagtgggtggcgtg

SEQ ID NO: 7200273 - DNA, 19 bp, Homo sapiens
aaaggcagtgggtggcgtg

SEQ ID NO: 7200274 - DNA, 22 bp, Homo sapiens
aaaggcatcattagtaccaagt

SEQ ID NO: 7200275 - DNA, 22 bp, Homo sapiens
aaaggcatgattaattctgtgt

SEQ ID NO: 7200276 - DNA, 22 bp, Homo sapiens
aaaggcagtgggtatgtggatc

SEQ ID NO: 7200277 - DNA, 22 bp, Homo sapiens
aaaggcagtgggtatgtggatc

SEQ ID NO: 7200278 - DNA, 22 bp, Homo sapiens
aaaggcagtgggtatgtggatc

SEQ ID NO: 7200279 - DNA, 22 bp, Homo sapiens
aaaggcagtgggtatgtggatc

SEQ ID NO: 7200280 - DNA, 22 bp, Homo sapiens
aaaggcagtgggtatgtggatc

SEQ ID NO: 7200281 - DNA, 23 bp, Homo sapiens
aaaggcaggcctaggacatattg

SEQ ID NO: 7200282 - DNA, 22 bp, Homo sapiens
aaaggcaggctttcacatctca

SEQ ID NO: 7200283 - DNA, 22 bp, Homo sapiens
aaaggcaggctttcacatctca

SEQ ID NO: 7200284 - DNA, 22 bp, Homo sapiens
aaaggcaggctttcacatctca

SEQ ID NO: 7200285 - DNA, 22 bp, Homo sapiens
aaaggcaggctttcacatctca

SEQ ID NO: 7200286 - DNA, 22 bp, Homo sapiens
aaaggcaggctttcacatctca

SEQ ID NO: 7200287 - DNA, 22 bp, Homo sapiens
aaaggttttggtaaggctttaa

SEQ ID NO: 7200288 - DNA, 22 bp, Homo sapiens
aaaggttttgccctgggtattc

SEQ ID NO: 7200289 - DNA, 22 bp, Homo sapiens
aaaggttttctgacccttagta

SEQ ID NO: 7200290 - DNA, 22 bp, Homo sapiens
aactgtgggagaaggcgatgtg

SEQ ID NO: 7200291 - DNA, 22 bp, Homo sapiens
aactgtggccagggactggagt

SEQ ID NO: 7200292 - DNA, 22 bp, Homo sapiens
aactgtgggatgcattaattca

SEQ ID NO: 7200293 - DNA, 22 bp, Homo sapiens
aactgtgtccttagctctcact

SEQ ID NO: 7200294 - DNA, 22 bp, Homo sapiens
aactgtgtggtatacctgtgat

SEQ ID NO: 7200295 - DNA, 22 bp, Homo sapiens
aactgtgtggtatacctgtgat

SEQ ID NO: 7200296 - DNA, 22 bp, Homo sapiens
aactgtgaggatgtgcaaattc

SEQ ID NO: 7200297 - DNA, 22 bp, Homo sapiens
aactgtcttgcctactcagcat

SEQ ID NO: 7200298 - DNA, 23 bp, Homo sapiens
aactgtcttgcaagtgtgatacc

SEQ ID NO: 7200299 - DNA, 23 bp, Homo sapiens
aactgtcttgcaagtgtgatacc

SEQ ID NO: 7200300 - DNA, 22 bp, Homo sapiens
aactgtagcaaagaacagctct

SEQ ID NO: 7200301 - DNA, 22 bp, Homo sapiens
aactgtatacaattgtcagaca

SEQ ID NO: 7200302 - DNA, 22 bp, Homo sapiens
aactgtcatctttcaaggaaga

SEQ ID NO: 7200303 - DNA, 22 bp, Homo sapiens
aactgtctaaggagaatatgaa

SEQ ID NO: 7200304 - DNA, 22 bp, Homo sapiens
aactgtctaaggagaatatgaa

SEQ ID NO: 7200305 - DNA, 21 bp, Homo sapiens
aactgcaaatgatgctggaga

SEQ ID NO: 7200306 - DNA, 22 bp, Homo sapiens
aactgtaagaaataaaattctg

SEQ ID NO: 7200307 - DNA, 22 bp, Homo sapiens
aactgtaagaaataaaattctg

SEQ ID NO: 7200308 - DNA, 22 bp, Homo sapiens
aactgtaagagaataaatgtgt

SEQ ID NO: 7200309 - DNA, 22 bp, Homo sapiens
aactgtaaggcttagaacagca

SEQ ID NO: 7200310 - DNA, 22 bp, Homo sapiens
aactgtaatgaattgttcatga

SEQ ID NO: 7200311 - DNA, 22 bp, Homo sapiens
aactgtaatgaattgttcatga

SEQ ID NO: 7200312 - DNA, 22 bp, Homo sapiens
aactgtaatgaattgttcatga

SEQ ID NO: 7200313 - DNA, 22 bp, Homo sapiens
aactgtaatttttacatagtaa

SEQ ID NO: 7200314 - DNA, 22 bp, Homo sapiens
aactgtaatttttacatagtaa

SEQ ID NO: 7200315 - DNA, 22 bp, Homo sapiens
aactgtagaagggacacaaaag

SEQ ID NO: 7200316 - DNA, 22 bp, Homo sapiens
aaagtaagaccaagtgatcatt

SEQ ID NO: 7200317 - DNA, 22 bp, Homo sapiens
aaagtaaagattgggaatgtgt

SEQ ID NO: 7200318 - DNA, 22 bp, Homo sapiens
aaagtaaagattgggaatgtgt

SEQ ID NO: 7200319 - DNA, 22 bp, Homo sapiens
aaagtaacaaaactgtgtgcca

SEQ ID NO: 7200320 - DNA, 22 bp, Homo sapiens
aaaggtttttcagcagggagat

SEQ ID NO: 7200321 - DNA, 22 bp, Homo sapiens
aaaggtttttatttatcctgga

SEQ ID NO: 7200322 - DNA, 22 bp, Homo sapiens
aaaggttttgttcatcgatttt

SEQ ID NO: 7200323 - DNA, 22 bp, Homo sapiens
aaagtaagatttgcatttcaga

SEQ ID NO: 7200324 - DNA, 22 bp, Homo sapiens
aaagtaagatttgcatttcaga

SEQ ID NO: 7200325 - DNA, 22 bp, Homo sapiens
aaagtaagggttaatctacttt

SEQ ID NO: 7200326 - DNA, 22 bp, Homo sapiens
aaagtaattaagaagctggaca

SEQ ID NO: 7200327 - DNA, 22 bp, Homo sapiens
aaagtaattaagaagctggaca

SEQ ID NO: 7200328 - DNA, 22 bp, Homo sapiens
aaagtaattgcagtttctgcca

SEQ ID NO: 7200329 - DNA, 22 bp, Homo sapiens
aaagtaattgcagtttctgcca

SEQ ID NO: 7200330 - DNA, 22 bp, Homo sapiens
aaagtaattgtggttcttgcca

SEQ ID NO: 7200331 - DNA, 22 bp, Homo sapiens
aagaaataagacttctctgtcc

SEQ ID NO: 7200332 - DNA, 22 bp, Homo sapiens
aagaacagtgtcctgggactcg

SEQ ID NO: 7200333 - DNA, 22 bp, Homo sapiens
aagaacataacagaagctgtgt

SEQ ID NO: 7200334 - DNA, 22 bp, Homo sapiens
aagaacatacagtggcggagtc

SEQ ID NO: 7200335 - DNA, 22 bp, Homo sapiens
aagaacagttgggaggtgagcc

SEQ ID NO: 7200336 - DNA, 22 bp, Homo sapiens
aagaacagttgggaggtgagcc

SEQ ID NO: 7200337 - DNA, 22 bp, Homo sapiens
aagaacataaacagaaggacag

SEQ ID NO: 7200338 - DNA, 22 bp, Homo sapiens
aagaacagttgggaggtgagcc

SEQ ID NO: 7200339 - DNA, 22 bp, Homo sapiens
aagaacagttgggaggtgagcc

SEQ ID NO: 7200340 - DNA, 22 bp, Homo sapiens
aagaacatgaagtcacaaatgc

SEQ ID NO: 7200341 - DNA, 22 bp, Homo sapiens
aagaacatgaacctcttctaac

SEQ ID NO: 7200342 - DNA, 22 bp, Homo sapiens
aagaacatgaacctcttctaac

SEQ ID NO: 7200343 - DNA, 22 bp, Homo sapiens
aagaacatgagttatgatgatt

SEQ ID NO: 7200344 - DNA, 22 bp, Homo sapiens
aagaacatgagttatgatgatt

SEQ ID NO: 7200345 - DNA, 22 bp, Homo sapiens
aagaacatgagttatgatgatt

SEQ ID NO: 7200346 - DNA, 22 bp, Homo sapiens
aagaacatgagttatgatgatt

SEQ ID NO: 7200347 - DNA, 22 bp, Homo sapiens
aatggccattgggtcatgctag

SEQ ID NO: 7200348 - DNA, 22 bp, Homo sapiens
aatggccattgggtcatgctag

SEQ ID NO: 7200349 - DNA, 22 bp, Homo sapiens
aatgctttctcagagtccttca

SEQ ID NO: 7200350 - DNA, 22 bp, Homo sapiens
aatgctttcttataaccactgc

SEQ ID NO: 7200351 - DNA, 22 bp, Homo sapiens
aactataatggggttaggaaat

SEQ ID NO: 7200352 - DNA, 22 bp, Homo sapiens
aatgctttctcagagtccttca

SEQ ID NO: 7200353 - DNA, 22 bp, Homo sapiens
aactagtttagctttttaagac

SEQ ID NO: 7200354 - DNA, 22 bp, Homo sapiens
aactagttttagctctagcaac

SEQ ID NO: 7200355 - DNA, 23 bp, Homo sapiens
aactagttgccatgaataaaagc

SEQ ID NO: 7200356 - DNA, 22 bp, Homo sapiens
aactagtcagtgattctcagaa

SEQ ID NO: 7200357 - DNA, 22 bp, Homo sapiens
aactagctggattagtgttttc

SEQ ID NO: 7200358 - DNA, 22 bp, Homo sapiens
aactagtaaaagcaacagtata

SEQ ID NO: 7200359 - DNA, 22 bp, Homo sapiens
aactagagcttccagcttcttg

SEQ ID NO: 7200360 - DNA, 22 bp, Homo sapiens
aactagcagctaagacataatt

SEQ ID NO: 7200361 - DNA, 22 bp, Homo sapiens
aactagaacgagaaagctgaac

SEQ ID NO: 7200362 - DNA, 22 bp, Homo sapiens
aactagaacgtctagttgctgg

SEQ ID NO: 7200363 - DNA, 22 bp, Homo sapiens
aatggctgggagtgtattttgg

SEQ ID NO: 7200364 - DNA, 21 bp, Homo sapiens
aatggctgggcaaggtctctc

SEQ ID NO: 7200365 - DNA, 22 bp, Homo sapiens
aatggctgccagggcaggaggt

SEQ ID NO: 7200366 - DNA, 22 bp, Homo sapiens
aatggctatacaacatgagtat

SEQ ID NO: 7200367 - DNA, 22 bp, Homo sapiens
aatggctctgatgttgttgtga

SEQ ID NO: 7200368 - DNA, 22 bp, Homo sapiens
aatggctctgatgttgttgtga

SEQ ID NO: 7200369 - DNA, 22 bp, Homo sapiens
aatggcttagctcagcgctcag

SEQ ID NO: 7200370 - DNA, 22 bp, Homo sapiens
aatggcttagtgcttcacttct

SEQ ID NO: 7200371 - DNA, 22 bp, Homo sapiens
aatggcttctttttggtataat

SEQ ID NO: 7200372 - DNA, 22 bp, Homo sapiens
aactagaaccacttgtatttcc

SEQ ID NO: 7200373 - DNA, 22 bp, Homo sapiens
aactagaaccacttgtatttcc

SEQ ID NO: 7200374 - DNA, 22 bp, Homo sapiens
aactagaaatcactacaggtat

SEQ ID NO: 7200375 - DNA, 22 bp, Homo sapiens
aactagaaatcactacaggtat

SEQ ID NO: 7200376 - DNA, 20 bp, Homo sapiens
aactagaaagcacccatgga

SEQ ID NO: 7200377 - DNA, 22 bp, Homo sapiens
aactagaacctgcattttaaca

SEQ ID NO: 7200378 - DNA, 22 bp, Homo sapiens
aactagaaccacttgtatttcc

SEQ ID NO: 7200379 - DNA, 22 bp, Homo sapiens
aactagaacgagaaagctgaac

SEQ ID NO: 7200380 - DNA, 22 bp, Homo sapiens
aactagaacgagaaagctgaac

SEQ ID NO: 7200381 - DNA, 22 bp, Homo sapiens
aactagaaagaacatatttcca

SEQ ID NO: 7200382 - DNA, 22 bp, Homo sapiens
aactagaaagaacatatttcca

SEQ ID NO: 7200383 - DNA, 22 bp, Homo sapiens
aactagaaaacaagatgctgat

SEQ ID NO: 7200384 - DNA, 20 bp, Homo sapiens
aactagaaagcacccatgga

SEQ ID NO: 7200385 - DNA, 19 bp, Homo sapiens
aactagaaaggttttgaga

SEQ ID NO: 7200386 - DNA, 23 bp, Homo sapiens
aatgacaggcaatgtaattgtgt

SEQ ID NO: 7200387 - DNA, 22 bp, Homo sapiens
aatgacagtattccctttatca

SEQ ID NO: 7200388 - DNA, 22 bp, Homo sapiens
aatgacagtggcacagtcactt

SEQ ID NO: 7200389 - DNA, 22 bp, Homo sapiens
aatgacataagtgcagatgcta

SEQ ID NO: 7200390 - DNA, 22 bp, Homo sapiens
aatgacataagtgcagatgcta

SEQ ID NO: 7200391 - DNA, 22 bp, Homo sapiens
aatgacatgctttttaattata

SEQ ID NO: 7200392 - DNA, 22 bp, Homo sapiens
aatgacatgctttttaattata

SEQ ID NO: 7200393 - DNA, 22 bp, Homo sapiens
aatgacatgctttttaattata

SEQ ID NO: 7200394 - DNA, 22 bp, Homo sapiens
aatgacatgctttttaattata

SEQ ID NO: 7200395 - DNA, 22 bp, Homo sapiens
aatgacatgctttttaattata

SEQ ID NO: 7200396 - DNA, 22 bp, Homo sapiens
aactactaccagtagtagtagt

SEQ ID NO: 7200397 - DNA, 22 bp, Homo sapiens
aactactctgctcatgtttata

SEQ ID NO: 7200398 - DNA, 20 bp, Homo sapiens
aactactctgggttgtcttt

SEQ ID NO: 7200399 - DNA, 22 bp, Homo sapiens
aactagaaaaagactttctgag

SEQ ID NO: 7200400 - DNA, 22 bp, Homo sapiens
aatgacagagatagaagggatg

SEQ ID NO: 7200401 - DNA, 22 bp, Homo sapiens
aatgacagccagattcttctct

SEQ ID NO: 7200402 - DNA, 23 bp, Homo sapiens
aatgacaggcaatgtaattgtgt

SEQ ID NO: 7200403 - DNA, 22 bp, Homo sapiens
aatgaattgcagtactgacttg

SEQ ID NO: 7200404 - DNA, 22 bp, Homo sapiens
aatgacaataatcattaacttt

SEQ ID NO: 7200405 - DNA, 22 bp, Homo sapiens
aatgacaataatcattaacttt

SEQ ID NO: 7200406 - DNA, 22 bp, Homo sapiens
aatgacaatattaatttggagg

SEQ ID NO: 7200407 - DNA, 22 bp, Homo sapiens
aaccatttgccattatcttaag

SEQ ID NO: 7200408 - DNA, 22 bp, Homo sapiens
aaccatttgccattatcttaag

SEQ ID NO: 7200409 - DNA, 22 bp, Homo sapiens
aaccatttgcagttactgagac

SEQ ID NO: 7200410 - DNA, 22 bp, Homo sapiens
aacatgttgctttaataatatt

SEQ ID NO: 7200411 - DNA, 22 bp, Homo sapiens
aaccatttgcagttactgagac

SEQ ID NO: 7200412 - DNA, 22 bp, Homo sapiens
aacatgtgtcttgcatttcttg

SEQ ID NO: 7200413 - DNA, 22 bp, Homo sapiens
aacatgttgagttgaaagtagc

SEQ ID NO: 7200414 - DNA, 22 bp, Homo sapiens
aacatgttgagttgaaagtagc

SEQ ID NO: 7200415 - DNA, 22 bp, Homo sapiens
aacatgttgctttaataatatt

SEQ ID NO: 7200416 - DNA, 22 bp, Homo sapiens
aacccgggaggcagaggttgtg

SEQ ID NO: 7200417 - DNA, 22 bp, Homo sapiens
aacccgggaggcggaggttgtg

SEQ ID NO: 7200418 - DNA, 22 bp, Homo sapiens
aacccgggaggcggaggttgtg

SEQ ID NO: 7200419 - DNA, 22 bp, Homo sapiens
aacccgggaggcggaggttgtg

SEQ ID NO: 7200420 - DNA, 22 bp, Homo sapiens
aacccgggaggcggaggttgtg

SEQ ID NO: 7200421 - DNA, 22 bp, Homo sapiens
aacctctctgtgccctgacttt

SEQ ID NO: 7200422 - DNA, 22 bp, Homo sapiens
aacctctttgtgaatgtcatga

SEQ ID NO: 7200423 - DNA, 22 bp, Homo sapiens
aacctctccctttgtgtccctg

SEQ ID NO: 7200424 - DNA, 16 bp, Homo sapiens
aacctctctactgtgg

SEQ ID NO: 7200425 - DNA, 22 bp, Homo sapiens
aacctcaggctctctggacaat

SEQ ID NO: 7200426 - DNA, 22 bp, Homo sapiens
aacctagacagggcctctgtta

SEQ ID NO: 7200427 - DNA, 22 bp, Homo sapiens
aacctagagttgccttttttaa

SEQ ID NO: 7200428 - DNA, 22 bp, Homo sapiens
aacctaggactatagatatcat

SEQ ID NO: 7200429 - DNA, 23 bp, Homo sapiens
aacctagactacttactatgtgg

SEQ ID NO: 7200430 - DNA, 22 bp, Homo sapiens
aacctagggcatgaggatggtt

SEQ ID NO: 7200431 - DNA, 22 bp, Homo sapiens
aacctcaaactcttgggcttaa

SEQ ID NO: 7200432 - DNA, 22 bp, Homo sapiens
aacctcaaactcttgggcttaa

SEQ ID NO: 7200433 - DNA, 22 bp, Homo sapiens
aacctcaaactcttgggcttaa

SEQ ID NO: 7200434 - DNA, 22 bp, Homo sapiens
aaccctaggtggcagaggttgc

SEQ ID NO: 7200435 - DNA, 22 bp, Homo sapiens
aaccctggagaaggctttggat

SEQ ID NO: 7200436 - DNA, 22 bp, Homo sapiens
aaccctggccctggaataggca

SEQ ID NO: 7200437 - DNA, 22 bp, Homo sapiens
aaccctggccctggaataggca

SEQ ID NO: 7200438 - DNA, 22 bp, Homo sapiens
aaccctgggaggcagctcagtt

SEQ ID NO: 7200439 - DNA, 22 bp, Homo sapiens
aaccctgggaggcagctcagtt

SEQ ID NO: 7200440 - DNA, 22 bp, Homo sapiens
aaccctggccctggaataggca

SEQ ID NO: 7200441 - DNA, 22 bp, Homo sapiens
aaccctgggaggcagctcagtt

SEQ ID NO: 7200442 - DNA, 22 bp, Homo sapiens
aaccctggggcagctgctaggg

SEQ ID NO: 7200443 - DNA, 22 bp, Homo sapiens
aaccctggggcagctgctaggg

SEQ ID NO: 7200444 - DNA, 22 bp, Homo sapiens
aaccctggggctgctctgcctg

SEQ ID NO: 7200445 - DNA, 22 bp, Homo sapiens
aaccgttttaccatttgtaact

SEQ ID NO: 7200446 - DNA, 22 bp, Homo sapiens
aacctaagtgctgttgaacgtt

SEQ ID NO: 7200447 - DNA, 21 bp, Homo sapiens
aacctgagacccacgggacta

SEQ ID NO: 7200448 - DNA, 22 bp, Homo sapiens
aacctgctttctcagagaaggg

SEQ ID NO: 7200449 - DNA, 22 bp, Homo sapiens
aacctgagtcttttgatttgct

SEQ ID NO: 7200450 - DNA, 22 bp, Homo sapiens
aacctgcagtttttattctgag

SEQ ID NO: 7200451 - DNA, 20 bp, Homo sapiens
aacctgaggcagtgttccag

SEQ ID NO: 7200452 - DNA, 22 bp, Homo sapiens
aacctgagggcaggaccccata

SEQ ID NO: 7200453 - DNA, 22 bp, Homo sapiens
aacctgagtcttttgatttgct

SEQ ID NO: 7200454 - DNA, 22 bp, Homo sapiens
aacctgagataataggagagta

SEQ ID NO: 7200455 - DNA, 22 bp, Homo sapiens
aacctgagataataggagagta

SEQ ID NO: 7200456 - DNA, 22 bp, Homo sapiens
aacctgagataataggagagta

SEQ ID NO: 7200457 - DNA, 22 bp, Homo sapiens
aacctgagatactggtctttat

SEQ ID NO: 7200458 - DNA, 22 bp, Homo sapiens
aacctgagcgcgttgctttcta

SEQ ID NO: 7200459 - DNA, 22 bp, Homo sapiens
aacctgcatgtttctaaaagca

SEQ ID NO: 7200460 - DNA, 22 bp, Homo sapiens
aacctggagcaccctcatatct

SEQ ID NO: 7200461 - DNA, 22 bp, Homo sapiens
aacctggagcaccctcatatct

SEQ ID NO: 7200462 - DNA, 22 bp, Homo sapiens
aacctggaggactgcaatccat

SEQ ID NO: 7200463 - DNA, 22 bp, Homo sapiens
aacctggaggctgtgtagtctt

SEQ ID NO: 7200464 - DNA, 22 bp, Homo sapiens
aacctggccccagattccccat

SEQ ID NO: 7200465 - DNA, 22 bp, Homo sapiens
aacctggccctaatcccagtag

SEQ ID NO: 7200466 - DNA, 22 bp, Homo sapiens
aacctggctgcaaagaagggga

SEQ ID NO: 7200467 - DNA, 22 bp, Homo sapiens
aacctgggcttgaacagtgcct

SEQ ID NO: 7200468 - DNA, 22 bp, Homo sapiens
aacctggctcatgcagaaccct

SEQ ID NO: 7200469 - DNA, 22 bp, Homo sapiens
aacctggctgccagcaatgtgt

SEQ ID NO: 7200470 - DNA, 22 bp, Homo sapiens
aacctgtaaatccaaacaatct

SEQ ID NO: 7200471 - DNA, 22 bp, Homo sapiens
aacctgttttggttgcatttca

SEQ ID NO: 7200472 - DNA, 22 bp, Homo sapiens
aacctgttttggttgcatttca

SEQ ID NO: 7200473 - DNA, 22 bp, Homo sapiens
aaccttatcatgcataagtaga

SEQ ID NO: 7200474 - DNA, 22 bp, Homo sapiens
aacctttccaagcatttctgtt

SEQ ID NO: 7200475 - DNA, 22 bp, Homo sapiens
aacctttatttggtactattct

SEQ ID NO: 7200476 - DNA, 22 bp, Homo sapiens
aacctttatttggtactattct

SEQ ID NO: 7200477 - DNA, 22 bp, Homo sapiens
aacctttatttggtactattct

SEQ ID NO: 7200478 - DNA, 22 bp, Homo sapiens
aacctttatttggtactattct

SEQ ID NO: 7200479 - DNA, 22 bp, Homo sapiens
aacctttcaattatcctcatct

SEQ ID NO: 7200480 - DNA, 22 bp, Homo sapiens
aacctttcaattatcctcatct

SEQ ID NO: 7200481 - DNA, 22 bp, Homo sapiens
aaccttttgcaagtgccttgac

SEQ ID NO: 7200482 - DNA, 22 bp, Homo sapiens
aacgaatagggatttttctaac

SEQ ID NO: 7200483 - DNA, 22 bp, Homo sapiens
aaccttatcatgcataagtaga

SEQ ID NO: 7200484 - DNA, 22 bp, Homo sapiens
aaccttgtataaaactttgaga

SEQ ID NO: 7200485 - DNA, 22 bp, Homo sapiens
aaccttgtataaaactttgaga

SEQ ID NO: 7200486 - DNA, 19 bp, Homo sapiens
aacctttagatcattctcc

SEQ ID NO: 7200487 - DNA, 19 bp, Homo sapiens
aacctttagatcattctcc

SEQ ID NO: 7200488 - DNA, 19 bp, Homo sapiens
aacctttagatcattctcc

SEQ ID NO: 7200489 - DNA, 22 bp, Homo sapiens
aatgaacaacactgaaggaaga

SEQ ID NO: 7200490 - DNA, 22 bp, Homo sapiens
aatgaacaacactgaaggaaga

SEQ ID NO: 7200491 - DNA, 22 bp, Homo sapiens
aatgaacaacactgaaggaaga

SEQ ID NO: 7200492 - DNA, 22 bp, Homo sapiens
aatgaacaacttgatttttgcc

SEQ ID NO: 7200493 - DNA, 22 bp, Homo sapiens
aatgaacaagaaagactttgag

SEQ ID NO: 7200494 - DNA, 22 bp, Homo sapiens
aatgaatgttttaaggcataaa

SEQ ID NO: 7200495 - DNA, 22 bp, Homo sapiens
aatgaacaagaaagactttgag

SEQ ID NO: 7200496 - DNA, 22 bp, Homo sapiens
aacatatcataggatgtcattg

SEQ ID NO: 7200497 - DNA, 22 bp, Homo sapiens
aacatatctacggatacgatta

SEQ ID NO: 7200498 - DNA, 22 bp, Homo sapiens
aacataaatttgaagtggcaaa

SEQ ID NO: 7200499 - DNA, 22 bp, Homo sapiens
aacatatcataggatgtcattg

SEQ ID NO: 7200500 - DNA, 22 bp, Homo sapiens
aacagcttgagactggatatgc

SEQ ID NO: 7200501 - DNA, 22 bp, Homo sapiens
aacagcttcatcacatggcata

SEQ ID NO: 7200502 - DNA, 22 bp, Homo sapiens
aacagcttcatcacatggcata

SEQ ID NO: 7200503 - DNA, 22 bp, Homo sapiens
aacagcttagaaatgttgctaa

SEQ ID NO: 7200504 - DNA, 22 bp, Homo sapiens
aacagctgttcgcagatgtagg

SEQ ID NO: 7200505 - DNA, 22 bp, Homo sapiens
aacagcttagaaatgttgctaa

SEQ ID NO: 7200506 - DNA, 22 bp, Homo sapiens
aacagcttcatcacatggcata

SEQ ID NO: 7200507 - DNA, 22 bp, Homo sapiens
aacagcttactcaatggtgatt

SEQ ID NO: 7200508 - DNA, 22 bp, Homo sapiens
aacagctgttcgcagatgtagg

SEQ ID NO: 7200509 - DNA, 22 bp, Homo sapiens
aacagctgttcgcagatgtagg

SEQ ID NO: 7200510 - DNA, 22 bp, Homo sapiens
aacagctgtatactgtagctgt

SEQ ID NO: 7200511 - DNA, 22 bp, Homo sapiens
aacagctgtctgcctatctctg

SEQ ID NO: 7200512 - DNA, 22 bp, Homo sapiens
aacagctgtctgcctatctctg

SEQ ID NO: 7200513 - DNA, 22 bp, Homo sapiens
aacatcacaatttcatttatgc

SEQ ID NO: 7200514 - DNA, 22 bp, Homo sapiens
aacatcacaatttcatttatgc

SEQ ID NO: 7200515 - DNA, 22 bp, Homo sapiens
aacatcagaagtagaagactca

SEQ ID NO: 7200516 - DNA, 22 bp, Homo sapiens
aacatcagaatatccatgttgg

SEQ ID NO: 7200517 - DNA, 22 bp, Homo sapiens
aacatcagcacacaatagcaag

SEQ ID NO: 7200518 - DNA, 22 bp, Homo sapiens
aacatcagcacacaatagcaag

SEQ ID NO: 7200519 - DNA, 22 bp, Homo sapiens
aacatcaggatcttgttacagt

SEQ ID NO: 7200520 - DNA, 22 bp, Homo sapiens
aacatcaggatcttgttacagt

SEQ ID NO: 7200521 - DNA, 22 bp, Homo sapiens
aacatcatcatgaacaactaat

SEQ ID NO: 7200522 - DNA, 22 bp, Homo sapiens
aacatcatcatgaacaactaat

SEQ ID NO: 7200523 - DNA, 22 bp, Homo sapiens
aacatcatcctttgagtattta

SEQ ID NO: 7200524 - DNA, 19 bp, Homo sapiens
aacatcatggctctttcca

SEQ ID NO: 7200525 - DNA, 19 bp, Homo sapiens
aacatcatggctctttcca

SEQ ID NO: 7200526 - DNA, 22 bp, Homo sapiens
aacatcattatgtccattaatg

SEQ ID NO: 7200527 - DNA, 22 bp, Homo sapiens
aacagctagtggtctagacttt

SEQ ID NO: 7200528 - DNA, 22 bp, Homo sapiens
aacagctagtaccaatccacta

SEQ ID NO: 7200529 - DNA, 22 bp, Homo sapiens
aacagctagtaccaatccacta

SEQ ID NO: 7200530 - DNA, 22 bp, Homo sapiens
aacagctgcttcagtacttgaa

SEQ ID NO: 7200531 - DNA, 22 bp, Homo sapiens
aacagctgcaaaaggttgcctg

SEQ ID NO: 7200532 - DNA, 22 bp, Homo sapiens
aagtgtctaactggttacttct

SEQ ID NO: 7200533 - DNA, 22 bp, Homo sapiens
aagtgtcctcattcaacatgca

SEQ ID NO: 7200534 - DNA, 22 bp, Homo sapiens
aagtgtataacgacctacagga

SEQ ID NO: 7200535 - DNA, 22 bp, Homo sapiens
aagtgtctaactggttacttct

SEQ ID NO: 7200536 - DNA, 22 bp, Homo sapiens
aagtgtctacatttgctaacca

SEQ ID NO: 7200537 - DNA, 22 bp, Homo sapiens
aagtgtctagcacctggatgca

SEQ ID NO: 7200538 - DNA, 22 bp, Homo sapiens
aagtgtctacatttgctaacca

SEQ ID NO: 7200539 - DNA, 22 bp, Homo sapiens
aagtgtctagcacctggatgca

SEQ ID NO: 7200540 - DNA, 22 bp, Homo sapiens
aacagcgacgtcctccccaaca

SEQ ID NO: 7200541 - DNA, 22 bp, Homo sapiens
aagtgcttctgggattaggagt

SEQ ID NO: 7200542 - DNA, 22 bp, Homo sapiens
aagtgcttggagcatacctgtt

SEQ ID NO: 7200543 - DNA, 22 bp, Homo sapiens
aagtggtgtgttggaagaaatc

SEQ ID NO: 7200544 - DNA, 22 bp, Homo sapiens
aagtggttattttgatctagaa

SEQ ID NO: 7200545 - DNA, 22 bp, Homo sapiens
aagtggttattttgatctagaa

SEQ ID NO: 7200546 - DNA, 22 bp, Homo sapiens
aagtggttgcttgtgagtcccc

SEQ ID NO: 7200547 - DNA, 22 bp, Homo sapiens
aagtggttgcttgtgagtcccc

SEQ ID NO: 7200548 - DNA, 22 bp, Homo sapiens
aagtggttattttgatctagaa

SEQ ID NO: 7200549 - DNA, 21 bp, Homo sapiens
aagtggtttacatccagctgt

SEQ ID NO: 7200550 - DNA, 21 bp, Homo sapiens
aagtggtttacatccagctgt

SEQ ID NO: 7200551 - DNA, 21 bp, Homo sapiens
aagtggtttacatccagctgt

SEQ ID NO: 7200552 - DNA, 21 bp, Homo sapiens
aagtggtttaggttaccgggg

SEQ ID NO: 7200553 - DNA, 21 bp, Homo sapiens
aagtggtttaggttaccgggg

SEQ ID NO: 7200554 - DNA, 22 bp, Homo sapiens
aagtggtttgagcacagtgctg

SEQ ID NO: 7200555 - DNA, 22 bp, Homo sapiens
aagtggtttgagcacagtgctg

SEQ ID NO: 7200556 - DNA, 22 bp, Homo sapiens
aagtggtttgattcagtttatg

SEQ ID NO: 7200557 - DNA, 22 bp, Homo sapiens
aagtggtttgattcagtttatg

SEQ ID NO: 7200558 - DNA, 22 bp, Homo sapiens
aagtggtttgattcagtttatg

SEQ ID NO: 7200559 - DNA, 22 bp, Homo sapiens
aagtggttttaagaggttcctt

SEQ ID NO: 7200560 - DNA, 22 bp, Homo sapiens
aagtggttttaagaggttcctt

SEQ ID NO: 7200561 - DNA, 23 bp, Homo sapiens
aagtggttttgaacccggaccct

SEQ ID NO: 7200562 - DNA, 23 bp, Homo sapiens
aagtggttttgaacccggaccct

SEQ ID NO: 7200563 - DNA, 22 bp, Homo sapiens
aagtgtaaattcacagacttca

SEQ ID NO: 7200564 - DNA, 22 bp, Homo sapiens
aacatctttgtagtgttctcct

SEQ ID NO: 7200565 - DNA, 22 bp, Homo sapiens
aacatctttgccaaattgctat

SEQ ID NO: 7200566 - DNA, 19 bp, Homo sapiens
aacatctttccagtagagg

SEQ ID NO: 7200567 - DNA, 19 bp, Homo sapiens
aacatctttccagtagagg

SEQ ID NO: 7200568 - DNA, 22 bp, Homo sapiens
aacatctttgataaacttagtg

SEQ ID NO: 7200569 - DNA, 22 bp, Homo sapiens
aacatctttgataaacttagtg

SEQ ID NO: 7200570 - DNA, 22 bp, Homo sapiens
aacatgaaaacctccacagcaa

SEQ ID NO: 7200571 - DNA, 22 bp, Homo sapiens
aacatgaaaacctccacagcaa

SEQ ID NO: 7200572 - DNA, 22 bp, Homo sapiens
aacatgaaaactacctgtgatt

SEQ ID NO: 7200573 - DNA, 22 bp, Homo sapiens
aacatgaaaagcccagagaggt

SEQ ID NO: 7200574 - DNA, 22 bp, Homo sapiens
aacatgaaaagcccagagaggt

SEQ ID NO: 7200575 - DNA, 22 bp, Homo sapiens
aacatgaaaactacctgtgatt

SEQ ID NO: 7200576 - DNA, 22 bp, Homo sapiens
aacatgaaaagcccagagaggt

SEQ ID NO: 7200577 - DNA, 20 bp, Homo sapiens
aatacatgagcacactttca

SEQ ID NO: 7200578 - DNA, 22 bp, Homo sapiens
aatacatgttttctactattct

SEQ ID NO: 7200579 - DNA, 22 bp, Homo sapiens
aatacatgttttctactattct

SEQ ID NO: 7200580 - DNA, 22 bp, Homo sapiens
aatagaatttaaatgcagtggc

SEQ ID NO: 7200581 - DNA, 22 bp, Homo sapiens
aacatctaggttctcatcgata

SEQ ID NO: 7200582 - DNA, 22 bp, Homo sapiens
aacatctactaagtgccaggca

SEQ ID NO: 7200583 - DNA, 22 bp, Homo sapiens
aacatctcagaagtgaccctga

SEQ ID NO: 7200584 - DNA, 22 bp, Homo sapiens
aacatctcatggactacattct

SEQ ID NO: 7200585 - DNA, 22 bp, Homo sapiens
aacatctccaacctacatccac

SEQ ID NO: 7200586 - DNA, 22 bp, Homo sapiens
aacatctccaacctacatccac

SEQ ID NO: 7200587 - DNA, 22 bp, Homo sapiens
aacatctctgtattttatagac

SEQ ID NO: 7200588 - DNA, 22 bp, Homo sapiens
aacatctccaacctacatccac

SEQ ID NO: 7200589 - DNA, 22 bp, Homo sapiens
aacatctgaaaaggcttcactc

SEQ ID NO: 7200590 - DNA, 22 bp, Homo sapiens
aacatctgatcgaacagtgcca

SEQ ID NO: 7200591 - DNA, 22 bp, Homo sapiens
aacatctgatcgaacagtgcca

SEQ ID NO: 7200592 - DNA, 22 bp, Homo sapiens
aacatctgtgaactccgaaaat

SEQ ID NO: 7200593 - DNA, 22 bp, Homo sapiens
aacatcttaagatagaagggga

SEQ ID NO: 7200594 - DNA, 22 bp, Homo sapiens
aacatcttaagatagaagggga

SEQ ID NO: 7200595 - DNA, 22 bp, Homo sapiens
aacatcttcagagaagctaagt

SEQ ID NO: 7200596 - DNA, 22 bp, Homo sapiens
aacatcttcagagaagctaagt

SEQ ID NO: 7200597 - DNA, 22 bp, Homo sapiens
aacatcttgtactgcacatttt

SEQ ID NO: 7200598 - DNA, 22 bp, Homo sapiens
aacatcttgaagattgggaaag

SEQ ID NO: 7200599 - DNA, 22 bp, Homo sapiens
aacatcttgtactgcacatttt

SEQ ID NO: 7200600 - DNA, 22 bp, Homo sapiens
aacatcttgtcaaatgtccaca

SEQ ID NO: 7200601 - DNA, 22 bp, Homo sapiens
aacatcttgtccttagattaaa

SEQ ID NO: 7200602 - DNA, 22 bp, Homo sapiens
aacatcttgtccttagattaaa

SEQ ID NO: 7200603 - DNA, 22 bp, Homo sapiens
aatagatactacttagatgtag

SEQ ID NO: 7200604 - DNA, 22 bp, Homo sapiens
aatagatactacttagatgtag

SEQ ID NO: 7200605 - DNA, 22 bp, Homo sapiens
aatagatactacttagatgtag

SEQ ID NO: 7200606 - DNA, 22 bp, Homo sapiens
aatagatactacttagatgtag

SEQ ID NO: 7200607 - DNA, 22 bp, Homo sapiens
aatagatactacttagatgtag

SEQ ID NO: 7200608 - DNA, 22 bp, Homo sapiens
aatagatactacttagatgtag

SEQ ID NO: 7200609 - DNA, 22 bp, Homo sapiens
aatagagtattttagcatctta

SEQ ID NO: 7200610 - DNA, 22 bp, Homo sapiens
aatagagtcagttctacattct

SEQ ID NO: 7200611 - DNA, 19 bp, Homo sapiens
aatagattaattatcctct

SEQ ID NO: 7200612 - DNA, 19 bp, Homo sapiens
aatagattaattatcctct

SEQ ID NO: 7200613 - DNA, 22 bp, Homo sapiens
aatagactttgtataatttccc

SEQ ID NO: 7200614 - DNA, 22 bp, Homo sapiens
aatagactttgtataatttccc

SEQ ID NO: 7200615 - DNA, 22 bp, Homo sapiens
aatagagacctagatgccatga

SEQ ID NO: 7200616 - DNA, 22 bp, Homo sapiens
aatagagagcagctttgcggtt

SEQ ID NO: 7200617 - DNA, 22 bp, Homo sapiens
aatagaggaagaaacctgattg

SEQ ID NO: 7200618 - DNA, 22 bp, Homo sapiens
aatagaggagctttggactccc

SEQ ID NO: 7200619 - DNA, 22 bp, Homo sapiens
aatagaggtggcatgttataga

SEQ ID NO: 7200620 - DNA, 22 bp, Homo sapiens
aatagacaattctagccaacat

SEQ ID NO: 7200621 - DNA, 22 bp, Homo sapiens
aatagacattatttctctatga

SEQ ID NO: 7200622 - DNA, 22 bp, Homo sapiens
aatagactttctttttagaaca

SEQ ID NO: 7200623 - DNA, 22 bp, Homo sapiens
aacatgtacctacaatcagaat

SEQ ID NO: 7200624 - DNA, 22 bp, Homo sapiens
aacatgtacctacaatcagaat

SEQ ID NO: 7200625 - DNA, 22 bp, Homo sapiens
aacatgtacctacaatcagaat

SEQ ID NO: 7200626 - DNA, 22 bp, Homo sapiens
aacatgtaaccagcattcatct

SEQ ID NO: 7200627 - DNA, 22 bp, Homo sapiens
aatagattcatggttaagagca

SEQ ID NO: 7200628 - DNA, 22 bp, Homo sapiens
aatagcaaacactggtaaagtt

SEQ ID NO: 7200629 - DNA, 22 bp, Homo sapiens
aatagcaaacactggtaaagtt

SEQ ID NO: 7200630 - DNA, 22 bp, Homo sapiens
aacatgtaaccagcattcatct

SEQ ID NO: 7200631 - DNA, 22 bp, Homo sapiens
aacatgtctgggtattcacaag

SEQ ID NO: 7200632 - DNA, 22 bp, Homo sapiens
aacatgtcttactttgctttct

SEQ ID NO: 7200633 - DNA, 22 bp, Homo sapiens
aacatgtcttactttgctttct

SEQ ID NO: 7200634 - DNA, 22 bp, Homo sapiens
aacatgtctttagagaaacatt

SEQ ID NO: 7200635 - DNA, 22 bp, Homo sapiens
aacatgtctttagagaaacatt

SEQ ID NO: 7200636 - DNA, 22 bp, Homo sapiens
aacatgtgagcaggttttttat

SEQ ID NO: 7200637 - DNA, 22 bp, Homo sapiens
aacatgtgtctggctagattgt

SEQ ID NO: 7200638 - DNA, 22 bp, Homo sapiens
aacatgtatcgctttttaatat

SEQ ID NO: 7200639 - DNA, 22 bp, Homo sapiens
aacatgtctgggtattcacaag

SEQ ID NO: 7200640 - DNA, 22 bp, Homo sapiens
aacatgtagcagaaacgactaa

SEQ ID NO: 7200641 - DNA, 22 bp, Homo sapiens
aacatgtagcagaaacgactaa

SEQ ID NO: 7200642 - DNA, 22 bp, Homo sapiens
aacatgtatcgctttttaatat

SEQ ID NO: 7200643 - DNA, 22 bp, Homo sapiens
aacacagaagtgccaagagcca

SEQ ID NO: 7200644 - DNA, 20 bp, Homo sapiens
aacacactggtggcatcagg

SEQ ID NO: 7200645 - DNA, 22 bp, Homo sapiens
aacacaatcttccagtttgctg

SEQ ID NO: 7200646 - DNA, 22 bp, Homo sapiens
aacacacgcctcctccatgggg

SEQ ID NO: 7200647 - DNA, 22 bp, Homo sapiens
aacacagaagtgccaagagcca

SEQ ID NO: 7200648 - DNA, 22 bp, Homo sapiens
aacacagaagtgccaagagcca

SEQ ID NO: 7200649 - DNA, 22 bp, Homo sapiens
aacacagacatagtgattacag

SEQ ID NO: 7200650 - DNA, 22 bp, Homo sapiens
aacacagacatagtgattacag

SEQ ID NO: 7200651 - DNA, 22 bp, Homo sapiens
aacacagagtatttgaagcatt

SEQ ID NO: 7200652 - DNA, 22 bp, Homo sapiens
aacacagacatagtgattacag

SEQ ID NO: 7200653 - DNA, 22 bp, Homo sapiens
aacacagacatagtgattacag

SEQ ID NO: 7200654 - DNA, 22 bp, Homo sapiens
aacacagagtatttgaagcatt

SEQ ID NO: 7200655 - DNA, 20 bp, Homo sapiens
aacacagataccaaaggttg

SEQ ID NO: 7200656 - DNA, 20 bp, Homo sapiens
aacacagataccaaaggttg

SEQ ID NO: 7200657 - DNA, 22 bp, Homo sapiens
aacacaggggcgtggctcttac

SEQ ID NO: 7200658 - DNA, 22 bp, Homo sapiens
aacacagggcagctgctgggaa

SEQ ID NO: 7200659 - DNA, 22 bp, Homo sapiens
aacacagggactcccaggagaa

SEQ ID NO: 7200660 - DNA, 22 bp, Homo sapiens
aacacagggactcccaggagaa

SEQ ID NO: 7200661 - DNA, 22 bp, Homo sapiens
aacacagggcagctgctgggaa

SEQ ID NO: 7200662 - DNA, 22 bp, Homo sapiens
aacacaggcatactggctccag

SEQ ID NO: 7200663 - DNA, 22 bp, Homo sapiens
aacacaggcatactggctccag

SEQ ID NO: 7200664 - DNA, 22 bp, Homo sapiens
aacacaggccagcctgtgcagt

SEQ ID NO: 7200665 - DNA, 22 bp, Homo sapiens
aacacaggccagcctgtgcagt

SEQ ID NO: 7200666 - DNA, 22 bp, Homo sapiens
aacacaggccagcctgtgcagt

SEQ ID NO: 7200667 - DNA, 22 bp, Homo sapiens
aacacagggactcccaggagaa

SEQ ID NO: 7200668 - DNA, 20 bp, Homo sapiens
aacacagataccaaaggttg

SEQ ID NO: 7200669 - DNA, 22 bp, Homo sapiens
aacacagatcaaaatatttcct

SEQ ID NO: 7200670 - DNA, 22 bp, Homo sapiens
aacacagatcaaaatatttcct

SEQ ID NO: 7200671 - DNA, 22 bp, Homo sapiens
aacacagctaatttctgtcaat

SEQ ID NO: 7200672 - DNA, 22 bp, Homo sapiens
aacacagctaatttctgtcaat

SEQ ID NO: 7200673 - DNA, 22 bp, Homo sapiens
aacacaggaaattggtaaatgg

SEQ ID NO: 7200674 - DNA, 22 bp, Homo sapiens
aacacaggaggctatgttttct

SEQ ID NO: 7200675 - DNA, 22 bp, Homo sapiens
aaatttctggaagtgtcagagt

SEQ ID NO: 7200676 - DNA, 21 bp, Homo sapiens
aaatttctgcaagcctcaact

SEQ ID NO: 7200677 - DNA, 22 bp, Homo sapiens
aaatttctaagtcaagaagaac

SEQ ID NO: 7200678 - DNA, 22 bp, Homo sapiens
aaggctggtttccttgatgttt

SEQ ID NO: 7200679 - DNA, 22 bp, Homo sapiens
aaggctggttccatccctggtg

SEQ ID NO: 7200680 - DNA, 22 bp, Homo sapiens
aaggctggttccatccctggtg

SEQ ID NO: 7200681 - DNA, 22 bp, Homo sapiens
aaggctggtggattatgaggtc

SEQ ID NO: 7200682 - DNA, 22 bp, Homo sapiens
aaggctggtggattatgaggtc

SEQ ID NO: 7200683 - DNA, 22 bp, Homo sapiens
aaggctggtcagatgtggtgaa

SEQ ID NO: 7200684 - DNA, 22 bp, Homo sapiens
aaatttctgttgttttgagcca

SEQ ID NO: 7200685 - DNA, 22 bp, Homo sapiens
aaatttctgttgttttgagcca

SEQ ID NO: 7200686 - DNA, 22 bp, Homo sapiens
aaatttgtcaacttcatatgtt

SEQ ID NO: 7200687 - DNA, 22 bp, Homo sapiens
aaatttgataagccattgttac

SEQ ID NO: 7200688 - DNA, 22 bp, Homo sapiens
aaatttgttcaatgtctatttg

SEQ ID NO: 7200689 - DNA, 22 bp, Homo sapiens
aaattttaaggctggaacttaa

SEQ ID NO: 7200690 - DNA, 22 bp, Homo sapiens
aaattttaaggctggaacttaa

SEQ ID NO: 7200691 - DNA, 22 bp, Homo sapiens
aacaatgcttgccaagtgtgat

SEQ ID NO: 7200692 - DNA, 22 bp, Homo sapiens
aacaatgcttgccaagtgtgat

SEQ ID NO: 7200693 - DNA, 23 bp, Homo sapiens
aacacaaagctgattccagtggc

SEQ ID NO: 7200694 - DNA, 23 bp, Homo sapiens
aacacaaagctgattccagtggc

SEQ ID NO: 7200695 - DNA, 22 bp, Homo sapiens
aacactttggaatagagatagg

SEQ ID NO: 7200696 - DNA, 22 bp, Homo sapiens
aacactttggaatagagatagg

SEQ ID NO: 7200697 - DNA, 22 bp, Homo sapiens
aacactttggaatagagatagg

SEQ ID NO: 7200698 - DNA, 22 bp, Homo sapiens
aacactttcttccttgctcagg

SEQ ID NO: 7200699 - DNA, 22 bp, Homo sapiens
aacactttctattattatggtt

SEQ ID NO: 7200700 - DNA, 22 bp, Homo sapiens
aacactttctattattatggtt

SEQ ID NO: 7200701 - DNA, 22 bp, Homo sapiens
aacactttcttccttgctcagg

SEQ ID NO: 7200702 - DNA, 22 bp, Homo sapiens
aacactttgggcatggccttcc

SEQ ID NO: 7200703 - DNA, 22 bp, Homo sapiens
aacactttgttgcctatgaacg

SEQ ID NO: 7200704 - DNA, 22 bp, Homo sapiens
aacactttttagtaaagattga

SEQ ID NO: 7200705 - DNA, 22 bp, Homo sapiens
aacactttttagtaaagattga

SEQ ID NO: 7200706 - DNA, 22 bp, Homo sapiens
aacactttttagtaaagattga

SEQ ID NO: 7200707 - DNA, 22 bp, Homo sapiens
aacactttttatatattgtatc

SEQ ID NO: 7200708 - DNA, 22 bp, Homo sapiens
aacactttttatatattgtatc

SEQ ID NO: 7200709 - DNA, 22 bp, Homo sapiens
aacactttttcctcctgtctgg

SEQ ID NO: 7200710 - DNA, 22 bp, Homo sapiens
aacactgtatcagtcttcaata

SEQ ID NO: 7200711 - DNA, 22 bp, Homo sapiens
aacactgtatcagtcttcaata

SEQ ID NO: 7200712 - DNA, 22 bp, Homo sapiens
aacactgtatcagtcttcaata

SEQ ID NO: 7200713 - DNA, 22 bp, Homo sapiens
aacacagtttctctatgagagt

SEQ ID NO: 7200714 - DNA, 22 bp, Homo sapiens
aacacagtttctgcattggtag

SEQ ID NO: 7200715 - DNA, 22 bp, Homo sapiens
aacacagttttccaaaatagag

SEQ ID NO: 7200716 - DNA, 22 bp, Homo sapiens
aacacagttttccaaaatagag

SEQ ID NO: 7200717 - DNA, 22 bp, Homo sapiens
aacacagttttccaaaatagag

SEQ ID NO: 7200718 - DNA, 22 bp, Homo sapiens
aacacagttttccaaaatagag

SEQ ID NO: 7200719 - DNA, 20 bp, Homo sapiens
aacacagggttaccatcaga

SEQ ID NO: 7200720 - DNA, 20 bp, Homo sapiens
aacacagggttaccatcaga

SEQ ID NO: 7200721 - DNA, 22 bp, Homo sapiens
aacacaggttcattctgtgagg

SEQ ID NO: 7200722 - DNA, 22 bp, Homo sapiens
aacacaggttcattctgtgagg

SEQ ID NO: 7200723 - DNA, 22 bp, Homo sapiens
aacacaggttgctgggcctcac

SEQ ID NO: 7200724 - DNA, 22 bp, Homo sapiens
aacacaggtttgtggtaaataa

SEQ ID NO: 7200725 - DNA, 22 bp, Homo sapiens
aacacagtcattagaggcagcc

SEQ ID NO: 7200726 - DNA, 22 bp, Homo sapiens
aacagaaaaggtaggtggcttt

SEQ ID NO: 7200727 - DNA, 22 bp, Homo sapiens
aacagaaaaggtaggtggcttt

SEQ ID NO: 7200728 - DNA, 22 bp, Homo sapiens
aacagaaaaggtaggtggcttt

SEQ ID NO: 7200729 - DNA, 22 bp, Homo sapiens
aacagaaaaggtaggtggcttt

SEQ ID NO: 7200730 - DNA, 22 bp, Homo sapiens
aacagaaaaggtaggtggcttt

SEQ ID NO: 7200731 - DNA, 22 bp, Homo sapiens
aacagaaatcatttagggctct

SEQ ID NO: 7200732 - DNA, 22 bp, Homo sapiens
aacagaaatcatttagggctct

SEQ ID NO: 7200733 - DNA, 22 bp, Homo sapiens
aacagaaatcatttagggctct

SEQ ID NO: 7200734 - DNA, 22 bp, Homo sapiens
aacagaacccgagtgtgaatct

SEQ ID NO: 7200735 - DNA, 22 bp, Homo sapiens
aacagaacccgagtgtgaatct

SEQ ID NO: 7200736 - DNA, 22 bp, Homo sapiens
aacagaagggggtatttacatt

SEQ ID NO: 7200737 - DNA, 22 bp, Homo sapiens
aacagaagggggtatttacatt

SEQ ID NO: 7200738 - DNA, 22 bp, Homo sapiens
aacagaagggggtatttacatt

SEQ ID NO: 7200739 - DNA, 22 bp, Homo sapiens
aacagaagggggtatttacatt

SEQ ID NO: 7200740 - DNA, 22 bp, Homo sapiens
aacagaagggggtatttacatt

SEQ ID NO: 7200741 - DNA, 22 bp, Homo sapiens
aacagaatatcaaaagattatg

SEQ ID NO: 7200742 - DNA, 22 bp, Homo sapiens
aacagaatatcaaaagattatg

SEQ ID NO: 7200743 - DNA, 22 bp, Homo sapiens
aacagaatcttgggttcttttc

SEQ ID NO: 7200744 - DNA, 22 bp, Homo sapiens
aacagaatgcaggggatgctgc

SEQ ID NO: 7200745 - DNA, 22 bp, Homo sapiens
aacagaatgcaggggatgctgc

SEQ ID NO: 7200746 - DNA, 22 bp, Homo sapiens
aacagaatatcaaaagattatg

SEQ ID NO: 7200747 - DNA, 22 bp, Homo sapiens
aacagaatagttgatgtacagt

SEQ ID NO: 7200748 - DNA, 22 bp, Homo sapiens
aacagaatagttgatgtacagt

SEQ ID NO: 7200749 - DNA, 22 bp, Homo sapiens
aacagaatagttgatgtacagt

SEQ ID NO: 7200750 - DNA, 22 bp, Homo sapiens
aacagaatagttgatgtacagt

SEQ ID NO: 7200751 - DNA, 22 bp, Homo sapiens
aacagaatagttgatgtacagt

SEQ ID NO: 7200752 - DNA, 22 bp, Homo sapiens
aacagaattgctgctgccaatg

SEQ ID NO: 7200753 - DNA, 22 bp, Homo sapiens
aacagaattgtacaccagggag

SEQ ID NO: 7200754 - DNA, 22 bp, Homo sapiens
aacagacaactcctgtggctca

SEQ ID NO: 7200755 - DNA, 22 bp, Homo sapiens
aacagacaactcctgtggctca

SEQ ID NO: 7200756 - DNA, 22 bp, Homo sapiens
aacagacagaaaaatgtgatct

SEQ ID NO: 7200757 - DNA, 22 bp, Homo sapiens
aacagacagaaaaatgtgatct

SEQ ID NO: 7200758 - DNA, 22 bp, Homo sapiens
aacagacagaaaaatgtgatct

SEQ ID NO: 7200759 - DNA, 22 bp, Homo sapiens
aacagacagaaaaatgtgatct

SEQ ID NO: 7200760 - DNA, 22 bp, Homo sapiens
aacagacatatttttaatatgc

SEQ ID NO: 7200761 - DNA, 22 bp, Homo sapiens
aacagacatatttttaatatgc

SEQ ID NO: 7200762 - DNA, 22 bp, Homo sapiens
aacagacatatttttaatatgc

SEQ ID NO: 7200763 - DNA, 22 bp, Homo sapiens
aacagactcacagctagagaag

SEQ ID NO: 7200764 - DNA, 22 bp, Homo sapiens
aacagactcacagctagagaag

SEQ ID NO: 7200765 - DNA, 22 bp, Homo sapiens
aacagagaggccacctcagcag

SEQ ID NO: 7200766 - DNA, 22 bp, Homo sapiens
aacagagatcttaattcctgta

SEQ ID NO: 7200767 - DNA, 22 bp, Homo sapiens
aagtgcttcgttctgtattggg

SEQ ID NO: 7200768 - DNA, 22 bp, Homo sapiens
aaggctgggtaacctgtccact

SEQ ID NO: 7200769 - DNA, 22 bp, Homo sapiens
aaggctgggtaacctgtccact

SEQ ID NO: 7200770 - DNA, 22 bp, Homo sapiens
aaggctgggtaacctgtccact

SEQ ID NO: 7200771 - DNA, 22 bp, Homo sapiens
aaggctgagccagggcccctat

SEQ ID NO: 7200772 - DNA, 21 bp, Homo sapiens
aaattcacctagtaaaacttc

SEQ ID NO: 7200773 - DNA, 22 bp, Homo sapiens
aaggctgggtttgggatgtgat

SEQ ID NO: 7200774 - DNA, 22 bp, Homo sapiens
aaggctgggtaacctgtccact

SEQ ID NO: 7200775 - DNA, 22 bp, Homo sapiens
aaggctgggtttgggatgtgat

SEQ ID NO: 7200776 - DNA, 19 bp, Homo sapiens
aaggctggtaccataggtt

SEQ ID NO: 7200777 - DNA, 22 bp, Homo sapiens
aaggctgggtttgggatgtgat

SEQ ID NO: 7200778 - DNA, 22 bp, Homo sapiens
aaggctggtcagatgtggtgaa

SEQ ID NO: 7200779 - DNA, 22 bp, Homo sapiens
aaattcaattaactttcatgct

SEQ ID NO: 7200780 - DNA, 22 bp, Homo sapiens
aaattcaatgatcactggctca

SEQ ID NO: 7200781 - DNA, 22 bp, Homo sapiens
aaattcaattaactttcatgct

SEQ ID NO: 7200782 - DNA, 22 bp, Homo sapiens
aaattcaattaactttcatgct

SEQ ID NO: 7200783 - DNA, 22 bp, Homo sapiens
aaattcacaagagcattgcctg

SEQ ID NO: 7200784 - DNA, 23 bp, Homo sapiens
aaattattgctcttcaattgcct

SEQ ID NO: 7200785 - DNA, 23 bp, Homo sapiens
aaattattgctcttcaattgcct

SEQ ID NO: 7200786 - DNA, 23 bp, Homo sapiens
aaattattgctcttcaattgcct

SEQ ID NO: 7200787 - DNA, 18 bp, Homo sapiens
aaattattcttccttttc

SEQ ID NO: 7200788 - DNA, 22 bp, Homo sapiens
aaattattctcatgtgtttctt

SEQ ID NO: 7200789 - DNA, 22 bp, Homo sapiens
aaattattctcatgtgtttctt

SEQ ID NO: 7200790 - DNA, 22 bp, Homo sapiens
aaattattctcatgtgtttctt

SEQ ID NO: 7200791 - DNA, 22 bp, Homo sapiens
aaattattcaaaaagctgtgtt

SEQ ID NO: 7200792 - DNA, 22 bp, Homo sapiens
aaggcagcacagcaactgctca

SEQ ID NO: 7200793 - DNA, 22 bp, Homo sapiens
aaggcagcaagaattccaggtt

SEQ ID NO: 7200794 - DNA, 22 bp, Homo sapiens
aaggcagcaccgcctcctgaaa

SEQ ID NO: 7200795 - DNA, 22 bp, Homo sapiens
aaggcagcagaggaaaggtgct

SEQ ID NO: 7200796 - DNA, 22 bp, Homo sapiens
aaggcagcagaggaaaggtgct

SEQ ID NO: 7200797 - DNA, 22 bp, Homo sapiens
aaggcagcaggatttggtgact

SEQ ID NO: 7200798 - DNA, 22 bp, Homo sapiens
aaggcagcaactaatggatctc

SEQ ID NO: 7200799 - DNA, 22 bp, Homo sapiens
aaggcagatataaagactagag

SEQ ID NO: 7200800 - DNA, 22 bp, Homo sapiens
aaggcagatataaagactagag

SEQ ID NO: 7200801 - DNA, 22 bp, Homo sapiens
aaggcacttaacgtgggaggat

SEQ ID NO: 7200802 - DNA, 22 bp, Homo sapiens
aaggcagatataaagactagag

SEQ ID NO: 7200803 - DNA, 22 bp, Homo sapiens
aaatgtctacttcccatctgta

SEQ ID NO: 7200804 - DNA, 22 bp, Homo sapiens
aaggcactgtactagttagtta

SEQ ID NO: 7200805 - DNA, 22 bp, Homo sapiens
aaggcactgtactagttagtta

SEQ ID NO: 7200806 - DNA, 22 bp, Homo sapiens
aaggcagcatgaatccctgtac

SEQ ID NO: 7200807 - DNA, 22 bp, Homo sapiens
aaggcagccagatcctttgggt

SEQ ID NO: 7200808 - DNA, 22 bp, Homo sapiens
aaggcagccagatcctttgggt

SEQ ID NO: 7200809 - DNA, 19 bp, Homo sapiens
aaggcagcagtagcatcca

SEQ ID NO: 7200810 - DNA, 19 bp, Homo sapiens
aaggcagcagtagcatcca

SEQ ID NO: 7200811 - DNA, 22 bp, Homo sapiens
aaggcagcagtgcacgactgat

SEQ ID NO: 7200812 - DNA, 22 bp, Homo sapiens
aaattattcaaaaagctgtgtt

SEQ ID NO: 7200813 - DNA, 22 bp, Homo sapiens
aaggcagccgtgtgactgcatg

SEQ ID NO: 7200814 - DNA, 22 bp, Homo sapiens
aaggcagccgtgtgactgcatg

SEQ ID NO: 7200815 - DNA, 22 bp, Homo sapiens
aaggcagccctggctcagcctg

SEQ ID NO: 7200816 - DNA, 22 bp, Homo sapiens
aaggcagccctggctcagcctg

SEQ ID NO: 7200817 - DNA, 22 bp, Homo sapiens
aaggcagccatagcaccatcca

SEQ ID NO: 7200818 - DNA, 22 bp, Homo sapiens
aaggcagccatgtgctttgggt

SEQ ID NO: 7200819 - DNA, 22 bp, Homo sapiens
aaggcagccctggctcagcctg

SEQ ID NO: 7200820 - DNA, 22 bp, Homo sapiens
aaggaagagaatccttctcaga

SEQ ID NO: 7200821 - DNA, 22 bp, Homo sapiens
aaggaagagaatccttctcaga

SEQ ID NO: 7200822 - DNA, 22 bp, Homo sapiens
aaggaagacttgagaaggttcc

SEQ ID NO: 7200823 - DNA, 22 bp, Homo sapiens
aaggaagactcgcaggtctatg

SEQ ID NO: 7200824 - DNA, 22 bp, Homo sapiens
aaggaagacttgagaaggttcc

SEQ ID NO: 7200825 - DNA, 22 bp, Homo sapiens
aaggaagacttgagaaggttcc

SEQ ID NO: 7200826 - DNA, 22 bp, Homo sapiens
aaggaagacttgagaaggttcc

SEQ ID NO: 7200827 - DNA, 22 bp, Homo sapiens
aaggaagacacagatgaagtga

SEQ ID NO: 7200828 - DNA, 22 bp, Homo sapiens
aaggaaagacaggacggaattc

SEQ ID NO: 7200829 - DNA, 22 bp, Homo sapiens
aaggaagacacagatgaagtga

SEQ ID NO: 7200830 - DNA, 22 bp, Homo sapiens
aaggaagacacagatgaagtga

SEQ ID NO: 7200831 - DNA, 22 bp, Homo sapiens
aaggaagactcgcaggtctatg

SEQ ID NO: 7200832 - DNA, 22 bp, Homo sapiens
aaggaagactcgcaggtctatg

SEQ ID NO: 7200833 - DNA, 22 bp, Homo sapiens
aaatgcattaagtcagaacaat

SEQ ID NO: 7200834 - DNA, 22 bp, Homo sapiens
aaatgcattaagtcagaacaat

SEQ ID NO: 7200835 - DNA, 22 bp, Homo sapiens
aaatgcattaagtcagaacaat

SEQ ID NO: 7200836 - DNA, 22 bp, Homo sapiens
aaatgcattctgttttcactag

SEQ ID NO: 7200837 - DNA, 22 bp, Homo sapiens
aaatgcattctgttttcactag

SEQ ID NO: 7200838 - DNA, 22 bp, Homo sapiens
aaatgcattctgttttcactag

SEQ ID NO: 7200839 - DNA, 22 bp, Homo sapiens
aaatgcattctgttttcactag

SEQ ID NO: 7200840 - DNA, 22 bp, Homo sapiens
aaatgcatgtatgtaatatgct

SEQ ID NO: 7200841 - DNA, 22 bp, Homo sapiens
aaatgcattaagtcagaacaat

SEQ ID NO: 7200842 - DNA, 22 bp, Homo sapiens
aaatgcattggtttctacttgt

SEQ ID NO: 7200843 - DNA, 22 bp, Homo sapiens
aaatgcattggtttctacttgt

SEQ ID NO: 7200844 - DNA, 22 bp, Homo sapiens
aaatgcattggtttctacttgt

SEQ ID NO: 7200845 - DNA, 22 bp, Homo sapiens
aaatgcattggtttctacttgt

SEQ ID NO: 7200846 - DNA, 22 bp, Homo sapiens
aaatgcatttcactaatgtttc

SEQ ID NO: 7200847 - DNA, 22 bp, Homo sapiens
aaatgcatttcactaatgtttc

SEQ ID NO: 7200848 - DNA, 22 bp, Homo sapiens
aaatgcatttcactaatgtttc

SEQ ID NO: 7200849 - DNA, 22 bp, Homo sapiens
aaggaaagacaggacggaattc

SEQ ID NO: 7200850 - DNA, 22 bp, Homo sapiens
aaggaaagacaggacggaattc

SEQ ID NO: 7200851 - DNA, 22 bp, Homo sapiens
aaatgcatttcactaatgtttc

SEQ ID NO: 7200852 - DNA, 22 bp, Homo sapiens
aaatgcatttttaattagaccc

SEQ ID NO: 7200853 - DNA, 22 bp, Homo sapiens
aaatgcatttttaattagaccc

SEQ ID NO: 7200854 - DNA, 22 bp, Homo sapiens
aaatgcatttttaattagaccc

SEQ ID NO: 7200855 - DNA, 22 bp, Homo sapiens
aaggaagagtctagaacaggca

SEQ ID NO: 7200856 - DNA, 22 bp, Homo sapiens
aaggaagagtctagaacaggca

SEQ ID NO: 7200857 - DNA, 22 bp, Homo sapiens
aaggaagagtctagaacaggca

SEQ ID NO: 7200858 - DNA, 22 bp, Homo sapiens
aaggaagagtctagaacaggca

SEQ ID NO: 7200859 - DNA, 22 bp, Homo sapiens
aaggaagagtctagaacaggca

SEQ ID NO: 7200860 - DNA, 22 bp, Homo sapiens
aaggaagatatatcaagcttaa

SEQ ID NO: 7200861 - DNA, 22 bp, Homo sapiens
aaggaagagcaaagaattatgt

SEQ ID NO: 7200862 - DNA, 22 bp, Homo sapiens
aaggaagaggcaggttttgctg

SEQ ID NO: 7200863 - DNA, 22 bp, Homo sapiens
aaggaagaggcaggttttgctg

SEQ ID NO: 7200864 - DNA, 22 bp, Homo sapiens
aaggaagagtctagaacaggca

SEQ ID NO: 7200865 - DNA, 22 bp, Homo sapiens
aaggaagagtctagaacaggca

SEQ ID NO: 7200866 - DNA, 22 bp, Homo sapiens
aaggaagatatatcaagcttaa

SEQ ID NO: 7200867 - DNA, 22 bp, Homo sapiens
aaggaagatgaaagtactgcta

SEQ ID NO: 7200868 - DNA, 22 bp, Homo sapiens
aaggaagatgaaagtactgcta

SEQ ID NO: 7200869 - DNA, 22 bp, Homo sapiens
aaatgtcaaggtgatagatgca

SEQ ID NO: 7200870 - DNA, 22 bp, Homo sapiens
aaggaagatgaggtgctgctta

SEQ ID NO: 7200871 - DNA, 22 bp, Homo sapiens
aaatgtcaaggtgatagatgca

SEQ ID NO: 7200872 - DNA, 22 bp, Homo sapiens
aaatgtcaaggtgatagatgca

SEQ ID NO: 7200873 - DNA, 22 bp, Homo sapiens
aaatgtcaaggtgatagatgca

SEQ ID NO: 7200874 - DNA, 22 bp, Homo sapiens
aaatgtcaaggtgatagatgca

SEQ ID NO: 7200875 - DNA, 22 bp, Homo sapiens
aaatgtcaaggtgatagatgca

SEQ ID NO: 7200876 - DNA, 22 bp, Homo sapiens
aaatgtcagaaaacatggagtg

SEQ ID NO: 7200877 - DNA, 22 bp, Homo sapiens
aaatgtcagaagctttacttct

SEQ ID NO: 7200878 - DNA, 22 bp, Homo sapiens
aaatgtcagaagctttacttct

SEQ ID NO: 7200879 - DNA, 22 bp, Homo sapiens
aaatgtcagaaaacatggagtg

SEQ ID NO: 7200880 - DNA, 22 bp, Homo sapiens
aaatgtcagaaaacatggagtg

SEQ ID NO: 7200881 - DNA, 22 bp, Homo sapiens
aaatgtcagaaaacatggagtg

SEQ ID NO: 7200882 - DNA, 22 bp, Homo sapiens
aaatgtcagaaaacatggagtg

SEQ ID NO: 7200883 - DNA, 22 bp, Homo sapiens
aaatgtcagaagctttacttct

SEQ ID NO: 7200884 - DNA, 22 bp, Homo sapiens
aaatgtcagaggaacatattga

SEQ ID NO: 7200885 - DNA, 22 bp, Homo sapiens
aaatgtcagagctggaaggggc

SEQ ID NO: 7200886 - DNA, 22 bp, Homo sapiens
aaatgtcagaggaacatattga

SEQ ID NO: 7200887 - DNA, 22 bp, Homo sapiens
aaatgtcagaggaacatattga

SEQ ID NO: 7200888 - DNA, 22 bp, Homo sapiens
aaatgtcagaggaacatattga

SEQ ID NO: 7200889 - DNA, 22 bp, Homo sapiens
aaatgtcaggtggtggatggct

SEQ ID NO: 7200890 - DNA, 22 bp, Homo sapiens
aaatgtcatatttaagtaggaa

SEQ ID NO: 7200891 - DNA, 22 bp, Homo sapiens
aaatgtcctgagattcaactta

SEQ ID NO: 7200892 - DNA, 22 bp, Homo sapiens
aagagcagcctccaggggtgga

SEQ ID NO: 7200893 - DNA, 22 bp, Homo sapiens
aagagcagattcctagtggagc

SEQ ID NO: 7200894 - DNA, 22 bp, Homo sapiens
aagagcagcctccaggggtgga

SEQ ID NO: 7200895 - DNA, 22 bp, Homo sapiens
aagagcagattcctagtggagc

SEQ ID NO: 7200896 - DNA, 22 bp, Homo sapiens
aagagcaccttaattatgcaga

SEQ ID NO: 7200897 - DNA, 22 bp, Homo sapiens
aagagcaccttaattatgcaga

SEQ ID NO: 7200898 - DNA, 22 bp, Homo sapiens
aagagcactaacagagctgata

SEQ ID NO: 7200899 - DNA, 22 bp, Homo sapiens
aagagcacttttcttatctgca

SEQ ID NO: 7200900 - DNA, 22 bp, Homo sapiens
aagagcacttttcttatctgca

SEQ ID NO: 7200901 - DNA, 22 bp, Homo sapiens
aagagcacttttcttatctgca

SEQ ID NO: 7200902 - DNA, 22 bp, Homo sapiens
aagagcagaagtccttggatcc

SEQ ID NO: 7200903 - DNA, 22 bp, Homo sapiens
aagagcaacttggaaacactca

SEQ ID NO: 7200904 - DNA, 22 bp, Homo sapiens
aagagcaagtgggtagtgaagc

SEQ ID NO: 7200905 - DNA, 22 bp, Homo sapiens
acacaaattgtaggataattgc

SEQ ID NO: 7200906 - DNA, 22 bp, Homo sapiens
acacaaattgtaggataattgc

SEQ ID NO: 7200907 - DNA, 22 bp, Homo sapiens
acacaaattgtaggataattgc

SEQ ID NO: 7200908 - DNA, 22 bp, Homo sapiens
acacaaattgtaggataattgc

SEQ ID NO: 7200909 - DNA, 22 bp, Homo sapiens
aagagatttctgtaaaatgtaa

SEQ ID NO: 7200910 - DNA, 22 bp, Homo sapiens
aagagcaacttggaaacactca

SEQ ID NO: 7200911 - DNA, 22 bp, Homo sapiens
aagagcaacttggaaacactca

SEQ ID NO: 7200912 - DNA, 22 bp, Homo sapiens
aagagcaacttggaaacactca

SEQ ID NO: 7200913 - DNA, 22 bp, Homo sapiens
acacaaagttggatgacaaaat

SEQ ID NO: 7200914 - DNA, 22 bp, Homo sapiens
acacaaagttggatgacaaaat

SEQ ID NO: 7200915 - DNA, 22 bp, Homo sapiens
acacaaagttggatgacaaaat

SEQ ID NO: 7200916 - DNA, 22 bp, Homo sapiens
acacaaagttggatgacaaaat

SEQ ID NO: 7200917 - DNA, 22 bp, Homo sapiens
acacaaactgctagaaaattgg

SEQ ID NO: 7200918 - DNA, 22 bp, Homo sapiens
acacaaactgctagaaaattgg

SEQ ID NO: 7200919 - DNA, 22 bp, Homo sapiens
acacaaactgctagaaaattgg

SEQ ID NO: 7200920 - DNA, 22 bp, Homo sapiens
acacaaactgctagaaaattgg

SEQ ID NO: 7200921 - DNA, 20 bp, Homo sapiens
acacaaagcaatggagtaca

SEQ ID NO: 7200922 - DNA, 22 bp, Homo sapiens
acacaaagctattgagtgtcat

SEQ ID NO: 7200923 - DNA, 22 bp, Homo sapiens
acacaaacagtctatagcacca

SEQ ID NO: 7200924 - DNA, 21 bp, Homo sapiens
acacaaacctcctcagcctgg

SEQ ID NO: 7200925 - DNA, 22 bp, Homo sapiens
acacaaaatcaaagtcctaggc

SEQ ID NO: 7200926 - DNA, 22 bp, Homo sapiens
acacaaacagtctatagcacca

SEQ ID NO: 7200927 - DNA, 22 bp, Homo sapiens
acacaaacagtctatagcacca

SEQ ID NO: 7200928 - DNA, 22 bp, Homo sapiens
acacaaacagtctatagcacca

SEQ ID NO: 7200929 - DNA, 22 bp, Homo sapiens
acacaaacagtctatagcacca

SEQ ID NO: 7200930 - DNA, 22 bp, Homo sapiens
aagagaatacaagcaggcagga

SEQ ID NO: 7200931 - DNA, 22 bp, Homo sapiens
aagagaatacaagcaggcagga

SEQ ID NO: 7200932 - DNA, 22 bp, Homo sapiens
aagagaatacaagcaggcagga

SEQ ID NO: 7200933 - DNA, 22 bp, Homo sapiens
aagagaatacaagcaggcagga

SEQ ID NO: 7200934 - DNA, 22 bp, Homo sapiens
aagagaaggattctgagcctgg

SEQ ID NO: 7200935 - DNA, 22 bp, Homo sapiens
aagagaaggccctgacccaccc

SEQ ID NO: 7200936 - DNA, 22 bp, Homo sapiens
aagagaaggccctgacccaccc

SEQ ID NO: 7200937 - DNA, 22 bp, Homo sapiens
aagagaaggtgaggaagccggt

SEQ ID NO: 7200938 - DNA, 22 bp, Homo sapiens
aagagaatgacaaggagaacct

SEQ ID NO: 7200939 - DNA, 22 bp, Homo sapiens
aagagacaagaattccaacgct

SEQ ID NO: 7200940 - DNA, 22 bp, Homo sapiens
aagagacaatgacacttgggag

SEQ ID NO: 7200941 - DNA, 22 bp, Homo sapiens
aagagacaatgtcttttggata

SEQ ID NO: 7200942 - DNA, 22 bp, Homo sapiens
aagagacaatgtcttttggata

SEQ ID NO: 7200943 - DNA, 22 bp, Homo sapiens
aagagacagagccatgtttcta

SEQ ID NO: 7200944 - DNA, 22 bp, Homo sapiens
aagagacagagccatgtttcta

SEQ ID NO: 7200945 - DNA, 22 bp, Homo sapiens
aagagacagagccatgtttcta

SEQ ID NO: 7200946 - DNA, 22 bp, Homo sapiens
aagagacatgaatactcgaagg

SEQ ID NO: 7200947 - DNA, 22 bp, Homo sapiens
aagagactggaaactagggtca

SEQ ID NO: 7200948 - DNA, 22 bp, Homo sapiens
aagagactggaaactagggtca

SEQ ID NO: 7200949 - DNA, 22 bp, Homo sapiens
aagagactaagaaagggcaata

SEQ ID NO: 7200950 - DNA, 22 bp, Homo sapiens
aagagactaagaaagggcaata

SEQ ID NO: 7200951 - DNA, 22 bp, Homo sapiens
aagagacatgaatactcgaagg

SEQ ID NO: 7200952 - DNA, 21 bp, Homo sapiens
aagagacatttctcatcagca

SEQ ID NO: 7200953 - DNA, 21 bp, Homo sapiens
aagagacatttctcatcagca

SEQ ID NO: 7200954 - DNA, 21 bp, Homo sapiens
aagagacatttctcatcagca

SEQ ID NO: 7200955 - DNA, 21 bp, Homo sapiens
aagagacatttctcatcagca

SEQ ID NO: 7200956 - DNA, 22 bp, Homo sapiens
acacaaaatcaaagtcctaggc

SEQ ID NO: 7200957 - DNA, 22 bp, Homo sapiens
acaatgttttgaaacatctagg

SEQ ID NO: 7200958 - DNA, 22 bp, Homo sapiens
acacaaaatcaaagtcctaggc

SEQ ID NO: 7200959 - DNA, 19 bp, Homo sapiens
acaatgttgttggacactc

SEQ ID NO: 7200960 - DNA, 22 bp, Homo sapiens
acaatgtttctctttagtcatt

SEQ ID NO: 7200961 - DNA, 22 bp, Homo sapiens
acaatgttttgaaacatctagg

SEQ ID NO: 7200962 - DNA, 22 bp, Homo sapiens
acaatgttttgaaacatctagg

SEQ ID NO: 7200963 - DNA, 22 bp, Homo sapiens
aagagacttctagatttgttga

SEQ ID NO: 7200964 - DNA, 22 bp, Homo sapiens
aagagacttctagatttgttga

SEQ ID NO: 7200965 - DNA, 22 bp, Homo sapiens
aagagacttgtccgaagttgta

SEQ ID NO: 7200966 - DNA, 19 bp, Homo sapiens
acaatgttgttggacactc

SEQ ID NO: 7200967 - DNA, 22 bp, Homo sapiens
aatttcagatgtcataaatata

SEQ ID NO: 7200968 - DNA, 22 bp, Homo sapiens
aatttcactgtggagcacattt

SEQ ID NO: 7200969 - DNA, 21 bp, Homo sapiens
aatttcagacccattttgcct

SEQ ID NO: 7200970 - DNA, 22 bp, Homo sapiens
aatttcagctcaaacttgtgtt

SEQ ID NO: 7200971 - DNA, 22 bp, Homo sapiens
aatttcagtatgaagtttcaca

SEQ ID NO: 7200972 - DNA, 22 bp, Homo sapiens
aatttcagttgctaataagttc

SEQ ID NO: 7200973 - DNA, 22 bp, Homo sapiens
aatttcagttgctaataagttc

SEQ ID NO: 7200974 - DNA, 22 bp, Homo sapiens
aattttaagcatatgactggtt

SEQ ID NO: 7200975 - DNA, 22 bp, Homo sapiens
aattttaagcatatgactggtt

SEQ ID NO: 7200976 - DNA, 22 bp, Homo sapiens
aattttacaaaatacctccgat

SEQ ID NO: 7200977 - DNA, 22 bp, Homo sapiens
aattttacaaaatacctccgat

SEQ ID NO: 7200978 - DNA, 22 bp, Homo sapiens
aattttacaagaaggcctcgta

SEQ ID NO: 7200979 - DNA, 22 bp, Homo sapiens
aattttacataggggatatggg

SEQ ID NO: 7200980 - DNA, 22 bp, Homo sapiens
aattttactaatctgagtgtga

SEQ ID NO: 7200981 - DNA, 22 bp, Homo sapiens
aattttactaatctgagtgtga

SEQ ID NO: 7200982 - DNA, 20 bp, Homo sapiens
aattttactgtcctatagag

SEQ ID NO: 7200983 - DNA, 22 bp, Homo sapiens
aattttaatcagtggtgctgag

SEQ ID NO: 7200984 - DNA, 22 bp, Homo sapiens
aagactttctcccaaatcctca

SEQ ID NO: 7200985 - DNA, 22 bp, Homo sapiens
aagactttccctcatcagaacg

SEQ ID NO: 7200986 - DNA, 22 bp, Homo sapiens
aagactttccctcatcagaacg

SEQ ID NO: 7200987 - DNA, 22 bp, Homo sapiens
aagactttccctcatcagaacg

SEQ ID NO: 7200988 - DNA, 22 bp, Homo sapiens
aagaccattgctgtatttgtag

SEQ ID NO: 7200989 - DNA, 22 bp, Homo sapiens
aagacccacaaggctgaatgtt

SEQ ID NO: 7200990 - DNA, 22 bp, Homo sapiens
aagacttgaccaggttgaaggc

SEQ ID NO: 7200991 - DNA, 22 bp, Homo sapiens
aagacttgaccaggttgaaggc

SEQ ID NO: 7200992 - DNA, 22 bp, Homo sapiens
aagacttgaccaggttgaaggc

SEQ ID NO: 7200993 - DNA, 22 bp, Homo sapiens
aagacttgaccaggttgaaggc

SEQ ID NO: 7200994 - DNA, 20 bp, Homo sapiens
aattttatctccatcctttg

SEQ ID NO: 7200995 - DNA, 22 bp, Homo sapiens
aattttatctctaagcaggctt

SEQ ID NO: 7200996 - DNA, 22 bp, Homo sapiens
aattttatctctaagcaggctt

SEQ ID NO: 7200997 - DNA, 20 bp, Homo sapiens
aattttatctccatcctttg

SEQ ID NO: 7200998 - DNA, 22 bp, Homo sapiens
aagaccataatgtaagatgaat

SEQ ID NO: 7200999 - DNA, 20 bp, Homo sapiens
aattttatctccatcctttg

SEQ ID NO: 7201000 - DNA, 20 bp, Homo sapiens
aattttatctccatcctttg

SEQ ID NO: 7201001 - DNA, 20 bp, Homo sapiens
aattttatctccatcctttg

SEQ ID NO: 7201002 - DNA, 22 bp, Homo sapiens
aattttacttccctcagtgtag

SEQ ID NO: 7201003 - DNA, 20 bp, Homo sapiens
aattttatctccatcctttg

SEQ ID NO: 7201004 - DNA, 22 bp, Homo sapiens
aagactttctgtaaagctacag

SEQ ID NO: 7201005 - DNA, 22 bp, Homo sapiens
aagactttctgtaaagctacag

SEQ ID NO: 7201006 - DNA, 22 bp, Homo sapiens
aagagaaagcagactttgtcat

SEQ ID NO: 7201007 - DNA, 22 bp, Homo sapiens
aagagaaagcagactttgtcat

SEQ ID NO: 7201008 - DNA, 22 bp, Homo sapiens
aagagaagaaagtgtctacaca

SEQ ID NO: 7201009 - DNA, 22 bp, Homo sapiens
aagagaagaaagtgtctacaca

SEQ ID NO: 7201010 - DNA, 22 bp, Homo sapiens
aagagaagaaagtgtctacaca

SEQ ID NO: 7201011 - DNA, 20 bp, Homo sapiens
aagagaagaagtctttgaaa

SEQ ID NO: 7201012 - DNA, 20 bp, Homo sapiens
aagagaagaagtctttgaaa

SEQ ID NO: 7201013 - DNA, 22 bp, Homo sapiens
aagagaaggattctgagcctgg

SEQ ID NO: 7201014 - DNA, 22 bp, Homo sapiens
aagagaaggattctgagcctgg

SEQ ID NO: 7201015 - DNA, 22 bp, Homo sapiens
aagaaactgttgcgtgacagcg

SEQ ID NO: 7201016 - DNA, 22 bp, Homo sapiens
aagaaactgttgcgtgacagcg

SEQ ID NO: 7201017 - DNA, 20 bp, Homo sapiens
aagaaacttgaaagtacaag

SEQ ID NO: 7201018 - DNA, 22 bp, Homo sapiens
aagaaactgttgcgtgacagcg

SEQ ID NO: 7201019 - DNA, 22 bp, Homo sapiens
aagaaactggaatatagagagc

SEQ ID NO: 7201020 - DNA, 22 bp, Homo sapiens
aagaaacctagtctggagcagc

SEQ ID NO: 7201021 - DNA, 22 bp, Homo sapiens
aagaaacaaccactgctctcct

SEQ ID NO: 7201022 - DNA, 22 bp, Homo sapiens
aagaaacaaccactgctctcct

SEQ ID NO: 7201023 - DNA, 22 bp, Homo sapiens
aagaaacaaccactgctctcct

SEQ ID NO: 7201024 - DNA, 22 bp, Homo sapiens
aagaaacaaccactgctctcct

SEQ ID NO: 7201025 - DNA, 22 bp, Homo sapiens
aagaaacaaccactgctctcct

SEQ ID NO: 7201026 - DNA, 22 bp, Homo sapiens
aagaaacaaccactgctctcct

SEQ ID NO: 7201027 - DNA, 22 bp, Homo sapiens
aagaaaccaaccctgccagcac

SEQ ID NO: 7201028 - DNA, 22 bp, Homo sapiens
aagaaaagaaacctgaggcttt

SEQ ID NO: 7201029 - DNA, 22 bp, Homo sapiens
aagaaaagaaacctgaggcttt

SEQ ID NO: 7201030 - DNA, 22 bp, Homo sapiens
aagaaaagatgtttggttttca

SEQ ID NO: 7201031 - DNA, 22 bp, Homo sapiens
aagaaaagaaacctgaggcttt

SEQ ID NO: 7201032 - DNA, 22 bp, Homo sapiens
aagaaaaggtaaccgcttatct

SEQ ID NO: 7201033 - DNA, 22 bp, Homo sapiens
aagaaaatcagttctggtcagt

SEQ ID NO: 7201034 - DNA, 22 bp, Homo sapiens
aagaaaacatgatctaatttaa

SEQ ID NO: 7201035 - DNA, 22 bp, Homo sapiens
aagaaaacaatgacttgccagc

SEQ ID NO: 7201036 - DNA, 22 bp, Homo sapiens
aagaaaacaatgacttgccagc

SEQ ID NO: 7201037 - DNA, 22 bp, Homo sapiens
aagaaaacatgatctaatttaa

SEQ ID NO: 7201038 - DNA, 20 bp, Homo sapiens
aagaaaacgtcttcagggga

SEQ ID NO: 7201039 - DNA, 22 bp, Homo sapiens
aagaaaacgttttgaggagttt

SEQ ID NO: 7201040 - DNA, 22 bp, Homo sapiens
aagaaaacgttttgaggagttt

SEQ ID NO: 7201041 - DNA, 22 bp, Homo sapiens
aagaaaagaaacctgaggcttt

SEQ ID NO: 7201042 - DNA, 22 bp, Homo sapiens
aagaaaagaaacctgaggcttt

SEQ ID NO: 7201043 - DNA, 22 bp, Homo sapiens
aagaaaagaaacctgaggcttt

SEQ ID NO: 7201044 - DNA, 17 bp, Homo sapiens
aactgctttttttagcc

SEQ ID NO: 7201045 - DNA, 22 bp, Homo sapiens
aactggaaagatcagtaggaag

SEQ ID NO: 7201046 - DNA, 22 bp, Homo sapiens
aactgcttgtaaataatgttga

SEQ ID NO: 7201047 - DNA, 22 bp, Homo sapiens
aactgcttgtagtgacttgcct

SEQ ID NO: 7201048 - DNA, 22 bp, Homo sapiens
aactgctttgtgagctttctgg

SEQ ID NO: 7201049 - DNA, 22 bp, Homo sapiens
aactgctttttgatctcaggag

SEQ ID NO: 7201050 - DNA, 22 bp, Homo sapiens
aactggaactggtagtgttggt

SEQ ID NO: 7201051 - DNA, 22 bp, Homo sapiens
aactggaactggtagtgttggt

SEQ ID NO: 7201052 - DNA, 22 bp, Homo sapiens
aactggaagagtgaatataact

SEQ ID NO: 7201053 - DNA, 22 bp, Homo sapiens
aactggaaggattgcagatgtc

SEQ ID NO: 7201054 - DNA, 22 bp, Homo sapiens
aactggaatagcacaggaaaag

SEQ ID NO: 7201055 - DNA, 22 bp, Homo sapiens
aatgggaagccagaagacaagg

SEQ ID NO: 7201056 - DNA, 22 bp, Homo sapiens
aactgcttgagatatgtttgtc

SEQ ID NO: 7201057 - DNA, 22 bp, Homo sapiens
aactgcttgagatatgtttgtc

SEQ ID NO: 7201058 - DNA, 22 bp, Homo sapiens
aatgggaagccagaagacaagg

SEQ ID NO: 7201059 - DNA, 22 bp, Homo sapiens
aactgcttgatgaagctcccac

SEQ ID NO: 7201060 - DNA, 22 bp, Homo sapiens
aactgcttgtaaataatgttga

SEQ ID NO: 7201061 - DNA, 22 bp, Homo sapiens
aatgggaaagagactagatgct

SEQ ID NO: 7201062 - DNA, 22 bp, Homo sapiens
aatgggaagccagaagacaagg

SEQ ID NO: 7201063 - DNA, 22 bp, Homo sapiens
aatgggaagccagaagacaagg

SEQ ID NO: 7201064 - DNA, 22 bp, Homo sapiens
aatggctttgacattttcaaat

SEQ ID NO: 7201065 - DNA, 22 bp, Homo sapiens
aatggcttttgcacttaaatcg

SEQ ID NO: 7201066 - DNA, 22 bp, Homo sapiens
aactttctgtctgagctgcaga

SEQ ID NO: 7201067 - DNA, 22 bp, Homo sapiens
aactttcttggatgtctcaaca

SEQ ID NO: 7201068 - DNA, 22 bp, Homo sapiens
aactttctgttacgtccccaga

SEQ ID NO: 7201069 - DNA, 22 bp, Homo sapiens
aactggtcctcaaattttgatg

SEQ ID NO: 7201070 - DNA, 23 bp, Homo sapiens
aactggtccaagatagattgtcc

SEQ ID NO: 7201071 - DNA, 22 bp, Homo sapiens
aactggtcttatgcaagcacta

SEQ ID NO: 7201072 - DNA, 22 bp, Homo sapiens
aactggtctttagaatattctg

SEQ ID NO: 7201073 - DNA, 22 bp, Homo sapiens
aactggtgagataaattattta

SEQ ID NO: 7201074 - DNA, 22 bp, Homo sapiens
aactggagcccctctgccactg

SEQ ID NO: 7201075 - DNA, 22 bp, Homo sapiens
aactggattattcagttgctgc

SEQ ID NO: 7201076 - DNA, 22 bp, Homo sapiens
aactggattttgatgagcagtt

SEQ ID NO: 7201077 - DNA, 22 bp, Homo sapiens
aagaaagagatcactcctccat

SEQ ID NO: 7201078 - DNA, 22 bp, Homo sapiens
aagaaagagatcactcctccat

SEQ ID NO: 7201079 - DNA, 22 bp, Homo sapiens
aagaaagagatcactcctccat

SEQ ID NO: 7201080 - DNA, 22 bp, Homo sapiens
aagaaagataaggtttgcttgg

SEQ ID NO: 7201081 - DNA, 21 bp, Homo sapiens
aagaaagataattaaggaccc

SEQ ID NO: 7201082 - DNA, 21 bp, Homo sapiens
aagaaagataattaaggaccc

SEQ ID NO: 7201083 - DNA, 21 bp, Homo sapiens
aagaaagataattaaggaccc

SEQ ID NO: 7201084 - DNA, 21 bp, Homo sapiens
aagaaagataattaaggaccc

SEQ ID NO: 7201085 - DNA, 22 bp, Homo sapiens
aattcacaatgtgtagtcatgc

SEQ ID NO: 7201086 - DNA, 22 bp, Homo sapiens
aattcacaatgtgtagtcatgc

SEQ ID NO: 7201087 - DNA, 22 bp, Homo sapiens
aattcacaatgtgtagtcatgc

SEQ ID NO: 7201088 - DNA, 22 bp, Homo sapiens
aattcacaattatgttgggaga

SEQ ID NO: 7201089 - DNA, 22 bp, Homo sapiens
aattcacaattatgttgggaga

SEQ ID NO: 7201090 - DNA, 22 bp, Homo sapiens
aattccctcaggggactccttt

SEQ ID NO: 7201091 - DNA, 22 bp, Homo sapiens
aattctgaaagattccttattc

SEQ ID NO: 7201092 - DNA, 22 bp, Homo sapiens
aattctctccagggtaacatca

SEQ ID NO: 7201093 - DNA, 22 bp, Homo sapiens
aattctctccagggtaacatca

SEQ ID NO: 7201094 - DNA, 22 bp, Homo sapiens
aattctctactgtttggtgctc

SEQ ID NO: 7201095 - DNA, 22 bp, Homo sapiens
aattctctccagggtaacatca

SEQ ID NO: 7201096 - DNA, 22 bp, Homo sapiens
aattctataggcaagctatttt

SEQ ID NO: 7201097 - DNA, 22 bp, Homo sapiens
aattctataggcaagctatttt

SEQ ID NO: 7201098 - DNA, 22 bp, Homo sapiens
aattctatgttcttgagtaaga

SEQ ID NO: 7201099 - DNA, 22 bp, Homo sapiens
aattctcaggaatttcatctgt

SEQ ID NO: 7201100 - DNA, 22 bp, Homo sapiens
aattctcaggaatttcatctgt

SEQ ID NO: 7201101 - DNA, 22 bp, Homo sapiens
aattctaaatgtaatttagaat

SEQ ID NO: 7201102 - DNA, 22 bp, Homo sapiens
aattctagcattgtgaaaatat

SEQ ID NO: 7201103 - DNA, 22 bp, Homo sapiens
aattctagcattgtgaaaatat

SEQ ID NO: 7201104 - DNA, 22 bp, Homo sapiens
aattctagcccaggcaaaacta

SEQ ID NO: 7201105 - DNA, 22 bp, Homo sapiens
aattcctgtcttaacagttctg

SEQ ID NO: 7201106 - DNA, 22 bp, Homo sapiens
aattcctgtcttaacagttctg

SEQ ID NO: 7201107 - DNA, 22 bp, Homo sapiens
aattcctagtccagatgtgttg

SEQ ID NO: 7201108 - DNA, 22 bp, Homo sapiens
aagaacaactgctttaaaagca

SEQ ID NO: 7201109 - DNA, 22 bp, Homo sapiens
aagaacaactgctttaaaagca

SEQ ID NO: 7201110 - DNA, 22 bp, Homo sapiens
aagaacaactgctttaaaagca

SEQ ID NO: 7201111 - DNA, 22 bp, Homo sapiens
aagaacaactgctttaaaagca

SEQ ID NO: 7201112 - DNA, 22 bp, Homo sapiens
aagaacaactgctttaaaagca

SEQ ID NO: 7201113 - DNA, 22 bp, Homo sapiens
aagaacaactgctttaaaagca

SEQ ID NO: 7201114 - DNA, 22 bp, Homo sapiens
aagaaattaaggaatgcaacga

SEQ ID NO: 7201115 - DNA, 22 bp, Homo sapiens
aagaaattaatgtgccattact

SEQ ID NO: 7201116 - DNA, 22 bp, Homo sapiens
aagaaatgtgaatattgaatag

SEQ ID NO: 7201117 - DNA, 22 bp, Homo sapiens
aagaaatgtgaatattgaatag

SEQ ID NO: 7201118 - DNA, 22 bp, Homo sapiens
aagaaatgtgaatattgaatag

SEQ ID NO: 7201119 - DNA, 22 bp, Homo sapiens
aagaaatgtgaatattgaatag

SEQ ID NO: 7201120 - DNA, 22 bp, Homo sapiens
aagaaatgtgaatattgaatag

SEQ ID NO: 7201121 - DNA, 22 bp, Homo sapiens
aattctgagaacaaaaggtact

SEQ ID NO: 7201122 - DNA, 22 bp, Homo sapiens
aagaaatggcttcatctgagta

SEQ ID NO: 7201123 - DNA, 22 bp, Homo sapiens
aagaaatggcttcatctgagta

SEQ ID NO: 7201124 - DNA, 22 bp, Homo sapiens
aagaaatgtagagcctagtaaa

SEQ ID NO: 7201125 - DNA, 22 bp, Homo sapiens
aagaaatgtagagcctagtaaa

SEQ ID NO: 7201126 - DNA, 22 bp, Homo sapiens
aatttcactgtggagcacattt

SEQ ID NO: 7201127 - DNA, 22 bp, Homo sapiens
aatttcactgtggagcacattt

SEQ ID NO: 7201128 - DNA, 22 bp, Homo sapiens
aatttcactggaaaagataatt

SEQ ID NO: 7201129 - DNA, 22 bp, Homo sapiens
aatttcactggaaaagataatt

SEQ ID NO: 7201130 - DNA, 22 bp, Homo sapiens
aatttaatcaagttctgctctg

SEQ ID NO: 7201131 - DNA, 22 bp, Homo sapiens
aatttacacttcatttggaggg

SEQ ID NO: 7201132 - DNA, 22 bp, Homo sapiens
aatttcacagtgaactttgagg

SEQ ID NO: 7201133 - DNA, 22 bp, Homo sapiens
aatttcacataaggctcattgg

SEQ ID NO: 7201134 - DNA, 22 bp, Homo sapiens
aatttcacctatcacttaagcc

SEQ ID NO: 7201135 - DNA, 22 bp, Homo sapiens
aatttcacctgcactacatcgc

SEQ ID NO: 7201136 - DNA, 22 bp, Homo sapiens
aatttcactgataaagactcca

SEQ ID NO: 7201137 - DNA, 17 bp, Homo sapiens
aagaacactcaatagca

SEQ ID NO: 7201138 - DNA, 17 bp, Homo sapiens
aagaacactcaatagca

SEQ ID NO: 7201139 - DNA, 22 bp, Homo sapiens
aagaacagattcagcctgaact

SEQ ID NO: 7201140 - DNA, 22 bp, Homo sapiens
aagaacagattcagcctgaact

SEQ ID NO: 7201141 - DNA, 22 bp, Homo sapiens
aatttaaggaggccttcactct

SEQ ID NO: 7201142 - DNA, 22 bp, Homo sapiens
aatttaatcaagttctgctctg

SEQ ID NO: 7201143 - DNA, 22 bp, Homo sapiens
acacatgattaatgccaagcat

SEQ ID NO: 7201144 - DNA, 22 bp, Homo sapiens
acacatgcacaacagttctttc

SEQ ID NO: 7201145 - DNA, 22 bp, Homo sapiens
acacatgcacaacagttctttc

SEQ ID NO: 7201146 - DNA, 22 bp, Homo sapiens
acacatgcacaacagttctttc

SEQ ID NO: 7201147 - DNA, 22 bp, Homo sapiens
acacatgcaggtatacatgttc

SEQ ID NO: 7201148 - DNA, 22 bp, Homo sapiens
acacatgcaggtatacatgttc

SEQ ID NO: 7201149 - DNA, 22 bp, Homo sapiens
acacatgcaggtatacatgttc

SEQ ID NO: 7201150 - DNA, 22 bp, Homo sapiens
acacatgcataagccttccctt

SEQ ID NO: 7201151 - DNA, 20 bp, Homo sapiens
acacatgcatagagagagag

SEQ ID NO: 7201152 - DNA, 20 bp, Homo sapiens
acacatgcatagagagagag

SEQ ID NO: 7201153 - DNA, 20 bp, Homo sapiens
acacatgcattcatgtgggc

SEQ ID NO: 7201154 - DNA, 22 bp, Homo sapiens
acacatgcgatagagaggtagg

SEQ ID NO: 7201155 - DNA, 22 bp, Homo sapiens
acacatgctcataaataaatag

SEQ ID NO: 7201156 - DNA, 22 bp, Homo sapiens
acacatgctcataaataaatag

SEQ ID NO: 7201157 - DNA, 22 bp, Homo sapiens
acacatgctcataaataaatag

SEQ ID NO: 7201158 - DNA, 22 bp, Homo sapiens
acacatgctccagtctccagga

SEQ ID NO: 7201159 - DNA, 22 bp, Homo sapiens
acacatgacctccgcagcagca

SEQ ID NO: 7201160 - DNA, 22 bp, Homo sapiens
acacatgacctccgcagcagca

SEQ ID NO: 7201161 - DNA, 22 bp, Homo sapiens
acacatgacctccgcagcagca

SEQ ID NO: 7201162 - DNA, 22 bp, Homo sapiens
acacatgagaaacatcagttgt

SEQ ID NO: 7201163 - DNA, 22 bp, Homo sapiens
acacatgagaaacatcagttgt

SEQ ID NO: 7201164 - DNA, 22 bp, Homo sapiens
acacatgagaaacatcagttgt

SEQ ID NO: 7201165 - DNA, 22 bp, Homo sapiens
acacatgagaaacatcagttgt

SEQ ID NO: 7201166 - DNA, 22 bp, Homo sapiens
acacatgaggaaggcctcaccc

SEQ ID NO: 7201167 - DNA, 22 bp, Homo sapiens
acacatgaggaaggcctcaccc

SEQ ID NO: 7201168 - DNA, 19 bp, Homo sapiens
acacatgaggagggacccc

SEQ ID NO: 7201169 - DNA, 19 bp, Homo sapiens
acacatgaggagggacccc

SEQ ID NO: 7201170 - DNA, 22 bp, Homo sapiens
acacatgaggatgaggggatca

SEQ ID NO: 7201171 - DNA, 22 bp, Homo sapiens
acacatgagttctcatcttgtg

SEQ ID NO: 7201172 - DNA, 22 bp, Homo sapiens
acacatgagttctcatcttgtg

SEQ ID NO: 7201173 - DNA, 22 bp, Homo sapiens
acacatgagttctcatcttgtg

SEQ ID NO: 7201174 - DNA, 22 bp, Homo sapiens
acacatgataagaaagtttaaa

SEQ ID NO: 7201175 - DNA, 22 bp, Homo sapiens
acacatgataagaaagtttaaa

SEQ ID NO: 7201176 - DNA, 22 bp, Homo sapiens
acacatgaatcactggtggaag

SEQ ID NO: 7201177 - DNA, 22 bp, Homo sapiens
acacatgaaataatattatgca

SEQ ID NO: 7201178 - DNA, 22 bp, Homo sapiens
acacatgaaagacattaaggtg

SEQ ID NO: 7201179 - DNA, 22 bp, Homo sapiens
acacatatatacatatttgtgc

SEQ ID NO: 7201180 - DNA, 22 bp, Homo sapiens
acacatatatacatatttgtgc

SEQ ID NO: 7201181 - DNA, 22 bp, Homo sapiens
acacatatatgtcgaagtcctc

SEQ ID NO: 7201182 - DNA, 22 bp, Homo sapiens
aagagcaggctgctgtggagta

SEQ ID NO: 7201183 - DNA, 22 bp, Homo sapiens
aagagcaggctgctgtggagta

SEQ ID NO: 7201184 - DNA, 22 bp, Homo sapiens
aagagcaggacagaatcagaac

SEQ ID NO: 7201185 - DNA, 22 bp, Homo sapiens
aagagcaggacagaatcagaac

SEQ ID NO: 7201186 - DNA, 22 bp, Homo sapiens
aagagcaggctgctgtggagta

SEQ ID NO: 7201187 - DNA, 22 bp, Homo sapiens
aagagcaggctgtcaatggggc

SEQ ID NO: 7201188 - DNA, 22 bp, Homo sapiens
aagagcaggctgtcaatggggc

SEQ ID NO: 7201189 - DNA, 19 bp, Homo sapiens
aagagcagggaaagaattg

SEQ ID NO: 7201190 - DNA, 19 bp, Homo sapiens
aagagcagggaaagaattg

SEQ ID NO: 7201191 - DNA, 22 bp, Homo sapiens
acacattcctgcagacatgatg

SEQ ID NO: 7201192 - DNA, 22 bp, Homo sapiens
acacattcatgagtgcatgcac

SEQ ID NO: 7201193 - DNA, 22 bp, Homo sapiens
acacattcatgagtgcatgcac

SEQ ID NO: 7201194 - DNA, 22 bp, Homo sapiens
acacattatgagcagttgtctt

SEQ ID NO: 7201195 - DNA, 21 bp, Homo sapiens
acacattatgagcatagactc

SEQ ID NO: 7201196 - DNA, 19 bp, Homo sapiens
acacatgctcctggagcct

SEQ ID NO: 7201197 - DNA, 19 bp, Homo sapiens
acacatgctcctggagcct

SEQ ID NO: 7201198 - DNA, 22 bp, Homo sapiens
acacatgctgataagaatataa

SEQ ID NO: 7201199 - DNA, 22 bp, Homo sapiens
acacatgctgataagaatataa

SEQ ID NO: 7201200 - DNA, 22 bp, Homo sapiens
acacatgctgataagaatataa

SEQ ID NO: 7201201 - DNA, 22 bp, Homo sapiens
acacattatgagcagttgtctt

SEQ ID NO: 7201202 - DNA, 22 bp, Homo sapiens
acacattatgagcagttgtctt

SEQ ID NO: 7201203 - DNA, 22 bp, Homo sapiens
acacattgcagacatctcatta

SEQ ID NO: 7201204 - DNA, 22 bp, Homo sapiens
acacattgcagacatctcatta

SEQ ID NO: 7201205 - DNA, 22 bp, Homo sapiens
acacattgtcatttccatacta

SEQ ID NO: 7201206 - DNA, 22 bp, Homo sapiens
acacatttaaaaaggaacatat

SEQ ID NO: 7201207 - DNA, 22 bp, Homo sapiens
acacatttacatgtttacgtat

SEQ ID NO: 7201208 - DNA, 22 bp, Homo sapiens
acacatttacatgtttacgtat

SEQ ID NO: 7201209 - DNA, 22 bp, Homo sapiens
aagatatagataaaactatgca

SEQ ID NO: 7201210 - DNA, 22 bp, Homo sapiens
aagatatagatggtggtataaa

SEQ ID NO: 7201211 - DNA, 22 bp, Homo sapiens
aagatatagatggtggtataaa

SEQ ID NO: 7201212 - DNA, 22 bp, Homo sapiens
aagatatagatggtggtataaa

SEQ ID NO: 7201213 - DNA, 22 bp, Homo sapiens
aagatatagatggtggtataaa

SEQ ID NO: 7201214 - DNA, 22 bp, Homo sapiens
aagatctagtggatggtgagtg

SEQ ID NO: 7201215 - DNA, 22 bp, Homo sapiens
aagatgaaaatttactgtgatg

SEQ ID NO: 7201216 - DNA, 22 bp, Homo sapiens
aagatgaagaacatgagcacac

SEQ ID NO: 7201217 - DNA, 22 bp, Homo sapiens
aagatgaatcagtatgtgtcct

SEQ ID NO: 7201218 - DNA, 22 bp, Homo sapiens
acacatttatggatcgcagaaa

SEQ ID NO: 7201219 - DNA, 22 bp, Homo sapiens
acacatttatggatcgcagaaa

SEQ ID NO: 7201220 - DNA, 22 bp, Homo sapiens
acacatttattacatgcatgtg

SEQ ID NO: 7201221 - DNA, 22 bp, Homo sapiens
acacatttattacatgcatgtg

SEQ ID NO: 7201222 - DNA, 22 bp, Homo sapiens
acacatttattacatgcatgtg

SEQ ID NO: 7201223 - DNA, 22 bp, Homo sapiens
acacatttattacatgcatgtg

SEQ ID NO: 7201224 - DNA, 22 bp, Homo sapiens
acacatttattacatgcatgtg

SEQ ID NO: 7201225 - DNA, 22 bp, Homo sapiens
acacatttattacatgcatgtg

SEQ ID NO: 7201226 - DNA, 22 bp, Homo sapiens
acacatttctaaatttttaccg

SEQ ID NO: 7201227 - DNA, 22 bp, Homo sapiens
acacatttctaaatttttaccg

SEQ ID NO: 7201228 - DNA, 23 bp, Homo sapiens
aagatgtatttttaccaaatgtc

SEQ ID NO: 7201229 - DNA, 22 bp, Homo sapiens
aagatgtatcagttaagtcttc

SEQ ID NO: 7201230 - DNA, 22 bp, Homo sapiens
aagatgtgaaattgtctctggg

SEQ ID NO: 7201231 - DNA, 22 bp, Homo sapiens
aagatgtatcagttaagtcttc

SEQ ID NO: 7201232 - DNA, 22 bp, Homo sapiens
aagatgtaaaggcaatataaag

SEQ ID NO: 7201233 - DNA, 22 bp, Homo sapiens
aagatggtggccagagtggaaa

SEQ ID NO: 7201234 - DNA, 21 bp, Homo sapiens
aagatggttatgtgctaaaga

SEQ ID NO: 7201235 - DNA, 22 bp, Homo sapiens
aagatggttatttcatcaccta

SEQ ID NO: 7201236 - DNA, 22 bp, Homo sapiens
aagatgcttgcaaatttctgaa

SEQ ID NO: 7201237 - DNA, 22 bp, Homo sapiens
aagatgcttgagaactgtttga

SEQ ID NO: 7201238 - DNA, 22 bp, Homo sapiens
aagatgctggcaggaatagcta

SEQ ID NO: 7201239 - DNA, 22 bp, Homo sapiens
aagatggagtagtgtaatggtt

SEQ ID NO: 7201240 - DNA, 22 bp, Homo sapiens
aagatggcaggaatcataagct

SEQ ID NO: 7201241 - DNA, 22 bp, Homo sapiens
aagatggcatctcctatagatg

SEQ ID NO: 7201242 - DNA, 22 bp, Homo sapiens
aagatggcttagagtcctggtg

SEQ ID NO: 7201243 - DNA, 22 bp, Homo sapiens
aagatgatgttgtgttttcact

SEQ ID NO: 7201244 - DNA, 22 bp, Homo sapiens
aagatgataggacttgcttaag

SEQ ID NO: 7201245 - DNA, 22 bp, Homo sapiens
aagatgatagatctgtcaatgt

SEQ ID NO: 7201246 - DNA, 22 bp, Homo sapiens
aagatgactatttatctgtaag

SEQ ID NO: 7201247 - DNA, 22 bp, Homo sapiens
aagatgactatttatctgtaag

SEQ ID NO: 7201248 - DNA, 22 bp, Homo sapiens
aagatgacagatgcttagagtc

SEQ ID NO: 7201249 - DNA, 22 bp, Homo sapiens
aagatgacagatgcttagagtc

SEQ ID NO: 7201250 - DNA, 22 bp, Homo sapiens
aagatgaccctgagggcaattg

SEQ ID NO: 7201251 - DNA, 22 bp, Homo sapiens
aagatgcatgctgaagctggct

SEQ ID NO: 7201252 - DNA, 22 bp, Homo sapiens
aagatgcagctttacaataagg

SEQ ID NO: 7201253 - DNA, 22 bp, Homo sapiens
aagatgcagctttacaataagg

SEQ ID NO: 7201254 - DNA, 22 bp, Homo sapiens
aagatgcagcttccacttttgc

SEQ ID NO: 7201255 - DNA, 22 bp, Homo sapiens
aagatgcagcaaactacttttt

SEQ ID NO: 7201256 - DNA, 22 bp, Homo sapiens
aagatgcacaatgtggcaatta

SEQ ID NO: 7201257 - DNA, 22 bp, Homo sapiens
aagatgcacaatgtggcaatta

SEQ ID NO: 7201258 - DNA, 22 bp, Homo sapiens
aagatgcggttgaccatggtgt

SEQ ID NO: 7201259 - DNA, 22 bp, Homo sapiens
aagatgtgtctcatcagggtgt

SEQ ID NO: 7201260 - DNA, 22 bp, Homo sapiens
aagatgttaaatctgtagaatt

SEQ ID NO: 7201261 - DNA, 22 bp, Homo sapiens
aagatgttaaatctgtagaatt

SEQ ID NO: 7201262 - DNA, 22 bp, Homo sapiens
aagatgttaaattgggggcatt

SEQ ID NO: 7201263 - DNA, 22 bp, Homo sapiens
aagatgttactcaaccaggata

SEQ ID NO: 7201264 - DNA, 22 bp, Homo sapiens
aagatgttagaggtcatgcaga

SEQ ID NO: 7201265 - DNA, 22 bp, Homo sapiens
aagatgttagaggtcatgcaga

SEQ ID NO: 7201266 - DNA, 22 bp, Homo sapiens
aagatgttagattatggggaca

SEQ ID NO: 7201267 - DNA, 22 bp, Homo sapiens
aagatgttaggaaagttagggt

SEQ ID NO: 7201268 - DNA, 22 bp, Homo sapiens
aagatgttagggtggaagggat

SEQ ID NO: 7201269 - DNA, 22 bp, Homo sapiens
aagatgttattgtcttccttgc

SEQ ID NO: 7201270 - DNA, 22 bp, Homo sapiens
aagcaaagacagtttgagtgga

SEQ ID NO: 7201271 - DNA, 22 bp, Homo sapiens
aagcaaagagataaccttttgg

SEQ ID NO: 7201272 - DNA, 22 bp, Homo sapiens
aagcaagacagaagttactgcc

SEQ ID NO: 7201273 - DNA, 22 bp, Homo sapiens
aagcaagaggaaatgtggacct

SEQ ID NO: 7201274 - DNA, 22 bp, Homo sapiens
aagcaagacagaagttactgcc

SEQ ID NO: 7201275 - DNA, 22 bp, Homo sapiens
aagcaagaggaaatgtggacct

SEQ ID NO: 7201276 - DNA, 22 bp, Homo sapiens
aagcaagagttggagtgatgtt

SEQ ID NO: 7201277 - DNA, 22 bp, Homo sapiens
aagcaataatcccaaagtgctg

SEQ ID NO: 7201278 - DNA, 22 bp, Homo sapiens
aagcaatagcaacaactttaca

SEQ ID NO: 7201279 - DNA, 22 bp, Homo sapiens
aagcaataaataatttttagta

SEQ ID NO: 7201280 - DNA, 22 bp, Homo sapiens
aagcaagtaggtatttgacaaa

SEQ ID NO: 7201281 - DNA, 22 bp, Homo sapiens
aagcaagttctcatcatttata

SEQ ID NO: 7201282 - DNA, 22 bp, Homo sapiens
aagcaagttctcatcatttata

SEQ ID NO: 7201283 - DNA, 22 bp, Homo sapiens
aagcaagagttggagtgatgtt

SEQ ID NO: 7201284 - DNA, 22 bp, Homo sapiens
aagcaagcagtgtggaatttta

SEQ ID NO: 7201285 - DNA, 22 bp, Homo sapiens
aagcaagccaatctgttttgtt

SEQ ID NO: 7201286 - DNA, 22 bp, Homo sapiens
aagcaagcccaggctcagtcaa

SEQ ID NO: 7201287 - DNA, 22 bp, Homo sapiens
aagcaagctgttggcaataggg

SEQ ID NO: 7201288 - DNA, 19 bp, Homo sapiens
aagcaagctttgagtgggt

SEQ ID NO: 7201289 - DNA, 19 bp, Homo sapiens
aagcaagctttgagtgggt

SEQ ID NO: 7201290 - DNA, 22 bp, Homo sapiens
aagcaaggcaacctatgtccag

SEQ ID NO: 7201291 - DNA, 22 bp, Homo sapiens
aagcaaggcccagagcatcagc

SEQ ID NO: 7201292 - DNA, 22 bp, Homo sapiens
aagcaaggccggaaggaaactc

SEQ ID NO: 7201293 - DNA, 22 bp, Homo sapiens
aagcagagcctgagacagggat

SEQ ID NO: 7201294 - DNA, 22 bp, Homo sapiens
aagcagagcctgagacagggat

SEQ ID NO: 7201295 - DNA, 22 bp, Homo sapiens
aagcagagcctgagacagggat

SEQ ID NO: 7201296 - DNA, 22 bp, Homo sapiens
aagcagaggaccgacggaggga

SEQ ID NO: 7201297 - DNA, 22 bp, Homo sapiens
aagcagagcctgagacagggat

SEQ ID NO: 7201298 - DNA, 22 bp, Homo sapiens
aagcagagcctgagacagggat

SEQ ID NO: 7201299 - DNA, 22 bp, Homo sapiens
aagcagagccaccagctttgga

SEQ ID NO: 7201300 - DNA, 22 bp, Homo sapiens
aagcagagccaccagctttgga

SEQ ID NO: 7201301 - DNA, 22 bp, Homo sapiens
aagcagagcaagcgtatttatt

SEQ ID NO: 7201302 - DNA, 22 bp, Homo sapiens
aagcagagagcagaattaagtt

SEQ ID NO: 7201303 - DNA, 22 bp, Homo sapiens
aagcagagaccggctaatggag

SEQ ID NO: 7201304 - DNA, 22 bp, Homo sapiens
aagcagagaatctgggagcgag

SEQ ID NO: 7201305 - DNA, 22 bp, Homo sapiens
aagcagagaccggctaatggag

SEQ ID NO: 7201306 - DNA, 22 bp, Homo sapiens
aagcagagaatctgggagcgag

SEQ ID NO: 7201307 - DNA, 19 bp, Homo sapiens
aagcagactctgagccagg

SEQ ID NO: 7201308 - DNA, 22 bp, Homo sapiens
aagcagaatttaatagaaaggt

SEQ ID NO: 7201309 - DNA, 22 bp, Homo sapiens
aagcagaatagaggcccttccc

SEQ ID NO: 7201310 - DNA, 22 bp, Homo sapiens
aagcagaatagaggcccttccc

SEQ ID NO: 7201311 - DNA, 22 bp, Homo sapiens
aagcagaagttgatctaccata

SEQ ID NO: 7201312 - DNA, 22 bp, Homo sapiens
aagcagaagttgatctaccata

SEQ ID NO: 7201313 - DNA, 22 bp, Homo sapiens
aagcagaagttgatctaccata

SEQ ID NO: 7201314 - DNA, 22 bp, Homo sapiens
aagcacctagcacagtagatta

SEQ ID NO: 7201315 - DNA, 20 bp, Homo sapiens
aagcagaagctgctctcagc

SEQ ID NO: 7201316 - DNA, 20 bp, Homo sapiens
aagcagaagctgctctcagc

SEQ ID NO: 7201317 - DNA, 22 bp, Homo sapiens
aagcagaaggggaataatattt

SEQ ID NO: 7201318 - DNA, 22 bp, Homo sapiens
aagcagaaggggaataatattt

SEQ ID NO: 7201319 - DNA, 22 bp, Homo sapiens
aagcagaatttaatagaaaggt

SEQ ID NO: 7201320 - DNA, 22 bp, Homo sapiens
aagcagaatttaatagaaaggt

SEQ ID NO: 7201321 - DNA, 22 bp, Homo sapiens
aagcagaatttaatagaaaggt

SEQ ID NO: 7201322 - DNA, 22 bp, Homo sapiens
aagcagaatttcccactagttg

SEQ ID NO: 7201323 - DNA, 22 bp, Homo sapiens
aagcagaatttcccactagttg

SEQ ID NO: 7201324 - DNA, 22 bp, Homo sapiens
aagcagaatttcccactagttg

SEQ ID NO: 7201325 - DNA, 18 bp, Homo sapiens
aagcagacagcagacagt

SEQ ID NO: 7201326 - DNA, 18 bp, Homo sapiens
aagcagacagcagacagt

SEQ ID NO: 7201327 - DNA, 18 bp, Homo sapiens
aagcagacagcagacagt

SEQ ID NO: 7201328 - DNA, 18 bp, Homo sapiens
aagcagacagcagacagt

SEQ ID NO: 7201329 - DNA, 21 bp, Homo sapiens
aagcagacctgagcacagaac

SEQ ID NO: 7201330 - DNA, 22 bp, Homo sapiens
aagcacctctatgattgctttt

SEQ ID NO: 7201331 - DNA, 22 bp, Homo sapiens
aagcacccaatttacagcagtt

SEQ ID NO: 7201332 - DNA, 22 bp, Homo sapiens
aagcacactcagatattgactc

SEQ ID NO: 7201333 - DNA, 22 bp, Homo sapiens
aagcacacagcaaaggggagct

SEQ ID NO: 7201334 - DNA, 22 bp, Homo sapiens
aagcacacctccctggcaggag

SEQ ID NO: 7201335 - DNA, 22 bp, Homo sapiens
aagcaattgtcctgtctctaca

SEQ ID NO: 7201336 - DNA, 22 bp, Homo sapiens
aagcacaatgaacatcttagat

SEQ ID NO: 7201337 - DNA, 22 bp, Homo sapiens
aagcaattcagcaaacctagaa

SEQ ID NO: 7201338 - DNA, 22 bp, Homo sapiens
aagcaattgtcctgtctctaca

SEQ ID NO: 7201339 - DNA, 22 bp, Homo sapiens
aagcaatatactgatatgatta

SEQ ID NO: 7201340 - DNA, 22 bp, Homo sapiens
aagcaatagggtaatctactca

SEQ ID NO: 7201341 - DNA, 22 bp, Homo sapiens
aagcaatagcaacaactttaca

SEQ ID NO: 7201342 - DNA, 22 bp, Homo sapiens
aagcaatagggtaatctactca

SEQ ID NO: 7201343 - DNA, 22 bp, Homo sapiens
aagcaatatactgatatgatta

SEQ ID NO: 7201344 - DNA, 23 bp, Homo sapiens
aagcaatgctgagccagttctga

SEQ ID NO: 7201345 - DNA, 23 bp, Homo sapiens
aagcaatgctgagccagttctga

SEQ ID NO: 7201346 - DNA, 23 bp, Homo sapiens
aagcaatgctgagccagttctga

SEQ ID NO: 7201347 - DNA, 23 bp, Homo sapiens
aagcaatgctgagccagttctga

SEQ ID NO: 7201348 - DNA, 22 bp, Homo sapiens
aagcaatgtgttaatgaatgag

SEQ ID NO: 7201349 - DNA, 22 bp, Homo sapiens
aagcaatgtgttaatgaatgag

SEQ ID NO: 7201350 - DNA, 22 bp, Homo sapiens
aagcaatgtgtttgaaaggcca

SEQ ID NO: 7201351 - DNA, 22 bp, Homo sapiens
aagcaatgtgtttgaaaggcca

SEQ ID NO: 7201352 - DNA, 22 bp, Homo sapiens
aagcaatgtgtttgaaaggcca

SEQ ID NO: 7201353 - DNA, 22 bp, Homo sapiens
aagcaatgttagaggccttagg

SEQ ID NO: 7201354 - DNA, 19 bp, Homo sapiens
aagcaatgttgtgaatcta

SEQ ID NO: 7201355 - DNA, 22 bp, Homo sapiens
acagcctggactggctctctgc

SEQ ID NO: 7201356 - DNA, 22 bp, Homo sapiens
acagcctggactggctctctgc

SEQ ID NO: 7201357 - DNA, 22 bp, Homo sapiens
acagcctggactggctctctgc

SEQ ID NO: 7201358 - DNA, 22 bp, Homo sapiens
acagcctggactggctctctgc

SEQ ID NO: 7201359 - DNA, 22 bp, Homo sapiens
acagccagggtctcaggaggcg

SEQ ID NO: 7201360 - DNA, 22 bp, Homo sapiens
aagcaggaagctcaggtccttg

SEQ ID NO: 7201361 - DNA, 22 bp, Homo sapiens
acagccagggcattgtcgccga

SEQ ID NO: 7201362 - DNA, 22 bp, Homo sapiens
aagcagcttttgaagagtgagg

SEQ ID NO: 7201363 - DNA, 21 bp, Homo sapiens
aagcaggaacttcaaagggac

SEQ ID NO: 7201364 - DNA, 22 bp, Homo sapiens
aagcagctttctttcctgtgaa

SEQ ID NO: 7201365 - DNA, 22 bp, Homo sapiens
aagcagctttctttcctgtgaa

SEQ ID NO: 7201366 - DNA, 22 bp, Homo sapiens
aagcagcttttgaagagtgagg

SEQ ID NO: 7201367 - DNA, 22 bp, Homo sapiens
aagcagcttccccaaagtgcct

SEQ ID NO: 7201368 - DNA, 22 bp, Homo sapiens
aagcagctgtgtgacataatct

SEQ ID NO: 7201369 - DNA, 22 bp, Homo sapiens
acagcagaggaaaagtctgata

SEQ ID NO: 7201370 - DNA, 22 bp, Homo sapiens
acagcagagtggagatgagcac

SEQ ID NO: 7201371 - DNA, 22 bp, Homo sapiens
acagcagagcctggtacttact

SEQ ID NO: 7201372 - DNA, 22 bp, Homo sapiens
acagcagagcctagcttaatct

SEQ ID NO: 7201373 - DNA, 22 bp, Homo sapiens
acagcagagcctagcttaatct

SEQ ID NO: 7201374 - DNA, 22 bp, Homo sapiens
acagcagaggaaaagtctgata

SEQ ID NO: 7201375 - DNA, 22 bp, Homo sapiens
acagcagaggaaaagtctgata

SEQ ID NO: 7201376 - DNA, 22 bp, Homo sapiens
acagcagaggaaaagtctgata

SEQ ID NO: 7201377 - DNA, 22 bp, Homo sapiens
acagcagaggaaaagtctgata

SEQ ID NO: 7201378 - DNA, 22 bp, Homo sapiens
acagcagagcaccagggccact

SEQ ID NO: 7201379 - DNA, 22 bp, Homo sapiens
acagcagagcaccagggccact

SEQ ID NO: 7201380 - DNA, 22 bp, Homo sapiens
acagcagagccagtggctctag

SEQ ID NO: 7201381 - DNA, 22 bp, Homo sapiens
acagcagagccagtggctctag

SEQ ID NO: 7201382 - DNA, 22 bp, Homo sapiens
acagcagagccagtggctctag

SEQ ID NO: 7201383 - DNA, 21 bp, Homo sapiens
acagcagagatcaagactaag

SEQ ID NO: 7201384 - DNA, 21 bp, Homo sapiens
acagcagagatcaagactaag

SEQ ID NO: 7201385 - DNA, 22 bp, Homo sapiens
acagcagagcaccagggccact

SEQ ID NO: 7201386 - DNA, 22 bp, Homo sapiens
acagcagagcaccagggccact

SEQ ID NO: 7201387 - DNA, 22 bp, Homo sapiens
acagcagagcaccagggccact

SEQ ID NO: 7201388 - DNA, 22 bp, Homo sapiens
acagcagagcaccagggccact

SEQ ID NO: 7201389 - DNA, 21 bp, Homo sapiens
acagcagagatcaagactaag

SEQ ID NO: 7201390 - DNA, 21 bp, Homo sapiens
acagcagagatcaagactaag

SEQ ID NO: 7201391 - DNA, 21 bp, Homo sapiens
acagcagagatcaagactaag

SEQ ID NO: 7201392 - DNA, 22 bp, Homo sapiens
acagcagagacactcaggaggc

SEQ ID NO: 7201393 - DNA, 22 bp, Homo sapiens
acagcagagacactcaggaggc

SEQ ID NO: 7201394 - DNA, 22 bp, Homo sapiens
acagcagactttctacagctca

SEQ ID NO: 7201395 - DNA, 22 bp, Homo sapiens
acagcagactttctacagctca

SEQ ID NO: 7201396 - DNA, 22 bp, Homo sapiens
acagcagagaactttagagggt

SEQ ID NO: 7201397 - DNA, 22 bp, Homo sapiens
acagcagagacactcaggaggc

SEQ ID NO: 7201398 - DNA, 22 bp, Homo sapiens
aagcagagggtatggccaggtt

SEQ ID NO: 7201399 - DNA, 22 bp, Homo sapiens
aagcagaggccacagagtgggc

SEQ ID NO: 7201400 - DNA, 22 bp, Homo sapiens
aagcagaggaccgacggaggga

SEQ ID NO: 7201401 - DNA, 22 bp, Homo sapiens
aagcagaggaccgacggaggga

SEQ ID NO: 7201402 - DNA, 22 bp, Homo sapiens
aagcagaggtagggtgtgcagt

SEQ ID NO: 7201403 - DNA, 22 bp, Homo sapiens
aagcagaggtagggtgtgcagt

SEQ ID NO: 7201404 - DNA, 22 bp, Homo sapiens
aagcagaggtagggtgtgcagt

SEQ ID NO: 7201405 - DNA, 22 bp, Homo sapiens
acagcaaaagacaagaacttaa

SEQ ID NO: 7201406 - DNA, 22 bp, Homo sapiens
acagcaaaagacaagaacttaa

SEQ ID NO: 7201407 - DNA, 22 bp, Homo sapiens
aatgggcacacttagagagtaa

SEQ ID NO: 7201408 - DNA, 22 bp, Homo sapiens
aatgggcatttggggttgagaa

SEQ ID NO: 7201409 - DNA, 22 bp, Homo sapiens
aatgggagtggcttggaaatca

SEQ ID NO: 7201410 - DNA, 22 bp, Homo sapiens
aatgggaagtcactactgttac

SEQ ID NO: 7201411 - DNA, 22 bp, Homo sapiens
aatgggaagtcactactgttac

SEQ ID NO: 7201412 - DNA, 22 bp, Homo sapiens
aatggcagtagttgcatgagag

SEQ ID NO: 7201413 - DNA, 22 bp, Homo sapiens
aatggcagtagttgcatgagag

SEQ ID NO: 7201414 - DNA, 22 bp, Homo sapiens
aatggcatgacttgcccaaggc

SEQ ID NO: 7201415 - DNA, 22 bp, Homo sapiens
aatggcagaggcaaagatggta

SEQ ID NO: 7201416 - DNA, 19 bp, Homo sapiens
aatggcagatgccatatct

SEQ ID NO: 7201417 - DNA, 22 bp, Homo sapiens
aatggcagaatgggccagaagc

SEQ ID NO: 7201418 - DNA, 22 bp, Homo sapiens
aatggcagaggcaaagatggta

SEQ ID NO: 7201419 - DNA, 22 bp, Homo sapiens
aatggcagaggcaaagatggta

SEQ ID NO: 7201420 - DNA, 22 bp, Homo sapiens
aatggagaggctgtgagtgaga

SEQ ID NO: 7201421 - DNA, 22 bp, Homo sapiens
agacaatttcaaagtaatatta

SEQ ID NO: 7201422 - DNA, 22 bp, Homo sapiens
aatggagactgacacaaagata

SEQ ID NO: 7201423 - DNA, 22 bp, Homo sapiens
aatggagacttcaaaatggatt

SEQ ID NO: 7201424 - DNA, 22 bp, Homo sapiens
agacaattgttctaagtaaaaa

SEQ ID NO: 7201425 - DNA, 22 bp, Homo sapiens
agacaatttcaaagtaatatta

SEQ ID NO: 7201426 - DNA, 22 bp, Homo sapiens
agacaattaaaaaattatgctt

SEQ ID NO: 7201427 - DNA, 22 bp, Homo sapiens
agacaattaaaaaattatgctt

SEQ ID NO: 7201428 - DNA, 22 bp, Homo sapiens
agacaattaaaaaattatgctt

SEQ ID NO: 7201429 - DNA, 22 bp, Homo sapiens
aatggagatgtctagagggtgc

SEQ ID NO: 7201430 - DNA, 22 bp, Homo sapiens
aatggaggtgtctggcctggta

SEQ ID NO: 7201431 - DNA, 22 bp, Homo sapiens
aatggcaaaaggataacaagga

SEQ ID NO: 7201432 - DNA, 22 bp, Homo sapiens
aatggcaaaaggataacaagga

SEQ ID NO: 7201433 - DNA, 22 bp, Homo sapiens
aatggcaagctgaactcagaag

SEQ ID NO: 7201434 - DNA, 22 bp, Homo sapiens
aatggcaagctgaactcagaag

SEQ ID NO: 7201435 - DNA, 22 bp, Homo sapiens
aatggcaaggaaaccgttacca

SEQ ID NO: 7201436 - DNA, 22 bp, Homo sapiens
aatggcacaagagtaaactgtt

SEQ ID NO: 7201437 - DNA, 22 bp, Homo sapiens
aatggcacccgtaataccaaag

SEQ ID NO: 7201438 - DNA, 22 bp, Homo sapiens
aatggcacctgctatatactga

SEQ ID NO: 7201439 - DNA, 22 bp, Homo sapiens
aatggcaccttcaagaagaaaa

SEQ ID NO: 7201440 - DNA, 22 bp, Homo sapiens
aatggcactttataaatgttaa

SEQ ID NO: 7201441 - DNA, 22 bp, Homo sapiens
agaagcagctttcaaggtgatt

SEQ ID NO: 7201442 - DNA, 22 bp, Homo sapiens
agaagcagctttcaaggtgatt

SEQ ID NO: 7201443 - DNA, 20 bp, Homo sapiens
agacaaaatgacttcatgca

SEQ ID NO: 7201444 - DNA, 20 bp, Homo sapiens
agacaaaatgacttcatgca

SEQ ID NO: 7201445 - DNA, 22 bp, Homo sapiens
agacaaaccttgttttatgatg

SEQ ID NO: 7201446 - DNA, 22 bp, Homo sapiens
agacaaaccttgttttatgatg

SEQ ID NO: 7201447 - DNA, 23 bp, Homo sapiens
agaagcagcttctggagtatcgg

SEQ ID NO: 7201448 - DNA, 23 bp, Homo sapiens
agaagcagcttctggagtatcgg

SEQ ID NO: 7201449 - DNA, 23 bp, Homo sapiens
agaagcagcttctggagtatcgg

SEQ ID NO: 7201450 - DNA, 23 bp, Homo sapiens
agaagcagcttctggagtatcgg

SEQ ID NO: 7201451 - DNA, 23 bp, Homo sapiens
agaagcagcttctggagtatcgg

SEQ ID NO: 7201452 - DNA, 23 bp, Homo sapiens
agaagcagcttctggagtatcgg

SEQ ID NO: 7201453 - DNA, 23 bp, Homo sapiens
agaagcagcttctggagtatcgg

SEQ ID NO: 7201454 - DNA, 23 bp, Homo sapiens
agaagcagcttctggagtatcgg

SEQ ID NO: 7201455 - DNA, 23 bp, Homo sapiens
agaagcagcttctggagtatcgg

SEQ ID NO: 7201456 - DNA, 22 bp, Homo sapiens
agaagcagaaggaagcagggcc

SEQ ID NO: 7201457 - DNA, 22 bp, Homo sapiens
agaagcagactctgaggcaagg

SEQ ID NO: 7201458 - DNA, 22 bp, Homo sapiens
agaagcagactctgaggcaagg

SEQ ID NO: 7201459 - DNA, 22 bp, Homo sapiens
agaagcagactctgaggcaagg

SEQ ID NO: 7201460 - DNA, 22 bp, Homo sapiens
agaagcagactctgaggcaagg

SEQ ID NO: 7201461 - DNA, 22 bp, Homo sapiens
agaagcagactctgaggcaagg

SEQ ID NO: 7201462 - DNA, 22 bp, Homo sapiens
agaagcagactctgaggcaagg

SEQ ID NO: 7201463 - DNA, 22 bp, Homo sapiens
agaagcagcaagcccttcaaag

SEQ ID NO: 7201464 - DNA, 22 bp, Homo sapiens
agaagcagcaagcccttcaaag

SEQ ID NO: 7201465 - DNA, 22 bp, Homo sapiens
agacaatggagggaaatacttc

SEQ ID NO: 7201466 - DNA, 22 bp, Homo sapiens
agacaatggctaagtaacctgt

SEQ ID NO: 7201467 - DNA, 22 bp, Homo sapiens
agacaatggctaagtaacctgt

SEQ ID NO: 7201468 - DNA, 22 bp, Homo sapiens
agacaatgtcaaggtgatcatc

SEQ ID NO: 7201469 - DNA, 22 bp, Homo sapiens
agacaatgtcaaggtgatcatc

SEQ ID NO: 7201470 - DNA, 22 bp, Homo sapiens
agacaatgtcaaggtgatcatc

SEQ ID NO: 7201471 - DNA, 22 bp, Homo sapiens
agacaatgtttggtctacactt

SEQ ID NO: 7201472 - DNA, 21 bp, Homo sapiens
agacaatgctgtaaaattcag

SEQ ID NO: 7201473 - DNA, 22 bp, Homo sapiens
agacaatggaccaagcaccttc

SEQ ID NO: 7201474 - DNA, 22 bp, Homo sapiens
agacaatggaccaagcaccttc

SEQ ID NO: 7201475 - DNA, 22 bp, Homo sapiens
agacaatggagagcagagtact

SEQ ID NO: 7201476 - DNA, 22 bp, Homo sapiens
agacaatatgtatattaagaat

SEQ ID NO: 7201477 - DNA, 23 bp, Homo sapiens
aatggtcttcctccacccctctg

SEQ ID NO: 7201478 - DNA, 23 bp, Homo sapiens
aatggtcttcctccacccctctg

SEQ ID NO: 7201479 - DNA, 23 bp, Homo sapiens
aatggtcttcctccacccctctg

SEQ ID NO: 7201480 - DNA, 22 bp, Homo sapiens
aatggtgaggctcctaaatttt

SEQ ID NO: 7201481 - DNA, 22 bp, Homo sapiens
aatggtgaggctcctaaatttt

SEQ ID NO: 7201482 - DNA, 22 bp, Homo sapiens
aatggttacagaaatgaaagta

SEQ ID NO: 7201483 - DNA, 22 bp, Homo sapiens
aatggtttaacatatgcttgag

SEQ ID NO: 7201484 - DNA, 22 bp, Homo sapiens
aatggtttaacatatgcttgag

SEQ ID NO: 7201485 - DNA, 22 bp, Homo sapiens
aatggtttagttaagactgagt

SEQ ID NO: 7201486 - DNA, 22 bp, Homo sapiens
aatggtttagttaagactgagt

SEQ ID NO: 7201487 - DNA, 22 bp, Homo sapiens
aatggtttatggggaccgcaaa

SEQ ID NO: 7201488 - DNA, 22 bp, Homo sapiens
aatggtttcaaacacactaagt

SEQ ID NO: 7201489 - DNA, 22 bp, Homo sapiens
aatggtttcaaacacactaagt

SEQ ID NO: 7201490 - DNA, 22 bp, Homo sapiens
aatggtttgatggacaaaatga

SEQ ID NO: 7201491 - DNA, 22 bp, Homo sapiens
aatggtttgatggacaaaatga

SEQ ID NO: 7201492 - DNA, 22 bp, Homo sapiens
aatggtttggactattcaatag

SEQ ID NO: 7201493 - DNA, 22 bp, Homo sapiens
aatggtttggactattcaatag

SEQ ID NO: 7201494 - DNA, 22 bp, Homo sapiens
aatggtttgtacctgtccttgg

SEQ ID NO: 7201495 - DNA, 22 bp, Homo sapiens
aatggttttctagaacatgaaa

SEQ ID NO: 7201496 - DNA, 22 bp, Homo sapiens
aatggttttctagaacatgaaa

SEQ ID NO: 7201497 - DNA, 22 bp, Homo sapiens
aatgggcatttgtttgtggtac

SEQ ID NO: 7201498 - DNA, 22 bp, Homo sapiens
aatgggcatttggggttgagaa

SEQ ID NO: 7201499 - DNA, 22 bp, Homo sapiens
aatgggctttcttggacaggag

SEQ ID NO: 7201500 - DNA, 20 bp, Homo sapiens
aatgggctttgatgagtgtg

SEQ ID NO: 7201501 - DNA, 22 bp, Homo sapiens
aatgggttgctttccacagcct

SEQ ID NO: 7201502 - DNA, 22 bp, Homo sapiens
aatgggtttctgtcccagctct

SEQ ID NO: 7201503 - DNA, 22 bp, Homo sapiens
aatggtaaatgtaacagcattc

SEQ ID NO: 7201504 - DNA, 22 bp, Homo sapiens
aatggtaaatgtaacagcattc

SEQ ID NO: 7201505 - DNA, 22 bp, Homo sapiens
aatggtaatattggcacagaaa

SEQ ID NO: 7201506 - DNA, 22 bp, Homo sapiens
aatggtaatatttcatagttgt

SEQ ID NO: 7201507 - DNA, 22 bp, Homo sapiens
aatggtaatatttcatagttgt

SEQ ID NO: 7201508 - DNA, 22 bp, Homo sapiens
aatggtaatggagagaactact

SEQ ID NO: 7201509 - DNA, 19 bp, Homo sapiens
aatggtaattagagaaatg

SEQ ID NO: 7201510 - DNA, 22 bp, Homo sapiens
aatggtaatttgcagaaagtcc

SEQ ID NO: 7201511 - DNA, 22 bp, Homo sapiens
aatggtatcacctcacagaatt

SEQ ID NO: 7201512 - DNA, 22 bp, Homo sapiens
aatgtgaatcttcctttttgat

SEQ ID NO: 7201513 - DNA, 22 bp, Homo sapiens
aatgtgaatcttcctttttgat

SEQ ID NO: 7201514 - DNA, 18 bp, Homo sapiens
aatgtgaatatttacttc

SEQ ID NO: 7201515 - DNA, 22 bp, Homo sapiens
aatgtgaactttgtcatgtaac

SEQ ID NO: 7201516 - DNA, 22 bp, Homo sapiens
aatgtcttcagtgtatacatgg

SEQ ID NO: 7201517 - DNA, 22 bp, Homo sapiens
aatgtaaaatatcttgtacttg

SEQ ID NO: 7201518 - DNA, 22 bp, Homo sapiens
aatgtaaaatatcttgtacttg

SEQ ID NO: 7201519 - DNA, 22 bp, Homo sapiens
aatggtttttgcatattcaggt

SEQ ID NO: 7201520 - DNA, 22 bp, Homo sapiens
aatggttttgtctcatcaatgt

SEQ ID NO: 7201521 - DNA, 22 bp, Homo sapiens
aatgtgagccaatgcccgtggg

SEQ ID NO: 7201522 - DNA, 22 bp, Homo sapiens
aatgtgagccaatgcccgtggg

SEQ ID NO: 7201523 - DNA, 22 bp, Homo sapiens
aatgtgagccaatgcccgtggg

SEQ ID NO: 7201524 - DNA, 22 bp, Homo sapiens
aatgtgagccaatgcccgtggg

SEQ ID NO: 7201525 - DNA, 22 bp, Homo sapiens
aatgtgaggccttggtagttat

SEQ ID NO: 7201526 - DNA, 22 bp, Homo sapiens
aatgtgaggccttggtagttat

SEQ ID NO: 7201527 - DNA, 22 bp, Homo sapiens
aatgtgaggccttggtagttat

SEQ ID NO: 7201528 - DNA, 22 bp, Homo sapiens
aatgtgatctgtcatgatggca

SEQ ID NO: 7201529 - DNA, 22 bp, Homo sapiens
aatgtgattttctcactccctt

SEQ ID NO: 7201530 - DNA, 22 bp, Homo sapiens
aatgtgctggtaactgctttgc

SEQ ID NO: 7201531 - DNA, 22 bp, Homo sapiens
aatgtgcttctggctgtggtca

SEQ ID NO: 7201532 - DNA, 19 bp, Homo sapiens
aatgtgcttgggagactgc

SEQ ID NO: 7201533 - DNA, 22 bp, Homo sapiens
aatgtggacatctttgccttgt

SEQ ID NO: 7201534 - DNA, 22 bp, Homo sapiens
aatgtggattcacaagtgctca

SEQ ID NO: 7201535 - DNA, 20 bp, Homo sapiens
agaccctctggactgggccc

SEQ ID NO: 7201536 - DNA, 22 bp, Homo sapiens
agaccctggtaaacactccagg

SEQ ID NO: 7201537 - DNA, 22 bp, Homo sapiens
agaccctggggaaagtcacttc

SEQ ID NO: 7201538 - DNA, 22 bp, Homo sapiens
agaccctgcattttccagggtt

SEQ ID NO: 7201539 - DNA, 22 bp, Homo sapiens
agaccctggggaaagtcacttc

SEQ ID NO: 7201540 - DNA, 22 bp, Homo sapiens
aatgtgtacatgacagatagaa

SEQ ID NO: 7201541 - DNA, 22 bp, Homo sapiens
aatgtgtacatgacagatagaa

SEQ ID NO: 7201542 - DNA, 22 bp, Homo sapiens
agaccccctttaatggaagtgc

SEQ ID NO: 7201543 - DNA, 22 bp, Homo sapiens
agaccctctccatgcccactgc

SEQ ID NO: 7201544 - DNA, 22 bp, Homo sapiens
agaccctatgcaacatttcacc

SEQ ID NO: 7201545 - DNA, 22 bp, Homo sapiens
aatgtggggaagccatggctga

SEQ ID NO: 7201546 - DNA, 22 bp, Homo sapiens
aatgtgggggtgagctgtatat

SEQ ID NO: 7201547 - DNA, 21 bp, Homo sapiens
aatgtggtacattacatgcat

SEQ ID NO: 7201548 - DNA, 22 bp, Homo sapiens
agacccttgcagtctggttgtc

SEQ ID NO: 7201549 - DNA, 20 bp, Homo sapiens
agaccctgtgtcctgtggcc

SEQ ID NO: 7201550 - DNA, 22 bp, Homo sapiens
agaccctgttagttccagtctt

SEQ ID NO: 7201551 - DNA, 22 bp, Homo sapiens
agacccttcatgtagttcccca

SEQ ID NO: 7201552 - DNA, 18 bp, Homo sapiens
agacccttcccaggcttg

SEQ ID NO: 7201553 - DNA, 22 bp, Homo sapiens
agaccctttgggtctgtgcagg

SEQ ID NO: 7201554 - DNA, 19 bp, Homo sapiens
agaccgctcacgccgtgct

SEQ ID NO: 7201555 - DNA, 22 bp, Homo sapiens
agacctaaagtacccagcatat

SEQ ID NO: 7201556 - DNA, 20 bp, Homo sapiens
agaccctgtgtcctgtggcc

SEQ ID NO: 7201557 - DNA, 22 bp, Homo sapiens
aattaaaaaaggagagcttgct

SEQ ID NO: 7201558 - DNA, 22 bp, Homo sapiens
aattaaaaaaggagagcttgct

SEQ ID NO: 7201559 - DNA, 22 bp, Homo sapiens
aatgttttaaaagagattgaga

SEQ ID NO: 7201560 - DNA, 22 bp, Homo sapiens
aatgttttttggtctgatgaat

SEQ ID NO: 7201561 - DNA, 22 bp, Homo sapiens
agacctcaataccaggcaccac

SEQ ID NO: 7201562 - DNA, 22 bp, Homo sapiens
aatgtttggctagatagatgga

SEQ ID NO: 7201563 - DNA, 22 bp, Homo sapiens
aatgtttgtcatcacacagata

SEQ ID NO: 7201564 - DNA, 18 bp, Homo sapiens
aatgtttgtcctctctaa

SEQ ID NO: 7201565 - DNA, 22 bp, Homo sapiens
aatgttttaaaagagattgaga

SEQ ID NO: 7201566 - DNA, 22 bp, Homo sapiens
aatgttttaaaagagattgaga

SEQ ID NO: 7201567 - DNA, 22 bp, Homo sapiens
aattaaaagataacccatgagt

SEQ ID NO: 7201568 - DNA, 22 bp, Homo sapiens
aattaaaaaaggagagcttgct

SEQ ID NO: 7201569 - DNA, 22 bp, Homo sapiens
aattaaaagataacccatgagt

SEQ ID NO: 7201570 - DNA, 22 bp, Homo sapiens
aattaaaggtcatgttaaaggg

SEQ ID NO: 7201571 - DNA, 22 bp, Homo sapiens
aattaaaggtcatgttaaaggg

SEQ ID NO: 7201572 - DNA, 22 bp, Homo sapiens
aattaaatgacaggggaagatg

SEQ ID NO: 7201573 - DNA, 22 bp, Homo sapiens
aattaaatgacaggggaagatg

SEQ ID NO: 7201574 - DNA, 22 bp, Homo sapiens
aattaaatgacaggggaagatg

SEQ ID NO: 7201575 - DNA, 22 bp, Homo sapiens
aattaaatgacaggggaagatg

SEQ ID NO: 7201576 - DNA, 23 bp, Homo sapiens
aattaaattgctagatccagggc

SEQ ID NO: 7201577 - DNA, 23 bp, Homo sapiens
aattaaattgctagatccagggc

SEQ ID NO: 7201578 - DNA, 22 bp, Homo sapiens
aattaaattggtttagagagga

SEQ ID NO: 7201579 - DNA, 22 bp, Homo sapiens
aattaaattggtttagagagga

SEQ ID NO: 7201580 - DNA, 22 bp, Homo sapiens
aattaaattggtttagagagga

SEQ ID NO: 7201581 - DNA, 22 bp, Homo sapiens
aattaaattggtttagagagga

SEQ ID NO: 7201582 - DNA, 22 bp, Homo sapiens
agagacagatctgagggacctc

SEQ ID NO: 7201583 - DNA, 22 bp, Homo sapiens
aattaacagagggcttattact

SEQ ID NO: 7201584 - DNA, 22 bp, Homo sapiens
aattaacagagggcttattact

SEQ ID NO: 7201585 - DNA, 22 bp, Homo sapiens
agagacagatctgagggacctc

SEQ ID NO: 7201586 - DNA, 22 bp, Homo sapiens
agagacagatctgagggacctc

SEQ ID NO: 7201587 - DNA, 18 bp, Homo sapiens
agagacagcagcaaaaga

SEQ ID NO: 7201588 - DNA, 22 bp, Homo sapiens
agagacaggatatctgctcatg

SEQ ID NO: 7201589 - DNA, 22 bp, Homo sapiens
agagacaggatatctgctcatg

SEQ ID NO: 7201590 - DNA, 22 bp, Homo sapiens
agagacaggatatctgctcatg

SEQ ID NO: 7201591 - DNA, 22 bp, Homo sapiens
agagacaggagttctgtttcca

SEQ ID NO: 7201592 - DNA, 22 bp, Homo sapiens
agagacaggaatggcattaaga

SEQ ID NO: 7201593 - DNA, 18 bp, Homo sapiens
agagacagcagcaaaaga

SEQ ID NO: 7201594 - DNA, 18 bp, Homo sapiens
agagacagcagcaaaaga

SEQ ID NO: 7201595 - DNA, 22 bp, Homo sapiens
agagcctggacctgggctctga

SEQ ID NO: 7201596 - DNA, 22 bp, Homo sapiens
agagcctggacctgagctacaa

SEQ ID NO: 7201597 - DNA, 22 bp, Homo sapiens
agagcctggacctgagctacaa

SEQ ID NO: 7201598 - DNA, 22 bp, Homo sapiens
agagcctggacctgagctacaa

SEQ ID NO: 7201599 - DNA, 22 bp, Homo sapiens
agagcctgctgtgtaagtcaca

SEQ ID NO: 7201600 - DNA, 22 bp, Homo sapiens
agagcctgctgtgtaagtcaca

SEQ ID NO: 7201601 - DNA, 22 bp, Homo sapiens
agagcctgctacctcattccag

SEQ ID NO: 7201602 - DNA, 20 bp, Homo sapiens
agagcctggaaaaagacatc

SEQ ID NO: 7201603 - DNA, 22 bp, Homo sapiens
agagcctgcatcaggcttgggg

SEQ ID NO: 7201604 - DNA, 22 bp, Homo sapiens
agagcctgcatctagcctcaga

SEQ ID NO: 7201605 - DNA, 22 bp, Homo sapiens
agagcctgcatctagcctcaga

SEQ ID NO: 7201606 - DNA, 22 bp, Homo sapiens
agagcctgcatctagcctcaga

SEQ ID NO: 7201607 - DNA, 22 bp, Homo sapiens
agagccagttacaactgtggag

SEQ ID NO: 7201608 - DNA, 22 bp, Homo sapiens
agagccagttgttaagcactta

SEQ ID NO: 7201609 - DNA, 22 bp, Homo sapiens
agagccagttgttaagcactta

SEQ ID NO: 7201610 - DNA, 22 bp, Homo sapiens
agagccagttgttaagcactta

SEQ ID NO: 7201611 - DNA, 22 bp, Homo sapiens
agagccagttgttaagcactta

SEQ ID NO: 7201612 - DNA, 22 bp, Homo sapiens
aattccagggggtaccattcat

SEQ ID NO: 7201613 - DNA, 22 bp, Homo sapiens
aattccaggcagaaatgtgagt

SEQ ID NO: 7201614 - DNA, 22 bp, Homo sapiens
aattccaggcagaaatgtgagt

SEQ ID NO: 7201615 - DNA, 22 bp, Homo sapiens
agagcctggcaaaaggtcctgc

SEQ ID NO: 7201616 - DNA, 22 bp, Homo sapiens
agagcctggaggttctgctgaa

SEQ ID NO: 7201617 - DNA, 22 bp, Homo sapiens
agagcctggacctgggctctga

SEQ ID NO: 7201618 - DNA, 22 bp, Homo sapiens
agagcctggacttttctgagcc

SEQ ID NO: 7201619 - DNA, 22 bp, Homo sapiens
agagcctggacttttctgagcc

SEQ ID NO: 7201620 - DNA, 22 bp, Homo sapiens
agagcctggacttttctgagcc

SEQ ID NO: 7201621 - DNA, 22 bp, Homo sapiens
agagcctggaggttctgctgaa

SEQ ID NO: 7201622 - DNA, 22 bp, Homo sapiens
aattccagtaggcaccactcat

SEQ ID NO: 7201623 - DNA, 22 bp, Homo sapiens
aattctgatccagaacctgtca

SEQ ID NO: 7201624 - DNA, 22 bp, Homo sapiens
aattctgatgaataaatcatcc

SEQ ID NO: 7201625 - DNA, 22 bp, Homo sapiens
aattctgatgaataaatcatcc

SEQ ID NO: 7201626 - DNA, 22 bp, Homo sapiens
agagccaggcggctgggcacct

SEQ ID NO: 7201627 - DNA, 22 bp, Homo sapiens
agagccaggcggctgggcacct

SEQ ID NO: 7201628 - DNA, 22 bp, Homo sapiens
agagccaggctcccatggggca

SEQ ID NO: 7201629 - DNA, 22 bp, Homo sapiens
agagccaggctcccatggggca

SEQ ID NO: 7201630 - DNA, 22 bp, Homo sapiens
agagccaggctcccatggggca

SEQ ID NO: 7201631 - DNA, 22 bp, Homo sapiens
agagcaggtggcaactctggga

SEQ ID NO: 7201632 - DNA, 22 bp, Homo sapiens
agagcagtcattaatacatgta

SEQ ID NO: 7201633 - DNA, 22 bp, Homo sapiens
agagccaggcggctgggcacct

SEQ ID NO: 7201634 - DNA, 22 bp, Homo sapiens
agagccaggcggctgggcacct

SEQ ID NO: 7201635 - DNA, 22 bp, Homo sapiens
agagccaggcggctgggcacct

SEQ ID NO: 7201636 - DNA, 22 bp, Homo sapiens
agagacagggttttgccatgtt

SEQ ID NO: 7201637 - DNA, 22 bp, Homo sapiens
agagcaggtggcaactctggga

SEQ ID NO: 7201638 - DNA, 22 bp, Homo sapiens
agagacagggttttgccatgtt

SEQ ID NO: 7201639 - DNA, 22 bp, Homo sapiens
agagacagggttttgccatgtt

SEQ ID NO: 7201640 - DNA, 22 bp, Homo sapiens
agagacagggttttgccatgtt

SEQ ID NO: 7201641 - DNA, 22 bp, Homo sapiens
agagacaggatatctgctcatg

SEQ ID NO: 7201642 - DNA, 22 bp, Homo sapiens
agagacaggatatctgctcatg

SEQ ID NO: 7201643 - DNA, 22 bp, Homo sapiens
agagacaggatatctgctcatg

SEQ ID NO: 7201644 - DNA, 22 bp, Homo sapiens
agagacaggatatctgctcatg

SEQ ID NO: 7201645 - DNA, 22 bp, Homo sapiens
agagacaggatatctgctcatg

SEQ ID NO: 7201646 - DNA, 22 bp, Homo sapiens
agagccaggctctacctgggtt

SEQ ID NO: 7201647 - DNA, 22 bp, Homo sapiens
agagccaggtgctgctgtttga

SEQ ID NO: 7201648 - DNA, 22 bp, Homo sapiens
agagccaggtgctgctgtttga

SEQ ID NO: 7201649 - DNA, 22 bp, Homo sapiens
agagccaggctcccatggggca

SEQ ID NO: 7201650 - DNA, 22 bp, Homo sapiens
agagccaggctcccatggggca

SEQ ID NO: 7201651 - DNA, 22 bp, Homo sapiens
agagccaggctctacctgggtt

SEQ ID NO: 7201652 - DNA, 22 bp, Homo sapiens
agagccaggctctacctgggtt

SEQ ID NO: 7201653 - DNA, 22 bp, Homo sapiens
agagccaggctcccatggggca

SEQ ID NO: 7201654 - DNA, 22 bp, Homo sapiens
agagccagttacaactgtggag

SEQ ID NO: 7201655 - DNA, 22 bp, Homo sapiens
agagccagttacaactgtggag

SEQ ID NO: 7201656 - DNA, 22 bp, Homo sapiens
agagccagttacaactgtggag

SEQ ID NO: 7201657 - DNA, 22 bp, Homo sapiens
agagccagttacaactgtggag

SEQ ID NO: 7201658 - DNA, 22 bp, Homo sapiens
agagccagttacaactgtggag

SEQ ID NO: 7201659 - DNA, 22 bp, Homo sapiens
agagccagttaagcacttacag

SEQ ID NO: 7201660 - DNA, 22 bp, Homo sapiens
agagccagttaagcacttacag

SEQ ID NO: 7201661 - DNA, 22 bp, Homo sapiens
agagccagttaagcacttacag

SEQ ID NO: 7201662 - DNA, 22 bp, Homo sapiens
agagccagttaagcacttacag

SEQ ID NO: 7201663 - DNA, 22 bp, Homo sapiens
agagccaggtgtagtctcggag

SEQ ID NO: 7201664 - DNA, 22 bp, Homo sapiens
agagccaggtgtagtctcggag

SEQ ID NO: 7201665 - DNA, 22 bp, Homo sapiens
agagccaggtgtagtctcggag

SEQ ID NO: 7201666 - DNA, 22 bp, Homo sapiens
acaaagacgggataaggtttgg

SEQ ID NO: 7201667 - DNA, 22 bp, Homo sapiens
acaaagacgggataaggtttgg

SEQ ID NO: 7201668 - DNA, 22 bp, Homo sapiens
acaaagaaggaattggtcttta

SEQ ID NO: 7201669 - DNA, 22 bp, Homo sapiens
acaaagaaggaattggtcttta

SEQ ID NO: 7201670 - DNA, 22 bp, Homo sapiens
acaaagaaggaattggtcttta

SEQ ID NO: 7201671 - DNA, 19 bp, Homo sapiens
acaaagctgtgagcagctt

SEQ ID NO: 7201672 - DNA, 22 bp, Homo sapiens
acaaagcttagacctaagagat

SEQ ID NO: 7201673 - DNA, 21 bp, Homo sapiens
acaaaggaagtctcttttaag

SEQ ID NO: 7201674 - DNA, 21 bp, Homo sapiens
acaaaggaagtctcttttaag

SEQ ID NO: 7201675 - DNA, 18 bp, Homo sapiens
acaaaggatcatgaggga

SEQ ID NO: 7201676 - DNA, 18 bp, Homo sapiens
acaaaggatcatgaggga

SEQ ID NO: 7201677 - DNA, 18 bp, Homo sapiens
acaaaggatcatgaggga

SEQ ID NO: 7201678 - DNA, 18 bp, Homo sapiens
acaaaggatcatgaggga

SEQ ID NO: 7201679 - DNA, 22 bp, Homo sapiens
acaaaggcagagaattcaacat

SEQ ID NO: 7201680 - DNA, 22 bp, Homo sapiens
acaaaggcagagaattcaacat

SEQ ID NO: 7201681 - DNA, 22 bp, Homo sapiens
acaaaggcagccaatcatctgc

SEQ ID NO: 7201682 - DNA, 22 bp, Homo sapiens
acaaaggcagccaatcatctgc

SEQ ID NO: 7201683 - DNA, 22 bp, Homo sapiens
acaaaggcagccaatcatctgc

SEQ ID NO: 7201684 - DNA, 22 bp, Homo sapiens
agaggctgttacactcccagat

SEQ ID NO: 7201685 - DNA, 22 bp, Homo sapiens
agaggctgttacactcccagat

SEQ ID NO: 7201686 - DNA, 22 bp, Homo sapiens
agaggctgttacactcccagat

SEQ ID NO: 7201687 - DNA, 22 bp, Homo sapiens
agaggctgttacactcccagat

SEQ ID NO: 7201688 - DNA, 22 bp, Homo sapiens
agaggctgtgcccaccaggcaa

SEQ ID NO: 7201689 - DNA, 22 bp, Homo sapiens
agaggctgtgcccaccaggcaa

SEQ ID NO: 7201690 - DNA, 22 bp, Homo sapiens
agaggctgttacactcccagat

SEQ ID NO: 7201691 - DNA, 22 bp, Homo sapiens
agaggctgtgcccaccaggcaa

SEQ ID NO: 7201692 - DNA, 22 bp, Homo sapiens
agaggctgtgcccaccaggcaa

SEQ ID NO: 7201693 - DNA, 22 bp, Homo sapiens
agaggctgtgcccaccaggcaa

SEQ ID NO: 7201694 - DNA, 22 bp, Homo sapiens
agaggctgtgcccaccaggcaa

SEQ ID NO: 7201695 - DNA, 22 bp, Homo sapiens
agaggctgtgcccaccaggcaa

SEQ ID NO: 7201696 - DNA, 22 bp, Homo sapiens
agaggctgtgcagagggagtgc

SEQ ID NO: 7201697 - DNA, 22 bp, Homo sapiens
agaggctgatggagtagtgtct

SEQ ID NO: 7201698 - DNA, 22 bp, Homo sapiens
agaggctgatggagtagtgtct

SEQ ID NO: 7201699 - DNA, 18 bp, Homo sapiens
acaaaggtctgcaagacc

SEQ ID NO: 7201700 - DNA, 22 bp, Homo sapiens
acaaagggggactgcagagggt

SEQ ID NO: 7201701 - DNA, 22 bp, Homo sapiens
acaaagggggactgcagagggt

SEQ ID NO: 7201702 - DNA, 22 bp, Homo sapiens
acaaaggcaggattgacttagt

SEQ ID NO: 7201703 - DNA, 22 bp, Homo sapiens
acaaaggcaggattgacttagt

SEQ ID NO: 7201704 - DNA, 22 bp, Homo sapiens
acaaaggcaggattgacttagt

SEQ ID NO: 7201705 - DNA, 22 bp, Homo sapiens
acaaaggcaggattgacttagt

SEQ ID NO: 7201706 - DNA, 22 bp, Homo sapiens
acaaaggcaggattgacttagt

SEQ ID NO: 7201707 - DNA, 22 bp, Homo sapiens
acaaaggcatagtgaatgtttt

SEQ ID NO: 7201708 - DNA, 22 bp, Homo sapiens
acaaaggcatagtgaatgtttt

SEQ ID NO: 7201709 - DNA, 22 bp, Homo sapiens
acaaaggtgagcagaagacaca

SEQ ID NO: 7201710 - DNA, 18 bp, Homo sapiens
acaaaggtctgcaagacc

SEQ ID NO: 7201711 - DNA, 22 bp, Homo sapiens
acaaaggtgagcagaagacaca

SEQ ID NO: 7201712 - DNA, 22 bp, Homo sapiens
acaaaggttgggtcaattgtcc

SEQ ID NO: 7201713 - DNA, 22 bp, Homo sapiens
acaaagtaagggctaatgagca

SEQ ID NO: 7201714 - DNA, 22 bp, Homo sapiens
acaaagtaggaagattagctga

SEQ ID NO: 7201715 - DNA, 22 bp, Homo sapiens
acaaagtaggtcatcaaagctc

SEQ ID NO: 7201716 - DNA, 22 bp, Homo sapiens
acaaagtaggtcatcaaagctc

SEQ ID NO: 7201717 - DNA, 22 bp, Homo sapiens
acaaagtagtcaaagtagatga

SEQ ID NO: 7201718 - DNA, 20 bp, Homo sapiens
acaaagtattgaggacaagt

SEQ ID NO: 7201719 - DNA, 22 bp, Homo sapiens
agaggggctcatatcctgtcat

SEQ ID NO: 7201720 - DNA, 22 bp, Homo sapiens
agagggggaaaatagaggtgtt

SEQ ID NO: 7201721 - DNA, 22 bp, Homo sapiens
agagggggtgttccagaagcat

SEQ ID NO: 7201722 - DNA, 22 bp, Homo sapiens
agagggggtgttccagaagcat

SEQ ID NO: 7201723 - DNA, 22 bp, Homo sapiens
agaggggtgggcacagcgccca

SEQ ID NO: 7201724 - DNA, 22 bp, Homo sapiens
agagggggtgttccagaagcat

SEQ ID NO: 7201725 - DNA, 22 bp, Homo sapiens
agagggggtgttccagaagcat

SEQ ID NO: 7201726 - DNA, 22 bp, Homo sapiens
agagggggtgtcagcactgcag

SEQ ID NO: 7201727 - DNA, 22 bp, Homo sapiens
agagggggtgtcagcactgcag

SEQ ID NO: 7201728 - DNA, 22 bp, Homo sapiens
agagggggtgtcagcactgcag

SEQ ID NO: 7201729 - DNA, 22 bp, Homo sapiens
agagggggcagcggaccagtga

SEQ ID NO: 7201730 - DNA, 22 bp, Homo sapiens
agagggggtgtcagcactgcag

SEQ ID NO: 7201731 - DNA, 22 bp, Homo sapiens
agagggggaaaatagaggtgtt

SEQ ID NO: 7201732 - DNA, 22 bp, Homo sapiens
agagggggaaaatagaggtgtt

SEQ ID NO: 7201733 - DNA, 22 bp, Homo sapiens
agagggggaaaatagaggtgtt

SEQ ID NO: 7201734 - DNA, 22 bp, Homo sapiens
agagggggaaaatagaggtgtt

SEQ ID NO: 7201735 - DNA, 22 bp, Homo sapiens
agagggggaaaatagaggtgtt

SEQ ID NO: 7201736 - DNA, 22 bp, Homo sapiens
agagggggaaaatagaggtgtt

SEQ ID NO: 7201737 - DNA, 22 bp, Homo sapiens
agagggggcagcggaccagtga

SEQ ID NO: 7201738 - DNA, 18 bp, Homo sapiens
agaggctcgatactagaa

SEQ ID NO: 7201739 - DNA, 22 bp, Homo sapiens
agaggctctaaggttggatcaa

SEQ ID NO: 7201740 - DNA, 18 bp, Homo sapiens
agaggctcgatactagaa

SEQ ID NO: 7201741 - DNA, 18 bp, Homo sapiens
agaggctcgatactagaa

SEQ ID NO: 7201742 - DNA, 22 bp, Homo sapiens
agaggccctctctctcctgatg

SEQ ID NO: 7201743 - DNA, 22 bp, Homo sapiens
aattgctagactatactgtaat

SEQ ID NO: 7201744 - DNA, 22 bp, Homo sapiens
aattgcttagagaatccaggta

SEQ ID NO: 7201745 - DNA, 22 bp, Homo sapiens
aattgcttcattaacatttagg

SEQ ID NO: 7201746 - DNA, 22 bp, Homo sapiens
agaggctgagaaaccctcttct

SEQ ID NO: 7201747 - DNA, 22 bp, Homo sapiens
agaggctgagaaaccctcttct

SEQ ID NO: 7201748 - DNA, 22 bp, Homo sapiens
agaggctgaatgatgtcatcat

SEQ ID NO: 7201749 - DNA, 22 bp, Homo sapiens
agaggctctttgcttgttctta

SEQ ID NO: 7201750 - DNA, 22 bp, Homo sapiens
agaggctgaatgatgtcatcat

SEQ ID NO: 7201751 - DNA, 22 bp, Homo sapiens
agaggctgaatgatgtcatcat

SEQ ID NO: 7201752 - DNA, 22 bp, Homo sapiens
agaggctctttgagctgggaga

SEQ ID NO: 7201753 - DNA, 22 bp, Homo sapiens
agaggctcttgcccttcccaca

SEQ ID NO: 7201754 - DNA, 22 bp, Homo sapiens
agaggctctaatcccctccaca

SEQ ID NO: 7201755 - DNA, 22 bp, Homo sapiens
agaggctctaataccagcatgg

SEQ ID NO: 7201756 - DNA, 22 bp, Homo sapiens
agaggctctaataccagcatgg

SEQ ID NO: 7201757 - DNA, 22 bp, Homo sapiens
agaggctctgccgcctcaggta

SEQ ID NO: 7201758 - DNA, 22 bp, Homo sapiens
agaggctctgccgcctcaggta

SEQ ID NO: 7201759 - DNA, 22 bp, Homo sapiens
agaggctctggtgcagcatgca

SEQ ID NO: 7201760 - DNA, 22 bp, Homo sapiens
agaggctctggtgcagcatgca

SEQ ID NO: 7201761 - DNA, 22 bp, Homo sapiens
agaggctctggtgggagttggt

SEQ ID NO: 7201762 - DNA, 22 bp, Homo sapiens
agaggctctggtgggagttggt

SEQ ID NO: 7201763 - DNA, 22 bp, Homo sapiens
agaggctcttgcccttcccaca

SEQ ID NO: 7201764 - DNA, 22 bp, Homo sapiens
agaggctcttgcccttcccaca

SEQ ID NO: 7201765 - DNA, 22 bp, Homo sapiens
aattcttaatcccataaagtga

SEQ ID NO: 7201766 - DNA, 22 bp, Homo sapiens
aattcttcaagtgctttggaga

SEQ ID NO: 7201767 - DNA, 22 bp, Homo sapiens
aattcttaatcccataaagtga

SEQ ID NO: 7201768 - DNA, 22 bp, Homo sapiens
aattcttaatcccataaagtga

SEQ ID NO: 7201769 - DNA, 22 bp, Homo sapiens
aattctgtgcaggcagagctat

SEQ ID NO: 7201770 - DNA, 22 bp, Homo sapiens
aattgaaaatattgtagaccat

SEQ ID NO: 7201771 - DNA, 22 bp, Homo sapiens
aattgaacaagtaatagaagag

SEQ ID NO: 7201772 - DNA, 22 bp, Homo sapiens
aattgaacaagtaatagaagag

SEQ ID NO: 7201773 - DNA, 22 bp, Homo sapiens
aattgaacaagtaatagaagag

SEQ ID NO: 7201774 - DNA, 22 bp, Homo sapiens
aattgaacttgatctttagcta

SEQ ID NO: 7201775 - DNA, 22 bp, Homo sapiens
aattgacaaatcatacttgtat

SEQ ID NO: 7201776 - DNA, 22 bp, Homo sapiens
aattgcaattttcttaaggtct

SEQ ID NO: 7201777 - DNA, 22 bp, Homo sapiens
aattgcactttagcaatggtga

SEQ ID NO: 7201778 - DNA, 22 bp, Homo sapiens
aattgcaacaggtagacttttc

SEQ ID NO: 7201779 - DNA, 22 bp, Homo sapiens
aattgcataaaattcaactctg

SEQ ID NO: 7201780 - DNA, 22 bp, Homo sapiens
aattgcatgttaatgactaagt

SEQ ID NO: 7201781 - DNA, 22 bp, Homo sapiens
aattgacagaaagtttacgagg

SEQ ID NO: 7201782 - DNA, 22 bp, Homo sapiens
aattgagtcatgctgtattgaa

SEQ ID NO: 7201783 - DNA, 22 bp, Homo sapiens
aattgatggacagagatgaaga

SEQ ID NO: 7201784 - DNA, 22 bp, Homo sapiens
aattgatgggcactgaaatatt

SEQ ID NO: 7201785 - DNA, 22 bp, Homo sapiens
aattgatgtctaccacatgcct

SEQ ID NO: 7201786 - DNA, 22 bp, Homo sapiens
aattgcaacaggtagacttttc

SEQ ID NO: 7201787 - DNA, 17 bp, Homo sapiens
acaacagaaatgtattc

SEQ ID NO: 7201788 - DNA, 17 bp, Homo sapiens
acaacagaaatgtattc

SEQ ID NO: 7201789 - DNA, 17 bp, Homo sapiens
acaacagaaatgtattc

SEQ ID NO: 7201790 - DNA, 17 bp, Homo sapiens
acaacagaaatgtattc

SEQ ID NO: 7201791 - DNA, 17 bp, Homo sapiens
acaacagaaatgtattc

SEQ ID NO: 7201792 - DNA, 22 bp, Homo sapiens
acaacacatgtgtatatgtgtg

SEQ ID NO: 7201793 - DNA, 22 bp, Homo sapiens
acaacacatgtgtatatgtgtg

SEQ ID NO: 7201794 - DNA, 22 bp, Homo sapiens
acaacacatgtgtatatgtgtg

SEQ ID NO: 7201795 - DNA, 22 bp, Homo sapiens
acaacagagctggactgagagg

SEQ ID NO: 7201796 - DNA, 22 bp, Homo sapiens
agataacatgttgcagattctg

SEQ ID NO: 7201797 - DNA, 22 bp, Homo sapiens
agataacatttattgaatgtaa

SEQ ID NO: 7201798 - DNA, 22 bp, Homo sapiens
agataacatttattgaatgtaa

SEQ ID NO: 7201799 - DNA, 22 bp, Homo sapiens
acaacacagctttcctcaagtt

SEQ ID NO: 7201800 - DNA, 22 bp, Homo sapiens
acaacaagagctaagggtaagg

SEQ ID NO: 7201801 - DNA, 22 bp, Homo sapiens
acaacaatctaccctagcttct

SEQ ID NO: 7201802 - DNA, 22 bp, Homo sapiens
agaggggttaagtgctagtccg

SEQ ID NO: 7201803 - DNA, 22 bp, Homo sapiens
agaggggtggtgctctcctgga

SEQ ID NO: 7201804 - DNA, 22 bp, Homo sapiens
agaggggttaagtgctagtccg

SEQ ID NO: 7201805 - DNA, 19 bp, Homo sapiens
acaaattggcaaaatgcaa

SEQ ID NO: 7201806 - DNA, 19 bp, Homo sapiens
acaaattggcaaaatgcaa

SEQ ID NO: 7201807 - DNA, 20 bp, Homo sapiens
acaaattggcagaatgacaa

SEQ ID NO: 7201808 - DNA, 20 bp, Homo sapiens
acaaattggcagaatgacaa

SEQ ID NO: 7201809 - DNA, 20 bp, Homo sapiens
acaacaaacttgcttaagga

SEQ ID NO: 7201810 - DNA, 22 bp, Homo sapiens
agataacttttgggtattcatg

SEQ ID NO: 7201811 - DNA, 22 bp, Homo sapiens
agataagatagtccagcacaat

SEQ ID NO: 7201812 - DNA, 22 bp, Homo sapiens
agataagctgtttttcaagaat

SEQ ID NO: 7201813 - DNA, 17 bp, Homo sapiens
agataagcttcagagct

SEQ ID NO: 7201814 - DNA, 22 bp, Homo sapiens
agataataaatgttttaggttt

SEQ ID NO: 7201815 - DNA, 22 bp, Homo sapiens
agataataagtctggtaataat

SEQ ID NO: 7201816 - DNA, 22 bp, Homo sapiens
agataatgaatgccatgacatt

SEQ ID NO: 7201817 - DNA, 22 bp, Homo sapiens
agataatgaatttattgaatgt

SEQ ID NO: 7201818 - DNA, 22 bp, Homo sapiens
acaaccttctggagatatctgt

SEQ ID NO: 7201819 - DNA, 22 bp, Homo sapiens
acaagaattatttctagttaac

SEQ ID NO: 7201820 - DNA, 22 bp, Homo sapiens
acaagaattatttctagttaac

SEQ ID NO: 7201821 - DNA, 22 bp, Homo sapiens
acaagagattatctacagatga

SEQ ID NO: 7201822 - DNA, 22 bp, Homo sapiens
acaagagattatctacagatga

SEQ ID NO: 7201823 - DNA, 22 bp, Homo sapiens
acaagagattatctacagatga

SEQ ID NO: 7201824 - DNA, 22 bp, Homo sapiens
acaagagacaagaggttcttct

SEQ ID NO: 7201825 - DNA, 22 bp, Homo sapiens
acaagagattatctacagatga

SEQ ID NO: 7201826 - DNA, 22 bp, Homo sapiens
acaagagattatctacagatga

SEQ ID NO: 7201827 - DNA, 22 bp, Homo sapiens
acaagaattatttctagttaac

SEQ ID NO: 7201828 - DNA, 22 bp, Homo sapiens
acaagaatttacatgtagtgga

SEQ ID NO: 7201829 - DNA, 22 bp, Homo sapiens
acaagactgtgctctaagagtg

SEQ ID NO: 7201830 - DNA, 22 bp, Homo sapiens
acaagagtgagattatcatgta

SEQ ID NO: 7201831 - DNA, 22 bp, Homo sapiens
acaagataaggtgtcagtgtgt

SEQ ID NO: 7201832 - DNA, 22 bp, Homo sapiens
acaagatactcagctacaagac

SEQ ID NO: 7201833 - DNA, 22 bp, Homo sapiens
acaagatactcagctacaagac

SEQ ID NO: 7201834 - DNA, 22 bp, Homo sapiens
acaagatactcagctacaagac

SEQ ID NO: 7201835 - DNA, 22 bp, Homo sapiens
acaatgaatttaataccttatt

SEQ ID NO: 7201836 - DNA, 22 bp, Homo sapiens
acaatgaccaaaatgtttccag

SEQ ID NO: 7201837 - DNA, 22 bp, Homo sapiens
acaatgatgcagatgagtaaga

SEQ ID NO: 7201838 - DNA, 22 bp, Homo sapiens
acaatgattttttagagtagtt

SEQ ID NO: 7201839 - DNA, 22 bp, Homo sapiens
acaatgcaataggagctagaaa

SEQ ID NO: 7201840 - DNA, 22 bp, Homo sapiens
acaatgcaataggagctagaaa

SEQ ID NO: 7201841 - DNA, 22 bp, Homo sapiens
acaatgaagctccactgagctt

SEQ ID NO: 7201842 - DNA, 22 bp, Homo sapiens
acaatgaagataatgttgcagt

SEQ ID NO: 7201843 - DNA, 22 bp, Homo sapiens
acaatgaagataatgttgcagt

SEQ ID NO: 7201844 - DNA, 22 bp, Homo sapiens
acaatgaagggagacacttgct

SEQ ID NO: 7201845 - DNA, 22 bp, Homo sapiens
acaatgaagggagacacttgct

SEQ ID NO: 7201846 - DNA, 22 bp, Homo sapiens
acaatgaagggagacacttgct

SEQ ID NO: 7201847 - DNA, 22 bp, Homo sapiens
acaatgaatactaagcaccagg

SEQ ID NO: 7201848 - DNA, 22 bp, Homo sapiens
acaatgaatatcatgaagtact

SEQ ID NO: 7201849 - DNA, 22 bp, Homo sapiens
acaatgaatatcatgaagtact

SEQ ID NO: 7201850 - DNA, 22 bp, Homo sapiens
acaatgaatatcatgaagtact

SEQ ID NO: 7201851 - DNA, 22 bp, Homo sapiens
acaatgaatatcatgaagtact

SEQ ID NO: 7201852 - DNA, 19 bp, Homo sapiens
acaatgaatgtgttctctt

SEQ ID NO: 7201853 - DNA, 22 bp, Homo sapiens
acaatgaacgctttttaactgt

SEQ ID NO: 7201854 - DNA, 22 bp, Homo sapiens
acaatgaaccaaatttaccaat

SEQ ID NO: 7201855 - DNA, 22 bp, Homo sapiens
acaatgaaccaaatttaccaat

SEQ ID NO: 7201856 - DNA, 22 bp, Homo sapiens
acaatgaacgctttttaactgt

SEQ ID NO: 7201857 - DNA, 22 bp, Homo sapiens
acaatgaaaggtattctgaact

SEQ ID NO: 7201858 - DNA, 22 bp, Homo sapiens
acaatgaaaggtattctgaact

SEQ ID NO: 7201859 - DNA, 22 bp, Homo sapiens
acaatgaacacacaaggaattc

SEQ ID NO: 7201860 - DNA, 22 bp, Homo sapiens
acaatgaacacacaaggaattc

SEQ ID NO: 7201861 - DNA, 22 bp, Homo sapiens
acaatgaacacacaaggaattc

SEQ ID NO: 7201862 - DNA, 22 bp, Homo sapiens
acaatgaaccaaatttaccaat

SEQ ID NO: 7201863 - DNA, 22 bp, Homo sapiens
acaatgaaagcaagaagacggc

SEQ ID NO: 7201864 - DNA, 22 bp, Homo sapiens
acaatgaaagcaagaagacggc

SEQ ID NO: 7201865 - DNA, 22 bp, Homo sapiens
acaatcttattagtagtataga

SEQ ID NO: 7201866 - DNA, 22 bp, Homo sapiens
acaatgaaaaaatttactgtgg

SEQ ID NO: 7201867 - DNA, 22 bp, Homo sapiens
acaatcattccgttcacaacag

SEQ ID NO: 7201868 - DNA, 22 bp, Homo sapiens
acaatcattggcttcattacaa

SEQ ID NO: 7201869 - DNA, 18 bp, Homo sapiens
acaatctgaaacctgtca

SEQ ID NO: 7201870 - DNA, 22 bp, Homo sapiens
acaatagacaaagtgaatggct

SEQ ID NO: 7201871 - DNA, 22 bp, Homo sapiens
acaatagacaaagtgaatggct

SEQ ID NO: 7201872 - DNA, 22 bp, Homo sapiens
acaagcttccaggtgatgctga

SEQ ID NO: 7201873 - DNA, 22 bp, Homo sapiens
acaagcttccaggtgatgctga

SEQ ID NO: 7201874 - DNA, 21 bp, Homo sapiens
acaatagaatagagtgtggtg

SEQ ID NO: 7201875 - DNA, 21 bp, Homo sapiens
acaatagaatagagtgtggtg

SEQ ID NO: 7201876 - DNA, 22 bp, Homo sapiens
acaatagacaaagtgaatggct

SEQ ID NO: 7201877 - DNA, 22 bp, Homo sapiens
acaatagacaaagtgaatggct

SEQ ID NO: 7201878 - DNA, 22 bp, Homo sapiens
acaagctcacatcagccaatga

SEQ ID NO: 7201879 - DNA, 22 bp, Homo sapiens
acaagctccttattcagctggg

SEQ ID NO: 7201880 - DNA, 22 bp, Homo sapiens
acaagctgtggtgggacaagag

SEQ ID NO: 7201881 - DNA, 22 bp, Homo sapiens
acaagcatgggctttgacatca

SEQ ID NO: 7201882 - DNA, 17 bp, Homo sapiens
acaagcagtggccatgg

SEQ ID NO: 7201883 - DNA, 17 bp, Homo sapiens
acaagcagtggccatgg

SEQ ID NO: 7201884 - DNA, 17 bp, Homo sapiens
acaagcagtggccatgg

SEQ ID NO: 7201885 - DNA, 22 bp, Homo sapiens
acaagcagtaaaggccacagtc

SEQ ID NO: 7201886 - DNA, 23 bp, Homo sapiens
acaagatagggataaaaagataa

SEQ ID NO: 7201887 - DNA, 22 bp, Homo sapiens
acaagatagcttagaagattca

SEQ ID NO: 7201888 - DNA, 22 bp, Homo sapiens
acaagataggttgagtctagcc

SEQ ID NO: 7201889 - DNA, 22 bp, Homo sapiens
acaagatggaatattgagaaaa

SEQ ID NO: 7201890 - DNA, 22 bp, Homo sapiens
acaagatgtgtttatacaagct

SEQ ID NO: 7201891 - DNA, 22 bp, Homo sapiens
acaagatgtgtttatacaagct

SEQ ID NO: 7201892 - DNA, 22 bp, Homo sapiens
acaagatgtgtttatacaagct

SEQ ID NO: 7201893 - DNA, 22 bp, Homo sapiens
acaagattcaatgaattgattg

SEQ ID NO: 7201894 - DNA, 22 bp, Homo sapiens
acaagattcaatgaattgattg

SEQ ID NO: 7201895 - DNA, 22 bp, Homo sapiens
acaagattgataagtctgccct

SEQ ID NO: 7201896 - DNA, 22 bp, Homo sapiens
acaagatttaatgcaacccaag

SEQ ID NO: 7201897 - DNA, 22 bp, Homo sapiens
acaagatttagcttaaagggct

SEQ ID NO: 7201898 - DNA, 22 bp, Homo sapiens
acaagatttggctgaaactcca

SEQ ID NO: 7201899 - DNA, 22 bp, Homo sapiens
acaagattttatgactcttttt

SEQ ID NO: 7201900 - DNA, 22 bp, Homo sapiens
acaagattttatgactcttttt

SEQ ID NO: 7201901 - DNA, 22 bp, Homo sapiens
acaagattttgtctggtagggt

SEQ ID NO: 7201902 - DNA, 22 bp, Homo sapiens
acaagcacttcactgtcctctg

SEQ ID NO: 7201903 - DNA, 22 bp, Homo sapiens
acaagcagaaggtggggtctta

SEQ ID NO: 7201904 - DNA, 22 bp, Homo sapiens
acaagcagagattaaatgtttt

SEQ ID NO: 7201905 - DNA, 22 bp, Homo sapiens
agcagctggttcccgagggcgt

SEQ ID NO: 7201906 - DNA, 22 bp, Homo sapiens
agcagctggttcccgagggcgt

SEQ ID NO: 7201907 - DNA, 22 bp, Homo sapiens
agcagctgtactttcatctgtt

SEQ ID NO: 7201908 - DNA, 22 bp, Homo sapiens
acacaggcatagccatacatgt

SEQ ID NO: 7201909 - DNA, 22 bp, Homo sapiens
acacaggcatagccatacatgt

SEQ ID NO: 7201910 - DNA, 18 bp, Homo sapiens
acacaggctgacagcacc

SEQ ID NO: 7201911 - DNA, 18 bp, Homo sapiens
acacaggctgacagcacc

SEQ ID NO: 7201912 - DNA, 18 bp, Homo sapiens
acacaggctgacagcacc

SEQ ID NO: 7201913 - DNA, 18 bp, Homo sapiens
acacaggctgacagcacc

SEQ ID NO: 7201914 - DNA, 17 bp, Homo sapiens
acacagggagagggagc

SEQ ID NO: 7201915 - DNA, 17 bp, Homo sapiens
acacagggagagggagc

SEQ ID NO: 7201916 - DNA, 17 bp, Homo sapiens
acacagggagagggagc

SEQ ID NO: 7201917 - DNA, 17 bp, Homo sapiens
acacagggagagggagc

SEQ ID NO: 7201918 - DNA, 22 bp, Homo sapiens
acacagggatatttcaggtggt

SEQ ID NO: 7201919 - DNA, 19 bp, Homo sapiens
acacagggatcagagggtt

SEQ ID NO: 7201920 - DNA, 22 bp, Homo sapiens
acacagggcggaaagcatgaga

SEQ ID NO: 7201921 - DNA, 22 bp, Homo sapiens
acacatctgcaagagccagacc

SEQ ID NO: 7201922 - DNA, 22 bp, Homo sapiens
acacatcttagactgaaatatg

SEQ ID NO: 7201923 - DNA, 22 bp, Homo sapiens
acacatcttagactgaaatatg

SEQ ID NO: 7201924 - DNA, 22 bp, Homo sapiens
acacatcttagactgaaatatg

SEQ ID NO: 7201925 - DNA, 22 bp, Homo sapiens
acacatgtaaaacacttagcaa

SEQ ID NO: 7201926 - DNA, 22 bp, Homo sapiens
acacatgtaaaacacttagcaa

SEQ ID NO: 7201927 - DNA, 22 bp, Homo sapiens
acacatgtaaaacacttagcaa

SEQ ID NO: 7201928 - DNA, 19 bp, Homo sapiens
acacagggatcagagggtt

SEQ ID NO: 7201929 - DNA, 19 bp, Homo sapiens
acacagggatcagagggtt

SEQ ID NO: 7201930 - DNA, 22 bp, Homo sapiens
acacagggcagagagctggctc

SEQ ID NO: 7201931 - DNA, 22 bp, Homo sapiens
acacagggcagagagctggctc

SEQ ID NO: 7201932 - DNA, 22 bp, Homo sapiens
acacatgtgtctgcatgcagtg

SEQ ID NO: 7201933 - DNA, 22 bp, Homo sapiens
acacatgtgtctgcatgcagtg

SEQ ID NO: 7201934 - DNA, 20 bp, Homo sapiens
acacatgtgcgtgttcagta

SEQ ID NO: 7201935 - DNA, 22 bp, Homo sapiens
acacatgtgtctgcatgcagtg

SEQ ID NO: 7201936 - DNA, 19 bp, Homo sapiens
acacatgtgtgttatgtgc

SEQ ID NO: 7201937 - DNA, 19 bp, Homo sapiens
acacatgtgtgttatgtgc

SEQ ID NO: 7201938 - DNA, 22 bp, Homo sapiens
acacatgttcaagaatgttcag

SEQ ID NO: 7201939 - DNA, 22 bp, Homo sapiens
acacatgttcaagaatgttcag

SEQ ID NO: 7201940 - DNA, 22 bp, Homo sapiens
acacatgttcaagaatgttcag

SEQ ID NO: 7201941 - DNA, 22 bp, Homo sapiens
acacatgtttacagtcttcagt

SEQ ID NO: 7201942 - DNA, 23 bp, Homo sapiens
acacatgtttatgcttgggggca

SEQ ID NO: 7201943 - DNA, 22 bp, Homo sapiens
acacatgtttccaaaagcaccc

SEQ ID NO: 7201944 - DNA, 22 bp, Homo sapiens
acacatgtttgtgtagtcagtt

SEQ ID NO: 7201945 - DNA, 22 bp, Homo sapiens
acacattaaaacgtctacaatg

SEQ ID NO: 7201946 - DNA, 22 bp, Homo sapiens
acacattaaaacgtctacaatg

SEQ ID NO: 7201947 - DNA, 19 bp, Homo sapiens
acacatgtaacagtttttc

SEQ ID NO: 7201948 - DNA, 19 bp, Homo sapiens
acacatgtaacagtttttc

SEQ ID NO: 7201949 - DNA, 22 bp, Homo sapiens
acacatgtacagattagtattt

SEQ ID NO: 7201950 - DNA, 22 bp, Homo sapiens
acacatgtacagattagtattt

SEQ ID NO: 7201951 - DNA, 22 bp, Homo sapiens
acacatgtacagattagtattt

SEQ ID NO: 7201952 - DNA, 22 bp, Homo sapiens
acacatgtacagattagtattt

SEQ ID NO: 7201953 - DNA, 22 bp, Homo sapiens
acacatgtatatgcttgtgtgt

SEQ ID NO: 7201954 - DNA, 22 bp, Homo sapiens
acacatgtatatgcttgtgtgt

SEQ ID NO: 7201955 - DNA, 22 bp, Homo sapiens
acacatgtatatgcttgtgtgt

SEQ ID NO: 7201956 - DNA, 22 bp, Homo sapiens
acacatgtatggcacttacatt

SEQ ID NO: 7201957 - DNA, 22 bp, Homo sapiens
acacatgtatggcacttacatt

SEQ ID NO: 7201958 - DNA, 22 bp, Homo sapiens
acacatgtatggcacttacatt

SEQ ID NO: 7201959 - DNA, 22 bp, Homo sapiens
acacatgtatgttttgtatttg

SEQ ID NO: 7201960 - DNA, 22 bp, Homo sapiens
acacatgtgattctaagacagc

SEQ ID NO: 7201961 - DNA, 22 bp, Homo sapiens
acacatgtgattctaagacagc

SEQ ID NO: 7201962 - DNA, 22 bp, Homo sapiens
acacatgtgattctaagacagc

SEQ ID NO: 7201963 - DNA, 22 bp, Homo sapiens
acacatgtgattctaagacagc

SEQ ID NO: 7201964 - DNA, 20 bp, Homo sapiens
acacatgtgcgtgttcagta

SEQ ID NO: 7201965 - DNA, 20 bp, Homo sapiens
acacatgtgcgtgttcagta

SEQ ID NO: 7201966 - DNA, 20 bp, Homo sapiens
acacatgtgcgtgttcagta

SEQ ID NO: 7201967 - DNA, 22 bp, Homo sapiens
acacatgtatgttttgtatttg

SEQ ID NO: 7201968 - DNA, 22 bp, Homo sapiens
acacatgtatgttttgtatttg

SEQ ID NO: 7201969 - DNA, 20 bp, Homo sapiens
acacatgtcaagctaaaggc

SEQ ID NO: 7201970 - DNA, 20 bp, Homo sapiens
acacatgtcaagctaaaggc

SEQ ID NO: 7201971 - DNA, 22 bp, Homo sapiens
acacatgtgattctaagacagc

SEQ ID NO: 7201972 - DNA, 22 bp, Homo sapiens
acacatgtgattctaagacagc

SEQ ID NO: 7201973 - DNA, 22 bp, Homo sapiens
acactgaatgtttaagaacttg

SEQ ID NO: 7201974 - DNA, 22 bp, Homo sapiens
acactgaatgtttaagaacttg

SEQ ID NO: 7201975 - DNA, 22 bp, Homo sapiens
acactgaatgtttaagaacttg

SEQ ID NO: 7201976 - DNA, 22 bp, Homo sapiens
acactgaatgtttaagaacttg

SEQ ID NO: 7201977 - DNA, 19 bp, Homo sapiens
acactgaatgtagaattgg

SEQ ID NO: 7201978 - DNA, 19 bp, Homo sapiens
acactgaatgtagaattgg

SEQ ID NO: 7201979 - DNA, 22 bp, Homo sapiens
acactgaatgctgtttagaaat

SEQ ID NO: 7201980 - DNA, 22 bp, Homo sapiens
acactgaatgctgtttagaaat

SEQ ID NO: 7201981 - DNA, 22 bp, Homo sapiens
acactgaatgctgtttagaaat

SEQ ID NO: 7201982 - DNA, 22 bp, Homo sapiens
acactgagctgagcattcttgt

SEQ ID NO: 7201983 - DNA, 22 bp, Homo sapiens
acactgagcatctctagaggca

SEQ ID NO: 7201984 - DNA, 22 bp, Homo sapiens
acactgagcatctctagaggca

SEQ ID NO: 7201985 - DNA, 22 bp, Homo sapiens
acactgagccatacaactggaa

SEQ ID NO: 7201986 - DNA, 22 bp, Homo sapiens
acactgagctgagcattcttgt

SEQ ID NO: 7201987 - DNA, 22 bp, Homo sapiens
acactgagctgagcattcttgt

SEQ ID NO: 7201988 - DNA, 22 bp, Homo sapiens
acactgagattttcctgacacc

SEQ ID NO: 7201989 - DNA, 22 bp, Homo sapiens
acactgagattttcctgacacc

SEQ ID NO: 7201990 - DNA, 22 bp, Homo sapiens
acactgagattttcctgacacc

SEQ ID NO: 7201991 - DNA, 22 bp, Homo sapiens
acactgacgcttgacagtcacc

SEQ ID NO: 7201992 - DNA, 22 bp, Homo sapiens
acactgacgcttgacagtcacc

SEQ ID NO: 7201993 - DNA, 22 bp, Homo sapiens
acactgagaggtgacagcgtgc

SEQ ID NO: 7201994 - DNA, 22 bp, Homo sapiens
acacttcacccctgctcccagt

SEQ ID NO: 7201995 - DNA, 22 bp, Homo sapiens
acactgcagatgaaagcataag

SEQ ID NO: 7201996 - DNA, 19 bp, Homo sapiens
acactgatcagatcagcag

SEQ ID NO: 7201997 - DNA, 22 bp, Homo sapiens
acactgatgttggccctggtca

SEQ ID NO: 7201998 - DNA, 22 bp, Homo sapiens
acactgattgtagtctgtggtg

SEQ ID NO: 7201999 - DNA, 22 bp, Homo sapiens
acactgattgtagtctgtggtg

SEQ ID NO: 7202000 - DNA, 22 bp, Homo sapiens
acactgagttttaccaggcaca

SEQ ID NO: 7202001 - DNA, 22 bp, Homo sapiens
acactgagtgtagaaatagcca

SEQ ID NO: 7202002 - DNA, 21 bp, Homo sapiens
acactgagtgaattagcacat

SEQ ID NO: 7202003 - DNA, 22 bp, Homo sapiens
acactttacagcttcctttgca

SEQ ID NO: 7202004 - DNA, 22 bp, Homo sapiens
acacttcagcagtatgcttggg

SEQ ID NO: 7202005 - DNA, 22 bp, Homo sapiens
acacttcagctccacaaacatt

SEQ ID NO: 7202006 - DNA, 22 bp, Homo sapiens
acacttcagctccacaaacatt

SEQ ID NO: 7202007 - DNA, 22 bp, Homo sapiens
acactttacagaatgttttgat

SEQ ID NO: 7202008 - DNA, 22 bp, Homo sapiens
acactttagtatgaagaggtag

SEQ ID NO: 7202009 - DNA, 22 bp, Homo sapiens
acactttagtatgaagaggtag

SEQ ID NO: 7202010 - DNA, 22 bp, Homo sapiens
acactttagaaaaaagaatggt

SEQ ID NO: 7202011 - DNA, 22 bp, Homo sapiens
acactgaataattgagagttga

SEQ ID NO: 7202012 - DNA, 22 bp, Homo sapiens
acactgaatatacaatgaatat

SEQ ID NO: 7202013 - DNA, 22 bp, Homo sapiens
acactgaatatacaatgaatat

SEQ ID NO: 7202014 - DNA, 22 bp, Homo sapiens
acactgaatatacaatgaatat

SEQ ID NO: 7202015 - DNA, 22 bp, Homo sapiens
acactgaagagcactttcaaag

SEQ ID NO: 7202016 - DNA, 22 bp, Homo sapiens
acactctttctgtgggtcacat

SEQ ID NO: 7202017 - DNA, 22 bp, Homo sapiens
acactctttcactaccttaatt

SEQ ID NO: 7202018 - DNA, 23 bp, Homo sapiens
acactcttcccagaaggttctga

SEQ ID NO: 7202019 - DNA, 22 bp, Homo sapiens
acactgaagagcactttcaaag

SEQ ID NO: 7202020 - DNA, 22 bp, Homo sapiens
acactcttctcacagtcagttt

SEQ ID NO: 7202021 - DNA, 23 bp, Homo sapiens
acactcttcccagaaggttctga

SEQ ID NO: 7202022 - DNA, 22 bp, Homo sapiens
acactcaccctcccactgcctg

SEQ ID NO: 7202023 - DNA, 22 bp, Homo sapiens
acactatacttccattgctggt

SEQ ID NO: 7202024 - DNA, 22 bp, Homo sapiens
acactataagacagatacagca

SEQ ID NO: 7202025 - DNA, 22 bp, Homo sapiens
acactctagagggaagcgcttt

SEQ ID NO: 7202026 - DNA, 22 bp, Homo sapiens
acactctcagcttttcaactta

SEQ ID NO: 7202027 - DNA, 22 bp, Homo sapiens
acactctgctctgagcttcagg

SEQ ID NO: 7202028 - DNA, 22 bp, Homo sapiens
acactctgtgaggcatgtaatg

SEQ ID NO: 7202029 - DNA, 22 bp, Homo sapiens
acacattataggcaatcaaaag

SEQ ID NO: 7202030 - DNA, 22 bp, Homo sapiens
acacattataggcaatcaaaag

SEQ ID NO: 7202031 - DNA, 22 bp, Homo sapiens
acacattataggcaatcaaaag

SEQ ID NO: 7202032 - DNA, 22 bp, Homo sapiens
acacattaacctttgaaattct

SEQ ID NO: 7202033 - DNA, 22 bp, Homo sapiens
acacccaggctggcgtgcagtg

SEQ ID NO: 7202034 - DNA, 22 bp, Homo sapiens
acacccaggaataaggactggg

SEQ ID NO: 7202035 - DNA, 22 bp, Homo sapiens
acacccaggaataaggactggg

SEQ ID NO: 7202036 - DNA, 22 bp, Homo sapiens
acactagtagaatagtgtttgc

SEQ ID NO: 7202037 - DNA, 22 bp, Homo sapiens
acactagtctcttcttgacttg

SEQ ID NO: 7202038 - DNA, 22 bp, Homo sapiens
acactagtggaaattgatttgt

SEQ ID NO: 7202039 - DNA, 22 bp, Homo sapiens
agcagagccagaattggaccag

SEQ ID NO: 7202040 - DNA, 22 bp, Homo sapiens
agcagagccaggtctctctgta

SEQ ID NO: 7202041 - DNA, 22 bp, Homo sapiens
agcagagccaggtctctctgta

SEQ ID NO: 7202042 - DNA, 19 bp, Homo sapiens
agcagagcagggccgtggg

SEQ ID NO: 7202043 - DNA, 19 bp, Homo sapiens
agcagagcagggccgtggg

SEQ ID NO: 7202044 - DNA, 19 bp, Homo sapiens
agcagagcagggccgtggg

SEQ ID NO: 7202045 - DNA, 22 bp, Homo sapiens
agcagagcatgctaagtgactc

SEQ ID NO: 7202046 - DNA, 22 bp, Homo sapiens
agcagagcatggtgggaagggc

SEQ ID NO: 7202047 - DNA, 22 bp, Homo sapiens
agcagagcatggtgggaagggc

SEQ ID NO: 7202048 - DNA, 22 bp, Homo sapiens
agcagagcagaatgtgaaggtg

SEQ ID NO: 7202049 - DNA, 19 bp, Homo sapiens
agcagagcaaagtggctga

SEQ ID NO: 7202050 - DNA, 22 bp, Homo sapiens
agcagagcagaatgtgaaggtg

SEQ ID NO: 7202051 - DNA, 22 bp, Homo sapiens
agcagagcagaatgtgaaggtg

SEQ ID NO: 7202052 - DNA, 22 bp, Homo sapiens
agcagagcagaatgtgaaggtg

SEQ ID NO: 7202053 - DNA, 18 bp, Homo sapiens
agcagagagtgaatggga

SEQ ID NO: 7202054 - DNA, 18 bp, Homo sapiens
agcagagagtgaatggga

SEQ ID NO: 7202055 - DNA, 18 bp, Homo sapiens
agcagagagtgaatggga

SEQ ID NO: 7202056 - DNA, 18 bp, Homo sapiens
agcagagagtgaatggga

SEQ ID NO: 7202057 - DNA, 22 bp, Homo sapiens
agcagagaggaggtggccctgt

SEQ ID NO: 7202058 - DNA, 22 bp, Homo sapiens
agcagagaggaggtggccctgt

SEQ ID NO: 7202059 - DNA, 22 bp, Homo sapiens
agcagaagaaagccacatgact

SEQ ID NO: 7202060 - DNA, 22 bp, Homo sapiens
agcagaagaaagccacatgact

SEQ ID NO: 7202061 - DNA, 22 bp, Homo sapiens
acaatgctgttgagacattctt

SEQ ID NO: 7202062 - DNA, 22 bp, Homo sapiens
acaatgctcatatttatgccaa

SEQ ID NO: 7202063 - DNA, 22 bp, Homo sapiens
acaatgctcatatttatgccaa

SEQ ID NO: 7202064 - DNA, 22 bp, Homo sapiens
acaatgctccctgtagtcagga

SEQ ID NO: 7202065 - DNA, 22 bp, Homo sapiens
acaatgctccctgtagtcagga

SEQ ID NO: 7202066 - DNA, 22 bp, Homo sapiens
acaatgctgcagggaaattagg

SEQ ID NO: 7202067 - DNA, 22 bp, Homo sapiens
acaatgctgcagggaaattagg

SEQ ID NO: 7202068 - DNA, 22 bp, Homo sapiens
acaatgctgcagggaaattagg

SEQ ID NO: 7202069 - DNA, 21 bp, Homo sapiens
acaatgcatggaactcatggc

SEQ ID NO: 7202070 - DNA, 21 bp, Homo sapiens
acaatgcatggaactcatggc

SEQ ID NO: 7202071 - DNA, 21 bp, Homo sapiens
acaatgcatggaactcatggc

SEQ ID NO: 7202072 - DNA, 21 bp, Homo sapiens
acaatgcatggaactcatggc

SEQ ID NO: 7202073 - DNA, 22 bp, Homo sapiens
acaatgcacctattttaaaact

SEQ ID NO: 7202074 - DNA, 22 bp, Homo sapiens
acaatgcacctattttaaaact

SEQ ID NO: 7202075 - DNA, 22 bp, Homo sapiens
acaatgcaccagcatcttcacc

SEQ ID NO: 7202076 - DNA, 22 bp, Homo sapiens
acaatgcaccagcatcttcacc

SEQ ID NO: 7202077 - DNA, 22 bp, Homo sapiens
acaatgcaccagcatcttcacc

SEQ ID NO: 7202078 - DNA, 22 bp, Homo sapiens
acaatgcaccagcatcttcacc

SEQ ID NO: 7202079 - DNA, 22 bp, Homo sapiens
acaatgcacctattttaaaact

SEQ ID NO: 7202080 - DNA, 23 bp, Homo sapiens
acaatgcactttaaatggttccc

SEQ ID NO: 7202081 - DNA, 22 bp, Homo sapiens
agcagatgagcctcatgactgg

SEQ ID NO: 7202082 - DNA, 22 bp, Homo sapiens
agcagatatttgttgagcactt

SEQ ID NO: 7202083 - DNA, 22 bp, Homo sapiens
agcagatagtagaacatgtata

SEQ ID NO: 7202084 - DNA, 20 bp, Homo sapiens
agcagatagcgggagagttt

SEQ ID NO: 7202085 - DNA, 22 bp, Homo sapiens
agcagagtgtgaaggcagggct

SEQ ID NO: 7202086 - DNA, 22 bp, Homo sapiens
agcagagtttctcaacatcagc

SEQ ID NO: 7202087 - DNA, 22 bp, Homo sapiens
agcagagtgtgaaggcagggct

SEQ ID NO: 7202088 - DNA, 22 bp, Homo sapiens
agcagagcctgggctaggggtg

SEQ ID NO: 7202089 - DNA, 22 bp, Homo sapiens
agcagagcctgggctaggggtg

SEQ ID NO: 7202090 - DNA, 22 bp, Homo sapiens
agcagagcccttccatggcctt

SEQ ID NO: 7202091 - DNA, 22 bp, Homo sapiens
agcagagcccttccatggcctt

SEQ ID NO: 7202092 - DNA, 18 bp, Homo sapiens
agcagagcccatgcattc

SEQ ID NO: 7202093 - DNA, 19 bp, Homo sapiens
agcagagccctgaagatcc

SEQ ID NO: 7202094 - DNA, 22 bp, Homo sapiens
agcagatgtgtctctgcactgt

SEQ ID NO: 7202095 - DNA, 22 bp, Homo sapiens
agcagatgcgtctgagtgggag

SEQ ID NO: 7202096 - DNA, 22 bp, Homo sapiens
agcagatggagaatggagtcag

SEQ ID NO: 7202097 - DNA, 22 bp, Homo sapiens
agcagatggagaatggagtcag

SEQ ID NO: 7202098 - DNA, 22 bp, Homo sapiens
agcagatgggagatggagctgc

SEQ ID NO: 7202099 - DNA, 22 bp, Homo sapiens
agcagatgggagatggagctgc

SEQ ID NO: 7202100 - DNA, 22 bp, Homo sapiens
agcagatgtttcagagcaggct

SEQ ID NO: 7202101 - DNA, 22 bp, Homo sapiens
agcagattggttaagcacatta

SEQ ID NO: 7202102 - DNA, 22 bp, Homo sapiens
agcagattggttaagcacatta

SEQ ID NO: 7202103 - DNA, 22 bp, Homo sapiens
acacagaagatctcttaatgct

SEQ ID NO: 7202104 - DNA, 22 bp, Homo sapiens
acacagaagatctcttaatgct

SEQ ID NO: 7202105 - DNA, 22 bp, Homo sapiens
agcagcaaagaataggccctct

SEQ ID NO: 7202106 - DNA, 17 bp, Homo sapiens
agcagctgggttgatct

SEQ ID NO: 7202107 - DNA, 17 bp, Homo sapiens
agcagctgggttgatct

SEQ ID NO: 7202108 - DNA, 22 bp, Homo sapiens
agcagctgggtccggcggagca

SEQ ID NO: 7202109 - DNA, 22 bp, Homo sapiens
agcagctggtaggagtggccac

SEQ ID NO: 7202110 - DNA, 22 bp, Homo sapiens
agcagctggtgagcaagctcag

SEQ ID NO: 7202111 - DNA, 22 bp, Homo sapiens
agcagctggtgagcaagctcag

SEQ ID NO: 7202112 - DNA, 22 bp, Homo sapiens
agcagctggtgagcaagctcag

SEQ ID NO: 7202113 - DNA, 22 bp, Homo sapiens
agcagctggtgcaactctaaga

SEQ ID NO: 7202114 - DNA, 22 bp, Homo sapiens
agcagctggtgcaactctaaga

SEQ ID NO: 7202115 - DNA, 22 bp, Homo sapiens
agcagctggggcctgtgacgat

SEQ ID NO: 7202116 - DNA, 22 bp, Homo sapiens
agcagctggggcctgtgacgat

SEQ ID NO: 7202117 - DNA, 22 bp, Homo sapiens
agcagctgggctcagagctggg

SEQ ID NO: 7202118 - DNA, 22 bp, Homo sapiens
acacagatgctatttagtctct

SEQ ID NO: 7202119 - DNA, 22 bp, Homo sapiens
agcagctgagccccagctgtga

SEQ ID NO: 7202120 - DNA, 22 bp, Homo sapiens
agcagctgagccccagctgtga

SEQ ID NO: 7202121 - DNA, 22 bp, Homo sapiens
acacagatattgtacttgatcc

SEQ ID NO: 7202122 - DNA, 22 bp, Homo sapiens
acacagatgatgttccaggaac

SEQ ID NO: 7202123 - DNA, 22 bp, Homo sapiens
acacagatgcattacacatcta

SEQ ID NO: 7202124 - DNA, 22 bp, Homo sapiens
acacagagcttctcaactggga

SEQ ID NO: 7202125 - DNA, 22 bp, Homo sapiens
acacagaggaaagtgtgaaggg

SEQ ID NO: 7202126 - DNA, 22 bp, Homo sapiens
acacagaggaaagtgtgaaggg

SEQ ID NO: 7202127 - DNA, 22 bp, Homo sapiens
acacagaggaaagtgtgaaggg

SEQ ID NO: 7202128 - DNA, 21 bp, Homo sapiens
acacagaggcatcatcacttt

SEQ ID NO: 7202129 - DNA, 22 bp, Homo sapiens
acacagaggcatgacagtggct

SEQ ID NO: 7202130 - DNA, 22 bp, Homo sapiens
acacagaggcatgacagtggct

SEQ ID NO: 7202131 - DNA, 22 bp, Homo sapiens
acacagaggcatgacagtggct

SEQ ID NO: 7202132 - DNA, 22 bp, Homo sapiens
acacagaggcatgacagtggct

SEQ ID NO: 7202133 - DNA, 22 bp, Homo sapiens
acacagaggcatgacagtggct

SEQ ID NO: 7202134 - DNA, 22 bp, Homo sapiens
acacagaggctccagagataga

SEQ ID NO: 7202135 - DNA, 22 bp, Homo sapiens
acacagaggctccagagataga

SEQ ID NO: 7202136 - DNA, 22 bp, Homo sapiens
acacagaggctccagagataga

SEQ ID NO: 7202137 - DNA, 22 bp, Homo sapiens
acacagaggctccagagataga

SEQ ID NO: 7202138 - DNA, 22 bp, Homo sapiens
acacagagggcagaagatacat

SEQ ID NO: 7202139 - DNA, 22 bp, Homo sapiens
acacagaggtggccactctttt

SEQ ID NO: 7202140 - DNA, 22 bp, Homo sapiens
acacagagtatcttttgcctag

SEQ ID NO: 7202141 - DNA, 22 bp, Homo sapiens
acacagagtatcttttgcctag

SEQ ID NO: 7202142 - DNA, 22 bp, Homo sapiens
acacagagtccttactgaggta

SEQ ID NO: 7202143 - DNA, 22 bp, Homo sapiens
acacagagtccttactgaggta

SEQ ID NO: 7202144 - DNA, 20 bp, Homo sapiens
acacagagtgagtctgcttg

SEQ ID NO: 7202145 - DNA, 20 bp, Homo sapiens
acacagagtgagtctgcttg

SEQ ID NO: 7202146 - DNA, 20 bp, Homo sapiens
acacagagtgagtctgcttg

SEQ ID NO: 7202147 - DNA, 22 bp, Homo sapiens
acacagagtatttagaaggggt

SEQ ID NO: 7202148 - DNA, 22 bp, Homo sapiens
acacagagtatttagaaggggt

SEQ ID NO: 7202149 - DNA, 22 bp, Homo sapiens
acacagagtatttagaaggggt

SEQ ID NO: 7202150 - DNA, 22 bp, Homo sapiens
acacagagtatttagaaggggt

SEQ ID NO: 7202151 - DNA, 22 bp, Homo sapiens
acacagagtatttagaaggggt

SEQ ID NO: 7202152 - DNA, 22 bp, Homo sapiens
acacagagtatttagaaggggt

SEQ ID NO: 7202153 - DNA, 22 bp, Homo sapiens
acacagagtccttactgaggta

SEQ ID NO: 7202154 - DNA, 22 bp, Homo sapiens
acacagagttattatgtgaact

SEQ ID NO: 7202155 - DNA, 22 bp, Homo sapiens
acacagagttattatgtgaact

SEQ ID NO: 7202156 - DNA, 22 bp, Homo sapiens
acacagagttattatgtgaact

SEQ ID NO: 7202157 - DNA, 22 bp, Homo sapiens
acacagagtggtttgtagaata

SEQ ID NO: 7202158 - DNA, 22 bp, Homo sapiens
acacagagttattatgtgaact

SEQ ID NO: 7202159 - DNA, 22 bp, Homo sapiens
acacagagttattatgtgaact

SEQ ID NO: 7202160 - DNA, 22 bp, Homo sapiens
acacagagtttgacacatggga

SEQ ID NO: 7202161 - DNA, 22 bp, Homo sapiens
acacagagtttgacacatggga

SEQ ID NO: 7202162 - DNA, 22 bp, Homo sapiens
acacagagtttgacacatggga

SEQ ID NO: 7202163 - DNA, 22 bp, Homo sapiens
acacagagtttgacacatggga

SEQ ID NO: 7202164 - DNA, 22 bp, Homo sapiens
acacagagtttgacacatggga

SEQ ID NO: 7202165 - DNA, 22 bp, Homo sapiens
acagcacaatctgagtcccaga

SEQ ID NO: 7202166 - DNA, 22 bp, Homo sapiens
acagcacaatctgagtcccaga

SEQ ID NO: 7202167 - DNA, 22 bp, Homo sapiens
acagcacaatctgagtcccaga

SEQ ID NO: 7202168 - DNA, 22 bp, Homo sapiens
acagcacaatctgagtcccaga

SEQ ID NO: 7202169 - DNA, 19 bp, Homo sapiens
acagcacagaaatatttca

SEQ ID NO: 7202170 - DNA, 19 bp, Homo sapiens
acagcacagaaatatttca

SEQ ID NO: 7202171 - DNA, 19 bp, Homo sapiens
acagcacagaaatatttca

SEQ ID NO: 7202172 - DNA, 22 bp, Homo sapiens
acagcacagagtggtatggctg

SEQ ID NO: 7202173 - DNA, 22 bp, Homo sapiens
acagcacagagtggtatggctg

SEQ ID NO: 7202174 - DNA, 22 bp, Homo sapiens
acagcacaggagttgaatgggc

SEQ ID NO: 7202175 - DNA, 22 bp, Homo sapiens
acagcacaggagttgaatgggc

SEQ ID NO: 7202176 - DNA, 22 bp, Homo sapiens
acagcacaggagttgaatgggc

SEQ ID NO: 7202177 - DNA, 22 bp, Homo sapiens
agctcctgctctttgtccctaa

SEQ ID NO: 7202178 - DNA, 22 bp, Homo sapiens
agctcctgctctttgtccctaa

SEQ ID NO: 7202179 - DNA, 22 bp, Homo sapiens
agctcctgcttgacagaagagg

SEQ ID NO: 7202180 - DNA, 22 bp, Homo sapiens
agctcctgcttgacagaagagg

SEQ ID NO: 7202181 - DNA, 22 bp, Homo sapiens
acagcaatgagtaactccttgg

SEQ ID NO: 7202182 - DNA, 22 bp, Homo sapiens
acagcaatgagtaactccttgg

SEQ ID NO: 7202183 - DNA, 22 bp, Homo sapiens
acagcaattgtatgcatagcat

SEQ ID NO: 7202184 - DNA, 22 bp, Homo sapiens
agctcctgcagactcctgctca

SEQ ID NO: 7202185 - DNA, 22 bp, Homo sapiens
agctcctgcagactcctgctca

SEQ ID NO: 7202186 - DNA, 22 bp, Homo sapiens
agctcctgcagactcctgctca

SEQ ID NO: 7202187 - DNA, 22 bp, Homo sapiens
agctcctgccaacactgatggg

SEQ ID NO: 7202188 - DNA, 22 bp, Homo sapiens
agctcctgccaacactgatggg

SEQ ID NO: 7202189 - DNA, 22 bp, Homo sapiens
agctcctgccaacactgatggg

SEQ ID NO: 7202190 - DNA, 22 bp, Homo sapiens
agctcccagagtcctctgccca

SEQ ID NO: 7202191 - DNA, 22 bp, Homo sapiens
agctcccagagtcctctgccca

SEQ ID NO: 7202192 - DNA, 22 bp, Homo sapiens
agctcctgcacccagccttgag

SEQ ID NO: 7202193 - DNA, 22 bp, Homo sapiens
agctcctgcgcacggtgcacac

SEQ ID NO: 7202194 - DNA, 22 bp, Homo sapiens
agctcctgcgcacggtgcacac

SEQ ID NO: 7202195 - DNA, 17 bp, Homo sapiens
agctcctgcccatggct

SEQ ID NO: 7202196 - DNA, 22 bp, Homo sapiens
agctcctgcccaggaaggctct

SEQ ID NO: 7202197 - DNA, 17 bp, Homo sapiens
agctcctgcccatggct

SEQ ID NO: 7202198 - DNA, 17 bp, Homo sapiens
agctcctgcccatggct

SEQ ID NO: 7202199 - DNA, 22 bp, Homo sapiens
acagattatggatatatgtgga

SEQ ID NO: 7202200 - DNA, 22 bp, Homo sapiens
acagattcactgcactggccat

SEQ ID NO: 7202201 - DNA, 22 bp, Homo sapiens
acagattcactgcactggccat

SEQ ID NO: 7202202 - DNA, 21 bp, Homo sapiens
acagatgtgatatgcagtctt

SEQ ID NO: 7202203 - DNA, 22 bp, Homo sapiens
acagatgtggagtttgcatgat

SEQ ID NO: 7202204 - DNA, 21 bp, Homo sapiens
acagattagcacaatgcaggc

SEQ ID NO: 7202205 - DNA, 21 bp, Homo sapiens
acagattagcacaatgcaggc

SEQ ID NO: 7202206 - DNA, 22 bp, Homo sapiens
acagatggaatgtgttatggga

SEQ ID NO: 7202207 - DNA, 22 bp, Homo sapiens
acagatggagctactaggtaaa

SEQ ID NO: 7202208 - DNA, 22 bp, Homo sapiens
acagatggaggttattatgaac

SEQ ID NO: 7202209 - DNA, 22 bp, Homo sapiens
acagatggaggttattatgaac

SEQ ID NO: 7202210 - DNA, 22 bp, Homo sapiens
acagatggcacctttttgctgt

SEQ ID NO: 7202211 - DNA, 22 bp, Homo sapiens
acagatggcactttttaggact

SEQ ID NO: 7202212 - DNA, 22 bp, Homo sapiens
acagatggcactttttaggact

SEQ ID NO: 7202213 - DNA, 20 bp, Homo sapiens
acagatggcagttattacat

SEQ ID NO: 7202214 - DNA, 20 bp, Homo sapiens
acagatggcagttattacat

SEQ ID NO: 7202215 - DNA, 22 bp, Homo sapiens
acagatggccatattactatat

SEQ ID NO: 7202216 - DNA, 22 bp, Homo sapiens
acagatggccatattactatat

SEQ ID NO: 7202217 - DNA, 21 bp, Homo sapiens
acagatgggatgagcacactg

SEQ ID NO: 7202218 - DNA, 22 bp, Homo sapiens
acagatggggcacaaagccaca

SEQ ID NO: 7202219 - DNA, 22 bp, Homo sapiens
acagatggtagcattatgttgg

SEQ ID NO: 7202220 - DNA, 22 bp, Homo sapiens
acagatggtagcattatgttgg

SEQ ID NO: 7202221 - DNA, 22 bp, Homo sapiens
acagatggtagcattatgttgg

SEQ ID NO: 7202222 - DNA, 22 bp, Homo sapiens
acagatggtgagccgctgatgt

SEQ ID NO: 7202223 - DNA, 22 bp, Homo sapiens
acagatggtagcattatgttgg

SEQ ID NO: 7202224 - DNA, 22 bp, Homo sapiens
acagatgtaatctattcacatt

SEQ ID NO: 7202225 - DNA, 22 bp, Homo sapiens
acagatggttattgtcatttct

SEQ ID NO: 7202226 - DNA, 20 bp, Homo sapiens
agccctgtttcctggagaga

SEQ ID NO: 7202227 - DNA, 20 bp, Homo sapiens
agccctgtttcctggagaga

SEQ ID NO: 7202228 - DNA, 20 bp, Homo sapiens
agccctgtttcctggagaga

SEQ ID NO: 7202229 - DNA, 22 bp, Homo sapiens
acagagagggagtgataaatcc

SEQ ID NO: 7202230 - DNA, 22 bp, Homo sapiens
agcctcctgtagccctcaccca

SEQ ID NO: 7202231 - DNA, 22 bp, Homo sapiens
agcctcctgtagccctcaccca

SEQ ID NO: 7202232 - DNA, 22 bp, Homo sapiens
agcctcctgtagccctcaccca

SEQ ID NO: 7202233 - DNA, 22 bp, Homo sapiens
agcctctcactgtcaccctccc

SEQ ID NO: 7202234 - DNA, 22 bp, Homo sapiens
agcctctcactgtcaccctccc

SEQ ID NO: 7202235 - DNA, 22 bp, Homo sapiens
agcctctcactgtcaccctccc

SEQ ID NO: 7202236 - DNA, 22 bp, Homo sapiens
agcctctctgatgtgacagcta

SEQ ID NO: 7202237 - DNA, 22 bp, Homo sapiens
agcctctcttatcccttcaaag

SEQ ID NO: 7202238 - DNA, 22 bp, Homo sapiens
agcctctctccagcttggcaga

SEQ ID NO: 7202239 - DNA, 22 bp, Homo sapiens
agcctctcatgttctcccccag

SEQ ID NO: 7202240 - DNA, 21 bp, Homo sapiens
acagagccgggcacaaagctg

SEQ ID NO: 7202241 - DNA, 21 bp, Homo sapiens
acagagccgggcacaaagctg

SEQ ID NO: 7202242 - DNA, 22 bp, Homo sapiens
acagagcatttgggacagagag

SEQ ID NO: 7202243 - DNA, 22 bp, Homo sapiens
acagagcatttgggacagagag

SEQ ID NO: 7202244 - DNA, 22 bp, Homo sapiens
agcctctgatggctcccaagga

SEQ ID NO: 7202245 - DNA, 22 bp, Homo sapiens
acagagccactttggtgcctac

SEQ ID NO: 7202246 - DNA, 22 bp, Homo sapiens
agcctctctttattcccagcta

SEQ ID NO: 7202247 - DNA, 22 bp, Homo sapiens
agcctctgactgtcagcaaggt

SEQ ID NO: 7202248 - DNA, 22 bp, Homo sapiens
agcctctgactgtcagcaaggt

SEQ ID NO: 7202249 - DNA, 22 bp, Homo sapiens
agcctctctttctggtggctaa

SEQ ID NO: 7202250 - DNA, 22 bp, Homo sapiens
agcctctgactgtcagcaaggt

SEQ ID NO: 7202251 - DNA, 22 bp, Homo sapiens
agcctctgatgatcacaggggg

SEQ ID NO: 7202252 - DNA, 22 bp, Homo sapiens
agcctctgatgatcacaggggg

SEQ ID NO: 7202253 - DNA, 20 bp, Homo sapiens
acagatatttgattttcagt

SEQ ID NO: 7202254 - DNA, 20 bp, Homo sapiens
acagatatttgattttcagt

SEQ ID NO: 7202255 - DNA, 20 bp, Homo sapiens
acagatatttgattttcagt

SEQ ID NO: 7202256 - DNA, 22 bp, Homo sapiens
acagatatttggggaaagacgt

SEQ ID NO: 7202257 - DNA, 22 bp, Homo sapiens
acagatatttggggaaagacgt

SEQ ID NO: 7202258 - DNA, 22 bp, Homo sapiens
acagatgaggcccatcagtctg

SEQ ID NO: 7202259 - DNA, 22 bp, Homo sapiens
acagagctgggatctgaaccca

SEQ ID NO: 7202260 - DNA, 22 bp, Homo sapiens
acagagcctccaggagtgctgg

SEQ ID NO: 7202261 - DNA, 22 bp, Homo sapiens
acagagctaatgttgcataggc

SEQ ID NO: 7202262 - DNA, 22 bp, Homo sapiens
acagagctaatgttgcataggc

SEQ ID NO: 7202263 - DNA, 22 bp, Homo sapiens
acagagctcccagccatctcct

SEQ ID NO: 7202264 - DNA, 22 bp, Homo sapiens
acagatgcaaggaaatgattgc

SEQ ID NO: 7202265 - DNA, 22 bp, Homo sapiens
acagatgcaaggaaatgattgc

SEQ ID NO: 7202266 - DNA, 22 bp, Homo sapiens
acagatgcgcttggttgccaga

SEQ ID NO: 7202267 - DNA, 19 bp, Homo sapiens
acagatgcttttgctgccc

SEQ ID NO: 7202268 - DNA, 22 bp, Homo sapiens
acagatgatttttatgaaaaca

SEQ ID NO: 7202269 - DNA, 22 bp, Homo sapiens
acagatgatttttatgaaaaca

SEQ ID NO: 7202270 - DNA, 22 bp, Homo sapiens
acagatgatttttatgaaaaca

SEQ ID NO: 7202271 - DNA, 22 bp, Homo sapiens
acagatgatttttatgaaaaca

SEQ ID NO: 7202272 - DNA, 22 bp, Homo sapiens
acagatgagttaaagcagagtg

SEQ ID NO: 7202273 - DNA, 22 bp, Homo sapiens
acagatgagttaaagcagagtg

SEQ ID NO: 7202274 - DNA, 22 bp, Homo sapiens
acagatatttggggaaagacgt

SEQ ID NO: 7202275 - DNA, 22 bp, Homo sapiens
acagatgaggctggcgagggca

SEQ ID NO: 7202276 - DNA, 22 bp, Homo sapiens
acagatgagttaaagcagagtg

SEQ ID NO: 7202277 - DNA, 22 bp, Homo sapiens
acagatgagttagaataggcag

SEQ ID NO: 7202278 - DNA, 22 bp, Homo sapiens
acagatgatgtgcacagataga

SEQ ID NO: 7202279 - DNA, 22 bp, Homo sapiens
acagacacaggcgtggagtcgc

SEQ ID NO: 7202280 - DNA, 22 bp, Homo sapiens
acagacacaggcgtggagtcgc

SEQ ID NO: 7202281 - DNA, 22 bp, Homo sapiens
acagacacaggcctgggctcct

SEQ ID NO: 7202282 - DNA, 22 bp, Homo sapiens
acagacacaggcgtggagtcgc

SEQ ID NO: 7202283 - DNA, 22 bp, Homo sapiens
acagacacaggcgtggagtcgc

SEQ ID NO: 7202284 - DNA, 22 bp, Homo sapiens
acagacaagtagttcagacaag

SEQ ID NO: 7202285 - DNA, 22 bp, Homo sapiens
acagacacaggcctgggctcct

SEQ ID NO: 7202286 - DNA, 22 bp, Homo sapiens
acagacacaggcctgggctcct

SEQ ID NO: 7202287 - DNA, 22 bp, Homo sapiens
acagacacaggcgtggagtcgc

SEQ ID NO: 7202288 - DNA, 22 bp, Homo sapiens
acagacacaggcgtggagtcgc

SEQ ID NO: 7202289 - DNA, 22 bp, Homo sapiens
acagacaagtagttcagacaag

SEQ ID NO: 7202290 - DNA, 22 bp, Homo sapiens
acagacaagtagttcagacaag

SEQ ID NO: 7202291 - DNA, 22 bp, Homo sapiens
acagacaagtagttcagacaag

SEQ ID NO: 7202292 - DNA, 22 bp, Homo sapiens
acagaattaggagatcctcttg

SEQ ID NO: 7202293 - DNA, 22 bp, Homo sapiens
acagaattaggagatcctcttg

SEQ ID NO: 7202294 - DNA, 20 bp, Homo sapiens
acagaaagagagaatgtcag

SEQ ID NO: 7202295 - DNA, 22 bp, Homo sapiens
acagaaagataggcacaaggtc

SEQ ID NO: 7202296 - DNA, 20 bp, Homo sapiens
acagaaagagagaatgtcag

SEQ ID NO: 7202297 - DNA, 20 bp, Homo sapiens
acagaaagagagaatgtcag

SEQ ID NO: 7202298 - DNA, 20 bp, Homo sapiens
acagaaagagagaatgtcag

SEQ ID NO: 7202299 - DNA, 20 bp, Homo sapiens
acagaaagagagaatgtcag

SEQ ID NO: 7202300 - DNA, 22 bp, Homo sapiens
acagaattaatgaaaattacaa

SEQ ID NO: 7202301 - DNA, 22 bp, Homo sapiens
acagacactgcactcccacctt

SEQ ID NO: 7202302 - DNA, 22 bp, Homo sapiens
acagacactgcactcccacctt

SEQ ID NO: 7202303 - DNA, 18 bp, Homo sapiens
acagacacttagtatgag

SEQ ID NO: 7202304 - DNA, 18 bp, Homo sapiens
acagacacttagtatgag

SEQ ID NO: 7202305 - DNA, 22 bp, Homo sapiens
acagacagacagagaactattc

SEQ ID NO: 7202306 - DNA, 22 bp, Homo sapiens
acagacagacagagaactattc

SEQ ID NO: 7202307 - DNA, 22 bp, Homo sapiens
acagacagacagagaactattc

SEQ ID NO: 7202308 - DNA, 22 bp, Homo sapiens
acagacagacagagaactattc

SEQ ID NO: 7202309 - DNA, 22 bp, Homo sapiens
acagacagacagattgcatatg

SEQ ID NO: 7202310 - DNA, 22 bp, Homo sapiens
acagacagacagagaactattc

SEQ ID NO: 7202311 - DNA, 22 bp, Homo sapiens
acagacagacagattgcatatg

SEQ ID NO: 7202312 - DNA, 22 bp, Homo sapiens
acagacagaggctccatgagga

SEQ ID NO: 7202313 - DNA, 22 bp, Homo sapiens
acagacagaggctccatgagga

SEQ ID NO: 7202314 - DNA, 22 bp, Homo sapiens
acagacagaggctccatgagga

SEQ ID NO: 7202315 - DNA, 22 bp, Homo sapiens
acagacagaggctccatgagga

SEQ ID NO: 7202316 - DNA, 22 bp, Homo sapiens
acagacagaggctccatgagga

SEQ ID NO: 7202317 - DNA, 22 bp, Homo sapiens
acagacagattttgtctgatgt

SEQ ID NO: 7202318 - DNA, 22 bp, Homo sapiens
acagacagattttgtctgatgt

SEQ ID NO: 7202319 - DNA, 22 bp, Homo sapiens
acagacagattttgtctgatgt

SEQ ID NO: 7202320 - DNA, 22 bp, Homo sapiens
acagacagattttgtctgatgt

SEQ ID NO: 7202321 - DNA, 22 bp, Homo sapiens
acagacagggcacctgcctcct

SEQ ID NO: 7202322 - DNA, 22 bp, Homo sapiens
acagacagattttgtctgatgt

SEQ ID NO: 7202323 - DNA, 22 bp, Homo sapiens
agccaggggattcatcagggac

SEQ ID NO: 7202324 - DNA, 22 bp, Homo sapiens
agccaggggattcatcagggac

SEQ ID NO: 7202325 - DNA, 22 bp, Homo sapiens
agccaggggattcatcagggac

SEQ ID NO: 7202326 - DNA, 22 bp, Homo sapiens
acactttgctacatttcatatt

SEQ ID NO: 7202327 - DNA, 22 bp, Homo sapiens
acactttgggctggataattat

SEQ ID NO: 7202328 - DNA, 22 bp, Homo sapiens
acacttttaagactttaatgaa

SEQ ID NO: 7202329 - DNA, 22 bp, Homo sapiens
acacttttaagactttaatgaa

SEQ ID NO: 7202330 - DNA, 22 bp, Homo sapiens
acacttttaagactttaatgaa

SEQ ID NO: 7202331 - DNA, 22 bp, Homo sapiens
acacttttaagactttaatgaa

SEQ ID NO: 7202332 - DNA, 22 bp, Homo sapiens
acacttttagctatgagttaat

SEQ ID NO: 7202333 - DNA, 22 bp, Homo sapiens
acacttttagctatgagttaat

SEQ ID NO: 7202334 - DNA, 22 bp, Homo sapiens
acacttttagctatgagttaat

SEQ ID NO: 7202335 - DNA, 22 bp, Homo sapiens
acacttttagctatgagttaat

SEQ ID NO: 7202336 - DNA, 22 bp, Homo sapiens
acacttttatctctggaggctt

SEQ ID NO: 7202337 - DNA, 22 bp, Homo sapiens
acactttatcaatattcaaaaa

SEQ ID NO: 7202338 - DNA, 22 bp, Homo sapiens
acactttatcaatattcaaaaa

SEQ ID NO: 7202339 - DNA, 22 bp, Homo sapiens
acactttatcaatattcaaaaa

SEQ ID NO: 7202340 - DNA, 22 bp, Homo sapiens
acactttatctcatctcagaca

SEQ ID NO: 7202341 - DNA, 22 bp, Homo sapiens
acactttatgtctagatctggg

SEQ ID NO: 7202342 - DNA, 22 bp, Homo sapiens
acagaaagaccttgtaacactt

SEQ ID NO: 7202343 - DNA, 22 bp, Homo sapiens
acagaaagaccttgtaacactt

SEQ ID NO: 7202344 - DNA, 22 bp, Homo sapiens
acagaaagaccttgtaacactt

SEQ ID NO: 7202345 - DNA, 22 bp, Homo sapiens
acagaaagaccttgtaacactt

SEQ ID NO: 7202346 - DNA, 22 bp, Homo sapiens
acagaaagaaggtgtatttgag

SEQ ID NO: 7202347 - DNA, 22 bp, Homo sapiens
acagaaagaaggtgtatttgag

SEQ ID NO: 7202348 - DNA, 22 bp, Homo sapiens
acagaaacccagaaaacctctc

SEQ ID NO: 7202349 - DNA, 22 bp, Homo sapiens
acagaaaatgccagaagggtgg

SEQ ID NO: 7202350 - DNA, 22 bp, Homo sapiens
acagaaaatgccagaagggtgg

SEQ ID NO: 7202351 - DNA, 22 bp, Homo sapiens
acagaaaatgccagaagggtgg

SEQ ID NO: 7202352 - DNA, 22 bp, Homo sapiens
acagaaaagtttacttttgctc

SEQ ID NO: 7202353 - DNA, 22 bp, Homo sapiens
acagaaaagtttacttttgctc

SEQ ID NO: 7202354 - DNA, 22 bp, Homo sapiens
acagaaaatgccagaagggtgg

SEQ ID NO: 7202355 - DNA, 22 bp, Homo sapiens
acagaaacccagaaaacctctc

SEQ ID NO: 7202356 - DNA, 22 bp, Homo sapiens
acagaaaagtttacttttgctc

SEQ ID NO: 7202357 - DNA, 22 bp, Homo sapiens
acagaaaagtttacttttgctc

SEQ ID NO: 7202358 - DNA, 22 bp, Homo sapiens
acagaaaaatgagggagctgga

SEQ ID NO: 7202359 - DNA, 22 bp, Homo sapiens
acagaaaagtttacttttgctc

SEQ ID NO: 7202360 - DNA, 22 bp, Homo sapiens
acacttttgtttgaagtctcca

SEQ ID NO: 7202361 - DNA, 22 bp, Homo sapiens
acagaaaaatgagggagctgga

SEQ ID NO: 7202362 - DNA, 22 bp, Homo sapiens
acacttttgtttgaagtctcca

SEQ ID NO: 7202363 - DNA, 22 bp, Homo sapiens
acacttttgtttgaagtctcca

SEQ ID NO: 7202364 - DNA, 22 bp, Homo sapiens
acacttttgtgtatatccagtt

SEQ ID NO: 7202365 - DNA, 22 bp, Homo sapiens
acacttttatctctggaggctt

SEQ ID NO: 7202366 - DNA, 22 bp, Homo sapiens
acacttttgtgtatatccagtt

SEQ ID NO: 7202367 - DNA, 22 bp, Homo sapiens
acacttttgtgtatatccagtt

SEQ ID NO: 7202368 - DNA, 22 bp, Homo sapiens
acagagactgggagcaagaggc

SEQ ID NO: 7202369 - DNA, 22 bp, Homo sapiens
acagagactgggagcaagaggc

SEQ ID NO: 7202370 - DNA, 22 bp, Homo sapiens
acagagactgggagcaagaggc

SEQ ID NO: 7202371 - DNA, 22 bp, Homo sapiens
acagagactgggatgcctgcct

SEQ ID NO: 7202372 - DNA, 22 bp, Homo sapiens
acagagactgggatgcctgcct

SEQ ID NO: 7202373 - DNA, 22 bp, Homo sapiens
acagagacttggagcaggctga

SEQ ID NO: 7202374 - DNA, 22 bp, Homo sapiens
acagagacttggagcaggctga

SEQ ID NO: 7202375 - DNA, 22 bp, Homo sapiens
acagagacttggagcaggctga

SEQ ID NO: 7202376 - DNA, 22 bp, Homo sapiens
acagagactcatgaaagatgac

SEQ ID NO: 7202377 - DNA, 22 bp, Homo sapiens
acagagactgggagcaagaggc

SEQ ID NO: 7202378 - DNA, 22 bp, Homo sapiens
acagagacttggagcaggctga

SEQ ID NO: 7202379 - DNA, 22 bp, Homo sapiens
acagagagaaacaatcagcagc

SEQ ID NO: 7202380 - DNA, 22 bp, Homo sapiens
acagagagaaacaatcagcagc

SEQ ID NO: 7202381 - DNA, 22 bp, Homo sapiens
acagagagaaacaatcagcagc

SEQ ID NO: 7202382 - DNA, 22 bp, Homo sapiens
acagagagaattgggtttacag

SEQ ID NO: 7202383 - DNA, 22 bp, Homo sapiens
acagagagaattgggtttacag

SEQ ID NO: 7202384 - DNA, 22 bp, Homo sapiens
acagagagaggcccgaggctgc

SEQ ID NO: 7202385 - DNA, 22 bp, Homo sapiens
acagagagaggcccgaggctgc

SEQ ID NO: 7202386 - DNA, 22 bp, Homo sapiens
acagagagctgtgattgagtta

SEQ ID NO: 7202387 - DNA, 22 bp, Homo sapiens
acagagaaagtgggctgaagat

SEQ ID NO: 7202388 - DNA, 22 bp, Homo sapiens
acagagaaagttcctctcaggc

SEQ ID NO: 7202389 - DNA, 22 bp, Homo sapiens
acagagacaaatgttagtagtt

SEQ ID NO: 7202390 - DNA, 22 bp, Homo sapiens
acagagacacggaagctaaaga

SEQ ID NO: 7202391 - DNA, 22 bp, Homo sapiens
acagagacaggcagacagtctt

SEQ ID NO: 7202392 - DNA, 22 bp, Homo sapiens
acagagacaggcagacagtctt

SEQ ID NO: 7202393 - DNA, 22 bp, Homo sapiens
acagagaccagcatcttctgcc

SEQ ID NO: 7202394 - DNA, 22 bp, Homo sapiens
acagagaccagttacagcgtcc

SEQ ID NO: 7202395 - DNA, 22 bp, Homo sapiens
acagagacctggccttgctttg

SEQ ID NO: 7202396 - DNA, 19 bp, Homo sapiens
agccagggtgagaaggagc

SEQ ID NO: 7202397 - DNA, 19 bp, Homo sapiens
agccagggtgagaaggagc

SEQ ID NO: 7202398 - DNA, 22 bp, Homo sapiens
agccagggtgagagggctttgt

SEQ ID NO: 7202399 - DNA, 22 bp, Homo sapiens
agccagggtgagagggctttgt

SEQ ID NO: 7202400 - DNA, 22 bp, Homo sapiens
agccagggtctctcgctctgtt

SEQ ID NO: 7202401 - DNA, 22 bp, Homo sapiens
agccagggtctctcgctctgtt

SEQ ID NO: 7202402 - DNA, 19 bp, Homo sapiens
agccagggtgagaaggagc

SEQ ID NO: 7202403 - DNA, 19 bp, Homo sapiens
agccagggtgagaaggagc

SEQ ID NO: 7202404 - DNA, 19 bp, Homo sapiens
agccagggtgagaaggagc

SEQ ID NO: 7202405 - DNA, 22 bp, Homo sapiens
agccagggggacgctttctggc

SEQ ID NO: 7202406 - DNA, 19 bp, Homo sapiens
agccagggtccagacatgt

SEQ ID NO: 7202407 - DNA, 19 bp, Homo sapiens
agccagggtccagacatgt

SEQ ID NO: 7202408 - DNA, 19 bp, Homo sapiens
agccagggtccagacatgt

SEQ ID NO: 7202409 - DNA, 19 bp, Homo sapiens
agccagggtccagacatgt

SEQ ID NO: 7202410 - DNA, 22 bp, Homo sapiens
agccagggtctctcgctctgtt

SEQ ID NO: 7202411 - DNA, 22 bp, Homo sapiens
agccagggtctctcgctctgtt

SEQ ID NO: 7202412 - DNA, 22 bp, Homo sapiens
acagagaaagtgggctgaagat

SEQ ID NO: 7202413 - DNA, 22 bp, Homo sapiens
acagagaaagtgggctgaagat

SEQ ID NO: 7202414 - DNA, 21 bp, Homo sapiens
acagagaaagagcagcctcct

SEQ ID NO: 7202415 - DNA, 22 bp, Homo sapiens
acagacttgttccctagtgagt

SEQ ID NO: 7202416 - DNA, 21 bp, Homo sapiens
agccagggtggacactgtatg

SEQ ID NO: 7202417 - DNA, 22 bp, Homo sapiens
acagacattcagctaagtctat

SEQ ID NO: 7202418 - DNA, 22 bp, Homo sapiens
acagacattcagctaagtctat

SEQ ID NO: 7202419 - DNA, 23 bp, Homo sapiens
acagacattccataatgtacacc

SEQ ID NO: 7202420 - DNA, 23 bp, Homo sapiens
acagacattccataatgtacacc

SEQ ID NO: 7202421 - DNA, 22 bp, Homo sapiens
acagactgtcatgacactatat

SEQ ID NO: 7202422 - DNA, 22 bp, Homo sapiens
acagactgtgagtatgcatagt

SEQ ID NO: 7202423 - DNA, 22 bp, Homo sapiens
aagcgcccatgcctgagagcgt

SEQ ID NO: 7202424 - DNA, 17 bp, Homo sapiens
aagcggagggccgggcc

SEQ ID NO: 7202425 - DNA, 22 bp, Homo sapiens
aagctaagattacagatttggg

SEQ ID NO: 7202426 - DNA, 22 bp, Homo sapiens
aagctaattgtacttctcacag

SEQ ID NO: 7202427 - DNA, 22 bp, Homo sapiens
aagctacacatctgttgggtat

SEQ ID NO: 7202428 - DNA, 22 bp, Homo sapiens
aagctacacatctgttgggtat

SEQ ID NO: 7202429 - DNA, 21 bp, Homo sapiens
aagctacagaaaataatttga

SEQ ID NO: 7202430 - DNA, 22 bp, Homo sapiens
aagctatacaatgcacaaatga

SEQ ID NO: 7202431 - DNA, 22 bp, Homo sapiens
aagctatacaatgcacaaatga

SEQ ID NO: 7202432 - DNA, 22 bp, Homo sapiens
aagctatcagctactatcagct

SEQ ID NO: 7202433 - DNA, 22 bp, Homo sapiens
aagctagattggcattcatttc

SEQ ID NO: 7202434 - DNA, 22 bp, Homo sapiens
aagctagattggcattcatttc

SEQ ID NO: 7202435 - DNA, 22 bp, Homo sapiens
aagctacagtttacccatggtt

SEQ ID NO: 7202436 - DNA, 22 bp, Homo sapiens
aagctacattaagcagatttac

SEQ ID NO: 7202437 - DNA, 22 bp, Homo sapiens
aagctagataacttttatattt

SEQ ID NO: 7202438 - DNA, 22 bp, Homo sapiens
aagctagataacttttatattt

SEQ ID NO: 7202439 - DNA, 22 bp, Homo sapiens
aagctagatgacgttatttttt

SEQ ID NO: 7202440 - DNA, 22 bp, Homo sapiens
aagctagatgacgttatttttt

SEQ ID NO: 7202441 - DNA, 22 bp, Homo sapiens
aagccttttccacctaatagag

SEQ ID NO: 7202442 - DNA, 22 bp, Homo sapiens
aagcgcaatcttttctgtcttt

SEQ ID NO: 7202443 - DNA, 22 bp, Homo sapiens
aagcctttctctctgggaagga

SEQ ID NO: 7202444 - DNA, 22 bp, Homo sapiens
aagcctttgtttgggaagtttt

SEQ ID NO: 7202445 - DNA, 22 bp, Homo sapiens
aagcctttctctctgggaagga

SEQ ID NO: 7202446 - DNA, 22 bp, Homo sapiens
aagcgccacgagaagctggacc

SEQ ID NO: 7202447 - DNA, 22 bp, Homo sapiens
aagccctggggttgcacaaggc

SEQ ID NO: 7202448 - DNA, 22 bp, Homo sapiens
aagccctggggttgcacaaggc

SEQ ID NO: 7202449 - DNA, 22 bp, Homo sapiens
aagccttggggctcctctgtat

SEQ ID NO: 7202450 - DNA, 22 bp, Homo sapiens
aagccttggcccttcattataa

SEQ ID NO: 7202451 - DNA, 23 bp, Homo sapiens
aagccttgtggaggctctcattt

SEQ ID NO: 7202452 - DNA, 22 bp, Homo sapiens
aagccaaaggctccagtgacct

SEQ ID NO: 7202453 - DNA, 22 bp, Homo sapiens
aagccaaataatgtaggtacat

SEQ ID NO: 7202454 - DNA, 22 bp, Homo sapiens
aagccaagagttaactatttgt

SEQ ID NO: 7202455 - DNA, 22 bp, Homo sapiens
aagccaagtgctggccatgggc

SEQ ID NO: 7202456 - DNA, 22 bp, Homo sapiens
aagccaagtgctggccatgggc

SEQ ID NO: 7202457 - DNA, 22 bp, Homo sapiens
aagccaaggttttggtcacagc

SEQ ID NO: 7202458 - DNA, 22 bp, Homo sapiens
aagccctgggatgttcagcagt

SEQ ID NO: 7202459 - DNA, 22 bp, Homo sapiens
acagcctgtttgatctggtgct

SEQ ID NO: 7202460 - DNA, 22 bp, Homo sapiens
acagcctgtttgatctggtgct

SEQ ID NO: 7202461 - DNA, 19 bp, Homo sapiens
acagcctgttggtggggct

SEQ ID NO: 7202462 - DNA, 22 bp, Homo sapiens
acagcctgtttgatctggtgct

SEQ ID NO: 7202463 - DNA, 22 bp, Homo sapiens
acagcctgtttgatctggtgct

SEQ ID NO: 7202464 - DNA, 22 bp, Homo sapiens
acagcctgtgtaccagctggga

SEQ ID NO: 7202465 - DNA, 22 bp, Homo sapiens
acagcctgtgtaccagctggga

SEQ ID NO: 7202466 - DNA, 19 bp, Homo sapiens
acagcctgttggtggggct

SEQ ID NO: 7202467 - DNA, 21 bp, Homo sapiens
acagcctgtcatctcatggtc

SEQ ID NO: 7202468 - DNA, 21 bp, Homo sapiens
acagcctgtcatctcatggtc

SEQ ID NO: 7202469 - DNA, 21 bp, Homo sapiens
acagcctgtcatctcatggtc

SEQ ID NO: 7202470 - DNA, 22 bp, Homo sapiens
acagcctgtgtaccagctggga

SEQ ID NO: 7202471 - DNA, 22 bp, Homo sapiens
acagcctgtgtaccagctggga

SEQ ID NO: 7202472 - DNA, 22 bp, Homo sapiens
acagcctggcctgagttaaggc

SEQ ID NO: 7202473 - DNA, 22 bp, Homo sapiens
acagcctggcctgagttaaggc

SEQ ID NO: 7202474 - DNA, 22 bp, Homo sapiens
acagcctggactggctctctgc

SEQ ID NO: 7202475 - DNA, 22 bp, Homo sapiens
acagcctggcctgagttaaggc

SEQ ID NO: 7202476 - DNA, 22 bp, Homo sapiens
acagcctggcctgagttaaggc

SEQ ID NO: 7202477 - DNA, 21 bp, Homo sapiens
acagcctgtcatctcatggtc

SEQ ID NO: 7202478 - DNA, 21 bp, Homo sapiens
acagcctgtcatctcatggtc

SEQ ID NO: 7202479 - DNA, 21 bp, Homo sapiens
acagcctgtcatctcatggtc

SEQ ID NO: 7202480 - DNA, 21 bp, Homo sapiens
acagcctgtcatctcatggtc

SEQ ID NO: 7202481 - DNA, 21 bp, Homo sapiens
acagcctgtcatctcatggtc

SEQ ID NO: 7202482 - DNA, 21 bp, Homo sapiens
acagcctgtcatctcatggtc

SEQ ID NO: 7202483 - DNA, 22 bp, Homo sapiens
aagcattttgccacttgaagtt

SEQ ID NO: 7202484 - DNA, 22 bp, Homo sapiens
aagcattttgttttaagaatga

SEQ ID NO: 7202485 - DNA, 22 bp, Homo sapiens
aagcatttttcacagcaacagc

SEQ ID NO: 7202486 - DNA, 22 bp, Homo sapiens
aagcattttagataaagcatca

SEQ ID NO: 7202487 - DNA, 22 bp, Homo sapiens
aagcattttagtaatgaacttg

SEQ ID NO: 7202488 - DNA, 23 bp, Homo sapiens
aagctgccttcgcagttggtctg

SEQ ID NO: 7202489 - DNA, 23 bp, Homo sapiens
aagctgccttcgcagttggtctg

SEQ ID NO: 7202490 - DNA, 22 bp, Homo sapiens
aagctgccttccatgtgaggaa

SEQ ID NO: 7202491 - DNA, 22 bp, Homo sapiens
aagctgcctgccacgctagata

SEQ ID NO: 7202492 - DNA, 22 bp, Homo sapiens
aagctgcctgccacgctagata

SEQ ID NO: 7202493 - DNA, 22 bp, Homo sapiens
aagctgcctgggaggaagggct

SEQ ID NO: 7202494 - DNA, 22 bp, Homo sapiens
aagctgcctagagttgaatgtc

SEQ ID NO: 7202495 - DNA, 19 bp, Homo sapiens
acagggcagcaataggata

SEQ ID NO: 7202496 - DNA, 19 bp, Homo sapiens
acagggcagcaataggata

SEQ ID NO: 7202497 - DNA, 19 bp, Homo sapiens
acagggcagcaataggata

SEQ ID NO: 7202498 - DNA, 22 bp, Homo sapiens
acagggcagagtgaaatgctat

SEQ ID NO: 7202499 - DNA, 22 bp, Homo sapiens
acagggcagcaactttgtgcct

SEQ ID NO: 7202500 - DNA, 22 bp, Homo sapiens
acagggcagcaactttgtgcct

SEQ ID NO: 7202501 - DNA, 22 bp, Homo sapiens
acagggcagcaactttgtgcct

SEQ ID NO: 7202502 - DNA, 19 bp, Homo sapiens
acagggcagcaataggata

SEQ ID NO: 7202503 - DNA, 22 bp, Homo sapiens
acagggcagagggcagttggta

SEQ ID NO: 7202504 - DNA, 22 bp, Homo sapiens
acagggcagagggcagttggta

SEQ ID NO: 7202505 - DNA, 22 bp, Homo sapiens
acagggcagagggcagttggta

SEQ ID NO: 7202506 - DNA, 22 bp, Homo sapiens
acagggcagagtgaaatgctat

SEQ ID NO: 7202507 - DNA, 22 bp, Homo sapiens
acagggcagagtgaaatgctat

SEQ ID NO: 7202508 - DNA, 22 bp, Homo sapiens
acagggcagagaggcaggcttg

SEQ ID NO: 7202509 - DNA, 22 bp, Homo sapiens
acagggcagagaggcaggcttg

SEQ ID NO: 7202510 - DNA, 22 bp, Homo sapiens
acagggcagagggcagttggta

SEQ ID NO: 7202511 - DNA, 22 bp, Homo sapiens
acagggcagaaatgttgcatct

SEQ ID NO: 7202512 - DNA, 22 bp, Homo sapiens
acagggcagagaggcaggcttg

SEQ ID NO: 7202513 - DNA, 22 bp, Homo sapiens
acagggcagagaggcaggcttg

SEQ ID NO: 7202514 - DNA, 22 bp, Homo sapiens
acagggcagagaggcaggcttg

SEQ ID NO: 7202515 - DNA, 17 bp, Homo sapiens
acagggcagaaacagct

SEQ ID NO: 7202516 - DNA, 17 bp, Homo sapiens
acagggcagaaacagct

SEQ ID NO: 7202517 - DNA, 22 bp, Homo sapiens
acagggcagaaatgttgcatct

SEQ ID NO: 7202518 - DNA, 22 bp, Homo sapiens
acagggcagaaatgttgcatct

SEQ ID NO: 7202519 - DNA, 22 bp, Homo sapiens
acagggcagaaatgttgcatct

SEQ ID NO: 7202520 - DNA, 22 bp, Homo sapiens
acagggcagagaggcaggcttg

SEQ ID NO: 7202521 - DNA, 22 bp, Homo sapiens
acagggcagagaggcaggcttg

SEQ ID NO: 7202522 - DNA, 18 bp, Homo sapiens
aagctctggctaggaaaa

SEQ ID NO: 7202523 - DNA, 18 bp, Homo sapiens
aagctctggctaggaaaa

SEQ ID NO: 7202524 - DNA, 20 bp, Homo sapiens
aagctctgcttcatgtggtc

SEQ ID NO: 7202525 - DNA, 22 bp, Homo sapiens
aagctctggttaaaaggcctgg

SEQ ID NO: 7202526 - DNA, 22 bp, Homo sapiens
aagctctgtagctcatgtgata

SEQ ID NO: 7202527 - DNA, 22 bp, Homo sapiens
aagctctgtagctcatgtgata

SEQ ID NO: 7202528 - DNA, 22 bp, Homo sapiens
aagctctgctcagcagactagg

SEQ ID NO: 7202529 - DNA, 22 bp, Homo sapiens
aagctctgctcatgatgacgtt

SEQ ID NO: 7202530 - DNA, 20 bp, Homo sapiens
aagctctgcttcatgtggtc

SEQ ID NO: 7202531 - DNA, 17 bp, Homo sapiens
acagggcagaaacagct

SEQ ID NO: 7202532 - DNA, 17 bp, Homo sapiens
acagggcagaaacagct

SEQ ID NO: 7202533 - DNA, 17 bp, Homo sapiens
acagggcagaaacagct

SEQ ID NO: 7202534 - DNA, 17 bp, Homo sapiens
acagggcagaaacagct

SEQ ID NO: 7202535 - DNA, 22 bp, Homo sapiens
acagggaacaggaatatacaaa

SEQ ID NO: 7202536 - DNA, 22 bp, Homo sapiens
acagggaaagggacagcagcag

SEQ ID NO: 7202537 - DNA, 22 bp, Homo sapiens
acagggaaagggacagcagcag

SEQ ID NO: 7202538 - DNA, 22 bp, Homo sapiens
aagctctgtctcttgggagtta

SEQ ID NO: 7202539 - DNA, 18 bp, Homo sapiens
aagctcttaaatggttca

SEQ ID NO: 7202540 - DNA, 22 bp, Homo sapiens
aagctcttatgatatttattta

SEQ ID NO: 7202541 - DNA, 22 bp, Homo sapiens
aagctcagcagccaggccctgt

SEQ ID NO: 7202542 - DNA, 22 bp, Homo sapiens
aagctcagcatgtctcctagaa

SEQ ID NO: 7202543 - DNA, 22 bp, Homo sapiens
aagctcagagtagctcagcgtc

SEQ ID NO: 7202544 - DNA, 22 bp, Homo sapiens
aagctcagagtctcggagggaa

SEQ ID NO: 7202545 - DNA, 22 bp, Homo sapiens
aagctcagagtctcggagggaa

SEQ ID NO: 7202546 - DNA, 22 bp, Homo sapiens
aagctcagagtctcggagggaa

SEQ ID NO: 7202547 - DNA, 22 bp, Homo sapiens
aagctatgggggagtttcaacc

SEQ ID NO: 7202548 - DNA, 22 bp, Homo sapiens
aagctatgttcctgcactgctc

SEQ ID NO: 7202549 - DNA, 22 bp, Homo sapiens
aagctattgaatttatagcata

SEQ ID NO: 7202550 - DNA, 22 bp, Homo sapiens
aagctattgaatttatagcata

SEQ ID NO: 7202551 - DNA, 22 bp, Homo sapiens
aagctcagagtagctcagcgtc

SEQ ID NO: 7202552 - DNA, 22 bp, Homo sapiens
aagctcaggaaagagtctggtt

SEQ ID NO: 7202553 - DNA, 22 bp, Homo sapiens
aagctcaggctggacctggctt

SEQ ID NO: 7202554 - DNA, 22 bp, Homo sapiens
aagctcaggctggacctggctt

SEQ ID NO: 7202555 - DNA, 22 bp, Homo sapiens
aagctcagtgatgcctccaggg

SEQ ID NO: 7202556 - DNA, 22 bp, Homo sapiens
aagctcagtgatgcctccaggg

SEQ ID NO: 7202557 - DNA, 18 bp, Homo sapiens
aagctcattctcttccta

SEQ ID NO: 7202558 - DNA, 19 bp, Homo sapiens
aagctccagcagatccttt

SEQ ID NO: 7202559 - DNA, 22 bp, Homo sapiens
aagctccccgaaacccacctct

SEQ ID NO: 7202560 - DNA, 22 bp, Homo sapiens
aagctctctgtcccctggactg

SEQ ID NO: 7202561 - DNA, 22 bp, Homo sapiens
aaggaggaatttcagggtgaat

SEQ ID NO: 7202562 - DNA, 22 bp, Homo sapiens
aaggaggaatttcagggtgaat

SEQ ID NO: 7202563 - DNA, 22 bp, Homo sapiens
aaggaggaatttcagggtgaat

SEQ ID NO: 7202564 - DNA, 22 bp, Homo sapiens
aaggaggaatttcagggtgaat

SEQ ID NO: 7202565 - DNA, 22 bp, Homo sapiens
aaggaggaatttcagggtgaat

SEQ ID NO: 7202566 - DNA, 22 bp, Homo sapiens
aaggaggacacccaggactggg

SEQ ID NO: 7202567 - DNA, 22 bp, Homo sapiens
acagtgtttatgtacagattgt

SEQ ID NO: 7202568 - DNA, 22 bp, Homo sapiens
aaggaggacacccaggactggg

SEQ ID NO: 7202569 - DNA, 22 bp, Homo sapiens
aaggaggacacccaggactggg

SEQ ID NO: 7202570 - DNA, 22 bp, Homo sapiens
aaggaggagcggaggcttgttg

SEQ ID NO: 7202571 - DNA, 22 bp, Homo sapiens
aaggaggagtggggtcctggaa

SEQ ID NO: 7202572 - DNA, 22 bp, Homo sapiens
aaggaggcaccctgagcctgcc

SEQ ID NO: 7202573 - DNA, 22 bp, Homo sapiens
acatagaacctggcacatagta

SEQ ID NO: 7202574 - DNA, 22 bp, Homo sapiens
acatagaacctggcacatagta

SEQ ID NO: 7202575 - DNA, 22 bp, Homo sapiens
acatagaacctggcacatagta

SEQ ID NO: 7202576 - DNA, 22 bp, Homo sapiens
acatatgaggtgttattctatg

SEQ ID NO: 7202577 - DNA, 22 bp, Homo sapiens
acatatgaggtgttattctatg

SEQ ID NO: 7202578 - DNA, 22 bp, Homo sapiens
acatagaacttcccagtgagca

SEQ ID NO: 7202579 - DNA, 22 bp, Homo sapiens
acatatctttactcatcatctc

SEQ ID NO: 7202580 - DNA, 20 bp, Homo sapiens
acatatgaatgatagagcca

SEQ ID NO: 7202581 - DNA, 22 bp, Homo sapiens
acatatgtgtctgcacatgccc

SEQ ID NO: 7202582 - DNA, 20 bp, Homo sapiens
acatatgtgtgcatatcttt

SEQ ID NO: 7202583 - DNA, 22 bp, Homo sapiens
acatatgtgttgtacatgcatg

SEQ ID NO: 7202584 - DNA, 22 bp, Homo sapiens
acatatgtctatttcatgtaaa

SEQ ID NO: 7202585 - DNA, 22 bp, Homo sapiens
acatatgtgcttatatccatga

SEQ ID NO: 7202586 - DNA, 19 bp, Homo sapiens
acatatgtggatatacatg

SEQ ID NO: 7202587 - DNA, 22 bp, Homo sapiens
acatatgatattgaggatctca

SEQ ID NO: 7202588 - DNA, 22 bp, Homo sapiens
acatatgatattgaggatctca

SEQ ID NO: 7202589 - DNA, 22 bp, Homo sapiens
acatatgagtactatacagtgc

SEQ ID NO: 7202590 - DNA, 22 bp, Homo sapiens
acatatgagtactatacagtgc

SEQ ID NO: 7202591 - DNA, 22 bp, Homo sapiens
acatatgagtactatacagtgc

SEQ ID NO: 7202592 - DNA, 22 bp, Homo sapiens
acatatgtatatgtacacagtc

SEQ ID NO: 7202593 - DNA, 22 bp, Homo sapiens
acatatgctcatctgcattccc

SEQ ID NO: 7202594 - DNA, 22 bp, Homo sapiens
acatatgtatatgtacacagtc

SEQ ID NO: 7202595 - DNA, 22 bp, Homo sapiens
acatatgcgatcataggatgca

SEQ ID NO: 7202596 - DNA, 22 bp, Homo sapiens
acatatgctcatctgcattccc

SEQ ID NO: 7202597 - DNA, 22 bp, Homo sapiens
aaggcagagggctggatcagag

SEQ ID NO: 7202598 - DNA, 22 bp, Homo sapiens
aaggcagagggctggatcagag

SEQ ID NO: 7202599 - DNA, 22 bp, Homo sapiens
aaggcagagggctggatcagag

SEQ ID NO: 7202600 - DNA, 22 bp, Homo sapiens
aaggcagagggctggatcagag

SEQ ID NO: 7202601 - DNA, 22 bp, Homo sapiens
aaggcagagggctggatcagag

SEQ ID NO: 7202602 - DNA, 22 bp, Homo sapiens
aaggcagagtctatcttggaag

SEQ ID NO: 7202603 - DNA, 22 bp, Homo sapiens
aaggcagagattagcagaatga

SEQ ID NO: 7202604 - DNA, 22 bp, Homo sapiens
aaggcagagattagcagaatga

SEQ ID NO: 7202605 - DNA, 22 bp, Homo sapiens
aaggcagagattagcagaatga

SEQ ID NO: 7202606 - DNA, 22 bp, Homo sapiens
aaggcagagattagcagaatga

SEQ ID NO: 7202607 - DNA, 22 bp, Homo sapiens
aaggcagagattagcagaatga

SEQ ID NO: 7202608 - DNA, 22 bp, Homo sapiens
aaggcagagattagcagaatga

SEQ ID NO: 7202609 - DNA, 22 bp, Homo sapiens
aaggcagaggaaggtctagttt

SEQ ID NO: 7202610 - DNA, 22 bp, Homo sapiens
aaggcagaggaaggtctagttt

SEQ ID NO: 7202611 - DNA, 22 bp, Homo sapiens
aaggaggaataaagaggtggtg

SEQ ID NO: 7202612 - DNA, 22 bp, Homo sapiens
aaggaggaataaagaggtggtg

SEQ ID NO: 7202613 - DNA, 22 bp, Homo sapiens
aaggaggaataaagaggtggtg

SEQ ID NO: 7202614 - DNA, 22 bp, Homo sapiens
aaggaggaataaagaggtggtg

SEQ ID NO: 7202615 - DNA, 19 bp, Homo sapiens
acagtcttacaaatgtcca

SEQ ID NO: 7202616 - DNA, 22 bp, Homo sapiens
acagtcttatgcatacactatt

SEQ ID NO: 7202617 - DNA, 22 bp, Homo sapiens
acagtcttatgcatacactatt

SEQ ID NO: 7202618 - DNA, 22 bp, Homo sapiens
acagtcttgctgtatggtcagg

SEQ ID NO: 7202619 - DNA, 22 bp, Homo sapiens
acagtcttgctgtatggtcagg

SEQ ID NO: 7202620 - DNA, 22 bp, Homo sapiens
acagtcttgcacttctatcagc

SEQ ID NO: 7202621 - DNA, 22 bp, Homo sapiens
acagtcttgcacttctatcagc

SEQ ID NO: 7202622 - DNA, 22 bp, Homo sapiens
acagtctttaatttctttgtgg

SEQ ID NO: 7202623 - DNA, 22 bp, Homo sapiens
acagtctttagagtattgtcct

SEQ ID NO: 7202624 - DNA, 22 bp, Homo sapiens
acagtctttaatttctttgtgg

SEQ ID NO: 7202625 - DNA, 22 bp, Homo sapiens
acagtctttagagtattgtcct

SEQ ID NO: 7202626 - DNA, 22 bp, Homo sapiens
acagtctttcagtaataatact

SEQ ID NO: 7202627 - DNA, 22 bp, Homo sapiens
acagtctttctacattctgtgc

SEQ ID NO: 7202628 - DNA, 17 bp, Homo sapiens
acagtgtctatgaaatg

SEQ ID NO: 7202629 - DNA, 22 bp, Homo sapiens
acagtgtttaaaaatcagatct

SEQ ID NO: 7202630 - DNA, 22 bp, Homo sapiens
aaggagacatttgcagagcacc

SEQ ID NO: 7202631 - DNA, 22 bp, Homo sapiens
aaggagacatttgcagagcacc

SEQ ID NO: 7202632 - DNA, 22 bp, Homo sapiens
aaggacaggctaacctgacatt

SEQ ID NO: 7202633 - DNA, 22 bp, Homo sapiens
aaggacaggctaacctgacatt

SEQ ID NO: 7202634 - DNA, 22 bp, Homo sapiens
aaggacaggctaacctgacatt

SEQ ID NO: 7202635 - DNA, 20 bp, Homo sapiens
aaggagaatgacacggctgc

SEQ ID NO: 7202636 - DNA, 22 bp, Homo sapiens
aaggagacatttgcagagcacc

SEQ ID NO: 7202637 - DNA, 22 bp, Homo sapiens
aaggagacatttgcagagcacc

SEQ ID NO: 7202638 - DNA, 22 bp, Homo sapiens
aaggagacatttgcagagcacc

SEQ ID NO: 7202639 - DNA, 22 bp, Homo sapiens
aaggagacttggcatcacttaa

SEQ ID NO: 7202640 - DNA, 22 bp, Homo sapiens
aaggagagagctttgctggaac

SEQ ID NO: 7202641 - DNA, 22 bp, Homo sapiens
aaggagagagctttgctggaac

SEQ ID NO: 7202642 - DNA, 22 bp, Homo sapiens
aaggagagagctttgctggaac

SEQ ID NO: 7202643 - DNA, 22 bp, Homo sapiens
aaggagagagctttgctggaac

SEQ ID NO: 7202644 - DNA, 22 bp, Homo sapiens
aaggacaggctaacctgacatt

SEQ ID NO: 7202645 - DNA, 22 bp, Homo sapiens
aaggacaggctaacctgacatt

SEQ ID NO: 7202646 - DNA, 22 bp, Homo sapiens
aaggacaggctaacctgacatt

SEQ ID NO: 7202647 - DNA, 22 bp, Homo sapiens
aaggacaggcacagtggtggag

SEQ ID NO: 7202648 - DNA, 22 bp, Homo sapiens
aaggacaggcacagtggtggag

SEQ ID NO: 7202649 - DNA, 22 bp, Homo sapiens
aagctggagagttaggtgaata

SEQ ID NO: 7202650 - DNA, 22 bp, Homo sapiens
aagctggacactgacccactgt

SEQ ID NO: 7202651 - DNA, 22 bp, Homo sapiens
aagctggaacatcttgaggaag

SEQ ID NO: 7202652 - DNA, 22 bp, Homo sapiens
aagctggaacatcttgaggaag

SEQ ID NO: 7202653 - DNA, 20 bp, Homo sapiens
aagctggaagaccagcattg

SEQ ID NO: 7202654 - DNA, 22 bp, Homo sapiens
aagctggacactgacccactgt

SEQ ID NO: 7202655 - DNA, 22 bp, Homo sapiens
aagctggacattgtagggggga

SEQ ID NO: 7202656 - DNA, 22 bp, Homo sapiens
aagctggacattgtagggggga

SEQ ID NO: 7202657 - DNA, 22 bp, Homo sapiens
aagctggactctgccatttact

SEQ ID NO: 7202658 - DNA, 22 bp, Homo sapiens
aaggagcgcttagggggcagaa

SEQ ID NO: 7202659 - DNA, 22 bp, Homo sapiens
aaggagcggagcctgctttcct

SEQ ID NO: 7202660 - DNA, 22 bp, Homo sapiens
aaggagctcttaaaatcagaga

SEQ ID NO: 7202661 - DNA, 22 bp, Homo sapiens
aaggagagtacaggagttggta

SEQ ID NO: 7202662 - DNA, 22 bp, Homo sapiens
aaggagagtacaggagttggta

SEQ ID NO: 7202663 - DNA, 22 bp, Homo sapiens
aaggagagagctttgctggaac

SEQ ID NO: 7202664 - DNA, 22 bp, Homo sapiens
aaggagagagctttgctggaac

SEQ ID NO: 7202665 - DNA, 22 bp, Homo sapiens
aaggagagagctttgctggaac

SEQ ID NO: 7202666 - DNA, 22 bp, Homo sapiens
aaggagattgttaaagctatat

SEQ ID NO: 7202667 - DNA, 22 bp, Homo sapiens
aaggagattgttaaagctatat

SEQ ID NO: 7202668 - DNA, 22 bp, Homo sapiens
aaggagcacacaatctagaacc

SEQ ID NO: 7202669 - DNA, 22 bp, Homo sapiens
aaggagagtacaggagttggta

SEQ ID NO: 7202670 - DNA, 20 bp, Homo sapiens
aaggcagagtgggttggagc

SEQ ID NO: 7202671 - DNA, 20 bp, Homo sapiens
aaggcagagtgggttggagc

SEQ ID NO: 7202672 - DNA, 20 bp, Homo sapiens
aaggcagagtgggttggagc

SEQ ID NO: 7202673 - DNA, 22 bp, Homo sapiens
aaggcagataagaattcagcaa

SEQ ID NO: 7202674 - DNA, 22 bp, Homo sapiens
aaggcagataagaattcagcaa

SEQ ID NO: 7202675 - DNA, 22 bp, Homo sapiens
aaggccaggggctggcgcctcc

SEQ ID NO: 7202676 - DNA, 22 bp, Homo sapiens
aaggcccttggaaaatgcagta

SEQ ID NO: 7202677 - DNA, 22 bp, Homo sapiens
aaggccctttagcagaggaggg

SEQ ID NO: 7202678 - DNA, 22 bp, Homo sapiens
aaggcctccctgtgtgcaggtg

SEQ ID NO: 7202679 - DNA, 22 bp, Homo sapiens
aaggcctcttctctctggagat

SEQ ID NO: 7202680 - DNA, 22 bp, Homo sapiens
aaggcctgctcagctgtctgtg

SEQ ID NO: 7202681 - DNA, 22 bp, Homo sapiens
aaggcctgaacatgaggagatg

SEQ ID NO: 7202682 - DNA, 22 bp, Homo sapiens
aaggcctgaacatgaggagatg

SEQ ID NO: 7202683 - DNA, 22 bp, Homo sapiens
aaggcctgctcagctgtctgtg

SEQ ID NO: 7202684 - DNA, 21 bp, Homo sapiens
aaggcctgcttactgctagtt

SEQ ID NO: 7202685 - DNA, 21 bp, Homo sapiens
aaggcctgcttactgctagtt

SEQ ID NO: 7202686 - DNA, 22 bp, Homo sapiens
aaggccttctcttgtgtctgtg

SEQ ID NO: 7202687 - DNA, 22 bp, Homo sapiens
aaggccttctcttgtgtctgtg

SEQ ID NO: 7202688 - DNA, 22 bp, Homo sapiens
aaggccttgccgaaggatgcca

SEQ ID NO: 7202689 - DNA, 22 bp, Homo sapiens
aaggccttgcctgacagcacca

SEQ ID NO: 7202690 - DNA, 22 bp, Homo sapiens
aaggccttggctctctgtgtgc

SEQ ID NO: 7202691 - DNA, 22 bp, Homo sapiens
aaggccttggctctctgtgtgc

SEQ ID NO: 7202692 - DNA, 22 bp, Homo sapiens
aaggcctttaggctttcattgt

SEQ ID NO: 7202693 - DNA, 22 bp, Homo sapiens
aaggcctttctagctttgtgct

SEQ ID NO: 7202694 - DNA, 22 bp, Homo sapiens
aaggcctttctagctttgtgct

SEQ ID NO: 7202695 - DNA, 22 bp, Homo sapiens
aaggcctttcttatcagtagat

SEQ ID NO: 7202696 - DNA, 22 bp, Homo sapiens
aaggcctttcttatcagtagat

SEQ ID NO: 7202697 - DNA, 22 bp, Homo sapiens
aaggctctctgatggcagcagt

SEQ ID NO: 7202698 - DNA, 22 bp, Homo sapiens
aaggctctctgatggcagcagt

SEQ ID NO: 7202699 - DNA, 22 bp, Homo sapiens
aaggctctgcaaaacctccaag

SEQ ID NO: 7202700 - DNA, 21 bp, Homo sapiens
aaggctcctcctctaggcctc

SEQ ID NO: 7202701 - DNA, 22 bp, Homo sapiens
aaggctctccaaatgatataat

SEQ ID NO: 7202702 - DNA, 22 bp, Homo sapiens
aaggctctgcaaaacctccaag

SEQ ID NO: 7202703 - DNA, 22 bp, Homo sapiens
aaggctctgcaaaacctccaag

SEQ ID NO: 7202704 - DNA, 22 bp, Homo sapiens
aaggctctgggtttcataggtg

SEQ ID NO: 7202705 - DNA, 22 bp, Homo sapiens
acattcttccagctggctgttg

SEQ ID NO: 7202706 - DNA, 22 bp, Homo sapiens
acattcttgaagtgaagtttat

SEQ ID NO: 7202707 - DNA, 22 bp, Homo sapiens
acattgttagtagaccagtggc

SEQ ID NO: 7202708 - DNA, 22 bp, Homo sapiens
acattgttagtagaccagtggc

SEQ ID NO: 7202709 - DNA, 23 bp, Homo sapiens
acattgttcaatgaaagttagga

SEQ ID NO: 7202710 - DNA, 23 bp, Homo sapiens
acattgttcaatgaaagttagga

SEQ ID NO: 7202711 - DNA, 22 bp, Homo sapiens
acattgttcacaggggcttctc

SEQ ID NO: 7202712 - DNA, 22 bp, Homo sapiens
acattgttcacaggggcttctc

SEQ ID NO: 7202713 - DNA, 22 bp, Homo sapiens
acattgttccagcgatagagaa

SEQ ID NO: 7202714 - DNA, 22 bp, Homo sapiens
acattgttccagcgatagagaa

SEQ ID NO: 7202715 - DNA, 22 bp, Homo sapiens
acattgttcctgagaacttggg

SEQ ID NO: 7202716 - DNA, 22 bp, Homo sapiens
acattgttcctgagaacttggg

SEQ ID NO: 7202717 - DNA, 22 bp, Homo sapiens
aaggctcagctactcagcctgc

SEQ ID NO: 7202718 - DNA, 22 bp, Homo sapiens
aaggctcagctactcagcctgc

SEQ ID NO: 7202719 - DNA, 22 bp, Homo sapiens
aaggctcaattaactaagaagt

SEQ ID NO: 7202720 - DNA, 22 bp, Homo sapiens
aaggctcaaagaagctaagtga

SEQ ID NO: 7202721 - DNA, 22 bp, Homo sapiens
aaggctccagtgaatgctggca

SEQ ID NO: 7202722 - DNA, 22 bp, Homo sapiens
aaggcctttgccccgatacagg

SEQ ID NO: 7202723 - DNA, 22 bp, Homo sapiens
aaggcctttgggggcctggtcc

SEQ ID NO: 7202724 - DNA, 22 bp, Homo sapiens
aaggcctttcctgctttgaatg

SEQ ID NO: 7202725 - DNA, 22 bp, Homo sapiens
aaggcgacacaggcagcaggcc

SEQ ID NO: 7202726 - DNA, 22 bp, Homo sapiens
aaggcggggggatcacgaggtc

SEQ ID NO: 7202727 - DNA, 22 bp, Homo sapiens
aaggctaaattctgtactgcat

SEQ ID NO: 7202728 - DNA, 22 bp, Homo sapiens
aaggctatattcattattctct

SEQ ID NO: 7202729 - DNA, 22 bp, Homo sapiens
aaggctatgatctttttcatga

SEQ ID NO: 7202730 - DNA, 22 bp, Homo sapiens
aaggctggacctggatgaatct

SEQ ID NO: 7202731 - DNA, 19 bp, Homo sapiens
acatttaaattcagatctc

SEQ ID NO: 7202732 - DNA, 19 bp, Homo sapiens
aaggctggagaaggcctct

SEQ ID NO: 7202733 - DNA, 22 bp, Homo sapiens
aaggctggacctggatgaatct

SEQ ID NO: 7202734 - DNA, 22 bp, Homo sapiens
aaggctggacctggatgaatct

SEQ ID NO: 7202735 - DNA, 22 bp, Homo sapiens
aaggctggacctggatgaatct

SEQ ID NO: 7202736 - DNA, 22 bp, Homo sapiens
aaggctggacctggatgaatct

SEQ ID NO: 7202737 - DNA, 22 bp, Homo sapiens
aaggctggagatggttggaatg

SEQ ID NO: 7202738 - DNA, 22 bp, Homo sapiens
aaggctggagatggttggaatg

SEQ ID NO: 7202739 - DNA, 21 bp, Homo sapiens
aaggctggagatgcaggtctg

SEQ ID NO: 7202740 - DNA, 21 bp, Homo sapiens
aaggctggagatgcaggtctg

SEQ ID NO: 7202741 - DNA, 21 bp, Homo sapiens
aaggctggagatgcaggtctg

SEQ ID NO: 7202742 - DNA, 22 bp, Homo sapiens
acatttaaatacctatgtttct

SEQ ID NO: 7202743 - DNA, 22 bp, Homo sapiens
acatttaaatacctatgtttct

SEQ ID NO: 7202744 - DNA, 22 bp, Homo sapiens
acattgtttgagaatacagatg

SEQ ID NO: 7202745 - DNA, 22 bp, Homo sapiens
acattgtttgagaatacagatg

SEQ ID NO: 7202746 - DNA, 22 bp, Homo sapiens
acattgtttggaggagtgagag

SEQ ID NO: 7202747 - DNA, 22 bp, Homo sapiens
acattgtttggaggagtgagag

SEQ ID NO: 7202748 - DNA, 22 bp, Homo sapiens
acatttaaatacctatgtttct

SEQ ID NO: 7202749 - DNA, 22 bp, Homo sapiens
acatttaaatacctatgtttct

SEQ ID NO: 7202750 - DNA, 22 bp, Homo sapiens
acatttaaatatgccttatatt

SEQ ID NO: 7202751 - DNA, 22 bp, Homo sapiens
acatttaaatatgccttatatt

SEQ ID NO: 7202752 - DNA, 22 bp, Homo sapiens
acattgttgtgcaattatagtt

SEQ ID NO: 7202753 - DNA, 22 bp, Homo sapiens
acattgttgtgcaattatagtt

SEQ ID NO: 7202754 - DNA, 22 bp, Homo sapiens
acattgttgtttgcagcacagg

SEQ ID NO: 7202755 - DNA, 22 bp, Homo sapiens
acattgttgtttgcagcacagg

SEQ ID NO: 7202756 - DNA, 22 bp, Homo sapiens
acattgttgtttgcagcacagg

SEQ ID NO: 7202757 - DNA, 22 bp, Homo sapiens
acattgtttctgaccatgatga

SEQ ID NO: 7202758 - DNA, 22 bp, Homo sapiens
acattgtttctgaccatgatga

SEQ ID NO: 7202759 - DNA, 22 bp, Homo sapiens
acattgtttgagaatacagatg

SEQ ID NO: 7202760 - DNA, 22 bp, Homo sapiens
acattgttctacttctagttag

SEQ ID NO: 7202761 - DNA, 22 bp, Homo sapiens
acattgttctacttctagttag

SEQ ID NO: 7202762 - DNA, 22 bp, Homo sapiens
acattgttgagcctcttgttca

SEQ ID NO: 7202763 - DNA, 22 bp, Homo sapiens
acattgttgagcctcttgttca

SEQ ID NO: 7202764 - DNA, 22 bp, Homo sapiens
acattgttgcctagccatgagt

SEQ ID NO: 7202765 - DNA, 22 bp, Homo sapiens
acattgttgtgcaattatagtt

SEQ ID NO: 7202766 - DNA, 22 bp, Homo sapiens
acattgttgcctagccatgagt

SEQ ID NO: 7202767 - DNA, 22 bp, Homo sapiens
acattgttgtgcaattatagtt

SEQ ID NO: 7202768 - DNA, 22 bp, Homo sapiens
acatttctgctagaataggtga

SEQ ID NO: 7202769 - DNA, 22 bp, Homo sapiens
acatttcttcctaattatccct

SEQ ID NO: 7202770 - DNA, 22 bp, Homo sapiens
acatttgtgcaacgtatccaca

SEQ ID NO: 7202771 - DNA, 22 bp, Homo sapiens
acatttcatgttttccagagca

SEQ ID NO: 7202772 - DNA, 22 bp, Homo sapiens
acatttcatttgcagtatggat

SEQ ID NO: 7202773 - DNA, 22 bp, Homo sapiens
aaggctggcaatatatttgtta

SEQ ID NO: 7202774 - DNA, 22 bp, Homo sapiens
aaggctgggaaacatgcaggcc

SEQ ID NO: 7202775 - DNA, 22 bp, Homo sapiens
aaggctgggaaacatgcaggcc

SEQ ID NO: 7202776 - DNA, 22 bp, Homo sapiens
acatttcatttgcagtatggat

SEQ ID NO: 7202777 - DNA, 22 bp, Homo sapiens
acatttctcttgatgtctctat

SEQ ID NO: 7202778 - DNA, 22 bp, Homo sapiens
acatttctgctagaataggtga

SEQ ID NO: 7202779 - DNA, 22 bp, Homo sapiens
acccagagctgggcttggcaaa

SEQ ID NO: 7202780 - DNA, 22 bp, Homo sapiens
acccagagctgggcttggcaaa

SEQ ID NO: 7202781 - DNA, 19 bp, Homo sapiens
acccagagccctttgcagg

SEQ ID NO: 7202782 - DNA, 22 bp, Homo sapiens
aaggggaaaaagtgttaggagt

SEQ ID NO: 7202783 - DNA, 22 bp, Homo sapiens
aaggggaaaaagtgttaggagt

SEQ ID NO: 7202784 - DNA, 22 bp, Homo sapiens
aagggcttagatttagaacatg

SEQ ID NO: 7202785 - DNA, 22 bp, Homo sapiens
aagggcttgatcatgttgaaga

SEQ ID NO: 7202786 - DNA, 22 bp, Homo sapiens
aagggctgttatgtttttatac

SEQ ID NO: 7202787 - DNA, 22 bp, Homo sapiens
aagggctgttatgtttttatac

SEQ ID NO: 7202788 - DNA, 22 bp, Homo sapiens
aagggcttaagaatcttcaagg

SEQ ID NO: 7202789 - DNA, 22 bp, Homo sapiens
aagggctgtagtttgttgatca

SEQ ID NO: 7202790 - DNA, 22 bp, Homo sapiens
aagggctgtagtttgttgatca

SEQ ID NO: 7202791 - DNA, 22 bp, Homo sapiens
aagggctgtagacaagattgct

SEQ ID NO: 7202792 - DNA, 22 bp, Homo sapiens
aagggctgtagacaagattgct

SEQ ID NO: 7202793 - DNA, 22 bp, Homo sapiens
aagggctgtaagccaagtaaag

SEQ ID NO: 7202794 - DNA, 22 bp, Homo sapiens
aagggctgtaagccaagtaaag

SEQ ID NO: 7202795 - DNA, 22 bp, Homo sapiens
aagggctgtaagccaagtaaag

SEQ ID NO: 7202796 - DNA, 22 bp, Homo sapiens
aagggctgtaagccaagtaaag

SEQ ID NO: 7202797 - DNA, 22 bp, Homo sapiens
aagggctggtctagaaagggag

SEQ ID NO: 7202798 - DNA, 22 bp, Homo sapiens
aagggctggtctagaaagggag

SEQ ID NO: 7202799 - DNA, 22 bp, Homo sapiens
aagggctggtctagaaagggag

SEQ ID NO: 7202800 - DNA, 22 bp, Homo sapiens
aagggctggtctagaaagggag

SEQ ID NO: 7202801 - DNA, 22 bp, Homo sapiens
aagggctgggtctggttaaccc

SEQ ID NO: 7202802 - DNA, 22 bp, Homo sapiens
aagggctgggtctggttaaccc

SEQ ID NO: 7202803 - DNA, 22 bp, Homo sapiens
accagggcacaggagtctgaag

SEQ ID NO: 7202804 - DNA, 22 bp, Homo sapiens
accagggcacaggagtctgaag

SEQ ID NO: 7202805 - DNA, 22 bp, Homo sapiens
accagggcaaatgtttgtactc

SEQ ID NO: 7202806 - DNA, 21 bp, Homo sapiens
accaggcttgtgggagggagc

SEQ ID NO: 7202807 - DNA, 21 bp, Homo sapiens
accaggcttgtgggagggagc

SEQ ID NO: 7202808 - DNA, 22 bp, Homo sapiens
accaggcttgatgatttgctta

SEQ ID NO: 7202809 - DNA, 22 bp, Homo sapiens
accaggcttgatgatttgctta

SEQ ID NO: 7202810 - DNA, 22 bp, Homo sapiens
accaggcttgataccaagaaat

SEQ ID NO: 7202811 - DNA, 22 bp, Homo sapiens
accaggcttgataccaagaaat

SEQ ID NO: 7202812 - DNA, 19 bp, Homo sapiens
accaggcttatggtcagtg

SEQ ID NO: 7202813 - DNA, 19 bp, Homo sapiens
accaggcttatggtcagtg

SEQ ID NO: 7202814 - DNA, 22 bp, Homo sapiens
accaggcttaatcctttgctat

SEQ ID NO: 7202815 - DNA, 19 bp, Homo sapiens
accaggcttatggtcagtg

SEQ ID NO: 7202816 - DNA, 22 bp, Homo sapiens
accaggctgttgggcccagtgt

SEQ ID NO: 7202817 - DNA, 22 bp, Homo sapiens
accaggctgttgggcccagtgt

SEQ ID NO: 7202818 - DNA, 21 bp, Homo sapiens
acattttctgttttaggaagt

SEQ ID NO: 7202819 - DNA, 22 bp, Homo sapiens
acattttgaaagggaaattgtt

SEQ ID NO: 7202820 - DNA, 22 bp, Homo sapiens
acattttgaaagggaaattgtt

SEQ ID NO: 7202821 - DNA, 22 bp, Homo sapiens
acattttgcccttatttgctga

SEQ ID NO: 7202822 - DNA, 21 bp, Homo sapiens
accaggccaggaggctggcac

SEQ ID NO: 7202823 - DNA, 21 bp, Homo sapiens
accaggccaggaggctggcac

SEQ ID NO: 7202824 - DNA, 22 bp, Homo sapiens
accaggcccaccgcatgctcct

SEQ ID NO: 7202825 - DNA, 22 bp, Homo sapiens
accaggcccaccgcatgctcct

SEQ ID NO: 7202826 - DNA, 22 bp, Homo sapiens
accaggcccaccgcatgctcct

SEQ ID NO: 7202827 - DNA, 21 bp, Homo sapiens
acattttctgttttaggaagt

SEQ ID NO: 7202828 - DNA, 22 bp, Homo sapiens
acattttacagttgtctggcta

SEQ ID NO: 7202829 - DNA, 22 bp, Homo sapiens
acattttacagttgtctggcta

SEQ ID NO: 7202830 - DNA, 22 bp, Homo sapiens
acattttacaccaagacttctt

SEQ ID NO: 7202831 - DNA, 22 bp, Homo sapiens
acattttacagttgtctggcta

SEQ ID NO: 7202832 - DNA, 22 bp, Homo sapiens
acattttacagttgtctggcta

SEQ ID NO: 7202833 - DNA, 22 bp, Homo sapiens
acattttacaccaagacttctt

SEQ ID NO: 7202834 - DNA, 22 bp, Homo sapiens
acattttacaccaagacttctt

SEQ ID NO: 7202835 - DNA, 22 bp, Homo sapiens
acattttacaccaagacttctt

SEQ ID NO: 7202836 - DNA, 22 bp, Homo sapiens
acattttacaccaagacttctt

SEQ ID NO: 7202837 - DNA, 22 bp, Homo sapiens
acattttacaccaagacttctt

SEQ ID NO: 7202838 - DNA, 22 bp, Homo sapiens
acattttaatatgcttagtgtg

SEQ ID NO: 7202839 - DNA, 22 bp, Homo sapiens
acattttaatatgcttagtgtg

SEQ ID NO: 7202840 - DNA, 22 bp, Homo sapiens
acatttgttgccattcatggag

SEQ ID NO: 7202841 - DNA, 22 bp, Homo sapiens
acatttgtgcacatgtgcatgg

SEQ ID NO: 7202842 - DNA, 20 bp, Homo sapiens
acatttgtggatctgagaga

SEQ ID NO: 7202843 - DNA, 20 bp, Homo sapiens
acatttgtggatctgagaga

SEQ ID NO: 7202844 - DNA, 22 bp, Homo sapiens
acatttgtgggggaacaggata

SEQ ID NO: 7202845 - DNA, 22 bp, Homo sapiens
acatttgttcagggctgaggaa

SEQ ID NO: 7202846 - DNA, 22 bp, Homo sapiens
accgggaagtcctgcactgggc

SEQ ID NO: 7202847 - DNA, 22 bp, Homo sapiens
accgggaagtcctgcactgggc

SEQ ID NO: 7202848 - DNA, 22 bp, Homo sapiens
accctgcctctgcttcctgtag

SEQ ID NO: 7202849 - DNA, 22 bp, Homo sapiens
acccttttgcctttaattcatg

SEQ ID NO: 7202850 - DNA, 22 bp, Homo sapiens
accctgccgtgggctgcttgtg

SEQ ID NO: 7202851 - DNA, 22 bp, Homo sapiens
accctgcctctgcttcctgtag

SEQ ID NO: 7202852 - DNA, 22 bp, Homo sapiens
accctgccgtgggctgcttgtg

SEQ ID NO: 7202853 - DNA, 20 bp, Homo sapiens
accctgccaggcatgtgaat

SEQ ID NO: 7202854 - DNA, 22 bp, Homo sapiens
accctgccctctccagctcagg

SEQ ID NO: 7202855 - DNA, 22 bp, Homo sapiens
accctgccctctccagctcagg

SEQ ID NO: 7202856 - DNA, 22 bp, Homo sapiens
accctgccgtgggctgcttgtg

SEQ ID NO: 7202857 - DNA, 22 bp, Homo sapiens
accctgaggggtatagcagaag

SEQ ID NO: 7202858 - DNA, 22 bp, Homo sapiens
accctgaggggtatagcagaag

SEQ ID NO: 7202859 - DNA, 22 bp, Homo sapiens
accctgagggtgctgggtttct

SEQ ID NO: 7202860 - DNA, 22 bp, Homo sapiens
accctgagtcactgtctgtctg

SEQ ID NO: 7202861 - DNA, 22 bp, Homo sapiens
accctgagtcagacagcctgac

SEQ ID NO: 7202862 - DNA, 22 bp, Homo sapiens
accctgagtgcaacggtgagga

SEQ ID NO: 7202863 - DNA, 20 bp, Homo sapiens
accctgcatactggaaggct

SEQ ID NO: 7202864 - DNA, 22 bp, Homo sapiens
accctgccaaggatggccccga

SEQ ID NO: 7202865 - DNA, 20 bp, Homo sapiens
accctgccaggcatgtgaat

SEQ ID NO: 7202866 - DNA, 22 bp, Homo sapiens
acccaggatagagtgctgcagt

SEQ ID NO: 7202867 - DNA, 22 bp, Homo sapiens
acccaggatagagtgctgcagt

SEQ ID NO: 7202868 - DNA, 22 bp, Homo sapiens
acccaggatagagtgctgcagt

SEQ ID NO: 7202869 - DNA, 22 bp, Homo sapiens
acccaggatgataatgttcaca

SEQ ID NO: 7202870 - DNA, 22 bp, Homo sapiens
acccctcatcagttgcttccta

SEQ ID NO: 7202871 - DNA, 22 bp, Homo sapiens
accccttctcctggctgttcca

SEQ ID NO: 7202872 - DNA, 22 bp, Homo sapiens
acccctccattctgaaggctgc

SEQ ID NO: 7202873 - DNA, 22 bp, Homo sapiens
accccttgaaggcagagaagct

SEQ ID NO: 7202874 - DNA, 22 bp, Homo sapiens
accctgaagaaacttctaagtg

SEQ ID NO: 7202875 - DNA, 22 bp, Homo sapiens
accctgagaaagtcacatgcat

SEQ ID NO: 7202876 - DNA, 22 bp, Homo sapiens
accctgagaaagtcacatgcat

SEQ ID NO: 7202877 - DNA, 22 bp, Homo sapiens
accctgagaatgagtgtctcct

SEQ ID NO: 7202878 - DNA, 22 bp, Homo sapiens
accctgagaatgagtgtctcct

SEQ ID NO: 7202879 - DNA, 19 bp, Homo sapiens
accctgagaggtggtccgg

SEQ ID NO: 7202880 - DNA, 22 bp, Homo sapiens
accctgagatgccacagcatga

SEQ ID NO: 7202881 - DNA, 22 bp, Homo sapiens
accctgagccaaaccagttaga

SEQ ID NO: 7202882 - DNA, 22 bp, Homo sapiens
accctgagccgccaggaaggcc

SEQ ID NO: 7202883 - DNA, 22 bp, Homo sapiens
accctgagccgccaggaaggcc

SEQ ID NO: 7202884 - DNA, 20 bp, Homo sapiens
accctgaggctccccagcct

SEQ ID NO: 7202885 - DNA, 22 bp, Homo sapiens
accctgagggatgagagttgca

SEQ ID NO: 7202886 - DNA, 22 bp, Homo sapiens
accctgagggatgagagttgca

SEQ ID NO: 7202887 - DNA, 22 bp, Homo sapiens
acccaggaggtggaggctgcag

SEQ ID NO: 7202888 - DNA, 22 bp, Homo sapiens
acccaggaggtggaggctgcag

SEQ ID NO: 7202889 - DNA, 22 bp, Homo sapiens
acccaggaggtggaggctgcag

SEQ ID NO: 7202890 - DNA, 22 bp, Homo sapiens
acccaggaggtgacacagggct

SEQ ID NO: 7202891 - DNA, 22 bp, Homo sapiens
acccaggaggtgacacagggct

SEQ ID NO: 7202892 - DNA, 22 bp, Homo sapiens
acccaggaggtgacacagggct

SEQ ID NO: 7202893 - DNA, 22 bp, Homo sapiens
acccaggaggtggaggctgcag

SEQ ID NO: 7202894 - DNA, 22 bp, Homo sapiens
acccaggataatctgtgtatct

SEQ ID NO: 7202895 - DNA, 22 bp, Homo sapiens
acccaggataatctgtgtatct

SEQ ID NO: 7202896 - DNA, 22 bp, Homo sapiens
acccaggataatctgtgtatct

SEQ ID NO: 7202897 - DNA, 22 bp, Homo sapiens
acccaggatagagtgctgcagt

SEQ ID NO: 7202898 - DNA, 22 bp, Homo sapiens
acccaggatagagtgctgcagt

SEQ ID NO: 7202899 - DNA, 22 bp, Homo sapiens
acccaggagccgtgagaggtta

SEQ ID NO: 7202900 - DNA, 22 bp, Homo sapiens
acccaggagccgtgagaggtta

SEQ ID NO: 7202901 - DNA, 22 bp, Homo sapiens
acccaggagccgtgagaggtta

SEQ ID NO: 7202902 - DNA, 22 bp, Homo sapiens
acccaggagctctggggtcctc

SEQ ID NO: 7202903 - DNA, 22 bp, Homo sapiens
acccaggagctctggggtcctc

SEQ ID NO: 7202904 - DNA, 22 bp, Homo sapiens
acccaggagctctggggtcctc

SEQ ID NO: 7202905 - DNA, 22 bp, Homo sapiens
acccaggagctctggggtcctc

SEQ ID NO: 7202906 - DNA, 22 bp, Homo sapiens
acccaggaggcaaggttgcagt

SEQ ID NO: 7202907 - DNA, 22 bp, Homo sapiens
acccaggaggcaaggttgcagt

SEQ ID NO: 7202908 - DNA, 22 bp, Homo sapiens
acccaggaggcaaggttgcagt

SEQ ID NO: 7202909 - DNA, 22 bp, Homo sapiens
acccaggaggcagaggttgcag

SEQ ID NO: 7202910 - DNA, 22 bp, Homo sapiens
acccaggaggcagaggttgcag

SEQ ID NO: 7202911 - DNA, 22 bp, Homo sapiens
acccaggaggcagaggttgcag

SEQ ID NO: 7202912 - DNA, 22 bp, Homo sapiens
acccagagtcatgtttattccc

SEQ ID NO: 7202913 - DNA, 22 bp, Homo sapiens
acccagagtgtctgtctcagtc

SEQ ID NO: 7202914 - DNA, 22 bp, Homo sapiens
acccagagtgtctgtctcagtc

SEQ ID NO: 7202915 - DNA, 22 bp, Homo sapiens
acccaggagccgtgagaggtta

SEQ ID NO: 7202916 - DNA, 22 bp, Homo sapiens
acccagagtcagacagccatgg

SEQ ID NO: 7202917 - DNA, 22 bp, Homo sapiens
acccagagtcagacagccatgg

SEQ ID NO: 7202918 - DNA, 22 bp, Homo sapiens
acccagagtcatggcacttagc

SEQ ID NO: 7202919 - DNA, 22 bp, Homo sapiens
acccagagtaacagatggattc

SEQ ID NO: 7202920 - DNA, 22 bp, Homo sapiens
acccagagtaacagatggattc

SEQ ID NO: 7202921 - DNA, 22 bp, Homo sapiens
actttcttaggctgtataaatg

SEQ ID NO: 7202922 - DNA, 22 bp, Homo sapiens
actttcttaggctgtataaatg

SEQ ID NO: 7202923 - DNA, 22 bp, Homo sapiens
actttcttggtcccatgtttga

SEQ ID NO: 7202924 - DNA, 22 bp, Homo sapiens
actttcttggtcccatgtttga

SEQ ID NO: 7202925 - DNA, 22 bp, Homo sapiens
actttcttggtcccatgtttga

SEQ ID NO: 7202926 - DNA, 22 bp, Homo sapiens
actttcttcttatgcattaagg

SEQ ID NO: 7202927 - DNA, 22 bp, Homo sapiens
actttcttaggctgtataaatg

SEQ ID NO: 7202928 - DNA, 22 bp, Homo sapiens
actttcttatccatgatctcac

SEQ ID NO: 7202929 - DNA, 22 bp, Homo sapiens
actttcttctactacttggaga

SEQ ID NO: 7202930 - DNA, 22 bp, Homo sapiens
actttcttggtcccatgtttga

SEQ ID NO: 7202931 - DNA, 22 bp, Homo sapiens
actttgaaaagacagtagctct

SEQ ID NO: 7202932 - DNA, 22 bp, Homo sapiens
actttgaaaagacagtagctct

SEQ ID NO: 7202933 - DNA, 22 bp, Homo sapiens
actttgaaactaaaattcatta

SEQ ID NO: 7202934 - DNA, 22 bp, Homo sapiens
actttgaaactaaaattcatta

SEQ ID NO: 7202935 - DNA, 22 bp, Homo sapiens
actttgaaatgtgtaagagaga

SEQ ID NO: 7202936 - DNA, 22 bp, Homo sapiens
actttgaaggggaacattttaa

SEQ ID NO: 7202937 - DNA, 22 bp, Homo sapiens
aatcacatctcattcaacagcc

SEQ ID NO: 7202938 - DNA, 22 bp, Homo sapiens
aatcacatgaaaactgtgtgtt

SEQ ID NO: 7202939 - DNA, 22 bp, Homo sapiens
aatcacatgcagggcctccacc

SEQ ID NO: 7202940 - DNA, 22 bp, Homo sapiens
aatcagaaagaggtcatgttgc

SEQ ID NO: 7202941 - DNA, 22 bp, Homo sapiens
aatcagaaaggctaaggaagca

SEQ ID NO: 7202942 - DNA, 22 bp, Homo sapiens
aatcagaaaggctaaggaagca

SEQ ID NO: 7202943 - DNA, 22 bp, Homo sapiens
aatcagaaattctacatcacaa

SEQ ID NO: 7202944 - DNA, 23 bp, Homo sapiens
actttattgaccccaggtcagtt

SEQ ID NO: 7202945 - DNA, 23 bp, Homo sapiens
actttattgaccccaggtcagtt

SEQ ID NO: 7202946 - DNA, 22 bp, Homo sapiens
actttatttcctattgcatcca

SEQ ID NO: 7202947 - DNA, 22 bp, Homo sapiens
actttatttcctattgcatcca

SEQ ID NO: 7202948 - DNA, 22 bp, Homo sapiens
actttatttcctattgcatcca

SEQ ID NO: 7202949 - DNA, 22 bp, Homo sapiens
actttatttcctattgcatcca

SEQ ID NO: 7202950 - DNA, 20 bp, Homo sapiens
actttatgagttcaattttg

SEQ ID NO: 7202951 - DNA, 20 bp, Homo sapiens
actttatgagttcaattttg

SEQ ID NO: 7202952 - DNA, 22 bp, Homo sapiens
actttatgtttgatatctatgg

SEQ ID NO: 7202953 - DNA, 23 bp, Homo sapiens
actttattgaccccaggtcagtt

SEQ ID NO: 7202954 - DNA, 23 bp, Homo sapiens
actttattgaccccaggtcagtt

SEQ ID NO: 7202955 - DNA, 23 bp, Homo sapiens
actttattgaccccaggtcagtt

SEQ ID NO: 7202956 - DNA, 23 bp, Homo sapiens
actttattgaccccaggtcagtt

SEQ ID NO: 7202957 - DNA, 22 bp, Homo sapiens
actgttcttcccatttatattg

SEQ ID NO: 7202958 - DNA, 22 bp, Homo sapiens
actgttcttcccatttatattg

SEQ ID NO: 7202959 - DNA, 22 bp, Homo sapiens
actttaaaactgatcatcagag

SEQ ID NO: 7202960 - DNA, 22 bp, Homo sapiens
actttaaaactgatcatcagag

SEQ ID NO: 7202961 - DNA, 22 bp, Homo sapiens
actgttcgaggctgacaaagta

SEQ ID NO: 7202962 - DNA, 19 bp, Homo sapiens
actgttctaacttgcagct

SEQ ID NO: 7202963 - DNA, 22 bp, Homo sapiens
actgttctgcatgctgtgaggg

SEQ ID NO: 7202964 - DNA, 22 bp, Homo sapiens
actgttctgcatgtacctgagg

SEQ ID NO: 7202965 - DNA, 22 bp, Homo sapiens
actgttctgccaagatcaacgt

SEQ ID NO: 7202966 - DNA, 19 bp, Homo sapiens
actgttctgtatgttgatt

SEQ ID NO: 7202967 - DNA, 22 bp, Homo sapiens
actgggcttcacttggcacatc

SEQ ID NO: 7202968 - DNA, 22 bp, Homo sapiens
actgggcttcacttggcacatc

SEQ ID NO: 7202969 - DNA, 22 bp, Homo sapiens
actgggctgtaaagagaggcaa

SEQ ID NO: 7202970 - DNA, 22 bp, Homo sapiens
aatactatgtagccaaaataat

SEQ ID NO: 7202971 - DNA, 22 bp, Homo sapiens
aatactatgtagccaaaataat

SEQ ID NO: 7202972 - DNA, 22 bp, Homo sapiens
aatactatgtagccaaaataat

SEQ ID NO: 7202973 - DNA, 22 bp, Homo sapiens
aatactatgtagccaaaataat

SEQ ID NO: 7202974 - DNA, 22 bp, Homo sapiens
aatactatgtagccaaaataat

SEQ ID NO: 7202975 - DNA, 20 bp, Homo sapiens
aatactaaacacaaagcagt

SEQ ID NO: 7202976 - DNA, 22 bp, Homo sapiens
aatactagttattaaagctttt

SEQ ID NO: 7202977 - DNA, 22 bp, Homo sapiens
aatactatgtagccaaaataat

SEQ ID NO: 7202978 - DNA, 22 bp, Homo sapiens
aatactgaattagttgagacaa

SEQ ID NO: 7202979 - DNA, 22 bp, Homo sapiens
aatactgaaagtattttcaaat

SEQ ID NO: 7202980 - DNA, 22 bp, Homo sapiens
aatactgaattagttgagacaa

SEQ ID NO: 7202981 - DNA, 22 bp, Homo sapiens
aatactatgttgtgacacatga

SEQ ID NO: 7202982 - DNA, 22 bp, Homo sapiens
aatactatgttgtgacacatga

SEQ ID NO: 7202983 - DNA, 22 bp, Homo sapiens
aatactctagggcagtgcttct

SEQ ID NO: 7202984 - DNA, 22 bp, Homo sapiens
aatactgcctgtgaggtaactc

SEQ ID NO: 7202985 - DNA, 22 bp, Homo sapiens
aatataattttattcctagagt

SEQ ID NO: 7202986 - DNA, 22 bp, Homo sapiens
aatagtctctcccacaccatcc

SEQ ID NO: 7202987 - DNA, 22 bp, Homo sapiens
aatagtatttatttggaaaaag

SEQ ID NO: 7202988 - DNA, 22 bp, Homo sapiens
aatagtcctgatttaatctggg

SEQ ID NO: 7202989 - DNA, 22 bp, Homo sapiens
aatagtccttagtaagctgtga

SEQ ID NO: 7202990 - DNA, 22 bp, Homo sapiens
aatagtatttatttggaaaaag

SEQ ID NO: 7202991 - DNA, 22 bp, Homo sapiens
aatagtatttatttggaaaaag

SEQ ID NO: 7202992 - DNA, 22 bp, Homo sapiens
aatatactatactactttctgg

SEQ ID NO: 7202993 - DNA, 22 bp, Homo sapiens
aatatactatactactttctgg

SEQ ID NO: 7202994 - DNA, 22 bp, Homo sapiens
aatatactatactactttctgg

SEQ ID NO: 7202995 - DNA, 22 bp, Homo sapiens
aatatagatttactcaagagaa

SEQ ID NO: 7202996 - DNA, 22 bp, Homo sapiens
aatatagcattgtatgactgtg

SEQ ID NO: 7202997 - DNA, 22 bp, Homo sapiens
aatatagttctagaaatatttt

SEQ ID NO: 7202998 - DNA, 22 bp, Homo sapiens
aatatagctcactataccatgg

SEQ ID NO: 7202999 - DNA, 22 bp, Homo sapiens
aatatagtgttagctcatttga

SEQ ID NO: 7203000 - DNA, 22 bp, Homo sapiens
aatatagtgttagctcatttga

SEQ ID NO: 7203001 - DNA, 22 bp, Homo sapiens
aatatagttctagaaatatttt

SEQ ID NO: 7203002 - DNA, 22 bp, Homo sapiens
aatatagttctagaaatatttt

SEQ ID NO: 7203003 - DNA, 21 bp, Homo sapiens
actgttcatttgatgaactgg

SEQ ID NO: 7203004 - DNA, 21 bp, Homo sapiens
actgttcatttgatgaactgg

SEQ ID NO: 7203005 - DNA, 22 bp, Homo sapiens
aatatagttctggtattgttaa

SEQ ID NO: 7203006 - DNA, 22 bp, Homo sapiens
aatatagttctggtattgttaa

SEQ ID NO: 7203007 - DNA, 22 bp, Homo sapiens
aatatagttctggtattgttaa

SEQ ID NO: 7203008 - DNA, 22 bp, Homo sapiens
aatgatgacaggataaagaaca

SEQ ID NO: 7203009 - DNA, 22 bp, Homo sapiens
aatgatgagttctaatagaccc

SEQ ID NO: 7203010 - DNA, 22 bp, Homo sapiens
aatgatgacaggataaagaaca

SEQ ID NO: 7203011 - DNA, 23 bp, Homo sapiens
aatgagttgggcagcatacaggc

SEQ ID NO: 7203012 - DNA, 23 bp, Homo sapiens
aatgagttgggcagcatacaggc

SEQ ID NO: 7203013 - DNA, 23 bp, Homo sapiens
aatgagttgggcagcatacaggc

SEQ ID NO: 7203014 - DNA, 22 bp, Homo sapiens
aatgagtttgttctattatttg

SEQ ID NO: 7203015 - DNA, 22 bp, Homo sapiens
aatgagttttagggccattaaa

SEQ ID NO: 7203016 - DNA, 22 bp, Homo sapiens
aatgatgacaggataaagaaca

SEQ ID NO: 7203017 - DNA, 22 bp, Homo sapiens
agaacaattgccccaaagcttg

SEQ ID NO: 7203018 - DNA, 22 bp, Homo sapiens
agaaattctaagcatcaatagc

SEQ ID NO: 7203019 - DNA, 22 bp, Homo sapiens
agaacaaaattagaggagtgca

SEQ ID NO: 7203020 - DNA, 22 bp, Homo sapiens
agaacaaaattagaggagtgca

SEQ ID NO: 7203021 - DNA, 22 bp, Homo sapiens
agaacaaaattagaggagtgca

SEQ ID NO: 7203022 - DNA, 22 bp, Homo sapiens
agaacaaatcgatggaagcctg

SEQ ID NO: 7203023 - DNA, 22 bp, Homo sapiens
agaacaaatcgatggaagcctg

SEQ ID NO: 7203024 - DNA, 20 bp, Homo sapiens
agaacaagtactaaaggaga

SEQ ID NO: 7203025 - DNA, 22 bp, Homo sapiens
agaaattatgcagtagttttat

SEQ ID NO: 7203026 - DNA, 22 bp, Homo sapiens
agaaatgacacacatgagacat

SEQ ID NO: 7203027 - DNA, 22 bp, Homo sapiens
agaaatgacacacatgagacat

SEQ ID NO: 7203028 - DNA, 22 bp, Homo sapiens
agaaatgacacacatgagacat

SEQ ID NO: 7203029 - DNA, 22 bp, Homo sapiens
agaaatgacacacatgagacat

SEQ ID NO: 7203030 - DNA, 22 bp, Homo sapiens
agaaatgacacacatgagacat

SEQ ID NO: 7203031 - DNA, 22 bp, Homo sapiens
agaaatgacacacatgagacat

SEQ ID NO: 7203032 - DNA, 22 bp, Homo sapiens
agaaatgacacacatgagacat

SEQ ID NO: 7203033 - DNA, 22 bp, Homo sapiens
agaaatgacacacatgagacat

SEQ ID NO: 7203034 - DNA, 22 bp, Homo sapiens
agaaattattagtgaatagtct

SEQ ID NO: 7203035 - DNA, 22 bp, Homo sapiens
agaaattattagtgaatagtct

SEQ ID NO: 7203036 - DNA, 22 bp, Homo sapiens
agaaattattagtgaatagtct

SEQ ID NO: 7203037 - DNA, 22 bp, Homo sapiens
agaaattcaattctaattagct

SEQ ID NO: 7203038 - DNA, 22 bp, Homo sapiens
agaaattcctaaggtacacaag

SEQ ID NO: 7203039 - DNA, 22 bp, Homo sapiens
agaaattctaagcatcaatagc

SEQ ID NO: 7203040 - DNA, 22 bp, Homo sapiens
aatgatttcccctacacagaag

SEQ ID NO: 7203041 - DNA, 23 bp, Homo sapiens
aatgatttcatgatgatagcagc

SEQ ID NO: 7203042 - DNA, 22 bp, Homo sapiens
aatgatttcccctacacagaag

SEQ ID NO: 7203043 - DNA, 22 bp, Homo sapiens
aatgatttcccctacacagaag

SEQ ID NO: 7203044 - DNA, 22 bp, Homo sapiens
aatgatttcccctacacagaag

SEQ ID NO: 7203045 - DNA, 22 bp, Homo sapiens
aatgatttcccctacacagaag

SEQ ID NO: 7203046 - DNA, 22 bp, Homo sapiens
aatgatttggcaaaggaatcca

SEQ ID NO: 7203047 - DNA, 22 bp, Homo sapiens
aatgatttggcaaaggaatcca

SEQ ID NO: 7203048 - DNA, 22 bp, Homo sapiens
aatgcaaacagcccagaatcca

SEQ ID NO: 7203049 - DNA, 22 bp, Homo sapiens
aatgcaaacagcccagaatcca

SEQ ID NO: 7203050 - DNA, 22 bp, Homo sapiens
agaagcagaaaagggcactttt

SEQ ID NO: 7203051 - DNA, 22 bp, Homo sapiens
agaagcagaaactgggcttgtg

SEQ ID NO: 7203052 - DNA, 22 bp, Homo sapiens
agaagcagaaactgggcttgtg

SEQ ID NO: 7203053 - DNA, 22 bp, Homo sapiens
agaagcagaaaagggcactttt

SEQ ID NO: 7203054 - DNA, 22 bp, Homo sapiens
agaagcagaaggaagcagggcc

SEQ ID NO: 7203055 - DNA, 22 bp, Homo sapiens
agaagcagaaggaagcagggcc

SEQ ID NO: 7203056 - DNA, 22 bp, Homo sapiens
agaagcagaaggaagcagggcc

SEQ ID NO: 7203057 - DNA, 22 bp, Homo sapiens
agaagcagaaggaagcagggcc

SEQ ID NO: 7203058 - DNA, 22 bp, Homo sapiens
agaagcagaaggaagcagggcc

SEQ ID NO: 7203059 - DNA, 22 bp, Homo sapiens
agaagcagaaggaagcagggcc

SEQ ID NO: 7203060 - DNA, 22 bp, Homo sapiens
agaagcagaaggaagcagggcc

SEQ ID NO: 7203061 - DNA, 22 bp, Homo sapiens
aatgatggttaaacactggagg

SEQ ID NO: 7203062 - DNA, 22 bp, Homo sapiens
aatgatggtttcatcacttgaa

SEQ ID NO: 7203063 - DNA, 22 bp, Homo sapiens
aatgatgtatgtataaggcagg

SEQ ID NO: 7203064 - DNA, 22 bp, Homo sapiens
aatgatgagttctaatagaccc

SEQ ID NO: 7203065 - DNA, 22 bp, Homo sapiens
aatgatgagaactggagtaatt

SEQ ID NO: 7203066 - DNA, 22 bp, Homo sapiens
aatgatgagttctaatagaccc

SEQ ID NO: 7203067 - DNA, 22 bp, Homo sapiens
aatgatggatttagacaagctg

SEQ ID NO: 7203068 - DNA, 22 bp, Homo sapiens
aatgatgggaaggagaaaagca

SEQ ID NO: 7203069 - DNA, 23 bp, Homo sapiens
aatgatttcatgatgatagcagc

SEQ ID NO: 7203070 - DNA, 23 bp, Homo sapiens
aatgatttcatgatgatagcagc

SEQ ID NO: 7203071 - DNA, 22 bp, Homo sapiens
aatgattgtcattccaaaaagt

SEQ ID NO: 7203072 - DNA, 22 bp, Homo sapiens
aatgattggcactagatacaca

SEQ ID NO: 7203073 - DNA, 23 bp, Homo sapiens
aatgatgtcagaagatgaagtct

SEQ ID NO: 7203074 - DNA, 22 bp, Homo sapiens
aatgatgtgagtttttattctc

SEQ ID NO: 7203075 - DNA, 22 bp, Homo sapiens
aatgatgtttttaaagaacata

SEQ ID NO: 7203076 - DNA, 22 bp, Homo sapiens
aatgattactgatcgcatagga

SEQ ID NO: 7203077 - DNA, 22 bp, Homo sapiens
aatgattactgatcgcatagga

SEQ ID NO: 7203078 - DNA, 22 bp, Homo sapiens
aatcaggatgactgtcatttca

SEQ ID NO: 7203079 - DNA, 22 bp, Homo sapiens
aatcaggatatgaacccaggta

SEQ ID NO: 7203080 - DNA, 22 bp, Homo sapiens
aatcaggatgactgtcatttca

SEQ ID NO: 7203081 - DNA, 22 bp, Homo sapiens
aatcaggaggaagccttgggca

SEQ ID NO: 7203082 - DNA, 22 bp, Homo sapiens
aatcaggaggataagggggtcc

SEQ ID NO: 7203083 - DNA, 22 bp, Homo sapiens
aatcaggagtgtgcactttgat

SEQ ID NO: 7203084 - DNA, 22 bp, Homo sapiens
aatcaggatagaacctcacgtg

SEQ ID NO: 7203085 - DNA, 22 bp, Homo sapiens
aatcaggacccactctacagtt

SEQ ID NO: 7203086 - DNA, 22 bp, Homo sapiens
aatcaggacccactctacagtt

SEQ ID NO: 7203087 - DNA, 21 bp, Homo sapiens
aatcaggaagtgtgtgtcctg

SEQ ID NO: 7203088 - DNA, 22 bp, Homo sapiens
aatcaggacccactctacagtt

SEQ ID NO: 7203089 - DNA, 22 bp, Homo sapiens
aatcaggacccactctacagtt

SEQ ID NO: 7203090 - DNA, 22 bp, Homo sapiens
aatcaggactgtgccaaaccta

SEQ ID NO: 7203091 - DNA, 22 bp, Homo sapiens
aatcaggagagctgcgaacgtt

SEQ ID NO: 7203092 - DNA, 19 bp, Homo sapiens
aatcaggagcctaattagg

SEQ ID NO: 7203093 - DNA, 22 bp, Homo sapiens
aatcaggagctagggggcaatg

SEQ ID NO: 7203094 - DNA, 22 bp, Homo sapiens
aatcaggagctgaggtttagcc

SEQ ID NO: 7203095 - DNA, 22 bp, Homo sapiens
aatcagcaaatgcttactcagg

SEQ ID NO: 7203096 - DNA, 22 bp, Homo sapiens
aatcagcaaatgcttactcagg

SEQ ID NO: 7203097 - DNA, 22 bp, Homo sapiens
aatcagcagaagagaggtctta

SEQ ID NO: 7203098 - DNA, 22 bp, Homo sapiens
aatcagcaggcttctaaatttt

SEQ ID NO: 7203099 - DNA, 22 bp, Homo sapiens
aatcagcaggcttctaaatttt

SEQ ID NO: 7203100 - DNA, 22 bp, Homo sapiens
aatcagcagttggaattagata

SEQ ID NO: 7203101 - DNA, 22 bp, Homo sapiens
aatcagcagttggaattagata

SEQ ID NO: 7203102 - DNA, 23 bp, Homo sapiens
aatcagcatgctctgtggctggc

SEQ ID NO: 7203103 - DNA, 23 bp, Homo sapiens
aatcagcatgctctgtggctggc

SEQ ID NO: 7203104 - DNA, 22 bp, Homo sapiens
aatcagcctgagcacaaggcca

SEQ ID NO: 7203105 - DNA, 22 bp, Homo sapiens
aatcagctaaataaactagtca

SEQ ID NO: 7203106 - DNA, 22 bp, Homo sapiens
aatcaggaaactatcaacacat

SEQ ID NO: 7203107 - DNA, 22 bp, Homo sapiens
aatcaggaactcaagtgcattg

SEQ ID NO: 7203108 - DNA, 22 bp, Homo sapiens
aatcaggaactcaagtgcattg

SEQ ID NO: 7203109 - DNA, 22 bp, Homo sapiens
aatcagagtcccaagatctgta

SEQ ID NO: 7203110 - DNA, 22 bp, Homo sapiens
aatcagaggaagtcaacggatc

SEQ ID NO: 7203111 - DNA, 21 bp, Homo sapiens
aatcagaggcttcctagttgg

SEQ ID NO: 7203112 - DNA, 17 bp, Homo sapiens
aatcagatttctgagga

SEQ ID NO: 7203113 - DNA, 22 bp, Homo sapiens
aatcagcaaaggtcagctctaa

SEQ ID NO: 7203114 - DNA, 22 bp, Homo sapiens
aatcagagccctctgagcttca

SEQ ID NO: 7203115 - DNA, 22 bp, Homo sapiens
aatcagagccctctgagcttca

SEQ ID NO: 7203116 - DNA, 22 bp, Homo sapiens
aatcagagaagtttcctatgcc

SEQ ID NO: 7203117 - DNA, 22 bp, Homo sapiens
aatcagagcaagacatggaaca

SEQ ID NO: 7203118 - DNA, 22 bp, Homo sapiens
aatcagaatttattgaatcttt

SEQ ID NO: 7203119 - DNA, 22 bp, Homo sapiens
aatcagaatttgtcccctgagt

SEQ ID NO: 7203120 - DNA, 22 bp, Homo sapiens
aatcagacacctggatggtctg

SEQ ID NO: 7203121 - DNA, 22 bp, Homo sapiens
aatcagacagttctggattcaa

SEQ ID NO: 7203122 - DNA, 22 bp, Homo sapiens
aatcagaccgttctggctgtcc

SEQ ID NO: 7203123 - DNA, 22 bp, Homo sapiens
aatcagactattaaagtctctt

SEQ ID NO: 7203124 - DNA, 22 bp, Homo sapiens
aatcagaaccttgggtcataac

SEQ ID NO: 7203125 - DNA, 22 bp, Homo sapiens
aatcagaacgctcgatcttcgg

SEQ ID NO: 7203126 - DNA, 22 bp, Homo sapiens
aatcagaatcagttgacacagc

SEQ ID NO: 7203127 - DNA, 22 bp, Homo sapiens
aatcagaatcagttgacacagc

SEQ ID NO: 7203128 - DNA, 22 bp, Homo sapiens
aatcagaatcagttgacacagc

SEQ ID NO: 7203129 - DNA, 22 bp, Homo sapiens
aatcagaatttattgaatcttt

SEQ ID NO: 7203130 - DNA, 22 bp, Homo sapiens
agaaatgacaagactgatcagg

SEQ ID NO: 7203131 - DNA, 22 bp, Homo sapiens
agaaatgacaagactgatcagg

SEQ ID NO: 7203132 - DNA, 22 bp, Homo sapiens
agaaatgacaagactgatcagg

SEQ ID NO: 7203133 - DNA, 22 bp, Homo sapiens
agaaatgacaagactgatcagg

SEQ ID NO: 7203134 - DNA, 22 bp, Homo sapiens
agaaatgaatatgtagtggtta

SEQ ID NO: 7203135 - DNA, 22 bp, Homo sapiens
agaaatgaagcaggagttatta

SEQ ID NO: 7203136 - DNA, 22 bp, Homo sapiens
agaaatgaagcaggagttatta

SEQ ID NO: 7203137 - DNA, 22 bp, Homo sapiens
agaaatgaagagagtcaaggtt

SEQ ID NO: 7203138 - DNA, 22 bp, Homo sapiens
agaaatgaaaccaaagcctaga

SEQ ID NO: 7203139 - DNA, 22 bp, Homo sapiens
agaaatagcagagtcaggcggg

SEQ ID NO: 7203140 - DNA, 22 bp, Homo sapiens
agaaatgaaaccaaagcctaga

SEQ ID NO: 7203141 - DNA, 22 bp, Homo sapiens
agaaatgaaaccaaagcctaga

SEQ ID NO: 7203142 - DNA, 22 bp, Homo sapiens
agaaatgaaaccaaagcctaga

SEQ ID NO: 7203143 - DNA, 22 bp, Homo sapiens
agaaatactttgtaaatctcac

SEQ ID NO: 7203144 - DNA, 22 bp, Homo sapiens
aatcataattcaaataagctta

SEQ ID NO: 7203145 - DNA, 21 bp, Homo sapiens
aatcagtacatactgcacatc

SEQ ID NO: 7203146 - DNA, 22 bp, Homo sapiens
aatcagtattggtatagaatga

SEQ ID NO: 7203147 - DNA, 22 bp, Homo sapiens
aatcagtcattagctctgacct

SEQ ID NO: 7203148 - DNA, 22 bp, Homo sapiens
aatcagtgcaaaggagagggta

SEQ ID NO: 7203149 - DNA, 22 bp, Homo sapiens
aatcagtggttcccagcccagg

SEQ ID NO: 7203150 - DNA, 22 bp, Homo sapiens
aatcagtgtggtgacttgtctg

SEQ ID NO: 7203151 - DNA, 22 bp, Homo sapiens
aatcagtgtgtaaagtggctgc

SEQ ID NO: 7203152 - DNA, 22 bp, Homo sapiens
actcagacgaaaacatgaacat

SEQ ID NO: 7203153 - DNA, 22 bp, Homo sapiens
actcagagaaacagcagggtgt

SEQ ID NO: 7203154 - DNA, 23 bp, Homo sapiens
actccccagtctcttcttgccaa

SEQ ID NO: 7203155 - DNA, 23 bp, Homo sapiens
actccccagtctcttcttgccaa

SEQ ID NO: 7203156 - DNA, 22 bp, Homo sapiens
actctaaatagcctcttaaaca

SEQ ID NO: 7203157 - DNA, 22 bp, Homo sapiens
actctaaattgtgccaatatgc

SEQ ID NO: 7203158 - DNA, 22 bp, Homo sapiens
actctacagaatgaatacctgt

SEQ ID NO: 7203159 - DNA, 19 bp, Homo sapiens
actctacagtgtgtacaac

SEQ ID NO: 7203160 - DNA, 19 bp, Homo sapiens
actctacagtgtgtacaac

SEQ ID NO: 7203161 - DNA, 20 bp, Homo sapiens
actctaccagggcagcagca

SEQ ID NO: 7203162 - DNA, 20 bp, Homo sapiens
actctaccagggcagcagca

SEQ ID NO: 7203163 - DNA, 22 bp, Homo sapiens
actctaccatgccactccatag

SEQ ID NO: 7203164 - DNA, 20 bp, Homo sapiens
actctacccctgttatcgca

SEQ ID NO: 7203165 - DNA, 22 bp, Homo sapiens
actctccctgagagggaggcat

SEQ ID NO: 7203166 - DNA, 22 bp, Homo sapiens
actctccctgagagggaggcat

SEQ ID NO: 7203167 - DNA, 22 bp, Homo sapiens
actctcccagctatatgtggtg

SEQ ID NO: 7203168 - DNA, 22 bp, Homo sapiens
actctccctgctatccacttcc

SEQ ID NO: 7203169 - DNA, 22 bp, Homo sapiens
actctccctgctatccacttcc

SEQ ID NO: 7203170 - DNA, 22 bp, Homo sapiens
actctccctgagagggaggcat

SEQ ID NO: 7203171 - DNA, 22 bp, Homo sapiens
actctcccacgttcgactctaa

SEQ ID NO: 7203172 - DNA, 22 bp, Homo sapiens
actctcccacgttcgactctaa

SEQ ID NO: 7203173 - DNA, 22 bp, Homo sapiens
actctcacagtctttgacttgg

SEQ ID NO: 7203174 - DNA, 22 bp, Homo sapiens
actctcaaatattaatctttgg

SEQ ID NO: 7203175 - DNA, 21 bp, Homo sapiens
actctatttcagtttcaacaa

SEQ ID NO: 7203176 - DNA, 22 bp, Homo sapiens
actctcactagctctgtgacct

SEQ ID NO: 7203177 - DNA, 22 bp, Homo sapiens
actctcactagctctgtgacct

SEQ ID NO: 7203178 - DNA, 22 bp, Homo sapiens
actctcactgcttggctcctgc

SEQ ID NO: 7203179 - DNA, 22 bp, Homo sapiens
actctcactgcttggctcctgc

SEQ ID NO: 7203180 - DNA, 22 bp, Homo sapiens
actctcacagtctttgacttgg

SEQ ID NO: 7203181 - DNA, 22 bp, Homo sapiens
actctcagagggtggcagcaat

SEQ ID NO: 7203182 - DNA, 22 bp, Homo sapiens
actctcagggctccagggaaag

SEQ ID NO: 7203183 - DNA, 22 bp, Homo sapiens
actctccacccactcactctgt

SEQ ID NO: 7203184 - DNA, 22 bp, Homo sapiens
actctccacccactcactctgt

SEQ ID NO: 7203185 - DNA, 22 bp, Homo sapiens
actctccagggatttaggatgg

SEQ ID NO: 7203186 - DNA, 22 bp, Homo sapiens
actcagaatgactgatgctgtg

SEQ ID NO: 7203187 - DNA, 22 bp, Homo sapiens
actcagaatgtcactgagggac

SEQ ID NO: 7203188 - DNA, 22 bp, Homo sapiens
actcagacagaccaaagttctg

SEQ ID NO: 7203189 - DNA, 22 bp, Homo sapiens
actcagaagatataatgactca

SEQ ID NO: 7203190 - DNA, 22 bp, Homo sapiens
actcagaagatgtgggtagata

SEQ ID NO: 7203191 - DNA, 22 bp, Homo sapiens
actcagaagatgtgggtagata

SEQ ID NO: 7203192 - DNA, 22 bp, Homo sapiens
actcagaaccatttactctgag

SEQ ID NO: 7203193 - DNA, 22 bp, Homo sapiens
actcactgggtcccggaagccc

SEQ ID NO: 7203194 - DNA, 22 bp, Homo sapiens
actcactttccattcaagcacc

SEQ ID NO: 7203195 - DNA, 22 bp, Homo sapiens
actcactttccattcaagcacc

SEQ ID NO: 7203196 - DNA, 22 bp, Homo sapiens
actcactgcactttgaaatgtg

SEQ ID NO: 7203197 - DNA, 22 bp, Homo sapiens
actcactcttaatcagactccc

SEQ ID NO: 7203198 - DNA, 22 bp, Homo sapiens
actatacattgaatgttaaggt

SEQ ID NO: 7203199 - DNA, 22 bp, Homo sapiens
actcaccacagagcagggaacc

SEQ ID NO: 7203200 - DNA, 22 bp, Homo sapiens
actcaccacagagcagggaacc

SEQ ID NO: 7203201 - DNA, 22 bp, Homo sapiens
actatacagtatgtacgtgcac

SEQ ID NO: 7203202 - DNA, 22 bp, Homo sapiens
actatacagtatgtacgtgcac

SEQ ID NO: 7203203 - DNA, 22 bp, Homo sapiens
actatacagtatgtacgtgcac

SEQ ID NO: 7203204 - DNA, 22 bp, Homo sapiens
actatacagtatgtacgtgcac

SEQ ID NO: 7203205 - DNA, 22 bp, Homo sapiens
actataaaaggataaaccagaa

SEQ ID NO: 7203206 - DNA, 23 bp, Homo sapiens
actataaagttgttctgatttac

SEQ ID NO: 7203207 - DNA, 22 bp, Homo sapiens
actataaaaggataaaccagaa

SEQ ID NO: 7203208 - DNA, 22 bp, Homo sapiens
actataaaaggataaaccagaa

SEQ ID NO: 7203209 - DNA, 22 bp, Homo sapiens
actataaaaggataaaccagaa

SEQ ID NO: 7203210 - DNA, 23 bp, Homo sapiens
actataaagttgttctgatttac

SEQ ID NO: 7203211 - DNA, 22 bp, Homo sapiens
actataacccatggaatataag

SEQ ID NO: 7203212 - DNA, 22 bp, Homo sapiens
actatacaccaaaatattaagg

SEQ ID NO: 7203213 - DNA, 22 bp, Homo sapiens
actatacaccaaaatattaagg

SEQ ID NO: 7203214 - DNA, 22 bp, Homo sapiens
actatacaccaaaatattaagg

SEQ ID NO: 7203215 - DNA, 22 bp, Homo sapiens
actatacaccaaaatattaagg

SEQ ID NO: 7203216 - DNA, 22 bp, Homo sapiens
actatacaccaaaatattaagg

SEQ ID NO: 7203217 - DNA, 22 bp, Homo sapiens
acctactaattgagataatagg

SEQ ID NO: 7203218 - DNA, 22 bp, Homo sapiens
acctagaaactgacagaatatt

SEQ ID NO: 7203219 - DNA, 22 bp, Homo sapiens
acctacatggctttaagtaagt

SEQ ID NO: 7203220 - DNA, 22 bp, Homo sapiens
acctagaatttaaaacattgct

SEQ ID NO: 7203221 - DNA, 22 bp, Homo sapiens
acctaacttacctaggtccaca

SEQ ID NO: 7203222 - DNA, 22 bp, Homo sapiens
accgtgtctgacactttgggcg

SEQ ID NO: 7203223 - DNA, 22 bp, Homo sapiens
accgggctaatttttgtatctt

SEQ ID NO: 7203224 - DNA, 22 bp, Homo sapiens
accgggctaatttttgtatctt

SEQ ID NO: 7203225 - DNA, 22 bp, Homo sapiens
acctacagagatctgcattttt

SEQ ID NO: 7203226 - DNA, 22 bp, Homo sapiens
acctacagatctttgaatgtgt

SEQ ID NO: 7203227 - DNA, 22 bp, Homo sapiens
acctacatagttaagtaacaaa

SEQ ID NO: 7203228 - DNA, 22 bp, Homo sapiens
acctacatagttaagtaacaaa

SEQ ID NO: 7203229 - DNA, 22 bp, Homo sapiens
acctaagctttgcatgataatg

SEQ ID NO: 7203230 - DNA, 22 bp, Homo sapiens
acctaagagatcttctggtcca

SEQ ID NO: 7203231 - DNA, 22 bp, Homo sapiens
acgtagcactgagagatgcagg

SEQ ID NO: 7203232 - DNA, 22 bp, Homo sapiens
acgtatattgaaatatcatgag

SEQ ID NO: 7203233 - DNA, 22 bp, Homo sapiens
acgtagcactgagagatgcagg

SEQ ID NO: 7203234 - DNA, 22 bp, Homo sapiens
acggtgctgggtattggggttc

SEQ ID NO: 7203235 - DNA, 22 bp, Homo sapiens
acgtagaaaccaaatagcatca

SEQ ID NO: 7203236 - DNA, 22 bp, Homo sapiens
acgtatcaatatattgtggcca

SEQ ID NO: 7203237 - DNA, 22 bp, Homo sapiens
acgtcatcgttgtcatcgtcat

SEQ ID NO: 7203238 - DNA, 22 bp, Homo sapiens
acgtgacccgatccctgggacc

SEQ ID NO: 7203239 - DNA, 22 bp, Homo sapiens
acgtgcaggatctggttggcga

SEQ ID NO: 7203240 - DNA, 22 bp, Homo sapiens
acgtgcatatgtatacacacat

SEQ ID NO: 7203241 - DNA, 22 bp, Homo sapiens
acctttatgaaacagctgtcgt

SEQ ID NO: 7203242 - DNA, 22 bp, Homo sapiens
acctttatgattcacaatgtat

SEQ ID NO: 7203243 - DNA, 22 bp, Homo sapiens
acctttatgattcacaatgtat

SEQ ID NO: 7203244 - DNA, 22 bp, Homo sapiens
acctttatgattcacaatgtat

SEQ ID NO: 7203245 - DNA, 22 bp, Homo sapiens
acctttatggagaacttgggat

SEQ ID NO: 7203246 - DNA, 22 bp, Homo sapiens
acctttatggagaacttgggat

SEQ ID NO: 7203247 - DNA, 22 bp, Homo sapiens
acctttatgtttgattacaatt

SEQ ID NO: 7203248 - DNA, 22 bp, Homo sapiens
acctttatgtttgattacaatt

SEQ ID NO: 7203249 - DNA, 22 bp, Homo sapiens
acctttatgtttgattacaatt

SEQ ID NO: 7203250 - DNA, 22 bp, Homo sapiens
acggggctagagaaggtttctt

SEQ ID NO: 7203251 - DNA, 22 bp, Homo sapiens
acggggctagagaaggtttctt

SEQ ID NO: 7203252 - DNA, 22 bp, Homo sapiens
acggggctagagaaggtttctt

SEQ ID NO: 7203253 - DNA, 22 bp, Homo sapiens
acggggctagagaaggtttctt

SEQ ID NO: 7203254 - DNA, 22 bp, Homo sapiens
acgggtggctgaggaggcctct

SEQ ID NO: 7203255 - DNA, 22 bp, Homo sapiens
acgggtggctgaggaggcctct

SEQ ID NO: 7203256 - DNA, 22 bp, Homo sapiens
acggtgaccaagcatcaccgag

SEQ ID NO: 7203257 - DNA, 22 bp, Homo sapiens
acgggtggtaatgagaaaagga

SEQ ID NO: 7203258 - DNA, 22 bp, Homo sapiens
aagtctcatccgtgtagctcca

SEQ ID NO: 7203259 - DNA, 22 bp, Homo sapiens
aagtctcagaaaactagtgtgg

SEQ ID NO: 7203260 - DNA, 22 bp, Homo sapiens
aagtctcagaaaactagtgtgg

SEQ ID NO: 7203261 - DNA, 22 bp, Homo sapiens
aagtctcagaaaactagtgtgg

SEQ ID NO: 7203262 - DNA, 22 bp, Homo sapiens
aagtctaggacaggaagtctat

SEQ ID NO: 7203263 - DNA, 22 bp, Homo sapiens
aagtcctttatcctaaaaggtc

SEQ ID NO: 7203264 - DNA, 22 bp, Homo sapiens
aagtcgtggcaggcttgcacga

SEQ ID NO: 7203265 - DNA, 20 bp, Homo sapiens
acgtggccaccagtggctta

SEQ ID NO: 7203266 - DNA, 22 bp, Homo sapiens
acgtggagccacagatggagca

SEQ ID NO: 7203267 - DNA, 20 bp, Homo sapiens
acgtggccaccagtggctta

SEQ ID NO: 7203268 - DNA, 20 bp, Homo sapiens
acgtggccaccagtggctta

SEQ ID NO: 7203269 - DNA, 20 bp, Homo sapiens
acgtggccaccagtggctta

SEQ ID NO: 7203270 - DNA, 22 bp, Homo sapiens
acgtggagagaatagggcacca

SEQ ID NO: 7203271 - DNA, 22 bp, Homo sapiens
acgtggagagaatagggcacca

SEQ ID NO: 7203272 - DNA, 22 bp, Homo sapiens
acgtgcatctttccatatgtgg

SEQ ID NO: 7203273 - DNA, 22 bp, Homo sapiens
acgtgcgtgtgcgcacacatac

SEQ ID NO: 7203274 - DNA, 18 bp, Homo sapiens
aagtctctgaaagctttt

SEQ ID NO: 7203275 - DNA, 22 bp, Homo sapiens
aagtctctgactcacacaatgt

SEQ ID NO: 7203276 - DNA, 18 bp, Homo sapiens
aagtctctgaaagctttt

SEQ ID NO: 7203277 - DNA, 22 bp, Homo sapiens
aagtctctctgtgtgggataag

SEQ ID NO: 7203278 - DNA, 22 bp, Homo sapiens
aagtctctgatgtgtgttaggt

SEQ ID NO: 7203279 - DNA, 22 bp, Homo sapiens
aagtctctggcaaatgatcttg

SEQ ID NO: 7203280 - DNA, 22 bp, Homo sapiens
aagtctctggcaaatgatcttg

SEQ ID NO: 7203281 - DNA, 22 bp, Homo sapiens
aagtctctgactcacacaatgt

SEQ ID NO: 7203282 - DNA, 22 bp, Homo sapiens
aagtctctgactcacacaatgt

SEQ ID NO: 7203283 - DNA, 22 bp, Homo sapiens
aagtctctgatgtgtgttaggt

SEQ ID NO: 7203284 - DNA, 22 bp, Homo sapiens
aagtctctgatgtgtgttaggt

SEQ ID NO: 7203285 - DNA, 22 bp, Homo sapiens
aagtctctctgtgtgggataag

SEQ ID NO: 7203286 - DNA, 22 bp, Homo sapiens
aagtctctctgtgtgggataag

SEQ ID NO: 7203287 - DNA, 22 bp, Homo sapiens
aagtctctcatggctgacagca

SEQ ID NO: 7203288 - DNA, 22 bp, Homo sapiens
aagtctctcatggctgacagca

SEQ ID NO: 7203289 - DNA, 22 bp, Homo sapiens
aagtctctcacatatctggtcc

SEQ ID NO: 7203290 - DNA, 22 bp, Homo sapiens
aagtctctaagactgtgccatc

SEQ ID NO: 7203291 - DNA, 22 bp, Homo sapiens
aagtctctcacatatctggtcc

SEQ ID NO: 7203292 - DNA, 22 bp, Homo sapiens
aagtctctcacatatctggtcc

SEQ ID NO: 7203293 - DNA, 22 bp, Homo sapiens
aagtctctaagactgtgccatc

SEQ ID NO: 7203294 - DNA, 22 bp, Homo sapiens
aagtctctttacctctccaggc

SEQ ID NO: 7203295 - DNA, 22 bp, Homo sapiens
aagtctctttacctctccaggc

SEQ ID NO: 7203296 - DNA, 22 bp, Homo sapiens
aagtctctttacctctccaggc

SEQ ID NO: 7203297 - DNA, 22 bp, Homo sapiens
aagtctcttcctctgccaaaga

SEQ ID NO: 7203298 - DNA, 22 bp, Homo sapiens
aagtctctttacctctccaggc

SEQ ID NO: 7203299 - DNA, 22 bp, Homo sapiens
aagtctctttacctctccaggc

SEQ ID NO: 7203300 - DNA, 22 bp, Homo sapiens
aagtctctttgggtactttatt

SEQ ID NO: 7203301 - DNA, 22 bp, Homo sapiens
actacactccaattttctaggt

SEQ ID NO: 7203302 - DNA, 22 bp, Homo sapiens
aagtctcttagtaatatccaac

SEQ ID NO: 7203303 - DNA, 22 bp, Homo sapiens
aagtctcttcctctgccaaaga

SEQ ID NO: 7203304 - DNA, 22 bp, Homo sapiens
aagtctctggttgcttgcatgg

SEQ ID NO: 7203305 - DNA, 22 bp, Homo sapiens
aagtctcttagtaatatccaac

SEQ ID NO: 7203306 - DNA, 22 bp, Homo sapiens
aagtctctggttgcttgcatgg

SEQ ID NO: 7203307 - DNA, 22 bp, Homo sapiens
aagtctctggtgatgcaggaaa

SEQ ID NO: 7203308 - DNA, 22 bp, Homo sapiens
aagtctctggttgcttgcatgg

SEQ ID NO: 7203309 - DNA, 22 bp, Homo sapiens
aagtctctggtgatgcaggaaa

SEQ ID NO: 7203310 - DNA, 22 bp, Homo sapiens
aagtctctggcaaatgatcttg

SEQ ID NO: 7203311 - DNA, 22 bp, Homo sapiens
aagtctctggtgatgcaggaaa

SEQ ID NO: 7203312 - DNA, 22 bp, Homo sapiens
aagtctctggtgatgcaggaaa

SEQ ID NO: 7203313 - DNA, 22 bp, Homo sapiens
actgataagttgcttgctctca

SEQ ID NO: 7203314 - DNA, 22 bp, Homo sapiens
actgatattaaacacaatttaa

SEQ ID NO: 7203315 - DNA, 22 bp, Homo sapiens
actgatattaaacacaatttaa

SEQ ID NO: 7203316 - DNA, 22 bp, Homo sapiens
actgatattaaacacaatttaa

SEQ ID NO: 7203317 - DNA, 21 bp, Homo sapiens
actgatattaaccttataaca

SEQ ID NO: 7203318 - DNA, 22 bp, Homo sapiens
actgatcaagggtttaatttta

SEQ ID NO: 7203319 - DNA, 22 bp, Homo sapiens
actgatcaagggtttaatttta

SEQ ID NO: 7203320 - DNA, 22 bp, Homo sapiens
actgatcacagatatgtatatt

SEQ ID NO: 7203321 - DNA, 22 bp, Homo sapiens
actgcactccaacctgggtgac

SEQ ID NO: 7203322 - DNA, 22 bp, Homo sapiens
actgagtggctggggagtggca

SEQ ID NO: 7203323 - DNA, 22 bp, Homo sapiens
actgagtgggaggtttgtgtga

SEQ ID NO: 7203324 - DNA, 22 bp, Homo sapiens
actgaggtttacttgaaggaga

SEQ ID NO: 7203325 - DNA, 22 bp, Homo sapiens
actgcactccagcctgggtgac

SEQ ID NO: 7203326 - DNA, 22 bp, Homo sapiens
actgcactccagcctgggtaac

SEQ ID NO: 7203327 - DNA, 22 bp, Homo sapiens
actgcactccagcctgggtaac

SEQ ID NO: 7203328 - DNA, 22 bp, Homo sapiens
actgcactccagcctgggtaac

SEQ ID NO: 7203329 - DNA, 22 bp, Homo sapiens
actgcactccagcctgggtaac

SEQ ID NO: 7203330 - DNA, 22 bp, Homo sapiens
actgcactccagcctcggggtc

SEQ ID NO: 7203331 - DNA, 22 bp, Homo sapiens
actgcactccagcctgggtaac

SEQ ID NO: 7203332 - DNA, 22 bp, Homo sapiens
actgcactccagcctgggtaac

SEQ ID NO: 7203333 - DNA, 22 bp, Homo sapiens
actgcactccagcccgggtgac

SEQ ID NO: 7203334 - DNA, 22 bp, Homo sapiens
actgcactccagcctcggggtc

SEQ ID NO: 7203335 - DNA, 22 bp, Homo sapiens
actgcactccaacctgggtgac

SEQ ID NO: 7203336 - DNA, 22 bp, Homo sapiens
actgcactccaacctgggtgac

SEQ ID NO: 7203337 - DNA, 22 bp, Homo sapiens
actgcactccaacctgggtgac

SEQ ID NO: 7203338 - DNA, 21 bp, Homo sapiens
actctgctgcgggcttggcct

SEQ ID NO: 7203339 - DNA, 22 bp, Homo sapiens
actctgctgataggtcctcaga

SEQ ID NO: 7203340 - DNA, 22 bp, Homo sapiens
actctgctgtctgatggcagga

SEQ ID NO: 7203341 - DNA, 22 bp, Homo sapiens
actctgctgtttactctctata

SEQ ID NO: 7203342 - DNA, 22 bp, Homo sapiens
actctgctgtttactctctata

SEQ ID NO: 7203343 - DNA, 22 bp, Homo sapiens
actctgctctttggacaatgcc

SEQ ID NO: 7203344 - DNA, 22 bp, Homo sapiens
actctcccttatctaactttac

SEQ ID NO: 7203345 - DNA, 22 bp, Homo sapiens
actctcccttatctaactttac

SEQ ID NO: 7203346 - DNA, 22 bp, Homo sapiens
actctcccttggagcctcaggc

SEQ ID NO: 7203347 - DNA, 22 bp, Homo sapiens
actctggcaagcttccacttcc

SEQ ID NO: 7203348 - DNA, 22 bp, Homo sapiens
actctggagatggatgtcagga

SEQ ID NO: 7203349 - DNA, 22 bp, Homo sapiens
actctggagatggatgtcagga

SEQ ID NO: 7203350 - DNA, 22 bp, Homo sapiens
actctgcttattgctgcaggca

SEQ ID NO: 7203351 - DNA, 22 bp, Homo sapiens
actctgcttgcccaatggaaac

SEQ ID NO: 7203352 - DNA, 22 bp, Homo sapiens
actctgcttgggccatatctgg

SEQ ID NO: 7203353 - DNA, 22 bp, Homo sapiens
actgaggtctatcatgagccag

SEQ ID NO: 7203354 - DNA, 22 bp, Homo sapiens
actgaggtctatcatgagccag

SEQ ID NO: 7203355 - DNA, 22 bp, Homo sapiens
actgaggtcaggggtatgtgat

SEQ ID NO: 7203356 - DNA, 22 bp, Homo sapiens
actgaggtagggcacacctagg

SEQ ID NO: 7203357 - DNA, 22 bp, Homo sapiens
actgagagaagggattttaagt

SEQ ID NO: 7203358 - DNA, 22 bp, Homo sapiens
actgagagaagggattttaagt

SEQ ID NO: 7203359 - DNA, 22 bp, Homo sapiens
actgagagagctgggtatctcc

SEQ ID NO: 7203360 - DNA, 22 bp, Homo sapiens
actgagagagctgggtatctcc

SEQ ID NO: 7203361 - DNA, 22 bp, Homo sapiens
actgaggtagggcacacctagg

SEQ ID NO: 7203362 - DNA, 22 bp, Homo sapiens
actgagagaacgggctgctccc

SEQ ID NO: 7203363 - DNA, 22 bp, Homo sapiens
actgagagaacgggctgctccc

SEQ ID NO: 7203364 - DNA, 22 bp, Homo sapiens
actctggcgggcgggcgagcca

SEQ ID NO: 7203365 - DNA, 22 bp, Homo sapiens
aatacagaggcttccagtaaaa

SEQ ID NO: 7203366 - DNA, 22 bp, Homo sapiens
aatacagaggcttccagtaaaa

SEQ ID NO: 7203367 - DNA, 22 bp, Homo sapiens
actggctctgcatttttggctc

SEQ ID NO: 7203368 - DNA, 22 bp, Homo sapiens
actggctgaggaagttgccact

SEQ ID NO: 7203369 - DNA, 22 bp, Homo sapiens
actggctgaggaagttgccact

SEQ ID NO: 7203370 - DNA, 22 bp, Homo sapiens
actggctgagttgcttcagcaa

SEQ ID NO: 7203371 - DNA, 22 bp, Homo sapiens
aatacagaggaaacatttaata

SEQ ID NO: 7203372 - DNA, 22 bp, Homo sapiens
aatacagaggaaacatttaata

SEQ ID NO: 7203373 - DNA, 22 bp, Homo sapiens
aataccagagacagtgtttacc

SEQ ID NO: 7203374 - DNA, 22 bp, Homo sapiens
aataccttccaacatcaagaca

SEQ ID NO: 7203375 - DNA, 22 bp, Homo sapiens
aataccttccaacatcaagaca

SEQ ID NO: 7203376 - DNA, 22 bp, Homo sapiens
aataccttttcagtgcacaaaa

SEQ ID NO: 7203377 - DNA, 22 bp, Homo sapiens
aatacgtggttactctatagag

SEQ ID NO: 7203378 - DNA, 20 bp, Homo sapiens
aatactaaacacaaagcagt

SEQ ID NO: 7203379 - DNA, 20 bp, Homo sapiens
aatactaaacacaaagcagt

SEQ ID NO: 7203380 - DNA, 22 bp, Homo sapiens
actggccagaactaagtcacat

SEQ ID NO: 7203381 - DNA, 22 bp, Homo sapiens
actggccaggagctggaaatac

SEQ ID NO: 7203382 - DNA, 22 bp, Homo sapiens
actggccaggcacagctgtggg

SEQ ID NO: 7203383 - DNA, 22 bp, Homo sapiens
actggccaggcagcagtagctt

SEQ ID NO: 7203384 - DNA, 22 bp, Homo sapiens
actggccaggcagcagtagctt

SEQ ID NO: 7203385 - DNA, 22 bp, Homo sapiens
actggccaggcgaaccacactg

SEQ ID NO: 7203386 - DNA, 22 bp, Homo sapiens
actggccaggcgaaccacactg

SEQ ID NO: 7203387 - DNA, 22 bp, Homo sapiens
actggccatgaacttgggatct

SEQ ID NO: 7203388 - DNA, 22 bp, Homo sapiens
actggccatgggatttatattt

SEQ ID NO: 7203389 - DNA, 22 bp, Homo sapiens
actggccctggctgctaggctg

SEQ ID NO: 7203390 - DNA, 22 bp, Homo sapiens
actggcccttgattgcatcagc

SEQ ID NO: 7203391 - DNA, 22 bp, Homo sapiens
actggctctctacatttgccag

SEQ ID NO: 7203392 - DNA, 22 bp, Homo sapiens
actggctctgtgatctatgatt

SEQ ID NO: 7203393 - DNA, 22 bp, Homo sapiens
actggagactgtgtcttttgat

SEQ ID NO: 7203394 - DNA, 22 bp, Homo sapiens
actggagcccgtggaggcgcag

SEQ ID NO: 7203395 - DNA, 22 bp, Homo sapiens
actggacatttctagaaagcag

SEQ ID NO: 7203396 - DNA, 22 bp, Homo sapiens
actggactccccaagggccagg

SEQ ID NO: 7203397 - DNA, 22 bp, Homo sapiens
actggacagaggaaatatggag

SEQ ID NO: 7203398 - DNA, 22 bp, Homo sapiens
actggacagaggaaatatggag

SEQ ID NO: 7203399 - DNA, 22 bp, Homo sapiens
actgctaaatctccatcgatta

SEQ ID NO: 7203400 - DNA, 22 bp, Homo sapiens
actgctagtgagaaaataacca

SEQ ID NO: 7203401 - DNA, 22 bp, Homo sapiens
actgcgggaacccgcggccggc

SEQ ID NO: 7203402 - DNA, 22 bp, Homo sapiens
actgcgggaacccgcggccggc

SEQ ID NO: 7203403 - DNA, 22 bp, Homo sapiens
actgcgtggggagctgtgacta

SEQ ID NO: 7203404 - DNA, 22 bp, Homo sapiens
actgcactccagcctgggtgac

SEQ ID NO: 7203405 - DNA, 22 bp, Homo sapiens
actgcactccagcctgggtgac

SEQ ID NO: 7203406 - DNA, 22 bp, Homo sapiens
actgcactccagcctgggtgac

SEQ ID NO: 7203407 - DNA, 19 bp, Homo sapiens
actggagcctgatggagga

SEQ ID NO: 7203408 - DNA, 22 bp, Homo sapiens
actggagctgagagcatgggta

SEQ ID NO: 7203409 - DNA, 22 bp, Homo sapiens
actggaggattcctggaaggcg

SEQ ID NO: 7203410 - DNA, 22 bp, Homo sapiens
actggaggattcctggaaggcg

SEQ ID NO: 7203411 - DNA, 22 bp, Homo sapiens
actggaggattcctggaaggcg

SEQ ID NO: 7203412 - DNA, 22 bp, Homo sapiens
actggaggattcctggaaggcg

SEQ ID NO: 7203413 - DNA, 22 bp, Homo sapiens
actggaggcccctcccagtgaa

SEQ ID NO: 7203414 - DNA, 22 bp, Homo sapiens
actggaggcccctcccagtgaa

SEQ ID NO: 7203415 - DNA, 22 bp, Homo sapiens
actggaggcccctcccagtgaa

SEQ ID NO: 7203416 - DNA, 22 bp, Homo sapiens
actggaggcccctcccagtgaa

SEQ ID NO: 7203417 - DNA, 22 bp, Homo sapiens
actggaggggaaaatggtagta

SEQ ID NO: 7203418 - DNA, 22 bp, Homo sapiens
actggaggggaaaatggtagta

SEQ ID NO: 7203419 - DNA, 22 bp, Homo sapiens
actggaggggaaaatggtagta

SEQ ID NO: 7203420 - DNA, 22 bp, Homo sapiens
actggaggggaaaatggtagta

SEQ ID NO: 7203421 - DNA, 20 bp, Homo sapiens
actggagtaccctagagaag

SEQ ID NO: 7203422 - DNA, 22 bp, Homo sapiens
actggagtagatctgactgagt

SEQ ID NO: 7203423 - DNA, 22 bp, Homo sapiens
actggagtgtttggaggatgca

SEQ ID NO: 7203424 - DNA, 22 bp, Homo sapiens
gtgacaggccactgcggctctg

SEQ ID NO: 7203425 - DNA, 22 bp, Homo sapiens
gtgacaggcccagtgggatgca

SEQ ID NO: 7203426 - DNA, 22 bp, Homo sapiens
gtgacaggcccagtgggatgca

SEQ ID NO: 7203427 - DNA, 22 bp, Homo sapiens
gtgacagggggcttggtttcta

SEQ ID NO: 7203428 - DNA, 22 bp, Homo sapiens
gtgacaggccactgcggctctg

SEQ ID NO: 7203429 - DNA, 22 bp, Homo sapiens
gtgacagatttgctgcgcatgg

SEQ ID NO: 7203430 - DNA, 22 bp, Homo sapiens
gtgacaggatagtcagctttgt

SEQ ID NO: 7203431 - DNA, 22 bp, Homo sapiens
gtgacaggcatggggtcatgca

SEQ ID NO: 7203432 - DNA, 22 bp, Homo sapiens
gtgacaggccactgcggctctg

SEQ ID NO: 7203433 - DNA, 22 bp, Homo sapiens
gtgacagcctcttgggaggttg

SEQ ID NO: 7203434 - DNA, 18 bp, Homo sapiens
gtgacagctgctagctca

SEQ ID NO: 7203435 - DNA, 18 bp, Homo sapiens
gtgacagctgctagctca

SEQ ID NO: 7203436 - DNA, 16 bp, Homo sapiens
gtgacagacaataggc

SEQ ID NO: 7203437 - DNA, 22 bp, Homo sapiens
gtgacagagctgggatttgaag

SEQ ID NO: 7203438 - DNA, 22 bp, Homo sapiens
gtgacagagctgggatttgaag

SEQ ID NO: 7203439 - DNA, 22 bp, Homo sapiens
gtgacagagtgagaccctgtct

SEQ ID NO: 7203440 - DNA, 22 bp, Homo sapiens
gtgacagagtgagaccttgtct

SEQ ID NO: 7203441 - DNA, 22 bp, Homo sapiens
gtgacagagttttagatctcat

SEQ ID NO: 7203442 - DNA, 22 bp, Homo sapiens
gtgacagagttttagatctcat

SEQ ID NO: 7203443 - DNA, 22 bp, Homo sapiens
gtgacagattatagggagcgtt

SEQ ID NO: 7203444 - DNA, 22 bp, Homo sapiens
gtgacagatttgctgcgcatgg

SEQ ID NO: 7203445 - DNA, 22 bp, Homo sapiens
gtgacaaaaacactgattattt

SEQ ID NO: 7203446 - DNA, 20 bp, Homo sapiens
gtgaagggagtcaggtgtgc

SEQ ID NO: 7203447 - DNA, 22 bp, Homo sapiens
gtctggggtactttcatctgat

SEQ ID NO: 7203448 - DNA, 22 bp, Homo sapiens
gtgaaggccagtagggtcctgg

SEQ ID NO: 7203449 - DNA, 22 bp, Homo sapiens
gtgacaaaaacactgattattt

SEQ ID NO: 7203450 - DNA, 22 bp, Homo sapiens
gtgacaaaggtcaagcttttga

SEQ ID NO: 7203451 - DNA, 22 bp, Homo sapiens
gtgacaaaggtcaagcttttga

SEQ ID NO: 7203452 - DNA, 22 bp, Homo sapiens
gtgacaaaggtcaagcttttga

SEQ ID NO: 7203453 - DNA, 22 bp, Homo sapiens
gtgacaaatgcaaattgggctg

SEQ ID NO: 7203454 - DNA, 22 bp, Homo sapiens
gtgacaaatgcaaattgggctg

SEQ ID NO: 7203455 - DNA, 22 bp, Homo sapiens
gtgacaatattagctcaggggc

SEQ ID NO: 7203456 - DNA, 22 bp, Homo sapiens
gtgacaatattagctcaggggc

SEQ ID NO: 7203457 - DNA, 22 bp, Homo sapiens
gtgacacccgcatgccactgtg

SEQ ID NO: 7203458 - DNA, 22 bp, Homo sapiens
gtgacagaaacagggctagaat

SEQ ID NO: 7203459 - DNA, 16 bp, Homo sapiens
gtgacagacaataggc

SEQ ID NO: 7203460 - DNA, 22 bp, Homo sapiens
gtgacagagattaatagcttgg

SEQ ID NO: 7203461 - DNA, 20 bp, Homo sapiens
gtgaccagaagacagtgggt

SEQ ID NO: 7203462 - DNA, 22 bp, Homo sapiens
gtgaccagaaaggcttccattt

SEQ ID NO: 7203463 - DNA, 22 bp, Homo sapiens
gtgacatttcgtgacgtgagaa

SEQ ID NO: 7203464 - DNA, 22 bp, Homo sapiens
gtgacatttttactgatgagag

SEQ ID NO: 7203465 - DNA, 22 bp, Homo sapiens
gtgacatttttactgatgagag

SEQ ID NO: 7203466 - DNA, 22 bp, Homo sapiens
gtgaccaatattatgctaatta

SEQ ID NO: 7203467 - DNA, 22 bp, Homo sapiens
gtgaccagacagagtctagccc

SEQ ID NO: 7203468 - DNA, 22 bp, Homo sapiens
gtgaccagttggcaggggtggg

SEQ ID NO: 7203469 - DNA, 22 bp, Homo sapiens
gtgaccagcccatagagaggcg

SEQ ID NO: 7203470 - DNA, 22 bp, Homo sapiens
gtgacattgctaggaacagatt

SEQ ID NO: 7203471 - DNA, 22 bp, Homo sapiens
gtgacatttacgaatcttatcc

SEQ ID NO: 7203472 - DNA, 22 bp, Homo sapiens
gtgacatttattagatgcttac

SEQ ID NO: 7203473 - DNA, 22 bp, Homo sapiens
gtgacaggtatactcaccattg

SEQ ID NO: 7203474 - DNA, 22 bp, Homo sapiens
gtgacaggtatactcaccattg

SEQ ID NO: 7203475 - DNA, 22 bp, Homo sapiens
gtgacagtcaaagacatgactt

SEQ ID NO: 7203476 - DNA, 22 bp, Homo sapiens
gtgcctgctgcagctgagcagt

SEQ ID NO: 7203477 - DNA, 22 bp, Homo sapiens
gtgcctgctgcagctgagcagt

SEQ ID NO: 7203478 - DNA, 22 bp, Homo sapiens
gtgcctgctgcagagtcgctgt

SEQ ID NO: 7203479 - DNA, 22 bp, Homo sapiens
gtgcctgctgcagagtcgctgt

SEQ ID NO: 7203480 - DNA, 22 bp, Homo sapiens
gtgcctgctgcagagtcgctgt

SEQ ID NO: 7203481 - DNA, 22 bp, Homo sapiens
gtgcctgctacctgacttgttt

SEQ ID NO: 7203482 - DNA, 22 bp, Homo sapiens
gtgcctgcagcaatccatggca

SEQ ID NO: 7203483 - DNA, 22 bp, Homo sapiens
gtgcctgccccactcctcagca

SEQ ID NO: 7203484 - DNA, 22 bp, Homo sapiens
gtgcctgccccactcctcagca

SEQ ID NO: 7203485 - DNA, 22 bp, Homo sapiens
gtgcctgcagcaatccatggca

SEQ ID NO: 7203486 - DNA, 22 bp, Homo sapiens
gtgcctgcagcaatccatggca

SEQ ID NO: 7203487 - DNA, 22 bp, Homo sapiens
gtgcctggaatgcgcctcggcg

SEQ ID NO: 7203488 - DNA, 22 bp, Homo sapiens
gtgcctggaatgcgcctcggcg

SEQ ID NO: 7203489 - DNA, 22 bp, Homo sapiens
gtgcctggaactgggtaggctg

SEQ ID NO: 7203490 - DNA, 22 bp, Homo sapiens
gtgcctggaactgggtaggctg

SEQ ID NO: 7203491 - DNA, 22 bp, Homo sapiens
gtgcctggaactgggtaggctg

SEQ ID NO: 7203492 - DNA, 22 bp, Homo sapiens
gtgcctggaactgggtaggctg

SEQ ID NO: 7203493 - DNA, 22 bp, Homo sapiens
gtgcgggcctgggggtttctct

SEQ ID NO: 7203494 - DNA, 22 bp, Homo sapiens
gtgcgccagctcaaggggaggc

SEQ ID NO: 7203495 - DNA, 22 bp, Homo sapiens
gtgcgcaccctcccggcatccc

SEQ ID NO: 7203496 - DNA, 22 bp, Homo sapiens
gtgcgcaccctcccggcatccc

SEQ ID NO: 7203497 - DNA, 22 bp, Homo sapiens
gtgctaattgaccatttgatat

SEQ ID NO: 7203498 - DNA, 22 bp, Homo sapiens
gtgcgtgtgcctatcaataaag

SEQ ID NO: 7203499 - DNA, 22 bp, Homo sapiens
gtgcgtgtgcctatcaataaag

SEQ ID NO: 7203500 - DNA, 22 bp, Homo sapiens
gtgctaataatgtgttaatttc

SEQ ID NO: 7203501 - DNA, 22 bp, Homo sapiens
gtgcgggcctgggggtttctct

SEQ ID NO: 7203502 - DNA, 22 bp, Homo sapiens
gtgcgggggttcccagcagccg

SEQ ID NO: 7203503 - DNA, 22 bp, Homo sapiens
gtgcgtcctgggggctgggtcg

SEQ ID NO: 7203504 - DNA, 22 bp, Homo sapiens
gtgcgtgaggcccctgagcgaa

SEQ ID NO: 7203505 - DNA, 22 bp, Homo sapiens
gtgcgtggttctagatcctgtc

SEQ ID NO: 7203506 - DNA, 22 bp, Homo sapiens
gtgcctgtttgtagactggaca

SEQ ID NO: 7203507 - DNA, 22 bp, Homo sapiens
gtgcctgggacacagcagatac

SEQ ID NO: 7203508 - DNA, 22 bp, Homo sapiens
gtgcctgggacacagcagatac

SEQ ID NO: 7203509 - DNA, 22 bp, Homo sapiens
gtgcctgtttcttttgaattca

SEQ ID NO: 7203510 - DNA, 22 bp, Homo sapiens
gtgcctggcatgcgccggtgct

SEQ ID NO: 7203511 - DNA, 22 bp, Homo sapiens
gtgcctggcagggtcagctgct

SEQ ID NO: 7203512 - DNA, 22 bp, Homo sapiens
gtgcctggcagggtcagctgct

SEQ ID NO: 7203513 - DNA, 20 bp, Homo sapiens
gtgcctggagaagaggctgt

SEQ ID NO: 7203514 - DNA, 20 bp, Homo sapiens
gtgcctggagaagaggctgt

SEQ ID NO: 7203515 - DNA, 20 bp, Homo sapiens
gtgcctggagaagaggctgt

SEQ ID NO: 7203516 - DNA, 20 bp, Homo sapiens
gtgcctggagaagaggctgt

SEQ ID NO: 7203517 - DNA, 20 bp, Homo sapiens
gtgcctggagaagaggctgt

SEQ ID NO: 7203518 - DNA, 22 bp, Homo sapiens
gtgcctggagctaatgtgtata

SEQ ID NO: 7203519 - DNA, 22 bp, Homo sapiens
gtgcctggcacacagaaggcaa

SEQ ID NO: 7203520 - DNA, 22 bp, Homo sapiens
gtgcctggcacacagaaggcaa

SEQ ID NO: 7203521 - DNA, 22 bp, Homo sapiens
gtgcctggcacacagaaggcaa

SEQ ID NO: 7203522 - DNA, 22 bp, Homo sapiens
gtgcctggcacacagaaggcaa

SEQ ID NO: 7203523 - DNA, 22 bp, Homo sapiens
gtggaagtagatttgagaaggt

SEQ ID NO: 7203524 - DNA, 22 bp, Homo sapiens
gtggaaggtgctagaacaagga

SEQ ID NO: 7203525 - DNA, 22 bp, Homo sapiens
gtggaaggtgaaggagcagcga

SEQ ID NO: 7203526 - DNA, 22 bp, Homo sapiens
gtggaaggtgaaggagcagcga

SEQ ID NO: 7203527 - DNA, 22 bp, Homo sapiens
gtggaaggtgaaggagcagcga

SEQ ID NO: 7203528 - DNA, 20 bp, Homo sapiens
gtggaatgcactctgtgctg

SEQ ID NO: 7203529 - DNA, 22 bp, Homo sapiens
gtggaatggccatgggatcctt

SEQ ID NO: 7203530 - DNA, 22 bp, Homo sapiens
gtggaattagctgcctaggaaa

SEQ ID NO: 7203531 - DNA, 22 bp, Homo sapiens
gtggaattaattcagttaatgc

SEQ ID NO: 7203532 - DNA, 22 bp, Homo sapiens
gtggaattcaaaatgtaggcat

SEQ ID NO: 7203533 - DNA, 22 bp, Homo sapiens
gtggaattgatgaggcacatta

SEQ ID NO: 7203534 - DNA, 22 bp, Homo sapiens
gtggaattgatttttggaggac

SEQ ID NO: 7203535 - DNA, 22 bp, Homo sapiens
gtggaagggactgcctagagga

SEQ ID NO: 7203536 - DNA, 22 bp, Homo sapiens
gtggaaggaattaacagactag

SEQ ID NO: 7203537 - DNA, 22 bp, Homo sapiens
gtggaaggaagagatggcccca

SEQ ID NO: 7203538 - DNA, 22 bp, Homo sapiens
gtggaaggtaatgcagcttact

SEQ ID NO: 7203539 - DNA, 22 bp, Homo sapiens
gtggaaggtgaaggagcagcga

SEQ ID NO: 7203540 - DNA, 22 bp, Homo sapiens
gtggaaggtgaaggagcagcga

SEQ ID NO: 7203541 - DNA, 22 bp, Homo sapiens
gtggaaggtgaaggagcagcga

SEQ ID NO: 7203542 - DNA, 22 bp, Homo sapiens
gtgctttttataaggcagactg

SEQ ID NO: 7203543 - DNA, 22 bp, Homo sapiens
gtgctaggattacaggcatggg

SEQ ID NO: 7203544 - DNA, 22 bp, Homo sapiens
gtgctttttataaggcagactg

SEQ ID NO: 7203545 - DNA, 22 bp, Homo sapiens
gtggaaaactgagaaaattgct

SEQ ID NO: 7203546 - DNA, 22 bp, Homo sapiens
gtggaaatagtttggttataga

SEQ ID NO: 7203547 - DNA, 22 bp, Homo sapiens
gtggaaatagtttggttataga

SEQ ID NO: 7203548 - DNA, 22 bp, Homo sapiens
gtggaaagaacacaaaattagg

SEQ ID NO: 7203549 - DNA, 22 bp, Homo sapiens
gtggaaatgcccccaaatagtg

SEQ ID NO: 7203550 - DNA, 22 bp, Homo sapiens
gtggaaattttaggatcatctt

SEQ ID NO: 7203551 - DNA, 22 bp, Homo sapiens
gtggaacaatatcgaagagagg

SEQ ID NO: 7203552 - DNA, 16 bp, Homo sapiens
gtggaacacattttgg

SEQ ID NO: 7203553 - DNA, 16 bp, Homo sapiens
gtggaacacattttgg

SEQ ID NO: 7203554 - DNA, 22 bp, Homo sapiens
gtggaacagaactgtttattga

SEQ ID NO: 7203555 - DNA, 22 bp, Homo sapiens
gtggaacagaactgtttattga

SEQ ID NO: 7203556 - DNA, 22 bp, Homo sapiens
gtggaacagcctgtgcaaacct

SEQ ID NO: 7203557 - DNA, 22 bp, Homo sapiens
gtggaacagcctgtgcaaacct

SEQ ID NO: 7203558 - DNA, 22 bp, Homo sapiens
gtggaacagggagcctggaatg

SEQ ID NO: 7203559 - DNA, 22 bp, Homo sapiens
gtggaacagtattttaaaagct

SEQ ID NO: 7203560 - DNA, 22 bp, Homo sapiens
gtggaacagtattttaaaagct

SEQ ID NO: 7203561 - DNA, 22 bp, Homo sapiens
gtggaacatgtccatatacatt

SEQ ID NO: 7203562 - DNA, 22 bp, Homo sapiens
gtggaacatgtccatatacatt

SEQ ID NO: 7203563 - DNA, 22 bp, Homo sapiens
gtggaacattcaaagtggagag

SEQ ID NO: 7203564 - DNA, 22 bp, Homo sapiens
gtggaagcaaccctggcaggag

SEQ ID NO: 7203565 - DNA, 22 bp, Homo sapiens
gtggaagcaaccctggcaggag

SEQ ID NO: 7203566 - DNA, 22 bp, Homo sapiens
gtggaagcagtaaggcaagttt

SEQ ID NO: 7203567 - DNA, 22 bp, Homo sapiens
gtggaagcctaagagtagggag

SEQ ID NO: 7203568 - DNA, 22 bp, Homo sapiens
gtggaggtcccgggcaggagca

SEQ ID NO: 7203569 - DNA, 22 bp, Homo sapiens
gtggagtgcaacggttggagtt

SEQ ID NO: 7203570 - DNA, 22 bp, Homo sapiens
gtggagtggcctggccctgaga

SEQ ID NO: 7203571 - DNA, 22 bp, Homo sapiens
gtggagtggcctggccctgaga

SEQ ID NO: 7203572 - DNA, 22 bp, Homo sapiens
gtggagggtttgcaatgtgcag

SEQ ID NO: 7203573 - DNA, 22 bp, Homo sapiens
gtggagggtttgcaatgtgcag

SEQ ID NO: 7203574 - DNA, 22 bp, Homo sapiens
gtggaggtcccgggcaggagca

SEQ ID NO: 7203575 - DNA, 22 bp, Homo sapiens
gtggaggtcccgggcaggagca

SEQ ID NO: 7203576 - DNA, 22 bp, Homo sapiens
gtggagtggtgatggataggtt

SEQ ID NO: 7203577 - DNA, 22 bp, Homo sapiens
gtggagtggtgatggataggtt

SEQ ID NO: 7203578 - DNA, 22 bp, Homo sapiens
gtggatctaaagaaggagggtg

SEQ ID NO: 7203579 - DNA, 22 bp, Homo sapiens
gtggatctactgtatgggatag

SEQ ID NO: 7203580 - DNA, 22 bp, Homo sapiens
gtggatgcttaggcagcctggg

SEQ ID NO: 7203581 - DNA, 18 bp, Homo sapiens
gtggatgcattgggaggg

SEQ ID NO: 7203582 - DNA, 22 bp, Homo sapiens
gtggatgcttaggcagcctggg

SEQ ID NO: 7203583 - DNA, 22 bp, Homo sapiens
gtggatggacatgggcaagagg

SEQ ID NO: 7203584 - DNA, 22 bp, Homo sapiens
gtggagggtgattgccggctgt

SEQ ID NO: 7203585 - DNA, 22 bp, Homo sapiens
gtggagggtgagctcatgtttg

SEQ ID NO: 7203586 - DNA, 22 bp, Homo sapiens
gtggagggtgattgccggctgt

SEQ ID NO: 7203587 - DNA, 22 bp, Homo sapiens
gtggagggtgattgccggctgt

SEQ ID NO: 7203588 - DNA, 18 bp, Homo sapiens
gtggagggttctcagaat

SEQ ID NO: 7203589 - DNA, 22 bp, Homo sapiens
gtggagggtgattgccggctgt

SEQ ID NO: 7203590 - DNA, 22 bp, Homo sapiens
gtggagggtgattgccggctgt

SEQ ID NO: 7203591 - DNA, 22 bp, Homo sapiens
gtggagggtttgcaatgtgcag

SEQ ID NO: 7203592 - DNA, 22 bp, Homo sapiens
gtggagggtttgcaatgtgcag

SEQ ID NO: 7203593 - DNA, 18 bp, Homo sapiens
gtggagggttctcagaat

SEQ ID NO: 7203594 - DNA, 18 bp, Homo sapiens
gtggagggttctcagaat

SEQ ID NO: 7203595 - DNA, 18 bp, Homo sapiens
gtggagggttctcagaat

SEQ ID NO: 7203596 - DNA, 22 bp, Homo sapiens
gtggagggaatgaatcttctct

SEQ ID NO: 7203597 - DNA, 22 bp, Homo sapiens
gtggaggcagtgacacagtagc

SEQ ID NO: 7203598 - DNA, 22 bp, Homo sapiens
gtggaggagaggcgccttgcgg

SEQ ID NO: 7203599 - DNA, 22 bp, Homo sapiens
gtggaggcagtgacacagtagc

SEQ ID NO: 7203600 - DNA, 22 bp, Homo sapiens
gtggaggacaaaagaagccttt

SEQ ID NO: 7203601 - DNA, 22 bp, Homo sapiens
gtggaggacaaaagaagccttt

SEQ ID NO: 7203602 - DNA, 22 bp, Homo sapiens
gtggaggagaggcgccttgcgg

SEQ ID NO: 7203603 - DNA, 22 bp, Homo sapiens
gtggagggaatgaatcttctct

SEQ ID NO: 7203604 - DNA, 22 bp, Homo sapiens
gtggagggtgagctcatgtttg

SEQ ID NO: 7203605 - DNA, 22 bp, Homo sapiens
gtggagggaatgaatcttctct

SEQ ID NO: 7203606 - DNA, 22 bp, Homo sapiens
gtggagggaatgaatcttctct

SEQ ID NO: 7203607 - DNA, 22 bp, Homo sapiens
gtggagggaatgaatcttctct

SEQ ID NO: 7203608 - DNA, 22 bp, Homo sapiens
gtggagggaatgaatcttctct

SEQ ID NO: 7203609 - DNA, 22 bp, Homo sapiens
gtggaggacaaaagaagccttt

SEQ ID NO: 7203610 - DNA, 22 bp, Homo sapiens
gtggaggacaaaagaagccttt

SEQ ID NO: 7203611 - DNA, 22 bp, Homo sapiens
gtggaggacaaaagaagccttt

SEQ ID NO: 7203612 - DNA, 22 bp, Homo sapiens
gtggaggacaaaagaagccttt

SEQ ID NO: 7203613 - DNA, 22 bp, Homo sapiens
gtggaggaagggattcagacca

SEQ ID NO: 7203614 - DNA, 22 bp, Homo sapiens
gtggaggaaaagaagttgggtg

SEQ ID NO: 7203615 - DNA, 22 bp, Homo sapiens
gtggaggaaaagaagttgggtg

SEQ ID NO: 7203616 - DNA, 22 bp, Homo sapiens
gtggaggaagggattcagacca

SEQ ID NO: 7203617 - DNA, 22 bp, Homo sapiens
gtggagccctggtagggacccc

SEQ ID NO: 7203618 - DNA, 19 bp, Homo sapiens
gtggagctaagaaaaggaa

SEQ ID NO: 7203619 - DNA, 22 bp, Homo sapiens
gtggagctggacccaggcctct

SEQ ID NO: 7203620 - DNA, 22 bp, Homo sapiens
gtggagctggacccaggcctct

SEQ ID NO: 7203621 - DNA, 22 bp, Homo sapiens
gtggagctggacccaggcctct

SEQ ID NO: 7203622 - DNA, 22 bp, Homo sapiens
gtggaggaaaagaagttgggtg

SEQ ID NO: 7203623 - DNA, 22 bp, Homo sapiens
gtggaggaaaagaagttgggtg

SEQ ID NO: 7203624 - DNA, 22 bp, Homo sapiens
gtggaggaaaagaagttgggtg

SEQ ID NO: 7203625 - DNA, 22 bp, Homo sapiens
gtggaggaaaagaagttgggtg

SEQ ID NO: 7203626 - DNA, 22 bp, Homo sapiens
gtggagagcaaataattggaat

SEQ ID NO: 7203627 - DNA, 22 bp, Homo sapiens
gtggagaggaacccagctctgt

SEQ ID NO: 7203628 - DNA, 22 bp, Homo sapiens
gtggagaggaacccagctctgt

SEQ ID NO: 7203629 - DNA, 22 bp, Homo sapiens
gtggagagagataagcctggtc

SEQ ID NO: 7203630 - DNA, 22 bp, Homo sapiens
gtggagagagtgacagcatctt

SEQ ID NO: 7203631 - DNA, 22 bp, Homo sapiens
gtggagagagtgacagcatctt

SEQ ID NO: 7203632 - DNA, 23 bp, Homo sapiens
gtggagagattagtaattcaccc

SEQ ID NO: 7203633 - DNA, 22 bp, Homo sapiens
gtggagacgggacagaagctaa

SEQ ID NO: 7203634 - DNA, 17 bp, Homo sapiens
gtggagacagatgcctc

SEQ ID NO: 7203635 - DNA, 22 bp, Homo sapiens
gtggagacttctactagagacc

SEQ ID NO: 7203636 - DNA, 22 bp, Homo sapiens
gtggagagagataagcctggtc

SEQ ID NO: 7203637 - DNA, 22 bp, Homo sapiens
gtggactggcagtgaccttggt

SEQ ID NO: 7203638 - DNA, 22 bp, Homo sapiens
gtggacttgagatggaccgagg

SEQ ID NO: 7203639 - DNA, 22 bp, Homo sapiens
gtggacttgagatggaccgagg

SEQ ID NO: 7203640 - DNA, 22 bp, Homo sapiens
gtggactgcgcttgagggggcc

SEQ ID NO: 7203641 - DNA, 22 bp, Homo sapiens
gtggacttgctgtcctggactt

SEQ ID NO: 7203642 - DNA, 22 bp, Homo sapiens
gtggacttgctgtcctggactt

SEQ ID NO: 7203643 - DNA, 22 bp, Homo sapiens
gtggagacctcctaggatgtgt

SEQ ID NO: 7203644 - DNA, 22 bp, Homo sapiens
gtggagacgggacagaagctaa

SEQ ID NO: 7203645 - DNA, 22 bp, Homo sapiens
gtggaccaaggtggaagataaa

SEQ ID NO: 7203646 - DNA, 22 bp, Homo sapiens
gtggacatgcatacatatgttt

SEQ ID NO: 7203647 - DNA, 22 bp, Homo sapiens
gtggaattggatgtggggtttt

SEQ ID NO: 7203648 - DNA, 22 bp, Homo sapiens
gtggacactggcagcagctcag

SEQ ID NO: 7203649 - DNA, 22 bp, Homo sapiens
gtggacagagctagaaaatgtg

SEQ ID NO: 7203650 - DNA, 22 bp, Homo sapiens
gtggacagagactaaatgttgt

SEQ ID NO: 7203651 - DNA, 22 bp, Homo sapiens
gtggacagagactaaatgttgt

SEQ ID NO: 7203652 - DNA, 22 bp, Homo sapiens
gtggacagagctagaaaatgtg

SEQ ID NO: 7203653 - DNA, 22 bp, Homo sapiens
gtggacagcttctaggtgccag

SEQ ID NO: 7203654 - DNA, 22 bp, Homo sapiens
gtggacagcttctaggtgccag

SEQ ID NO: 7203655 - DNA, 22 bp, Homo sapiens
gtggacagcttctaggtgccag

SEQ ID NO: 7203656 - DNA, 22 bp, Homo sapiens
gtggacaggcaggctgtcgggg

SEQ ID NO: 7203657 - DNA, 22 bp, Homo sapiens
gtggacaggcaggctgtcgggg

SEQ ID NO: 7203658 - DNA, 22 bp, Homo sapiens
gtggcagaggctctgggaccag

SEQ ID NO: 7203659 - DNA, 22 bp, Homo sapiens
gtggcagagccgtgcaggtagg

SEQ ID NO: 7203660 - DNA, 22 bp, Homo sapiens
gtggcagagggtgagctggact

SEQ ID NO: 7203661 - DNA, 22 bp, Homo sapiens
gtggcagagggtgagctggact

SEQ ID NO: 7203662 - DNA, 22 bp, Homo sapiens
gtggcagagggtgagctggact

SEQ ID NO: 7203663 - DNA, 22 bp, Homo sapiens
gtggcagagggtgagctggact

SEQ ID NO: 7203664 - DNA, 22 bp, Homo sapiens
gtggcagattgctcaccatggt

SEQ ID NO: 7203665 - DNA, 22 bp, Homo sapiens
gtggcagattgctcaccatggt

SEQ ID NO: 7203666 - DNA, 22 bp, Homo sapiens
gtggcagcaaaatcctgcattc

SEQ ID NO: 7203667 - DNA, 22 bp, Homo sapiens
gtggcagaggttcctcagtgtg

SEQ ID NO: 7203668 - DNA, 22 bp, Homo sapiens
gtggcagcaaatgcctggacta

SEQ ID NO: 7203669 - DNA, 22 bp, Homo sapiens
gtggcagcaaatgcctggacta

SEQ ID NO: 7203670 - DNA, 22 bp, Homo sapiens
gtggcagcaaatgcctggacta

SEQ ID NO: 7203671 - DNA, 19 bp, Homo sapiens
gtggcagcagatttggtgt

SEQ ID NO: 7203672 - DNA, 22 bp, Homo sapiens
gtggcagcaggtactcacgcac

SEQ ID NO: 7203673 - DNA, 22 bp, Homo sapiens
gtggcagccgcaggccctgtgt

SEQ ID NO: 7203674 - DNA, 22 bp, Homo sapiens
gtggcagccgcaggccctgtgt

SEQ ID NO: 7203675 - DNA, 22 bp, Homo sapiens
gtggcagcggcccaggccgtct

SEQ ID NO: 7203676 - DNA, 22 bp, Homo sapiens
gtggcagcggcccaggccgtct

SEQ ID NO: 7203677 - DNA, 22 bp, Homo sapiens
gtggcagcggtgtgcaaggagg

SEQ ID NO: 7203678 - DNA, 22 bp, Homo sapiens
gtggcagcggtgtgcaaggagg

SEQ ID NO: 7203679 - DNA, 22 bp, Homo sapiens
gtggcagcggtgtgcaaggagg

SEQ ID NO: 7203680 - DNA, 22 bp, Homo sapiens
gtggcagagccgtgcaggtagg

SEQ ID NO: 7203681 - DNA, 22 bp, Homo sapiens
gtggcagagccaggctttgaac

SEQ ID NO: 7203682 - DNA, 22 bp, Homo sapiens
gtggcagagccaaggctggagc

SEQ ID NO: 7203683 - DNA, 22 bp, Homo sapiens
gtggcacattggtagggtctgt

SEQ ID NO: 7203684 - DNA, 22 bp, Homo sapiens
gtggcacattggtagggtctgt

SEQ ID NO: 7203685 - DNA, 22 bp, Homo sapiens
gtggcacattggtagggtctgt

SEQ ID NO: 7203686 - DNA, 22 bp, Homo sapiens
gtggcacataggatcctgtggc

SEQ ID NO: 7203687 - DNA, 22 bp, Homo sapiens
gtggcacataggatcctgtggc

SEQ ID NO: 7203688 - DNA, 22 bp, Homo sapiens
gtggcacataggatcctgtggc

SEQ ID NO: 7203689 - DNA, 22 bp, Homo sapiens
gtggcacatgctgctgcttctg

SEQ ID NO: 7203690 - DNA, 22 bp, Homo sapiens
gtggcacagtgggagagcccca

SEQ ID NO: 7203691 - DNA, 22 bp, Homo sapiens
gtggcacagggttgttggtcat

SEQ ID NO: 7203692 - DNA, 22 bp, Homo sapiens
gtggcacagtgggagagcccca

SEQ ID NO: 7203693 - DNA, 22 bp, Homo sapiens
gtggcacagtgggagagcccca

SEQ ID NO: 7203694 - DNA, 22 bp, Homo sapiens
gtggcacagtctgaaattttga

SEQ ID NO: 7203695 - DNA, 22 bp, Homo sapiens
gtggcaagtgttccaagaggcg

SEQ ID NO: 7203696 - DNA, 22 bp, Homo sapiens
gtggcacaaggcttacacagca

SEQ ID NO: 7203697 - DNA, 22 bp, Homo sapiens
gtggcacacaggagagagctca

SEQ ID NO: 7203698 - DNA, 22 bp, Homo sapiens
gtggcacacaggagagagctca

SEQ ID NO: 7203699 - DNA, 22 bp, Homo sapiens
gtggcacagaagtttagagaac

SEQ ID NO: 7203700 - DNA, 22 bp, Homo sapiens
gtggcacagagatggggcatga

SEQ ID NO: 7203701 - DNA, 22 bp, Homo sapiens
gtggcacagagatggggcatga

SEQ ID NO: 7203702 - DNA, 22 bp, Homo sapiens
gtggcacagagatggggcatga

SEQ ID NO: 7203703 - DNA, 22 bp, Homo sapiens
gtggcacagagatggggcatga

SEQ ID NO: 7203704 - DNA, 22 bp, Homo sapiens
gtggcacagccaagcctcactc

SEQ ID NO: 7203705 - DNA, 22 bp, Homo sapiens
gtggcacagccaagcctcactc

SEQ ID NO: 7203706 - DNA, 22 bp, Homo sapiens
gtggcacagggtgtggcacaca

SEQ ID NO: 7203707 - DNA, 22 bp, Homo sapiens
gtggcacagggtgtggcacaca

SEQ ID NO: 7203708 - DNA, 22 bp, Homo sapiens
gtggcacagggtgtggcacaca

SEQ ID NO: 7203709 - DNA, 22 bp, Homo sapiens
gtggcacagggttgttggtcat

SEQ ID NO: 7203710 - DNA, 22 bp, Homo sapiens
gtggcaagtgttccaagaggcg

SEQ ID NO: 7203711 - DNA, 22 bp, Homo sapiens
gtggcaacaaaagagcctagtg

SEQ ID NO: 7203712 - DNA, 22 bp, Homo sapiens
gtggcaacaaaagagcctagtg

SEQ ID NO: 7203713 - DNA, 22 bp, Homo sapiens
gtggatggctagttgagaaggg

SEQ ID NO: 7203714 - DNA, 22 bp, Homo sapiens
gtggatggctagttgagaaggg

SEQ ID NO: 7203715 - DNA, 22 bp, Homo sapiens
gtggattacaagacagttgaga

SEQ ID NO: 7203716 - DNA, 22 bp, Homo sapiens
gtggatggagctggaagccatt

SEQ ID NO: 7203717 - DNA, 22 bp, Homo sapiens
gtggatggagctggaagccatt

SEQ ID NO: 7203718 - DNA, 22 bp, Homo sapiens
gtggatggattgaggcagtggg

SEQ ID NO: 7203719 - DNA, 22 bp, Homo sapiens
gtggatggagctggaagccatt

SEQ ID NO: 7203720 - DNA, 22 bp, Homo sapiens
gtggatggagctggaagccatt

SEQ ID NO: 7203721 - DNA, 22 bp, Homo sapiens
gtggatggattgaggcagtggg

SEQ ID NO: 7203722 - DNA, 22 bp, Homo sapiens
gtggatggattgaggcagtggg

SEQ ID NO: 7203723 - DNA, 22 bp, Homo sapiens
gtggcccaggttggagtgcagt

SEQ ID NO: 7203724 - DNA, 22 bp, Homo sapiens
gtggcccaggttggagtgcagt

SEQ ID NO: 7203725 - DNA, 22 bp, Homo sapiens
gtggcccaggttggagtgcagt

SEQ ID NO: 7203726 - DNA, 22 bp, Homo sapiens
gtggcccaggcttggcgctggc

SEQ ID NO: 7203727 - DNA, 22 bp, Homo sapiens
gtggcccaggcttggcgctggc

SEQ ID NO: 7203728 - DNA, 22 bp, Homo sapiens
gtggcccaggctggagtgcagt

SEQ ID NO: 7203729 - DNA, 22 bp, Homo sapiens
gtggcccaggctggagtgcagt

SEQ ID NO: 7203730 - DNA, 22 bp, Homo sapiens
gtggcccaggctggagtgcagt

SEQ ID NO: 7203731 - DNA, 22 bp, Homo sapiens
gtggccctaacaccgtttctca

SEQ ID NO: 7203732 - DNA, 22 bp, Homo sapiens
gtggccctatttgaggacccca

SEQ ID NO: 7203733 - DNA, 22 bp, Homo sapiens
gtggccctcagcagttgccaag

SEQ ID NO: 7203734 - DNA, 22 bp, Homo sapiens
gtggccctcagcagttgccaag

SEQ ID NO: 7203735 - DNA, 22 bp, Homo sapiens
gtggccctcagcagttgccaag

SEQ ID NO: 7203736 - DNA, 22 bp, Homo sapiens
gtggccctctgatagggtcagg

SEQ ID NO: 7203737 - DNA, 22 bp, Homo sapiens
gtggccctctgatagggtcagg

SEQ ID NO: 7203738 - DNA, 22 bp, Homo sapiens
gtggccctctgatagggtcagg

SEQ ID NO: 7203739 - DNA, 22 bp, Homo sapiens
gtggccctctgatagggtcagg

SEQ ID NO: 7203740 - DNA, 22 bp, Homo sapiens
gtggccctctgatagggtcagg

SEQ ID NO: 7203741 - DNA, 22 bp, Homo sapiens
gtggccctgagccctttgacag

SEQ ID NO: 7203742 - DNA, 21 bp, Homo sapiens
gtggccctgccgcagtgtcca

SEQ ID NO: 7203743 - DNA, 21 bp, Homo sapiens
gtggccctgccgcagtgtcca

SEQ ID NO: 7203744 - DNA, 22 bp, Homo sapiens
gtggccctggagttgtgacact

SEQ ID NO: 7203745 - DNA, 22 bp, Homo sapiens
gtggccaggacattgccaggca

SEQ ID NO: 7203746 - DNA, 22 bp, Homo sapiens
gtggccaggagaccttgggcat

SEQ ID NO: 7203747 - DNA, 22 bp, Homo sapiens
gtggccaggagaccttgggcat

SEQ ID NO: 7203748 - DNA, 22 bp, Homo sapiens
gtggccagctgtcagcaccctt

SEQ ID NO: 7203749 - DNA, 22 bp, Homo sapiens
gtggccaggacattgccaggca

SEQ ID NO: 7203750 - DNA, 22 bp, Homo sapiens
gtggccaggacattgccaggca

SEQ ID NO: 7203751 - DNA, 22 bp, Homo sapiens
gtggccaggagaccttgggcat

SEQ ID NO: 7203752 - DNA, 22 bp, Homo sapiens
gtggccaggagagggtgggaca

SEQ ID NO: 7203753 - DNA, 22 bp, Homo sapiens
gtggccaggagagggtgggaca

SEQ ID NO: 7203754 - DNA, 22 bp, Homo sapiens
gtggccaggagagggtgggaca

SEQ ID NO: 7203755 - DNA, 22 bp, Homo sapiens
gtggccaggagagggtgggaca

SEQ ID NO: 7203756 - DNA, 22 bp, Homo sapiens
gtggccaggccgactgccaggc

SEQ ID NO: 7203757 - DNA, 22 bp, Homo sapiens
gtggccaggccgactgccaggc

SEQ ID NO: 7203758 - DNA, 22 bp, Homo sapiens
gtggccaggccgactgccaggc

SEQ ID NO: 7203759 - DNA, 22 bp, Homo sapiens
gtggccaggccgactgccaggc

SEQ ID NO: 7203760 - DNA, 22 bp, Homo sapiens
gtggcccacacagacagcatct

SEQ ID NO: 7203761 - DNA, 22 bp, Homo sapiens
gtggcccacttacgtcatgtgt

SEQ ID NO: 7203762 - DNA, 22 bp, Homo sapiens
gtggcccacttacgtcatgtgt

SEQ ID NO: 7203763 - DNA, 22 bp, Homo sapiens
gtggccagaaccaggagaatga

SEQ ID NO: 7203764 - DNA, 22 bp, Homo sapiens
gtggccagaaccaggagaatga

SEQ ID NO: 7203765 - DNA, 22 bp, Homo sapiens
gtggccagaaccaggagaatga

SEQ ID NO: 7203766 - DNA, 22 bp, Homo sapiens
gtggccagaagactgcaatgct

SEQ ID NO: 7203767 - DNA, 22 bp, Homo sapiens
gtggccagaagactgcaatgct

SEQ ID NO: 7203768 - DNA, 22 bp, Homo sapiens
gtggccagaagactgcaatgct

SEQ ID NO: 7203769 - DNA, 22 bp, Homo sapiens
gtggccagaagttaagtggtta

SEQ ID NO: 7203770 - DNA, 22 bp, Homo sapiens
gtggccagaagttaagtggtta

SEQ ID NO: 7203771 - DNA, 22 bp, Homo sapiens
gtggccagaatcttgaggcctt

SEQ ID NO: 7203772 - DNA, 22 bp, Homo sapiens
gtggccagaatcttgaggcctt

SEQ ID NO: 7203773 - DNA, 22 bp, Homo sapiens
gtggccagaatcttgaggcctt

SEQ ID NO: 7203774 - DNA, 22 bp, Homo sapiens
gtggccagaatcttgaggcctt

SEQ ID NO: 7203775 - DNA, 22 bp, Homo sapiens
gtggccagaatcttgaggcctt

SEQ ID NO: 7203776 - DNA, 22 bp, Homo sapiens
gtggccagagattaaatagagt

SEQ ID NO: 7203777 - DNA, 22 bp, Homo sapiens
gtggccagagattaaatagagt

SEQ ID NO: 7203778 - DNA, 22 bp, Homo sapiens
gtggccagaggtcccatgtgtc

SEQ ID NO: 7203779 - DNA, 22 bp, Homo sapiens
gtggccagaggtcccatgtgtc

SEQ ID NO: 7203780 - DNA, 22 bp, Homo sapiens
gtggccagaggtcccatgtgtc

SEQ ID NO: 7203781 - DNA, 22 bp, Homo sapiens
gtggccagaggtcccatgtgtc

SEQ ID NO: 7203782 - DNA, 22 bp, Homo sapiens
gtggccagaggtcccatgtgtc

SEQ ID NO: 7203783 - DNA, 22 bp, Homo sapiens
gtggccagaggtcccatgtgtc

SEQ ID NO: 7203784 - DNA, 22 bp, Homo sapiens
gtggccagcaagtgctgcctct

SEQ ID NO: 7203785 - DNA, 22 bp, Homo sapiens
gtggccagcaagtgctgcctct

SEQ ID NO: 7203786 - DNA, 22 bp, Homo sapiens
gtggccagcaagtgctgcctct

SEQ ID NO: 7203787 - DNA, 22 bp, Homo sapiens
gtggccagcaagtgctgcctct

SEQ ID NO: 7203788 - DNA, 22 bp, Homo sapiens
gtggccagccagggtgctgatg

SEQ ID NO: 7203789 - DNA, 22 bp, Homo sapiens
gtggccagccagggtgctgatg

SEQ ID NO: 7203790 - DNA, 22 bp, Homo sapiens
gtggccagccagggtgctgatg

SEQ ID NO: 7203791 - DNA, 22 bp, Homo sapiens
gtggccagccagggtgctgatg

SEQ ID NO: 7203792 - DNA, 22 bp, Homo sapiens
gtggccagccagggtgctgatg

SEQ ID NO: 7203793 - DNA, 22 bp, Homo sapiens
gtggccagccccatggacagtt

SEQ ID NO: 7203794 - DNA, 22 bp, Homo sapiens
gtggccagccccatggacagtt

SEQ ID NO: 7203795 - DNA, 22 bp, Homo sapiens
gtggccagccccatggacagtt

SEQ ID NO: 7203796 - DNA, 22 bp, Homo sapiens
gtggccagccccatggacagtt

SEQ ID NO: 7203797 - DNA, 18 bp, Homo sapiens
gtggccagcctggtcttg

SEQ ID NO: 7203798 - DNA, 18 bp, Homo sapiens
gtggccagcctggtcttg

SEQ ID NO: 7203799 - DNA, 18 bp, Homo sapiens
gtggccagcctggtcttg

SEQ ID NO: 7203800 - DNA, 22 bp, Homo sapiens
gtggcagggtgctcatcatgca

SEQ ID NO: 7203801 - DNA, 22 bp, Homo sapiens
gtggcagggtgctcatcatgca

SEQ ID NO: 7203802 - DNA, 22 bp, Homo sapiens
gtggcagggtgctcatcatgca

SEQ ID NO: 7203803 - DNA, 22 bp, Homo sapiens
gtggcagggtgctcatcatgca

SEQ ID NO: 7203804 - DNA, 22 bp, Homo sapiens
gtggcaggggcgggctgttccg

SEQ ID NO: 7203805 - DNA, 22 bp, Homo sapiens
gtggcaggggtattccagctga

SEQ ID NO: 7203806 - DNA, 22 bp, Homo sapiens
gtggcaggggtattccagctga

SEQ ID NO: 7203807 - DNA, 22 bp, Homo sapiens
gtggcaggggtattccagctga

SEQ ID NO: 7203808 - DNA, 22 bp, Homo sapiens
gtggcaggggtattccagctga

SEQ ID NO: 7203809 - DNA, 22 bp, Homo sapiens
gtggcagtggagacccgagcct

SEQ ID NO: 7203810 - DNA, 20 bp, Homo sapiens
gtggcagtggtggcagcagt

SEQ ID NO: 7203811 - DNA, 22 bp, Homo sapiens
gtggcagttgctgtggcaataa

SEQ ID NO: 7203812 - DNA, 22 bp, Homo sapiens
gtggcatcaagatttagattca

SEQ ID NO: 7203813 - DNA, 22 bp, Homo sapiens
gtggcatgacagtgaatgggca

SEQ ID NO: 7203814 - DNA, 22 bp, Homo sapiens
gtggcatgatgtcggcttagtg

SEQ ID NO: 7203815 - DNA, 22 bp, Homo sapiens
gtggccaaaaggaagaaggtta

SEQ ID NO: 7203816 - DNA, 22 bp, Homo sapiens
gtggccaagagataaaattgtg

SEQ ID NO: 7203817 - DNA, 22 bp, Homo sapiens
gtggccaagaggggactggata

SEQ ID NO: 7203818 - DNA, 22 bp, Homo sapiens
gtggccaagaggggactggata

SEQ ID NO: 7203819 - DNA, 22 bp, Homo sapiens
gtggccaaggcagagaaagagc

SEQ ID NO: 7203820 - DNA, 22 bp, Homo sapiens
gtggccaaggtgcagagcagct

SEQ ID NO: 7203821 - DNA, 22 bp, Homo sapiens
gtggccaataggagcagctatc

SEQ ID NO: 7203822 - DNA, 22 bp, Homo sapiens
gtggccaatttccatctgtaag

SEQ ID NO: 7203823 - DNA, 22 bp, Homo sapiens
gtggcagctggtatgcagacag

SEQ ID NO: 7203824 - DNA, 22 bp, Homo sapiens
gtggcagctgtgggacactggt

SEQ ID NO: 7203825 - DNA, 22 bp, Homo sapiens
gtggcaggagactggaagatgg

SEQ ID NO: 7203826 - DNA, 22 bp, Homo sapiens
gtggcaggagactggaagatgg

SEQ ID NO: 7203827 - DNA, 22 bp, Homo sapiens
gtggcaggagtgggccttgaag

SEQ ID NO: 7203828 - DNA, 22 bp, Homo sapiens
gtggcaggatcacggctcactg

SEQ ID NO: 7203829 - DNA, 22 bp, Homo sapiens
gtggcaggatcacggctcactg

SEQ ID NO: 7203830 - DNA, 22 bp, Homo sapiens
gtggcaggatcacggctcactg

SEQ ID NO: 7203831 - DNA, 22 bp, Homo sapiens
gtggcaggagtgggccttgaag

SEQ ID NO: 7203832 - DNA, 22 bp, Homo sapiens
gtggcaggagtgggccttgaag

SEQ ID NO: 7203833 - DNA, 22 bp, Homo sapiens
gtggcaggagtgggccttgaag

SEQ ID NO: 7203834 - DNA, 22 bp, Homo sapiens
gtggcaggagagacacagccat

SEQ ID NO: 7203835 - DNA, 22 bp, Homo sapiens
gtggcaggagagacacagccat

SEQ ID NO: 7203836 - DNA, 22 bp, Homo sapiens
gtggcaggagagacacagccat

SEQ ID NO: 7203837 - DNA, 22 bp, Homo sapiens
gtggcaggagagacacagccat

SEQ ID NO: 7203838 - DNA, 22 bp, Homo sapiens
gtggcagggagaagccattggg

SEQ ID NO: 7203839 - DNA, 22 bp, Homo sapiens
gtggcagggcaatgctccctct

SEQ ID NO: 7203840 - DNA, 22 bp, Homo sapiens
gtggcagggcaatgctccctct

SEQ ID NO: 7203841 - DNA, 22 bp, Homo sapiens
gtggcagggagaagccattggg

SEQ ID NO: 7203842 - DNA, 20 bp, Homo sapiens
gtggcaggcagtgaaggagc

SEQ ID NO: 7203843 - DNA, 22 bp, Homo sapiens
gtggcagggagaagccattggg

SEQ ID NO: 7203844 - DNA, 22 bp, Homo sapiens
gtggcagggagaagccattggg

SEQ ID NO: 7203845 - DNA, 22 bp, Homo sapiens
gtggcagggctttgctgttctt

SEQ ID NO: 7203846 - DNA, 20 bp, Homo sapiens
gtggcaggcagtgaaggagc

SEQ ID NO: 7203847 - DNA, 20 bp, Homo sapiens
gtggcaggcagtgaaggagc

SEQ ID NO: 7203848 - DNA, 20 bp, Homo sapiens
gtggcaggcagtgaaggagc

SEQ ID NO: 7203849 - DNA, 20 bp, Homo sapiens
gtggcaggcagtgaaggagc

SEQ ID NO: 7203850 - DNA, 20 bp, Homo sapiens
gtggcaggcagtgaaggagc

SEQ ID NO: 7203851 - DNA, 22 bp, Homo sapiens
gtggcaggatcacggctcactg

SEQ ID NO: 7203852 - DNA, 22 bp, Homo sapiens
gtgggcaacgattaagaggcaa

SEQ ID NO: 7203853 - DNA, 22 bp, Homo sapiens
gtgggcaaagggactagggcca

SEQ ID NO: 7203854 - DNA, 22 bp, Homo sapiens
gtgggatgcttaggatcttgcc

SEQ ID NO: 7203855 - DNA, 22 bp, Homo sapiens
gtgggagtttgaacttcatgtt

SEQ ID NO: 7203856 - DNA, 21 bp, Homo sapiens
gtgggatacaattacggcagg

SEQ ID NO: 7203857 - DNA, 22 bp, Homo sapiens
gtgggatgcagtggtgagtggc

SEQ ID NO: 7203858 - DNA, 22 bp, Homo sapiens
gtgggatgcagtggtgagtggc

SEQ ID NO: 7203859 - DNA, 22 bp, Homo sapiens
gtgggatgcagtggtgagtggc

SEQ ID NO: 7203860 - DNA, 22 bp, Homo sapiens
gtgggagctttggcatcaggct

SEQ ID NO: 7203861 - DNA, 22 bp, Homo sapiens
gtgggagctttggcatcaggct

SEQ ID NO: 7203862 - DNA, 22 bp, Homo sapiens
gtgggagtggggaagcagagtg

SEQ ID NO: 7203863 - DNA, 22 bp, Homo sapiens
gtgggagctgcggaggcctggg

SEQ ID NO: 7203864 - DNA, 22 bp, Homo sapiens
gtgggagccctcagggaggtgc

SEQ ID NO: 7203865 - DNA, 22 bp, Homo sapiens
gtgggagctgcggaggcctggg

SEQ ID NO: 7203866 - DNA, 22 bp, Homo sapiens
gtgggagctgcggaggcctggg

SEQ ID NO: 7203867 - DNA, 22 bp, Homo sapiens
gtgggagctgcggaggcctggg

SEQ ID NO: 7203868 - DNA, 22 bp, Homo sapiens
gtgggagctgctacctccttcc

SEQ ID NO: 7203869 - DNA, 22 bp, Homo sapiens
gtgggagcttcatcaagcagtt

SEQ ID NO: 7203870 - DNA, 22 bp, Homo sapiens
gtgggagctttggcatcaggct

SEQ ID NO: 7203871 - DNA, 22 bp, Homo sapiens
gtggcttccaagactaagtcac

SEQ ID NO: 7203872 - DNA, 22 bp, Homo sapiens
gtggcttcatgaacactgatga

SEQ ID NO: 7203873 - DNA, 22 bp, Homo sapiens
gtgggagaaattagctctagtt

SEQ ID NO: 7203874 - DNA, 22 bp, Homo sapiens
gtgggagaaattagctctagtt

SEQ ID NO: 7203875 - DNA, 22 bp, Homo sapiens
gtgggagaagatttggtcatct

SEQ ID NO: 7203876 - DNA, 22 bp, Homo sapiens
gtgggagaagatttggtcatct

SEQ ID NO: 7203877 - DNA, 22 bp, Homo sapiens
gtgggagccctcagggaggtgc

SEQ ID NO: 7203878 - DNA, 22 bp, Homo sapiens
gtgggagccctcagggaggtgc

SEQ ID NO: 7203879 - DNA, 22 bp, Homo sapiens
gtgggagaagatttggtcatct

SEQ ID NO: 7203880 - DNA, 22 bp, Homo sapiens
gtgggagaagatttggtcatct

SEQ ID NO: 7203881 - DNA, 22 bp, Homo sapiens
gtgggagagaccccgcttaggg

SEQ ID NO: 7203882 - DNA, 22 bp, Homo sapiens
gtgggagcatggtcccagtgcc

SEQ ID NO: 7203883 - DNA, 22 bp, Homo sapiens
gtgggagagaccccgcttaggg

SEQ ID NO: 7203884 - DNA, 22 bp, Homo sapiens
gtgggagcatggtcccagtgcc

SEQ ID NO: 7203885 - DNA, 22 bp, Homo sapiens
gtggctgctgtcctctctggtt

SEQ ID NO: 7203886 - DNA, 22 bp, Homo sapiens
gtggctgctcgggctccggccc

SEQ ID NO: 7203887 - DNA, 22 bp, Homo sapiens
gtggctgctggtactctgggaa

SEQ ID NO: 7203888 - DNA, 19 bp, Homo sapiens
gtggctgccgatcgcggct

SEQ ID NO: 7203889 - DNA, 22 bp, Homo sapiens
gtggctgctaagtctccttcct

SEQ ID NO: 7203890 - DNA, 22 bp, Homo sapiens
gtggctgctacagagctggagg

SEQ ID NO: 7203891 - DNA, 22 bp, Homo sapiens
gtggctgctcgggctccggccc

SEQ ID NO: 7203892 - DNA, 22 bp, Homo sapiens
gtggctgcagagggcacagcat

SEQ ID NO: 7203893 - DNA, 22 bp, Homo sapiens
gtggctgcagagggcacagcat

SEQ ID NO: 7203894 - DNA, 22 bp, Homo sapiens
gtggctgcagcccagcggcacg

SEQ ID NO: 7203895 - DNA, 22 bp, Homo sapiens
gtggctgcatcggggtgaccag

SEQ ID NO: 7203896 - DNA, 22 bp, Homo sapiens
gtggctggtttcctgcatgcaa

SEQ ID NO: 7203897 - DNA, 22 bp, Homo sapiens
gtggctggtttcctgcatgcaa

SEQ ID NO: 7203898 - DNA, 22 bp, Homo sapiens
gtggctggtttcctgcatgcaa

SEQ ID NO: 7203899 - DNA, 22 bp, Homo sapiens
gtggctggtttcctgcatgcaa

SEQ ID NO: 7203900 - DNA, 22 bp, Homo sapiens
gtggctggtttcctgcatgcaa

SEQ ID NO: 7203901 - DNA, 22 bp, Homo sapiens
gtggctgttcttgccccatgct

SEQ ID NO: 7203902 - DNA, 22 bp, Homo sapiens
gtggctgggctccgagcggctt

SEQ ID NO: 7203903 - DNA, 22 bp, Homo sapiens
gtggctgggctccgagcggctt

SEQ ID NO: 7203904 - DNA, 22 bp, Homo sapiens
gtggctggagtatgaggaaagg

SEQ ID NO: 7203905 - DNA, 22 bp, Homo sapiens
gtggctggagtatgaggaaagg

SEQ ID NO: 7203906 - DNA, 22 bp, Homo sapiens
gtggctggagtatgaggaaagg

SEQ ID NO: 7203907 - DNA, 22 bp, Homo sapiens
gtggctggagtatgaggaaagg

SEQ ID NO: 7203908 - DNA, 22 bp, Homo sapiens
gtggctggagtatgaggaaagg

SEQ ID NO: 7203909 - DNA, 22 bp, Homo sapiens
gtggctggccctggaccctaag

SEQ ID NO: 7203910 - DNA, 22 bp, Homo sapiens
gtggctctgtaaaatgcctgca

SEQ ID NO: 7203911 - DNA, 22 bp, Homo sapiens
gtggctctggctttccaggcgg

SEQ ID NO: 7203912 - DNA, 22 bp, Homo sapiens
gtggctctctggtcccctgcca

SEQ ID NO: 7203913 - DNA, 22 bp, Homo sapiens
gtggctctcgccagcctgcggg

SEQ ID NO: 7203914 - DNA, 22 bp, Homo sapiens
gtggctgagcagcagagagctg

SEQ ID NO: 7203915 - DNA, 22 bp, Homo sapiens
gtggctgacaaccactggagga

SEQ ID NO: 7203916 - DNA, 17 bp, Homo sapiens
gtggctgcacacacatg

SEQ ID NO: 7203917 - DNA, 22 bp, Homo sapiens
gtggctgcagagccagcaagct

SEQ ID NO: 7203918 - DNA, 22 bp, Homo sapiens
gtggctgcagagccagcaagct

SEQ ID NO: 7203919 - DNA, 22 bp, Homo sapiens
gtggctgcagagccagcaagct

SEQ ID NO: 7203920 - DNA, 22 bp, Homo sapiens
gtggctgcagagggcacagcat

SEQ ID NO: 7203921 - DNA, 19 bp, Homo sapiens
gtggctcatgtagtgggcc

SEQ ID NO: 7203922 - DNA, 22 bp, Homo sapiens
gtggctccttttcaggaggctg

SEQ ID NO: 7203923 - DNA, 22 bp, Homo sapiens
gtggctctaggtgagcatggag

SEQ ID NO: 7203924 - DNA, 22 bp, Homo sapiens
gtggctctaggtgagcatggag

SEQ ID NO: 7203925 - DNA, 19 bp, Homo sapiens
gtggctcatgtagtgggcc

SEQ ID NO: 7203926 - DNA, 19 bp, Homo sapiens
gtggctcatgtagtgggcc

SEQ ID NO: 7203927 - DNA, 22 bp, Homo sapiens
gtggctcatctttgggaagtaa

SEQ ID NO: 7203928 - DNA, 22 bp, Homo sapiens
gtggctcatctttgggaagtaa

SEQ ID NO: 7203929 - DNA, 22 bp, Homo sapiens
gtggctcatctttgggaagtaa

SEQ ID NO: 7203930 - DNA, 22 bp, Homo sapiens
gtggctcagcggagctctgcac

SEQ ID NO: 7203931 - DNA, 22 bp, Homo sapiens
gtggctcagcggagctctgcac

SEQ ID NO: 7203932 - DNA, 22 bp, Homo sapiens
gtggctcagttaacttccatgt

SEQ ID NO: 7203933 - DNA, 22 bp, Homo sapiens
gtggctcagttaacttccatgt

SEQ ID NO: 7203934 - DNA, 22 bp, Homo sapiens
gtggcctggatgagcttcgaca

SEQ ID NO: 7203935 - DNA, 22 bp, Homo sapiens
gtggcctggcgagctggcgcgg

SEQ ID NO: 7203936 - DNA, 22 bp, Homo sapiens
gtggcctggcgagctggcgcgg

SEQ ID NO: 7203937 - DNA, 22 bp, Homo sapiens
gtggcctggatgagcttcgaca

SEQ ID NO: 7203938 - DNA, 22 bp, Homo sapiens
gtggcctggcgagctggcgcgg

SEQ ID NO: 7203939 - DNA, 22 bp, Homo sapiens
gtggcctggggtttgttctgag

SEQ ID NO: 7203940 - DNA, 22 bp, Homo sapiens
gtggcctggggtttgttctgag

SEQ ID NO: 7203941 - DNA, 22 bp, Homo sapiens
gtggctcagcggagctctgcac

SEQ ID NO: 7203942 - DNA, 22 bp, Homo sapiens
gtggcctctgttggctcctagg

SEQ ID NO: 7203943 - DNA, 22 bp, Homo sapiens
gtggcctctgttggctcctagg

SEQ ID NO: 7203944 - DNA, 22 bp, Homo sapiens
gtggcctctgtgctcctgccta

SEQ ID NO: 7203945 - DNA, 20 bp, Homo sapiens
gtggcctctcacattctgag

SEQ ID NO: 7203946 - DNA, 22 bp, Homo sapiens
gtggcctcctccgtccgcctct

SEQ ID NO: 7203947 - DNA, 19 bp, Homo sapiens
gtggcctcggagcgcgcgg

SEQ ID NO: 7203948 - DNA, 22 bp, Homo sapiens
gtggcctcatgtctataaagag

SEQ ID NO: 7203949 - DNA, 23 bp, Homo sapiens
gtggcctccccggaatgcctcgc

SEQ ID NO: 7203950 - DNA, 22 bp, Homo sapiens
gtggccctttgttttgatacct

SEQ ID NO: 7203951 - DNA, 22 bp, Homo sapiens
gtggcctagaggtgcaaggaac

SEQ ID NO: 7203952 - DNA, 22 bp, Homo sapiens
gtggcctagaggtgcaaggaac

SEQ ID NO: 7203953 - DNA, 22 bp, Homo sapiens
gtggccctggagttgtgacact

SEQ ID NO: 7203954 - DNA, 21 bp, Homo sapiens
gtggccctggtgtggctgcac

SEQ ID NO: 7203955 - DNA, 21 bp, Homo sapiens
gtggccctggtgtggctgcac

SEQ ID NO: 7203956 - DNA, 22 bp, Homo sapiens
gtggccctgtcccaggcctcct

SEQ ID NO: 7203957 - DNA, 22 bp, Homo sapiens
gtggccctgtcccaggcctcct

SEQ ID NO: 7203958 - DNA, 22 bp, Homo sapiens
gtggccctgtgaacagcgcagt

SEQ ID NO: 7203959 - DNA, 22 bp, Homo sapiens
gtggccctgtgaacagcgcagt

SEQ ID NO: 7203960 - DNA, 20 bp, Homo sapiens
gtggcccttaaagagggaag

SEQ ID NO: 7203961 - DNA, 20 bp, Homo sapiens
gtggcccttaaagagggaag

SEQ ID NO: 7203962 - DNA, 20 bp, Homo sapiens
gtggcccttaaagagggaag

SEQ ID NO: 7203963 - DNA, 20 bp, Homo sapiens
gtggcccttaaagagggaag

SEQ ID NO: 7203964 - DNA, 22 bp, Homo sapiens
gtggcccttgaagcagcttcat

SEQ ID NO: 7203965 - DNA, 22 bp, Homo sapiens
gtggcccttggagttgtgacct

SEQ ID NO: 7203966 - DNA, 22 bp, Homo sapiens
gtggcctgccagcagatggcgc

SEQ ID NO: 7203967 - DNA, 22 bp, Homo sapiens
gtggcctgccagcagatggcgc

SEQ ID NO: 7203968 - DNA, 22 bp, Homo sapiens
gtggcctgccagcagatggcgc

SEQ ID NO: 7203969 - DNA, 22 bp, Homo sapiens
gtggcctgccagcagatggcgc

SEQ ID NO: 7203970 - DNA, 22 bp, Homo sapiens
gtggcctgccagcagatggcgc

SEQ ID NO: 7203971 - DNA, 22 bp, Homo sapiens
gtggcctgccgcaccccaatat

SEQ ID NO: 7203972 - DNA, 22 bp, Homo sapiens
gtggcctgcaggcaccttgggg

SEQ ID NO: 7203973 - DNA, 22 bp, Homo sapiens
gtggcctgcaggcaccttgggg

SEQ ID NO: 7203974 - DNA, 22 bp, Homo sapiens
gtggcctgagcttcagagttgg

SEQ ID NO: 7203975 - DNA, 22 bp, Homo sapiens
gtggcctgagcttcagagttgg

SEQ ID NO: 7203976 - DNA, 22 bp, Homo sapiens
gtggcctgatgccagccctgtg

SEQ ID NO: 7203977 - DNA, 22 bp, Homo sapiens
gtggcctgatgccagccctgtg

SEQ ID NO: 7203978 - DNA, 22 bp, Homo sapiens
gtggcctgatgccagccctgtg

SEQ ID NO: 7203979 - DNA, 21 bp, Homo sapiens
gtggcctgattatgaatgggt

SEQ ID NO: 7203980 - DNA, 21 bp, Homo sapiens
gtggcctgattatgaatgggt

SEQ ID NO: 7203981 - DNA, 22 bp, Homo sapiens
gtggcctgccgtgtggtatggg

SEQ ID NO: 7203982 - DNA, 19 bp, Homo sapiens
gtggcctgcgctgggtgcg

SEQ ID NO: 7203983 - DNA, 19 bp, Homo sapiens
gtggcctgcgctgggtgcg

SEQ ID NO: 7203984 - DNA, 22 bp, Homo sapiens
gtggcctggaaaggctggtctg

SEQ ID NO: 7203985 - DNA, 22 bp, Homo sapiens
gtggcctggaaaggctggtctg

SEQ ID NO: 7203986 - DNA, 22 bp, Homo sapiens
gtggcctggagtttgatgtagg

SEQ ID NO: 7203987 - DNA, 22 bp, Homo sapiens
gtggcctggatagactccatct

SEQ ID NO: 7203988 - DNA, 22 bp, Homo sapiens
gtggcctggatagactccatct

SEQ ID NO: 7203989 - DNA, 22 bp, Homo sapiens
ggtgcaggcggtggggcaagta

SEQ ID NO: 7203990 - DNA, 22 bp, Homo sapiens
ggtgcaggcggtggggcaagta

SEQ ID NO: 7203991 - DNA, 22 bp, Homo sapiens
ggtgcaggcggtggggcaagta

SEQ ID NO: 7203992 - DNA, 22 bp, Homo sapiens
ggtgcaggcggtggggcaagta

SEQ ID NO: 7203993 - DNA, 22 bp, Homo sapiens
ggtgcaggagcggggtgctcgg

SEQ ID NO: 7203994 - DNA, 22 bp, Homo sapiens
ggtgcaggagcggggtgctcgg

SEQ ID NO: 7203995 - DNA, 22 bp, Homo sapiens
ggtgcaggagcggggtgctcgg

SEQ ID NO: 7203996 - DNA, 22 bp, Homo sapiens
ggtggcagcatggtcccagtgt

SEQ ID NO: 7203997 - DNA, 22 bp, Homo sapiens
ggtggcagaggtgcatcagccc

SEQ ID NO: 7203998 - DNA, 22 bp, Homo sapiens
ggtggcagaggtgcatcagccc

SEQ ID NO: 7203999 - DNA, 22 bp, Homo sapiens
ggtggcagagaggaggtagttt

SEQ ID NO: 7204000 - DNA, 22 bp, Homo sapiens
ggtggcagaggtgcatcagccc

SEQ ID NO: 7204001 - DNA, 22 bp, Homo sapiens
ggtggcagaggtgcatcagccc

SEQ ID NO: 7204002 - DNA, 22 bp, Homo sapiens
ggtggcagaggtgcatcagccc

SEQ ID NO: 7204003 - DNA, 22 bp, Homo sapiens
ggtgcaggagcggggtgctcgg

SEQ ID NO: 7204004 - DNA, 22 bp, Homo sapiens
ggtgcaggacgaagtgggggtt

SEQ ID NO: 7204005 - DNA, 22 bp, Homo sapiens
ggtgcaggaatctgcaattgaa

SEQ ID NO: 7204006 - DNA, 22 bp, Homo sapiens
ggtgcaaaagtaatcacagttt

SEQ ID NO: 7204007 - DNA, 22 bp, Homo sapiens
ggtgcaaaagtaatttggtttt

SEQ ID NO: 7204008 - DNA, 22 bp, Homo sapiens
ggtgcaaaagtaattgcggttt

SEQ ID NO: 7204009 - DNA, 22 bp, Homo sapiens
ggtgatttatccattttctggt

SEQ ID NO: 7204010 - DNA, 22 bp, Homo sapiens
ggtgatttccttttgcaaagtc

SEQ ID NO: 7204011 - DNA, 22 bp, Homo sapiens
ggtgcaaaaatctatcaccagc

SEQ ID NO: 7204012 - DNA, 22 bp, Homo sapiens
ggtgcaaaaataattgcggttt

SEQ ID NO: 7204013 - DNA, 22 bp, Homo sapiens
ggtgagtttcatggttgtttac

SEQ ID NO: 7204014 - DNA, 22 bp, Homo sapiens
ggtgatcagccttctgatttct

SEQ ID NO: 7204015 - DNA, 22 bp, Homo sapiens
ggtgatccaccagcctcggcct

SEQ ID NO: 7204016 - DNA, 22 bp, Homo sapiens
ggtgagtgtcaatggttagagt

SEQ ID NO: 7204017 - DNA, 22 bp, Homo sapiens
ggtgagggtaaatataggcaaa

SEQ ID NO: 7204018 - DNA, 22 bp, Homo sapiens
ggtgagggtaaatataggcaaa

SEQ ID NO: 7204019 - DNA, 22 bp, Homo sapiens
ggtgagggtaaactaaaacatc

SEQ ID NO: 7204020 - DNA, 22 bp, Homo sapiens
ggtgagggtaaatataggcaaa

SEQ ID NO: 7204021 - DNA, 22 bp, Homo sapiens
ggtgagggtaaatataggcaaa

SEQ ID NO: 7204022 - DNA, 22 bp, Homo sapiens
ggtgagggtaaatataggcaaa

SEQ ID NO: 7204023 - DNA, 22 bp, Homo sapiens
ggtgaggggcgcctctgcccgg

SEQ ID NO: 7204024 - DNA, 22 bp, Homo sapiens
ggtgaggggctcctctgcccgg

SEQ ID NO: 7204025 - DNA, 22 bp, Homo sapiens
ggtgaggggctcctctgcccgg

SEQ ID NO: 7204026 - DNA, 22 bp, Homo sapiens
ggtgaggggagagtgaaagaaa

SEQ ID NO: 7204027 - DNA, 22 bp, Homo sapiens
ggtgaggggagagtgaaagaaa

SEQ ID NO: 7204028 - DNA, 22 bp, Homo sapiens
ggtgaggggagagtgaaagaaa

SEQ ID NO: 7204029 - DNA, 22 bp, Homo sapiens
ggtgaggggagagtgaaagaaa

SEQ ID NO: 7204030 - DNA, 22 bp, Homo sapiens
ggtgaggggcacctctgcccgg

SEQ ID NO: 7204031 - DNA, 22 bp, Homo sapiens
ggtgaggggcacctctgcccgg

SEQ ID NO: 7204032 - DNA, 22 bp, Homo sapiens
ggtgaggggcgcctctgcccag

SEQ ID NO: 7204033 - DNA, 22 bp, Homo sapiens
ggtgaggggcgcctctgcccag

SEQ ID NO: 7204034 - DNA, 22 bp, Homo sapiens
ggtgaggggcgcctctgcccgg

SEQ ID NO: 7204035 - DNA, 21 bp, Homo sapiens
gggtggggttccagccttttc

SEQ ID NO: 7204036 - DNA, 22 bp, Homo sapiens
gggtggggttcaggaatcttca

SEQ ID NO: 7204037 - DNA, 22 bp, Homo sapiens
gggtggggttcaggaatcttca

SEQ ID NO: 7204038 - DNA, 22 bp, Homo sapiens
gggtggggttcaggaatcttca

SEQ ID NO: 7204039 - DNA, 22 bp, Homo sapiens
gggtggggttcaggaatcttca

SEQ ID NO: 7204040 - DNA, 22 bp, Homo sapiens
gggtggggttcaggaatcttca

SEQ ID NO: 7204041 - DNA, 22 bp, Homo sapiens
gggtggggtgtatcggatccta

SEQ ID NO: 7204042 - DNA, 22 bp, Homo sapiens
gggtggggtgtatcggatccta

SEQ ID NO: 7204043 - DNA, 22 bp, Homo sapiens
gggtggggtgtatcggatccta

SEQ ID NO: 7204044 - DNA, 22 bp, Homo sapiens
gggtggggcccaggaaatctat

SEQ ID NO: 7204045 - DNA, 22 bp, Homo sapiens
gggtggggccaggcaatttgca

SEQ ID NO: 7204046 - DNA, 22 bp, Homo sapiens
gggtggggccaggcaatttgca

SEQ ID NO: 7204047 - DNA, 22 bp, Homo sapiens
gggtggggccaggcaatttgca

SEQ ID NO: 7204048 - DNA, 22 bp, Homo sapiens
gggtggggccaggcaatttgca

SEQ ID NO: 7204049 - DNA, 22 bp, Homo sapiens
gggtgggcctgtctggccatgt

SEQ ID NO: 7204050 - DNA, 22 bp, Homo sapiens
gggtggggccaggcaatttgca

SEQ ID NO: 7204051 - DNA, 22 bp, Homo sapiens
gggtggggccaggcaatttgca

SEQ ID NO: 7204052 - DNA, 22 bp, Homo sapiens
gggtggggcccaggaaatctat

SEQ ID NO: 7204053 - DNA, 22 bp, Homo sapiens
gggtggggcccaggaaatctat

SEQ ID NO: 7204054 - DNA, 22 bp, Homo sapiens
gggtggggcccaggaaatctat

SEQ ID NO: 7204055 - DNA, 22 bp, Homo sapiens
gggtggggcccaggaaatctat

SEQ ID NO: 7204056 - DNA, 22 bp, Homo sapiens
gggtggggcccaggaaatctat

SEQ ID NO: 7204057 - DNA, 22 bp, Homo sapiens
gggtggggtgtatcggatccta

SEQ ID NO: 7204058 - DNA, 22 bp, Homo sapiens
ggtggcagttacaggggcaaat

SEQ ID NO: 7204059 - DNA, 22 bp, Homo sapiens
ggtggcaggctggcattggcaa

SEQ ID NO: 7204060 - DNA, 22 bp, Homo sapiens
ggtggcagttacaggggcaaat

SEQ ID NO: 7204061 - DNA, 22 bp, Homo sapiens
ggtggcatcacagtactggggg

SEQ ID NO: 7204062 - DNA, 22 bp, Homo sapiens
ggtggcattcagaagagctggc

SEQ ID NO: 7204063 - DNA, 22 bp, Homo sapiens
ggtggccaggagacatttgtca

SEQ ID NO: 7204064 - DNA, 22 bp, Homo sapiens
ggtggccaggagacatttgtca

SEQ ID NO: 7204065 - DNA, 22 bp, Homo sapiens
ggtggccaggccagctctggcc

SEQ ID NO: 7204066 - DNA, 22 bp, Homo sapiens
ggtggccaggccagctctggcc

SEQ ID NO: 7204067 - DNA, 22 bp, Homo sapiens
ggtggccaggccagctctggcc

SEQ ID NO: 7204068 - DNA, 22 bp, Homo sapiens
ggtggccaggccagctctggcc

SEQ ID NO: 7204069 - DNA, 22 bp, Homo sapiens
ggtggccataggaccagcctgg

SEQ ID NO: 7204070 - DNA, 22 bp, Homo sapiens
ggtggccataggaccagcctgg

SEQ ID NO: 7204071 - DNA, 22 bp, Homo sapiens
ggtggccataggaccagcctgg

SEQ ID NO: 7204072 - DNA, 22 bp, Homo sapiens
ggtggccataggaccagcctgg

SEQ ID NO: 7204073 - DNA, 22 bp, Homo sapiens
ggtggcaggctggcattggcaa

SEQ ID NO: 7204074 - DNA, 22 bp, Homo sapiens
ggtggcaggctggcattggcaa

SEQ ID NO: 7204075 - DNA, 22 bp, Homo sapiens
ggtggcaggctggcattggcaa

SEQ ID NO: 7204076 - DNA, 22 bp, Homo sapiens
ggtggcaggccctgagcatccc

SEQ ID NO: 7204077 - DNA, 22 bp, Homo sapiens
ggtggcaggctggcattggcaa

SEQ ID NO: 7204078 - DNA, 22 bp, Homo sapiens
ggtggcaggctggcattggcaa

SEQ ID NO: 7204079 - DNA, 22 bp, Homo sapiens
ggtggcaggccctgagcatccc

SEQ ID NO: 7204080 - DNA, 22 bp, Homo sapiens
ggtggcaggccctgagcatccc

SEQ ID NO: 7204081 - DNA, 22 bp, Homo sapiens
ggtggcaggccctgagcatccc

SEQ ID NO: 7204082 - DNA, 22 bp, Homo sapiens
ggtggcaggccctgagcatccc

SEQ ID NO: 7204083 - DNA, 22 bp, Homo sapiens
ggtggcaggccctgagcatccc

SEQ ID NO: 7204084 - DNA, 22 bp, Homo sapiens
ggtggcaggccctgagcatccc

SEQ ID NO: 7204085 - DNA, 23 bp, Homo sapiens
ggtggcaggagtggatgctgagc

SEQ ID NO: 7204086 - DNA, 23 bp, Homo sapiens
ggtggcaggagtggatgctgagc

SEQ ID NO: 7204087 - DNA, 23 bp, Homo sapiens
ggtggcaggagtggatgctgagc

SEQ ID NO: 7204088 - DNA, 23 bp, Homo sapiens
ggtggcaggagtggatgctgagc

SEQ ID NO: 7204089 - DNA, 19 bp, Homo sapiens
ggtggcaggaataaaggtc

SEQ ID NO: 7204090 - DNA, 22 bp, Homo sapiens
ggtggcagcgtctatctgacat

SEQ ID NO: 7204091 - DNA, 22 bp, Homo sapiens
ggtggcagcatggtcccagtgt

SEQ ID NO: 7204092 - DNA, 22 bp, Homo sapiens
ggtgtccgcgctgtagaaggtc

SEQ ID NO: 7204093 - DNA, 22 bp, Homo sapiens
ggtgtcctacagggccgcaggc

SEQ ID NO: 7204094 - DNA, 22 bp, Homo sapiens
ggtgtcctactgcttggttgct

SEQ ID NO: 7204095 - DNA, 19 bp, Homo sapiens
ggtgtcctagagataagag

SEQ ID NO: 7204096 - DNA, 22 bp, Homo sapiens
ggtgtcatccaacaggacaggg

SEQ ID NO: 7204097 - DNA, 22 bp, Homo sapiens
ggtgtccacattccctggcagg

SEQ ID NO: 7204098 - DNA, 22 bp, Homo sapiens
ggtgtcagatttgacatccaga

SEQ ID NO: 7204099 - DNA, 22 bp, Homo sapiens
ggtgtcaggaaaatctcagtgt

SEQ ID NO: 7204100 - DNA, 19 bp, Homo sapiens
ggtgtcaggcctctctcct

SEQ ID NO: 7204101 - DNA, 20 bp, Homo sapiens
ggtgtcagggccatgcctgg

SEQ ID NO: 7204102 - DNA, 20 bp, Homo sapiens
ggtgtcagggccatgcctgg

SEQ ID NO: 7204103 - DNA, 22 bp, Homo sapiens
ggtgtcagttgctcatcagagt

SEQ ID NO: 7204104 - DNA, 22 bp, Homo sapiens
ggtgtagctctgtgtcccactg

SEQ ID NO: 7204105 - DNA, 22 bp, Homo sapiens
ggtggttcacgcctataatccc

SEQ ID NO: 7204106 - DNA, 22 bp, Homo sapiens
ggtggttgcataggccagcagc

SEQ ID NO: 7204107 - DNA, 22 bp, Homo sapiens
ggtggttcacgcctataatccc

SEQ ID NO: 7204108 - DNA, 18 bp, Homo sapiens
ggtggtttggaagcaggt

SEQ ID NO: 7204109 - DNA, 22 bp, Homo sapiens
ggtgtagctctgtgtcccactg

SEQ ID NO: 7204110 - DNA, 22 bp, Homo sapiens
ggtggccatggtcaggtagcgg

SEQ ID NO: 7204111 - DNA, 22 bp, Homo sapiens
ggtggccataggaccagcctgg

SEQ ID NO: 7204112 - DNA, 22 bp, Homo sapiens
ggtggccatggtcaggtagcgg

SEQ ID NO: 7204113 - DNA, 22 bp, Homo sapiens
ggtggccattctaccgccttct

SEQ ID NO: 7204114 - DNA, 22 bp, Homo sapiens
ggtggccattctaccgccttct

SEQ ID NO: 7204115 - DNA, 22 bp, Homo sapiens
ggtggccctaaccgcagcctcc

SEQ ID NO: 7204116 - DNA, 22 bp, Homo sapiens
ggtggccctaaccgcagcctcc

SEQ ID NO: 7204117 - DNA, 22 bp, Homo sapiens
ggtggtggtcccgacttgggag

SEQ ID NO: 7204118 - DNA, 22 bp, Homo sapiens
ggtggtggtcccgacttgggag

SEQ ID NO: 7204119 - DNA, 22 bp, Homo sapiens
ggtggtggtcccgacttgggag

SEQ ID NO: 7204120 - DNA, 23 bp, Homo sapiens
ggtggtggtgagtcacgggctca

SEQ ID NO: 7204121 - DNA, 23 bp, Homo sapiens
ggtggtggtgagtcacgggctca

SEQ ID NO: 7204122 - DNA, 22 bp, Homo sapiens
ggtggtggtcccgacttgggag

SEQ ID NO: 7204123 - DNA, 23 bp, Homo sapiens
ggtggtggtgagtcacgggctca

SEQ ID NO: 7204124 - DNA, 22 bp, Homo sapiens
ggtggtgtttggaaggaggtgc

SEQ ID NO: 7204125 - DNA, 22 bp, Homo sapiens
ggtggtgtttggaaggaggtgc

SEQ ID NO: 7204126 - DNA, 21 bp, Homo sapiens
gtacagggatagtagtgtcaa

SEQ ID NO: 7204127 - DNA, 22 bp, Homo sapiens
gtacaggtcttatctcctagga

SEQ ID NO: 7204128 - DNA, 22 bp, Homo sapiens
gtacaggtcttatctcctagga

SEQ ID NO: 7204129 - DNA, 22 bp, Homo sapiens
gtacaggtcttatctcctagga

SEQ ID NO: 7204130 - DNA, 22 bp, Homo sapiens
gtacaggttggctctatcgctg

SEQ ID NO: 7204131 - DNA, 22 bp, Homo sapiens
gtacaggttggctctatcgctg

SEQ ID NO: 7204132 - DNA, 22 bp, Homo sapiens
gtacagtagagccaggttcagt

SEQ ID NO: 7204133 - DNA, 19 bp, Homo sapiens
gtacagtctgtgggtttgg

SEQ ID NO: 7204134 - DNA, 22 bp, Homo sapiens
gtacagtgggtgtagggaccag

SEQ ID NO: 7204135 - DNA, 22 bp, Homo sapiens
gtacataagaaattactacaga

SEQ ID NO: 7204136 - DNA, 22 bp, Homo sapiens
gtacataagaaattactacaga

SEQ ID NO: 7204137 - DNA, 22 bp, Homo sapiens
gtacataagaaattactacaga

SEQ ID NO: 7204138 - DNA, 22 bp, Homo sapiens
gtacatatggcacatgctattt

SEQ ID NO: 7204139 - DNA, 22 bp, Homo sapiens
gtacatatggcacatgctattt

SEQ ID NO: 7204140 - DNA, 22 bp, Homo sapiens
gtacatattaaaggtctataaa

SEQ ID NO: 7204141 - DNA, 22 bp, Homo sapiens
gtacatattaaaggtctataaa

SEQ ID NO: 7204142 - DNA, 22 bp, Homo sapiens
gtacatattacagacaaagctt

SEQ ID NO: 7204143 - DNA, 22 bp, Homo sapiens
gtacatgtgcacaatgtgcagg

SEQ ID NO: 7204144 - DNA, 22 bp, Homo sapiens
gtacatgcagattatagctaat

SEQ ID NO: 7204145 - DNA, 22 bp, Homo sapiens
gtacatgcagattatagctaat

SEQ ID NO: 7204146 - DNA, 22 bp, Homo sapiens
gtacatgtatgagatatgtgta

SEQ ID NO: 7204147 - DNA, 22 bp, Homo sapiens
gtacatattataaaatacagct

SEQ ID NO: 7204148 - DNA, 22 bp, Homo sapiens
gtacatccccaaagccacgccc

SEQ ID NO: 7204149 - DNA, 22 bp, Homo sapiens
gtacatctgtcttgttctgttg

SEQ ID NO: 7204150 - DNA, 22 bp, Homo sapiens
gtacatgattccccataaaaag

SEQ ID NO: 7204151 - DNA, 22 bp, Homo sapiens
gtacatgttggttgtttccagt

SEQ ID NO: 7204152 - DNA, 22 bp, Homo sapiens
gtacattcagcttagcacttct

SEQ ID NO: 7204153 - DNA, 22 bp, Homo sapiens
gtacattcatggttccaccagg

SEQ ID NO: 7204154 - DNA, 22 bp, Homo sapiens
gtacatttactgatgaaaagta

SEQ ID NO: 7204155 - DNA, 22 bp, Homo sapiens
gtacatttaggattcattgaaa

SEQ ID NO: 7204156 - DNA, 22 bp, Homo sapiens
gtatatatgtgtgaacatgtat

SEQ ID NO: 7204157 - DNA, 22 bp, Homo sapiens
gtatatatgtgtgaacatgtat

SEQ ID NO: 7204158 - DNA, 22 bp, Homo sapiens
gtatatatgtgtgaacatgtat

SEQ ID NO: 7204159 - DNA, 22 bp, Homo sapiens
gtatataaggtaaagcgattgt

SEQ ID NO: 7204160 - DNA, 22 bp, Homo sapiens
gtatataaggtaaagcgattgt

SEQ ID NO: 7204161 - DNA, 20 bp, Homo sapiens
gtatataaccatagtgacta

SEQ ID NO: 7204162 - DNA, 20 bp, Homo sapiens
gtatataaccatagtgacta

SEQ ID NO: 7204163 - DNA, 22 bp, Homo sapiens
gtatataaggtaaagcgattgt

SEQ ID NO: 7204164 - DNA, 22 bp, Homo sapiens
gtatataaggtaaagcgattgt

SEQ ID NO: 7204165 - DNA, 22 bp, Homo sapiens
gtatatatcggcactattttaa

SEQ ID NO: 7204166 - DNA, 22 bp, Homo sapiens
gtatatatcggcactattttaa

SEQ ID NO: 7204167 - DNA, 22 bp, Homo sapiens
gtatactcaacctgcctagaat

SEQ ID NO: 7204168 - DNA, 22 bp, Homo sapiens
gtatacttgcagacatttatat

SEQ ID NO: 7204169 - DNA, 22 bp, Homo sapiens
gtatactcatgtctcagaggac

SEQ ID NO: 7204170 - DNA, 22 bp, Homo sapiens
gtatagaaacccagaaagatag

SEQ ID NO: 7204171 - DNA, 22 bp, Homo sapiens
gtatagaaacccagaaagatag

SEQ ID NO: 7204172 - DNA, 22 bp, Homo sapiens
gtatagttccaagcatattttg

SEQ ID NO: 7204173 - DNA, 22 bp, Homo sapiens
gtataggtgagggacttgatca

SEQ ID NO: 7204174 - DNA, 22 bp, Homo sapiens
gtatagtttgcgatttgtggtt

SEQ ID NO: 7204175 - DNA, 20 bp, Homo sapiens
gtatataaccatagtgacta

SEQ ID NO: 7204176 - DNA, 20 bp, Homo sapiens
gtatataaccatagtgacta

SEQ ID NO: 7204177 - DNA, 20 bp, Homo sapiens
gtatataaccatagtgacta

SEQ ID NO: 7204178 - DNA, 22 bp, Homo sapiens
gtatatattggataaaccagag

SEQ ID NO: 7204179 - DNA, 21 bp, Homo sapiens
gtatatcagcagtgaattcaa

SEQ ID NO: 7204180 - DNA, 22 bp, Homo sapiens
gtatatctcttacatacacaca

SEQ ID NO: 7204181 - DNA, 22 bp, Homo sapiens
gtatatctcttacatacacaca

SEQ ID NO: 7204182 - DNA, 18 bp, Homo sapiens
gtatatctgcacatatac

SEQ ID NO: 7204183 - DNA, 18 bp, Homo sapiens
gtatatctgcacatatac

SEQ ID NO: 7204184 - DNA, 22 bp, Homo sapiens
gtatatcttcagaaattatagg

SEQ ID NO: 7204185 - DNA, 22 bp, Homo sapiens
gtatatcttcagaaattatagg

SEQ ID NO: 7204186 - DNA, 22 bp, Homo sapiens
gtatatgagctctatgtaatgg

SEQ ID NO: 7204187 - DNA, 22 bp, Homo sapiens
gtacagcatttgaaattactgg

SEQ ID NO: 7204188 - DNA, 22 bp, Homo sapiens
gtacagcatttgaaattactgg

SEQ ID NO: 7204189 - DNA, 22 bp, Homo sapiens
gtacagaggttgctggaggctc

SEQ ID NO: 7204190 - DNA, 22 bp, Homo sapiens
gtacagattaataatatactga

SEQ ID NO: 7204191 - DNA, 22 bp, Homo sapiens
gtacagattaataatatactga

SEQ ID NO: 7204192 - DNA, 22 bp, Homo sapiens
gtacagcacagagcatcgcaca

SEQ ID NO: 7204193 - DNA, 22 bp, Homo sapiens
gtacaggacatagacagagtag

SEQ ID NO: 7204194 - DNA, 22 bp, Homo sapiens
gtacaggaccgcggccccctgg

SEQ ID NO: 7204195 - DNA, 22 bp, Homo sapiens
gtacagggcccctcagcagggc

SEQ ID NO: 7204196 - DNA, 22 bp, Homo sapiens
gtacagaatgcttggtaaggca

SEQ ID NO: 7204197 - DNA, 22 bp, Homo sapiens
gtacagaatgcttggtaaggca

SEQ ID NO: 7204198 - DNA, 22 bp, Homo sapiens
gtacagaattatgccatgaggg

SEQ ID NO: 7204199 - DNA, 22 bp, Homo sapiens
gtacagaaatggggccccaggt

SEQ ID NO: 7204200 - DNA, 22 bp, Homo sapiens
gtacagaaatgtgatgacgcaa

SEQ ID NO: 7204201 - DNA, 22 bp, Homo sapiens
gtacagaaggagctttggattc

SEQ ID NO: 7204202 - DNA, 22 bp, Homo sapiens
gtacagaaggagctttggattc

SEQ ID NO: 7204203 - DNA, 22 bp, Homo sapiens
gtacagaaggatttctagtagt

SEQ ID NO: 7204204 - DNA, 22 bp, Homo sapiens
gtacagaaggatttctagtagt

SEQ ID NO: 7204205 - DNA, 22 bp, Homo sapiens
gtacacaaataataaagttaca

SEQ ID NO: 7204206 - DNA, 22 bp, Homo sapiens
gtacagaaagtacccatagaag

SEQ ID NO: 7204207 - DNA, 22 bp, Homo sapiens
gtaaatattccctcggttccta

SEQ ID NO: 7204208 - DNA, 22 bp, Homo sapiens
gtaaatattccctcggttccta

SEQ ID NO: 7204209 - DNA, 22 bp, Homo sapiens
gtaaatattaaaggctgctaga

SEQ ID NO: 7204210 - DNA, 22 bp, Homo sapiens
gtaaatattaaaggctgctaga

SEQ ID NO: 7204211 - DNA, 18 bp, Homo sapiens
gtacacaaagtcaaagta

SEQ ID NO: 7204212 - DNA, 18 bp, Homo sapiens
gtacacaaagtcaaagta

SEQ ID NO: 7204213 - DNA, 22 bp, Homo sapiens
gtacacaaagtgagacttgata

SEQ ID NO: 7204214 - DNA, 22 bp, Homo sapiens
gtacacaaagtgagacttgata

SEQ ID NO: 7204215 - DNA, 22 bp, Homo sapiens
gtacacaaataataaagttaca

SEQ ID NO: 7204216 - DNA, 22 bp, Homo sapiens
gtacacaaataataaagttaca

SEQ ID NO: 7204217 - DNA, 22 bp, Homo sapiens
gtaaatattaaaggctgctaga

SEQ ID NO: 7204218 - DNA, 22 bp, Homo sapiens
gtaaatattaaaggctgctaga

SEQ ID NO: 7204219 - DNA, 22 bp, Homo sapiens
gtaaatataaatgctagctgcc

SEQ ID NO: 7204220 - DNA, 22 bp, Homo sapiens
gtaaatattaaaggctgctaga

SEQ ID NO: 7204221 - DNA, 22 bp, Homo sapiens
gtaaatataaatgctagctgcc

SEQ ID NO: 7204222 - DNA, 22 bp, Homo sapiens
gtaaatataaatgctagctgcc

SEQ ID NO: 7204223 - DNA, 22 bp, Homo sapiens
gtaaatataaatgctagctgcc

SEQ ID NO: 7204224 - DNA, 22 bp, Homo sapiens
gtaaataactggtaattggggt

SEQ ID NO: 7204225 - DNA, 22 bp, Homo sapiens
gtaaataactggtaattggggt

SEQ ID NO: 7204226 - DNA, 22 bp, Homo sapiens
gtaaataactggtaattggggt

SEQ ID NO: 7204227 - DNA, 23 bp, Homo sapiens
gtaaaatacgcagtgcagtgtga

SEQ ID NO: 7204228 - DNA, 22 bp, Homo sapiens
ggtgtcctgggcaggcagctga

SEQ ID NO: 7204229 - DNA, 22 bp, Homo sapiens
ggtgtcctgggcaggcagctga

SEQ ID NO: 7204230 - DNA, 22 bp, Homo sapiens
ggtgtcctgtcagctagagtga

SEQ ID NO: 7204231 - DNA, 22 bp, Homo sapiens
ggtgtcctcggattcagggcag

SEQ ID NO: 7204232 - DNA, 21 bp, Homo sapiens
ggtgtcctgagggataggtag

SEQ ID NO: 7204233 - DNA, 22 bp, Homo sapiens
ggtgtcctcatgattttctaga

SEQ ID NO: 7204234 - DNA, 22 bp, Homo sapiens
ggtgtcctcatgattttctaga

SEQ ID NO: 7204235 - DNA, 22 bp, Homo sapiens
ggtgtcctcactatagcaagtc

SEQ ID NO: 7204236 - DNA, 22 bp, Homo sapiens
gtaaacatgctgtgtactcagc

SEQ ID NO: 7204237 - DNA, 23 bp, Homo sapiens
gtaaaatacgcagtgcagtgtga

SEQ ID NO: 7204238 - DNA, 23 bp, Homo sapiens
gtaaaatacgcagtgcagtgtga

SEQ ID NO: 7204239 - DNA, 22 bp, Homo sapiens
gtaaaatagaataacgtggcta

SEQ ID NO: 7204240 - DNA, 22 bp, Homo sapiens
gtaaacattttcatctgtgccc

SEQ ID NO: 7204241 - DNA, 22 bp, Homo sapiens
gtaaactatgggctttggagga

SEQ ID NO: 7204242 - DNA, 22 bp, Homo sapiens
gtaaacattactgtgctgtata

SEQ ID NO: 7204243 - DNA, 22 bp, Homo sapiens
gtaaactgaattggatactgtg

SEQ ID NO: 7204244 - DNA, 22 bp, Homo sapiens
gtaaactgattgttggagttac

SEQ ID NO: 7204245 - DNA, 22 bp, Homo sapiens
gtaaactgtagctacttaacta

SEQ ID NO: 7204246 - DNA, 22 bp, Homo sapiens
gtaaactgtagctacttaacta

SEQ ID NO: 7204247 - DNA, 22 bp, Homo sapiens
gtaaactgtccacatgtggcac

SEQ ID NO: 7204248 - DNA, 22 bp, Homo sapiens
gtaaactgtctactctgtgcta

SEQ ID NO: 7204249 - DNA, 22 bp, Homo sapiens
gtaaagaaggcaacctggttat

SEQ ID NO: 7204250 - DNA, 22 bp, Homo sapiens
gtaaagaaggcaacctggttat

SEQ ID NO: 7204251 - DNA, 22 bp, Homo sapiens
gtaaactgtgttaaaggttgac

SEQ ID NO: 7204252 - DNA, 22 bp, Homo sapiens
gtaaactgaattggatactgtg

SEQ ID NO: 7204253 - DNA, 22 bp, Homo sapiens
gtaaagaagtttttgaatgcat

SEQ ID NO: 7204254 - DNA, 22 bp, Homo sapiens
gtaaagaagtttttgaatgcat

SEQ ID NO: 7204255 - DNA, 22 bp, Homo sapiens
gtaaagcaaaatgtagagattg

SEQ ID NO: 7204256 - DNA, 22 bp, Homo sapiens
gtaaagcaaaatgtagagattg

SEQ ID NO: 7204257 - DNA, 22 bp, Homo sapiens
gtaaagcaggtagttgggacac

SEQ ID NO: 7204258 - DNA, 20 bp, Homo sapiens
gtaaagcattcttggcatac

SEQ ID NO: 7204259 - DNA, 20 bp, Homo sapiens
gtaaagcattcttggcatac

SEQ ID NO: 7204260 - DNA, 22 bp, Homo sapiens
gtaaagctctcatttaatatca

SEQ ID NO: 7204261 - DNA, 22 bp, Homo sapiens
gtaaagctggagaggtctttta

SEQ ID NO: 7204262 - DNA, 22 bp, Homo sapiens
gtaaaggctctgataagtactg

SEQ ID NO: 7204263 - DNA, 22 bp, Homo sapiens
gtaaagtcctacatatgtcagg

SEQ ID NO: 7204264 - DNA, 22 bp, Homo sapiens
gtaaagtctggctgaaacatgc

SEQ ID NO: 7204265 - DNA, 22 bp, Homo sapiens
gtaaagttctatttgaatttag

SEQ ID NO: 7204266 - DNA, 22 bp, Homo sapiens
gtaaataactggtaattggggt

SEQ ID NO: 7204267 - DNA, 22 bp, Homo sapiens
gtaaataactggtaattggggt

SEQ ID NO: 7204268 - DNA, 22 bp, Homo sapiens
gtcctgggtccccgcaggtcag

SEQ ID NO: 7204269 - DNA, 22 bp, Homo sapiens
gtcctgggtccccgcaggtcag

SEQ ID NO: 7204270 - DNA, 22 bp, Homo sapiens
gtcctggtagctggcttggtca

SEQ ID NO: 7204271 - DNA, 22 bp, Homo sapiens
gtcctgggtccccgcaggtcag

SEQ ID NO: 7204272 - DNA, 22 bp, Homo sapiens
gtcctggtagctggcttggtca

SEQ ID NO: 7204273 - DNA, 22 bp, Homo sapiens
gtcctggtagggctctgtgtct

SEQ ID NO: 7204274 - DNA, 22 bp, Homo sapiens
gtcctggtagggctctgtgtct

SEQ ID NO: 7204275 - DNA, 22 bp, Homo sapiens
gtcctggtagctggcttggtca

SEQ ID NO: 7204276 - DNA, 22 bp, Homo sapiens
gtcctgtgtactcctgatactt

SEQ ID NO: 7204277 - DNA, 22 bp, Homo sapiens
gtcctgtgtgacttcccaaatg

SEQ ID NO: 7204278 - DNA, 22 bp, Homo sapiens
gtcctgtgtgacttcccaaatg

SEQ ID NO: 7204279 - DNA, 22 bp, Homo sapiens
gtccttaacaaacggggaaaag

SEQ ID NO: 7204280 - DNA, 22 bp, Homo sapiens
gtccttaaagagagcatcattc

SEQ ID NO: 7204281 - DNA, 22 bp, Homo sapiens
gtccttatttcacttaaacgta

SEQ ID NO: 7204282 - DNA, 22 bp, Homo sapiens
gtccttcaaggtccttggtgtg

SEQ ID NO: 7204283 - DNA, 22 bp, Homo sapiens
gtcctgtgtgagtgcaccacct

SEQ ID NO: 7204284 - DNA, 22 bp, Homo sapiens
gtcctgtgtgagtgcaccacct

SEQ ID NO: 7204285 - DNA, 22 bp, Homo sapiens
gtcctgtgtgttgccggctgaa

SEQ ID NO: 7204286 - DNA, 22 bp, Homo sapiens
gtcctgttaagatgcagagtcc

SEQ ID NO: 7204287 - DNA, 22 bp, Homo sapiens
gtcctgttggggtgttgcagtc

SEQ ID NO: 7204288 - DNA, 22 bp, Homo sapiens
gtcctgtttgtatttgctggaa

SEQ ID NO: 7204289 - DNA, 22 bp, Homo sapiens
gtcccagggaggttcagggctt

SEQ ID NO: 7204290 - DNA, 22 bp, Homo sapiens
gtcccagggatgcagacatgag

SEQ ID NO: 7204291 - DNA, 22 bp, Homo sapiens
gtcccagggatgcagacatgag

SEQ ID NO: 7204292 - DNA, 22 bp, Homo sapiens
gtcccagggatgcagacatgag

SEQ ID NO: 7204293 - DNA, 22 bp, Homo sapiens
gtcccagggcaaggctgtttct

SEQ ID NO: 7204294 - DNA, 22 bp, Homo sapiens
gtcccagggccaccatatatag

SEQ ID NO: 7204295 - DNA, 22 bp, Homo sapiens
gtcccagggccaccatatatag

SEQ ID NO: 7204296 - DNA, 22 bp, Homo sapiens
gtcccaggtcccagcacatctg

SEQ ID NO: 7204297 - DNA, 22 bp, Homo sapiens
gtcccaggtgcccagtgggcag

SEQ ID NO: 7204298 - DNA, 22 bp, Homo sapiens
gtcccaggtgcccagtgggcag

SEQ ID NO: 7204299 - DNA, 22 bp, Homo sapiens
gtcccaggtgcccagtgggcag

SEQ ID NO: 7204300 - DNA, 22 bp, Homo sapiens
gtcccaggtgggctccacctct

SEQ ID NO: 7204301 - DNA, 22 bp, Homo sapiens
gtcccaggtgggctccacctct

SEQ ID NO: 7204302 - DNA, 22 bp, Homo sapiens
gtcccagttcctcctgtcagca

SEQ ID NO: 7204303 - DNA, 22 bp, Homo sapiens
gtcccagttcctcctgtcagca

SEQ ID NO: 7204304 - DNA, 22 bp, Homo sapiens
gtcccataagtagtgcaacttg

SEQ ID NO: 7204305 - DNA, 22 bp, Homo sapiens
gtcccagaaacatattgctggt

SEQ ID NO: 7204306 - DNA, 22 bp, Homo sapiens
gtcccactgggcaactagaaaa

SEQ ID NO: 7204307 - DNA, 22 bp, Homo sapiens
gtcccagggaggttcagggctt

SEQ ID NO: 7204308 - DNA, 22 bp, Homo sapiens
gtccattgttctatggctcaaa

SEQ ID NO: 7204309 - DNA, 22 bp, Homo sapiens
gtccattttattcagagacttt

SEQ ID NO: 7204310 - DNA, 22 bp, Homo sapiens
gtccatctaagtatccagcctg

SEQ ID NO: 7204311 - DNA, 22 bp, Homo sapiens
gtccatctcttattgatcctaa

SEQ ID NO: 7204312 - DNA, 22 bp, Homo sapiens
gtccatgcagtcacctccagct

SEQ ID NO: 7204313 - DNA, 22 bp, Homo sapiens
gtccagggccccgagcaccagg

SEQ ID NO: 7204314 - DNA, 22 bp, Homo sapiens
gtccagtcactgtcaatgttcc

SEQ ID NO: 7204315 - DNA, 22 bp, Homo sapiens
gtccagtgctaacaggttgagg

SEQ ID NO: 7204316 - DNA, 22 bp, Homo sapiens
gtccagtgcttatagaatcagt

SEQ ID NO: 7204317 - DNA, 21 bp, Homo sapiens
gtccagtggaggaggacagga

SEQ ID NO: 7204318 - DNA, 22 bp, Homo sapiens
gtccagtgtgtttatcttggat

SEQ ID NO: 7204319 - DNA, 19 bp, Homo sapiens
gtccagtgttttccagtca

SEQ ID NO: 7204320 - DNA, 22 bp, Homo sapiens
gtccatacagtggcacacatct

SEQ ID NO: 7204321 - DNA, 22 bp, Homo sapiens
gtccatagagtatatattttga

SEQ ID NO: 7204322 - DNA, 22 bp, Homo sapiens
gtcaggaaaacccgggttgact

SEQ ID NO: 7204323 - DNA, 22 bp, Homo sapiens
gtcagctgtctccccagagtgg

SEQ ID NO: 7204324 - DNA, 21 bp, Homo sapiens
gtcagctgtgtgtgaggaccc

SEQ ID NO: 7204325 - DNA, 22 bp, Homo sapiens
gtcagaggggcagctgccaggc

SEQ ID NO: 7204326 - DNA, 22 bp, Homo sapiens
gtcagctcagcaggtgggagtg

SEQ ID NO: 7204327 - DNA, 22 bp, Homo sapiens
gtcagctcatccatcccggtgg

SEQ ID NO: 7204328 - DNA, 22 bp, Homo sapiens
gtcagctcctagcaccccccaa

SEQ ID NO: 7204329 - DNA, 22 bp, Homo sapiens
gtcagctgcacaggtgggagct

SEQ ID NO: 7204330 - DNA, 22 bp, Homo sapiens
gtcagctgcagtgggcacagcc

SEQ ID NO: 7204331 - DNA, 22 bp, Homo sapiens
gtcagctgcagtgggcacagcc

SEQ ID NO: 7204332 - DNA, 22 bp, Homo sapiens
gtatgtgaggttggtttccagg

SEQ ID NO: 7204333 - DNA, 22 bp, Homo sapiens
gtatgtgcaattcactgtgaga

SEQ ID NO: 7204334 - DNA, 22 bp, Homo sapiens
gtatgtgctcagtaagtacatg

SEQ ID NO: 7204335 - DNA, 22 bp, Homo sapiens
gtatgtctgagtaataatgtgt

SEQ ID NO: 7204336 - DNA, 22 bp, Homo sapiens
gtatgtcaaaatctgcatgata

SEQ ID NO: 7204337 - DNA, 22 bp, Homo sapiens
gtcagaggggacaagacacaga

SEQ ID NO: 7204338 - DNA, 18 bp, Homo sapiens
gtcagaggatggggaaat

SEQ ID NO: 7204339 - DNA, 22 bp, Homo sapiens
gtcagaggggacaagacacaga

SEQ ID NO: 7204340 - DNA, 22 bp, Homo sapiens
gtattacatttagtaattaggc

SEQ ID NO: 7204341 - DNA, 22 bp, Homo sapiens
gtattacatttagtaattaggc

SEQ ID NO: 7204342 - DNA, 22 bp, Homo sapiens
gtattacaaataaatgttactg

SEQ ID NO: 7204343 - DNA, 20 bp, Homo sapiens
gtattacaggcttagaacca

SEQ ID NO: 7204344 - DNA, 19 bp, Homo sapiens
gtcaggcacgtgagagcat

SEQ ID NO: 7204345 - DNA, 19 bp, Homo sapiens
gtcaggcacgtgagagcat

SEQ ID NO: 7204346 - DNA, 22 bp, Homo sapiens
gtcaggcagcctggagattcag

SEQ ID NO: 7204347 - DNA, 22 bp, Homo sapiens
gtcaggcagtggaaattaaaaa

SEQ ID NO: 7204348 - DNA, 18 bp, Homo sapiens
gtcaggcatgaatctggg

SEQ ID NO: 7204349 - DNA, 22 bp, Homo sapiens
gtcaggcatttaggatgagttc

SEQ ID NO: 7204350 - DNA, 21 bp, Homo sapiens
gtcaggcccatagcagtgcct

SEQ ID NO: 7204351 - DNA, 22 bp, Homo sapiens
gtcaggccctggcagccgtgac

SEQ ID NO: 7204352 - DNA, 22 bp, Homo sapiens
gtcaggccctggcagccgtgac

SEQ ID NO: 7204353 - DNA, 22 bp, Homo sapiens
gtcaggccctggcagccgtgac

SEQ ID NO: 7204354 - DNA, 22 bp, Homo sapiens
gtccagggccccgagcaccagg

SEQ ID NO: 7204355 - DNA, 22 bp, Homo sapiens
gtccagggccccgagcaccagg

SEQ ID NO: 7204356 - DNA, 22 bp, Homo sapiens
gtcaggaagtggcattggagaa

SEQ ID NO: 7204357 - DNA, 22 bp, Homo sapiens
gtcaggaagtggcattggagaa

SEQ ID NO: 7204358 - DNA, 22 bp, Homo sapiens
gtcaggacaaggtggtctccag

SEQ ID NO: 7204359 - DNA, 22 bp, Homo sapiens
gtcaggaagcaaggttgggcat

SEQ ID NO: 7204360 - DNA, 19 bp, Homo sapiens
gtcaggaagtactttccgg

SEQ ID NO: 7204361 - DNA, 22 bp, Homo sapiens
gtcaggacaggctctggactga

SEQ ID NO: 7204362 - DNA, 22 bp, Homo sapiens
gtcaggacattttaccatcctg

SEQ ID NO: 7204363 - DNA, 22 bp, Homo sapiens
gtcaggactctgacccgtcccg

SEQ ID NO: 7204364 - DNA, 22 bp, Homo sapiens
gtcaggactctgacccgtcccg

SEQ ID NO: 7204365 - DNA, 22 bp, Homo sapiens
gtcaggactctgacccgtcccg

SEQ ID NO: 7204366 - DNA, 22 bp, Homo sapiens
gtcaggactctgacccgtcccg

SEQ ID NO: 7204367 - DNA, 22 bp, Homo sapiens
gtcaggagatagggcaagcttc

SEQ ID NO: 7204368 - DNA, 22 bp, Homo sapiens
gtcaggagagatcaggacagca

SEQ ID NO: 7204369 - DNA, 22 bp, Homo sapiens
gtcaggagagatcaggacagca

SEQ ID NO: 7204370 - DNA, 22 bp, Homo sapiens
gtcaggagagatcaggacagca

SEQ ID NO: 7204371 - DNA, 22 bp, Homo sapiens
gtcaggatcaaattgaagttat

SEQ ID NO: 7204372 - DNA, 22 bp, Homo sapiens
gtctggggcagcaaggcgcgcg

SEQ ID NO: 7204373 - DNA, 22 bp, Homo sapiens
gtctggggaagtcagggcatca

SEQ ID NO: 7204374 - DNA, 22 bp, Homo sapiens
gtctggggaagtcagggcatca

SEQ ID NO: 7204375 - DNA, 22 bp, Homo sapiens
gtctggggcagcaaggcgcgcg

SEQ ID NO: 7204376 - DNA, 22 bp, Homo sapiens
gtctggggcagcaaggcgcgcg

SEQ ID NO: 7204377 - DNA, 22 bp, Homo sapiens
gtctgggggtccgggtgcctgc

SEQ ID NO: 7204378 - DNA, 22 bp, Homo sapiens
gtctgggggtccgggtgcctgc

SEQ ID NO: 7204379 - DNA, 22 bp, Homo sapiens
gtctgggggtccgggtgcctgc

SEQ ID NO: 7204380 - DNA, 22 bp, Homo sapiens
gtctggggcagcaaggcgcgcg

SEQ ID NO: 7204381 - DNA, 22 bp, Homo sapiens
gtctggggcagcaaggcgcgcg

SEQ ID NO: 7204382 - DNA, 22 bp, Homo sapiens
gtctgggggtccgggtgcctgc

SEQ ID NO: 7204383 - DNA, 22 bp, Homo sapiens
gtctgggcttcagagttagaga

SEQ ID NO: 7204384 - DNA, 22 bp, Homo sapiens
gtctgggcttcagagttagaga

SEQ ID NO: 7204385 - DNA, 17 bp, Homo sapiens
gtctgggctttagagac

SEQ ID NO: 7204386 - DNA, 22 bp, Homo sapiens
gtctggggaagtcagggcatca

SEQ ID NO: 7204387 - DNA, 22 bp, Homo sapiens
gtctggggaagtcagggcatca

SEQ ID NO: 7204388 - DNA, 22 bp, Homo sapiens
gtctggggaagtcagggcatca

SEQ ID NO: 7204389 - DNA, 22 bp, Homo sapiens
gtctgggctcccagggtcggcg

SEQ ID NO: 7204390 - DNA, 22 bp, Homo sapiens
gtctgggctcctggcaggcagc

SEQ ID NO: 7204391 - DNA, 22 bp, Homo sapiens
gtctgggctcctggcaggcagc

SEQ ID NO: 7204392 - DNA, 22 bp, Homo sapiens
gtctgggctcctggcaggcagc

SEQ ID NO: 7204393 - DNA, 22 bp, Homo sapiens
gtctgggctcctggcaggcagc

SEQ ID NO: 7204394 - DNA, 22 bp, Homo sapiens
gtctgggcttagggacatggca

SEQ ID NO: 7204395 - DNA, 22 bp, Homo sapiens
gtctggctttatatttgctatt

SEQ ID NO: 7204396 - DNA, 22 bp, Homo sapiens
gtctggctttcatggctctgca

SEQ ID NO: 7204397 - DNA, 22 bp, Homo sapiens
gtctggctttgctcagatgctg

SEQ ID NO: 7204398 - DNA, 22 bp, Homo sapiens
gtctggcttttgccctgtgttt

SEQ ID NO: 7204399 - DNA, 22 bp, Homo sapiens
gtctgggacaggactggggaac

SEQ ID NO: 7204400 - DNA, 22 bp, Homo sapiens
gtctgggagtttggtgctgccg

SEQ ID NO: 7204401 - DNA, 22 bp, Homo sapiens
gtctgggcaagggagatggcgc

SEQ ID NO: 7204402 - DNA, 22 bp, Homo sapiens
gtctgggcaagggagatggcgc

SEQ ID NO: 7204403 - DNA, 22 bp, Homo sapiens
gtctgggcaagggagatggcgc

SEQ ID NO: 7204404 - DNA, 22 bp, Homo sapiens
gtctgggcaagggagatggcgc

SEQ ID NO: 7204405 - DNA, 22 bp, Homo sapiens
gtctgggcacctggcctgggaa

SEQ ID NO: 7204406 - DNA, 22 bp, Homo sapiens
gtctgggcacctggcctgggaa

SEQ ID NO: 7204407 - DNA, 22 bp, Homo sapiens
gtctgggcacctggcctgggaa

SEQ ID NO: 7204408 - DNA, 22 bp, Homo sapiens
gtctgggcacctggcctgggaa

SEQ ID NO: 7204409 - DNA, 22 bp, Homo sapiens
gtctgggcagcagcatttctta

SEQ ID NO: 7204410 - DNA, 22 bp, Homo sapiens
gtctgggcaggaatctgcattc

SEQ ID NO: 7204411 - DNA, 22 bp, Homo sapiens
gtctgggccaggcgagccgagg

SEQ ID NO: 7204412 - DNA, 22 bp, Homo sapiens
gtctggctctggaaggcaaagg

SEQ ID NO: 7204413 - DNA, 22 bp, Homo sapiens
gtctggctcctggattttccgg

SEQ ID NO: 7204414 - DNA, 22 bp, Homo sapiens
gtctggctccgaggagtggcag

SEQ ID NO: 7204415 - DNA, 22 bp, Homo sapiens
gtctggctccgaggagtggcag

SEQ ID NO: 7204416 - DNA, 22 bp, Homo sapiens
gtctggctcgctctcgcccgtc

SEQ ID NO: 7204417 - DNA, 22 bp, Homo sapiens
gtctggctgataaaatgctctt

SEQ ID NO: 7204418 - DNA, 22 bp, Homo sapiens
gtctggctgtccagcttatcta

SEQ ID NO: 7204419 - DNA, 22 bp, Homo sapiens
gtctggctgttcctgcctgtga

SEQ ID NO: 7204420 - DNA, 20 bp, Homo sapiens
gtctggcttcgtgattctgg

SEQ ID NO: 7204421 - DNA, 20 bp, Homo sapiens
gtctggcttcgtgattctgg

SEQ ID NO: 7204422 - DNA, 22 bp, Homo sapiens
gtctggcattcttcctggagaa

SEQ ID NO: 7204423 - DNA, 22 bp, Homo sapiens
gtctggcagatcgagcagccca

SEQ ID NO: 7204424 - DNA, 22 bp, Homo sapiens
gtctggcatatgcaaagtgcat

SEQ ID NO: 7204425 - DNA, 22 bp, Homo sapiens
gtctggctaattttggtaattt

SEQ ID NO: 7204426 - DNA, 22 bp, Homo sapiens
gtctggctagagacaccctccc

SEQ ID NO: 7204427 - DNA, 22 bp, Homo sapiens
gtctggctaggcacgccgtgtt

SEQ ID NO: 7204428 - DNA, 22 bp, Homo sapiens
gtctggctcagtcctagctgta

SEQ ID NO: 7204429 - DNA, 22 bp, Homo sapiens
gtctggctccaggatctcatga

SEQ ID NO: 7204430 - DNA, 22 bp, Homo sapiens
gtctggctcccactcttacaaa

SEQ ID NO: 7204431 - DNA, 22 bp, Homo sapiens
gtctgcagagggaaggcttcag

SEQ ID NO: 7204432 - DNA, 22 bp, Homo sapiens
gtctgcagcacatagattagaa

SEQ ID NO: 7204433 - DNA, 20 bp, Homo sapiens
gtctgcagtaagagggaata

SEQ ID NO: 7204434 - DNA, 22 bp, Homo sapiens
gtctggcacataagaggagctc

SEQ ID NO: 7204435 - DNA, 22 bp, Homo sapiens
gtctggagtggtggatttaaag

SEQ ID NO: 7204436 - DNA, 22 bp, Homo sapiens
gtctgagggttgtgctggagga

SEQ ID NO: 7204437 - DNA, 22 bp, Homo sapiens
gtctgagggttgtgctggagga

SEQ ID NO: 7204438 - DNA, 22 bp, Homo sapiens
gtctgagggttgtgctggagga

SEQ ID NO: 7204439 - DNA, 22 bp, Homo sapiens
gtctgaggtcattagctctctt

SEQ ID NO: 7204440 - DNA, 21 bp, Homo sapiens
gtctgatgcttgatgcagttg

SEQ ID NO: 7204441 - DNA, 22 bp, Homo sapiens
gtctgcacggggaggatgggct

SEQ ID NO: 7204442 - DNA, 22 bp, Homo sapiens
gtctgcagacaacttagaagca

SEQ ID NO: 7204443 - DNA, 22 bp, Homo sapiens
gtctgcactgtggagtactgtg

SEQ ID NO: 7204444 - DNA, 22 bp, Homo sapiens
gtctgaggggtttcccaggaca

SEQ ID NO: 7204445 - DNA, 22 bp, Homo sapiens
gtctgagggtcatgggtctcac

SEQ ID NO: 7204446 - DNA, 22 bp, Homo sapiens
gtctgaggggtttcccaggaca

SEQ ID NO: 7204447 - DNA, 22 bp, Homo sapiens
gtctgagggagaaggatctggg

SEQ ID NO: 7204448 - DNA, 22 bp, Homo sapiens
gtctgagggagaaggatctggg

SEQ ID NO: 7204449 - DNA, 22 bp, Homo sapiens
gtctgaggggtttcccaggaca

SEQ ID NO: 7204450 - DNA, 22 bp, Homo sapiens
gtctgaggcgaggcctgagaac

SEQ ID NO: 7204451 - DNA, 22 bp, Homo sapiens
gtctgaggcgaggcctgagaac

SEQ ID NO: 7204452 - DNA, 22 bp, Homo sapiens
gtctgagggacagagtcctggc

SEQ ID NO: 7204453 - DNA, 22 bp, Homo sapiens
gtctgagggacagagtcctggc

SEQ ID NO: 7204454 - DNA, 22 bp, Homo sapiens
gtctgagggacagagtcctggc

SEQ ID NO: 7204455 - DNA, 22 bp, Homo sapiens
gtctgagggacagagtcctggc

SEQ ID NO: 7204456 - DNA, 22 bp, Homo sapiens
gtctgagaggaggcagcctcgg

SEQ ID NO: 7204457 - DNA, 22 bp, Homo sapiens
gtctgagcgctggagcttgtgt

SEQ ID NO: 7204458 - DNA, 22 bp, Homo sapiens
gtctgagctacttaggatataa

SEQ ID NO: 7204459 - DNA, 22 bp, Homo sapiens
gtctgagctacttaggatataa

SEQ ID NO: 7204460 - DNA, 22 bp, Homo sapiens
gtctgagcccccgggaagctgg

SEQ ID NO: 7204461 - DNA, 22 bp, Homo sapiens
gtctgagcccccgggaagctgg

SEQ ID NO: 7204462 - DNA, 22 bp, Homo sapiens
gtctgaggaagatgcaggggga

SEQ ID NO: 7204463 - DNA, 22 bp, Homo sapiens
gtctgaggaagatgcaggggga

SEQ ID NO: 7204464 - DNA, 22 bp, Homo sapiens
gtctgaggaagatgcaggggga

SEQ ID NO: 7204465 - DNA, 20 bp, Homo sapiens
gtctgaggagcagtgggaaa

SEQ ID NO: 7204466 - DNA, 22 bp, Homo sapiens
gtctgaggcctgaggccctggg

SEQ ID NO: 7204467 - DNA, 22 bp, Homo sapiens
gtctgaggcctgaggccctggg

SEQ ID NO: 7204468 - DNA, 22 bp, Homo sapiens
gtctgaggcctgaggccctggg

SEQ ID NO: 7204469 - DNA, 22 bp, Homo sapiens
gtctcttttatggtgagttgat

SEQ ID NO: 7204470 - DNA, 19 bp, Homo sapiens
gtctctggatttcaggtcc

SEQ ID NO: 7204471 - DNA, 19 bp, Homo sapiens
gtctctgctccagggtctc

SEQ ID NO: 7204472 - DNA, 22 bp, Homo sapiens
gtctctgagctctgagctggct

SEQ ID NO: 7204473 - DNA, 22 bp, Homo sapiens
gtctgaatacgtacttgtgaag

SEQ ID NO: 7204474 - DNA, 22 bp, Homo sapiens
gtctgaatgatgagtgggactc

SEQ ID NO: 7204475 - DNA, 22 bp, Homo sapiens
gtctgacacctagagtccagga

SEQ ID NO: 7204476 - DNA, 22 bp, Homo sapiens
gtccttcatctggagcctggtc

SEQ ID NO: 7204477 - DNA, 22 bp, Homo sapiens
gtccttcatctggagcctggtc

SEQ ID NO: 7204478 - DNA, 22 bp, Homo sapiens
gtccttccacatggccaacttc

SEQ ID NO: 7204479 - DNA, 22 bp, Homo sapiens
gtccttccccagccagctctgg

SEQ ID NO: 7204480 - DNA, 22 bp, Homo sapiens
gtccttcctgcagggatggatg

SEQ ID NO: 7204481 - DNA, 22 bp, Homo sapiens
gtccttgagtaagtcatggtgg

SEQ ID NO: 7204482 - DNA, 22 bp, Homo sapiens
gtccttggaaagtctaatctct

SEQ ID NO: 7204483 - DNA, 22 bp, Homo sapiens
gtccttggagctcccctctgta

SEQ ID NO: 7204484 - DNA, 22 bp, Homo sapiens
gtccttggaggtgtggaatctg

SEQ ID NO: 7204485 - DNA, 22 bp, Homo sapiens
gtccttggcacccatgtgattc

SEQ ID NO: 7204486 - DNA, 22 bp, Homo sapiens
gtccttggctgggcttgcctcg

SEQ ID NO: 7204487 - DNA, 22 bp, Homo sapiens
gtcctttcttaaattcctgctt

SEQ ID NO: 7204488 - DNA, 22 bp, Homo sapiens
gtccttgtattccaagatacaa

SEQ ID NO: 7204489 - DNA, 22 bp, Homo sapiens
gtcctttgtctctgatccagga

SEQ ID NO: 7204490 - DNA, 22 bp, Homo sapiens
gtcgccatgacaacaccagccg

SEQ ID NO: 7204491 - DNA, 22 bp, Homo sapiens
gtcgctgaggagatgtgcaagg

SEQ ID NO: 7204492 - DNA, 22 bp, Homo sapiens
gtcggcagcgcggctgccaggg

SEQ ID NO: 7204493 - DNA, 19 bp, Homo sapiens
gttcaaacactgattcagc

SEQ ID NO: 7204494 - DNA, 22 bp, Homo sapiens
gttcaaaattcaaatggtatac

SEQ ID NO: 7204495 - DNA, 22 bp, Homo sapiens
gttattttcattggctcagact

SEQ ID NO: 7204496 - DNA, 22 bp, Homo sapiens
gttattttcattggctcagact

SEQ ID NO: 7204497 - DNA, 21 bp, Homo sapiens
gttattttaagtgagctttgc

SEQ ID NO: 7204498 - DNA, 22 bp, Homo sapiens
gttattttatctctgagaggtt

SEQ ID NO: 7204499 - DNA, 22 bp, Homo sapiens
gttattttatctctgagaggtt

SEQ ID NO: 7204500 - DNA, 22 bp, Homo sapiens
gttattttatctctgagaggtt

SEQ ID NO: 7204501 - DNA, 22 bp, Homo sapiens
gttattttatctctgagaggtt

SEQ ID NO: 7204502 - DNA, 22 bp, Homo sapiens
gttattttcattggctcagact

SEQ ID NO: 7204503 - DNA, 22 bp, Homo sapiens
gttattttcattggctcagact

SEQ ID NO: 7204504 - DNA, 22 bp, Homo sapiens
gttattttcattggctcagact

SEQ ID NO: 7204505 - DNA, 22 bp, Homo sapiens
gtgtgtcctcagtagtggcatg

SEQ ID NO: 7204506 - DNA, 22 bp, Homo sapiens
gttattttaacttctcagtaat

SEQ ID NO: 7204507 - DNA, 22 bp, Homo sapiens
gttattttaacttctcagtaat

SEQ ID NO: 7204508 - DNA, 21 bp, Homo sapiens
gttattttaagtgagctttgc

SEQ ID NO: 7204509 - DNA, 21 bp, Homo sapiens
gttattttaagtgagctttgc

SEQ ID NO: 7204510 - DNA, 22 bp, Homo sapiens
gtgtgtccaaggcacggatgac

SEQ ID NO: 7204511 - DNA, 22 bp, Homo sapiens
gtgtgtcaggtactgtgctagg

SEQ ID NO: 7204512 - DNA, 22 bp, Homo sapiens
gtgtgtccaaggccacaatagc

SEQ ID NO: 7204513 - DNA, 22 bp, Homo sapiens
gtgtgtccacacatacatacat

SEQ ID NO: 7204514 - DNA, 22 bp, Homo sapiens
gtgtgtccaggcgggagtcaag

SEQ ID NO: 7204515 - DNA, 23 bp, Homo sapiens
gtgtgtccattcgcactcttagg

SEQ ID NO: 7204516 - DNA, 22 bp, Homo sapiens
gtgtgtccctacaacagcttca

SEQ ID NO: 7204517 - DNA, 22 bp, Homo sapiens
gtgtgtccctcctctcctgagt

SEQ ID NO: 7204518 - DNA, 22 bp, Homo sapiens
gtgtgtccctacaacagcttca

SEQ ID NO: 7204519 - DNA, 22 bp, Homo sapiens
gtgtgtcccttggaacctcagc

SEQ ID NO: 7204520 - DNA, 22 bp, Homo sapiens
gtgtgtcctcagtagtggcatg

SEQ ID NO: 7204521 - DNA, 22 bp, Homo sapiens
gttcaaatggctgcagttacca

SEQ ID NO: 7204522 - DNA, 21 bp, Homo sapiens
gttcaaatcctgacactacac

SEQ ID NO: 7204523 - DNA, 21 bp, Homo sapiens
gttcaaatcctgacactacac

SEQ ID NO: 7204524 - DNA, 22 bp, Homo sapiens
gttcaaatctcaggacttcaga

SEQ ID NO: 7204525 - DNA, 21 bp, Homo sapiens
gttcaaatgggtagattcaca

SEQ ID NO: 7204526 - DNA, 22 bp, Homo sapiens
gttcaaattctatgaaatatgt

SEQ ID NO: 7204527 - DNA, 22 bp, Homo sapiens
gttcaaattgagatggtataaa

SEQ ID NO: 7204528 - DNA, 22 bp, Homo sapiens
gttcaaattgagatggtataaa

SEQ ID NO: 7204529 - DNA, 22 bp, Homo sapiens
gttcaaattttctaggtgggtg

SEQ ID NO: 7204530 - DNA, 22 bp, Homo sapiens
gttcaaattttggctgtactgc

SEQ ID NO: 7204531 - DNA, 22 bp, Homo sapiens
gttcaaattttggctgtactgc

SEQ ID NO: 7204532 - DNA, 22 bp, Homo sapiens
gttcaaccatgattaggaactg

SEQ ID NO: 7204533 - DNA, 22 bp, Homo sapiens
gttcaaccccttgatggtacag

SEQ ID NO: 7204534 - DNA, 22 bp, Homo sapiens
gttcaagaccagcctggccaac

SEQ ID NO: 7204535 - DNA, 22 bp, Homo sapiens
gttcaagaccagcctggccaac

SEQ ID NO: 7204536 - DNA, 22 bp, Homo sapiens
gttcaagaccagcctggccaac

SEQ ID NO: 7204537 - DNA, 22 bp, Homo sapiens
gttcaagaccagcctggccaac

SEQ ID NO: 7204538 - DNA, 22 bp, Homo sapiens
gttcaagaccagcctggccaac

SEQ ID NO: 7204539 - DNA, 22 bp, Homo sapiens
gttcaaggttttacagagtgta

SEQ ID NO: 7204540 - DNA, 18 bp, Homo sapiens
gttcaaggtcaagagaga

SEQ ID NO: 7204541 - DNA, 18 bp, Homo sapiens
gttcaagccaacatcaag

SEQ ID NO: 7204542 - DNA, 22 bp, Homo sapiens
gttcaaggaagggaggaaagcc

SEQ ID NO: 7204543 - DNA, 22 bp, Homo sapiens
gttcaagaccagcctggccaac

SEQ ID NO: 7204544 - DNA, 22 bp, Homo sapiens
gttctagcctggggctccttgg

SEQ ID NO: 7204545 - DNA, 22 bp, Homo sapiens
gttctacagttcctattactta

SEQ ID NO: 7204546 - DNA, 21 bp, Homo sapiens
gttctacagttttagaattcc

SEQ ID NO: 7204547 - DNA, 22 bp, Homo sapiens
gttctacatgacactcaacatt

SEQ ID NO: 7204548 - DNA, 22 bp, Homo sapiens
gttctacatgacactcaacatt

SEQ ID NO: 7204549 - DNA, 22 bp, Homo sapiens
gttgttcttctcatccagcttg

SEQ ID NO: 7204550 - DNA, 22 bp, Homo sapiens
gttgttcttctcatccagcttg

SEQ ID NO: 7204551 - DNA, 22 bp, Homo sapiens
gttgttgatcacatgcatatct

SEQ ID NO: 7204552 - DNA, 22 bp, Homo sapiens
gttgttgctatgttattgttat

SEQ ID NO: 7204553 - DNA, 22 bp, Homo sapiens
gttgttgatgaagatctgactg

SEQ ID NO: 7204554 - DNA, 22 bp, Homo sapiens
gttgtttataaaaatatctagc

SEQ ID NO: 7204555 - DNA, 22 bp, Homo sapiens
gttgttttaaaatactccagaa

SEQ ID NO: 7204556 - DNA, 22 bp, Homo sapiens
gttgttttaaaatactccagaa

SEQ ID NO: 7204557 - DNA, 22 bp, Homo sapiens
gttgttttataattgattgcaa

SEQ ID NO: 7204558 - DNA, 22 bp, Homo sapiens
gttgttttataggctcatgcct

SEQ ID NO: 7204559 - DNA, 22 bp, Homo sapiens
gttgttttataggctcatgcct

SEQ ID NO: 7204560 - DNA, 22 bp, Homo sapiens
gttgttttattgtgagtcccat

SEQ ID NO: 7204561 - DNA, 22 bp, Homo sapiens
gttgttttcacaaacccatgat

SEQ ID NO: 7204562 - DNA, 22 bp, Homo sapiens
gttgtgattgtagctaaactag

SEQ ID NO: 7204563 - DNA, 22 bp, Homo sapiens
gttgtgattgtagctaaactag

SEQ ID NO: 7204564 - DNA, 22 bp, Homo sapiens
gttctgcacatcacacaggtgc

SEQ ID NO: 7204565 - DNA, 22 bp, Homo sapiens
gttctgagtggcccaagccctg

SEQ ID NO: 7204566 - DNA, 22 bp, Homo sapiens
gttctgagtcctcctttgaagg

SEQ ID NO: 7204567 - DNA, 22 bp, Homo sapiens
gttctgagtcctcctttgaagg

SEQ ID NO: 7204568 - DNA, 22 bp, Homo sapiens
gttgtatagagggcatgaatct

SEQ ID NO: 7204569 - DNA, 22 bp, Homo sapiens
gttgtataaggaatgttgttta

SEQ ID NO: 7204570 - DNA, 22 bp, Homo sapiens
gttgtacatatgaggataagtt

SEQ ID NO: 7204571 - DNA, 22 bp, Homo sapiens
gttgtacatgttggggtacctt

SEQ ID NO: 7204572 - DNA, 22 bp, Homo sapiens
gttgtcaggtaaaacagtatgg

SEQ ID NO: 7204573 - DNA, 22 bp, Homo sapiens
gttgtatatgtagagaatggtc

SEQ ID NO: 7204574 - DNA, 22 bp, Homo sapiens
gttgtattcttcaatatcagag

SEQ ID NO: 7204575 - DNA, 22 bp, Homo sapiens
gttctctctgcttccaagatgg

SEQ ID NO: 7204576 - DNA, 22 bp, Homo sapiens
gttctgagtcctcctttgaagg

SEQ ID NO: 7204577 - DNA, 22 bp, Homo sapiens
gttctgagtcctcctttgaagg

SEQ ID NO: 7204578 - DNA, 22 bp, Homo sapiens
gttctctgccggcacctacccg

SEQ ID NO: 7204579 - DNA, 22 bp, Homo sapiens
gttctccttgtggctgcagcag

SEQ ID NO: 7204580 - DNA, 22 bp, Homo sapiens
gttctccttgtggctgcagcag

SEQ ID NO: 7204581 - DNA, 22 bp, Homo sapiens
gttctcctcttgtcccaggctg

SEQ ID NO: 7204582 - DNA, 22 bp, Homo sapiens
gttctcctcttgtcccaggctg

SEQ ID NO: 7204583 - DNA, 22 bp, Homo sapiens
gttctcctggctcccaccctgc

SEQ ID NO: 7204584 - DNA, 22 bp, Homo sapiens
gttctccattcagcttcctgtg

SEQ ID NO: 7204585 - DNA, 22 bp, Homo sapiens
gttctccattcagcttcctgtg

SEQ ID NO: 7204586 - DNA, 22 bp, Homo sapiens
gttctcctcttagctgtgccac

SEQ ID NO: 7204587 - DNA, 22 bp, Homo sapiens
gttctcctcttagctgtgccac

SEQ ID NO: 7204588 - DNA, 22 bp, Homo sapiens
gttctcagtggggagcagggtt

SEQ ID NO: 7204589 - DNA, 22 bp, Homo sapiens
gttctcagttcaggaaggacat

SEQ ID NO: 7204590 - DNA, 22 bp, Homo sapiens
gtgtcagctaatttgggagctc

SEQ ID NO: 7204591 - DNA, 22 bp, Homo sapiens
gtgtcagaaacaggaaggggaa

SEQ ID NO: 7204592 - DNA, 22 bp, Homo sapiens
gtgtcaggagaattagggcttt

SEQ ID NO: 7204593 - DNA, 22 bp, Homo sapiens
gtgtcaggagaattagggcttt

SEQ ID NO: 7204594 - DNA, 22 bp, Homo sapiens
gtgtcaggagccttccatgggc

SEQ ID NO: 7204595 - DNA, 19 bp, Homo sapiens
gtgtcaggatgtgcagggg

SEQ ID NO: 7204596 - DNA, 19 bp, Homo sapiens
gtgtcaggatgtgcagggg

SEQ ID NO: 7204597 - DNA, 22 bp, Homo sapiens
gtgtcaggcagtcagcatggag

SEQ ID NO: 7204598 - DNA, 22 bp, Homo sapiens
gtgtcaggccctgcattatgtg

SEQ ID NO: 7204599 - DNA, 22 bp, Homo sapiens
gtgtcaggggcagccaggaaat

SEQ ID NO: 7204600 - DNA, 20 bp, Homo sapiens
gtgtcagtaaatattatgtg

SEQ ID NO: 7204601 - DNA, 22 bp, Homo sapiens
gtgtcatggggtttgttataca

SEQ ID NO: 7204602 - DNA, 22 bp, Homo sapiens
gtgtcatgcacactcagtgttg

SEQ ID NO: 7204603 - DNA, 22 bp, Homo sapiens
gtgtcatgcacactcagtgttg

SEQ ID NO: 7204604 - DNA, 22 bp, Homo sapiens
gtgtccacggctgagaatgatt

SEQ ID NO: 7204605 - DNA, 22 bp, Homo sapiens
gtgtccacggctgagaatgatt

SEQ ID NO: 7204606 - DNA, 22 bp, Homo sapiens
gtgtccactccatgcccatcct

SEQ ID NO: 7204607 - DNA, 22 bp, Homo sapiens
gtgtccactcgtggtctgtcag

SEQ ID NO: 7204608 - DNA, 22 bp, Homo sapiens
gtgtccagagaaactcacagct

SEQ ID NO: 7204609 - DNA, 22 bp, Homo sapiens
gtgtccagttttttctctgctg

SEQ ID NO: 7204610 - DNA, 22 bp, Homo sapiens
gtgtccagttttttctctgctg

SEQ ID NO: 7204611 - DNA, 22 bp, Homo sapiens
gtgtccagggggtatcccagct

SEQ ID NO: 7204612 - DNA, 22 bp, Homo sapiens
gtgtccagtcatagcccagggc

SEQ ID NO: 7204613 - DNA, 22 bp, Homo sapiens
gtgtccagagaaactcacagct

SEQ ID NO: 7204614 - DNA, 22 bp, Homo sapiens
gtgtgagccatgatgtgtccag

SEQ ID NO: 7204615 - DNA, 22 bp, Homo sapiens
gtgtgagccatgatgtgtccag

SEQ ID NO: 7204616 - DNA, 22 bp, Homo sapiens
gtgtctgagtttggaaagtcca

SEQ ID NO: 7204617 - DNA, 22 bp, Homo sapiens
gtgtccttttatgtgactggtt

SEQ ID NO: 7204618 - DNA, 22 bp, Homo sapiens
gtgtccttttgagggtccacag

SEQ ID NO: 7204619 - DNA, 22 bp, Homo sapiens
gtgtcgtgcttgccatgggtac

SEQ ID NO: 7204620 - DNA, 22 bp, Homo sapiens
gtgtcgtgcttgccatgggtac

SEQ ID NO: 7204621 - DNA, 22 bp, Homo sapiens
gtgtccttttgagggtccacag

SEQ ID NO: 7204622 - DNA, 22 bp, Homo sapiens
gtgtctataatgaaatgcactt

SEQ ID NO: 7204623 - DNA, 22 bp, Homo sapiens
gtgtctctaggacctggtacta

SEQ ID NO: 7204624 - DNA, 22 bp, Homo sapiens
gtgtctctatctatgcctgaag

SEQ ID NO: 7204625 - DNA, 22 bp, Homo sapiens
gtgtctctatctatgcctgaag

SEQ ID NO: 7204626 - DNA, 22 bp, Homo sapiens
gtgtcctgtttccctgtctata

SEQ ID NO: 7204627 - DNA, 22 bp, Homo sapiens
gtgtcctggttccttgtggctg

SEQ ID NO: 7204628 - DNA, 22 bp, Homo sapiens
gtgtcctgttcagaagcttggg

SEQ ID NO: 7204629 - DNA, 22 bp, Homo sapiens
gtgtcctgggggacttcaggtt

SEQ ID NO: 7204630 - DNA, 22 bp, Homo sapiens
gtgtcctgggtctctgattctt

SEQ ID NO: 7204631 - DNA, 22 bp, Homo sapiens
gtgtcctgggtctctgattctt

SEQ ID NO: 7204632 - DNA, 22 bp, Homo sapiens
gtgtccttaagtcggttctcct

SEQ ID NO: 7204633 - DNA, 22 bp, Homo sapiens
gtgtccttatgcataccagagt

SEQ ID NO: 7204634 - DNA, 22 bp, Homo sapiens
gtgtccttatgcataccagagt

SEQ ID NO: 7204635 - DNA, 22 bp, Homo sapiens
gtgtccttatttctgtctctca

SEQ ID NO: 7204636 - DNA, 22 bp, Homo sapiens
gtgtccttatttctgtctctca

SEQ ID NO: 7204637 - DNA, 22 bp, Homo sapiens
gtgtccttcattggaatctctc

SEQ ID NO: 7204638 - DNA, 22 bp, Homo sapiens
gtgtccttgcagtttgaagaaa

SEQ ID NO: 7204639 - DNA, 22 bp, Homo sapiens
gtgtccttcattggaatctctc

SEQ ID NO: 7204640 - DNA, 18 bp, Homo sapiens
gtgtcctttgcaagaaac

SEQ ID NO: 7204641 - DNA, 22 bp, Homo sapiens
gtgtccttttatgtgactggtt

SEQ ID NO: 7204642 - DNA, 22 bp, Homo sapiens
gtgtcctcttattgctcttggc

SEQ ID NO: 7204643 - DNA, 22 bp, Homo sapiens
gtgtcccaggagaggagacaat

SEQ ID NO: 7204644 - DNA, 22 bp, Homo sapiens
gtgtcctgatcaattgagctgg

SEQ ID NO: 7204645 - DNA, 22 bp, Homo sapiens
gtgtcctgcaggccaggaatgg

SEQ ID NO: 7204646 - DNA, 22 bp, Homo sapiens
gtgtcctgcaggccaggaatgg

SEQ ID NO: 7204647 - DNA, 22 bp, Homo sapiens
gtgtcctgcaggccaggaatgg

SEQ ID NO: 7204648 - DNA, 22 bp, Homo sapiens
gtgtcctgcaggccaggaatgg

SEQ ID NO: 7204649 - DNA, 22 bp, Homo sapiens
gtgtcctgcaggccaggaatgg

SEQ ID NO: 7204650 - DNA, 22 bp, Homo sapiens
gtgtcctgcattggctctgccc

SEQ ID NO: 7204651 - DNA, 22 bp, Homo sapiens
gtgtcctgcattggctctgccc

SEQ ID NO: 7204652 - DNA, 22 bp, Homo sapiens
gtgtcctgccaccctgggcttt

SEQ ID NO: 7204653 - DNA, 18 bp, Homo sapiens
gtgtcctggctgcggcgc

SEQ ID NO: 7204654 - DNA, 22 bp, Homo sapiens
gtgtcctgggcattaggcttag

SEQ ID NO: 7204655 - DNA, 22 bp, Homo sapiens
gtgtcctgggctggtagagctg

SEQ ID NO: 7204656 - DNA, 22 bp, Homo sapiens
gtgtgcagaacagggagtgggt

SEQ ID NO: 7204657 - DNA, 22 bp, Homo sapiens
gtgtgcagaacagggagtgggt

SEQ ID NO: 7204658 - DNA, 22 bp, Homo sapiens
gtgtgcacagagctccagtgtt

SEQ ID NO: 7204659 - DNA, 22 bp, Homo sapiens
gtgtgcacagtatactagggtt

SEQ ID NO: 7204660 - DNA, 22 bp, Homo sapiens
gtgtgcacagtatactagggtt

SEQ ID NO: 7204661 - DNA, 22 bp, Homo sapiens
gtgtgagtgaaagtagtttgat

SEQ ID NO: 7204662 - DNA, 22 bp, Homo sapiens
gtgtgagtgaaagtagtttgat

SEQ ID NO: 7204663 - DNA, 21 bp, Homo sapiens
gtgtgagtagcatgtgtctca

SEQ ID NO: 7204664 - DNA, 21 bp, Homo sapiens
gtgtgagtagcatgtgtctca

SEQ ID NO: 7204665 - DNA, 21 bp, Homo sapiens
gtgtgagtagcatgtgtctca

SEQ ID NO: 7204666 - DNA, 21 bp, Homo sapiens
gtgtgagtagcatgtgtctca

SEQ ID NO: 7204667 - DNA, 22 bp, Homo sapiens
gtgtgagtgaaagtagtttgat

SEQ ID NO: 7204668 - DNA, 21 bp, Homo sapiens
gtgtgagtagcatgtgtctca

SEQ ID NO: 7204669 - DNA, 22 bp, Homo sapiens
gtgtgcagaggcaggaggtgct

SEQ ID NO: 7204670 - DNA, 22 bp, Homo sapiens
gtgtgcagaggcaggaggtgct

SEQ ID NO: 7204671 - DNA, 22 bp, Homo sapiens
gtgtgcagaagacacaagacat

SEQ ID NO: 7204672 - DNA, 22 bp, Homo sapiens
gtgtgcagaagacacaagacat

SEQ ID NO: 7204673 - DNA, 22 bp, Homo sapiens
gtgtgcagaacagggagtgggt

SEQ ID NO: 7204674 - DNA, 22 bp, Homo sapiens
gtgtgcagaacagggagtgggt

SEQ ID NO: 7204675 - DNA, 22 bp, Homo sapiens
gtgtgcagcagagacaggactc

SEQ ID NO: 7204676 - DNA, 22 bp, Homo sapiens
gtgtgcagcagagacaggactc

SEQ ID NO: 7204677 - DNA, 22 bp, Homo sapiens
gtgtgcagcagagacaggactc

SEQ ID NO: 7204678 - DNA, 22 bp, Homo sapiens
gtgtgcagaggcaggaggtgct

SEQ ID NO: 7204679 - DNA, 22 bp, Homo sapiens
gtgtgcagatgtgatgctgggc

SEQ ID NO: 7204680 - DNA, 22 bp, Homo sapiens
gtgtgcagatgtgatgctgggc

SEQ ID NO: 7204681 - DNA, 22 bp, Homo sapiens
gtgtgcagggatgagtgcaggt

SEQ ID NO: 7204682 - DNA, 22 bp, Homo sapiens
gtgtgcagggatgagtgcaggt

SEQ ID NO: 7204683 - DNA, 22 bp, Homo sapiens
gtgtgcagggctgcctgtgccg

SEQ ID NO: 7204684 - DNA, 22 bp, Homo sapiens
gtgtgcagggatgagtgcaggt

SEQ ID NO: 7204685 - DNA, 22 bp, Homo sapiens
gtgtgcagggctgcctgtgccg

SEQ ID NO: 7204686 - DNA, 22 bp, Homo sapiens
gtgtgcaggccacaggccaggg

SEQ ID NO: 7204687 - DNA, 22 bp, Homo sapiens
gtgtgcaggccacaggccaggg

SEQ ID NO: 7204688 - DNA, 22 bp, Homo sapiens
gtgtgcaggcttgaggattagg

SEQ ID NO: 7204689 - DNA, 22 bp, Homo sapiens
gtgtgcagggggccagcgcagc

SEQ ID NO: 7204690 - DNA, 22 bp, Homo sapiens
gtgtgcaggggcttggtggagc

SEQ ID NO: 7204691 - DNA, 22 bp, Homo sapiens
gtgtgcagggggccagcgcagc

SEQ ID NO: 7204692 - DNA, 22 bp, Homo sapiens
gtgtgcagggggccagcgcagc

SEQ ID NO: 7204693 - DNA, 22 bp, Homo sapiens
gtgtgcaggtgtcagtgcagct

SEQ ID NO: 7204694 - DNA, 22 bp, Homo sapiens
gtgtgcaggtgtcagtgcagct

SEQ ID NO: 7204695 - DNA, 22 bp, Homo sapiens
gtgtgcagggggccagcgcagc

SEQ ID NO: 7204696 - DNA, 22 bp, Homo sapiens
gtgtgcaggtgtcagtgcagct

SEQ ID NO: 7204697 - DNA, 22 bp, Homo sapiens
gtgtggggagctgcagccacat

SEQ ID NO: 7204698 - DNA, 22 bp, Homo sapiens
gtgtgggctgcagaggcacagc

SEQ ID NO: 7204699 - DNA, 22 bp, Homo sapiens
gtgtgggctgcagaggcacagc

SEQ ID NO: 7204700 - DNA, 22 bp, Homo sapiens
gtgtggggagctgcagccacat

SEQ ID NO: 7204701 - DNA, 22 bp, Homo sapiens
gtgtggggagctgcagccacat

SEQ ID NO: 7204702 - DNA, 22 bp, Homo sapiens
gtgtggggaggagagagccctt

SEQ ID NO: 7204703 - DNA, 22 bp, Homo sapiens
gtgtggggaggagagagccctt

SEQ ID NO: 7204704 - DNA, 22 bp, Homo sapiens
gtgtggggaggagagagccctt

SEQ ID NO: 7204705 - DNA, 22 bp, Homo sapiens
gtgtggggccaggatcagggct

SEQ ID NO: 7204706 - DNA, 22 bp, Homo sapiens
gtgtggggccaggatcagggct

SEQ ID NO: 7204707 - DNA, 22 bp, Homo sapiens
gtgtggggccaggatcagggct

SEQ ID NO: 7204708 - DNA, 22 bp, Homo sapiens
gtgtggggccaggatcagggct

SEQ ID NO: 7204709 - DNA, 22 bp, Homo sapiens
gtgtggggccaggatcagggct

SEQ ID NO: 7204710 - DNA, 22 bp, Homo sapiens
gtgtggggctcagtgggaatgt

SEQ ID NO: 7204711 - DNA, 22 bp, Homo sapiens
gtgtgggctgcagaggcacagc

SEQ ID NO: 7204712 - DNA, 18 bp, Homo sapiens
gtgtgggctcctccgagt

SEQ ID NO: 7204713 - DNA, 22 bp, Homo sapiens
gtgtgggctatgtgcgtgggca

SEQ ID NO: 7204714 - DNA, 22 bp, Homo sapiens
gtgtgggcagggccgtgctccc

SEQ ID NO: 7204715 - DNA, 22 bp, Homo sapiens
gtgtgggcagggccgtgctccc

SEQ ID NO: 7204716 - DNA, 22 bp, Homo sapiens
gtgtgggcagggccgtgctccc

SEQ ID NO: 7204717 - DNA, 22 bp, Homo sapiens
gtgtgggctatgtgcgtgggca

SEQ ID NO: 7204718 - DNA, 22 bp, Homo sapiens
gtgtgggctatgtgcgtgggca

SEQ ID NO: 7204719 - DNA, 22 bp, Homo sapiens
gtgtgcagtctgctaggcaggg

SEQ ID NO: 7204720 - DNA, 22 bp, Homo sapiens
gtgtgcagtctgctaggcaggg

SEQ ID NO: 7204721 - DNA, 22 bp, Homo sapiens
gtgtgggacgggtgagtggcca

SEQ ID NO: 7204722 - DNA, 22 bp, Homo sapiens
gtgtgggaggaaggtgaacaga

SEQ ID NO: 7204723 - DNA, 22 bp, Homo sapiens
gtgtggggctcagtgggaatgt

SEQ ID NO: 7204724 - DNA, 22 bp, Homo sapiens
gtgtggggctcagtgggaatgt

SEQ ID NO: 7204725 - DNA, 22 bp, Homo sapiens
gtgtgggggcagctctgatatg

SEQ ID NO: 7204726 - DNA, 22 bp, Homo sapiens
gtgtgggggcagctctgatatg

SEQ ID NO: 7204727 - DNA, 22 bp, Homo sapiens
gtgtgggggcagctctgatatg

SEQ ID NO: 7204728 - DNA, 22 bp, Homo sapiens
gtgtggggtcttctcttggcct

SEQ ID NO: 7204729 - DNA, 22 bp, Homo sapiens
gtgtggggtcttctcttggcct

SEQ ID NO: 7204730 - DNA, 22 bp, Homo sapiens
gtgtggggtcttctcttggcct

SEQ ID NO: 7204731 - DNA, 22 bp, Homo sapiens
gtgtggggtcttctcttggcct

SEQ ID NO: 7204732 - DNA, 22 bp, Homo sapiens
gtgtggtggccctccttcaggc

SEQ ID NO: 7204733 - DNA, 22 bp, Homo sapiens
gtgtggtgaggccccttaggct

SEQ ID NO: 7204734 - DNA, 22 bp, Homo sapiens
gtgtgtacaaatttcatgtaaa

SEQ ID NO: 7204735 - DNA, 22 bp, Homo sapiens
gtgtgtacatatttttaatggg

SEQ ID NO: 7204736 - DNA, 22 bp, Homo sapiens
gtgtgtatgtagaactatgtat

SEQ ID NO: 7204737 - DNA, 22 bp, Homo sapiens
gtgtgtatgtagaactatgtat

SEQ ID NO: 7204738 - DNA, 22 bp, Homo sapiens
gtgtgtcagagctcagagaagt

SEQ ID NO: 7204739 - DNA, 22 bp, Homo sapiens
gtgtgtcaggtactgtgctagg

SEQ ID NO: 7204740 - DNA, 22 bp, Homo sapiens
gtgtgtcaggtactgtgctagg

SEQ ID NO: 7204741 - DNA, 22 bp, Homo sapiens
gtgggggtggaaaggcaagttg

SEQ ID NO: 7204742 - DNA, 22 bp, Homo sapiens
gtgggggtggaaaggcaagttg

SEQ ID NO: 7204743 - DNA, 22 bp, Homo sapiens
gtgggggtggaaaggcaagttg

SEQ ID NO: 7204744 - DNA, 22 bp, Homo sapiens
gtggggtagatctttctcagga

SEQ ID NO: 7204745 - DNA, 22 bp, Homo sapiens
gtggggtagatctttctcagga

SEQ ID NO: 7204746 - DNA, 22 bp, Homo sapiens
gtgggggtttcattaagacaat

SEQ ID NO: 7204747 - DNA, 22 bp, Homo sapiens
gtgggggtttcattaagacaat

SEQ ID NO: 7204748 - DNA, 22 bp, Homo sapiens
gtggggtagatctttctcagga

SEQ ID NO: 7204749 - DNA, 22 bp, Homo sapiens
gtggggtagatctttctcagga

SEQ ID NO: 7204750 - DNA, 22 bp, Homo sapiens
gtggggtagatctttctcagga

SEQ ID NO: 7204751 - DNA, 22 bp, Homo sapiens
gtggggtagatctttctcagga

SEQ ID NO: 7204752 - DNA, 22 bp, Homo sapiens
gtggggtagatctttctcagga

SEQ ID NO: 7204753 - DNA, 22 bp, Homo sapiens
gtggggggagctgcaagctgga

SEQ ID NO: 7204754 - DNA, 22 bp, Homo sapiens
gtggggggagctgcaagctgga

SEQ ID NO: 7204755 - DNA, 22 bp, Homo sapiens
gtggggggagctgcaagctgga

SEQ ID NO: 7204756 - DNA, 22 bp, Homo sapiens
gtggggggagctgcaagctgga

SEQ ID NO: 7204757 - DNA, 22 bp, Homo sapiens
gtggggggagctgcaagctgga

SEQ ID NO: 7204758 - DNA, 22 bp, Homo sapiens
gtgggggctggctcgtcctgtg

SEQ ID NO: 7204759 - DNA, 22 bp, Homo sapiens
gtgggggctggctcgtcctgtg

SEQ ID NO: 7204760 - DNA, 22 bp, Homo sapiens
gtggggggacgttggtcacttt

SEQ ID NO: 7204761 - DNA, 22 bp, Homo sapiens
gtggggggacgttggtcacttt

SEQ ID NO: 7204762 - DNA, 22 bp, Homo sapiens
gtggggggacgttggtcacttt

SEQ ID NO: 7204763 - DNA, 22 bp, Homo sapiens
gtggggtgtccagcagcgagct

SEQ ID NO: 7204764 - DNA, 22 bp, Homo sapiens
gtggggtgggctgagttaggcc

SEQ ID NO: 7204765 - DNA, 22 bp, Homo sapiens
gtggggtgggctgagttaggcc

SEQ ID NO: 7204766 - DNA, 22 bp, Homo sapiens
gtggggtgggctgagttaggcc

SEQ ID NO: 7204767 - DNA, 22 bp, Homo sapiens
gtggggtgggctgagttaggcc

SEQ ID NO: 7204768 - DNA, 22 bp, Homo sapiens
gtggggtgggctgagttaggcc

SEQ ID NO: 7204769 - DNA, 18 bp, Homo sapiens
gtggggtgttgtgaggat

SEQ ID NO: 7204770 - DNA, 18 bp, Homo sapiens
gtggggtgttgtgaggat

SEQ ID NO: 7204771 - DNA, 22 bp, Homo sapiens
gtggggtgtccagcagcgagct

SEQ ID NO: 7204772 - DNA, 18 bp, Homo sapiens
gtggggtgttgtgaggat

SEQ ID NO: 7204773 - DNA, 18 bp, Homo sapiens
gtggggtgttgtgaggat

SEQ ID NO: 7204774 - DNA, 18 bp, Homo sapiens
gtggggtgttgtgaggat

SEQ ID NO: 7204775 - DNA, 22 bp, Homo sapiens
gtggggtgtccagcagcgagct

SEQ ID NO: 7204776 - DNA, 22 bp, Homo sapiens
gtggggtgtccagcagcgagct

SEQ ID NO: 7204777 - DNA, 22 bp, Homo sapiens
gtggggtgtccagcagcgagct

SEQ ID NO: 7204778 - DNA, 22 bp, Homo sapiens
gtggggtgtccagcagcgagct

SEQ ID NO: 7204779 - DNA, 22 bp, Homo sapiens
gtgggtgcggggagccgaggcg

SEQ ID NO: 7204780 - DNA, 22 bp, Homo sapiens
gtgggtgcggggagccgaggcg

SEQ ID NO: 7204781 - DNA, 22 bp, Homo sapiens
gtgggtgctgtcaggcagggaa

SEQ ID NO: 7204782 - DNA, 22 bp, Homo sapiens
gtgggtgctgtcaggcagggaa

SEQ ID NO: 7204783 - DNA, 18 bp, Homo sapiens
gtggggtgttgtgaggat

SEQ ID NO: 7204784 - DNA, 18 bp, Homo sapiens
gtggggtgttgtgaggat

SEQ ID NO: 7204785 - DNA, 22 bp, Homo sapiens
gtgggtaattggagggctgcct

SEQ ID NO: 7204786 - DNA, 22 bp, Homo sapiens
gtgggtcagcaagccaggagta

SEQ ID NO: 7204787 - DNA, 22 bp, Homo sapiens
gtgggtgatgtactggaggcca

SEQ ID NO: 7204788 - DNA, 22 bp, Homo sapiens
gtgggtgatgtactggaggcca

SEQ ID NO: 7204789 - DNA, 22 bp, Homo sapiens
gtgggtggacggtgcttttgtt

SEQ ID NO: 7204790 - DNA, 22 bp, Homo sapiens
gtgggtggacggtgcttttgtt

SEQ ID NO: 7204791 - DNA, 22 bp, Homo sapiens
gtgggtggagactgggtgcaag

SEQ ID NO: 7204792 - DNA, 22 bp, Homo sapiens
gtgggtggagactgggtgcaag

SEQ ID NO: 7204793 - DNA, 22 bp, Homo sapiens
gtgggtggagactgggtgcaag

SEQ ID NO: 7204794 - DNA, 22 bp, Homo sapiens
gtgggtggagactgggtgcaag

SEQ ID NO: 7204795 - DNA, 22 bp, Homo sapiens
gtgggtggagactgggtgcaag

SEQ ID NO: 7204796 - DNA, 22 bp, Homo sapiens
gtgggtggagactgggtgcaag

SEQ ID NO: 7204797 - DNA, 22 bp, Homo sapiens
gtgggtggagactgggtgcaag

SEQ ID NO: 7204798 - DNA, 22 bp, Homo sapiens
gtgggtggagactgggtgcaag

SEQ ID NO: 7204799 - DNA, 22 bp, Homo sapiens
gtgggtggaggcgtcgagggca

SEQ ID NO: 7204800 - DNA, 22 bp, Homo sapiens
gtgggtggaggcgtcgagggca

SEQ ID NO: 7204801 - DNA, 22 bp, Homo sapiens
gtgggtggaggcgtcgagggca

SEQ ID NO: 7204802 - DNA, 22 bp, Homo sapiens
gtgggtggaggcgtcgagggca

SEQ ID NO: 7204803 - DNA, 22 bp, Homo sapiens
gtggtcatcacggaaggaagat

SEQ ID NO: 7204804 - DNA, 22 bp, Homo sapiens
gtggtcatcacggaaggaagat

SEQ ID NO: 7204805 - DNA, 22 bp, Homo sapiens
gtggtcatcaactgagaatggt

SEQ ID NO: 7204806 - DNA, 22 bp, Homo sapiens
gtggtcatcaactgagaatggt

SEQ ID NO: 7204807 - DNA, 22 bp, Homo sapiens
gtggtcagtggtacagtttgaa

SEQ ID NO: 7204808 - DNA, 22 bp, Homo sapiens
gtggtcagtggtacagtttgaa

SEQ ID NO: 7204809 - DNA, 22 bp, Homo sapiens
gtggtcaggggctgtggctatg

SEQ ID NO: 7204810 - DNA, 22 bp, Homo sapiens
gtggtcaggttatcagatcata

SEQ ID NO: 7204811 - DNA, 22 bp, Homo sapiens
gtggtcagcagcagtgggagtg

SEQ ID NO: 7204812 - DNA, 22 bp, Homo sapiens
gtggtcagccccggtgagccct

SEQ ID NO: 7204813 - DNA, 22 bp, Homo sapiens
gtggtcaggcagtgggagagaa

SEQ ID NO: 7204814 - DNA, 22 bp, Homo sapiens
gtggtcaggcagtgggagagaa

SEQ ID NO: 7204815 - DNA, 22 bp, Homo sapiens
gtggtcaggcagtgggagagaa

SEQ ID NO: 7204816 - DNA, 22 bp, Homo sapiens
gtggtcagggagcagagccatg

SEQ ID NO: 7204817 - DNA, 22 bp, Homo sapiens
gtggtcaggggctgaggtgccc

SEQ ID NO: 7204818 - DNA, 22 bp, Homo sapiens
gtgggtggaggcgtcgagggca

SEQ ID NO: 7204819 - DNA, 22 bp, Homo sapiens
gtggtatctgtctcccccactg

SEQ ID NO: 7204820 - DNA, 22 bp, Homo sapiens
gtggtcaaagcatcagagacct

SEQ ID NO: 7204821 - DNA, 20 bp, Homo sapiens
gtggtcacacctgagtgggt

SEQ ID NO: 7204822 - DNA, 22 bp, Homo sapiens
gtggtcaccatgaatgtgggtt

SEQ ID NO: 7204823 - DNA, 22 bp, Homo sapiens
gtggtcagaaatctcagtggca

SEQ ID NO: 7204824 - DNA, 22 bp, Homo sapiens
gtggtcagaaatctcagtggca

SEQ ID NO: 7204825 - DNA, 22 bp, Homo sapiens
gtggtcagaatggagcccagga

SEQ ID NO: 7204826 - DNA, 22 bp, Homo sapiens
gtggtcagaatggagcccagga

SEQ ID NO: 7204827 - DNA, 22 bp, Homo sapiens
gtggtcagagatgacagtgggt

SEQ ID NO: 7204828 - DNA, 22 bp, Homo sapiens
gtggtcagagatgacagtgggt

SEQ ID NO: 7204829 - DNA, 22 bp, Homo sapiens
gtggtcagcagcagtgggagtg

SEQ ID NO: 7204830 - DNA, 22 bp, Homo sapiens
gtggtcctgccagccaggtcca

SEQ ID NO: 7204831 - DNA, 22 bp, Homo sapiens
gtggtccccagagctgtgtaca

SEQ ID NO: 7204832 - DNA, 22 bp, Homo sapiens
gtggtcatggaaggtcctacct

SEQ ID NO: 7204833 - DNA, 22 bp, Homo sapiens
gtggtccatcatgcagagctcc

SEQ ID NO: 7204834 - DNA, 22 bp, Homo sapiens
gtggtccatcatgcagagctcc

SEQ ID NO: 7204835 - DNA, 22 bp, Homo sapiens
gtggtcatttgtctgagctcca

SEQ ID NO: 7204836 - DNA, 22 bp, Homo sapiens
gtggtcatttgtctgagctcca

SEQ ID NO: 7204837 - DNA, 22 bp, Homo sapiens
gtggtcatgttaattatgatcc

SEQ ID NO: 7204838 - DNA, 22 bp, Homo sapiens
gtggtcattgcttgaaagatca

SEQ ID NO: 7204839 - DNA, 22 bp, Homo sapiens
gtggtcattgcttgaaagatca

SEQ ID NO: 7204840 - DNA, 22 bp, Homo sapiens
gtggtcatcattagtattatta

SEQ ID NO: 7204841 - DNA, 22 bp, Homo sapiens
gtggtcatctaactaaattttc

SEQ ID NO: 7204842 - DNA, 22 bp, Homo sapiens
gtggtcatctgggtttgtggca

SEQ ID NO: 7204843 - DNA, 22 bp, Homo sapiens
gtggtctggggtcaggcctgag

SEQ ID NO: 7204844 - DNA, 22 bp, Homo sapiens
gtggtctggggtcaggcctgag

SEQ ID NO: 7204845 - DNA, 22 bp, Homo sapiens
gtggtctggggtcaggcctgag

SEQ ID NO: 7204846 - DNA, 22 bp, Homo sapiens
gtggtcctggcaaccatggtga

SEQ ID NO: 7204847 - DNA, 22 bp, Homo sapiens
gtggtgaagccccatctctgct

SEQ ID NO: 7204848 - DNA, 22 bp, Homo sapiens
gtggtgaagccccatctctgct

SEQ ID NO: 7204849 - DNA, 22 bp, Homo sapiens
gtggtgagagtaggtgtcctct

SEQ ID NO: 7204850 - DNA, 21 bp, Homo sapiens
gtggttctagagaaacagaat

SEQ ID NO: 7204851 - DNA, 21 bp, Homo sapiens
gtggttctagagaaacagaat

SEQ ID NO: 7204852 - DNA, 22 bp, Homo sapiens
gtggtttaggggaaagaactgt

SEQ ID NO: 7204853 - DNA, 22 bp, Homo sapiens
gtggtgtgtgcttagggctagg

SEQ ID NO: 7204854 - DNA, 22 bp, Homo sapiens
gtggtgttcccacgcctgctag

SEQ ID NO: 7204855 - DNA, 22 bp, Homo sapiens
gtggtgtttgccagttaataac

SEQ ID NO: 7204856 - DNA, 22 bp, Homo sapiens
gtggtgtttttggggcagagga

SEQ ID NO: 7204857 - DNA, 22 bp, Homo sapiens
gtggtgtttttggggcagagga

SEQ ID NO: 7204858 - DNA, 22 bp, Homo sapiens
gtggttcacttgaggtcaggag

SEQ ID NO: 7204859 - DNA, 22 bp, Homo sapiens
gtggttccgaatatttatttct

SEQ ID NO: 7204860 - DNA, 22 bp, Homo sapiens
gtggtgcaggaagcatctggct

SEQ ID NO: 7204861 - DNA, 22 bp, Homo sapiens
gtggtgcaggccagcaggggcg

SEQ ID NO: 7204862 - DNA, 22 bp, Homo sapiens
gtggtgagttcaggctggggtg

SEQ ID NO: 7204863 - DNA, 22 bp, Homo sapiens
gtggtgcaggaagcatctggct

SEQ ID NO: 7204864 - DNA, 22 bp, Homo sapiens
gtggtgcaggaagcatctggct

SEQ ID NO: 7204865 - DNA, 22 bp, Homo sapiens
gtggtgtaggtcacagttagga

SEQ ID NO: 7204866 - DNA, 22 bp, Homo sapiens
gtggtgtaggtcacagttagga

SEQ ID NO: 7204867 - DNA, 22 bp, Homo sapiens
gtggtgcaggtgtcactgcaga

SEQ ID NO: 7204868 - DNA, 22 bp, Homo sapiens
gtggtgcatgcatgcatatgta

SEQ ID NO: 7204869 - DNA, 22 bp, Homo sapiens
gtgtaaaaacatactatttcta

SEQ ID NO: 7204870 - DNA, 18 bp, Homo sapiens
gtgtaaacagccattgag

SEQ ID NO: 7204871 - DNA, 21 bp, Homo sapiens
gtgtaaacggactcatgcagt

SEQ ID NO: 7204872 - DNA, 22 bp, Homo sapiens
gtgtaaagatgccaggaatctt

SEQ ID NO: 7204873 - DNA, 22 bp, Homo sapiens
gtgtaaaggaatccaggtggtc

SEQ ID NO: 7204874 - DNA, 22 bp, Homo sapiens
gtgtaacttttattcatgctct

SEQ ID NO: 7204875 - DNA, 22 bp, Homo sapiens
gtgtaaggccccaggttcttta

SEQ ID NO: 7204876 - DNA, 22 bp, Homo sapiens
gtgtaaggtgaaatcaacaaat

SEQ ID NO: 7204877 - DNA, 22 bp, Homo sapiens
gtgtcacaggcccagctcttca

SEQ ID NO: 7204878 - DNA, 22 bp, Homo sapiens
gtgtcaatgaggtttatttttg

SEQ ID NO: 7204879 - DNA, 22 bp, Homo sapiens
gtgtcaatgaggtttatttttg

SEQ ID NO: 7204880 - DNA, 22 bp, Homo sapiens
gtgtcacaagagcccaggaaac

SEQ ID NO: 7204881 - DNA, 22 bp, Homo sapiens
gtgtcacaggcccagctcttca

SEQ ID NO: 7204882 - DNA, 22 bp, Homo sapiens
gtgtcacatggtttactgcagc

SEQ ID NO: 7204883 - DNA, 22 bp, Homo sapiens
gtgtcacatggtttactgcagc

SEQ ID NO: 7204884 - DNA, 22 bp, Homo sapiens
gtgtacagatatctcacgttct

SEQ ID NO: 7204885 - DNA, 22 bp, Homo sapiens
gtgtacagatatctcacgttct

SEQ ID NO: 7204886 - DNA, 22 bp, Homo sapiens
gtgtacaggatgactgtactta

SEQ ID NO: 7204887 - DNA, 22 bp, Homo sapiens
gtgtaatgttgtcagcatcatc

SEQ ID NO: 7204888 - DNA, 22 bp, Homo sapiens
gtgtaattagtagtaaattcaa

SEQ ID NO: 7204889 - DNA, 22 bp, Homo sapiens
gtgtaattatataaagatctac

SEQ ID NO: 7204890 - DNA, 22 bp, Homo sapiens
gtgtaattgaaattgagaacca

SEQ ID NO: 7204891 - DNA, 22 bp, Homo sapiens
gtgtaatttctaggtaatttga

SEQ ID NO: 7204892 - DNA, 22 bp, Homo sapiens
gtgtaattttgtggtcctgtac

SEQ ID NO: 7204893 - DNA, 22 bp, Homo sapiens
gtgtacacatacacatattgaa

SEQ ID NO: 7204894 - DNA, 22 bp, Homo sapiens
gtgtacacatcattcacatata

SEQ ID NO: 7204895 - DNA, 22 bp, Homo sapiens
gtgggcttcccttaagccagag

SEQ ID NO: 7204896 - DNA, 22 bp, Homo sapiens
gtgggctgttgttccctgttct

SEQ ID NO: 7204897 - DNA, 22 bp, Homo sapiens
gtgggctgttgttccctgttct

SEQ ID NO: 7204898 - DNA, 22 bp, Homo sapiens
gtgggctggaccctcctgctcc

SEQ ID NO: 7204899 - DNA, 22 bp, Homo sapiens
gtgggctggagcaatgatttca

SEQ ID NO: 7204900 - DNA, 22 bp, Homo sapiens
gtgggctggatttgcttgcaga

SEQ ID NO: 7204901 - DNA, 22 bp, Homo sapiens
gtgggctggatttgcttgcaga

SEQ ID NO: 7204902 - DNA, 22 bp, Homo sapiens
gtgggctggatttgcttgcaga

SEQ ID NO: 7204903 - DNA, 22 bp, Homo sapiens
gtgggctggatttgcttgcaga

SEQ ID NO: 7204904 - DNA, 22 bp, Homo sapiens
gtgggctggatttgcttgcaga

SEQ ID NO: 7204905 - DNA, 22 bp, Homo sapiens
gtgggctggatttgcttgcaga

SEQ ID NO: 7204906 - DNA, 22 bp, Homo sapiens
gtgggctgcccttgaggtcagc

SEQ ID NO: 7204907 - DNA, 22 bp, Homo sapiens
gtgggctgcccttgaggtcagc

SEQ ID NO: 7204908 - DNA, 22 bp, Homo sapiens
gtgggctgcccttgaggtcagc

SEQ ID NO: 7204909 - DNA, 22 bp, Homo sapiens
gtgggctgcccttgaggtcagc

SEQ ID NO: 7204910 - DNA, 22 bp, Homo sapiens
gtgggctgcccttgaggtcagc

SEQ ID NO: 7204911 - DNA, 22 bp, Homo sapiens
gtgggctgcccttgaggtcagc

SEQ ID NO: 7204912 - DNA, 22 bp, Homo sapiens
gtgggctgcttcctccttccac

SEQ ID NO: 7204913 - DNA, 22 bp, Homo sapiens
gtgggctgcttcctccttccac

SEQ ID NO: 7204914 - DNA, 22 bp, Homo sapiens
gtgggctgcttcctccttccac

SEQ ID NO: 7204915 - DNA, 22 bp, Homo sapiens
gtgggctgcttcctccttccac

SEQ ID NO: 7204916 - DNA, 22 bp, Homo sapiens
gtgggctggaccctcctgctcc

SEQ ID NO: 7204917 - DNA, 22 bp, Homo sapiens
gtgggctgcttcctccttccac

SEQ ID NO: 7204918 - DNA, 22 bp, Homo sapiens
gtgggctggaccctcctgctcc

SEQ ID NO: 7204919 - DNA, 22 bp, Homo sapiens
gtgggctggaccctcctgctcc

SEQ ID NO: 7204920 - DNA, 22 bp, Homo sapiens
gtgggctgcccttgaggtcagc

SEQ ID NO: 7204921 - DNA, 22 bp, Homo sapiens
gtgggctgcccttgaggtcagc

SEQ ID NO: 7204922 - DNA, 22 bp, Homo sapiens
gtgggctgcccttgaggtcagc

SEQ ID NO: 7204923 - DNA, 22 bp, Homo sapiens
gtgggctgaggggacaccaagg

SEQ ID NO: 7204924 - DNA, 22 bp, Homo sapiens
gtgggctgcatgtttactattc

SEQ ID NO: 7204925 - DNA, 22 bp, Homo sapiens
gtgggctcccctggcatgtcca

SEQ ID NO: 7204926 - DNA, 22 bp, Homo sapiens
gtgggctcccctggcatgtcca

SEQ ID NO: 7204927 - DNA, 22 bp, Homo sapiens
gtgggctgaggggacaccaagg

SEQ ID NO: 7204928 - DNA, 22 bp, Homo sapiens
gtgggctgaggggacaccaagg

SEQ ID NO: 7204929 - DNA, 22 bp, Homo sapiens
gtgggccttgcagggtgcaggg

SEQ ID NO: 7204930 - DNA, 22 bp, Homo sapiens
gtgggccttgcagggtgcaggg

SEQ ID NO: 7204931 - DNA, 22 bp, Homo sapiens
gtgggcgatcatctcagccgtc

SEQ ID NO: 7204932 - DNA, 22 bp, Homo sapiens
gtgggctcaggcctctgtgggg

SEQ ID NO: 7204933 - DNA, 22 bp, Homo sapiens
gtgggctcccctggcatgtcca

SEQ ID NO: 7204934 - DNA, 22 bp, Homo sapiens
gtgggccaggcgtctaggccct

SEQ ID NO: 7204935 - DNA, 22 bp, Homo sapiens
gtgggccagttcctcacaggta

SEQ ID NO: 7204936 - DNA, 22 bp, Homo sapiens
gtgggccttgcagggtgcaggg

SEQ ID NO: 7204937 - DNA, 22 bp, Homo sapiens
gtgggccttgcagggtgcaggg

SEQ ID NO: 7204938 - DNA, 22 bp, Homo sapiens
gtgggcctgatgctgccatgag

SEQ ID NO: 7204939 - DNA, 22 bp, Homo sapiens
gtgggcctgatgctgccatgag

SEQ ID NO: 7204940 - DNA, 22 bp, Homo sapiens
gtgggggatgctgagttggaaa

SEQ ID NO: 7204941 - DNA, 22 bp, Homo sapiens
gtgggggatgctgagttggaaa

SEQ ID NO: 7204942 - DNA, 22 bp, Homo sapiens
gtgggggacccaggtgctgtcc

SEQ ID NO: 7204943 - DNA, 22 bp, Homo sapiens
gtgggggatgctgagttggaaa

SEQ ID NO: 7204944 - DNA, 22 bp, Homo sapiens
gtgggggatgctgagttggaaa

SEQ ID NO: 7204945 - DNA, 22 bp, Homo sapiens
gtgggggatgctgagttggaaa

SEQ ID NO: 7204946 - DNA, 22 bp, Homo sapiens
gtggggcttcctggggcaagtt

SEQ ID NO: 7204947 - DNA, 22 bp, Homo sapiens
gtgggggacccaggtgctgtcc

SEQ ID NO: 7204948 - DNA, 22 bp, Homo sapiens
gtggggcttcctggggcaagtt

SEQ ID NO: 7204949 - DNA, 22 bp, Homo sapiens
gtggggcttcctggggcaagtt

SEQ ID NO: 7204950 - DNA, 22 bp, Homo sapiens
gtggggcttcctggggcaagtt

SEQ ID NO: 7204951 - DNA, 22 bp, Homo sapiens
gtgggggctggaaatcttgcca

SEQ ID NO: 7204952 - DNA, 22 bp, Homo sapiens
gtgggggatgctgagttggaaa

SEQ ID NO: 7204953 - DNA, 22 bp, Homo sapiens
gtgggggcaggcagtgctagga

SEQ ID NO: 7204954 - DNA, 22 bp, Homo sapiens
gtgggggcaggcagtgctagga

SEQ ID NO: 7204955 - DNA, 22 bp, Homo sapiens
gtgggggcaggcagtgctagga

SEQ ID NO: 7204956 - DNA, 22 bp, Homo sapiens
gtggggaggcctaagcaagttg

SEQ ID NO: 7204957 - DNA, 22 bp, Homo sapiens
gtggggaggcctaagcaagttg

SEQ ID NO: 7204958 - DNA, 22 bp, Homo sapiens
gtggggaggcctaagcaagttg

SEQ ID NO: 7204959 - DNA, 22 bp, Homo sapiens
gtggggaggcattcttctccct

SEQ ID NO: 7204960 - DNA, 22 bp, Homo sapiens
gtggggaggcattcttctccct

SEQ ID NO: 7204961 - DNA, 22 bp, Homo sapiens
gtggggaggcattcttctccct

SEQ ID NO: 7204962 - DNA, 22 bp, Homo sapiens
gtggggaggcattcttctccct

SEQ ID NO: 7204963 - DNA, 22 bp, Homo sapiens
gtggggcttcctggggcaagtt

SEQ ID NO: 7204964 - DNA, 22 bp, Homo sapiens
gtggggctggaagatgggtact

SEQ ID NO: 7204965 - DNA, 22 bp, Homo sapiens
gtggggctggaagatgggtact

SEQ ID NO: 7204966 - DNA, 22 bp, Homo sapiens
gtggggaggcctaagcaagttg

SEQ ID NO: 7204967 - DNA, 22 bp, Homo sapiens
gtggggaggcctaagcaagttg

SEQ ID NO: 7204968 - DNA, 22 bp, Homo sapiens
gtggggaggcctaagcaagttg

SEQ ID NO: 7204969 - DNA, 22 bp, Homo sapiens
gtgggcttttgacagtgcctgg

SEQ ID NO: 7204970 - DNA, 22 bp, Homo sapiens
gtggggaaaggagtggggctca

SEQ ID NO: 7204971 - DNA, 22 bp, Homo sapiens
gtggggaaaggagtggggctca

SEQ ID NO: 7204972 - DNA, 22 bp, Homo sapiens
gtggggaaaggagtggggctca

SEQ ID NO: 7204973 - DNA, 22 bp, Homo sapiens
gtggggaaaggagtggggctca

SEQ ID NO: 7204974 - DNA, 22 bp, Homo sapiens
gtggggaaaggagtggggctca

SEQ ID NO: 7204975 - DNA, 22 bp, Homo sapiens
gtggggacgggatggctcactg

SEQ ID NO: 7204976 - DNA, 22 bp, Homo sapiens
gtggggagcagccttagcccct

SEQ ID NO: 7204977 - DNA, 22 bp, Homo sapiens
gtggggagcagccttagcccct

SEQ ID NO: 7204978 - DNA, 22 bp, Homo sapiens
gtggggagcagccttagcccct

SEQ ID NO: 7204979 - DNA, 22 bp, Homo sapiens
gtggggagcagccttagcccct

SEQ ID NO: 7204980 - DNA, 22 bp, Homo sapiens
gtggggaggcattcttctccct

SEQ ID NO: 7204981 - DNA, 22 bp, Homo sapiens
gtgggcagacagtgctttgcag

SEQ ID NO: 7204982 - DNA, 22 bp, Homo sapiens
gtgggcagaattgaatctttaa

SEQ ID NO: 7204983 - DNA, 22 bp, Homo sapiens
gtgggcagaacatttgtaggct

SEQ ID NO: 7204984 - DNA, 22 bp, Homo sapiens
gtgggcagaacatttgtaggct

SEQ ID NO: 7204985 - DNA, 22 bp, Homo sapiens
gtgggcaaggtccctgccagct

SEQ ID NO: 7204986 - DNA, 22 bp, Homo sapiens
gtgggcagaacatttgtaggct

SEQ ID NO: 7204987 - DNA, 22 bp, Homo sapiens
gtgggcagaacatttgtaggct

SEQ ID NO: 7204988 - DNA, 22 bp, Homo sapiens
gtgggcagaacatttgtaggct

SEQ ID NO: 7204989 - DNA, 22 bp, Homo sapiens
gtgggcagacagtgctttgcag

SEQ ID NO: 7204990 - DNA, 22 bp, Homo sapiens
gtgggcagacatgatagaagga

SEQ ID NO: 7204991 - DNA, 22 bp, Homo sapiens
gtgggcagacatgatagaagga

SEQ ID NO: 7204992 - DNA, 22 bp, Homo sapiens
gtgggcagaggagagaacatta

SEQ ID NO: 7204993 - DNA, 20 bp, Homo sapiens
gtgggcagagcaccacctgg

SEQ ID NO: 7204994 - DNA, 20 bp, Homo sapiens
gtgggcagagcaccacctgg

SEQ ID NO: 7204995 - DNA, 20 bp, Homo sapiens
gtgggcagagcaccacctgg

SEQ ID NO: 7204996 - DNA, 22 bp, Homo sapiens
gtgggcagagcaagggaactca

SEQ ID NO: 7204997 - DNA, 20 bp, Homo sapiens
gtgggcagagcaccacctgg

SEQ ID NO: 7204998 - DNA, 20 bp, Homo sapiens
gtgggcagagcaccacctgg

SEQ ID NO: 7204999 - DNA, 22 bp, Homo sapiens
gtgggcagagcaagggaactca

SEQ ID NO: 7205000 - DNA, 22 bp, Homo sapiens
gtgggcagacatgatagaagga

SEQ ID NO: 7205001 - DNA, 22 bp, Homo sapiens
gtgggcagagcaagggaactca

SEQ ID NO: 7205002 - DNA, 22 bp, Homo sapiens
gtgggcagattatagatgatgc

SEQ ID NO: 7205003 - DNA, 22 bp, Homo sapiens
gtgggcagattaatttctcaat

SEQ ID NO: 7205004 - DNA, 20 bp, Homo sapiens
gtgggcagatgtgtgcatgg

SEQ ID NO: 7205005 - DNA, 22 bp, Homo sapiens
gtgggcagattaatttctcaat

SEQ ID NO: 7205006 - DNA, 22 bp, Homo sapiens
gtgggcagattatagatgatgc

SEQ ID NO: 7205007 - DNA, 22 bp, Homo sapiens
gtgggcagattaatttctcaat

SEQ ID NO: 7205008 - DNA, 22 bp, Homo sapiens
gtgggcagattatagatgatgc

SEQ ID NO: 7205009 - DNA, 22 bp, Homo sapiens
gtgggcagaggagagaacatta

SEQ ID NO: 7205010 - DNA, 22 bp, Homo sapiens
gtgggcagaggagagaacatta

SEQ ID NO: 7205011 - DNA, 22 bp, Homo sapiens
gtgggcagatacatttgatatg

SEQ ID NO: 7205012 - DNA, 22 bp, Homo sapiens
gtgggcagatacatttgatatg

SEQ ID NO: 7205013 - DNA, 20 bp, Homo sapiens
gtgggcagatgtgtgcatgg

SEQ ID NO: 7205014 - DNA, 20 bp, Homo sapiens
gtgggcagatgtgtgcatgg

SEQ ID NO: 7205015 - DNA, 20 bp, Homo sapiens
gtgggcagatgtgtgcatgg

SEQ ID NO: 7205016 - DNA, 20 bp, Homo sapiens
gtgggcagcaggcatactgg

SEQ ID NO: 7205017 - DNA, 20 bp, Homo sapiens
gtgggcagcaggcatactgg

SEQ ID NO: 7205018 - DNA, 22 bp, Homo sapiens
gtgggcagcaccagggaagtgt

SEQ ID NO: 7205019 - DNA, 22 bp, Homo sapiens
gtgggcagcaccagggaagtgt

SEQ ID NO: 7205020 - DNA, 22 bp, Homo sapiens
gtgggcagcaccagggaagtgt

SEQ ID NO: 7205021 - DNA, 22 bp, Homo sapiens
gtgggcagattatagatgatgc

SEQ ID NO: 7205022 - DNA, 22 bp, Homo sapiens
gtgggcagcaccagggaagtgt

SEQ ID NO: 7205023 - DNA, 22 bp, Homo sapiens
gtgggcagcaccagggaagtgt

SEQ ID NO: 7205024 - DNA, 22 bp, Homo sapiens
gtgggcagcaccagggaagtgt

SEQ ID NO: 7205025 - DNA, 22 bp, Homo sapiens
gtgggcagcaccagggaagtgt

SEQ ID NO: 7205026 - DNA, 20 bp, Homo sapiens
gtgggcagcaggcatactgg

SEQ ID NO: 7205027 - DNA, 20 bp, Homo sapiens
gtgggcagcaggcatactgg

SEQ ID NO: 7205028 - DNA, 22 bp, Homo sapiens
gtgggcagccccttcaaggcca

SEQ ID NO: 7205029 - DNA, 22 bp, Homo sapiens
gtgggcagccccttcaaggcca

SEQ ID NO: 7205030 - DNA, 22 bp, Homo sapiens
gtgggcagcctcctttattttc

SEQ ID NO: 7205031 - DNA, 22 bp, Homo sapiens
gtgggcagcctgtccggagacc

SEQ ID NO: 7205032 - DNA, 22 bp, Homo sapiens
gtgggcagcctgtccggagacc

SEQ ID NO: 7205033 - DNA, 22 bp, Homo sapiens
gtgggcagccccttcaaggcca

SEQ ID NO: 7205034 - DNA, 22 bp, Homo sapiens
gtgggcagccccttcaaggcca

SEQ ID NO: 7205035 - DNA, 22 bp, Homo sapiens
gtgggcagccccttcaaggcca

SEQ ID NO: 7205036 - DNA, 22 bp, Homo sapiens
gtgggcaggaggccctgccctg

SEQ ID NO: 7205037 - DNA, 22 bp, Homo sapiens
gtgggcagcctgtccggagacc

SEQ ID NO: 7205038 - DNA, 22 bp, Homo sapiens
gtgggcaggaggccctgccctg

SEQ ID NO: 7205039 - DNA, 22 bp, Homo sapiens
gtgggcagcctgtccggagacc

SEQ ID NO: 7205040 - DNA, 22 bp, Homo sapiens
gtgggcagtgtgtcagtatctt

SEQ ID NO: 7205041 - DNA, 22 bp, Homo sapiens
gtgggcagtgtgtcagtatctt

SEQ ID NO: 7205042 - DNA, 22 bp, Homo sapiens
gtgggcagttcaattctgggag

SEQ ID NO: 7205043 - DNA, 22 bp, Homo sapiens
gtgggcagttcaattctgggag

SEQ ID NO: 7205044 - DNA, 22 bp, Homo sapiens
gtgggcagttcaattctgggag

SEQ ID NO: 7205045 - DNA, 22 bp, Homo sapiens
gtgggcagttcaattctgggag

SEQ ID NO: 7205046 - DNA, 22 bp, Homo sapiens
gtgggcagtgtgtcagtatctt

SEQ ID NO: 7205047 - DNA, 22 bp, Homo sapiens
gtgggcagtggtttgcgcggtc

SEQ ID NO: 7205048 - DNA, 22 bp, Homo sapiens
gtgggcagtggtttgcgcggtc

SEQ ID NO: 7205049 - DNA, 22 bp, Homo sapiens
gtgggcagtggtttgcgcggtc

SEQ ID NO: 7205050 - DNA, 22 bp, Homo sapiens
gtgggcagtggtttgcgcggtc

SEQ ID NO: 7205051 - DNA, 22 bp, Homo sapiens
gtgggcagtggtttgcgcggtc

SEQ ID NO: 7205052 - DNA, 22 bp, Homo sapiens
gtgggcagtggtttgcgcggtc

SEQ ID NO: 7205053 - DNA, 22 bp, Homo sapiens
gtgggcaggaggccctgccctg

SEQ ID NO: 7205054 - DNA, 22 bp, Homo sapiens
gtgggcagtggtttgcgcggtc

SEQ ID NO: 7205055 - DNA, 22 bp, Homo sapiens
gtgggcagttcaattctgggag

SEQ ID NO: 7205056 - DNA, 22 bp, Homo sapiens
gtgggcagttggtgattctcgt

SEQ ID NO: 7205057 - DNA, 22 bp, Homo sapiens
gtgggccacatcccagggctct

SEQ ID NO: 7205058 - DNA, 22 bp, Homo sapiens
gtgggccacatcccagggctct

SEQ ID NO: 7205059 - DNA, 22 bp, Homo sapiens
gtgggccactgggaggcaaggg

SEQ ID NO: 7205060 - DNA, 22 bp, Homo sapiens
gtgggccacatcccagggctct

SEQ ID NO: 7205061 - DNA, 22 bp, Homo sapiens
gtgggccacatcccagggctct

SEQ ID NO: 7205062 - DNA, 22 bp, Homo sapiens
gtgggccactgggaggcaaggg

SEQ ID NO: 7205063 - DNA, 22 bp, Homo sapiens
gtgggccaggccggagtgcaga

SEQ ID NO: 7205064 - DNA, 22 bp, Homo sapiens
gtgggccaggccggagtgcaga

SEQ ID NO: 7205065 - DNA, 19 bp, Homo sapiens
gtgggccaggcagaaggct

SEQ ID NO: 7205066 - DNA, 22 bp, Homo sapiens
gtgggccaggccggagtgcaga

SEQ ID NO: 7205067 - DNA, 22 bp, Homo sapiens
gtgggccaggccggagtgcaga

SEQ ID NO: 7205068 - DNA, 22 bp, Homo sapiens
gtgggccaggcgtctaggccct

SEQ ID NO: 7205069 - DNA, 22 bp, Homo sapiens
gtgggccaggcgtctaggccct

SEQ ID NO: 7205070 - DNA, 22 bp, Homo sapiens
gtgggccactgggaggcaaggg

SEQ ID NO: 7205071 - DNA, 22 bp, Homo sapiens
gtgggccagcttttctcctggg

SEQ ID NO: 7205072 - DNA, 22 bp, Homo sapiens
gtgggccaggacccgctgtccg

SEQ ID NO: 7205073 - DNA, 19 bp, Homo sapiens
gtgggccaggcagaaggct

SEQ ID NO: 7205074 - DNA, 19 bp, Homo sapiens
gtgggccaggcagaaggct

SEQ ID NO: 7205075 - DNA, 22 bp, Homo sapiens
gtttttctttgtgtgaagacaa

SEQ ID NO: 7205076 - DNA, 22 bp, Homo sapiens
gtttttctttgtgtgaagacaa

SEQ ID NO: 7205077 - DNA, 22 bp, Homo sapiens
gtttttctttgtgtgaagacaa

SEQ ID NO: 7205078 - DNA, 22 bp, Homo sapiens
gtttttctttgtgtgaagacaa

SEQ ID NO: 7205079 - DNA, 22 bp, Homo sapiens
gtttttctttgtgtgaagacaa

SEQ ID NO: 7205080 - DNA, 22 bp, Homo sapiens
gtttttgtccatggaggcaaac

SEQ ID NO: 7205081 - DNA, 22 bp, Homo sapiens
gtttttgtcgagttccttgacc

SEQ ID NO: 7205082 - DNA, 22 bp, Homo sapiens
gttttttcatgagtagttatct

SEQ ID NO: 7205083 - DNA, 22 bp, Homo sapiens
gttttttcatgagtagttatct

SEQ ID NO: 7205084 - DNA, 22 bp, Homo sapiens
gttttttcatgagtagttatct

SEQ ID NO: 7205085 - DNA, 22 bp, Homo sapiens
gttttttcatgagtagttatct

SEQ ID NO: 7205086 - DNA, 22 bp, Homo sapiens
gttttttcatgagtagttatct

SEQ ID NO: 7205087 - DNA, 22 bp, Homo sapiens
gttttttcatgagtagttatct

SEQ ID NO: 7205088 - DNA, 22 bp, Homo sapiens
gttttttgggtgtatatcttct

SEQ ID NO: 7205089 - DNA, 22 bp, Homo sapiens
taaaaaacattactctgtcctg

SEQ ID NO: 7205090 - DNA, 22 bp, Homo sapiens
taaaacacataaactctctatt

SEQ ID NO: 7205091 - DNA, 22 bp, Homo sapiens
taaaacacataaactctctatt

SEQ ID NO: 7205092 - DNA, 22 bp, Homo sapiens
taaaacacctgtagtgtctgcc

SEQ ID NO: 7205093 - DNA, 22 bp, Homo sapiens
taaaacacctgtagtgtctgcc

SEQ ID NO: 7205094 - DNA, 22 bp, Homo sapiens
taaaacactcagcacctagcaa

SEQ ID NO: 7205095 - DNA, 22 bp, Homo sapiens
taaaacacctgtagtgtctgcc

SEQ ID NO: 7205096 - DNA, 22 bp, Homo sapiens
taaaacactcagcacctagcaa

SEQ ID NO: 7205097 - DNA, 20 bp, Homo sapiens
gtttttctctcttgccacta

SEQ ID NO: 7205098 - DNA, 22 bp, Homo sapiens
gtttttctaggaccatgtgatt

SEQ ID NO: 7205099 - DNA, 22 bp, Homo sapiens
gtttttctaggaccatgtgatt

SEQ ID NO: 7205100 - DNA, 22 bp, Homo sapiens
gtttttctaggaccatgtgatt

SEQ ID NO: 7205101 - DNA, 22 bp, Homo sapiens
gtttttctaggaccatgtgatt

SEQ ID NO: 7205102 - DNA, 22 bp, Homo sapiens
gtttttctagaaatctcctcct

SEQ ID NO: 7205103 - DNA, 22 bp, Homo sapiens
gtttttctagactgggagtttg

SEQ ID NO: 7205104 - DNA, 22 bp, Homo sapiens
gtttttctagactgggagtttg

SEQ ID NO: 7205105 - DNA, 22 bp, Homo sapiens
gtttttctagactgggagtttg

SEQ ID NO: 7205106 - DNA, 22 bp, Homo sapiens
gtttttctaggaccatgtgatt

SEQ ID NO: 7205107 - DNA, 20 bp, Homo sapiens
gtttttctctcttgccacta

SEQ ID NO: 7205108 - DNA, 20 bp, Homo sapiens
gtttttctctcttgccacta

SEQ ID NO: 7205109 - DNA, 20 bp, Homo sapiens
gtttttctctcttgccacta

SEQ ID NO: 7205110 - DNA, 22 bp, Homo sapiens
gtttttctctgaaatagttgac

SEQ ID NO: 7205111 - DNA, 22 bp, Homo sapiens
gtttttctctgaaatagttgac

SEQ ID NO: 7205112 - DNA, 22 bp, Homo sapiens
gtttttctctgaaatagttgac

SEQ ID NO: 7205113 - DNA, 22 bp, Homo sapiens
gtttttctctgaaatagttgac

SEQ ID NO: 7205114 - DNA, 22 bp, Homo sapiens
gtttttctgtgagcggtaaagg

SEQ ID NO: 7205115 - DNA, 22 bp, Homo sapiens
gtttttctgtgagcggtaaagg

SEQ ID NO: 7205116 - DNA, 20 bp, Homo sapiens
gtttttcttgggcgagctat

SEQ ID NO: 7205117 - DNA, 20 bp, Homo sapiens
gtttttcttgggcgagctat

SEQ ID NO: 7205118 - DNA, 20 bp, Homo sapiens
gtttttcttgggcgagctat

SEQ ID NO: 7205119 - DNA, 22 bp, Homo sapiens
gtttaaccattgcatatccata

SEQ ID NO: 7205120 - DNA, 22 bp, Homo sapiens
gtttaagaaaattcatgttgtt

SEQ ID NO: 7205121 - DNA, 22 bp, Homo sapiens
gtttaaccaagagcattgtgca

SEQ ID NO: 7205122 - DNA, 22 bp, Homo sapiens
gtttaagaaaattcatgttgtt

SEQ ID NO: 7205123 - DNA, 22 bp, Homo sapiens
gtttaagtttcagaagctaaga

SEQ ID NO: 7205124 - DNA, 22 bp, Homo sapiens
gtttaataatgttgaattacta

SEQ ID NO: 7205125 - DNA, 22 bp, Homo sapiens
gtttaataatgttgaattacta

SEQ ID NO: 7205126 - DNA, 22 bp, Homo sapiens
gtttaataatgttgaattacta

SEQ ID NO: 7205127 - DNA, 22 bp, Homo sapiens
gtttaatcagaggaattataga

SEQ ID NO: 7205128 - DNA, 22 bp, Homo sapiens
gtttaattcccacacctgccct

SEQ ID NO: 7205129 - DNA, 21 bp, Homo sapiens
gtttttcagccctgaggtgag

SEQ ID NO: 7205130 - DNA, 22 bp, Homo sapiens
gtttttcctgctgacttgggtc

SEQ ID NO: 7205131 - DNA, 22 bp, Homo sapiens
gtttttctaagtagcgatattt

SEQ ID NO: 7205132 - DNA, 22 bp, Homo sapiens
gtttttctaagtagcgatattt

SEQ ID NO: 7205133 - DNA, 22 bp, Homo sapiens
gtttttctagaaatctcctcct

SEQ ID NO: 7205134 - DNA, 22 bp, Homo sapiens
gtttttctagaaatctcctcct

SEQ ID NO: 7205135 - DNA, 22 bp, Homo sapiens
gtttttctagaaatctcctcct

SEQ ID NO: 7205136 - DNA, 22 bp, Homo sapiens
gtttaaataattaggggcctgt

SEQ ID NO: 7205137 - DNA, 22 bp, Homo sapiens
gtttaaagtcttggaaggagga

SEQ ID NO: 7205138 - DNA, 22 bp, Homo sapiens
gtttaaagtcttggaaggagga

SEQ ID NO: 7205139 - DNA, 22 bp, Homo sapiens
gtttaaagtagcttccttttgg

SEQ ID NO: 7205140 - DNA, 22 bp, Homo sapiens
gttgtttttgttctctatagct

SEQ ID NO: 7205141 - DNA, 22 bp, Homo sapiens
gttgtttttgttctctatagct

SEQ ID NO: 7205142 - DNA, 22 bp, Homo sapiens
gttgtttttgttctctatagct

SEQ ID NO: 7205143 - DNA, 22 bp, Homo sapiens
gttgttttgcaggatccttaca

SEQ ID NO: 7205144 - DNA, 22 bp, Homo sapiens
gttgttttgctgtctgtcttag

SEQ ID NO: 7205145 - DNA, 22 bp, Homo sapiens
gttgttttgcaggatccttaca

SEQ ID NO: 7205146 - DNA, 22 bp, Homo sapiens
gttgttttgctgtctgtcttag

SEQ ID NO: 7205147 - DNA, 22 bp, Homo sapiens
gttgttttcagcagtttatgac

SEQ ID NO: 7205148 - DNA, 22 bp, Homo sapiens
gttgttttcagcagtttatgac

SEQ ID NO: 7205149 - DNA, 22 bp, Homo sapiens
gttgttttcagcagtttatgac

SEQ ID NO: 7205150 - DNA, 22 bp, Homo sapiens
gttgttttgctgtctgtcttag

SEQ ID NO: 7205151 - DNA, 22 bp, Homo sapiens
gttgttttgctgtctgtcttag

SEQ ID NO: 7205152 - DNA, 22 bp, Homo sapiens
gttgttttgctgtctgtcttag

SEQ ID NO: 7205153 - DNA, 19 bp, Homo sapiens
gttgtttttcttattatgg

SEQ ID NO: 7205154 - DNA, 19 bp, Homo sapiens
gttgtttttcttattatgg

SEQ ID NO: 7205155 - DNA, 19 bp, Homo sapiens
gttgtttttcttattatgg

SEQ ID NO: 7205156 - DNA, 19 bp, Homo sapiens
gttgtttttcttattatgg

SEQ ID NO: 7205157 - DNA, 19 bp, Homo sapiens
gttgtttttcttattatgg

SEQ ID NO: 7205158 - DNA, 22 bp, Homo sapiens
gttgtttttgaacggtggtggc

SEQ ID NO: 7205159 - DNA, 22 bp, Homo sapiens
taaaggaactgctgctatggaa

SEQ ID NO: 7205160 - DNA, 22 bp, Homo sapiens
taaagcttgtattgcaatattt

SEQ ID NO: 7205161 - DNA, 22 bp, Homo sapiens
taaaggaacagaggactcattt

SEQ ID NO: 7205162 - DNA, 21 bp, Homo sapiens
taaagctcgttcaggaaagtc

SEQ ID NO: 7205163 - DNA, 22 bp, Homo sapiens
taaagctagaattgttccagca

SEQ ID NO: 7205164 - DNA, 22 bp, Homo sapiens
taaagctagccaaccactgtct

SEQ ID NO: 7205165 - DNA, 22 bp, Homo sapiens
taaagctatgcttaatttatca

SEQ ID NO: 7205166 - DNA, 22 bp, Homo sapiens
taaagctatgcttaatttatca

SEQ ID NO: 7205167 - DNA, 22 bp, Homo sapiens
taaagctatgcttaatttatca

SEQ ID NO: 7205168 - DNA, 22 bp, Homo sapiens
taaagctattgctgtttattgt

SEQ ID NO: 7205169 - DNA, 22 bp, Homo sapiens
taaagctagaaggtgctgtaca

SEQ ID NO: 7205170 - DNA, 21 bp, Homo sapiens
taaagctagaaccttagcttt

SEQ ID NO: 7205171 - DNA, 22 bp, Homo sapiens
taaagcagtgcaaaagcgtttt

SEQ ID NO: 7205172 - DNA, 21 bp, Homo sapiens
taaagctagaaccttagcttt

SEQ ID NO: 7205173 - DNA, 22 bp, Homo sapiens
taaagcagtatgatggaaggat

SEQ ID NO: 7205174 - DNA, 22 bp, Homo sapiens
taaagcaggtgctcagtgacca

SEQ ID NO: 7205175 - DNA, 22 bp, Homo sapiens
taaagcagtctgtgtatgtgaa

SEQ ID NO: 7205176 - DNA, 22 bp, Homo sapiens
taaagcagtctgtgtatgtgaa

SEQ ID NO: 7205177 - DNA, 22 bp, Homo sapiens
taaagcaggccacatatgtgat

SEQ ID NO: 7205178 - DNA, 22 bp, Homo sapiens
taaagcaggccacatatgtgat

SEQ ID NO: 7205179 - DNA, 22 bp, Homo sapiens
taaagcaggccacatatgtgat

SEQ ID NO: 7205180 - DNA, 22 bp, Homo sapiens
taaagcaggccacatatgtgat

SEQ ID NO: 7205181 - DNA, 22 bp, Homo sapiens
taaagcaggtgctcagtgacca

SEQ ID NO: 7205182 - DNA, 22 bp, Homo sapiens
taaagcaggtgctcagtgacca

SEQ ID NO: 7205183 - DNA, 22 bp, Homo sapiens
taaaactagaccgtgagtctaa

SEQ ID NO: 7205184 - DNA, 22 bp, Homo sapiens
taaaactagaccgtgagtctaa

SEQ ID NO: 7205185 - DNA, 22 bp, Homo sapiens
taaaactagaccgtgagtctaa

SEQ ID NO: 7205186 - DNA, 22 bp, Homo sapiens
taaaactagtggttgggactaa

SEQ ID NO: 7205187 - DNA, 22 bp, Homo sapiens
taaaactagtggttgggactaa

SEQ ID NO: 7205188 - DNA, 22 bp, Homo sapiens
taaaactagtggttgggactaa

SEQ ID NO: 7205189 - DNA, 22 bp, Homo sapiens
taaaactgaatacatactgagg

SEQ ID NO: 7205190 - DNA, 22 bp, Homo sapiens
taaaactgaatacatactgagg

SEQ ID NO: 7205191 - DNA, 22 bp, Homo sapiens
taaaacagcagggcagagaagt

SEQ ID NO: 7205192 - DNA, 22 bp, Homo sapiens
taaaacagcagggcagagaagt

SEQ ID NO: 7205193 - DNA, 22 bp, Homo sapiens
taaaacagcagggcagagaagt

SEQ ID NO: 7205194 - DNA, 22 bp, Homo sapiens
taaaaccataaggctggaagga

SEQ ID NO: 7205195 - DNA, 22 bp, Homo sapiens
taaaaccataaggctggaagga

SEQ ID NO: 7205196 - DNA, 22 bp, Homo sapiens
taaaaccataaggctggaagga

SEQ ID NO: 7205197 - DNA, 22 bp, Homo sapiens
taaaggcacggagttgttatgg

SEQ ID NO: 7205198 - DNA, 22 bp, Homo sapiens
taaaggcaattcagcaagccac

SEQ ID NO: 7205199 - DNA, 22 bp, Homo sapiens
taaaggcactgcgtccctcaaa

SEQ ID NO: 7205200 - DNA, 22 bp, Homo sapiens
taaaggattttgtataatataa

SEQ ID NO: 7205201 - DNA, 22 bp, Homo sapiens
taaaggcaaatgtgtgtttgtg

SEQ ID NO: 7205202 - DNA, 22 bp, Homo sapiens
taaaggataactttcaagaatt

SEQ ID NO: 7205203 - DNA, 22 bp, Homo sapiens
taaaggattttgtataatataa

SEQ ID NO: 7205204 - DNA, 22 bp, Homo sapiens
taaaggagtgtgatgaaaggga

SEQ ID NO: 7205205 - DNA, 22 bp, Homo sapiens
taaaggaggagttaatgagact

SEQ ID NO: 7205206 - DNA, 22 bp, Homo sapiens
taaaggaggagttaatgagact

SEQ ID NO: 7205207 - DNA, 22 bp, Homo sapiens
taaaggaatcagttttagagat

SEQ ID NO: 7205208 - DNA, 19 bp, Homo sapiens
taaaggaagaagggaggat

SEQ ID NO: 7205209 - DNA, 22 bp, Homo sapiens
taaaggaagaattctctgtgat

SEQ ID NO: 7205210 - DNA, 18 bp, Homo sapiens
taaaggaagtgggagagg

SEQ ID NO: 7205211 - DNA, 22 bp, Homo sapiens
taaatactttacaggatgtctc

SEQ ID NO: 7205212 - DNA, 22 bp, Homo sapiens
taaaggcttcggagtgcacact

SEQ ID NO: 7205213 - DNA, 21 bp, Homo sapiens
taaaggctttagaatggcaaa

SEQ ID NO: 7205214 - DNA, 22 bp, Homo sapiens
taaaggctttattttccagtca

SEQ ID NO: 7205215 - DNA, 22 bp, Homo sapiens
taaaggcagccactgagctcaa

SEQ ID NO: 7205216 - DNA, 22 bp, Homo sapiens
taaaggcagtaattcctgagtt

SEQ ID NO: 7205217 - DNA, 22 bp, Homo sapiens
taaaggctcagggaaccagatc

SEQ ID NO: 7205218 - DNA, 22 bp, Homo sapiens
taagaaatttagttatagaatg

SEQ ID NO: 7205219 - DNA, 20 bp, Homo sapiens
taagaacaagactaggaagc

SEQ ID NO: 7205220 - DNA, 22 bp, Homo sapiens
taacagcagtcctcttctcatg

SEQ ID NO: 7205221 - DNA, 22 bp, Homo sapiens
taacagcagggttacaggcatt

SEQ ID NO: 7205222 - DNA, 22 bp, Homo sapiens
taacagcactggcaggcactgt

SEQ ID NO: 7205223 - DNA, 21 bp, Homo sapiens
taacagcagggaaatacgtgc

SEQ ID NO: 7205224 - DNA, 21 bp, Homo sapiens
taacagcagggaaatacgtgc

SEQ ID NO: 7205225 - DNA, 22 bp, Homo sapiens
taacagcagggttacaggcatt

SEQ ID NO: 7205226 - DNA, 22 bp, Homo sapiens
taacagcagggttacaggcatt

SEQ ID NO: 7205227 - DNA, 22 bp, Homo sapiens
taacagcactggcaggcactgt

SEQ ID NO: 7205228 - DNA, 22 bp, Homo sapiens
taacagcactggcaggcactgt

SEQ ID NO: 7205229 - DNA, 22 bp, Homo sapiens
taacagcaaccacagtgctggt

SEQ ID NO: 7205230 - DNA, 22 bp, Homo sapiens
taacagcaaccacagtgctggt

SEQ ID NO: 7205231 - DNA, 22 bp, Homo sapiens
taacagagtgaaaatcagcaca

SEQ ID NO: 7205232 - DNA, 22 bp, Homo sapiens
taacagagatagaaatgtaaag

SEQ ID NO: 7205233 - DNA, 22 bp, Homo sapiens
taacagaatttgctaaactccg

SEQ ID NO: 7205234 - DNA, 22 bp, Homo sapiens
taacagaatttgctaaactccg

SEQ ID NO: 7205235 - DNA, 22 bp, Homo sapiens
taacagaatttgctaaactccg

SEQ ID NO: 7205236 - DNA, 22 bp, Homo sapiens
taacagaatttgctaaactccg

SEQ ID NO: 7205237 - DNA, 22 bp, Homo sapiens
taacactgtccaaagaattcca

SEQ ID NO: 7205238 - DNA, 22 bp, Homo sapiens
taacactgtaaacctagatgtt

SEQ ID NO: 7205239 - DNA, 22 bp, Homo sapiens
taacactgtccaaagaattcca

SEQ ID NO: 7205240 - DNA, 22 bp, Homo sapiens
taacactgtccaaagaattcca

SEQ ID NO: 7205241 - DNA, 22 bp, Homo sapiens
taacactgtccaaagaattcca

SEQ ID NO: 7205242 - DNA, 22 bp, Homo sapiens
taacactgtgcccagagtccca

SEQ ID NO: 7205243 - DNA, 22 bp, Homo sapiens
taacactgtgcccagagtccca

SEQ ID NO: 7205244 - DNA, 22 bp, Homo sapiens
taacactgtgcccagagtccca

SEQ ID NO: 7205245 - DNA, 22 bp, Homo sapiens
taacactgtggtgttctttgtc

SEQ ID NO: 7205246 - DNA, 22 bp, Homo sapiens
taacactgtggtgttctttgtc

SEQ ID NO: 7205247 - DNA, 22 bp, Homo sapiens
taacactgtgtctgccatatcc

SEQ ID NO: 7205248 - DNA, 22 bp, Homo sapiens
taacactgtgtctgccatatcc

SEQ ID NO: 7205249 - DNA, 22 bp, Homo sapiens
taacagaatagcagaaacagaa

SEQ ID NO: 7205250 - DNA, 22 bp, Homo sapiens
taacagaatagcagaaacagaa

SEQ ID NO: 7205251 - DNA, 22 bp, Homo sapiens
taacagaatagcagaaacagaa

SEQ ID NO: 7205252 - DNA, 22 bp, Homo sapiens
taacagaatagcagaaacagaa

SEQ ID NO: 7205253 - DNA, 22 bp, Homo sapiens
taacagaatagcagaaacagaa

SEQ ID NO: 7205254 - DNA, 22 bp, Homo sapiens
taacagaatcctgttattgcca

SEQ ID NO: 7205255 - DNA, 22 bp, Homo sapiens
taacagaatcctgttattgcca

SEQ ID NO: 7205256 - DNA, 22 bp, Homo sapiens
taacagaatcctgttattgcca

SEQ ID NO: 7205257 - DNA, 22 bp, Homo sapiens
taacagaatttgctaaactccg

SEQ ID NO: 7205258 - DNA, 20 bp, Homo sapiens
taagaacaagactaggaagc

SEQ ID NO: 7205259 - DNA, 22 bp, Homo sapiens
taacactggttatccctgtgca

SEQ ID NO: 7205260 - DNA, 22 bp, Homo sapiens
taacactgtaaacctagatgtt

SEQ ID NO: 7205261 - DNA, 22 bp, Homo sapiens
taacactggttatccctgtgca

SEQ ID NO: 7205262 - DNA, 22 bp, Homo sapiens
taacactggtatttcatttagt

SEQ ID NO: 7205263 - DNA, 22 bp, Homo sapiens
taacactggtatttcatttagt

SEQ ID NO: 7205264 - DNA, 22 bp, Homo sapiens
taacactggcttttgctgaggc

SEQ ID NO: 7205265 - DNA, 22 bp, Homo sapiens
taacactggtatttcatttagt

SEQ ID NO: 7205266 - DNA, 22 bp, Homo sapiens
taacactggtatttcatttagt

SEQ ID NO: 7205267 - DNA, 22 bp, Homo sapiens
taacactggcttttgctgaggc

SEQ ID NO: 7205268 - DNA, 22 bp, Homo sapiens
taacactggcttttgctgaggc

SEQ ID NO: 7205269 - DNA, 22 bp, Homo sapiens
taacactgatttgttctcaggg

SEQ ID NO: 7205270 - DNA, 22 bp, Homo sapiens
taacactgaaaatgatgcatgt

SEQ ID NO: 7205271 - DNA, 22 bp, Homo sapiens
taacactgaaaatgatgcatgt

SEQ ID NO: 7205272 - DNA, 22 bp, Homo sapiens
taacactgatttgttctcaggg

SEQ ID NO: 7205273 - DNA, 22 bp, Homo sapiens
taacactgatttgttctcaggg

SEQ ID NO: 7205274 - DNA, 22 bp, Homo sapiens
taacactgatttgttctcaggg

SEQ ID NO: 7205275 - DNA, 22 bp, Homo sapiens
taacactgccatgctggagtca

SEQ ID NO: 7205276 - DNA, 22 bp, Homo sapiens
taacactgccatgctggagtca

SEQ ID NO: 7205277 - DNA, 22 bp, Homo sapiens
taacactgccatgctggagtca

SEQ ID NO: 7205278 - DNA, 22 bp, Homo sapiens
taacactgcttcattttggaga

SEQ ID NO: 7205279 - DNA, 22 bp, Homo sapiens
taacactggagagttggttgtg

SEQ ID NO: 7205280 - DNA, 22 bp, Homo sapiens
taaatgataataatgctagtgt

SEQ ID NO: 7205281 - DNA, 22 bp, Homo sapiens
taacactgaaaatgatgcatgt

SEQ ID NO: 7205282 - DNA, 22 bp, Homo sapiens
taaatgagggctgacatgattg

SEQ ID NO: 7205283 - DNA, 22 bp, Homo sapiens
taaatgagggctgacatgattg

SEQ ID NO: 7205284 - DNA, 22 bp, Homo sapiens
taaatgagggctgacatgattg

SEQ ID NO: 7205285 - DNA, 22 bp, Homo sapiens
taaatgagatgtacataactca

SEQ ID NO: 7205286 - DNA, 22 bp, Homo sapiens
taaatgacattcttaagtcttg

SEQ ID NO: 7205287 - DNA, 22 bp, Homo sapiens
taaatgacattcttaagtcttg

SEQ ID NO: 7205288 - DNA, 22 bp, Homo sapiens
taaatgaagaaatggagattgt

SEQ ID NO: 7205289 - DNA, 22 bp, Homo sapiens
taaatgaagctcatgggccaca

SEQ ID NO: 7205290 - DNA, 22 bp, Homo sapiens
taaatgaagaaatggagattgt

SEQ ID NO: 7205291 - DNA, 22 bp, Homo sapiens
taaatgaagctcatgggccaca

SEQ ID NO: 7205292 - DNA, 22 bp, Homo sapiens
taaatgacattcttaagtcttg

SEQ ID NO: 7205293 - DNA, 22 bp, Homo sapiens
taaatagaatctaaactgctca

SEQ ID NO: 7205294 - DNA, 22 bp, Homo sapiens
taaatagaatctaaactgctca

SEQ ID NO: 7205295 - DNA, 22 bp, Homo sapiens
taaatagaatctaaactgctca

SEQ ID NO: 7205296 - DNA, 22 bp, Homo sapiens
taaatcacccatctcctaatct

SEQ ID NO: 7205297 - DNA, 22 bp, Homo sapiens
taaatcactcctaataatcagt

SEQ ID NO: 7205298 - DNA, 22 bp, Homo sapiens
taaatcactcctaataatcagt

SEQ ID NO: 7205299 - DNA, 22 bp, Homo sapiens
taaatcactcttctctcaccac

SEQ ID NO: 7205300 - DNA, 22 bp, Homo sapiens
taaatcactgtactttattcct

SEQ ID NO: 7205301 - DNA, 22 bp, Homo sapiens
taaatcactgttcattccacac

SEQ ID NO: 7205302 - DNA, 22 bp, Homo sapiens
taaatcactgttcattccacac

SEQ ID NO: 7205303 - DNA, 22 bp, Homo sapiens
taaatcaggaaggaaacttgga

SEQ ID NO: 7205304 - DNA, 22 bp, Homo sapiens
taaatcaggaaggaaacttgga

SEQ ID NO: 7205305 - DNA, 22 bp, Homo sapiens
taaatcagggagtcatctgcga

SEQ ID NO: 7205306 - DNA, 22 bp, Homo sapiens
taaatcagtaaggcatattctc

SEQ ID NO: 7205307 - DNA, 22 bp, Homo sapiens
taaatcagtaaggcatattctc

SEQ ID NO: 7205308 - DNA, 22 bp, Homo sapiens
taaatcagtagatatggtatag

SEQ ID NO: 7205309 - DNA, 22 bp, Homo sapiens
taaatcagtagatatggtatag

SEQ ID NO: 7205310 - DNA, 22 bp, Homo sapiens
taaatccagcttctaatttaga

SEQ ID NO: 7205311 - DNA, 22 bp, Homo sapiens
taaatccagcttctaatttaga

SEQ ID NO: 7205312 - DNA, 22 bp, Homo sapiens
taaatccctacatctgtgtttt

SEQ ID NO: 7205313 - DNA, 22 bp, Homo sapiens
taaatccttatcttctttgaat

SEQ ID NO: 7205314 - DNA, 22 bp, Homo sapiens
taaatctcaataaagtctgtgg

SEQ ID NO: 7205315 - DNA, 22 bp, Homo sapiens
taaatctcactgggtatattgg

SEQ ID NO: 7205316 - DNA, 22 bp, Homo sapiens
taaatctcactgggtatattgg

SEQ ID NO: 7205317 - DNA, 22 bp, Homo sapiens
taaatctcactgggtatattgg

SEQ ID NO: 7205318 - DNA, 22 bp, Homo sapiens
taaatctcagcctttctgctta

SEQ ID NO: 7205319 - DNA, 22 bp, Homo sapiens
taaatctcagggaatatattga

SEQ ID NO: 7205320 - DNA, 22 bp, Homo sapiens
taaatctcagggaatatattga

SEQ ID NO: 7205321 - DNA, 22 bp, Homo sapiens
taaatctcctgtttttcatcta

SEQ ID NO: 7205322 - DNA, 22 bp, Homo sapiens
taaatctcctgtttttcatcta

SEQ ID NO: 7205323 - DNA, 22 bp, Homo sapiens
taaatctctcagtggccagaga

SEQ ID NO: 7205324 - DNA, 18 bp, Homo sapiens
taaatctctctttagtca

SEQ ID NO: 7205325 - DNA, 18 bp, Homo sapiens
taaatctctctttagtca

SEQ ID NO: 7205326 - DNA, 22 bp, Homo sapiens
taaatctctgctcctcttgggt

SEQ ID NO: 7205327 - DNA, 21 bp, Homo sapiens
taaatctctgtattcttcagt

SEQ ID NO: 7205328 - DNA, 22 bp, Homo sapiens
taaatcttgtggcaatgcttct

SEQ ID NO: 7205329 - DNA, 22 bp, Homo sapiens
taaatgaaagggtttaatttat

SEQ ID NO: 7205330 - DNA, 22 bp, Homo sapiens
taaatgaaagggtttaatttat

SEQ ID NO: 7205331 - DNA, 22 bp, Homo sapiens
taaatgaaagggtttaatttat

SEQ ID NO: 7205332 - DNA, 22 bp, Homo sapiens
taaatgaagaaatggagattgt

SEQ ID NO: 7205333 - DNA, 22 bp, Homo sapiens
ggccagaagctggggcatagga

SEQ ID NO: 7205334 - DNA, 22 bp, Homo sapiens
ggccaccttcctgtggtctctg

SEQ ID NO: 7205335 - DNA, 22 bp, Homo sapiens
ggccaccttaagttaaggatat

SEQ ID NO: 7205336 - DNA, 22 bp, Homo sapiens
ggccacctctgccctactgagt

SEQ ID NO: 7205337 - DNA, 20 bp, Homo sapiens
ggccacctgcttcagacccc

SEQ ID NO: 7205338 - DNA, 22 bp, Homo sapiens
ggccacctggctgtgggggcag

SEQ ID NO: 7205339 - DNA, 22 bp, Homo sapiens
ggccacctgggttcgactgggc

SEQ ID NO: 7205340 - DNA, 22 bp, Homo sapiens
ggccagagaagtcagacccttg

SEQ ID NO: 7205341 - DNA, 22 bp, Homo sapiens
ggccagagaagtcagacccttg

SEQ ID NO: 7205342 - DNA, 22 bp, Homo sapiens
ggccagagaatatgccttacgt

SEQ ID NO: 7205343 - DNA, 22 bp, Homo sapiens
ggccagagaagtcagacccttg

SEQ ID NO: 7205344 - DNA, 22 bp, Homo sapiens
ggccagagaagtcagacccttg

SEQ ID NO: 7205345 - DNA, 22 bp, Homo sapiens
ggccagaagttggaaaagagcc

SEQ ID NO: 7205346 - DNA, 22 bp, Homo sapiens
ggccagaagttggaaaagagcc

SEQ ID NO: 7205347 - DNA, 22 bp, Homo sapiens
ggccagaagttggaaaagagcc

SEQ ID NO: 7205348 - DNA, 22 bp, Homo sapiens
ggccagaagttggaaaagagcc

SEQ ID NO: 7205349 - DNA, 22 bp, Homo sapiens
ggccagactgagtgaggtcaag

SEQ ID NO: 7205350 - DNA, 22 bp, Homo sapiens
ggcaggtgctgggagcatctca

SEQ ID NO: 7205351 - DNA, 22 bp, Homo sapiens
ggcaggtgctgggagcatctca

SEQ ID NO: 7205352 - DNA, 22 bp, Homo sapiens
ggcaggtgctgggagcatctca

SEQ ID NO: 7205353 - DNA, 20 bp, Homo sapiens
ggcaggtgctgtcccctcct

SEQ ID NO: 7205354 - DNA, 20 bp, Homo sapiens
ggcaggtgctcgcttggtct

SEQ ID NO: 7205355 - DNA, 22 bp, Homo sapiens
ggcaggtgctctgtgggcctgg

SEQ ID NO: 7205356 - DNA, 22 bp, Homo sapiens
ggcaggtgctctgtgggcctgg

SEQ ID NO: 7205357 - DNA, 20 bp, Homo sapiens
ggcaggtgctgtcccctcct

SEQ ID NO: 7205358 - DNA, 22 bp, Homo sapiens
ggcaggtgcttgtcgaaggcct

SEQ ID NO: 7205359 - DNA, 22 bp, Homo sapiens
ggcaggtgcttgtcgaaggcct

SEQ ID NO: 7205360 - DNA, 22 bp, Homo sapiens
ggcaggtgcttgtcgaaggcct

SEQ ID NO: 7205361 - DNA, 22 bp, Homo sapiens
ggcaggtgcttgtcgaaggcct

SEQ ID NO: 7205362 - DNA, 22 bp, Homo sapiens
ggcaggtgcttgtcgaaggcct

SEQ ID NO: 7205363 - DNA, 22 bp, Homo sapiens
ggcaggtgcttgtcgaaggcct

SEQ ID NO: 7205364 - DNA, 22 bp, Homo sapiens
ggcaggtggaaggtctccattc

SEQ ID NO: 7205365 - DNA, 22 bp, Homo sapiens
ggcaggtggaaggtctccattc

SEQ ID NO: 7205366 - DNA, 22 bp, Homo sapiens
ggcaggtggaagttggcagagc

SEQ ID NO: 7205367 - DNA, 22 bp, Homo sapiens
ggcaggtggaagttggcagagc

SEQ ID NO: 7205368 - DNA, 22 bp, Homo sapiens
ggcaggtggaagttggcagagc

SEQ ID NO: 7205369 - DNA, 22 bp, Homo sapiens
ggcaggtggaagttggcagagc

SEQ ID NO: 7205370 - DNA, 22 bp, Homo sapiens
ggccatgggaagaggtggagag

SEQ ID NO: 7205371 - DNA, 22 bp, Homo sapiens
ggccatgggaagaggtggagag

SEQ ID NO: 7205372 - DNA, 22 bp, Homo sapiens
ggccatgggaagaggtggagag

SEQ ID NO: 7205373 - DNA, 22 bp, Homo sapiens
ggccagaggtgtcctcagttct

SEQ ID NO: 7205374 - DNA, 22 bp, Homo sapiens
ggccagaggtgtcctcagttct

SEQ ID NO: 7205375 - DNA, 18 bp, Homo sapiens
ggccagagggagggtccc

SEQ ID NO: 7205376 - DNA, 18 bp, Homo sapiens
ggccagagggagggtccc

SEQ ID NO: 7205377 - DNA, 18 bp, Homo sapiens
ggccagagggagggtccc

SEQ ID NO: 7205378 - DNA, 18 bp, Homo sapiens
ggccagagggagggtccc

SEQ ID NO: 7205379 - DNA, 22 bp, Homo sapiens
ggccagagggagggcacaaatc

SEQ ID NO: 7205380 - DNA, 17 bp, Homo sapiens
ggccagaggcggggctg

SEQ ID NO: 7205381 - DNA, 22 bp, Homo sapiens
ggccagagggagggcacaaatc

SEQ ID NO: 7205382 - DNA, 22 bp, Homo sapiens
ggccagagggagggcacaaatc

SEQ ID NO: 7205383 - DNA, 22 bp, Homo sapiens
ggccagaggccatcctcctgct

SEQ ID NO: 7205384 - DNA, 22 bp, Homo sapiens
ggccagaggccatcctcctgct

SEQ ID NO: 7205385 - DNA, 17 bp, Homo sapiens
ggccagaggcggggctg

SEQ ID NO: 7205386 - DNA, 17 bp, Homo sapiens
ggccagaggcggggctg

SEQ ID NO: 7205387 - DNA, 17 bp, Homo sapiens
ggccagaggcggggctg

SEQ ID NO: 7205388 - DNA, 17 bp, Homo sapiens
ggccagaggcggggctg

SEQ ID NO: 7205389 - DNA, 22 bp, Homo sapiens
ggccagagagcagccaggattc

SEQ ID NO: 7205390 - DNA, 22 bp, Homo sapiens
ggccagagagcagccaggattc

SEQ ID NO: 7205391 - DNA, 22 bp, Homo sapiens
ggccagagagcagccaggattc

SEQ ID NO: 7205392 - DNA, 22 bp, Homo sapiens
ggccagagagcagccaggattc

SEQ ID NO: 7205393 - DNA, 22 bp, Homo sapiens
ggccagagagccgctgttagga

SEQ ID NO: 7205394 - DNA, 22 bp, Homo sapiens
ggccagagagccgctgttagga

SEQ ID NO: 7205395 - DNA, 22 bp, Homo sapiens
ggccagagctcaaacagtcgca

SEQ ID NO: 7205396 - DNA, 22 bp, Homo sapiens
ggccagagctgacctatcaatg

SEQ ID NO: 7205397 - DNA, 22 bp, Homo sapiens
ggccagaggacctctcatagcc

SEQ ID NO: 7205398 - DNA, 22 bp, Homo sapiens
ggccagaggacctctcatagcc

SEQ ID NO: 7205399 - DNA, 22 bp, Homo sapiens
ggccagaggccatcctcctgct

SEQ ID NO: 7205400 - DNA, 22 bp, Homo sapiens
ggccagaggccacagctgtgtc

SEQ ID NO: 7205401 - DNA, 22 bp, Homo sapiens
ggccagaggccacagctgtgtc

SEQ ID NO: 7205402 - DNA, 22 bp, Homo sapiens
ggccagaggccacagctgtgtc

SEQ ID NO: 7205403 - DNA, 22 bp, Homo sapiens
ggccagaggacctctcatagcc

SEQ ID NO: 7205404 - DNA, 22 bp, Homo sapiens
ggccagaggccacagctgtgtc

SEQ ID NO: 7205405 - DNA, 22 bp, Homo sapiens
ggccagaggccacagctgtgtc

SEQ ID NO: 7205406 - DNA, 22 bp, Homo sapiens
ggccagaggccacagctgtgtc

SEQ ID NO: 7205407 - DNA, 22 bp, Homo sapiens
ggcccctgcggactgcctagag

SEQ ID NO: 7205408 - DNA, 22 bp, Homo sapiens
ggcccctcttgtggcacatacg

SEQ ID NO: 7205409 - DNA, 22 bp, Homo sapiens
ggcccctcagcatctgagtcag

SEQ ID NO: 7205410 - DNA, 22 bp, Homo sapiens
ggcccctcagcatctgagtcag

SEQ ID NO: 7205411 - DNA, 19 bp, Homo sapiens
ggcccctctcacaggagtt

SEQ ID NO: 7205412 - DNA, 21 bp, Homo sapiens
ggccccgcagacccagcacgt

SEQ ID NO: 7205413 - DNA, 22 bp, Homo sapiens
ggccccagttcactcctggccg

SEQ ID NO: 7205414 - DNA, 22 bp, Homo sapiens
ggcccagcgaggccacctacag

SEQ ID NO: 7205415 - DNA, 22 bp, Homo sapiens
ggcccagcgaggccacctacag

SEQ ID NO: 7205416 - DNA, 22 bp, Homo sapiens
ggcccagccttggggtttcttt

SEQ ID NO: 7205417 - DNA, 22 bp, Homo sapiens
ggcccagcctggcaacaatgac

SEQ ID NO: 7205418 - DNA, 22 bp, Homo sapiens
ggcccagcctcagacatgccct

SEQ ID NO: 7205419 - DNA, 22 bp, Homo sapiens
ggcccagcctggcaacaatgac

SEQ ID NO: 7205420 - DNA, 22 bp, Homo sapiens
ggcccagcctggcaacaatgac

SEQ ID NO: 7205421 - DNA, 22 bp, Homo sapiens
ggcccagcctcagacatgccct

SEQ ID NO: 7205422 - DNA, 22 bp, Homo sapiens
ggcccagccggcgagtctcgcg

SEQ ID NO: 7205423 - DNA, 22 bp, Homo sapiens
ggcccagcctcagacatgccct

SEQ ID NO: 7205424 - DNA, 22 bp, Homo sapiens
ggcccagcctcagacatgccct

SEQ ID NO: 7205425 - DNA, 22 bp, Homo sapiens
ggccccagcagaccctcctctg

SEQ ID NO: 7205426 - DNA, 22 bp, Homo sapiens
ggccccagcagaccctcctctg

SEQ ID NO: 7205427 - DNA, 22 bp, Homo sapiens
ggccccagcagaccctcctctg

SEQ ID NO: 7205428 - DNA, 22 bp, Homo sapiens
ggccccaggtctgaacacgctg

SEQ ID NO: 7205429 - DNA, 22 bp, Homo sapiens
ggccccaggtctgaacacgctg

SEQ ID NO: 7205430 - DNA, 22 bp, Homo sapiens
ggccccagattctgggctgggt

SEQ ID NO: 7205431 - DNA, 22 bp, Homo sapiens
ggccccacgggggagtcctagt

SEQ ID NO: 7205432 - DNA, 22 bp, Homo sapiens
ggccatggtcatgggtgagctt

SEQ ID NO: 7205433 - DNA, 22 bp, Homo sapiens
ggccatggtcatgggtgagctt

SEQ ID NO: 7205434 - DNA, 22 bp, Homo sapiens
ggccatggtcatgggtgagctt

SEQ ID NO: 7205435 - DNA, 22 bp, Homo sapiens
ggccatggtgaggtcttctcag

SEQ ID NO: 7205436 - DNA, 20 bp, Homo sapiens
ggccatgggttgcctgaggt

SEQ ID NO: 7205437 - DNA, 20 bp, Homo sapiens
ggccatgggttgcctgaggt

SEQ ID NO: 7205438 - DNA, 22 bp, Homo sapiens
ggccatggggacagagggtgaa

SEQ ID NO: 7205439 - DNA, 22 bp, Homo sapiens
ggccatggggacagagggtgaa

SEQ ID NO: 7205440 - DNA, 22 bp, Homo sapiens
ggccatggggacagagggtgaa

SEQ ID NO: 7205441 - DNA, 20 bp, Homo sapiens
ggccatgggttgcctgaggt

SEQ ID NO: 7205442 - DNA, 20 bp, Homo sapiens
ggccatgggttgcctgaggt

SEQ ID NO: 7205443 - DNA, 20 bp, Homo sapiens
ggccatgggttgcctgaggt

SEQ ID NO: 7205444 - DNA, 22 bp, Homo sapiens
ggccatgtttggcagaaggatt

SEQ ID NO: 7205445 - DNA, 23 bp, Homo sapiens
ggccatttcatttggttcaaact

SEQ ID NO: 7205446 - DNA, 22 bp, Homo sapiens
ggccatttcttccttctcaaca

SEQ ID NO: 7205447 - DNA, 22 bp, Homo sapiens
ggccatttgcttggagaacttt

SEQ ID NO: 7205448 - DNA, 22 bp, Homo sapiens
ggccatttgctttattcacttc

SEQ ID NO: 7205449 - DNA, 22 bp, Homo sapiens
ggccattttataggcagtgggg

SEQ ID NO: 7205450 - DNA, 22 bp, Homo sapiens
ggccattttataggcagtgggg

SEQ ID NO: 7205451 - DNA, 22 bp, Homo sapiens
ggccatttttactttgggacag

SEQ ID NO: 7205452 - DNA, 22 bp, Homo sapiens
ggccatttttactttgggacag

SEQ ID NO: 7205453 - DNA, 22 bp, Homo sapiens
ggccatttttgttcttatctct

SEQ ID NO: 7205454 - DNA, 17 bp, Homo sapiens
ggccatggtgcaaggtt

SEQ ID NO: 7205455 - DNA, 17 bp, Homo sapiens
ggccatggtgcaaggtt

SEQ ID NO: 7205456 - DNA, 22 bp, Homo sapiens
ggccatggtggtttgagcacct

SEQ ID NO: 7205457 - DNA, 22 bp, Homo sapiens
ggccatggtggtttgagcacct

SEQ ID NO: 7205458 - DNA, 22 bp, Homo sapiens
ggccatggtggtttgagcacct

SEQ ID NO: 7205459 - DNA, 22 bp, Homo sapiens
ggccatggtggtttgagcacct

SEQ ID NO: 7205460 - DNA, 22 bp, Homo sapiens
ggccatggttggggaagacatg

SEQ ID NO: 7205461 - DNA, 22 bp, Homo sapiens
ggcccacactgacagctgagct

SEQ ID NO: 7205462 - DNA, 22 bp, Homo sapiens
ggcccaaggtgccaaggcctcc

SEQ ID NO: 7205463 - DNA, 19 bp, Homo sapiens
ggcccaagtactgagtgcc

SEQ ID NO: 7205464 - DNA, 19 bp, Homo sapiens
ggcccaagtactgagtgcc

SEQ ID NO: 7205465 - DNA, 21 bp, Homo sapiens
ggccattttcactcattccat

SEQ ID NO: 7205466 - DNA, 22 bp, Homo sapiens
ggcccaaaccaagtacctcaaa

SEQ ID NO: 7205467 - DNA, 22 bp, Homo sapiens
ggcccaaggcccaggtcgagct

SEQ ID NO: 7205468 - DNA, 22 bp, Homo sapiens
ggcccaaggcccaggtcgagct

SEQ ID NO: 7205469 - DNA, 22 bp, Homo sapiens
ggcccaaggcccaggtcgagct

SEQ ID NO: 7205470 - DNA, 22 bp, Homo sapiens
ggcccaaggcccaggtcgagct

SEQ ID NO: 7205471 - DNA, 22 bp, Homo sapiens
ggcccaaggtgccaaggcctcc

SEQ ID NO: 7205472 - DNA, 22 bp, Homo sapiens
ggcccagaagccagaagcctcc

SEQ ID NO: 7205473 - DNA, 22 bp, Homo sapiens
ggcccacatggaagcatcgagg

SEQ ID NO: 7205474 - DNA, 22 bp, Homo sapiens
ggcccacatggaagcatcgagg

SEQ ID NO: 7205475 - DNA, 22 bp, Homo sapiens
ggcccacttgaaatggagctca

SEQ ID NO: 7205476 - DNA, 22 bp, Homo sapiens
ggcccagccggcgagtctcgcg

SEQ ID NO: 7205477 - DNA, 22 bp, Homo sapiens
ggcccagcccgagtcagccttc

SEQ ID NO: 7205478 - DNA, 22 bp, Homo sapiens
ggcccagccggcgagtctcgcg

SEQ ID NO: 7205479 - DNA, 22 bp, Homo sapiens
ggcccagccggcgagtctcgcg

SEQ ID NO: 7205480 - DNA, 22 bp, Homo sapiens
ggcctgggcccactgtcaagag

SEQ ID NO: 7205481 - DNA, 22 bp, Homo sapiens
ggcctgggcccactgtcaagag

SEQ ID NO: 7205482 - DNA, 22 bp, Homo sapiens
ggcctggctggttcagtaccct

SEQ ID NO: 7205483 - DNA, 22 bp, Homo sapiens
ggccctgcgattaggtggcagg

SEQ ID NO: 7205484 - DNA, 22 bp, Homo sapiens
ggcctgggcctttgtgttttga

SEQ ID NO: 7205485 - DNA, 22 bp, Homo sapiens
ggcctgggcctttgtgttttga

SEQ ID NO: 7205486 - DNA, 22 bp, Homo sapiens
ggccctgcgattaggtggcagg

SEQ ID NO: 7205487 - DNA, 22 bp, Homo sapiens
ggccctgctcaggctgcgatga

SEQ ID NO: 7205488 - DNA, 22 bp, Homo sapiens
ggccctgcaaggtacccaggcc

SEQ ID NO: 7205489 - DNA, 22 bp, Homo sapiens
ggccctgcatgagattaaggtt

SEQ ID NO: 7205490 - DNA, 22 bp, Homo sapiens
ggccctgcgattaggtggcagg

SEQ ID NO: 7205491 - DNA, 22 bp, Homo sapiens
ggccctgagtctagctgctctt

SEQ ID NO: 7205492 - DNA, 22 bp, Homo sapiens
ggccctgcaaggtacccaggcc

SEQ ID NO: 7205493 - DNA, 22 bp, Homo sapiens
ggccctgcaaggtacccaggcc

SEQ ID NO: 7205494 - DNA, 22 bp, Homo sapiens
ggccctcttttggtttggatgt

SEQ ID NO: 7205495 - DNA, 22 bp, Homo sapiens
ggccctcttttatccatcataa

SEQ ID NO: 7205496 - DNA, 22 bp, Homo sapiens
ggccctctgtggctgccatgga

SEQ ID NO: 7205497 - DNA, 22 bp, Homo sapiens
ggccctctggcttccgcatggg

SEQ ID NO: 7205498 - DNA, 22 bp, Homo sapiens
ggccctctgctctgagatgaag

SEQ ID NO: 7205499 - DNA, 22 bp, Homo sapiens
ggccctctggtgagtatcacat

SEQ ID NO: 7205500 - DNA, 22 bp, Homo sapiens
ggccctctgtggctgccatgga

SEQ ID NO: 7205501 - DNA, 22 bp, Homo sapiens
ggccctccctgagccaggtggg

SEQ ID NO: 7205502 - DNA, 22 bp, Homo sapiens
ggccctccctgagccaggtggg

SEQ ID NO: 7205503 - DNA, 22 bp, Homo sapiens
ggcccctgcggactgcctagag

SEQ ID NO: 7205504 - DNA, 22 bp, Homo sapiens
ggcccctgtaaaatgtacatgt

SEQ ID NO: 7205505 - DNA, 22 bp, Homo sapiens
ggcccctggcaccaggctgatt

SEQ ID NO: 7205506 - DNA, 22 bp, Homo sapiens
ggccctccctgagccaggtggg

SEQ ID NO: 7205507 - DNA, 22 bp, Homo sapiens
ggccttgatcctccagagcact

SEQ ID NO: 7205508 - DNA, 22 bp, Homo sapiens
ggccttgatcctccagagcact

SEQ ID NO: 7205509 - DNA, 22 bp, Homo sapiens
ggccttgatcctccagagcact

SEQ ID NO: 7205510 - DNA, 22 bp, Homo sapiens
ggccttgacagttaagagacct

SEQ ID NO: 7205511 - DNA, 22 bp, Homo sapiens
ggccttgagcagggagaaacca

SEQ ID NO: 7205512 - DNA, 22 bp, Homo sapiens
ggccttgatcctccagagcact

SEQ ID NO: 7205513 - DNA, 22 bp, Homo sapiens
ggccttgagagccagtgcaggc

SEQ ID NO: 7205514 - DNA, 22 bp, Homo sapiens
ggccttgacctcagtgggtttg

SEQ ID NO: 7205515 - DNA, 22 bp, Homo sapiens
ggccttgagagccagtgcaggc

SEQ ID NO: 7205516 - DNA, 22 bp, Homo sapiens
ggccttctgcctttcagcaatg

SEQ ID NO: 7205517 - DNA, 22 bp, Homo sapiens
ggccttgatctctctaactgct

SEQ ID NO: 7205518 - DNA, 19 bp, Homo sapiens
ggccttgatgagtggggag

SEQ ID NO: 7205519 - DNA, 22 bp, Homo sapiens
ggccttgatgttcttgggagat

SEQ ID NO: 7205520 - DNA, 23 bp, Homo sapiens
ggccttgcagtaaaccaaatgac

SEQ ID NO: 7205521 - DNA, 22 bp, Homo sapiens
ggccttgccaaggagcccttaa

SEQ ID NO: 7205522 - DNA, 22 bp, Homo sapiens
ggccttgcctcaatagctccac

SEQ ID NO: 7205523 - DNA, 22 bp, Homo sapiens
ggccttgcggaacgctcaggcg

SEQ ID NO: 7205524 - DNA, 20 bp, Homo sapiens
ggccttgctctgtgaccccc

SEQ ID NO: 7205525 - DNA, 22 bp, Homo sapiens
ggccttgctgcttccagaaggt

SEQ ID NO: 7205526 - DNA, 22 bp, Homo sapiens
ggccttgctgcttccagaaggt

SEQ ID NO: 7205527 - DNA, 22 bp, Homo sapiens
ggccttggaaagatacccagct

SEQ ID NO: 7205528 - DNA, 22 bp, Homo sapiens
ggccttggaaagatacccagct

SEQ ID NO: 7205529 - DNA, 20 bp, Homo sapiens
ggccttggaatagcacagct

SEQ ID NO: 7205530 - DNA, 20 bp, Homo sapiens
ggccttggaatagcacagct

SEQ ID NO: 7205531 - DNA, 22 bp, Homo sapiens
ggccttggagtcagccttgagc

SEQ ID NO: 7205532 - DNA, 22 bp, Homo sapiens
ggccttggagtcagccttgagc

SEQ ID NO: 7205533 - DNA, 22 bp, Homo sapiens
ggccttggagtcctccactgga

SEQ ID NO: 7205534 - DNA, 22 bp, Homo sapiens
ggccttggatccaagctgcggc

SEQ ID NO: 7205535 - DNA, 22 bp, Homo sapiens
ggccttggatccaagctgcggc

SEQ ID NO: 7205536 - DNA, 22 bp, Homo sapiens
ggccttccagggaagacagggc

SEQ ID NO: 7205537 - DNA, 22 bp, Homo sapiens
ggccttcctgctgctccgggcc

SEQ ID NO: 7205538 - DNA, 22 bp, Homo sapiens
ggccttcctggcggctcagggt

SEQ ID NO: 7205539 - DNA, 22 bp, Homo sapiens
ggccttcctggcggctcagggt

SEQ ID NO: 7205540 - DNA, 22 bp, Homo sapiens
ggccttccttcccagcctactg

SEQ ID NO: 7205541 - DNA, 22 bp, Homo sapiens
ggctcagcttatctgggcaggc

SEQ ID NO: 7205542 - DNA, 22 bp, Homo sapiens
ggctcagcgcgctgggagggag

SEQ ID NO: 7205543 - DNA, 22 bp, Homo sapiens
ggctcagccccgtaacacagca

SEQ ID NO: 7205544 - DNA, 22 bp, Homo sapiens
ggctcagccccgtaacacagca

SEQ ID NO: 7205545 - DNA, 22 bp, Homo sapiens
ggctcagccccgtaacacagca

SEQ ID NO: 7205546 - DNA, 22 bp, Homo sapiens
ggctcagccccgtaacacagca

SEQ ID NO: 7205547 - DNA, 18 bp, Homo sapiens
ggctcagcaggctctctc

SEQ ID NO: 7205548 - DNA, 22 bp, Homo sapiens
ggccttgggatgtggctgcagc

SEQ ID NO: 7205549 - DNA, 22 bp, Homo sapiens
ggccttgggatgtggctgcagc

SEQ ID NO: 7205550 - DNA, 22 bp, Homo sapiens
ggccttgggatgtggctgcagc

SEQ ID NO: 7205551 - DNA, 22 bp, Homo sapiens
ggctcagcacagggctggcatc

SEQ ID NO: 7205552 - DNA, 22 bp, Homo sapiens
ggctcagcacagggctggcatc

SEQ ID NO: 7205553 - DNA, 18 bp, Homo sapiens
ggctcagcaggctctctc

SEQ ID NO: 7205554 - DNA, 20 bp, Homo sapiens
ggccttggcctctttgcagc

SEQ ID NO: 7205555 - DNA, 21 bp, Homo sapiens
ggccttggcgggggccgaatt

SEQ ID NO: 7205556 - DNA, 22 bp, Homo sapiens
ggccttggctcctgcagggagt

SEQ ID NO: 7205557 - DNA, 22 bp, Homo sapiens
ggccttggctcctgcagggagt

SEQ ID NO: 7205558 - DNA, 22 bp, Homo sapiens
ggccttggctcctgcagggagt

SEQ ID NO: 7205559 - DNA, 22 bp, Homo sapiens
ggccttgggaggagggtcagaa

SEQ ID NO: 7205560 - DNA, 22 bp, Homo sapiens
ggccttgggaggagggtcagaa

SEQ ID NO: 7205561 - DNA, 22 bp, Homo sapiens
ggccttgggaggagggtcagaa

SEQ ID NO: 7205562 - DNA, 22 bp, Homo sapiens
ggctcaggatgagccttctcat

SEQ ID NO: 7205563 - DNA, 22 bp, Homo sapiens
ggctcaggagaggggctaaaag

SEQ ID NO: 7205564 - DNA, 22 bp, Homo sapiens
ggctcaggatgagccttctcat

SEQ ID NO: 7205565 - DNA, 22 bp, Homo sapiens
ggctcaggagaggggctaaaag

SEQ ID NO: 7205566 - DNA, 22 bp, Homo sapiens
ggctcaggatgagccttctcat

SEQ ID NO: 7205567 - DNA, 22 bp, Homo sapiens
ggctcaggatgagccttctcat

SEQ ID NO: 7205568 - DNA, 22 bp, Homo sapiens
ggctcaggccagaccacgactc

SEQ ID NO: 7205569 - DNA, 22 bp, Homo sapiens
ggctcagcttatctgggcaggc

SEQ ID NO: 7205570 - DNA, 22 bp, Homo sapiens
ggctcagcttggtgcgcagaaa

SEQ ID NO: 7205571 - DNA, 22 bp, Homo sapiens
ggctcagcttggtgcgcagaaa

SEQ ID NO: 7205572 - DNA, 22 bp, Homo sapiens
ggctcaggacacagtggtttag

SEQ ID NO: 7205573 - DNA, 22 bp, Homo sapiens
ggctcaggacctgggattgcca

SEQ ID NO: 7205574 - DNA, 22 bp, Homo sapiens
ggctcaggacctgggattgcca

SEQ ID NO: 7205575 - DNA, 22 bp, Homo sapiens
ggctcaggacacagtggtttag

SEQ ID NO: 7205576 - DNA, 22 bp, Homo sapiens
ggctcaggactgcagcgtagag

SEQ ID NO: 7205577 - DNA, 22 bp, Homo sapiens
ggctcaggactgcagcgtagag

SEQ ID NO: 7205578 - DNA, 22 bp, Homo sapiens
ggctccaccctgcttccagaag

SEQ ID NO: 7205579 - DNA, 22 bp, Homo sapiens
ggctccaccctgcttccagaag

SEQ ID NO: 7205580 - DNA, 22 bp, Homo sapiens
ggctccaagtctcagagtgaag

SEQ ID NO: 7205581 - DNA, 22 bp, Homo sapiens
ggctcctgatttgagggggctg

SEQ ID NO: 7205582 - DNA, 22 bp, Homo sapiens
ggctcctgatttgagggggctg

SEQ ID NO: 7205583 - DNA, 22 bp, Homo sapiens
ggctcctgatttgagggggctg

SEQ ID NO: 7205584 - DNA, 22 bp, Homo sapiens
ggctcctgcacctgtccctctg

SEQ ID NO: 7205585 - DNA, 22 bp, Homo sapiens
ggctcctgcacctgtccctctg

SEQ ID NO: 7205586 - DNA, 21 bp, Homo sapiens
ggctcctgctttgtgaggggc

SEQ ID NO: 7205587 - DNA, 21 bp, Homo sapiens
ggctcctgctttgtgaggggc

SEQ ID NO: 7205588 - DNA, 19 bp, Homo sapiens
ggctcagtgacataggtgc

SEQ ID NO: 7205589 - DNA, 22 bp, Homo sapiens
ggctcatatcccggccatcatt

SEQ ID NO: 7205590 - DNA, 22 bp, Homo sapiens
ggctcaggtttccttcccagct

SEQ ID NO: 7205591 - DNA, 22 bp, Homo sapiens
ggctcagtaagtcaggttcatt

SEQ ID NO: 7205592 - DNA, 22 bp, Homo sapiens
ggctcaggccagaccacgactc

SEQ ID NO: 7205593 - DNA, 22 bp, Homo sapiens
ggctcaggccagaccacgactc

SEQ ID NO: 7205594 - DNA, 22 bp, Homo sapiens
ggctcaggccagaccacgactc

SEQ ID NO: 7205595 - DNA, 22 bp, Homo sapiens
ggctcaggcctgtaatcctagc

SEQ ID NO: 7205596 - DNA, 22 bp, Homo sapiens
ggctcaggtttaaagtgcttta

SEQ ID NO: 7205597 - DNA, 22 bp, Homo sapiens
ggctcaggtttaaagtgcttta

SEQ ID NO: 7205598 - DNA, 22 bp, Homo sapiens
ggctcaggtttaaagtgcttta

SEQ ID NO: 7205599 - DNA, 22 bp, Homo sapiens
ggctcaggtttccttcccagct

SEQ ID NO: 7205600 - DNA, 22 bp, Homo sapiens
ggctcaggtttccttcccagct

SEQ ID NO: 7205601 - DNA, 22 bp, Homo sapiens
gggaagagaccgtaccctggcc

SEQ ID NO: 7205602 - DNA, 22 bp, Homo sapiens
gggaagacttagtcggttcaat

SEQ ID NO: 7205603 - DNA, 22 bp, Homo sapiens
gggaagaagacatggtgaaggc

SEQ ID NO: 7205604 - DNA, 22 bp, Homo sapiens
gggaagagaggaggtggtttcg

SEQ ID NO: 7205605 - DNA, 22 bp, Homo sapiens
gggaagagaggaggtggtttcg

SEQ ID NO: 7205606 - DNA, 22 bp, Homo sapiens
gggaagagaggaggtggtttcg

SEQ ID NO: 7205607 - DNA, 18 bp, Homo sapiens
gggaagaggatctggccc

SEQ ID NO: 7205608 - DNA, 22 bp, Homo sapiens
gggaccaggtcagggctctgac

SEQ ID NO: 7205609 - DNA, 22 bp, Homo sapiens
gggaccaggtcagggctctgac

SEQ ID NO: 7205610 - DNA, 22 bp, Homo sapiens
gggaacagggcctgagctgggg

SEQ ID NO: 7205611 - DNA, 22 bp, Homo sapiens
gggaacagggcctgagctgggg

SEQ ID NO: 7205612 - DNA, 22 bp, Homo sapiens
gggaacagggcctgagctgggg

SEQ ID NO: 7205613 - DNA, 22 bp, Homo sapiens
gggaacagggcctgagctgggg

SEQ ID NO: 7205614 - DNA, 22 bp, Homo sapiens
gggaacagggcctgagctgggg

SEQ ID NO: 7205615 - DNA, 22 bp, Homo sapiens
gggaaccagccgcttccgcctc

SEQ ID NO: 7205616 - DNA, 22 bp, Homo sapiens
gggaagaagacatggtgaaggc

SEQ ID NO: 7205617 - DNA, 22 bp, Homo sapiens
gggaagaagacatggtgaaggc

SEQ ID NO: 7205618 - DNA, 22 bp, Homo sapiens
gggaacagcttgggctctgcca

SEQ ID NO: 7205619 - DNA, 22 bp, Homo sapiens
gggaacagcatatctgaagggt

SEQ ID NO: 7205620 - DNA, 22 bp, Homo sapiens
gggaacagcatatctgaagggt

SEQ ID NO: 7205621 - DNA, 22 bp, Homo sapiens
gggaacagcatatctgaagggt

SEQ ID NO: 7205622 - DNA, 22 bp, Homo sapiens
gggaacagaggagggtgttgct

SEQ ID NO: 7205623 - DNA, 22 bp, Homo sapiens
gggaacagagtgccagactgac

SEQ ID NO: 7205624 - DNA, 22 bp, Homo sapiens
ggctttggggtgtgcagagatg

SEQ ID NO: 7205625 - DNA, 22 bp, Homo sapiens
ggctttgggattcagcatgaga

SEQ ID NO: 7205626 - DNA, 22 bp, Homo sapiens
ggcttcctttcactaccctcag

SEQ ID NO: 7205627 - DNA, 22 bp, Homo sapiens
ggcttcctttcactaccctcag

SEQ ID NO: 7205628 - DNA, 22 bp, Homo sapiens
ggcttcctggggcctcctgcaa

SEQ ID NO: 7205629 - DNA, 22 bp, Homo sapiens
ggcttcctggagaaggtctgag

SEQ ID NO: 7205630 - DNA, 22 bp, Homo sapiens
ggcttcctccttcctgctgtca

SEQ ID NO: 7205631 - DNA, 22 bp, Homo sapiens
ggcttcctggagaaggtctgag

SEQ ID NO: 7205632 - DNA, 22 bp, Homo sapiens
ggcttcctaatactccctacac

SEQ ID NO: 7205633 - DNA, 22 bp, Homo sapiens
gggaaattgtcaacactctcaa

SEQ ID NO: 7205634 - DNA, 22 bp, Homo sapiens
gggaaattgtgtgagatctttg

SEQ ID NO: 7205635 - DNA, 22 bp, Homo sapiens
gggaacagaggagggtgttgct

SEQ ID NO: 7205636 - DNA, 22 bp, Homo sapiens
gggaacagagtgccagactgac

SEQ ID NO: 7205637 - DNA, 21 bp, Homo sapiens
gggaaattaggattgctcatc

SEQ ID NO: 7205638 - DNA, 21 bp, Homo sapiens
gggaaattaggattgctcatc

SEQ ID NO: 7205639 - DNA, 19 bp, Homo sapiens
gggaaattcacttgcttcc

SEQ ID NO: 7205640 - DNA, 19 bp, Homo sapiens
gggaaattcacttgcttcc

SEQ ID NO: 7205641 - DNA, 23 bp, Homo sapiens
gggaaatcaaaagatatttcttc

SEQ ID NO: 7205642 - DNA, 22 bp, Homo sapiens
gggaaatagagctggaaccttg

SEQ ID NO: 7205643 - DNA, 22 bp, Homo sapiens
gggaaatctcgtcctctattta

SEQ ID NO: 7205644 - DNA, 22 bp, Homo sapiens
gggaaatctcgtcctctattta

SEQ ID NO: 7205645 - DNA, 22 bp, Homo sapiens
gggaaatctcgtcctctattta

SEQ ID NO: 7205646 - DNA, 22 bp, Homo sapiens
gggaaaggatcagtgggaggct

SEQ ID NO: 7205647 - DNA, 22 bp, Homo sapiens
gggaaaggatcagtgggaggct

SEQ ID NO: 7205648 - DNA, 22 bp, Homo sapiens
gggaaaggatttacagtttgat

SEQ ID NO: 7205649 - DNA, 22 bp, Homo sapiens
gggaaaggatttacagtttgat

SEQ ID NO: 7205650 - DNA, 22 bp, Homo sapiens
gggaaaggatttacagtttgat

SEQ ID NO: 7205651 - DNA, 22 bp, Homo sapiens
ggctttgtggggtgaagtaaag

SEQ ID NO: 7205652 - DNA, 22 bp, Homo sapiens
ggcttcccaaggagccaggatg

SEQ ID NO: 7205653 - DNA, 22 bp, Homo sapiens
ggcttcccaaggagccaggatg

SEQ ID NO: 7205654 - DNA, 22 bp, Homo sapiens
ggcttcccagcagagggcgcac

SEQ ID NO: 7205655 - DNA, 22 bp, Homo sapiens
ggcttcccagcagagggcgcac

SEQ ID NO: 7205656 - DNA, 22 bp, Homo sapiens
ggcttccccacaaagcacacaa

SEQ ID NO: 7205657 - DNA, 22 bp, Homo sapiens
ggcttccccacagtcctgagct

SEQ ID NO: 7205658 - DNA, 22 bp, Homo sapiens
ggcttccccacagtcctgagct

SEQ ID NO: 7205659 - DNA, 22 bp, Homo sapiens
ggcttccctgtttgctgtgcct

SEQ ID NO: 7205660 - DNA, 22 bp, Homo sapiens
ggcttcaggggcccagtcagca

SEQ ID NO: 7205661 - DNA, 23 bp, Homo sapiens
ggcttcagtgagagtccctgctg

SEQ ID NO: 7205662 - DNA, 22 bp, Homo sapiens
ggctgtgtccccacctgagcag

SEQ ID NO: 7205663 - DNA, 22 bp, Homo sapiens
ggctgtgtggccgtgggctcta

SEQ ID NO: 7205664 - DNA, 22 bp, Homo sapiens
ggctgtgtggccgtgggctcta

SEQ ID NO: 7205665 - DNA, 22 bp, Homo sapiens
ggctgtgtcctgtatgattatt

SEQ ID NO: 7205666 - DNA, 21 bp, Homo sapiens
ggctgtgttcagggcatgcgg

SEQ ID NO: 7205667 - DNA, 22 bp, Homo sapiens
ggctgtgttccaagtgtcagga

SEQ ID NO: 7205668 - DNA, 22 bp, Homo sapiens
ggctgtgttccaagtgtcagga

SEQ ID NO: 7205669 - DNA, 22 bp, Homo sapiens
ggcttcagtgagctgagctcac

SEQ ID NO: 7205670 - DNA, 22 bp, Homo sapiens
ggcttcagtgagctgagctcac

SEQ ID NO: 7205671 - DNA, 22 bp, Homo sapiens
ggcttcagtgagctgagctcac

SEQ ID NO: 7205672 - DNA, 22 bp, Homo sapiens
ggcttcatctcgttgacacctc

SEQ ID NO: 7205673 - DNA, 22 bp, Homo sapiens
ggcttcatggagttctacacca

SEQ ID NO: 7205674 - DNA, 22 bp, Homo sapiens
ggctggctcttaccgacagcgt

SEQ ID NO: 7205675 - DNA, 22 bp, Homo sapiens
ggctggctcttaccgacagcgt

SEQ ID NO: 7205676 - DNA, 22 bp, Homo sapiens
ggctggctccacctaggtagct

SEQ ID NO: 7205677 - DNA, 22 bp, Homo sapiens
ggctggctcagggcttgagaga

SEQ ID NO: 7205678 - DNA, 22 bp, Homo sapiens
ggctggctcttaccgacagcgt

SEQ ID NO: 7205679 - DNA, 22 bp, Homo sapiens
ggctggctgataaagggttgag

SEQ ID NO: 7205680 - DNA, 22 bp, Homo sapiens
ggctggcttgccaagctcaggg

SEQ ID NO: 7205681 - DNA, 22 bp, Homo sapiens
ggctggcttgccaagctcaggg

SEQ ID NO: 7205682 - DNA, 19 bp, Homo sapiens
ggctgtggtggtgccttgc

SEQ ID NO: 7205683 - DNA, 22 bp, Homo sapiens
ggctgtggtctgggtgctcccc

SEQ ID NO: 7205684 - DNA, 22 bp, Homo sapiens
ggctgtggtggcatccctgagc

SEQ ID NO: 7205685 - DNA, 22 bp, Homo sapiens
ggctggctggcttagcagagga

SEQ ID NO: 7205686 - DNA, 22 bp, Homo sapiens
ggctggctggctggtagacaag

SEQ ID NO: 7205687 - DNA, 22 bp, Homo sapiens
ggctggctggcttagcagagga

SEQ ID NO: 7205688 - DNA, 22 bp, Homo sapiens
ggctggctgtgccctgtactct

SEQ ID NO: 7205689 - DNA, 22 bp, Homo sapiens
ggctgagttgagaggattactt

SEQ ID NO: 7205690 - DNA, 22 bp, Homo sapiens
ggctctcggcggaccctgggaa

SEQ ID NO: 7205691 - DNA, 22 bp, Homo sapiens
ggctctctccttggctttcaga

SEQ ID NO: 7205692 - DNA, 22 bp, Homo sapiens
ggctctctccttggctttcaga

SEQ ID NO: 7205693 - DNA, 19 bp, Homo sapiens
ggctctcccttgagagagc

SEQ ID NO: 7205694 - DNA, 22 bp, Homo sapiens
ggctctccactatggatgagaa

SEQ ID NO: 7205695 - DNA, 22 bp, Homo sapiens
ggctctccactatggatgagaa

SEQ ID NO: 7205696 - DNA, 22 bp, Homo sapiens
ggctctccactatggatgagaa

SEQ ID NO: 7205697 - DNA, 22 bp, Homo sapiens
ggctgcacgcctctcagcttgc

SEQ ID NO: 7205698 - DNA, 22 bp, Homo sapiens
ggctgcacactgcaaactcaga

SEQ ID NO: 7205699 - DNA, 22 bp, Homo sapiens
ggctgcaaaggaaaagtggtga

SEQ ID NO: 7205700 - DNA, 22 bp, Homo sapiens
ggctgcaagacaaggttggttt

SEQ ID NO: 7205701 - DNA, 19 bp, Homo sapiens
ggctgatgtagacagtgtc

SEQ ID NO: 7205702 - DNA, 19 bp, Homo sapiens
ggctgatgtagacagtgtc

SEQ ID NO: 7205703 - DNA, 22 bp, Homo sapiens
ggctgatgagcttagctagaga

SEQ ID NO: 7205704 - DNA, 22 bp, Homo sapiens
ggctgcagaggcgatctgaggt

SEQ ID NO: 7205705 - DNA, 22 bp, Homo sapiens
ggctgcagaggcgatctgaggt

SEQ ID NO: 7205706 - DNA, 22 bp, Homo sapiens
ggctgcaggaacgacggagggg

SEQ ID NO: 7205707 - DNA, 22 bp, Homo sapiens
ggctgcaggaacgacggagggg

SEQ ID NO: 7205708 - DNA, 22 bp, Homo sapiens
ggctgcagaggcgatctgaggt

SEQ ID NO: 7205709 - DNA, 22 bp, Homo sapiens
ggctgcagaggcccccagtggg

SEQ ID NO: 7205710 - DNA, 22 bp, Homo sapiens
ggctgcagagctgggtgggcct

SEQ ID NO: 7205711 - DNA, 22 bp, Homo sapiens
ggctgcagagctggtgccctgg

SEQ ID NO: 7205712 - DNA, 22 bp, Homo sapiens
ggctgcagagctggtgccctgg

SEQ ID NO: 7205713 - DNA, 22 bp, Homo sapiens
ggctgcagagctgggtgggcct

SEQ ID NO: 7205714 - DNA, 19 bp, Homo sapiens
ggctgcagagccccggcgc

SEQ ID NO: 7205715 - DNA, 19 bp, Homo sapiens
ggctgcagagccccggcgc

SEQ ID NO: 7205716 - DNA, 20 bp, Homo sapiens
ggctccttctttcatggccc

SEQ ID NO: 7205717 - DNA, 20 bp, Homo sapiens
ggctccttctttcatggccc

SEQ ID NO: 7205718 - DNA, 22 bp, Homo sapiens
ggctccttgccaccagctctgc

SEQ ID NO: 7205719 - DNA, 22 bp, Homo sapiens
ggctccttgccaccagctctgc

SEQ ID NO: 7205720 - DNA, 23 bp, Homo sapiens
ggctccttgcccatccagcagcc

SEQ ID NO: 7205721 - DNA, 22 bp, Homo sapiens
ggctcgtgtccagtatagaaag

SEQ ID NO: 7205722 - DNA, 22 bp, Homo sapiens
ggctctagagactctagagaaa

SEQ ID NO: 7205723 - DNA, 22 bp, Homo sapiens
ggctctagagactctagagaaa

SEQ ID NO: 7205724 - DNA, 22 bp, Homo sapiens
ggctctagagctgtgcacacat

SEQ ID NO: 7205725 - DNA, 22 bp, Homo sapiens
ggctctccactatggatgagaa

SEQ ID NO: 7205726 - DNA, 22 bp, Homo sapiens
ggctcctggggaggtgagcttg

SEQ ID NO: 7205727 - DNA, 22 bp, Homo sapiens
ggctcctggggaggtgagcttg

SEQ ID NO: 7205728 - DNA, 22 bp, Homo sapiens
ggctcctggggaggtgagcttg

SEQ ID NO: 7205729 - DNA, 22 bp, Homo sapiens
ggctcctggggaggtgagcttg

SEQ ID NO: 7205730 - DNA, 19 bp, Homo sapiens
ggctcctggggctcagccc

SEQ ID NO: 7205731 - DNA, 19 bp, Homo sapiens
ggctcctggggctcagccc

SEQ ID NO: 7205732 - DNA, 19 bp, Homo sapiens
ggctcctgtggctgcagcc

SEQ ID NO: 7205733 - DNA, 22 bp, Homo sapiens
ggctcctgttttaaaaggtgaa

SEQ ID NO: 7205734 - DNA, 22 bp, Homo sapiens
ggctccttatctctcctatgcc

SEQ ID NO: 7205735 - DNA, 22 bp, Homo sapiens
ggctccttatctctcctatgcc

SEQ ID NO: 7205736 - DNA, 22 bp, Homo sapiens
ggctccttcaaagcacctggct

SEQ ID NO: 7205737 - DNA, 22 bp, Homo sapiens
ggctccttcaaagcacctggct

SEQ ID NO: 7205738 - DNA, 22 bp, Homo sapiens
ggctcctgggatgggactgagc

SEQ ID NO: 7205739 - DNA, 22 bp, Homo sapiens
ggctcctgggatgggactgagc

SEQ ID NO: 7205740 - DNA, 22 bp, Homo sapiens
ggctcctgggagatagaggtca

SEQ ID NO: 7205741 - DNA, 22 bp, Homo sapiens
ggctcctgggcagctgctccct

SEQ ID NO: 7205742 - DNA, 22 bp, Homo sapiens
ggctcctggcatctggtgggta

SEQ ID NO: 7205743 - DNA, 23 bp, Homo sapiens
ggctcctggattcaaatcctgcc

SEQ ID NO: 7205744 - DNA, 22 bp, Homo sapiens
ggctcctggaaagccctcgctc

SEQ ID NO: 7205745 - DNA, 22 bp, Homo sapiens
ggctcctggaggcaccactggt

SEQ ID NO: 7205746 - DNA, 23 bp, Homo sapiens
ggctcctggattcaaatcctgcc

SEQ ID NO: 7205747 - DNA, 22 bp, Homo sapiens
ggctggctacattggaggaagg

SEQ ID NO: 7205748 - DNA, 22 bp, Homo sapiens
ggctggctacattggaggaagg

SEQ ID NO: 7205749 - DNA, 22 bp, Homo sapiens
ggctggcctctacagggaggca

SEQ ID NO: 7205750 - DNA, 22 bp, Homo sapiens
ggctggcctgtgtggccgccac

SEQ ID NO: 7205751 - DNA, 22 bp, Homo sapiens
ggctggcgctctcccagcgctg

SEQ ID NO: 7205752 - DNA, 22 bp, Homo sapiens
ggctggcctcagggtcctcgct

SEQ ID NO: 7205753 - DNA, 22 bp, Homo sapiens
ggctggcctcagggtcctcgct

SEQ ID NO: 7205754 - DNA, 22 bp, Homo sapiens
ggctgctgaacaagggaaccct

SEQ ID NO: 7205755 - DNA, 22 bp, Homo sapiens
ggctgctgaacaagggaaccct

SEQ ID NO: 7205756 - DNA, 19 bp, Homo sapiens
ggctgctgaagagaattac

SEQ ID NO: 7205757 - DNA, 23 bp, Homo sapiens
ggctggcccggggctgctcctga

SEQ ID NO: 7205758 - DNA, 22 bp, Homo sapiens
ggctgctgaacaagggaaccct

SEQ ID NO: 7205759 - DNA, 22 bp, Homo sapiens
ggctgctgaacaagggaaccct

SEQ ID NO: 7205760 - DNA, 22 bp, Homo sapiens
ggctgctgaacaagggaaccct

SEQ ID NO: 7205761 - DNA, 19 bp, Homo sapiens
ggctgccttctgctcatct

SEQ ID NO: 7205762 - DNA, 22 bp, Homo sapiens
ggctgccttgaccctggctccg

SEQ ID NO: 7205763 - DNA, 22 bp, Homo sapiens
ggctgctcggagcctcctgtga

SEQ ID NO: 7205764 - DNA, 22 bp, Homo sapiens
ggctgctcggcagctcctgagc

SEQ ID NO: 7205765 - DNA, 22 bp, Homo sapiens
ggctgctcggcagctcctgagc

SEQ ID NO: 7205766 - DNA, 22 bp, Homo sapiens
ggctgctctccatcccaggcct

SEQ ID NO: 7205767 - DNA, 22 bp, Homo sapiens
ggctgctctccatcccaggcct

SEQ ID NO: 7205768 - DNA, 22 bp, Homo sapiens
ggctgctctccatcccaggcct

SEQ ID NO: 7205769 - DNA, 22 bp, Homo sapiens
ggctgctctgagagtgggtttt

SEQ ID NO: 7205770 - DNA, 22 bp, Homo sapiens
ggctgctctgcacaggggctgg

SEQ ID NO: 7205771 - DNA, 22 bp, Homo sapiens
ggctgctctgccttccagctgg

SEQ ID NO: 7205772 - DNA, 22 bp, Homo sapiens
ggctgctctgccttccagctgg

SEQ ID NO: 7205773 - DNA, 22 bp, Homo sapiens
ggctgctcttcttggcgacctc

SEQ ID NO: 7205774 - DNA, 22 bp, Homo sapiens
ggctgctcttcttggcgacctc

SEQ ID NO: 7205775 - DNA, 22 bp, Homo sapiens
ggctgctcttcttggcgacctc

SEQ ID NO: 7205776 - DNA, 22 bp, Homo sapiens
ggctgcaggaacgacggagggg

SEQ ID NO: 7205777 - DNA, 22 bp, Homo sapiens
ggctgcaggaacgacggagggg

SEQ ID NO: 7205778 - DNA, 22 bp, Homo sapiens
ggctgcaggaacgacggagggg

SEQ ID NO: 7205779 - DNA, 22 bp, Homo sapiens
ggctgcaggatgcccagccgtg

SEQ ID NO: 7205780 - DNA, 20 bp, Homo sapiens
ggctgcaggactcattggct

SEQ ID NO: 7205781 - DNA, 20 bp, Homo sapiens
ggctgcaggactcattggct

SEQ ID NO: 7205782 - DNA, 22 bp, Homo sapiens
ggctgcaggatgcccagccgtg

SEQ ID NO: 7205783 - DNA, 22 bp, Homo sapiens
ggctgcaggatgcccagccgtg

SEQ ID NO: 7205784 - DNA, 22 bp, Homo sapiens
ggctgcaggatgcccagccgtg

SEQ ID NO: 7205785 - DNA, 22 bp, Homo sapiens
ggctgcaggatgcccagccgtg

SEQ ID NO: 7205786 - DNA, 22 bp, Homo sapiens
ggctgcaggcagaggctgtctg

SEQ ID NO: 7205787 - DNA, 22 bp, Homo sapiens
ggctgcaggcagaggctgtctg

SEQ ID NO: 7205788 - DNA, 22 bp, Homo sapiens
ggctgcaggcagaggctgtctg

SEQ ID NO: 7205789 - DNA, 22 bp, Homo sapiens
ggctgcaggcagaggctgtctg

SEQ ID NO: 7205790 - DNA, 22 bp, Homo sapiens
ggctgcaggatgcccagccgtg

SEQ ID NO: 7205791 - DNA, 22 bp, Homo sapiens
ggctgcaggcagggtatccact

SEQ ID NO: 7205792 - DNA, 22 bp, Homo sapiens
ggctgcaggcagaggctgtctg

SEQ ID NO: 7205793 - DNA, 19 bp, Homo sapiens
ggctgcctggagcgagggc

SEQ ID NO: 7205794 - DNA, 22 bp, Homo sapiens
ggctgccttcagactccagctt

SEQ ID NO: 7205795 - DNA, 22 bp, Homo sapiens
ggctgcctgtgcccaggcacac

SEQ ID NO: 7205796 - DNA, 18 bp, Homo sapiens
ggctgcctgttcctgaag

SEQ ID NO: 7205797 - DNA, 22 bp, Homo sapiens
ggctgccttcatagaccatggg

SEQ ID NO: 7205798 - DNA, 22 bp, Homo sapiens
ggctgccttcatagaccatggg

SEQ ID NO: 7205799 - DNA, 22 bp, Homo sapiens
ggctgccttcatagaccatggg

SEQ ID NO: 7205800 - DNA, 22 bp, Homo sapiens
ggctgcctgggagccctcctct

SEQ ID NO: 7205801 - DNA, 22 bp, Homo sapiens
ggctgcctggtttagtgctgac

SEQ ID NO: 7205802 - DNA, 22 bp, Homo sapiens
ggctgcctggtttagtgctgac

SEQ ID NO: 7205803 - DNA, 22 bp, Homo sapiens
ggctgcctggtttcttgtaagg

SEQ ID NO: 7205804 - DNA, 22 bp, Homo sapiens
ggggacgggacttagcatgagt

SEQ ID NO: 7205805 - DNA, 22 bp, Homo sapiens
ggggacgcagaaagagtggcag

SEQ ID NO: 7205806 - DNA, 22 bp, Homo sapiens
ggggacgcagaaagagtggcag

SEQ ID NO: 7205807 - DNA, 22 bp, Homo sapiens
ggggacgcagaaagagtggcag

SEQ ID NO: 7205808 - DNA, 22 bp, Homo sapiens
ggggacgggacttagcatgagt

SEQ ID NO: 7205809 - DNA, 22 bp, Homo sapiens
ggggactctgcttctgggatca

SEQ ID NO: 7205810 - DNA, 22 bp, Homo sapiens
ggggacctggccacccatcctt

SEQ ID NO: 7205811 - DNA, 22 bp, Homo sapiens
ggggactgccttccacagacac

SEQ ID NO: 7205812 - DNA, 19 bp, Homo sapiens
ggggagaactagagacagc

SEQ ID NO: 7205813 - DNA, 19 bp, Homo sapiens
ggggagaactagagacagc

SEQ ID NO: 7205814 - DNA, 22 bp, Homo sapiens
ggggactgaggcactgaaggtg

SEQ ID NO: 7205815 - DNA, 22 bp, Homo sapiens
ggggactgaggcactgaaggtg

SEQ ID NO: 7205816 - DNA, 22 bp, Homo sapiens
gggggctgaggctgttctgagg

SEQ ID NO: 7205817 - DNA, 22 bp, Homo sapiens
gggggctctgactccctcagct

SEQ ID NO: 7205818 - DNA, 22 bp, Homo sapiens
gggggctgaggctgttctgagg

SEQ ID NO: 7205819 - DNA, 22 bp, Homo sapiens
gggggctgaggctgttctgagg

SEQ ID NO: 7205820 - DNA, 22 bp, Homo sapiens
gggggctcctcccagctgccag

SEQ ID NO: 7205821 - DNA, 22 bp, Homo sapiens
gggggctctgactccctcagct

SEQ ID NO: 7205822 - DNA, 22 bp, Homo sapiens
gggggctctgactccctcagct

SEQ ID NO: 7205823 - DNA, 22 bp, Homo sapiens
gggggctccaggcgagaatgtg

SEQ ID NO: 7205824 - DNA, 22 bp, Homo sapiens
gggggctccaggcgagaatgtg

SEQ ID NO: 7205825 - DNA, 22 bp, Homo sapiens
gggggctcctcccagctgccag

SEQ ID NO: 7205826 - DNA, 22 bp, Homo sapiens
gggggctcctcccagctgccag

SEQ ID NO: 7205827 - DNA, 22 bp, Homo sapiens
gggggctcctcccagctgccag

SEQ ID NO: 7205828 - DNA, 22 bp, Homo sapiens
gggggctgtcctgtgcattgta

SEQ ID NO: 7205829 - DNA, 23 bp, Homo sapiens
gggggctggttgactctctgcag

SEQ ID NO: 7205830 - DNA, 23 bp, Homo sapiens
gggggctggttgactctctgcag

SEQ ID NO: 7205831 - DNA, 22 bp, Homo sapiens
gggggctgtcctgtgcattgta

SEQ ID NO: 7205832 - DNA, 22 bp, Homo sapiens
gggggctgtcctgtgcattgta

SEQ ID NO: 7205833 - DNA, 22 bp, Homo sapiens
gggggctgtcctgtgcattgta

SEQ ID NO: 7205834 - DNA, 22 bp, Homo sapiens
gggggctgtcctgtgcattgta

SEQ ID NO: 7205835 - DNA, 22 bp, Homo sapiens
gggggcttggcccggtctggtt

SEQ ID NO: 7205836 - DNA, 22 bp, Homo sapiens
gggggctggactttcccacaca

SEQ ID NO: 7205837 - DNA, 22 bp, Homo sapiens
gggggctggactttcccacaca

SEQ ID NO: 7205838 - DNA, 22 bp, Homo sapiens
gggggctggactttcccacaca

SEQ ID NO: 7205839 - DNA, 23 bp, Homo sapiens
gggggctggttgactctctgcag

SEQ ID NO: 7205840 - DNA, 23 bp, Homo sapiens
gggggctggttgactctctgcag

SEQ ID NO: 7205841 - DNA, 22 bp, Homo sapiens
gggggctggaatatccatcaac

SEQ ID NO: 7205842 - DNA, 22 bp, Homo sapiens
gggggctggactttcccacaca

SEQ ID NO: 7205843 - DNA, 22 bp, Homo sapiens
gggggctggaatatccatcaac

SEQ ID NO: 7205844 - DNA, 22 bp, Homo sapiens
gggggctggaatatccatcaac

SEQ ID NO: 7205845 - DNA, 22 bp, Homo sapiens
gggggctggaatatccatcaac

SEQ ID NO: 7205846 - DNA, 22 bp, Homo sapiens
gggggctggaatatccatcaac

SEQ ID NO: 7205847 - DNA, 22 bp, Homo sapiens
gggggctgatcatttactgggc

SEQ ID NO: 7205848 - DNA, 22 bp, Homo sapiens
gggggctgaggctgttctgagg

SEQ ID NO: 7205849 - DNA, 22 bp, Homo sapiens
gggggtgacgatggcagctggt

SEQ ID NO: 7205850 - DNA, 22 bp, Homo sapiens
gggggtgacgatggcagctggt

SEQ ID NO: 7205851 - DNA, 22 bp, Homo sapiens
gggggtgacgatggcagctggt

SEQ ID NO: 7205852 - DNA, 22 bp, Homo sapiens
ggggggtgctgatcagtggagc

SEQ ID NO: 7205853 - DNA, 22 bp, Homo sapiens
ggggggtgctgatcagtggagc

SEQ ID NO: 7205854 - DNA, 22 bp, Homo sapiens
ggggggtgctgatcagtggagc

SEQ ID NO: 7205855 - DNA, 22 bp, Homo sapiens
ggggggtgctgatcagtggagc

SEQ ID NO: 7205856 - DNA, 22 bp, Homo sapiens
ggggggtgacaagtagaggttg

SEQ ID NO: 7205857 - DNA, 20 bp, Homo sapiens
ggggggcttcagggcctgtg

SEQ ID NO: 7205858 - DNA, 20 bp, Homo sapiens
ggggggcttcagggcctgtg

SEQ ID NO: 7205859 - DNA, 20 bp, Homo sapiens
ggggggcttcagggcctgtg

SEQ ID NO: 7205860 - DNA, 20 bp, Homo sapiens
ggggggcttcagggcctgtg

SEQ ID NO: 7205861 - DNA, 22 bp, Homo sapiens
ggggggcagctgtcctggccat

SEQ ID NO: 7205862 - DNA, 22 bp, Homo sapiens
ggggggcagctgtcctggccat

SEQ ID NO: 7205863 - DNA, 22 bp, Homo sapiens
ggggggctgttctggacaggaa

SEQ ID NO: 7205864 - DNA, 22 bp, Homo sapiens
ggggggctgttctggacaggaa

SEQ ID NO: 7205865 - DNA, 22 bp, Homo sapiens
ggggggctgttctggacaggaa

SEQ ID NO: 7205866 - DNA, 16 bp, Homo sapiens
gggggtgagagagagt

SEQ ID NO: 7205867 - DNA, 22 bp, Homo sapiens
gggggtgagcctgccaggccca

SEQ ID NO: 7205868 - DNA, 22 bp, Homo sapiens
gggggtgagcctgccaggccca

SEQ ID NO: 7205869 - DNA, 22 bp, Homo sapiens
gggggtgaggacaggagcactg

SEQ ID NO: 7205870 - DNA, 22 bp, Homo sapiens
gggggtgaggacaggagcactg

SEQ ID NO: 7205871 - DNA, 22 bp, Homo sapiens
gggggtggttctaagtcctata

SEQ ID NO: 7205872 - DNA, 22 bp, Homo sapiens
gggggtggttctaagtcctata

SEQ ID NO: 7205873 - DNA, 22 bp, Homo sapiens
gggggtggttctaagtcctata

SEQ ID NO: 7205874 - DNA, 22 bp, Homo sapiens
gggggtggttctaagtcctata

SEQ ID NO: 7205875 - DNA, 22 bp, Homo sapiens
gggggtggttctaagtcctata

SEQ ID NO: 7205876 - DNA, 22 bp, Homo sapiens
gggggtttctgggctgagcaga

SEQ ID NO: 7205877 - DNA, 22 bp, Homo sapiens
ggggtactggctggagccccac

SEQ ID NO: 7205878 - DNA, 22 bp, Homo sapiens
ggggtactggctggagccccac

SEQ ID NO: 7205879 - DNA, 22 bp, Homo sapiens
ggggtactggctggagccccac

SEQ ID NO: 7205880 - DNA, 22 bp, Homo sapiens
ggggtaggcaggtgatctgatc

SEQ ID NO: 7205881 - DNA, 20 bp, Homo sapiens
gggtccaggactctgaattt

SEQ ID NO: 7205882 - DNA, 22 bp, Homo sapiens
gggtccaggcgtggcccagatg

SEQ ID NO: 7205883 - DNA, 22 bp, Homo sapiens
gggtccaggcgtggcccagatg

SEQ ID NO: 7205884 - DNA, 22 bp, Homo sapiens
gggtccagggccagtggctgag

SEQ ID NO: 7205885 - DNA, 22 bp, Homo sapiens
gggtgggaacaggatgccagga

SEQ ID NO: 7205886 - DNA, 22 bp, Homo sapiens
gggtgggaacaggatgccagga

SEQ ID NO: 7205887 - DNA, 22 bp, Homo sapiens
gggtgggaacaggatgccagga

SEQ ID NO: 7205888 - DNA, 22 bp, Homo sapiens
gggtgggaaggctaagggattg

SEQ ID NO: 7205889 - DNA, 22 bp, Homo sapiens
gggtgggatgccgctgtctcca

SEQ ID NO: 7205890 - DNA, 22 bp, Homo sapiens
gggtgaggagctgccagtcatg

SEQ ID NO: 7205891 - DNA, 22 bp, Homo sapiens
gggtgaggagctgccagtcatg

SEQ ID NO: 7205892 - DNA, 20 bp, Homo sapiens
gggtgagatgtaggagaggg

SEQ ID NO: 7205893 - DNA, 20 bp, Homo sapiens
gggtgagatgtaggagaggg

SEQ ID NO: 7205894 - DNA, 22 bp, Homo sapiens
gggtgaggagctgccagtcatg

SEQ ID NO: 7205895 - DNA, 22 bp, Homo sapiens
gggtgaggagctgccagtcatg

SEQ ID NO: 7205896 - DNA, 22 bp, Homo sapiens
gggtggctgagaacaggacccc

SEQ ID NO: 7205897 - DNA, 22 bp, Homo sapiens
gggtgggatggcaggagccgct

SEQ ID NO: 7205898 - DNA, 22 bp, Homo sapiens
gggtgggatggcaggagccgct

SEQ ID NO: 7205899 - DNA, 17 bp, Homo sapiens
gggtgggcactgctggc

SEQ ID NO: 7205900 - DNA, 17 bp, Homo sapiens
gggtgggcactgctggc

SEQ ID NO: 7205901 - DNA, 17 bp, Homo sapiens
gggtgggcactgctggc

SEQ ID NO: 7205902 - DNA, 17 bp, Homo sapiens
gggtgggcactgctggc

SEQ ID NO: 7205903 - DNA, 23 bp, Homo sapiens
gggtgggccaaattaggtagcct

SEQ ID NO: 7205904 - DNA, 23 bp, Homo sapiens
gggtgggccaaattaggtagcct

SEQ ID NO: 7205905 - DNA, 23 bp, Homo sapiens
gggtgggccaaattaggtagcct

SEQ ID NO: 7205906 - DNA, 23 bp, Homo sapiens
gggtgggccaaattaggtagcct

SEQ ID NO: 7205907 - DNA, 23 bp, Homo sapiens
gggtgggccaaattaggtagcct

SEQ ID NO: 7205908 - DNA, 22 bp, Homo sapiens
gggtgggccactgagcagcgtg

SEQ ID NO: 7205909 - DNA, 22 bp, Homo sapiens
gggtgggccactgagcagcgtg

SEQ ID NO: 7205910 - DNA, 22 bp, Homo sapiens
gggtgggccactgagcagcgtg

SEQ ID NO: 7205911 - DNA, 22 bp, Homo sapiens
gggtgggcccagcccagagaag

SEQ ID NO: 7205912 - DNA, 22 bp, Homo sapiens
gggtgggcccagcccagagaag

SEQ ID NO: 7205913 - DNA, 22 bp, Homo sapiens
gggtgggcccagcccagagaag

SEQ ID NO: 7205914 - DNA, 22 bp, Homo sapiens
gggtgggccccaggtatctgta

SEQ ID NO: 7205915 - DNA, 22 bp, Homo sapiens
gggtgggccccaggtatctgta

SEQ ID NO: 7205916 - DNA, 22 bp, Homo sapiens
gggtgggcctgtctggccatgt

SEQ ID NO: 7205917 - DNA, 22 bp, Homo sapiens
gggtgggcctgtctggccatgt

SEQ ID NO: 7205918 - DNA, 22 bp, Homo sapiens
gggtgggcctgtctggccatgt

SEQ ID NO: 7205919 - DNA, 22 bp, Homo sapiens
gggtgggcctgtctggccatgt

SEQ ID NO: 7205920 - DNA, 22 bp, Homo sapiens
gggtctggcatgctgagatgga

SEQ ID NO: 7205921 - DNA, 22 bp, Homo sapiens
gggtctggcatgctgagatgga

SEQ ID NO: 7205922 - DNA, 22 bp, Homo sapiens
gggtctggcatgctgagatgga

SEQ ID NO: 7205923 - DNA, 22 bp, Homo sapiens
gggtctggcatgctgagatgga

SEQ ID NO: 7205924 - DNA, 22 bp, Homo sapiens
gggtgaagctcctgcaggggcc

SEQ ID NO: 7205925 - DNA, 22 bp, Homo sapiens
gggtctggcatgctgagatgga

SEQ ID NO: 7205926 - DNA, 22 bp, Homo sapiens
gggtctgggcaggcgcttcctc

SEQ ID NO: 7205927 - DNA, 20 bp, Homo sapiens
gggtgagatgtaggagaggg

SEQ ID NO: 7205928 - DNA, 22 bp, Homo sapiens
gggtgagagtcaggcagagatt

SEQ ID NO: 7205929 - DNA, 20 bp, Homo sapiens
gggtgagatgtaggagaggg

SEQ ID NO: 7205930 - DNA, 22 bp, Homo sapiens
gggtgagacagaaagagcaaaa

SEQ ID NO: 7205931 - DNA, 22 bp, Homo sapiens
gggtgagacagaaagagcaaaa

SEQ ID NO: 7205932 - DNA, 22 bp, Homo sapiens
gggtgaagctcctgcaggggcc

SEQ ID NO: 7205933 - DNA, 22 bp, Homo sapiens
gggtgaaccagagctgttttct

SEQ ID NO: 7205934 - DNA, 22 bp, Homo sapiens
gggtgacatagtgatggggcat

SEQ ID NO: 7205935 - DNA, 22 bp, Homo sapiens
gggtgacattaggaagatagac

SEQ ID NO: 7205936 - DNA, 22 bp, Homo sapiens
gggtctcctaatggaggatgac

SEQ ID NO: 7205937 - DNA, 22 bp, Homo sapiens
gggtctgcctgctgtgaagtca

SEQ ID NO: 7205938 - DNA, 22 bp, Homo sapiens
gggtctgctccacctgcagccc

SEQ ID NO: 7205939 - DNA, 22 bp, Homo sapiens
gggtctggacggctgcaggaag

SEQ ID NO: 7205940 - DNA, 22 bp, Homo sapiens
gggtctggacggctgcaggaag

SEQ ID NO: 7205941 - DNA, 22 bp, Homo sapiens
gggtctggacggctgcaggaag

SEQ ID NO: 7205942 - DNA, 22 bp, Homo sapiens
gggtctggacggctgcaggaag

SEQ ID NO: 7205943 - DNA, 22 bp, Homo sapiens
gggtctggacggctgcaggaag

SEQ ID NO: 7205944 - DNA, 22 bp, Homo sapiens
gggtctggacggctgcaggaag

SEQ ID NO: 7205945 - DNA, 22 bp, Homo sapiens
gggtctggacggctgcaggaag

SEQ ID NO: 7205946 - DNA, 22 bp, Homo sapiens
gggtctggacggctgcaggaag

SEQ ID NO: 7205947 - DNA, 22 bp, Homo sapiens
gggtctggagatccgggtgaag

SEQ ID NO: 7205948 - DNA, 22 bp, Homo sapiens
gggtctggagatccgggtgaag

SEQ ID NO: 7205949 - DNA, 22 bp, Homo sapiens
gggtctggagatccgggtgaag

SEQ ID NO: 7205950 - DNA, 22 bp, Homo sapiens
gggctgagacgatggggtcttc

SEQ ID NO: 7205951 - DNA, 22 bp, Homo sapiens
gggctgagacgatggggtcttc

SEQ ID NO: 7205952 - DNA, 22 bp, Homo sapiens
gggctgagacgatggggtcttc

SEQ ID NO: 7205953 - DNA, 22 bp, Homo sapiens
gggctgagagctggaatctgag

SEQ ID NO: 7205954 - DNA, 22 bp, Homo sapiens
gggctgagacgatggggtcttc

SEQ ID NO: 7205955 - DNA, 22 bp, Homo sapiens
gggctgagacgatggggtcttc

SEQ ID NO: 7205956 - DNA, 22 bp, Homo sapiens
gggctgagacgatggggtcttc

SEQ ID NO: 7205957 - DNA, 22 bp, Homo sapiens
gggctgagacgatggggtcttc

SEQ ID NO: 7205958 - DNA, 22 bp, Homo sapiens
gggctgagaattcagctttcct

SEQ ID NO: 7205959 - DNA, 22 bp, Homo sapiens
gggctgagaattcagctttcct

SEQ ID NO: 7205960 - DNA, 22 bp, Homo sapiens
gggctgagaattcagctttcct

SEQ ID NO: 7205961 - DNA, 22 bp, Homo sapiens
gggctctgtgttctagctctcg

SEQ ID NO: 7205962 - DNA, 22 bp, Homo sapiens
gggctgagaagttgatcccaag

SEQ ID NO: 7205963 - DNA, 22 bp, Homo sapiens
gggctgagaattcagctttcct

SEQ ID NO: 7205964 - DNA, 22 bp, Homo sapiens
gggctgagaattcagctttcct

SEQ ID NO: 7205965 - DNA, 22 bp, Homo sapiens
gggctgagaagttgatcccaag

SEQ ID NO: 7205966 - DNA, 22 bp, Homo sapiens
gggctctgtggcttccttctta

SEQ ID NO: 7205967 - DNA, 22 bp, Homo sapiens
gggctctgtggcttccttctta

SEQ ID NO: 7205968 - DNA, 22 bp, Homo sapiens
gggctctgtggttgtgctttgt

SEQ ID NO: 7205969 - DNA, 22 bp, Homo sapiens
gggctctgtggttgtgctttgt

SEQ ID NO: 7205970 - DNA, 22 bp, Homo sapiens
gggctctgtgttctagctctcg

SEQ ID NO: 7205971 - DNA, 22 bp, Homo sapiens
gggctctgtgttctagctctcg

SEQ ID NO: 7205972 - DNA, 22 bp, Homo sapiens
gggctgagagctggaatctgag

SEQ ID NO: 7205973 - DNA, 22 bp, Homo sapiens
gggctgctgtgttcctgaggca

SEQ ID NO: 7205974 - DNA, 22 bp, Homo sapiens
gggctgcttcctggggaatgct

SEQ ID NO: 7205975 - DNA, 22 bp, Homo sapiens
gggctgcttgctggagacagac

SEQ ID NO: 7205976 - DNA, 22 bp, Homo sapiens
gggctgcttgctggagacagac

SEQ ID NO: 7205977 - DNA, 22 bp, Homo sapiens
gggctgcttgctggagacagac

SEQ ID NO: 7205978 - DNA, 22 bp, Homo sapiens
gggctgcttgctggagacagac

SEQ ID NO: 7205979 - DNA, 22 bp, Homo sapiens
gggctgcttgctggagacagac

SEQ ID NO: 7205980 - DNA, 22 bp, Homo sapiens
gggctgcttggaggaggcgctc

SEQ ID NO: 7205981 - DNA, 22 bp, Homo sapiens
gggctgcttggaggaggcgctc

SEQ ID NO: 7205982 - DNA, 22 bp, Homo sapiens
gggctgcttggaggaggcgctc

SEQ ID NO: 7205983 - DNA, 22 bp, Homo sapiens
gggctgcttggaggaggcgctc

SEQ ID NO: 7205984 - DNA, 22 bp, Homo sapiens
gggctgcttttaagggtctcag

SEQ ID NO: 7205985 - DNA, 22 bp, Homo sapiens
gggctgcttttttcttagcaga

SEQ ID NO: 7205986 - DNA, 22 bp, Homo sapiens
gggctgcttttttcttagcaga

SEQ ID NO: 7205987 - DNA, 22 bp, Homo sapiens
gggctgcttttttcttagcaga

SEQ ID NO: 7205988 - DNA, 22 bp, Homo sapiens
gggctggaaaaacaacatacaa

SEQ ID NO: 7205989 - DNA, 22 bp, Homo sapiens
gggctggaagacaggaaatgct

SEQ ID NO: 7205990 - DNA, 22 bp, Homo sapiens
gggctggaagacaggaaatgct

SEQ ID NO: 7205991 - DNA, 22 bp, Homo sapiens
gggctggaagacaggaaatgct

SEQ ID NO: 7205992 - DNA, 22 bp, Homo sapiens
gggctggaagacaggaaatgct

SEQ ID NO: 7205993 - DNA, 22 bp, Homo sapiens
gggctggaagtgcattgatgct

SEQ ID NO: 7205994 - DNA, 22 bp, Homo sapiens
gggctggaagtgcattgatgct

SEQ ID NO: 7205995 - DNA, 22 bp, Homo sapiens
gggctggacatctaaggtagct

SEQ ID NO: 7205996 - DNA, 22 bp, Homo sapiens
gggctggacatctaaggtagct

SEQ ID NO: 7205997 - DNA, 22 bp, Homo sapiens
gggctggacatctaaggtagct

SEQ ID NO: 7205998 - DNA, 22 bp, Homo sapiens
gggctggacatctaaggtagct

SEQ ID NO: 7205999 - DNA, 22 bp, Homo sapiens
gggctggacatctaaggtagct

SEQ ID NO: 7206000 - DNA, 21 bp, Homo sapiens
gggctggacatggtggctcat

SEQ ID NO: 7206001 - DNA, 22 bp, Homo sapiens
gggctctgtggatgtgagagct

SEQ ID NO: 7206002 - DNA, 22 bp, Homo sapiens
gggctctgtggatgtgagagct

SEQ ID NO: 7206003 - DNA, 22 bp, Homo sapiens
gggctctgtggcttccttctta

SEQ ID NO: 7206004 - DNA, 22 bp, Homo sapiens
gggctctgtggatgtgagagct

SEQ ID NO: 7206005 - DNA, 22 bp, Homo sapiens
gggctctgtccattccttcata

SEQ ID NO: 7206006 - DNA, 22 bp, Homo sapiens
gggctctgtgcaccccagcacc

SEQ ID NO: 7206007 - DNA, 22 bp, Homo sapiens
gggctctgtgcaccccagcacc

SEQ ID NO: 7206008 - DNA, 22 bp, Homo sapiens
gggctctgtgcaccccagcacc

SEQ ID NO: 7206009 - DNA, 22 bp, Homo sapiens
gggctctgtgcaccccagcacc

SEQ ID NO: 7206010 - DNA, 22 bp, Homo sapiens
gggctctgtgcaccccagcacc

SEQ ID NO: 7206011 - DNA, 22 bp, Homo sapiens
gggctctggtacttcctggctc

SEQ ID NO: 7206012 - DNA, 22 bp, Homo sapiens
gggctctggtacttcctggctc

SEQ ID NO: 7206013 - DNA, 22 bp, Homo sapiens
gggctctggtcctgaactgaag

SEQ ID NO: 7206014 - DNA, 22 bp, Homo sapiens
gggctctggtcctgaactgaag

SEQ ID NO: 7206015 - DNA, 22 bp, Homo sapiens
gggctctggtcctgaactgaag

SEQ ID NO: 7206016 - DNA, 22 bp, Homo sapiens
gggctctggtcctgaactgaag

SEQ ID NO: 7206017 - DNA, 22 bp, Homo sapiens
gggctctggtcctgaactgaag

SEQ ID NO: 7206018 - DNA, 22 bp, Homo sapiens
gggctctggtgccttcacagaa

SEQ ID NO: 7206019 - DNA, 22 bp, Homo sapiens
gggctctggtgccttcacagaa

SEQ ID NO: 7206020 - DNA, 22 bp, Homo sapiens
gggctctggtgctattgacgaa

SEQ ID NO: 7206021 - DNA, 20 bp, Homo sapiens
gggctctgtaaggttgaaag

SEQ ID NO: 7206022 - DNA, 20 bp, Homo sapiens
gggctctgtaaggttgaaag

SEQ ID NO: 7206023 - DNA, 22 bp, Homo sapiens
gggctctgtccattccttcata

SEQ ID NO: 7206024 - DNA, 22 bp, Homo sapiens
gggctctggtacttcctggctc

SEQ ID NO: 7206025 - DNA, 22 bp, Homo sapiens
gggctctggggtgccctggcat

SEQ ID NO: 7206026 - DNA, 22 bp, Homo sapiens
gggctctgggtcgtgtctccat

SEQ ID NO: 7206027 - DNA, 22 bp, Homo sapiens
gggctctgggtcgtgtctccat

SEQ ID NO: 7206028 - DNA, 22 bp, Homo sapiens
gggctctgggtcgtgtctccat

SEQ ID NO: 7206029 - DNA, 22 bp, Homo sapiens
gggctaggcttggccagcactg

SEQ ID NO: 7206030 - DNA, 22 bp, Homo sapiens
gggctagcctcttccctgctcc

SEQ ID NO: 7206031 - DNA, 22 bp, Homo sapiens
gggctagcctcttccctgctcc

SEQ ID NO: 7206032 - DNA, 22 bp, Homo sapiens
gggctagcctcttccctgctcc

SEQ ID NO: 7206033 - DNA, 20 bp, Homo sapiens
gggctagaccagggcagagg

SEQ ID NO: 7206034 - DNA, 22 bp, Homo sapiens
gggctagcctcttccctgctcc

SEQ ID NO: 7206035 - DNA, 22 bp, Homo sapiens
gggctagcctcttccctgctcc

SEQ ID NO: 7206036 - DNA, 22 bp, Homo sapiens
gggctagcctcttccctgctcc

SEQ ID NO: 7206037 - DNA, 22 bp, Homo sapiens
ggggaagggagtccaagtgtta

SEQ ID NO: 7206038 - DNA, 22 bp, Homo sapiens
ggggaagggagtccaagtgtta

SEQ ID NO: 7206039 - DNA, 16 bp, Homo sapiens
ggggaaggcaagaggg

SEQ ID NO: 7206040 - DNA, 16 bp, Homo sapiens
ggggaaggcaagaggg

SEQ ID NO: 7206041 - DNA, 22 bp, Homo sapiens
ggggaagggagtccaagtgtta

SEQ ID NO: 7206042 - DNA, 22 bp, Homo sapiens
ggggaagggagtccaagtgtta

SEQ ID NO: 7206043 - DNA, 22 bp, Homo sapiens
ggggaaggattgagttgaccca

SEQ ID NO: 7206044 - DNA, 22 bp, Homo sapiens
ggggaaggattgagttgaccca

SEQ ID NO: 7206045 - DNA, 22 bp, Homo sapiens
ggggaaggattgagttgaccca

SEQ ID NO: 7206046 - DNA, 22 bp, Homo sapiens
ggggaaggattgagttgaccca

SEQ ID NO: 7206047 - DNA, 22 bp, Homo sapiens
ggggaaggattgagttgaccca

SEQ ID NO: 7206048 - DNA, 16 bp, Homo sapiens
ggggaaggcaagaggg

SEQ ID NO: 7206049 - DNA, 16 bp, Homo sapiens
ggggaaggcaagaggg

SEQ ID NO: 7206050 - DNA, 16 bp, Homo sapiens
ggggaaggcaagaggg

SEQ ID NO: 7206051 - DNA, 16 bp, Homo sapiens
ggggaaggcaagaggg

SEQ ID NO: 7206052 - DNA, 23 bp, Homo sapiens
ggggaagtggcagtgagtgaggc

SEQ ID NO: 7206053 - DNA, 22 bp, Homo sapiens
ggggaagggagtccaagtgtta

SEQ ID NO: 7206054 - DNA, 23 bp, Homo sapiens
ggggaagtggcagtgagtgaggc

SEQ ID NO: 7206055 - DNA, 22 bp, Homo sapiens
ggggaatgagtgcccagaaagc

SEQ ID NO: 7206056 - DNA, 23 bp, Homo sapiens
ggggacagagggcagcccgcatc

SEQ ID NO: 7206057 - DNA, 23 bp, Homo sapiens
ggggacagagggcagcccgcatc

SEQ ID NO: 7206058 - DNA, 23 bp, Homo sapiens
ggggacagagggcagcccgcatc

SEQ ID NO: 7206059 - DNA, 23 bp, Homo sapiens
ggggacagagggcagcccgcatc

SEQ ID NO: 7206060 - DNA, 23 bp, Homo sapiens
ggggacagagggcagcccgcatc

SEQ ID NO: 7206061 - DNA, 23 bp, Homo sapiens
ggggacagagggcagcccgcatc

SEQ ID NO: 7206062 - DNA, 22 bp, Homo sapiens
ggggacagtcgatctagtgatt

SEQ ID NO: 7206063 - DNA, 22 bp, Homo sapiens
ggggacagtcgatctagtgatt

SEQ ID NO: 7206064 - DNA, 22 bp, Homo sapiens
ggggacagtcgatctagtgatt

SEQ ID NO: 7206065 - DNA, 22 bp, Homo sapiens
ggggacagtcgatctagtgatt

SEQ ID NO: 7206066 - DNA, 22 bp, Homo sapiens
ggggacagtcgatctagtgatt

SEQ ID NO: 7206067 - DNA, 22 bp, Homo sapiens
ggggacagttaaagaccaagac

SEQ ID NO: 7206068 - DNA, 22 bp, Homo sapiens
ggggacagttaaagaccaagac

SEQ ID NO: 7206069 - DNA, 22 bp, Homo sapiens
ggggacagttaaagaccaagac

SEQ ID NO: 7206070 - DNA, 22 bp, Homo sapiens
ggggacagtcgatctagtgatt

SEQ ID NO: 7206071 - DNA, 22 bp, Homo sapiens
ggggacagtcgatctagtgatt

SEQ ID NO: 7206072 - DNA, 22 bp, Homo sapiens
ggggacagttaaagaccaagac

SEQ ID NO: 7206073 - DNA, 23 bp, Homo sapiens
ggggacagttcccactggggtct

SEQ ID NO: 7206074 - DNA, 23 bp, Homo sapiens
ggggacagttcccactggggtct

SEQ ID NO: 7206075 - DNA, 23 bp, Homo sapiens
ggggacagttcccactggggtct

SEQ ID NO: 7206076 - DNA, 23 bp, Homo sapiens
ggggacagttcccactggggtct

SEQ ID NO: 7206077 - DNA, 23 bp, Homo sapiens
ggggacagttcccactggggtct

SEQ ID NO: 7206078 - DNA, 23 bp, Homo sapiens
ggggacagttcccactggggtct

SEQ ID NO: 7206079 - DNA, 23 bp, Homo sapiens
ggggacagttcccactggggtct

SEQ ID NO: 7206080 - DNA, 20 bp, Homo sapiens
ggggacccagaatcacagct

SEQ ID NO: 7206081 - DNA, 22 bp, Homo sapiens
ggggaccctcaggactgcgtct

SEQ ID NO: 7206082 - DNA, 22 bp, Homo sapiens
ggggaccctcaggactgcgtct

SEQ ID NO: 7206083 - DNA, 22 bp, Homo sapiens
ggggaccctcaggactgcgtct

SEQ ID NO: 7206084 - DNA, 22 bp, Homo sapiens
gggctggcaggacctgggctga

SEQ ID NO: 7206085 - DNA, 22 bp, Homo sapiens
gggctggcaggacctgggctga

SEQ ID NO: 7206086 - DNA, 22 bp, Homo sapiens
gggctggcaggacctgggctga

SEQ ID NO: 7206087 - DNA, 22 bp, Homo sapiens
gggctggcaggacctgggctga

SEQ ID NO: 7206088 - DNA, 22 bp, Homo sapiens
gggctggcaggacctgggctga

SEQ ID NO: 7206089 - DNA, 22 bp, Homo sapiens
gggctggcaggacctgggctga

SEQ ID NO: 7206090 - DNA, 22 bp, Homo sapiens
gggctggcatcagttgccgaga

SEQ ID NO: 7206091 - DNA, 22 bp, Homo sapiens
gggctggcatcggttgctgaga

SEQ ID NO: 7206092 - DNA, 22 bp, Homo sapiens
gggctggatgtttgatgacgaa

SEQ ID NO: 7206093 - DNA, 22 bp, Homo sapiens
gggctggatgtttgatgacgaa

SEQ ID NO: 7206094 - DNA, 22 bp, Homo sapiens
gggctggatgggagccttggcc

SEQ ID NO: 7206095 - DNA, 22 bp, Homo sapiens
gggctggattactgaactgagt

SEQ ID NO: 7206096 - DNA, 22 bp, Homo sapiens
gggctggattactgaactgagt

SEQ ID NO: 7206097 - DNA, 22 bp, Homo sapiens
gggctggatctcctgcaggcag

SEQ ID NO: 7206098 - DNA, 22 bp, Homo sapiens
gggctggatgggagccttggcc

SEQ ID NO: 7206099 - DNA, 22 bp, Homo sapiens
gggctggagcctggcggtggtt

SEQ ID NO: 7206100 - DNA, 22 bp, Homo sapiens
gggctggagcctggcggtggtt

SEQ ID NO: 7206101 - DNA, 22 bp, Homo sapiens
gggctggagcctggcggtggtt

SEQ ID NO: 7206102 - DNA, 22 bp, Homo sapiens
gggctggagcctggcggtggtt

SEQ ID NO: 7206103 - DNA, 22 bp, Homo sapiens
gggctggagcctggcggtggtt

SEQ ID NO: 7206104 - DNA, 22 bp, Homo sapiens
gggctggagccagctgtggctg

SEQ ID NO: 7206105 - DNA, 22 bp, Homo sapiens
gggctggagccagctgtggctg

SEQ ID NO: 7206106 - DNA, 22 bp, Homo sapiens
gggctggagccagctgtggctg

SEQ ID NO: 7206107 - DNA, 22 bp, Homo sapiens
gggctggagacaagtgagccgc

SEQ ID NO: 7206108 - DNA, 22 bp, Homo sapiens
gggctggagacaagtgagccgc

SEQ ID NO: 7206109 - DNA, 22 bp, Homo sapiens
gggctggagacaagtgagccgc

SEQ ID NO: 7206110 - DNA, 22 bp, Homo sapiens
gggctggagagtcccacgtggg

SEQ ID NO: 7206111 - DNA, 22 bp, Homo sapiens
gggctggagagtcccacgtggg

SEQ ID NO: 7206112 - DNA, 16 bp, Homo sapiens
gggctggagatacagt

SEQ ID NO: 7206113 - DNA, 21 bp, Homo sapiens
gggctggacatggtggctcat

SEQ ID NO: 7206114 - DNA, 22 bp, Homo sapiens
gggctggaccgcgacccctgag

SEQ ID NO: 7206115 - DNA, 22 bp, Homo sapiens
gggctggaccgctcgcctccct

SEQ ID NO: 7206116 - DNA, 22 bp, Homo sapiens
gggatggctttgtggctgactc

SEQ ID NO: 7206117 - DNA, 22 bp, Homo sapiens
gggatggctgcctgcatcagga

SEQ ID NO: 7206118 - DNA, 22 bp, Homo sapiens
gggatggctgcctgcatcagga

SEQ ID NO: 7206119 - DNA, 22 bp, Homo sapiens
gggatggctgcctgcatcagga

SEQ ID NO: 7206120 - DNA, 22 bp, Homo sapiens
gggatggctgcctgcatcagga

SEQ ID NO: 7206121 - DNA, 22 bp, Homo sapiens
gggatggctcaaaggagtcagg

SEQ ID NO: 7206122 - DNA, 22 bp, Homo sapiens
gggatggctcaaaggagtcagg

SEQ ID NO: 7206123 - DNA, 22 bp, Homo sapiens
gggatggctcaaaggagtcagg

SEQ ID NO: 7206124 - DNA, 22 bp, Homo sapiens
gggatggatcttggctgaggct

SEQ ID NO: 7206125 - DNA, 22 bp, Homo sapiens
gggatggatcttggctgaggct

SEQ ID NO: 7206126 - DNA, 22 bp, Homo sapiens
gggatggatcttggctgaggct

SEQ ID NO: 7206127 - DNA, 22 bp, Homo sapiens
gggatggactgacggtagcgcg

SEQ ID NO: 7206128 - DNA, 22 bp, Homo sapiens
gggatggactgacggtagcgcg

SEQ ID NO: 7206129 - DNA, 22 bp, Homo sapiens
gggatggacttggggactccag

SEQ ID NO: 7206130 - DNA, 22 bp, Homo sapiens
gggatggacttggggactccag

SEQ ID NO: 7206131 - DNA, 22 bp, Homo sapiens
gggatggagggtagagcaagtg

SEQ ID NO: 7206132 - DNA, 22 bp, Homo sapiens
gggatggagggtagagcaagtg

SEQ ID NO: 7206133 - DNA, 22 bp, Homo sapiens
gggatggagggtagagcaagtg

SEQ ID NO: 7206134 - DNA, 22 bp, Homo sapiens
gggatggagggtagagcaagtg

SEQ ID NO: 7206135 - DNA, 22 bp, Homo sapiens
gggatggatcttggctgaggct

SEQ ID NO: 7206136 - DNA, 22 bp, Homo sapiens
gggatggatcttggctgaggct

SEQ ID NO: 7206137 - DNA, 22 bp, Homo sapiens
gggatggatcttggctgaggct

SEQ ID NO: 7206138 - DNA, 22 bp, Homo sapiens
gggatggatcttggctgaggct

SEQ ID NO: 7206139 - DNA, 22 bp, Homo sapiens
gggatggatcttggctgaggct

SEQ ID NO: 7206140 - DNA, 22 bp, Homo sapiens
gggatggatcttggctgaggct

SEQ ID NO: 7206141 - DNA, 22 bp, Homo sapiens
gggatggggagctggaaagggg

SEQ ID NO: 7206142 - DNA, 22 bp, Homo sapiens
gggatggggagctggaaagggg

SEQ ID NO: 7206143 - DNA, 22 bp, Homo sapiens
gggatggggagctggaaagggg

SEQ ID NO: 7206144 - DNA, 22 bp, Homo sapiens
gggatggggagctggaaagggg

SEQ ID NO: 7206145 - DNA, 22 bp, Homo sapiens
gggatggggagctggaaagggg

SEQ ID NO: 7206146 - DNA, 22 bp, Homo sapiens
gggatggggagctggaaagggg

SEQ ID NO: 7206147 - DNA, 22 bp, Homo sapiens
gggatggggagctggaaagggg

SEQ ID NO: 7206148 - DNA, 22 bp, Homo sapiens
gggatggggagctggaaagggg

SEQ ID NO: 7206149 - DNA, 19 bp, Homo sapiens
gggatgggccctcaccctc

SEQ ID NO: 7206150 - DNA, 22 bp, Homo sapiens
gggatggggagctggaaagggg

SEQ ID NO: 7206151 - DNA, 22 bp, Homo sapiens
gggatggggagctggaaagggg

SEQ ID NO: 7206152 - DNA, 22 bp, Homo sapiens
gggatggctttgtggctgactc

SEQ ID NO: 7206153 - DNA, 22 bp, Homo sapiens
gggatgggagagcatttagaga

SEQ ID NO: 7206154 - DNA, 22 bp, Homo sapiens
gggatggggagctggaaagggg

SEQ ID NO: 7206155 - DNA, 22 bp, Homo sapiens
gggcagaggggcgcttccctct

SEQ ID NO: 7206156 - DNA, 22 bp, Homo sapiens
gggatggggagctggaaagggg

SEQ ID NO: 7206157 - DNA, 22 bp, Homo sapiens
gggcagaggggcgcttccctct

SEQ ID NO: 7206158 - DNA, 22 bp, Homo sapiens
gggcagaggggcgcttccctct

SEQ ID NO: 7206159 - DNA, 22 bp, Homo sapiens
gggcagaggggcgcttccctct

SEQ ID NO: 7206160 - DNA, 22 bp, Homo sapiens
gggagggaaggtacctgtgtga

SEQ ID NO: 7206161 - DNA, 22 bp, Homo sapiens
gggagggaaggtacctgtgtga

SEQ ID NO: 7206162 - DNA, 22 bp, Homo sapiens
gggagggaaggaggcgccgtgt

SEQ ID NO: 7206163 - DNA, 22 bp, Homo sapiens
gggagggaaggaggcgccgtgt

SEQ ID NO: 7206164 - DNA, 22 bp, Homo sapiens
gggagggaaggaggcgccgtgt

SEQ ID NO: 7206165 - DNA, 22 bp, Homo sapiens
gggagggaaggtacctgtgtga

SEQ ID NO: 7206166 - DNA, 22 bp, Homo sapiens
gggagggaaggtacctgtgtga

SEQ ID NO: 7206167 - DNA, 22 bp, Homo sapiens
gggagggaaagcttgatctgtc

SEQ ID NO: 7206168 - DNA, 22 bp, Homo sapiens
gggagggaaagcttgatctgtc

SEQ ID NO: 7206169 - DNA, 22 bp, Homo sapiens
gggagggaaggaccttatgaat

SEQ ID NO: 7206170 - DNA, 22 bp, Homo sapiens
gggagggaaggaccttatgaat

SEQ ID NO: 7206171 - DNA, 22 bp, Homo sapiens
gggagggaaggaccttatgaat

SEQ ID NO: 7206172 - DNA, 22 bp, Homo sapiens
gggagggaaagcttgatctgtc

SEQ ID NO: 7206173 - DNA, 22 bp, Homo sapiens
gggagggaaagcttgatctgtc

SEQ ID NO: 7206174 - DNA, 22 bp, Homo sapiens
gggaggcttgagccatactgcc

SEQ ID NO: 7206175 - DNA, 22 bp, Homo sapiens
gggaggcttgagccatactgcc

SEQ ID NO: 7206176 - DNA, 22 bp, Homo sapiens
gggagggaaagcttgatctgtc

SEQ ID NO: 7206177 - DNA, 22 bp, Homo sapiens
gggagggaaagcttgatctgtc

SEQ ID NO: 7206178 - DNA, 22 bp, Homo sapiens
gggaggctgccatccttcagga

SEQ ID NO: 7206179 - DNA, 22 bp, Homo sapiens
gggaggctggctctggccacag

SEQ ID NO: 7206180 - DNA, 22 bp, Homo sapiens
gggaggctggctctggccacag

SEQ ID NO: 7206181 - DNA, 22 bp, Homo sapiens
gggaggctggctctggccacag

SEQ ID NO: 7206182 - DNA, 22 bp, Homo sapiens
gggaggctggctctggccacag

SEQ ID NO: 7206183 - DNA, 22 bp, Homo sapiens
gggaggcttgagccatactgcc

SEQ ID NO: 7206184 - DNA, 22 bp, Homo sapiens
gggaggcttgagccatactgcc

SEQ ID NO: 7206185 - DNA, 22 bp, Homo sapiens
gggaggcttgagccatactgcc

SEQ ID NO: 7206186 - DNA, 22 bp, Homo sapiens
gggagggaaggtacctgtgtga

SEQ ID NO: 7206187 - DNA, 22 bp, Homo sapiens
gggagggaaggtacctgtgtga

SEQ ID NO: 7206188 - DNA, 22 bp, Homo sapiens
gggatctgagtaggcagaagct

SEQ ID NO: 7206189 - DNA, 22 bp, Homo sapiens
gggatgaggatcaatcagggag

SEQ ID NO: 7206190 - DNA, 22 bp, Homo sapiens
gggatgaggatcaatcagggag

SEQ ID NO: 7206191 - DNA, 19 bp, Homo sapiens
gggatgcactctgaccact

SEQ ID NO: 7206192 - DNA, 22 bp, Homo sapiens
gggatgcagactacagggctta

SEQ ID NO: 7206193 - DNA, 22 bp, Homo sapiens
gggatgaggatcaatcagggag

SEQ ID NO: 7206194 - DNA, 22 bp, Homo sapiens
gggatgcagactacagggctta

SEQ ID NO: 7206195 - DNA, 22 bp, Homo sapiens
gggatgcagtatgtatattttc

SEQ ID NO: 7206196 - DNA, 22 bp, Homo sapiens
gggatgcagtcagagcccctgt

SEQ ID NO: 7206197 - DNA, 22 bp, Homo sapiens
gggatggactgacggtagcgcg

SEQ ID NO: 7206198 - DNA, 22 bp, Homo sapiens
gggatggactgacggtagcgcg

SEQ ID NO: 7206199 - DNA, 22 bp, Homo sapiens
gggacgagatcttggcagtgtg

SEQ ID NO: 7206200 - DNA, 22 bp, Homo sapiens
gggacgagatcttggcagtgtg

SEQ ID NO: 7206201 - DNA, 22 bp, Homo sapiens
gggacgagccccaggctggagg

SEQ ID NO: 7206202 - DNA, 22 bp, Homo sapiens
gggacgacaggctctgtggtag

SEQ ID NO: 7206203 - DNA, 22 bp, Homo sapiens
gggacgacaggctctgtggtag

SEQ ID NO: 7206204 - DNA, 22 bp, Homo sapiens
gggacgagatcttggcagtgtg

SEQ ID NO: 7206205 - DNA, 22 bp, Homo sapiens
gggacgacaggctctgtggtag

SEQ ID NO: 7206206 - DNA, 22 bp, Homo sapiens
gggacgggcacggagggccctc

SEQ ID NO: 7206207 - DNA, 22 bp, Homo sapiens
gggacgagccccaggctggagg

SEQ ID NO: 7206208 - DNA, 22 bp, Homo sapiens
gggacgggcacggagggccctc

SEQ ID NO: 7206209 - DNA, 22 bp, Homo sapiens
gggacgggcagtccaaggggtc

SEQ ID NO: 7206210 - DNA, 22 bp, Homo sapiens
gggacgggcagtccaaggggtc

SEQ ID NO: 7206211 - DNA, 22 bp, Homo sapiens
gggacgggcacggagggccctc

SEQ ID NO: 7206212 - DNA, 22 bp, Homo sapiens
gggacgggcacggagggccctc

SEQ ID NO: 7206213 - DNA, 22 bp, Homo sapiens
gggacgggcacggagggccctc

SEQ ID NO: 7206214 - DNA, 22 bp, Homo sapiens
gggacgggcagtccaaggggtc

SEQ ID NO: 7206215 - DNA, 22 bp, Homo sapiens
gggacgggcagtccaaggggtc

SEQ ID NO: 7206216 - DNA, 22 bp, Homo sapiens
gggacgtgagtgaagaaggtct

SEQ ID NO: 7206217 - DNA, 17 bp, Homo sapiens
gggactcaagatggggt

SEQ ID NO: 7206218 - DNA, 22 bp, Homo sapiens
gggactccagggccactgggcc

SEQ ID NO: 7206219 - DNA, 22 bp, Homo sapiens
gggactccataagcacatggat

SEQ ID NO: 7206220 - DNA, 22 bp, Homo sapiens
gggactccaaaactgtacccaa

SEQ ID NO: 7206221 - DNA, 22 bp, Homo sapiens
gggactccaaaactgtacccaa

SEQ ID NO: 7206222 - DNA, 22 bp, Homo sapiens
gggactccagggccactgggcc

SEQ ID NO: 7206223 - DNA, 22 bp, Homo sapiens
gggagaaggagctagttcttga

SEQ ID NO: 7206224 - DNA, 22 bp, Homo sapiens
gggagaagaatgtgtcaattgt

SEQ ID NO: 7206225 - DNA, 22 bp, Homo sapiens
gggagaagaatgtgtcaattgt

SEQ ID NO: 7206226 - DNA, 22 bp, Homo sapiens
gggagaagaatgtgtcaattgt

SEQ ID NO: 7206227 - DNA, 22 bp, Homo sapiens
gggagaaatgtctggcctgctg

SEQ ID NO: 7206228 - DNA, 22 bp, Homo sapiens
gggagaaatgtctggcctgctg

SEQ ID NO: 7206229 - DNA, 22 bp, Homo sapiens
gggagaactgggtggagcatct

SEQ ID NO: 7206230 - DNA, 22 bp, Homo sapiens
gggacctgcgccactcactgtc

SEQ ID NO: 7206231 - DNA, 22 bp, Homo sapiens
gggacctggcgagggtcacaca

SEQ ID NO: 7206232 - DNA, 22 bp, Homo sapiens
gggacctgccaaggccacccag

SEQ ID NO: 7206233 - DNA, 22 bp, Homo sapiens
gggacctgccattgctcacagg

SEQ ID NO: 7206234 - DNA, 22 bp, Homo sapiens
gggacctgggccagaggacagt

SEQ ID NO: 7206235 - DNA, 22 bp, Homo sapiens
gggacctggtctagcactgagc

SEQ ID NO: 7206236 - DNA, 22 bp, Homo sapiens
gggaccctcaacatctgcttct

SEQ ID NO: 7206237 - DNA, 22 bp, Homo sapiens
gggaccctgggaggctggcgca

SEQ ID NO: 7206238 - DNA, 22 bp, Homo sapiens
gggacctcgcatgcacgaagcc

SEQ ID NO: 7206239 - DNA, 22 bp, Homo sapiens
gggacctgaggccctgctccac

SEQ ID NO: 7206240 - DNA, 22 bp, Homo sapiens
gggaccataactaggcatgatg

SEQ ID NO: 7206241 - DNA, 22 bp, Homo sapiens
gggaccaggtgggtgcattccg

SEQ ID NO: 7206242 - DNA, 22 bp, Homo sapiens
gggaccaggtgggtgcattccg

SEQ ID NO: 7206243 - DNA, 20 bp, Homo sapiens
gggaggcgagggctgagcag

SEQ ID NO: 7206244 - DNA, 20 bp, Homo sapiens
gggaggcgagggctgagcag

SEQ ID NO: 7206245 - DNA, 20 bp, Homo sapiens
gggaggcgagggctgagcag

SEQ ID NO: 7206246 - DNA, 17 bp, Homo sapiens
gggaggccttggtttcc

SEQ ID NO: 7206247 - DNA, 18 bp, Homo sapiens
gggaggccccagcaggag

SEQ ID NO: 7206248 - DNA, 22 bp, Homo sapiens
gggaggcgccgagggtagctaa

SEQ ID NO: 7206249 - DNA, 20 bp, Homo sapiens
gggaggcgagggctgagcag

SEQ ID NO: 7206250 - DNA, 22 bp, Homo sapiens
gggaggctcagtggtgtcctct

SEQ ID NO: 7206251 - DNA, 22 bp, Homo sapiens
gggaggcgccgagggtagctaa

SEQ ID NO: 7206252 - DNA, 22 bp, Homo sapiens
gggaggctcagtggtgtcctct

SEQ ID NO: 7206253 - DNA, 22 bp, Homo sapiens
gggaggctcagtggtgtcctct

SEQ ID NO: 7206254 - DNA, 22 bp, Homo sapiens
gggaggcgccgagggtagctaa

SEQ ID NO: 7206255 - DNA, 22 bp, Homo sapiens
gggaggctcagtggtgtcctct

SEQ ID NO: 7206256 - DNA, 22 bp, Homo sapiens
gggaggctcagtggtgtcctct

SEQ ID NO: 7206257 - DNA, 22 bp, Homo sapiens
gggaggctctgctcagcccccg

SEQ ID NO: 7206258 - DNA, 22 bp, Homo sapiens
gggaggctctgctcagcccccg

SEQ ID NO: 7206259 - DNA, 22 bp, Homo sapiens
gggaggctctgctcagcccccg

SEQ ID NO: 7206260 - DNA, 22 bp, Homo sapiens
gggaggctctgctcagcccccg

SEQ ID NO: 7206261 - DNA, 22 bp, Homo sapiens
gggaggctctgctcagcccccg

SEQ ID NO: 7206262 - DNA, 22 bp, Homo sapiens
gggaggctctgctcagcccccg

SEQ ID NO: 7206263 - DNA, 22 bp, Homo sapiens
gggaggctgccatccttcagga

SEQ ID NO: 7206264 - DNA, 22 bp, Homo sapiens
gggaggctgccatccttcagga

SEQ ID NO: 7206265 - DNA, 22 bp, Homo sapiens
gggaggctgccatccttcagga

SEQ ID NO: 7206266 - DNA, 22 bp, Homo sapiens
gggaggctggctctggccacag

SEQ ID NO: 7206267 - DNA, 22 bp, Homo sapiens
gggaggctgccatccttcagga

SEQ ID NO: 7206268 - DNA, 22 bp, Homo sapiens
gggaggctgccatccttcagga

SEQ ID NO: 7206269 - DNA, 22 bp, Homo sapiens
gggaggagggtgctggctaaac

SEQ ID NO: 7206270 - DNA, 22 bp, Homo sapiens
gggaggaggaatgttttgtgta

SEQ ID NO: 7206271 - DNA, 22 bp, Homo sapiens
gggaggagcttggagattcact

SEQ ID NO: 7206272 - DNA, 22 bp, Homo sapiens
gggaggagcttggagattcact

SEQ ID NO: 7206273 - DNA, 22 bp, Homo sapiens
gggagaagtggaaatctcatta

SEQ ID NO: 7206274 - DNA, 20 bp, Homo sapiens
gggagaagggctgatgagag

SEQ ID NO: 7206275 - DNA, 22 bp, Homo sapiens
gggaggagcttggagattcact

SEQ ID NO: 7206276 - DNA, 20 bp, Homo sapiens
gggagaagggctgatgagag

SEQ ID NO: 7206277 - DNA, 20 bp, Homo sapiens
gggagaagggctgatgagag

SEQ ID NO: 7206278 - DNA, 20 bp, Homo sapiens
gggagaagggctgatgagag

SEQ ID NO: 7206279 - DNA, 20 bp, Homo sapiens
gggagaagggctgatgagag

SEQ ID NO: 7206280 - DNA, 20 bp, Homo sapiens
gggagaagggctgatgagag

SEQ ID NO: 7206281 - DNA, 20 bp, Homo sapiens
gggagaagggctgatgagag

SEQ ID NO: 7206282 - DNA, 22 bp, Homo sapiens
gggagaaggaggactgtgctgt

SEQ ID NO: 7206283 - DNA, 22 bp, Homo sapiens
gggagaaggaggactgtgctgt

SEQ ID NO: 7206284 - DNA, 22 bp, Homo sapiens
gggagaaggaggactgtgctgt

SEQ ID NO: 7206285 - DNA, 22 bp, Homo sapiens
gggagaaggaggactgtgctgt

SEQ ID NO: 7206286 - DNA, 22 bp, Homo sapiens
gggagaaggagctagttcttga

SEQ ID NO: 7206287 - DNA, 22 bp, Homo sapiens
gggagaaggagctagttcttga

SEQ ID NO: 7206288 - DNA, 22 bp, Homo sapiens
gggcagcacagacagtgaaggc

SEQ ID NO: 7206289 - DNA, 22 bp, Homo sapiens
gggcagcacagacagtgaaggc

SEQ ID NO: 7206290 - DNA, 22 bp, Homo sapiens
gggcagcaaatctgagtctggt

SEQ ID NO: 7206291 - DNA, 22 bp, Homo sapiens
gggcagcaaatctgagtctggt

SEQ ID NO: 7206292 - DNA, 18 bp, Homo sapiens
gggcagcacagcagcctc

SEQ ID NO: 7206293 - DNA, 22 bp, Homo sapiens
gggcagcacagacagtgaaggc

SEQ ID NO: 7206294 - DNA, 22 bp, Homo sapiens
gggcagcaaatctgagtctggt

SEQ ID NO: 7206295 - DNA, 22 bp, Homo sapiens
gggcagcaaatctgagtctggt

SEQ ID NO: 7206296 - DNA, 22 bp, Homo sapiens
gggcagatgtctggacacctca

SEQ ID NO: 7206297 - DNA, 22 bp, Homo sapiens
gggcagatggggcacaggctga

SEQ ID NO: 7206298 - DNA, 22 bp, Homo sapiens
gggcagatggggcacaggctga

SEQ ID NO: 7206299 - DNA, 22 bp, Homo sapiens
gggcagaggttcaacttcaaca

SEQ ID NO: 7206300 - DNA, 22 bp, Homo sapiens
gggcagaggggcgcttccctct

SEQ ID NO: 7206301 - DNA, 22 bp, Homo sapiens
gggcagaggggcgcttccctct

SEQ ID NO: 7206302 - DNA, 22 bp, Homo sapiens
gggcagaggttcaacttcaaca

SEQ ID NO: 7206303 - DNA, 22 bp, Homo sapiens
gggcagaggttcaacttcaaca

SEQ ID NO: 7206304 - DNA, 22 bp, Homo sapiens
gggcagatcacctgaggtcagg

SEQ ID NO: 7206305 - DNA, 22 bp, Homo sapiens
gggcagcagaattggacagaaa

SEQ ID NO: 7206306 - DNA, 22 bp, Homo sapiens
gggcagcagaattggacagaaa

SEQ ID NO: 7206307 - DNA, 22 bp, Homo sapiens
gggcagcactcatacctatatt

SEQ ID NO: 7206308 - DNA, 22 bp, Homo sapiens
gggcagcacgtttcaggaggat

SEQ ID NO: 7206309 - DNA, 22 bp, Homo sapiens
gggcagcacgtttcaggaggat

SEQ ID NO: 7206310 - DNA, 22 bp, Homo sapiens
gggcagcacgtttcaggaggat

SEQ ID NO: 7206311 - DNA, 22 bp, Homo sapiens
gggcagcacgtttcaggaggat

SEQ ID NO: 7206312 - DNA, 22 bp, Homo sapiens
gggcagcacgtttcaggaggat

SEQ ID NO: 7206313 - DNA, 21 bp, Homo sapiens
gggcagcacgtcattcctgtg

SEQ ID NO: 7206314 - DNA, 21 bp, Homo sapiens
gggcagcacgtcattcctgtg

SEQ ID NO: 7206315 - DNA, 18 bp, Homo sapiens
gggcagcacagcagcctc

SEQ ID NO: 7206316 - DNA, 21 bp, Homo sapiens
gggcagcacgtcattcctgtg

SEQ ID NO: 7206317 - DNA, 22 bp, Homo sapiens
gggcagcacgtttcaggaggat

SEQ ID NO: 7206318 - DNA, 22 bp, Homo sapiens
gggcagcacgtttcaggaggat

SEQ ID NO: 7206319 - DNA, 22 bp, Homo sapiens
gggcagcacgtttcaggaggat

SEQ ID NO: 7206320 - DNA, 20 bp, Homo sapiens
gggcagcctcgggagtgggt

SEQ ID NO: 7206321 - DNA, 22 bp, Homo sapiens
gggcagccgcgtgacctgccag

SEQ ID NO: 7206322 - DNA, 22 bp, Homo sapiens
gggcagccgcgtgacctgccag

SEQ ID NO: 7206323 - DNA, 20 bp, Homo sapiens
gggcagcctcgggagtgggt

SEQ ID NO: 7206324 - DNA, 20 bp, Homo sapiens
gggcagcctcgggagtgggt

SEQ ID NO: 7206325 - DNA, 20 bp, Homo sapiens
gggcagcctcgggagtgggt

SEQ ID NO: 7206326 - DNA, 20 bp, Homo sapiens
gggcagcctcgggagtgggt

SEQ ID NO: 7206327 - DNA, 20 bp, Homo sapiens
gggcagcctcgggagtgggt

SEQ ID NO: 7206328 - DNA, 20 bp, Homo sapiens
gggcagcctcgggagtgggt

SEQ ID NO: 7206329 - DNA, 20 bp, Homo sapiens
gggcagcctcgggagtgggt

SEQ ID NO: 7206330 - DNA, 22 bp, Homo sapiens
gggcagcagaattggacagaaa

SEQ ID NO: 7206331 - DNA, 22 bp, Homo sapiens
gggcagcagaattggacagaaa

SEQ ID NO: 7206332 - DNA, 22 bp, Homo sapiens
gggcagcagaattggacagaaa

SEQ ID NO: 7206333 - DNA, 22 bp, Homo sapiens
gggcagcagaattggacagaaa

SEQ ID NO: 7206334 - DNA, 22 bp, Homo sapiens
gggcagcagagccctgccgagt

SEQ ID NO: 7206335 - DNA, 22 bp, Homo sapiens
gggcagcccagaactgctgcag

SEQ ID NO: 7206336 - DNA, 22 bp, Homo sapiens
gggcagcctgctttctgatcca

SEQ ID NO: 7206337 - DNA, 22 bp, Homo sapiens
gggcagcctcggtgcctgctgc

SEQ ID NO: 7206338 - DNA, 20 bp, Homo sapiens
gggcagcctcgggagtgggt

SEQ ID NO: 7206339 - DNA, 22 bp, Homo sapiens
gggcagcctcggtgcctgctgc

SEQ ID NO: 7206340 - DNA, 22 bp, Homo sapiens
gggcagcctcggtgcctgctgc

SEQ ID NO: 7206341 - DNA, 22 bp, Homo sapiens
gggcagcctcggtgcctgctgc

SEQ ID NO: 7206342 - DNA, 22 bp, Homo sapiens
gggcagctagccctctagccca

SEQ ID NO: 7206343 - DNA, 22 bp, Homo sapiens
gggcagctagccctctagccca

SEQ ID NO: 7206344 - DNA, 22 bp, Homo sapiens
gggcagctcagccaccatgcag

SEQ ID NO: 7206345 - DNA, 22 bp, Homo sapiens
gggcagctcagccaccatgcag

SEQ ID NO: 7206346 - DNA, 20 bp, Homo sapiens
gggcagctcccctcattctg

SEQ ID NO: 7206347 - DNA, 20 bp, Homo sapiens
gggcagctcccctcattctg

SEQ ID NO: 7206348 - DNA, 22 bp, Homo sapiens
gggcagctcagccaccatgcag

SEQ ID NO: 7206349 - DNA, 20 bp, Homo sapiens
gggcagctcccctcattctg

SEQ ID NO: 7206350 - DNA, 22 bp, Homo sapiens
gggcagctcctgtggaatccac

SEQ ID NO: 7206351 - DNA, 22 bp, Homo sapiens
gggcagctcggaagtgggaaag

SEQ ID NO: 7206352 - DNA, 22 bp, Homo sapiens
gggcagctcggaagtgggaaag

SEQ ID NO: 7206353 - DNA, 22 bp, Homo sapiens
gggcagctcggaagtgggaaag

SEQ ID NO: 7206354 - DNA, 22 bp, Homo sapiens
gggcagctctcacagcagccaa

SEQ ID NO: 7206355 - DNA, 22 bp, Homo sapiens
gggcagctctcacagcagccaa

SEQ ID NO: 7206356 - DNA, 22 bp, Homo sapiens
gggcagctctcacagcagccaa

SEQ ID NO: 7206357 - DNA, 21 bp, Homo sapiens
gggccacaccttctgcagacc

SEQ ID NO: 7206358 - DNA, 22 bp, Homo sapiens
gggccacaggagaggctgtcag

SEQ ID NO: 7206359 - DNA, 22 bp, Homo sapiens
gggccaggtcggtgaatggtca

SEQ ID NO: 7206360 - DNA, 22 bp, Homo sapiens
gggccaggagtggagatatggg

SEQ ID NO: 7206361 - DNA, 22 bp, Homo sapiens
gggccaggtatcgtctttagta

SEQ ID NO: 7206362 - DNA, 22 bp, Homo sapiens
gggccaggtatcgtctttagta

SEQ ID NO: 7206363 - DNA, 22 bp, Homo sapiens
gggccacaggccttgcccgcag

SEQ ID NO: 7206364 - DNA, 22 bp, Homo sapiens
gggccacaggccttgcccgcag

SEQ ID NO: 7206365 - DNA, 22 bp, Homo sapiens
gggccaggagtggagatatggg

SEQ ID NO: 7206366 - DNA, 22 bp, Homo sapiens
gggccaggtcggtgaatggtca

SEQ ID NO: 7206367 - DNA, 22 bp, Homo sapiens
gggccaggtcggtgaatggtca

SEQ ID NO: 7206368 - DNA, 22 bp, Homo sapiens
gggccaggtcggtgaatggtca

SEQ ID NO: 7206369 - DNA, 22 bp, Homo sapiens
gggccaggtggaccccagcctc

SEQ ID NO: 7206370 - DNA, 22 bp, Homo sapiens
gggccaggtggaccccagcctc

SEQ ID NO: 7206371 - DNA, 22 bp, Homo sapiens
gggccaggtggaccccagcctc

SEQ ID NO: 7206372 - DNA, 22 bp, Homo sapiens
gggccagtagcacctgtgtgga

SEQ ID NO: 7206373 - DNA, 22 bp, Homo sapiens
gggccagtagcacctgtgtgga

SEQ ID NO: 7206374 - DNA, 22 bp, Homo sapiens
gggccagtctgactctgctggt

SEQ ID NO: 7206375 - DNA, 19 bp, Homo sapiens
gggcccagcatggagggtt

SEQ ID NO: 7206376 - DNA, 19 bp, Homo sapiens
gggcccagcatggagggtt

SEQ ID NO: 7206377 - DNA, 22 bp, Homo sapiens
gggcccagcactggctgggatc

SEQ ID NO: 7206378 - DNA, 19 bp, Homo sapiens
gggcccagcatggagggtt

SEQ ID NO: 7206379 - DNA, 19 bp, Homo sapiens
gggcccagcatggagggtt

SEQ ID NO: 7206380 - DNA, 22 bp, Homo sapiens
gggcccagcgtggttccatctg

SEQ ID NO: 7206381 - DNA, 22 bp, Homo sapiens
gggcccagccctctgctcactg

SEQ ID NO: 7206382 - DNA, 22 bp, Homo sapiens
gggcccagccctctgctcactg

SEQ ID NO: 7206383 - DNA, 19 bp, Homo sapiens
gggcccagcatggagggtt

SEQ ID NO: 7206384 - DNA, 22 bp, Homo sapiens
gggcccagccctctgctcactg

SEQ ID NO: 7206385 - DNA, 22 bp, Homo sapiens
gggcccagccctctgctcactg

SEQ ID NO: 7206386 - DNA, 22 bp, Homo sapiens
gggcctggtgcttctgactcct

SEQ ID NO: 7206387 - DNA, 22 bp, Homo sapiens
gggcccagcgtggttccatctg

SEQ ID NO: 7206388 - DNA, 22 bp, Homo sapiens
gggcccagcgtggttccatctg

SEQ ID NO: 7206389 - DNA, 22 bp, Homo sapiens
gggcccaggcctccttccttcc

SEQ ID NO: 7206390 - DNA, 22 bp, Homo sapiens
gggcccaggcctccttccttcc

SEQ ID NO: 7206391 - DNA, 22 bp, Homo sapiens
gggcctggtgcttctgactcct

SEQ ID NO: 7206392 - DNA, 22 bp, Homo sapiens
gggcccagcactggctgggatc

SEQ ID NO: 7206393 - DNA, 22 bp, Homo sapiens
gggcccagcactggctgggatc

SEQ ID NO: 7206394 - DNA, 22 bp, Homo sapiens
gggcccagcactggctgggatc

SEQ ID NO: 7206395 - DNA, 22 bp, Homo sapiens
gggcccagcactggctgggatc

SEQ ID NO: 7206396 - DNA, 22 bp, Homo sapiens
gggcccagcactggctgggatc

SEQ ID NO: 7206397 - DNA, 23 bp, Homo sapiens
gggcccagcacaggacctggcag

SEQ ID NO: 7206398 - DNA, 23 bp, Homo sapiens
gggcccagcacaggacctggcag

SEQ ID NO: 7206399 - DNA, 23 bp, Homo sapiens
gggcccagcacaggacctggcag

SEQ ID NO: 7206400 - DNA, 23 bp, Homo sapiens
gggcccagcacaggacctggcag

SEQ ID NO: 7206401 - DNA, 23 bp, Homo sapiens
gggcccagcacaggacctggcag

SEQ ID NO: 7206402 - DNA, 22 bp, Homo sapiens
gggccagtgaacaatgagggaa

SEQ ID NO: 7206403 - DNA, 22 bp, Homo sapiens
gggccagtgagtcgggagagct

SEQ ID NO: 7206404 - DNA, 22 bp, Homo sapiens
gggccagtgagtcgggagagct

SEQ ID NO: 7206405 - DNA, 22 bp, Homo sapiens
gggccagtgggacctgggtctc

SEQ ID NO: 7206406 - DNA, 22 bp, Homo sapiens
gggccagtgggacctgggtctc

SEQ ID NO: 7206407 - DNA, 22 bp, Homo sapiens
gggccatctacactccccaaaa

SEQ ID NO: 7206408 - DNA, 22 bp, Homo sapiens
gggccatgagaggttcatcaac

SEQ ID NO: 7206409 - DNA, 22 bp, Homo sapiens
gggccatgagaggttcatcaac

SEQ ID NO: 7206410 - DNA, 22 bp, Homo sapiens
gggccatgagaggttcatcaac

SEQ ID NO: 7206411 - DNA, 22 bp, Homo sapiens
gggccatgagaggttcatcaac

SEQ ID NO: 7206412 - DNA, 22 bp, Homo sapiens
gggccatgagaggttcatcaac

SEQ ID NO: 7206413 - DNA, 22 bp, Homo sapiens
gggccatgagaggttcatcaac

SEQ ID NO: 7206414 - DNA, 22 bp, Homo sapiens
gggctaagtggatcagtcagga

SEQ ID NO: 7206415 - DNA, 22 bp, Homo sapiens
gggctactgagctggaactggg

SEQ ID NO: 7206416 - DNA, 22 bp, Homo sapiens
gggcgtggatggtcagtgcagg

SEQ ID NO: 7206417 - DNA, 21 bp, Homo sapiens
gggctaagagtgaccaggcag

SEQ ID NO: 7206418 - DNA, 22 bp, Homo sapiens
gggctaagctcgcccagggcca

SEQ ID NO: 7206419 - DNA, 22 bp, Homo sapiens
gggctactgagctggaactggg

SEQ ID NO: 7206420 - DNA, 22 bp, Homo sapiens
gggctactgagctggaactggg

SEQ ID NO: 7206421 - DNA, 22 bp, Homo sapiens
gggctagaaattctgcagtgga

SEQ ID NO: 7206422 - DNA, 22 bp, Homo sapiens
gggctagaagttagctagagaa

SEQ ID NO: 7206423 - DNA, 22 bp, Homo sapiens
gggctagaagttagctagagaa

SEQ ID NO: 7206424 - DNA, 22 bp, Homo sapiens
gggctagaagttagctagagaa

SEQ ID NO: 7206425 - DNA, 22 bp, Homo sapiens
gggctagaagttagctagagaa

SEQ ID NO: 7206426 - DNA, 22 bp, Homo sapiens
gggcgtggatggtcagtgcagg

SEQ ID NO: 7206427 - DNA, 22 bp, Homo sapiens
gggcgtggatggtcagtgcagg

SEQ ID NO: 7206428 - DNA, 22 bp, Homo sapiens
gggcggtgcctgtctccgaagc

SEQ ID NO: 7206429 - DNA, 22 bp, Homo sapiens
gggcgtcctggaccctcccctg

SEQ ID NO: 7206430 - DNA, 22 bp, Homo sapiens
gggcgtggatggtcagtgcagg

SEQ ID NO: 7206431 - DNA, 22 bp, Homo sapiens
gggcgtggatggtcagtgcagg

SEQ ID NO: 7206432 - DNA, 22 bp, Homo sapiens
gggcggggggagctggaatgaa

SEQ ID NO: 7206433 - DNA, 22 bp, Homo sapiens
gggcggggggagctggaatgaa

SEQ ID NO: 7206434 - DNA, 22 bp, Homo sapiens
gggcggggggagctggaatgaa

SEQ ID NO: 7206435 - DNA, 22 bp, Homo sapiens
gggcggggtggctcatgcctgt

SEQ ID NO: 7206436 - DNA, 22 bp, Homo sapiens
gggcggggtggctcatgcctgt

SEQ ID NO: 7206437 - DNA, 22 bp, Homo sapiens
gggcggggtggctcatgcctgt

SEQ ID NO: 7206438 - DNA, 19 bp, Homo sapiens
gggcggagcctgacctggg

SEQ ID NO: 7206439 - DNA, 22 bp, Homo sapiens
gggcggatcacctgaggtcagg

SEQ ID NO: 7206440 - DNA, 22 bp, Homo sapiens
gggcggatcacctgaggtcagg

SEQ ID NO: 7206441 - DNA, 22 bp, Homo sapiens
gggcggatcacctgaggtcagg

SEQ ID NO: 7206442 - DNA, 22 bp, Homo sapiens
gggcggatcacctgaggtcagg

SEQ ID NO: 7206443 - DNA, 22 bp, Homo sapiens
gggcggatcacctgaggtcagg

SEQ ID NO: 7206444 - DNA, 22 bp, Homo sapiens
gggcggatcacctgaggtcagg

SEQ ID NO: 7206445 - DNA, 22 bp, Homo sapiens
gggcggatcatttgaggtcagg

SEQ ID NO: 7206446 - DNA, 22 bp, Homo sapiens
gggcggatcatttgaggtcagg

SEQ ID NO: 7206447 - DNA, 22 bp, Homo sapiens
gggcggatcatttgaggtcagg

SEQ ID NO: 7206448 - DNA, 22 bp, Homo sapiens
gggcggatcatttgaggtcagg

SEQ ID NO: 7206449 - DNA, 22 bp, Homo sapiens
gggcggatcatttgaggtcagg

SEQ ID NO: 7206450 - DNA, 22 bp, Homo sapiens
gggcggatcatttgaggtcagg

SEQ ID NO: 7206451 - DNA, 22 bp, Homo sapiens
gggcggggcttccgtcctccac

SEQ ID NO: 7206452 - DNA, 22 bp, Homo sapiens
gggcggggggagctggaatgaa

SEQ ID NO: 7206453 - DNA, 22 bp, Homo sapiens
gggcggggggagctggaatgaa

SEQ ID NO: 7206454 - DNA, 22 bp, Homo sapiens
gggcggggggagctggaatgaa

SEQ ID NO: 7206455 - DNA, 22 bp, Homo sapiens
gggcggggggagctggaatgaa

SEQ ID NO: 7206456 - DNA, 22 bp, Homo sapiens
gggcggggggagctggaatgaa

SEQ ID NO: 7206457 - DNA, 22 bp, Homo sapiens
gggcggggggagctggaatgaa

SEQ ID NO: 7206458 - DNA, 22 bp, Homo sapiens
ggcaggcctgagaggcagggct

SEQ ID NO: 7206459 - DNA, 22 bp, Homo sapiens
ggcaggcctgagaggcagggct

SEQ ID NO: 7206460 - DNA, 22 bp, Homo sapiens
ggcaggcgtggtggcctcagaa

SEQ ID NO: 7206461 - DNA, 16 bp, Homo sapiens
ggcaggcgcggagccc

SEQ ID NO: 7206462 - DNA, 16 bp, Homo sapiens
ggcaggcgcggagccc

SEQ ID NO: 7206463 - DNA, 22 bp, Homo sapiens
ggcaggcgtggtggcctcagaa

SEQ ID NO: 7206464 - DNA, 22 bp, Homo sapiens
ggcaggcgtggtggcctcagaa

SEQ ID NO: 7206465 - DNA, 22 bp, Homo sapiens
ggcaggctagcactgatgtcct

SEQ ID NO: 7206466 - DNA, 22 bp, Homo sapiens
ggcaggctagcactgatgtcct

SEQ ID NO: 7206467 - DNA, 22 bp, Homo sapiens
ggcaggctcagcagccaaggag

SEQ ID NO: 7206468 - DNA, 22 bp, Homo sapiens
ggcaggctcagcagccaaggag

SEQ ID NO: 7206469 - DNA, 22 bp, Homo sapiens
ggcaggcattgcaacatgtaca

SEQ ID NO: 7206470 - DNA, 22 bp, Homo sapiens
ggcaggcattgcaacatgtaca

SEQ ID NO: 7206471 - DNA, 22 bp, Homo sapiens
ggcaggcctgagaggcagggct

SEQ ID NO: 7206472 - DNA, 22 bp, Homo sapiens
ggcaggcctgagaggcagggct

SEQ ID NO: 7206473 - DNA, 22 bp, Homo sapiens
ggcaggcctgagaggcagggct

SEQ ID NO: 7206474 - DNA, 22 bp, Homo sapiens
ggcaggcattagagattcccag

SEQ ID NO: 7206475 - DNA, 22 bp, Homo sapiens
ggcaggcattagagattcccag

SEQ ID NO: 7206476 - DNA, 22 bp, Homo sapiens
ggcaggcattgcaacatgtaca

SEQ ID NO: 7206477 - DNA, 22 bp, Homo sapiens
ggcaggcattgcaacatgtaca

SEQ ID NO: 7206478 - DNA, 22 bp, Homo sapiens
ggcaggcagatggctgcaccaa

SEQ ID NO: 7206479 - DNA, 22 bp, Homo sapiens
ggcaggcagcctccatccacag

SEQ ID NO: 7206480 - DNA, 22 bp, Homo sapiens
ggcaggcagcctccatccacag

SEQ ID NO: 7206481 - DNA, 22 bp, Homo sapiens
ggcaggcagcctccatccacag

SEQ ID NO: 7206482 - DNA, 22 bp, Homo sapiens
ggcaggcaggagcgtgcttggg

SEQ ID NO: 7206483 - DNA, 22 bp, Homo sapiens
ggcaggcagcctccatccacag

SEQ ID NO: 7206484 - DNA, 22 bp, Homo sapiens
ggcaggcaggagcgtgcttggg

SEQ ID NO: 7206485 - DNA, 22 bp, Homo sapiens
ggcaggcaggagcgtgcttggg

SEQ ID NO: 7206486 - DNA, 22 bp, Homo sapiens
ggcaggctcagcagccaaggag

SEQ ID NO: 7206487 - DNA, 22 bp, Homo sapiens
ggcaggctccaagcatcctatg

SEQ ID NO: 7206488 - DNA, 22 bp, Homo sapiens
ggcaggctccaagcatcctatg

SEQ ID NO: 7206489 - DNA, 22 bp, Homo sapiens
ggcaggctccaagcatcctatg

SEQ ID NO: 7206490 - DNA, 22 bp, Homo sapiens
ggcaggctccagagccctctcc

SEQ ID NO: 7206491 - DNA, 22 bp, Homo sapiens
ggcaggctccgtgttccattcc

SEQ ID NO: 7206492 - DNA, 18 bp, Homo sapiens
ggcaggctctctgggtca

SEQ ID NO: 7206493 - DNA, 18 bp, Homo sapiens
ggcaggctctctgggtca

SEQ ID NO: 7206494 - DNA, 18 bp, Homo sapiens
ggcaggctctctgggtca

SEQ ID NO: 7206495 - DNA, 22 bp, Homo sapiens
ggcaggctcttggccttatgag

SEQ ID NO: 7206496 - DNA, 22 bp, Homo sapiens
ggcaggctcttggccttatgag

SEQ ID NO: 7206497 - DNA, 22 bp, Homo sapiens
ggcaggctgcttgggtcatgtc

SEQ ID NO: 7206498 - DNA, 22 bp, Homo sapiens
ggcaggctgcttgggtcatgtc

SEQ ID NO: 7206499 - DNA, 22 bp, Homo sapiens
ggcaggctgcttgggtcatgtc

SEQ ID NO: 7206500 - DNA, 22 bp, Homo sapiens
ggcaggctgcttgggtcatgtc

SEQ ID NO: 7206501 - DNA, 22 bp, Homo sapiens
ggcaggctgcttgggtcatgtc

SEQ ID NO: 7206502 - DNA, 22 bp, Homo sapiens
ggcaggtgctctgtgggcctgg

SEQ ID NO: 7206503 - DNA, 22 bp, Homo sapiens
ggcaggtgctctgtgggcctgg

SEQ ID NO: 7206504 - DNA, 20 bp, Homo sapiens
ggcaggtgctcgcttggtct

SEQ ID NO: 7206505 - DNA, 20 bp, Homo sapiens
ggcaggtgctcgcttggtct

SEQ ID NO: 7206506 - DNA, 20 bp, Homo sapiens
ggcaggtgctcgcttggtct

SEQ ID NO: 7206507 - DNA, 22 bp, Homo sapiens
ggcaggtgctaagagaggtaaa

SEQ ID NO: 7206508 - DNA, 22 bp, Homo sapiens
ggcaggtgctaagagaggtaaa

SEQ ID NO: 7206509 - DNA, 22 bp, Homo sapiens
ggcaggtgctaagagaggtaaa

SEQ ID NO: 7206510 - DNA, 22 bp, Homo sapiens
ggcaggtgctcaaaaatatttg

SEQ ID NO: 7206511 - DNA, 22 bp, Homo sapiens
ggcaggtgctaagagaggtaaa

SEQ ID NO: 7206512 - DNA, 22 bp, Homo sapiens
ggcaggtgctaagagaggtaaa

SEQ ID NO: 7206513 - DNA, 17 bp, Homo sapiens
ggcaggtgcggggccgc

SEQ ID NO: 7206514 - DNA, 17 bp, Homo sapiens
ggcaggtgcggggccgc

SEQ ID NO: 7206515 - DNA, 17 bp, Homo sapiens
ggcaggtgcggggccgc

SEQ ID NO: 7206516 - DNA, 17 bp, Homo sapiens
ggcaggtgcggggccgc

SEQ ID NO: 7206517 - DNA, 22 bp, Homo sapiens
ggcaggctgggagtcatcagag

SEQ ID NO: 7206518 - DNA, 22 bp, Homo sapiens
ggcaggctgggagtcatcagag

SEQ ID NO: 7206519 - DNA, 22 bp, Homo sapiens
ggcaggctgggagtcatcagag

SEQ ID NO: 7206520 - DNA, 19 bp, Homo sapiens
ggcaggctggatagagagg

SEQ ID NO: 7206521 - DNA, 22 bp, Homo sapiens
ggcaggctggctttgttccagg

SEQ ID NO: 7206522 - DNA, 22 bp, Homo sapiens
ggcaggctgggtgtcatggagt

SEQ ID NO: 7206523 - DNA, 22 bp, Homo sapiens
ggcaggctgggtgtcatggagt

SEQ ID NO: 7206524 - DNA, 22 bp, Homo sapiens
ggcaggtgaggcatgtgcctgg

SEQ ID NO: 7206525 - DNA, 22 bp, Homo sapiens
ggcaggtgaggcatgtgcctgg

SEQ ID NO: 7206526 - DNA, 22 bp, Homo sapiens
ggcaggtgaggcatgtgcctgg

SEQ ID NO: 7206527 - DNA, 22 bp, Homo sapiens
ggcaggtgaggcatgtgcctgg

SEQ ID NO: 7206528 - DNA, 22 bp, Homo sapiens
ggcaggtgagttcattatctgc

SEQ ID NO: 7206529 - DNA, 22 bp, Homo sapiens
ggcagaggaagctggaagtggg

SEQ ID NO: 7206530 - DNA, 22 bp, Homo sapiens
ggcagaggaagctggaagtggg

SEQ ID NO: 7206531 - DNA, 22 bp, Homo sapiens
ggcagaggaagctggaagtggg

SEQ ID NO: 7206532 - DNA, 22 bp, Homo sapiens
ggcagaggaagctggaagtggg

SEQ ID NO: 7206533 - DNA, 22 bp, Homo sapiens
ggcagaggaagctggaagtggg

SEQ ID NO: 7206534 - DNA, 22 bp, Homo sapiens
ggcagaggaagctggaagtggg

SEQ ID NO: 7206535 - DNA, 22 bp, Homo sapiens
ggcagaggaagctggaagtggg

SEQ ID NO: 7206536 - DNA, 22 bp, Homo sapiens
ggcagaggaagctggaagtggg

SEQ ID NO: 7206537 - DNA, 22 bp, Homo sapiens
ggcagaggaagctggaagtggg

SEQ ID NO: 7206538 - DNA, 22 bp, Homo sapiens
ggcagaggaagctggaagtggg

SEQ ID NO: 7206539 - DNA, 22 bp, Homo sapiens
ggcagaggaagctggaagtggg

SEQ ID NO: 7206540 - DNA, 22 bp, Homo sapiens
ggcagaggaagctggaagtggg

SEQ ID NO: 7206541 - DNA, 22 bp, Homo sapiens
ggcagaggaagctggaagtggg

SEQ ID NO: 7206542 - DNA, 22 bp, Homo sapiens
ggcagctcgtcaggctgcggcg

SEQ ID NO: 7206543 - DNA, 20 bp, Homo sapiens
ggcagctctagtcgaggccc

SEQ ID NO: 7206544 - DNA, 20 bp, Homo sapiens
ggcagctctagtcgaggccc

SEQ ID NO: 7206545 - DNA, 20 bp, Homo sapiens
ggcagctctagtcgaggccc

SEQ ID NO: 7206546 - DNA, 22 bp, Homo sapiens
ggcagctctgatgatgctctgg

SEQ ID NO: 7206547 - DNA, 19 bp, Homo sapiens
ggcagctggacgctgttca

SEQ ID NO: 7206548 - DNA, 19 bp, Homo sapiens
ggcagctggacgctgttca

SEQ ID NO: 7206549 - DNA, 22 bp, Homo sapiens
ggcagctggcctcctcgcccac

SEQ ID NO: 7206550 - DNA, 22 bp, Homo sapiens
ggcagctctgtgtctgggaagc

SEQ ID NO: 7206551 - DNA, 22 bp, Homo sapiens
ggcagctctgctccacatgagt

SEQ ID NO: 7206552 - DNA, 22 bp, Homo sapiens
ggcagctctgctccttggctcc

SEQ ID NO: 7206553 - DNA, 22 bp, Homo sapiens
ggcagctctgctccttggctcc

SEQ ID NO: 7206554 - DNA, 22 bp, Homo sapiens
ggcaggcagatggctgcaccaa

SEQ ID NO: 7206555 - DNA, 22 bp, Homo sapiens
ggcagctgtgaagtgcctcaca

SEQ ID NO: 7206556 - DNA, 22 bp, Homo sapiens
ggcagctgtctctgagttagca

SEQ ID NO: 7206557 - DNA, 22 bp, Homo sapiens
ggcagctgtgaagtgcctcaca

SEQ ID NO: 7206558 - DNA, 22 bp, Homo sapiens
ggcagctgtgaagtgcctcaca

SEQ ID NO: 7206559 - DNA, 22 bp, Homo sapiens
ggcagctggttctttccattaa

SEQ ID NO: 7206560 - DNA, 22 bp, Homo sapiens
ggcagctgtaagatgagtgaat

SEQ ID NO: 7206561 - DNA, 22 bp, Homo sapiens
ggcagctgtctcattcacacct

SEQ ID NO: 7206562 - DNA, 22 bp, Homo sapiens
ggcagctggggcagtgccctgt

SEQ ID NO: 7206563 - DNA, 22 bp, Homo sapiens
ggcagctggggcagtgccctgt

SEQ ID NO: 7206564 - DNA, 22 bp, Homo sapiens
ggcagctggggcagtgccctgt

SEQ ID NO: 7206565 - DNA, 23 bp, Homo sapiens
ggcagctgggcagcactcatggg

SEQ ID NO: 7206566 - DNA, 22 bp, Homo sapiens
ggcagctggggcagtgccctgt

SEQ ID NO: 7206567 - DNA, 22 bp, Homo sapiens
ggcagctggggcagtgccctgt

SEQ ID NO: 7206568 - DNA, 22 bp, Homo sapiens
ggcagctgggtgcctaataatg

SEQ ID NO: 7206569 - DNA, 22 bp, Homo sapiens
ggcagctgggttggccagaaac

SEQ ID NO: 7206570 - DNA, 22 bp, Homo sapiens
ggcagctgggttggccagaaac

SEQ ID NO: 7206571 - DNA, 22 bp, Homo sapiens
ggcagctgggttggccagaaac

SEQ ID NO: 7206572 - DNA, 22 bp, Homo sapiens
ggcagctggttctttccattaa

SEQ ID NO: 7206573 - DNA, 22 bp, Homo sapiens
ggcacagagttggcagagctgc

SEQ ID NO: 7206574 - DNA, 22 bp, Homo sapiens
ggcacagagttggcagagctgc

SEQ ID NO: 7206575 - DNA, 22 bp, Homo sapiens
ggcacagaggttgcctccagat

SEQ ID NO: 7206576 - DNA, 22 bp, Homo sapiens
ggcacagaggttgcctccagat

SEQ ID NO: 7206577 - DNA, 22 bp, Homo sapiens
ggcacagaggttgcctccagat

SEQ ID NO: 7206578 - DNA, 22 bp, Homo sapiens
ggcacagaggttgcctccagat

SEQ ID NO: 7206579 - DNA, 22 bp, Homo sapiens
ggcacagagctttgtcccagtt

SEQ ID NO: 7206580 - DNA, 22 bp, Homo sapiens
ggcacagagctttgtcccagtt

SEQ ID NO: 7206581 - DNA, 22 bp, Homo sapiens
ggcacagagctttgtcccagtt

SEQ ID NO: 7206582 - DNA, 22 bp, Homo sapiens
ggcacagagctccagccttggc

SEQ ID NO: 7206583 - DNA, 22 bp, Homo sapiens
ggcacagacctgctgcgatatc

SEQ ID NO: 7206584 - DNA, 22 bp, Homo sapiens
ggcacagagctccagccttggc

SEQ ID NO: 7206585 - DNA, 22 bp, Homo sapiens
ggcacagagctccagccttggc

SEQ ID NO: 7206586 - DNA, 22 bp, Homo sapiens
ggcacagagctccagccttggc

SEQ ID NO: 7206587 - DNA, 22 bp, Homo sapiens
ggcacagatagatcaagtgtct

SEQ ID NO: 7206588 - DNA, 23 bp, Homo sapiens
ggcacagatgctgagcatgtgca

SEQ ID NO: 7206589 - DNA, 23 bp, Homo sapiens
ggcacagatgctgagcatgtgca

SEQ ID NO: 7206590 - DNA, 23 bp, Homo sapiens
ggcacagatgctgagcatgtgca

SEQ ID NO: 7206591 - DNA, 23 bp, Homo sapiens
ggcacagatgctgagcatgtgca

SEQ ID NO: 7206592 - DNA, 23 bp, Homo sapiens
ggcacagatgctgagcatgtgca

SEQ ID NO: 7206593 - DNA, 22 bp, Homo sapiens
ggcacagaggttgcctccagat

SEQ ID NO: 7206594 - DNA, 22 bp, Homo sapiens
ggcacagagttggcagagctgc

SEQ ID NO: 7206595 - DNA, 22 bp, Homo sapiens
ggcacagcaagaagggaaatga

SEQ ID NO: 7206596 - DNA, 22 bp, Homo sapiens
ggcacagcaagaagggaaatga

SEQ ID NO: 7206597 - DNA, 22 bp, Homo sapiens
ggcacagcacagagcacatgta

SEQ ID NO: 7206598 - DNA, 22 bp, Homo sapiens
ggcacagcacagagcacatgta

SEQ ID NO: 7206599 - DNA, 22 bp, Homo sapiens
ggcacagcacagagcacatgta

SEQ ID NO: 7206600 - DNA, 22 bp, Homo sapiens
ggcacagcacagagcacatgta

SEQ ID NO: 7206601 - DNA, 22 bp, Homo sapiens
ggcacagcacagagcacatgta

SEQ ID NO: 7206602 - DNA, 22 bp, Homo sapiens
ggcacagcacagtggacccagg

SEQ ID NO: 7206603 - DNA, 22 bp, Homo sapiens
ggcacagcacagtggacccagg

SEQ ID NO: 7206604 - DNA, 22 bp, Homo sapiens
ggcacagcacagtggacccagg

SEQ ID NO: 7206605 - DNA, 22 bp, Homo sapiens
ggcacagcaccttttcacattg

SEQ ID NO: 7206606 - DNA, 22 bp, Homo sapiens
ggcacagcaccttttcacattg

SEQ ID NO: 7206607 - DNA, 22 bp, Homo sapiens
ggcacagcaccttttcacattg

SEQ ID NO: 7206608 - DNA, 22 bp, Homo sapiens
ggcacagcactgtaggcctggg

SEQ ID NO: 7206609 - DNA, 22 bp, Homo sapiens
ggcacagcactgtaggcctggg

SEQ ID NO: 7206610 - DNA, 22 bp, Homo sapiens
ggcacagcactgtaggcctggg

SEQ ID NO: 7206611 - DNA, 22 bp, Homo sapiens
ggcacagcactgtaggcctggg

SEQ ID NO: 7206612 - DNA, 22 bp, Homo sapiens
ggcacagcactgtaggcctggg

SEQ ID NO: 7206613 - DNA, 22 bp, Homo sapiens
ggcacagcactgtaggcctggg

SEQ ID NO: 7206614 - DNA, 22 bp, Homo sapiens
ggcacagcaggagctatgtgaa

SEQ ID NO: 7206615 - DNA, 22 bp, Homo sapiens
ggcagaatggaaagatatcata

SEQ ID NO: 7206616 - DNA, 22 bp, Homo sapiens
ggcagaatttgccattcaagct

SEQ ID NO: 7206617 - DNA, 22 bp, Homo sapiens
ggcagacaatctgtctgttagg

SEQ ID NO: 7206618 - DNA, 22 bp, Homo sapiens
ggcagaggaagctggaagtggg

SEQ ID NO: 7206619 - DNA, 22 bp, Homo sapiens
ggcagaggaagctggaagtggg

SEQ ID NO: 7206620 - DNA, 22 bp, Homo sapiens
ggcagaggaagctggaagtggg

SEQ ID NO: 7206621 - DNA, 22 bp, Homo sapiens
ggcagagcttgttccttctgtt

SEQ ID NO: 7206622 - DNA, 22 bp, Homo sapiens
ggcagagcttgttccttctgtt

SEQ ID NO: 7206623 - DNA, 22 bp, Homo sapiens
ggcagagcttgttccttctgtt

SEQ ID NO: 7206624 - DNA, 23 bp, Homo sapiens
ggcagagagcatggctggggccc

SEQ ID NO: 7206625 - DNA, 22 bp, Homo sapiens
ggcagagactgggttggcagag

SEQ ID NO: 7206626 - DNA, 23 bp, Homo sapiens
ggcagagagcatggctggggccc

SEQ ID NO: 7206627 - DNA, 23 bp, Homo sapiens
ggcagagagcatggctggggccc

SEQ ID NO: 7206628 - DNA, 22 bp, Homo sapiens
ggcagagagttctccacctctc

SEQ ID NO: 7206629 - DNA, 22 bp, Homo sapiens
ggcagagactgggttggcagag

SEQ ID NO: 7206630 - DNA, 22 bp, Homo sapiens
ggcagagacaccgaatgactct

SEQ ID NO: 7206631 - DNA, 22 bp, Homo sapiens
ggcagagactgggttggcagag

SEQ ID NO: 7206632 - DNA, 22 bp, Homo sapiens
ggcagagactgggttggcagag

SEQ ID NO: 7206633 - DNA, 22 bp, Homo sapiens
ggcagagacaccgaatgactct

SEQ ID NO: 7206634 - DNA, 22 bp, Homo sapiens
ggcagagacaccgaatgactct

SEQ ID NO: 7206635 - DNA, 23 bp, Homo sapiens
ggcagagagcatggctggggccc

SEQ ID NO: 7206636 - DNA, 23 bp, Homo sapiens
ggcagagagcatggctggggccc

SEQ ID NO: 7206637 - DNA, 23 bp, Homo sapiens
ggcagagagcatggctggggccc

SEQ ID NO: 7206638 - DNA, 22 bp, Homo sapiens
ggcagagactgggttggcagag

SEQ ID NO: 7206639 - DNA, 22 bp, Homo sapiens
ggcagagactgggttggcagag

SEQ ID NO: 7206640 - DNA, 22 bp, Homo sapiens
ggcagagactgggttggcagag

SEQ ID NO: 7206641 - DNA, 22 bp, Homo sapiens
ggcagagactgggttggcagag

SEQ ID NO: 7206642 - DNA, 21 bp, Homo sapiens
ggcagagaagctggaagttgg

SEQ ID NO: 7206643 - DNA, 21 bp, Homo sapiens
ggcagagaagctggaagttgg

SEQ ID NO: 7206644 - DNA, 20 bp, Homo sapiens
ggcagacctgctgagagccc

SEQ ID NO: 7206645 - DNA, 18 bp, Homo sapiens
ggcagacgcgaggggcgg

SEQ ID NO: 7206646 - DNA, 22 bp, Homo sapiens
ggcagagaatctggctgtttac

SEQ ID NO: 7206647 - DNA, 22 bp, Homo sapiens
ggcagagaatctggctgtttac

SEQ ID NO: 7206648 - DNA, 22 bp, Homo sapiens
ggcagagaatctggctgtttac

SEQ ID NO: 7206649 - DNA, 22 bp, Homo sapiens
ggcagactttttctctgaaggg

SEQ ID NO: 7206650 - DNA, 21 bp, Homo sapiens
ggcagagaagctggaagttgg

SEQ ID NO: 7206651 - DNA, 21 bp, Homo sapiens
ggcagagaagctggaagttgg

SEQ ID NO: 7206652 - DNA, 21 bp, Homo sapiens
ggcagagaagctggaagttgg

SEQ ID NO: 7206653 - DNA, 22 bp, Homo sapiens
ggcagacctctccagccccaca

SEQ ID NO: 7206654 - DNA, 22 bp, Homo sapiens
ggcagacctctccagccccaca

SEQ ID NO: 7206655 - DNA, 22 bp, Homo sapiens
ggcagacctctccagccccaca

SEQ ID NO: 7206656 - DNA, 22 bp, Homo sapiens
ggcagacctctccagccccaca

SEQ ID NO: 7206657 - DNA, 22 bp, Homo sapiens
ggcagacactcaaaagctggga

SEQ ID NO: 7206658 - DNA, 22 bp, Homo sapiens
ggcagacactcaaaagctggga

SEQ ID NO: 7206659 - DNA, 19 bp, Homo sapiens
ggcagacacagttgacatg

SEQ ID NO: 7206660 - DNA, 22 bp, Homo sapiens
ggcagacacaaaaacataaggt

SEQ ID NO: 7206661 - DNA, 22 bp, Homo sapiens
ggcagacacaaaaacataaggt

SEQ ID NO: 7206662 - DNA, 19 bp, Homo sapiens
ggcagacacagttgacatg

SEQ ID NO: 7206663 - DNA, 19 bp, Homo sapiens
ggcagacacagttgacatg

SEQ ID NO: 7206664 - DNA, 19 bp, Homo sapiens
ggagtgggtagttagtggt

SEQ ID NO: 7206665 - DNA, 19 bp, Homo sapiens
ggagtgggtagttagtggt

SEQ ID NO: 7206666 - DNA, 22 bp, Homo sapiens
ggagtgggcagcactgccctgt

SEQ ID NO: 7206667 - DNA, 19 bp, Homo sapiens
ggagtgggtagttagtggt

SEQ ID NO: 7206668 - DNA, 19 bp, Homo sapiens
ggagtgggtagttagtggt

SEQ ID NO: 7206669 - DNA, 22 bp, Homo sapiens
ggagtgggcagcactgccctgt

SEQ ID NO: 7206670 - DNA, 22 bp, Homo sapiens
ggagtgggcagcactgccctgt

SEQ ID NO: 7206671 - DNA, 22 bp, Homo sapiens
ggagtgggcagcactgccctgt

SEQ ID NO: 7206672 - DNA, 22 bp, Homo sapiens
ggagtgggcagcactgccctgt

SEQ ID NO: 7206673 - DNA, 22 bp, Homo sapiens
ggagtgggcagcactgccctgt

SEQ ID NO: 7206674 - DNA, 22 bp, Homo sapiens
ggagtgggcagcactgccctgt

SEQ ID NO: 7206675 - DNA, 22 bp, Homo sapiens
ggagtggctgtttctgccccca

SEQ ID NO: 7206676 - DNA, 22 bp, Homo sapiens
ggagtggctgtttctgccccca

SEQ ID NO: 7206677 - DNA, 22 bp, Homo sapiens
ggagtggctatttgtgctggtt

SEQ ID NO: 7206678 - DNA, 22 bp, Homo sapiens
ggagtggctatttgtgctggtt

SEQ ID NO: 7206679 - DNA, 22 bp, Homo sapiens
ggagtgggaacaatgacatggt

SEQ ID NO: 7206680 - DNA, 22 bp, Homo sapiens
ggagtggctgtttctgccccca

SEQ ID NO: 7206681 - DNA, 22 bp, Homo sapiens
ggagtgggaacaatgacatggt

SEQ ID NO: 7206682 - DNA, 22 bp, Homo sapiens
ggagtgggaacaatgacatggt

SEQ ID NO: 7206683 - DNA, 22 bp, Homo sapiens
ggagtgggaacaatgacatggt

SEQ ID NO: 7206684 - DNA, 22 bp, Homo sapiens
ggagtgggaacaatgacatggt

SEQ ID NO: 7206685 - DNA, 22 bp, Homo sapiens
ggagtgggaacaatgacatggt

SEQ ID NO: 7206686 - DNA, 22 bp, Homo sapiens
ggagtgggaacaatgacatggt

SEQ ID NO: 7206687 - DNA, 22 bp, Homo sapiens
ggagtgggaacaatgacatggt

SEQ ID NO: 7206688 - DNA, 22 bp, Homo sapiens
ggagtggctatttgtgctggtt

SEQ ID NO: 7206689 - DNA, 22 bp, Homo sapiens
ggagtggcctctcctgtgcagg

SEQ ID NO: 7206690 - DNA, 22 bp, Homo sapiens
ggagtggcctctcctgtgcagg

SEQ ID NO: 7206691 - DNA, 22 bp, Homo sapiens
ggagtggcctctcctgtgcagg

SEQ ID NO: 7206692 - DNA, 22 bp, Homo sapiens
ggagtggccacgactgggagat

SEQ ID NO: 7206693 - DNA, 22 bp, Homo sapiens
ggagtggccacgactgggagat

SEQ ID NO: 7206694 - DNA, 22 bp, Homo sapiens
ggagtggccacgactgggagat

SEQ ID NO: 7206695 - DNA, 22 bp, Homo sapiens
ggagtggcaggccacagtgctg

SEQ ID NO: 7206696 - DNA, 22 bp, Homo sapiens
ggagtggcagctaggctgtcag

SEQ ID NO: 7206697 - DNA, 22 bp, Homo sapiens
ggagtggcaggccacagtgctg

SEQ ID NO: 7206698 - DNA, 22 bp, Homo sapiens
ggagtggcaggccacagtgctg

SEQ ID NO: 7206699 - DNA, 22 bp, Homo sapiens
ggagtggcactctgaggcgggg

SEQ ID NO: 7206700 - DNA, 22 bp, Homo sapiens
ggagtggcagctaggctgtcag

SEQ ID NO: 7206701 - DNA, 22 bp, Homo sapiens
ggagtggcagcgaggatcagat

SEQ ID NO: 7206702 - DNA, 22 bp, Homo sapiens
ggagtggcagcgaggatcagat

SEQ ID NO: 7206703 - DNA, 22 bp, Homo sapiens
ggagtggcagcgaggatcagat

SEQ ID NO: 7206704 - DNA, 22 bp, Homo sapiens
ggagttgattttggatatatta

SEQ ID NO: 7206705 - DNA, 22 bp, Homo sapiens
ggagttgattttggatatatta

SEQ ID NO: 7206706 - DNA, 22 bp, Homo sapiens
ggcaaggccaggcctccaagac

SEQ ID NO: 7206707 - DNA, 22 bp, Homo sapiens
ggcaaggcctgcagctcagtgt

SEQ ID NO: 7206708 - DNA, 17 bp, Homo sapiens
ggagttctgcagtcagg

SEQ ID NO: 7206709 - DNA, 22 bp, Homo sapiens
ggagttgacagtttagaagctt

SEQ ID NO: 7206710 - DNA, 22 bp, Homo sapiens
ggagttgatcagagtaggaggt

SEQ ID NO: 7206711 - DNA, 22 bp, Homo sapiens
ggagttaaggcctaagaaatag

SEQ ID NO: 7206712 - DNA, 22 bp, Homo sapiens
ggagtgtggagaggacatgggt

SEQ ID NO: 7206713 - DNA, 22 bp, Homo sapiens
ggagtggtgtcactgagaggaa

SEQ ID NO: 7206714 - DNA, 22 bp, Homo sapiens
ggagtgtcccgattttccaggt

SEQ ID NO: 7206715 - DNA, 23 bp, Homo sapiens
ggagtgtgaagacctgatatagc

SEQ ID NO: 7206716 - DNA, 22 bp, Homo sapiens
ggagtgtggagaggacatgggt

SEQ ID NO: 7206717 - DNA, 22 bp, Homo sapiens
ggagtggtgtcactgagaggaa

SEQ ID NO: 7206718 - DNA, 22 bp, Homo sapiens
ggagtggtgtcactgagaggaa

SEQ ID NO: 7206719 - DNA, 22 bp, Homo sapiens
ggcacagacttttgcttgcgtt

SEQ ID NO: 7206720 - DNA, 22 bp, Homo sapiens
ggcacagagaggccctggaagg

SEQ ID NO: 7206721 - DNA, 22 bp, Homo sapiens
ggcacagagaggccctggaagg

SEQ ID NO: 7206722 - DNA, 22 bp, Homo sapiens
ggcacagagaggccctggaagg

SEQ ID NO: 7206723 - DNA, 22 bp, Homo sapiens
ggcacagagcaggccactaatc

SEQ ID NO: 7206724 - DNA, 22 bp, Homo sapiens
ggcacagagcccagcttcctag

SEQ ID NO: 7206725 - DNA, 22 bp, Homo sapiens
ggcacagagcccagcttcctag

SEQ ID NO: 7206726 - DNA, 22 bp, Homo sapiens
ggcacacaggcagatggagtgt

SEQ ID NO: 7206727 - DNA, 22 bp, Homo sapiens
ggcacacatagatctgcactgg

SEQ ID NO: 7206728 - DNA, 22 bp, Homo sapiens
ggcacacatggtggttggtgaa

SEQ ID NO: 7206729 - DNA, 22 bp, Homo sapiens
ggcacactcaccacgtggaggg

SEQ ID NO: 7206730 - DNA, 22 bp, Homo sapiens
ggcaagggacggccgtgagaca

SEQ ID NO: 7206731 - DNA, 22 bp, Homo sapiens
ggcaagggacggccgtgagaca

SEQ ID NO: 7206732 - DNA, 22 bp, Homo sapiens
ggcacacagatggagcactagc

SEQ ID NO: 7206733 - DNA, 22 bp, Homo sapiens
ggcacacagatggagcactagc

SEQ ID NO: 7206734 - DNA, 22 bp, Homo sapiens
ggcacacagatggagcactagc

SEQ ID NO: 7206735 - DNA, 22 bp, Homo sapiens
ggcacacagcggaatttgctct

SEQ ID NO: 7206736 - DNA, 22 bp, Homo sapiens
ggcacacagcttggcaggagat

SEQ ID NO: 7206737 - DNA, 22 bp, Homo sapiens
ggcacacagcttggcaggagat

SEQ ID NO: 7206738 - DNA, 22 bp, Homo sapiens
ggcacacagcttggcaggagat

SEQ ID NO: 7206739 - DNA, 22 bp, Homo sapiens
ggaggggtggtcgcgaagagca

SEQ ID NO: 7206740 - DNA, 22 bp, Homo sapiens
ggaggggtggtcgcgaagagca

SEQ ID NO: 7206741 - DNA, 22 bp, Homo sapiens
ggaggggtggtcacctggcagg

SEQ ID NO: 7206742 - DNA, 22 bp, Homo sapiens
ggaggggtggtcacctggcagg

SEQ ID NO: 7206743 - DNA, 22 bp, Homo sapiens
ggagggtgcttaagttgtgttt

SEQ ID NO: 7206744 - DNA, 20 bp, Homo sapiens
ggagggtggaagaaagcaag

SEQ ID NO: 7206745 - DNA, 22 bp, Homo sapiens
ggagggtgcattttaccctgtg

SEQ ID NO: 7206746 - DNA, 22 bp, Homo sapiens
ggagggtgcttaagttgtgttt

SEQ ID NO: 7206747 - DNA, 22 bp, Homo sapiens
ggagggtgcagaccctttgcaa

SEQ ID NO: 7206748 - DNA, 22 bp, Homo sapiens
ggagggtgcattttaccctgtg

SEQ ID NO: 7206749 - DNA, 22 bp, Homo sapiens
ggaggggtgctcagctgtcacg

SEQ ID NO: 7206750 - DNA, 22 bp, Homo sapiens
ggaggggtgctcagctgtcacg

SEQ ID NO: 7206751 - DNA, 22 bp, Homo sapiens
ggaggggtgctcagctgtcacg

SEQ ID NO: 7206752 - DNA, 22 bp, Homo sapiens
ggaggggtgagaatggctgcct

SEQ ID NO: 7206753 - DNA, 22 bp, Homo sapiens
ggaggggtctctagcgaggaga

SEQ ID NO: 7206754 - DNA, 22 bp, Homo sapiens
ggaggggtgagaatggctgcct

SEQ ID NO: 7206755 - DNA, 22 bp, Homo sapiens
ggaggggtgagaatggctgcct

SEQ ID NO: 7206756 - DNA, 22 bp, Homo sapiens
ggagggggactgacactgattt

SEQ ID NO: 7206757 - DNA, 22 bp, Homo sapiens
ggagggggactgacactgattt

SEQ ID NO: 7206758 - DNA, 22 bp, Homo sapiens
ggaggggtctctagcgaggaga

SEQ ID NO: 7206759 - DNA, 22 bp, Homo sapiens
ggaggggtctctagcgaggaga

SEQ ID NO: 7206760 - DNA, 22 bp, Homo sapiens
ggagggggactgacactgattt

SEQ ID NO: 7206761 - DNA, 22 bp, Homo sapiens
ggagggggactgacactgattt

SEQ ID NO: 7206762 - DNA, 22 bp, Homo sapiens
ggagggggactgacactgattt

SEQ ID NO: 7206763 - DNA, 22 bp, Homo sapiens
ggagggggactgacactgattt

SEQ ID NO: 7206764 - DNA, 22 bp, Homo sapiens
ggaggggtctctagcgaggaga

SEQ ID NO: 7206765 - DNA, 22 bp, Homo sapiens
ggaggggtctctagcgaggaga

SEQ ID NO: 7206766 - DNA, 22 bp, Homo sapiens
ggaggggaggtccagctgatct

SEQ ID NO: 7206767 - DNA, 22 bp, Homo sapiens
ggaggggaggtccagctgatct

SEQ ID NO: 7206768 - DNA, 22 bp, Homo sapiens
ggaggggaggtccagctgatct

SEQ ID NO: 7206769 - DNA, 22 bp, Homo sapiens
ggaggggaggtccagctgatct

SEQ ID NO: 7206770 - DNA, 22 bp, Homo sapiens
ggaggggagtctcccaaagccg

SEQ ID NO: 7206771 - DNA, 22 bp, Homo sapiens
ggaggggagtctcccaaagccg

SEQ ID NO: 7206772 - DNA, 22 bp, Homo sapiens
ggaggggagtctcccaaagccg

SEQ ID NO: 7206773 - DNA, 22 bp, Homo sapiens
ggaggggagatgtttgggctca

SEQ ID NO: 7206774 - DNA, 22 bp, Homo sapiens
ggaggggagatgtttgggctca

SEQ ID NO: 7206775 - DNA, 22 bp, Homo sapiens
ggaggggagatgtttgggctca

SEQ ID NO: 7206776 - DNA, 22 bp, Homo sapiens
ggaggggaggattaatgacaaa

SEQ ID NO: 7206777 - DNA, 22 bp, Homo sapiens
ggaggggaggattaatgacaaa

SEQ ID NO: 7206778 - DNA, 22 bp, Homo sapiens
ggaggggaggattaatgacaaa

SEQ ID NO: 7206779 - DNA, 22 bp, Homo sapiens
ggaggggaggattaatgacaaa

SEQ ID NO: 7206780 - DNA, 22 bp, Homo sapiens
ggaggggaggattaatgacaaa

SEQ ID NO: 7206781 - DNA, 22 bp, Homo sapiens
ggaggggaggattaatgacaaa

SEQ ID NO: 7206782 - DNA, 22 bp, Homo sapiens
ggaggggaggattaatgacaaa

SEQ ID NO: 7206783 - DNA, 22 bp, Homo sapiens
ggagggggaattcagccccagc

SEQ ID NO: 7206784 - DNA, 22 bp, Homo sapiens
ggagggggaagaagctaaagac

SEQ ID NO: 7206785 - DNA, 22 bp, Homo sapiens
ggagggggaagaagctaaagac

SEQ ID NO: 7206786 - DNA, 22 bp, Homo sapiens
ggagggggaagaagctaaagac

SEQ ID NO: 7206787 - DNA, 22 bp, Homo sapiens
ggagggggaagaagctaaagac

SEQ ID NO: 7206788 - DNA, 22 bp, Homo sapiens
ggagggggaagaagctaaagac

SEQ ID NO: 7206789 - DNA, 22 bp, Homo sapiens
ggagggggaagaagctaaagac

SEQ ID NO: 7206790 - DNA, 22 bp, Homo sapiens
ggagggggaattcagccccagc

SEQ ID NO: 7206791 - DNA, 22 bp, Homo sapiens
ggagggggaattcagccccagc

SEQ ID NO: 7206792 - DNA, 22 bp, Homo sapiens
ggagggggaattcagccccagc

SEQ ID NO: 7206793 - DNA, 22 bp, Homo sapiens
ggagggggaattcagccccagc

SEQ ID NO: 7206794 - DNA, 22 bp, Homo sapiens
ggaggggctcctgttcgccccc

SEQ ID NO: 7206795 - DNA, 22 bp, Homo sapiens
ggaggggctcctgttcgccccc

SEQ ID NO: 7206796 - DNA, 22 bp, Homo sapiens
ggaggggagtctcccaaagccg

SEQ ID NO: 7206797 - DNA, 22 bp, Homo sapiens
ggaggggctcctgttcgccccc

SEQ ID NO: 7206798 - DNA, 22 bp, Homo sapiens
ggaggggctcctgttcgccccc

SEQ ID NO: 7206799 - DNA, 22 bp, Homo sapiens
ggaggggctcctgttcgccccc

SEQ ID NO: 7206800 - DNA, 22 bp, Homo sapiens
ggaggggctgagcaactttcag

SEQ ID NO: 7206801 - DNA, 22 bp, Homo sapiens
ggaggggctcctgttcgccccc

SEQ ID NO: 7206802 - DNA, 22 bp, Homo sapiens
ggaggggctcctgttcgccccc

SEQ ID NO: 7206803 - DNA, 22 bp, Homo sapiens
ggaggggctgagcaactttcag

SEQ ID NO: 7206804 - DNA, 22 bp, Homo sapiens
ggaggggctgagcaactttcag

SEQ ID NO: 7206805 - DNA, 22 bp, Homo sapiens
ggaggggctgagcaactttcag

SEQ ID NO: 7206806 - DNA, 22 bp, Homo sapiens
ggagggggaaactttggctgcc

SEQ ID NO: 7206807 - DNA, 22 bp, Homo sapiens
ggagggggaaactttggctgcc

SEQ ID NO: 7206808 - DNA, 22 bp, Homo sapiens
ggagggggaaactttggctgcc

SEQ ID NO: 7206809 - DNA, 22 bp, Homo sapiens
ggagggggaaactttggctgcc

SEQ ID NO: 7206810 - DNA, 22 bp, Homo sapiens
ggagggggaaactttggctgcc

SEQ ID NO: 7206811 - DNA, 22 bp, Homo sapiens
ggagggggaaactttggctgcc

SEQ ID NO: 7206812 - DNA, 22 bp, Homo sapiens
ggaggtagtctgagtcataggc

SEQ ID NO: 7206813 - DNA, 22 bp, Homo sapiens
ggagggtgggtcattcttacat

SEQ ID NO: 7206814 - DNA, 22 bp, Homo sapiens
ggagggttagcaaaggcacaga

SEQ ID NO: 7206815 - DNA, 22 bp, Homo sapiens
ggagggttgggacaccagggtc

SEQ ID NO: 7206816 - DNA, 22 bp, Homo sapiens
ggaggtcaaatggagggctggg

SEQ ID NO: 7206817 - DNA, 22 bp, Homo sapiens
ggaggtatgatagctgtgtcct

SEQ ID NO: 7206818 - DNA, 20 bp, Homo sapiens
ggaggtcaaatgatgagaag

SEQ ID NO: 7206819 - DNA, 22 bp, Homo sapiens
ggagggtggcagcgtcctgggc

SEQ ID NO: 7206820 - DNA, 22 bp, Homo sapiens
ggagggtggcagcgtcctgggc

SEQ ID NO: 7206821 - DNA, 22 bp, Homo sapiens
ggagggtggcagcgtcctgggc

SEQ ID NO: 7206822 - DNA, 20 bp, Homo sapiens
ggagggtggaagaaagcaag

SEQ ID NO: 7206823 - DNA, 20 bp, Homo sapiens
ggagggtggaagaaagcaag

SEQ ID NO: 7206824 - DNA, 20 bp, Homo sapiens
ggagggtggaagaaagcaag

SEQ ID NO: 7206825 - DNA, 20 bp, Homo sapiens
ggagggtggaagaaagcaag

SEQ ID NO: 7206826 - DNA, 22 bp, Homo sapiens
ggagggtggcagcgtcctgggc

SEQ ID NO: 7206827 - DNA, 22 bp, Homo sapiens
ggagggtggcagcgtcctgggc

SEQ ID NO: 7206828 - DNA, 22 bp, Homo sapiens
ggagggtggcagcgtcctgggc

SEQ ID NO: 7206829 - DNA, 22 bp, Homo sapiens
ggaggtggcagagggacattct

SEQ ID NO: 7206830 - DNA, 22 bp, Homo sapiens
ggaggtggcagagggacattct

SEQ ID NO: 7206831 - DNA, 22 bp, Homo sapiens
ggaggtggcagagggacattct

SEQ ID NO: 7206832 - DNA, 22 bp, Homo sapiens
ggaggtggaggttgcagtgagc

SEQ ID NO: 7206833 - DNA, 22 bp, Homo sapiens
ggaggtggaggttgcagtgagc

SEQ ID NO: 7206834 - DNA, 22 bp, Homo sapiens
ggaggtggaggttgcagtgagc

SEQ ID NO: 7206835 - DNA, 22 bp, Homo sapiens
ggaggtggaggttgcagtgagc

SEQ ID NO: 7206836 - DNA, 22 bp, Homo sapiens
ggaggtggaggttgcagtgagc

SEQ ID NO: 7206837 - DNA, 22 bp, Homo sapiens
ggaggtggaggttgcagtgagc

SEQ ID NO: 7206838 - DNA, 22 bp, Homo sapiens
ggaggtggaggttgcagtgagc

SEQ ID NO: 7206839 - DNA, 22 bp, Homo sapiens
ggaggtcatagctgtgcaggta

SEQ ID NO: 7206840 - DNA, 22 bp, Homo sapiens
ggaggtggaggttgcagtgagc

SEQ ID NO: 7206841 - DNA, 22 bp, Homo sapiens
ggaggtcacgactgggatgcct

SEQ ID NO: 7206842 - DNA, 22 bp, Homo sapiens
ggaggtcataagtgtatagatg

SEQ ID NO: 7206843 - DNA, 22 bp, Homo sapiens
ggaggtcataagtgtatagatg

SEQ ID NO: 7206844 - DNA, 22 bp, Homo sapiens
ggaggtcacgactgggatgcct

SEQ ID NO: 7206845 - DNA, 23 bp, Homo sapiens
ggaggtcagtgcctgagggtgag

SEQ ID NO: 7206846 - DNA, 22 bp, Homo sapiens
ggaggtgggctaaggactctct

SEQ ID NO: 7206847 - DNA, 22 bp, Homo sapiens
ggaggtgggctaaggactctct

SEQ ID NO: 7206848 - DNA, 22 bp, Homo sapiens
ggaggtgggctaaggactctct

SEQ ID NO: 7206849 - DNA, 16 bp, Homo sapiens
ggaggtgggtaaggtg

SEQ ID NO: 7206850 - DNA, 22 bp, Homo sapiens
ggaggtggtggcagtgacaatt

SEQ ID NO: 7206851 - DNA, 22 bp, Homo sapiens
ggaggtggtggcagtgacaatt

SEQ ID NO: 7206852 - DNA, 22 bp, Homo sapiens
ggaggtggtttgatttctatat

SEQ ID NO: 7206853 - DNA, 22 bp, Homo sapiens
ggaggtggtggcagtgacaatt

SEQ ID NO: 7206854 - DNA, 22 bp, Homo sapiens
ggaggtggtggcagtgacaatt

SEQ ID NO: 7206855 - DNA, 22 bp, Homo sapiens
ggagtaggccccgggagagagt

SEQ ID NO: 7206856 - DNA, 22 bp, Homo sapiens
ggagtagctgcattccgagcac

SEQ ID NO: 7206857 - DNA, 22 bp, Homo sapiens
ggagtagctgcattccgagcac

SEQ ID NO: 7206858 - DNA, 22 bp, Homo sapiens
ggaggtgggagcctccagtggt

SEQ ID NO: 7206859 - DNA, 22 bp, Homo sapiens
ggaggtgggagcctccagtggt

SEQ ID NO: 7206860 - DNA, 22 bp, Homo sapiens
ggaggtgggagcctccagtggt

SEQ ID NO: 7206861 - DNA, 22 bp, Homo sapiens
ggaggtgggagcctccagtggt

SEQ ID NO: 7206862 - DNA, 22 bp, Homo sapiens
ggaggtgggagcctccagtggt

SEQ ID NO: 7206863 - DNA, 22 bp, Homo sapiens
ggaggtgggagtttagttcttg

SEQ ID NO: 7206864 - DNA, 22 bp, Homo sapiens
ggaggtgggattaggacctaaa

SEQ ID NO: 7206865 - DNA, 22 bp, Homo sapiens
ggaggtgggattaggacctaaa

SEQ ID NO: 7206866 - DNA, 22 bp, Homo sapiens
ggaggtgggattaggacctaaa

SEQ ID NO: 7206867 - DNA, 22 bp, Homo sapiens
ggaggtgggattaggacctaaa

SEQ ID NO: 7206868 - DNA, 22 bp, Homo sapiens
ggaggtgggagacataggcggc

SEQ ID NO: 7206869 - DNA, 22 bp, Homo sapiens
ggaggtgggagacataggcggc

SEQ ID NO: 7206870 - DNA, 22 bp, Homo sapiens
ggaggtgggagacataggcggc

SEQ ID NO: 7206871 - DNA, 22 bp, Homo sapiens
ggaggtgggagacataggcggc

SEQ ID NO: 7206872 - DNA, 22 bp, Homo sapiens
ggaggtgggagcctccagtggt

SEQ ID NO: 7206873 - DNA, 22 bp, Homo sapiens
ggaggtggcagggaacataatt

SEQ ID NO: 7206874 - DNA, 22 bp, Homo sapiens
ggaggtggcctgaaaatgtggc

SEQ ID NO: 7206875 - DNA, 22 bp, Homo sapiens
ggaggtggcagagggacattct

SEQ ID NO: 7206876 - DNA, 22 bp, Homo sapiens
ggagggccatcttgggtgtgat

SEQ ID NO: 7206877 - DNA, 22 bp, Homo sapiens
ggagggcccctccagtgggcag

SEQ ID NO: 7206878 - DNA, 22 bp, Homo sapiens
ggagggccctgggtgcagctct

SEQ ID NO: 7206879 - DNA, 22 bp, Homo sapiens
ggagggccctgggtgcagctct

SEQ ID NO: 7206880 - DNA, 22 bp, Homo sapiens
ggagggcccctccagtgggcag

SEQ ID NO: 7206881 - DNA, 22 bp, Homo sapiens
ggagggccatcttgggtgtgat

SEQ ID NO: 7206882 - DNA, 22 bp, Homo sapiens
ggagggcatcaatcaggcctgg

SEQ ID NO: 7206883 - DNA, 20 bp, Homo sapiens
ggagggcagctgagagttgg

SEQ ID NO: 7206884 - DNA, 20 bp, Homo sapiens
ggagggcagctgagagttgg

SEQ ID NO: 7206885 - DNA, 20 bp, Homo sapiens
ggagggcagctgagagttgg

SEQ ID NO: 7206886 - DNA, 22 bp, Homo sapiens
ggagggcatcaatcaggcctgg

SEQ ID NO: 7206887 - DNA, 22 bp, Homo sapiens
ggagggcatcaatcaggcctgg

SEQ ID NO: 7206888 - DNA, 21 bp, Homo sapiens
ggagggcagcccagactggct

SEQ ID NO: 7206889 - DNA, 21 bp, Homo sapiens
ggagggcagcccagactggct

SEQ ID NO: 7206890 - DNA, 21 bp, Homo sapiens
ggagggcagcccagactggct

SEQ ID NO: 7206891 - DNA, 21 bp, Homo sapiens
ggagggcagcccagactggct

SEQ ID NO: 7206892 - DNA, 21 bp, Homo sapiens
ggagggcagcccagactggct

SEQ ID NO: 7206893 - DNA, 22 bp, Homo sapiens
ggagggacccactgcggtgacc

SEQ ID NO: 7206894 - DNA, 22 bp, Homo sapiens
ggagggacccactctagaggtg

SEQ ID NO: 7206895 - DNA, 22 bp, Homo sapiens
ggagggacccactgcggtgacc

SEQ ID NO: 7206896 - DNA, 22 bp, Homo sapiens
ggagggacccactgcggtgacc

SEQ ID NO: 7206897 - DNA, 22 bp, Homo sapiens
ggagggagagtgaccctaccaa

SEQ ID NO: 7206898 - DNA, 22 bp, Homo sapiens
ggagggagagtgaccctaccaa

SEQ ID NO: 7206899 - DNA, 22 bp, Homo sapiens
ggagggagagtgaccctaccaa

SEQ ID NO: 7206900 - DNA, 22 bp, Homo sapiens
ggagggagagtgaccctaccaa

SEQ ID NO: 7206901 - DNA, 22 bp, Homo sapiens
ggagggacccactctagaggtg

SEQ ID NO: 7206902 - DNA, 22 bp, Homo sapiens
ggagggacccactctagaggtg

SEQ ID NO: 7206903 - DNA, 22 bp, Homo sapiens
ggagggaatgtctagcattctt

SEQ ID NO: 7206904 - DNA, 22 bp, Homo sapiens
ggagggacccactctagaggtg

SEQ ID NO: 7206905 - DNA, 22 bp, Homo sapiens
ggagggacccactctagaggtg

SEQ ID NO: 7206906 - DNA, 22 bp, Homo sapiens
ggaggcttgatgatcttggata

SEQ ID NO: 7206907 - DNA, 22 bp, Homo sapiens
ggagggaaccttggctggattg

SEQ ID NO: 7206908 - DNA, 22 bp, Homo sapiens
ggagggaaccttggctggattg

SEQ ID NO: 7206909 - DNA, 22 bp, Homo sapiens
ggagggaagtgagttctcagct

SEQ ID NO: 7206910 - DNA, 22 bp, Homo sapiens
ggaggggaactaatcccgtgac

SEQ ID NO: 7206911 - DNA, 22 bp, Homo sapiens
ggaggggaactaatcccgtgac

SEQ ID NO: 7206912 - DNA, 23 bp, Homo sapiens
ggagggcttcatcagacccccag

SEQ ID NO: 7206913 - DNA, 23 bp, Homo sapiens
ggagggcttcatcagacccccag

SEQ ID NO: 7206914 - DNA, 18 bp, Homo sapiens
ggagggctttggggactg

SEQ ID NO: 7206915 - DNA, 18 bp, Homo sapiens
ggagggctttggggactg

SEQ ID NO: 7206916 - DNA, 18 bp, Homo sapiens
ggagggctttggggactg

SEQ ID NO: 7206917 - DNA, 22 bp, Homo sapiens
ggagggctgtagaggagacctg

SEQ ID NO: 7206918 - DNA, 22 bp, Homo sapiens
ggagggctgtagaggagacctg

SEQ ID NO: 7206919 - DNA, 22 bp, Homo sapiens
ggagggctgtagaggagacctg

SEQ ID NO: 7206920 - DNA, 22 bp, Homo sapiens
ggagggctgtagaggagacctg

SEQ ID NO: 7206921 - DNA, 22 bp, Homo sapiens
ggagggctgccaggtggagcgg

SEQ ID NO: 7206922 - DNA, 22 bp, Homo sapiens
ggagggctgccaggtggagcgg

SEQ ID NO: 7206923 - DNA, 22 bp, Homo sapiens
ggagggctcaattgactcctga

SEQ ID NO: 7206924 - DNA, 22 bp, Homo sapiens
ggagggccctgggtgcagctct

SEQ ID NO: 7206925 - DNA, 22 bp, Homo sapiens
ggagggctcaattgactcctga

SEQ ID NO: 7206926 - DNA, 22 bp, Homo sapiens
ggagggctccctgggagtggat

SEQ ID NO: 7206927 - DNA, 22 bp, Homo sapiens
ggagggctccctgggagtggat

SEQ ID NO: 7206928 - DNA, 22 bp, Homo sapiens
ggagggctccctgggagtggat

SEQ ID NO: 7206929 - DNA, 22 bp, Homo sapiens
ggagggctccctgggagtggat

SEQ ID NO: 7206930 - DNA, 22 bp, Homo sapiens
ggagggctccctgggagtggat

SEQ ID NO: 7206931 - DNA, 22 bp, Homo sapiens
ggagggctccctgggagtggat

SEQ ID NO: 7206932 - DNA, 22 bp, Homo sapiens
ggagggctccctgggagtggat

SEQ ID NO: 7206933 - DNA, 22 bp, Homo sapiens
ggagggctgccacccgctcacg

SEQ ID NO: 7206934 - DNA, 22 bp, Homo sapiens
ggagggctgccaggtggagcgg

SEQ ID NO: 7206935 - DNA, 22 bp, Homo sapiens
ggagggctgccaggtggagcgg

SEQ ID NO: 7206936 - DNA, 22 bp, Homo sapiens
ggagggctgagactggggtctg

SEQ ID NO: 7206937 - DNA, 22 bp, Homo sapiens
ggagggctgagactggggtctg

SEQ ID NO: 7206938 - DNA, 22 bp, Homo sapiens
ggagggctgagactggggtctg

SEQ ID NO: 7206939 - DNA, 22 bp, Homo sapiens
ggagggctcgtcatccaccact

SEQ ID NO: 7206940 - DNA, 22 bp, Homo sapiens
ggagggctcgtcatccaccact

SEQ ID NO: 7206941 - DNA, 22 bp, Homo sapiens
ggagggctgagactggggtctg

SEQ ID NO: 7206942 - DNA, 22 bp, Homo sapiens
ggagggctgagactggggtctg

SEQ ID NO: 7206943 - DNA, 22 bp, Homo sapiens
ggaggcggaggttgcagtgagt

SEQ ID NO: 7206944 - DNA, 22 bp, Homo sapiens
ggaggcggaggttgcagtgagc

SEQ ID NO: 7206945 - DNA, 22 bp, Homo sapiens
ggaggcggaggttgcagtgagc

SEQ ID NO: 7206946 - DNA, 22 bp, Homo sapiens
ggaggcggaggttgcagtgagc

SEQ ID NO: 7206947 - DNA, 22 bp, Homo sapiens
ggaggcggaggttgcagtgagc

SEQ ID NO: 7206948 - DNA, 22 bp, Homo sapiens
ggaggcggaggttgcagtgagt

SEQ ID NO: 7206949 - DNA, 22 bp, Homo sapiens
ggaggcggaggttgcagtgagt

SEQ ID NO: 7206950 - DNA, 22 bp, Homo sapiens
ggaggcggaggttgcagtgagt

SEQ ID NO: 7206951 - DNA, 22 bp, Homo sapiens
ggaggcggaggttgcagtgagt

SEQ ID NO: 7206952 - DNA, 22 bp, Homo sapiens
ggaggcggaggttgcagtgagt

SEQ ID NO: 7206953 - DNA, 22 bp, Homo sapiens
ggaggcggggaaggcatcccat

SEQ ID NO: 7206954 - DNA, 22 bp, Homo sapiens
ggaggcggggaaggcatcccat

SEQ ID NO: 7206955 - DNA, 23 bp, Homo sapiens
ggaggctcaagtatcacgggcag

SEQ ID NO: 7206956 - DNA, 22 bp, Homo sapiens
ggaggctcagactccatcctca

SEQ ID NO: 7206957 - DNA, 22 bp, Homo sapiens
ggaggctcagactccatcctca

SEQ ID NO: 7206958 - DNA, 22 bp, Homo sapiens
ggaggctcagactccatcctca

SEQ ID NO: 7206959 - DNA, 22 bp, Homo sapiens
ggaggctcagtgaggaaatgga

SEQ ID NO: 7206960 - DNA, 22 bp, Homo sapiens
ggaggctccactgctcttcctg

SEQ ID NO: 7206961 - DNA, 22 bp, Homo sapiens
ggaggctccatgagctcctgca

SEQ ID NO: 7206962 - DNA, 22 bp, Homo sapiens
ggaggctccatgagctcctgca

SEQ ID NO: 7206963 - DNA, 22 bp, Homo sapiens
ggaggctccatgagctcctgca

SEQ ID NO: 7206964 - DNA, 22 bp, Homo sapiens
ggaggctccatgagctcctgca

SEQ ID NO: 7206965 - DNA, 22 bp, Homo sapiens
ggaggctccatgagctcctgca

SEQ ID NO: 7206966 - DNA, 22 bp, Homo sapiens
ggaggctcccacgcagctcaca

SEQ ID NO: 7206967 - DNA, 22 bp, Homo sapiens
ggaggccatgggcagaatcttt

SEQ ID NO: 7206968 - DNA, 22 bp, Homo sapiens
ggaggccatgggcagaatcttt

SEQ ID NO: 7206969 - DNA, 22 bp, Homo sapiens
ggaggcccagaaggaagcccag

SEQ ID NO: 7206970 - DNA, 22 bp, Homo sapiens
ggaggcccagaaggaagcccag

SEQ ID NO: 7206971 - DNA, 22 bp, Homo sapiens
ggaggcccagaaggaagcccag

SEQ ID NO: 7206972 - DNA, 22 bp, Homo sapiens
ggaggcccagaaggaagcccag

SEQ ID NO: 7206973 - DNA, 22 bp, Homo sapiens
ggaggcccagagaggtgaagtg

SEQ ID NO: 7206974 - DNA, 22 bp, Homo sapiens
ggaggcctaaggtacagtttgc

SEQ ID NO: 7206975 - DNA, 22 bp, Homo sapiens
ggaggcctagaaaagtggttct

SEQ ID NO: 7206976 - DNA, 22 bp, Homo sapiens
ggaggcctagccagctccagtt

SEQ ID NO: 7206977 - DNA, 22 bp, Homo sapiens
ggaggcctagccagctccagtt

SEQ ID NO: 7206978 - DNA, 22 bp, Homo sapiens
ggaggcctagccagctccagtt

SEQ ID NO: 7206979 - DNA, 22 bp, Homo sapiens
ggaggcctagccagctccagtt

SEQ ID NO: 7206980 - DNA, 22 bp, Homo sapiens
ggaggcctagccagctccagtt

SEQ ID NO: 7206981 - DNA, 22 bp, Homo sapiens
ggaggcctcatcttgccccgtg

SEQ ID NO: 7206982 - DNA, 22 bp, Homo sapiens
ggaggcctcctgggggaggttc

SEQ ID NO: 7206983 - DNA, 22 bp, Homo sapiens
ggaggcctcctgggggaggttc

SEQ ID NO: 7206984 - DNA, 22 bp, Homo sapiens
ggaggcctggacttcctgatgg

SEQ ID NO: 7206985 - DNA, 22 bp, Homo sapiens
ggaggccttgaggccaggagct

SEQ ID NO: 7206986 - DNA, 22 bp, Homo sapiens
ggaggccttgaggccaggagct

SEQ ID NO: 7206987 - DNA, 22 bp, Homo sapiens
ggaggcggaggttgcagtgagc

SEQ ID NO: 7206988 - DNA, 22 bp, Homo sapiens
ggaggctgaggcaggcggatca

SEQ ID NO: 7206989 - DNA, 22 bp, Homo sapiens
ggaggctgaggcaggcggatca

SEQ ID NO: 7206990 - DNA, 22 bp, Homo sapiens
ggaggctgaggcaggcggatca

SEQ ID NO: 7206991 - DNA, 22 bp, Homo sapiens
ggaggctgaggcaggcggatca

SEQ ID NO: 7206992 - DNA, 22 bp, Homo sapiens
ggaggctgaggcaggcggatca

SEQ ID NO: 7206993 - DNA, 22 bp, Homo sapiens
ggaggctgaggcccctcacagg

SEQ ID NO: 7206994 - DNA, 22 bp, Homo sapiens
ggaggctgaggcccctcacagg

SEQ ID NO: 7206995 - DNA, 22 bp, Homo sapiens
ggaggctgaggcccctcacagg

SEQ ID NO: 7206996 - DNA, 22 bp, Homo sapiens
ggaggctgaggcccctcacagg

SEQ ID NO: 7206997 - DNA, 22 bp, Homo sapiens
ggaggctgctgcctcacgtggg

SEQ ID NO: 7206998 - DNA, 19 bp, Homo sapiens
ggaggcttcttggggtcgg

SEQ ID NO: 7206999 - DNA, 22 bp, Homo sapiens
ggaggcttcctggctcttgatt

SEQ ID NO: 7207000 - DNA, 22 bp, Homo sapiens
ggaggctgctgcctcacgtggg

SEQ ID NO: 7207001 - DNA, 22 bp, Homo sapiens
ggaggctgctgcctcacgtggg

SEQ ID NO: 7207002 - DNA, 22 bp, Homo sapiens
ggaggctgctgcctcacgtggg

SEQ ID NO: 7207003 - DNA, 22 bp, Homo sapiens
ggaggctgaggcccctcacagg

SEQ ID NO: 7207004 - DNA, 22 bp, Homo sapiens
ggaggctgctgcctcacgtggg

SEQ ID NO: 7207005 - DNA, 22 bp, Homo sapiens
ggaggctgagaggtcgcagtgg

SEQ ID NO: 7207006 - DNA, 22 bp, Homo sapiens
ggaggctgagaagtccaagatc

SEQ ID NO: 7207007 - DNA, 22 bp, Homo sapiens
ggaggctcttgagaggggagta

SEQ ID NO: 7207008 - DNA, 22 bp, Homo sapiens
ggaggctgagaagtccaagatc

SEQ ID NO: 7207009 - DNA, 22 bp, Homo sapiens
ggaggctgagaagtccaagatc

SEQ ID NO: 7207010 - DNA, 18 bp, Homo sapiens
ggaggctctgtggtttcc

SEQ ID NO: 7207011 - DNA, 22 bp, Homo sapiens
ggaggctcttatttgttcaaca

SEQ ID NO: 7207012 - DNA, 22 bp, Homo sapiens
ggaggctcttgagaggggagta

SEQ ID NO: 7207013 - DNA, 22 bp, Homo sapiens
ggaggctcttgagaggggagta

SEQ ID NO: 7207014 - DNA, 22 bp, Homo sapiens
ggaggctctgccatctgtcaca

SEQ ID NO: 7207015 - DNA, 22 bp, Homo sapiens
ggaggctctgccatctgtcaca

SEQ ID NO: 7207016 - DNA, 22 bp, Homo sapiens
ggaggctctgctccgtgtgttc

SEQ ID NO: 7207017 - DNA, 22 bp, Homo sapiens
ggaggctctgcttatgaaaggc

SEQ ID NO: 7207018 - DNA, 22 bp, Homo sapiens
ggaggctctgcttatgaaaggc

SEQ ID NO: 7207019 - DNA, 22 bp, Homo sapiens
ggaggctctgcttatgaaaggc

SEQ ID NO: 7207020 - DNA, 22 bp, Homo sapiens
ggaggctctgaccatttaccca

SEQ ID NO: 7207021 - DNA, 22 bp, Homo sapiens
ggaggctctcctggccttgtct

SEQ ID NO: 7207022 - DNA, 22 bp, Homo sapiens
ggaggctctaaactttccttgg

SEQ ID NO: 7207023 - DNA, 22 bp, Homo sapiens
ggaggctctcctggccttgtct

SEQ ID NO: 7207024 - DNA, 22 bp, Homo sapiens
ggaggctcccacgcagctcaca

SEQ ID NO: 7207025 - DNA, 22 bp, Homo sapiens
ggaggctcccacgcagctcaca

SEQ ID NO: 7207026 - DNA, 22 bp, Homo sapiens
ggaggctcccacgcagctcaca

SEQ ID NO: 7207027 - DNA, 22 bp, Homo sapiens
ggaggctcctaagctgacttga

SEQ ID NO: 7207028 - DNA, 22 bp, Homo sapiens
ggaggctcctaagctgacttga

SEQ ID NO: 7207029 - DNA, 22 bp, Homo sapiens
ggaggctcgctggtcgcacagc

SEQ ID NO: 7207030 - DNA, 22 bp, Homo sapiens
ggaggctcgctggtcgcacagc

SEQ ID NO: 7207031 - DNA, 22 bp, Homo sapiens
ggaggctcgctggtcgcacagc

SEQ ID NO: 7207032 - DNA, 22 bp, Homo sapiens
ggaggctctaaactttccttgg

SEQ ID NO: 7207033 - DNA, 21 bp, Homo sapiens
ggaaagaaggcaaggctcagg

SEQ ID NO: 7207034 - DNA, 21 bp, Homo sapiens
ggaaagaaggcaaggctcagg

SEQ ID NO: 7207035 - DNA, 22 bp, Homo sapiens
ggaaagaatagagactttatca

SEQ ID NO: 7207036 - DNA, 22 bp, Homo sapiens
ggaaagaatagagactttatca

SEQ ID NO: 7207037 - DNA, 22 bp, Homo sapiens
ggaaagaaccctggatggctgg

SEQ ID NO: 7207038 - DNA, 21 bp, Homo sapiens
ggaaagaaggcaaggctcagg

SEQ ID NO: 7207039 - DNA, 21 bp, Homo sapiens
ggaaagaaggcaaggctcagg

SEQ ID NO: 7207040 - DNA, 22 bp, Homo sapiens
ggaaagaaccctggatggctgg

SEQ ID NO: 7207041 - DNA, 22 bp, Homo sapiens
ggaaagaaccctggatggctgg

SEQ ID NO: 7207042 - DNA, 22 bp, Homo sapiens
ggaaagaatcaagtgatcctgt

SEQ ID NO: 7207043 - DNA, 22 bp, Homo sapiens
ggaaagaatcaagtgatcctgt

SEQ ID NO: 7207044 - DNA, 22 bp, Homo sapiens
ggaaagaatcaagtgatcctgt

SEQ ID NO: 7207045 - DNA, 22 bp, Homo sapiens
ggaaagaatcaagtgatcctgt

SEQ ID NO: 7207046 - DNA, 22 bp, Homo sapiens
ggaaagagaagttgggaggaat

SEQ ID NO: 7207047 - DNA, 22 bp, Homo sapiens
ggaaagagaagttgggaggaat

SEQ ID NO: 7207048 - DNA, 22 bp, Homo sapiens
ggaaagagaagttgggaggaat

SEQ ID NO: 7207049 - DNA, 23 bp, Homo sapiens
ggaaagagaggagttgtgcatag

SEQ ID NO: 7207050 - DNA, 23 bp, Homo sapiens
ggaaagagaggagttgtgcatag

SEQ ID NO: 7207051 - DNA, 22 bp, Homo sapiens
ggaaagagcccagcagtgcttg

SEQ ID NO: 7207052 - DNA, 22 bp, Homo sapiens
ggaaagagcccagcagtgcttg

SEQ ID NO: 7207053 - DNA, 22 bp, Homo sapiens
ggaactcctgctccaagcagct

SEQ ID NO: 7207054 - DNA, 22 bp, Homo sapiens
ggaactcctgctccaagcagct

SEQ ID NO: 7207055 - DNA, 22 bp, Homo sapiens
ggaactcctgctccaagcagct

SEQ ID NO: 7207056 - DNA, 22 bp, Homo sapiens
ggaaagccaggtgctctggtgt

SEQ ID NO: 7207057 - DNA, 19 bp, Homo sapiens
ggaactcacttagagaaac

SEQ ID NO: 7207058 - DNA, 22 bp, Homo sapiens
ggaactcagacgatcctatgtt

SEQ ID NO: 7207059 - DNA, 22 bp, Homo sapiens
ggaactcagtatcagactccag

SEQ ID NO: 7207060 - DNA, 22 bp, Homo sapiens
ggaaagaggatagtgggtaggt

SEQ ID NO: 7207061 - DNA, 22 bp, Homo sapiens
ggaaagagttttggtatatttg

SEQ ID NO: 7207062 - DNA, 22 bp, Homo sapiens
ggaaagagctaaaagggtgaga

SEQ ID NO: 7207063 - DNA, 22 bp, Homo sapiens
ggaaagagctaaaagggtgaga

SEQ ID NO: 7207064 - DNA, 22 bp, Homo sapiens
ggaaagagctaaaagggtgaga

SEQ ID NO: 7207065 - DNA, 22 bp, Homo sapiens
ggaaagagctaaaagggtgaga

SEQ ID NO: 7207066 - DNA, 22 bp, Homo sapiens
ggaaagaggatagtgggtaggt

SEQ ID NO: 7207067 - DNA, 22 bp, Homo sapiens
ggaaagaggatagtgggtaggt

SEQ ID NO: 7207068 - DNA, 22 bp, Homo sapiens
ggaaaactgaggctctcagcag

SEQ ID NO: 7207069 - DNA, 22 bp, Homo sapiens
ggaaaacaagagaatgatgttt

SEQ ID NO: 7207070 - DNA, 22 bp, Homo sapiens
ggaaaacagcgattggtatcat

SEQ ID NO: 7207071 - DNA, 22 bp, Homo sapiens
ggaaaacagcgattggtatcat

SEQ ID NO: 7207072 - DNA, 22 bp, Homo sapiens
gcttctggtgaggcctcaggaa

SEQ ID NO: 7207073 - DNA, 22 bp, Homo sapiens
ggaaaacaagagaatgatgttt

SEQ ID NO: 7207074 - DNA, 22 bp, Homo sapiens
ggaaaacaagagaatgatgttt

SEQ ID NO: 7207075 - DNA, 22 bp, Homo sapiens
gcttctggaagctgcttctgcc

SEQ ID NO: 7207076 - DNA, 22 bp, Homo sapiens
gcttctggaagctgcttctgcc

SEQ ID NO: 7207077 - DNA, 22 bp, Homo sapiens
gcttctggaagctgcttctgcc

SEQ ID NO: 7207078 - DNA, 17 bp, Homo sapiens
gcttctggagcttctgt

SEQ ID NO: 7207079 - DNA, 17 bp, Homo sapiens
gcttctggagcttctgt

SEQ ID NO: 7207080 - DNA, 22 bp, Homo sapiens
gcttctggaggagctgggctga

SEQ ID NO: 7207081 - DNA, 22 bp, Homo sapiens
gcttctggaggagctgggctga

SEQ ID NO: 7207082 - DNA, 22 bp, Homo sapiens
gcttctggaggagctgggctga

SEQ ID NO: 7207083 - DNA, 22 bp, Homo sapiens
gcttctggagtcttcagaggaa

SEQ ID NO: 7207084 - DNA, 22 bp, Homo sapiens
gcttctggcagtgcagccacca

SEQ ID NO: 7207085 - DNA, 22 bp, Homo sapiens
gcttctggggttctggcatgct

SEQ ID NO: 7207086 - DNA, 22 bp, Homo sapiens
ggaaacttggatgccagcactc

SEQ ID NO: 7207087 - DNA, 22 bp, Homo sapiens
ggaaacttggcataattttaag

SEQ ID NO: 7207088 - DNA, 22 bp, Homo sapiens
ggaaacttggcataattttaag

SEQ ID NO: 7207089 - DNA, 22 bp, Homo sapiens
ggaaacttgttattgtattttc

SEQ ID NO: 7207090 - DNA, 22 bp, Homo sapiens
ggaaagaaagtgtgaacaactt

SEQ ID NO: 7207091 - DNA, 22 bp, Homo sapiens
ggaaagaaagtgtgaacaactt

SEQ ID NO: 7207092 - DNA, 22 bp, Homo sapiens
ggaaagaaagtgtgaacaactt

SEQ ID NO: 7207093 - DNA, 21 bp, Homo sapiens
ggaaaccttccaagcagagac

SEQ ID NO: 7207094 - DNA, 22 bp, Homo sapiens
ggaaactaaagaggtgtttttg

SEQ ID NO: 7207095 - DNA, 19 bp, Homo sapiens
ggaaacagcacacttttga

SEQ ID NO: 7207096 - DNA, 19 bp, Homo sapiens
ggaaacaggggccagagga

SEQ ID NO: 7207097 - DNA, 19 bp, Homo sapiens
ggaaacaggggccagagga

SEQ ID NO: 7207098 - DNA, 19 bp, Homo sapiens
ggaaacaggggccagagga

SEQ ID NO: 7207099 - DNA, 22 bp, Homo sapiens
ggaaacatgcctgctggacagt

SEQ ID NO: 7207100 - DNA, 22 bp, Homo sapiens
ggaaacatgcctgctggacagt

SEQ ID NO: 7207101 - DNA, 22 bp, Homo sapiens
ggaagggcaaaagagatgaact

SEQ ID NO: 7207102 - DNA, 22 bp, Homo sapiens
ggaagggcaaaagagatgaact

SEQ ID NO: 7207103 - DNA, 22 bp, Homo sapiens
ggaaggggtcacctcctgatga

SEQ ID NO: 7207104 - DNA, 22 bp, Homo sapiens
ggaagggcaataaaatctcagg

SEQ ID NO: 7207105 - DNA, 22 bp, Homo sapiens
ggaagggcaaaagagatgaact

SEQ ID NO: 7207106 - DNA, 22 bp, Homo sapiens
ggaaggggtcacctcctgatga

SEQ ID NO: 7207107 - DNA, 21 bp, Homo sapiens
ggaaggggtcctcccaacagt

SEQ ID NO: 7207108 - DNA, 21 bp, Homo sapiens
ggaaggggtcctcccaacagt

SEQ ID NO: 7207109 - DNA, 22 bp, Homo sapiens
ggaaggggtgggtgagcctcag

SEQ ID NO: 7207110 - DNA, 22 bp, Homo sapiens
ggaaggggtgggtgagcctcag

SEQ ID NO: 7207111 - DNA, 22 bp, Homo sapiens
ggaaggggtgggtgagcctcag

SEQ ID NO: 7207112 - DNA, 22 bp, Homo sapiens
ggaaggggtgggtgagcctcag

SEQ ID NO: 7207113 - DNA, 22 bp, Homo sapiens
ggaaggggtgggtgagcctcag

SEQ ID NO: 7207114 - DNA, 22 bp, Homo sapiens
ggaagaaatctggttaagagat

SEQ ID NO: 7207115 - DNA, 22 bp, Homo sapiens
ggaagaaatgctcttctatgcg

SEQ ID NO: 7207116 - DNA, 22 bp, Homo sapiens
ggaagaaatgctcttctatgcg

SEQ ID NO: 7207117 - DNA, 22 bp, Homo sapiens
ggaagaacaggtttattttcct

SEQ ID NO: 7207118 - DNA, 22 bp, Homo sapiens
ggaagggagtagttggaatgca

SEQ ID NO: 7207119 - DNA, 22 bp, Homo sapiens
ggaagggagtagttggaatgca

SEQ ID NO: 7207120 - DNA, 22 bp, Homo sapiens
ggaagggagtagttggaatgca

SEQ ID NO: 7207121 - DNA, 22 bp, Homo sapiens
ggaaggggtgtcgcccatggat

SEQ ID NO: 7207122 - DNA, 22 bp, Homo sapiens
ggaaggggtgtcgcccatggat

SEQ ID NO: 7207123 - DNA, 22 bp, Homo sapiens
ggaaggggtgtcgcccatggat

SEQ ID NO: 7207124 - DNA, 22 bp, Homo sapiens
ggaaggggtgtcgcccatggat

SEQ ID NO: 7207125 - DNA, 22 bp, Homo sapiens
ggaaggggttaggggtccctga

SEQ ID NO: 7207126 - DNA, 22 bp, Homo sapiens
ggaaggggttaggggtccctga

SEQ ID NO: 7207127 - DNA, 22 bp, Homo sapiens
ggaaggggttaggggtccctga

SEQ ID NO: 7207128 - DNA, 22 bp, Homo sapiens
ggaagggtttaagcaggagagt

SEQ ID NO: 7207129 - DNA, 22 bp, Homo sapiens
ggaagggtttaagcaggagagt

SEQ ID NO: 7207130 - DNA, 22 bp, Homo sapiens
ggaaggtcgagctgcatctggc

SEQ ID NO: 7207131 - DNA, 19 bp, Homo sapiens
ggaaggtgacagtggtgaa

SEQ ID NO: 7207132 - DNA, 19 bp, Homo sapiens
ggaaggtgacagtggtgaa

SEQ ID NO: 7207133 - DNA, 22 bp, Homo sapiens
ggaaggtgaggtaaggtcttgt

SEQ ID NO: 7207134 - DNA, 18 bp, Homo sapiens
ggaaggtgatgtgaaaag

SEQ ID NO: 7207135 - DNA, 22 bp, Homo sapiens
ggaaggtgctccctggacagag

SEQ ID NO: 7207136 - DNA, 22 bp, Homo sapiens
ggaagaaaggtggacaacaggt

SEQ ID NO: 7207137 - DNA, 22 bp, Homo sapiens
ggaagaaaggtggacaacaggt

SEQ ID NO: 7207138 - DNA, 22 bp, Homo sapiens
ggaagaaaggtggacaacaggt

SEQ ID NO: 7207139 - DNA, 22 bp, Homo sapiens
ggaagaaaggtggacaacaggt

SEQ ID NO: 7207140 - DNA, 22 bp, Homo sapiens
ggaagaaaggtggacaacaggt

SEQ ID NO: 7207141 - DNA, 22 bp, Homo sapiens
ggaagaaaggtggacaacaggt

SEQ ID NO: 7207142 - DNA, 22 bp, Homo sapiens
ggaagaaaggtggacaacaggt

SEQ ID NO: 7207143 - DNA, 22 bp, Homo sapiens
ggaagaaagtagaaaaccgtgg

SEQ ID NO: 7207144 - DNA, 22 bp, Homo sapiens
ggaagaaagtagaaaaccgtgg

SEQ ID NO: 7207145 - DNA, 22 bp, Homo sapiens
ggaagaaagtagaaaaccgtgg

SEQ ID NO: 7207146 - DNA, 22 bp, Homo sapiens
ggaagaaatctggttaagagat

SEQ ID NO: 7207147 - DNA, 22 bp, Homo sapiens
ggaagaaatctggttaagagat

SEQ ID NO: 7207148 - DNA, 22 bp, Homo sapiens
ggaagaaatctggttaagagat

SEQ ID NO: 7207149 - DNA, 22 bp, Homo sapiens
ggaagaaagcacacaaacttga

SEQ ID NO: 7207150 - DNA, 22 bp, Homo sapiens
ggaagaaagcacacaaacttga

SEQ ID NO: 7207151 - DNA, 22 bp, Homo sapiens
ggaagaaagacatttattttga

SEQ ID NO: 7207152 - DNA, 22 bp, Homo sapiens
ggaagaaagcacacaaacttga

SEQ ID NO: 7207153 - DNA, 22 bp, Homo sapiens
ggaagaaagcacacaaacttga

SEQ ID NO: 7207154 - DNA, 22 bp, Homo sapiens
ggaagaaaggtggacaacaggt

SEQ ID NO: 7207155 - DNA, 22 bp, Homo sapiens
ggaagaaaggtggacaacaggt

SEQ ID NO: 7207156 - DNA, 22 bp, Homo sapiens
ggaagaaagacatttattttga

SEQ ID NO: 7207157 - DNA, 22 bp, Homo sapiens
ggaagaaaatgggcaacaggtg

SEQ ID NO: 7207158 - DNA, 22 bp, Homo sapiens
ggaagaaaatgggcaacaggtg

SEQ ID NO: 7207159 - DNA, 22 bp, Homo sapiens
ggaagaaaatgggcaacaggtg

SEQ ID NO: 7207160 - DNA, 17 bp, Homo sapiens
ggaagaaaaggatcatc

SEQ ID NO: 7207161 - DNA, 17 bp, Homo sapiens
ggaagaaaaggatcatc

SEQ ID NO: 7207162 - DNA, 18 bp, Homo sapiens
ggaagaaaaggaactcag

SEQ ID NO: 7207163 - DNA, 18 bp, Homo sapiens
ggaagaaaaggaactcag

SEQ ID NO: 7207164 - DNA, 18 bp, Homo sapiens
ggaagaaaaggaactcag

SEQ ID NO: 7207165 - DNA, 22 bp, Homo sapiens
ggaagaaaagcttccagcgcct

SEQ ID NO: 7207166 - DNA, 18 bp, Homo sapiens
ggaagaaaaggaactcag

SEQ ID NO: 7207167 - DNA, 18 bp, Homo sapiens
ggaagaaaaggaactcag

SEQ ID NO: 7207168 - DNA, 17 bp, Homo sapiens
ggaagaaaaggatcatc

SEQ ID NO: 7207169 - DNA, 17 bp, Homo sapiens
ggaagaaaaggatcatc

SEQ ID NO: 7207170 - DNA, 22 bp, Homo sapiens
ggaagaaaatgggcaacaggtg

SEQ ID NO: 7207171 - DNA, 22 bp, Homo sapiens
ggaagaaaatgggcaacaggtg

SEQ ID NO: 7207172 - DNA, 22 bp, Homo sapiens
ggaactgaggaacgaactggga

SEQ ID NO: 7207173 - DNA, 22 bp, Homo sapiens
ggaagaaaagcttccagcgcct

SEQ ID NO: 7207174 - DNA, 22 bp, Homo sapiens
gcttctgcgcctagcctcaggt

SEQ ID NO: 7207175 - DNA, 22 bp, Homo sapiens
gcttctgatgtcagacttctgg

SEQ ID NO: 7207176 - DNA, 22 bp, Homo sapiens
gcttctgcagggtcctcgctgt

SEQ ID NO: 7207177 - DNA, 23 bp, Homo sapiens
gcttctgccatttgctagctgtg

SEQ ID NO: 7207178 - DNA, 22 bp, Homo sapiens
gcttcggggtccaagcgcgtgt

SEQ ID NO: 7207179 - DNA, 22 bp, Homo sapiens
gcttctaatttcctttgagatt

SEQ ID NO: 7207180 - DNA, 22 bp, Homo sapiens
gcttctaattttttacagaata

SEQ ID NO: 7207181 - DNA, 22 bp, Homo sapiens
gcttctaattttttacagaata

SEQ ID NO: 7207182 - DNA, 22 bp, Homo sapiens
gcttctagggaaggcagtcaca

SEQ ID NO: 7207183 - DNA, 23 bp, Homo sapiens
gcttctagtcaatttcaccagga

SEQ ID NO: 7207184 - DNA, 22 bp, Homo sapiens
gcttctcaattctcaccctcca

SEQ ID NO: 7207185 - DNA, 20 bp, Homo sapiens
gcttctcagggcttctctga

SEQ ID NO: 7207186 - DNA, 17 bp, Homo sapiens
gcttcctgtgctgggga

SEQ ID NO: 7207187 - DNA, 22 bp, Homo sapiens
gcttcctgtccaggccccacat

SEQ ID NO: 7207188 - DNA, 22 bp, Homo sapiens
gcttcctgtccctcagccatga

SEQ ID NO: 7207189 - DNA, 22 bp, Homo sapiens
gcttcctgtccctcagccatga

SEQ ID NO: 7207190 - DNA, 22 bp, Homo sapiens
gcttcctgtccctcagccatga

SEQ ID NO: 7207191 - DNA, 22 bp, Homo sapiens
gcttcctgtatcctcctgtacc

SEQ ID NO: 7207192 - DNA, 22 bp, Homo sapiens
gcttcctgtatcctcctgtacc

SEQ ID NO: 7207193 - DNA, 22 bp, Homo sapiens
gcttcctgtatcctcctgtacc

SEQ ID NO: 7207194 - DNA, 22 bp, Homo sapiens
gcttcctgtatcctcctgtacc

SEQ ID NO: 7207195 - DNA, 22 bp, Homo sapiens
gcttcctgtaggcaggtccaag

SEQ ID NO: 7207196 - DNA, 22 bp, Homo sapiens
gcttcctgtaggcaggtccaag

SEQ ID NO: 7207197 - DNA, 22 bp, Homo sapiens
gcttcctgtaggcaggtccaag

SEQ ID NO: 7207198 - DNA, 22 bp, Homo sapiens
gcttcctgtaggcaggtccaag

SEQ ID NO: 7207199 - DNA, 22 bp, Homo sapiens
gcttccttattgttgccatagt

SEQ ID NO: 7207200 - DNA, 22 bp, Homo sapiens
gcttccttccttacattggtgg

SEQ ID NO: 7207201 - DNA, 22 bp, Homo sapiens
gcttccttctaccacatcatgc

SEQ ID NO: 7207202 - DNA, 22 bp, Homo sapiens
gcttccttggtcctggtctaag

SEQ ID NO: 7207203 - DNA, 22 bp, Homo sapiens
gcttcggggtccaagcgcgtgt

SEQ ID NO: 7207204 - DNA, 22 bp, Homo sapiens
gcttcatgaaaatcactggtca

SEQ ID NO: 7207205 - DNA, 22 bp, Homo sapiens
gcttcagcctcacactgatatc

SEQ ID NO: 7207206 - DNA, 22 bp, Homo sapiens
gcttcagcctcacactgatatc

SEQ ID NO: 7207207 - DNA, 22 bp, Homo sapiens
gcttcagctttgtctccttggg

SEQ ID NO: 7207208 - DNA, 20 bp, Homo sapiens
gcttcagtttcctcactggt

SEQ ID NO: 7207209 - DNA, 22 bp, Homo sapiens
gcttcatttgagaacctctgtg

SEQ ID NO: 7207210 - DNA, 22 bp, Homo sapiens
gcttcctggagggagagagctg

SEQ ID NO: 7207211 - DNA, 22 bp, Homo sapiens
gcttcctggagggagagagctg

SEQ ID NO: 7207212 - DNA, 22 bp, Homo sapiens
gcttcattactgacagtctgtg

SEQ ID NO: 7207213 - DNA, 22 bp, Homo sapiens
gcttcctggagggagagagctg

SEQ ID NO: 7207214 - DNA, 22 bp, Homo sapiens
gcttcctgggacaggctatgtg

SEQ ID NO: 7207215 - DNA, 22 bp, Homo sapiens
gcttcctgggacaggctatgtg

SEQ ID NO: 7207216 - DNA, 22 bp, Homo sapiens
gcttcctgggacaggctatgtg

SEQ ID NO: 7207217 - DNA, 22 bp, Homo sapiens
gcttattttcaccttctctcag

SEQ ID NO: 7207218 - DNA, 20 bp, Homo sapiens
gcttcagaacctgggtgctg

SEQ ID NO: 7207219 - DNA, 22 bp, Homo sapiens
gcttcagaagttgggctctgac

SEQ ID NO: 7207220 - DNA, 22 bp, Homo sapiens
gcttcagacctgaaaggaaaaa

SEQ ID NO: 7207221 - DNA, 22 bp, Homo sapiens
gcttcagactggagcagaggaa

SEQ ID NO: 7207222 - DNA, 22 bp, Homo sapiens
gcttcagactgtgcttctgttg

SEQ ID NO: 7207223 - DNA, 22 bp, Homo sapiens
gcttcagagatttcactagttt

SEQ ID NO: 7207224 - DNA, 22 bp, Homo sapiens
gcttcagattcctcttctgtaa

SEQ ID NO: 7207225 - DNA, 22 bp, Homo sapiens
gcttcagattcttttcatgtct

SEQ ID NO: 7207226 - DNA, 21 bp, Homo sapiens
gcttcagcaaggcttgctggt

SEQ ID NO: 7207227 - DNA, 22 bp, Homo sapiens
gcttcagcccatcccagtacat

SEQ ID NO: 7207228 - DNA, 22 bp, Homo sapiens
gcttcagcccatcccagtacat

SEQ ID NO: 7207229 - DNA, 22 bp, Homo sapiens
gcttcagccgggcacttaatga

SEQ ID NO: 7207230 - DNA, 22 bp, Homo sapiens
gcttcagcctcacactgatatc

SEQ ID NO: 7207231 - DNA, 22 bp, Homo sapiens
gctgggctgagctagacttggc

SEQ ID NO: 7207232 - DNA, 22 bp, Homo sapiens
gctgggctctgtcatgccttcc

SEQ ID NO: 7207233 - DNA, 21 bp, Homo sapiens
gctgggctccagtctgccgct

SEQ ID NO: 7207234 - DNA, 22 bp, Homo sapiens
gctgggctcgttcccacacgcg

SEQ ID NO: 7207235 - DNA, 22 bp, Homo sapiens
gctgggccagagcagcagcact

SEQ ID NO: 7207236 - DNA, 22 bp, Homo sapiens
gctgggccagagcagcagcact

SEQ ID NO: 7207237 - DNA, 22 bp, Homo sapiens
gctgggccagagcagcagcact

SEQ ID NO: 7207238 - DNA, 22 bp, Homo sapiens
gctgggccagagcagcagcact

SEQ ID NO: 7207239 - DNA, 22 bp, Homo sapiens
gctgggcagtgagtgagtcctt

SEQ ID NO: 7207240 - DNA, 22 bp, Homo sapiens
gctgggccagactttcaatgtc

SEQ ID NO: 7207241 - DNA, 22 bp, Homo sapiens
gctgggctccaggccagggtga

SEQ ID NO: 7207242 - DNA, 22 bp, Homo sapiens
gctgggctccaggccagggtga

SEQ ID NO: 7207243 - DNA, 22 bp, Homo sapiens
gctgggctcatttgtgtgtctg

SEQ ID NO: 7207244 - DNA, 22 bp, Homo sapiens
gctgggctcatttgtgtgtctg

SEQ ID NO: 7207245 - DNA, 22 bp, Homo sapiens
gctgggctccaccctcaactgt

SEQ ID NO: 7207246 - DNA, 22 bp, Homo sapiens
gcttagaagtacacatgccttt

SEQ ID NO: 7207247 - DNA, 22 bp, Homo sapiens
gcttagcaatgtgacaagatgc

SEQ ID NO: 7207248 - DNA, 22 bp, Homo sapiens
gcttagcaatgtgacaagatgc

SEQ ID NO: 7207249 - DNA, 20 bp, Homo sapiens
gcttagcaggcatagtagct

SEQ ID NO: 7207250 - DNA, 22 bp, Homo sapiens
gcttagcagtcacacattgttc

SEQ ID NO: 7207251 - DNA, 22 bp, Homo sapiens
gcttagcatcttacaatgctga

SEQ ID NO: 7207252 - DNA, 22 bp, Homo sapiens
gcttacactaaacaagtttcct

SEQ ID NO: 7207253 - DNA, 22 bp, Homo sapiens
gcttacaagccagctgtaccac

SEQ ID NO: 7207254 - DNA, 22 bp, Homo sapiens
gcttagaaagtgattgatacat

SEQ ID NO: 7207255 - DNA, 22 bp, Homo sapiens
gcttagaagattgaccctggtt

SEQ ID NO: 7207256 - DNA, 22 bp, Homo sapiens
gcttagtcaattataaataggc

SEQ ID NO: 7207257 - DNA, 22 bp, Homo sapiens
gcttagtcaattataaataggc

SEQ ID NO: 7207258 - DNA, 22 bp, Homo sapiens
gcttagtcaattataaataggc

SEQ ID NO: 7207259 - DNA, 22 bp, Homo sapiens
gcttagtcaattataaataggc

SEQ ID NO: 7207260 - DNA, 22 bp, Homo sapiens
gcttattttatcctattcacta

SEQ ID NO: 7207261 - DNA, 22 bp, Homo sapiens
gcttattttcaccttctctcag

SEQ ID NO: 7207262 - DNA, 22 bp, Homo sapiens
gcttattttcaccttctctcag

SEQ ID NO: 7207263 - DNA, 22 bp, Homo sapiens
gctgggctgcgtcggggaagcc

SEQ ID NO: 7207264 - DNA, 22 bp, Homo sapiens
gctgggctgcgtcggggaagcc

SEQ ID NO: 7207265 - DNA, 22 bp, Homo sapiens
gctgggctgcccaacctctgac

SEQ ID NO: 7207266 - DNA, 22 bp, Homo sapiens
gcttaattctggctcagtttcc

SEQ ID NO: 7207267 - DNA, 22 bp, Homo sapiens
gcttaattctggctcagtttcc

SEQ ID NO: 7207268 - DNA, 22 bp, Homo sapiens
gcttacaaacaacagaaattaa

SEQ ID NO: 7207269 - DNA, 22 bp, Homo sapiens
gcttacaagatcgtgctccagt

SEQ ID NO: 7207270 - DNA, 22 bp, Homo sapiens
gctgggctggaaggccaaggca

SEQ ID NO: 7207271 - DNA, 22 bp, Homo sapiens
gcttaagatgtttgtggcaatt

SEQ ID NO: 7207272 - DNA, 22 bp, Homo sapiens
gcttaattctggctcagtttcc

SEQ ID NO: 7207273 - DNA, 22 bp, Homo sapiens
gcttaattctggctcagtttcc

SEQ ID NO: 7207274 - DNA, 22 bp, Homo sapiens
ggaggaagccctcggtgcccca

SEQ ID NO: 7207275 - DNA, 22 bp, Homo sapiens
ggaggaagtgcagttctactac

SEQ ID NO: 7207276 - DNA, 22 bp, Homo sapiens
ggaggaagggtagcataatgta

SEQ ID NO: 7207277 - DNA, 22 bp, Homo sapiens
ggaggaagggcccaggctttat

SEQ ID NO: 7207278 - DNA, 22 bp, Homo sapiens
ggaggaagcacacggcttgtat

SEQ ID NO: 7207279 - DNA, 22 bp, Homo sapiens
ggaggaagcacacggcttgtat

SEQ ID NO: 7207280 - DNA, 22 bp, Homo sapiens
ggaggaaatgaaaggagggttt

SEQ ID NO: 7207281 - DNA, 22 bp, Homo sapiens
ggaggaaatgaaaggagggttt

SEQ ID NO: 7207282 - DNA, 22 bp, Homo sapiens
ggaggaagaggttgttctctca

SEQ ID NO: 7207283 - DNA, 22 bp, Homo sapiens
ggaggagctgctgtgggggccc

SEQ ID NO: 7207284 - DNA, 22 bp, Homo sapiens
ggaggagcatgagagggtagtg

SEQ ID NO: 7207285 - DNA, 22 bp, Homo sapiens
ggaggagcatgagagggtagtg

SEQ ID NO: 7207286 - DNA, 22 bp, Homo sapiens
ggaggagcatgagagggtagtg

SEQ ID NO: 7207287 - DNA, 22 bp, Homo sapiens
ggaggagcatgagagggtagtg

SEQ ID NO: 7207288 - DNA, 22 bp, Homo sapiens
ggaggagcatgagagggtagtg

SEQ ID NO: 7207289 - DNA, 22 bp, Homo sapiens
ggaggacaggggctgcagcaca

SEQ ID NO: 7207290 - DNA, 22 bp, Homo sapiens
ggaggacactggctctgccttc

SEQ ID NO: 7207291 - DNA, 22 bp, Homo sapiens
ggaggacactggctctgccttc

SEQ ID NO: 7207292 - DNA, 22 bp, Homo sapiens
ggagctgaggtaacagtgagtg

SEQ ID NO: 7207293 - DNA, 22 bp, Homo sapiens
ggagctgaggtaacagtgagtg

SEQ ID NO: 7207294 - DNA, 22 bp, Homo sapiens
ggagctgagttcttcagccggg

SEQ ID NO: 7207295 - DNA, 22 bp, Homo sapiens
ggagctgaggaatagctttgat

SEQ ID NO: 7207296 - DNA, 22 bp, Homo sapiens
ggagctgatgacgtcaccatgg

SEQ ID NO: 7207297 - DNA, 22 bp, Homo sapiens
ggagctgatggtagaagaatga

SEQ ID NO: 7207298 - DNA, 22 bp, Homo sapiens
ggagctgatggtagaagaatga

SEQ ID NO: 7207299 - DNA, 22 bp, Homo sapiens
ggagctgcacgctctgaagcct

SEQ ID NO: 7207300 - DNA, 22 bp, Homo sapiens
ggaggaaatccttagtaaggca

SEQ ID NO: 7207301 - DNA, 22 bp, Homo sapiens
ggaggaaatccttagtaaggca

SEQ ID NO: 7207302 - DNA, 22 bp, Homo sapiens
ggaggaaatccttagtaaggca

SEQ ID NO: 7207303 - DNA, 22 bp, Homo sapiens
ggagctgagacccagtggctga

SEQ ID NO: 7207304 - DNA, 22 bp, Homo sapiens
ggagctgagacccagtggctga

SEQ ID NO: 7207305 - DNA, 22 bp, Homo sapiens
ggagctctcctgatgtgaagat

SEQ ID NO: 7207306 - DNA, 22 bp, Homo sapiens
ggagctctgtgtctctcctgcc

SEQ ID NO: 7207307 - DNA, 22 bp, Homo sapiens
ggagctcataacaaggtagcca

SEQ ID NO: 7207308 - DNA, 22 bp, Homo sapiens
ggagctcataacaaggtagcca

SEQ ID NO: 7207309 - DNA, 22 bp, Homo sapiens
ggagctcagaagtgagtgagtt

SEQ ID NO: 7207310 - DNA, 22 bp, Homo sapiens
ggagctcagaagtgagtgagtt

SEQ ID NO: 7207311 - DNA, 22 bp, Homo sapiens
ggagctcaggcccagcaaggcc

SEQ ID NO: 7207312 - DNA, 22 bp, Homo sapiens
ggagctcagtggggggactgtg

SEQ ID NO: 7207313 - DNA, 22 bp, Homo sapiens
ggagctcagtggggggactgtg

SEQ ID NO: 7207314 - DNA, 22 bp, Homo sapiens
ggaggcagaatagagtgtgggt

SEQ ID NO: 7207315 - DNA, 22 bp, Homo sapiens
ggaggcagaatagagtgtgggt

SEQ ID NO: 7207316 - DNA, 22 bp, Homo sapiens
ggaggaggcggcagaagttcct

SEQ ID NO: 7207317 - DNA, 22 bp, Homo sapiens
ggaggcagaatagagtgtgggt

SEQ ID NO: 7207318 - DNA, 22 bp, Homo sapiens
ggaggcagaatagagtgtgggt

SEQ ID NO: 7207319 - DNA, 22 bp, Homo sapiens
ggaggcagaatagagtgtgggt

SEQ ID NO: 7207320 - DNA, 22 bp, Homo sapiens
ggaggcagaatagagtgtgggt

SEQ ID NO: 7207321 - DNA, 22 bp, Homo sapiens
ggaggcagaatagagtgtgggt

SEQ ID NO: 7207322 - DNA, 22 bp, Homo sapiens
ggaggcagaatagagtgtgggt

SEQ ID NO: 7207323 - DNA, 22 bp, Homo sapiens
ggaggccaaggcgggcggatca

SEQ ID NO: 7207324 - DNA, 22 bp, Homo sapiens
ggaggaggcggcagaagttcct

SEQ ID NO: 7207325 - DNA, 22 bp, Homo sapiens
ggaggaggcggcagaagttcct

SEQ ID NO: 7207326 - DNA, 22 bp, Homo sapiens
ggaggaggcaagtaccagatgc

SEQ ID NO: 7207327 - DNA, 22 bp, Homo sapiens
ggaggaggcaagtaccagatgc

SEQ ID NO: 7207328 - DNA, 22 bp, Homo sapiens
ggaggaggcggcagaagttcct

SEQ ID NO: 7207329 - DNA, 22 bp, Homo sapiens
ggaggaggcggcagaagttcct

SEQ ID NO: 7207330 - DNA, 22 bp, Homo sapiens
ggaggaggcaagtaccagatgc

SEQ ID NO: 7207331 - DNA, 22 bp, Homo sapiens
ggaggaggcaagtaccagatgc

SEQ ID NO: 7207332 - DNA, 22 bp, Homo sapiens
ggaggaggcaagtaccagatgc

SEQ ID NO: 7207333 - DNA, 22 bp, Homo sapiens
ggaggagctgctgtgggggccc

SEQ ID NO: 7207334 - DNA, 22 bp, Homo sapiens
ggaggaggcaagtaccagatgc

SEQ ID NO: 7207335 - DNA, 22 bp, Homo sapiens
ggaggaggcaagtaccagatgc

SEQ ID NO: 7207336 - DNA, 22 bp, Homo sapiens
ggaggaggcaagtaccagatgc

SEQ ID NO: 7207337 - DNA, 22 bp, Homo sapiens
ggaggaggcaagtaccagatgc

SEQ ID NO: 7207338 - DNA, 22 bp, Homo sapiens
ggaggccacctgacctgctgtt

SEQ ID NO: 7207339 - DNA, 22 bp, Homo sapiens
ggaggccacctgacctgctgtt

SEQ ID NO: 7207340 - DNA, 22 bp, Homo sapiens
ggaggccacctgacctgctgtt

SEQ ID NO: 7207341 - DNA, 22 bp, Homo sapiens
ggaggccacggtttagcaccga

SEQ ID NO: 7207342 - DNA, 22 bp, Homo sapiens
ggaggccagaatctgtgttgga

SEQ ID NO: 7207343 - DNA, 22 bp, Homo sapiens
ggaggccagcctgaggctgagg

SEQ ID NO: 7207344 - DNA, 22 bp, Homo sapiens
ggaggccagcctgaggctgagg

SEQ ID NO: 7207345 - DNA, 22 bp, Homo sapiens
ggaggccaccatggagtcactt

SEQ ID NO: 7207346 - DNA, 22 bp, Homo sapiens
ggaggccaccatggagtcactt

SEQ ID NO: 7207347 - DNA, 22 bp, Homo sapiens
ggaggccaattttctaactgca

SEQ ID NO: 7207348 - DNA, 22 bp, Homo sapiens
ggaggccaattttctaactgca

SEQ ID NO: 7207349 - DNA, 22 bp, Homo sapiens
ggaggccaaggcgggcggatca

SEQ ID NO: 7207350 - DNA, 22 bp, Homo sapiens
ggaggccaaggtgggcggatca

SEQ ID NO: 7207351 - DNA, 22 bp, Homo sapiens
ggaggccaaggtgggcggatca

SEQ ID NO: 7207352 - DNA, 22 bp, Homo sapiens
ggaggccaagtcactgacctgg

SEQ ID NO: 7207353 - DNA, 22 bp, Homo sapiens
ggaggccatgaggctctaggtg

SEQ ID NO: 7207354 - DNA, 22 bp, Homo sapiens
ggaggccatctggctggaggct

SEQ ID NO: 7207355 - DNA, 22 bp, Homo sapiens
ggaggccatctggctggaggct

SEQ ID NO: 7207356 - DNA, 22 bp, Homo sapiens
ggaggccatgaggctctaggtg

SEQ ID NO: 7207357 - DNA, 22 bp, Homo sapiens
ggaggccatcagggagggcatt

SEQ ID NO: 7207358 - DNA, 22 bp, Homo sapiens
ggaggccatcagggagggcatt

SEQ ID NO: 7207359 - DNA, 22 bp, Homo sapiens
ggaggccatctggctggaggct

SEQ ID NO: 7207360 - DNA, 22 bp, Homo sapiens
ggaggccatctggctggaggct

SEQ ID NO: 7207361 - DNA, 22 bp, Homo sapiens
ggaggccatcagggagggcatt

SEQ ID NO: 7207362 - DNA, 22 bp, Homo sapiens
ggaggccatcagggagggcatt

SEQ ID NO: 7207363 - DNA, 22 bp, Homo sapiens
ggaggccagtcctggccgggct

SEQ ID NO: 7207364 - DNA, 22 bp, Homo sapiens
ggaggccagtcctggccgggct

SEQ ID NO: 7207365 - DNA, 22 bp, Homo sapiens
ggaggccatagtttgggagtca

SEQ ID NO: 7207366 - DNA, 22 bp, Homo sapiens
ggaggccatagtttgggagtca

SEQ ID NO: 7207367 - DNA, 22 bp, Homo sapiens
ggaggccagcctgaggctgagg

SEQ ID NO: 7207368 - DNA, 22 bp, Homo sapiens
ggaggccagcctgaggctgagg

SEQ ID NO: 7207369 - DNA, 22 bp, Homo sapiens
ggaggccagcctgaggctgagg

SEQ ID NO: 7207370 - DNA, 22 bp, Homo sapiens
ggaggccaggaagagccgccct

SEQ ID NO: 7207371 - DNA, 22 bp, Homo sapiens
ggaggccaggaagagccgccct

SEQ ID NO: 7207372 - DNA, 22 bp, Homo sapiens
ggaggccaggaaggctcggaga

SEQ ID NO: 7207373 - DNA, 22 bp, Homo sapiens
ggaggccaggaaggctcggaga

SEQ ID NO: 7207374 - DNA, 22 bp, Homo sapiens
ggaggccaggatgggaactcaa

SEQ ID NO: 7207375 - DNA, 15 bp, Homo sapiens
ggaggccaggctgtg

SEQ ID NO: 7207376 - DNA, 22 bp, Homo sapiens
ggaggccagggacccagtcagc

SEQ ID NO: 7207377 - DNA, 22 bp, Homo sapiens
ggaggccagggtgggtggatcg

SEQ ID NO: 7207378 - DNA, 22 bp, Homo sapiens
ggaggccaggtgggagtcatct

SEQ ID NO: 7207379 - DNA, 22 bp, Homo sapiens
ggaggccaggtgggagtcatct

SEQ ID NO: 7207380 - DNA, 22 bp, Homo sapiens
ggaggccaggtgggagtcatct

SEQ ID NO: 7207381 - DNA, 22 bp, Homo sapiens
ggaggccaggtgggagtcatct

SEQ ID NO: 7207382 - DNA, 22 bp, Homo sapiens
ggagaggggaacttgttgcttg

SEQ ID NO: 7207383 - DNA, 22 bp, Homo sapiens
ggagaggggaacttgttgcttg

SEQ ID NO: 7207384 - DNA, 22 bp, Homo sapiens
ggagaggcttggcccagcctgg

SEQ ID NO: 7207385 - DNA, 22 bp, Homo sapiens
ggagaggggaacttgttgcttg

SEQ ID NO: 7207386 - DNA, 22 bp, Homo sapiens
ggagaggggaacttgttgcttg

SEQ ID NO: 7207387 - DNA, 22 bp, Homo sapiens
ggagagggggctccctgcttgg

SEQ ID NO: 7207388 - DNA, 22 bp, Homo sapiens
ggagagggggctccctgcttgg

SEQ ID NO: 7207389 - DNA, 22 bp, Homo sapiens
ggagaggggaacttgttgcttg

SEQ ID NO: 7207390 - DNA, 22 bp, Homo sapiens
ggagaggggcaagtttatctag

SEQ ID NO: 7207391 - DNA, 23 bp, Homo sapiens
ggagaggggtgtgggcatcttta

SEQ ID NO: 7207392 - DNA, 22 bp, Homo sapiens
ggagagggggctccctgcttgg

SEQ ID NO: 7207393 - DNA, 22 bp, Homo sapiens
ggagagggggctccctgcttgg

SEQ ID NO: 7207394 - DNA, 22 bp, Homo sapiens
ggagagggtaggggtcctgccc

SEQ ID NO: 7207395 - DNA, 22 bp, Homo sapiens
ggagagggtaggggtcctgccc

SEQ ID NO: 7207396 - DNA, 22 bp, Homo sapiens
ggagagggtaggggtcctgccc

SEQ ID NO: 7207397 - DNA, 22 bp, Homo sapiens
ggagagggtaggggtcctgccc

SEQ ID NO: 7207398 - DNA, 22 bp, Homo sapiens
ggagagggtaggggtcctgccc

SEQ ID NO: 7207399 - DNA, 23 bp, Homo sapiens
ggagaggggtgtgggcatcttta

SEQ ID NO: 7207400 - DNA, 23 bp, Homo sapiens
ggagaggggtgtgggcatcttta

SEQ ID NO: 7207401 - DNA, 23 bp, Homo sapiens
ggagaggggtgtgggcatcttta

SEQ ID NO: 7207402 - DNA, 23 bp, Homo sapiens
ggagaggggtgtgggcatcttta

SEQ ID NO: 7207403 - DNA, 22 bp, Homo sapiens
ggagagggtaggggtcctgccc

SEQ ID NO: 7207404 - DNA, 22 bp, Homo sapiens
ggagagggtaggggtcctgccc

SEQ ID NO: 7207405 - DNA, 22 bp, Homo sapiens
ggagagggtaggggtcctgccc

SEQ ID NO: 7207406 - DNA, 22 bp, Homo sapiens
ggagagggtgtggaaagttatc

SEQ ID NO: 7207407 - DNA, 22 bp, Homo sapiens
ggagagggtgtggaaagttatc

SEQ ID NO: 7207408 - DNA, 22 bp, Homo sapiens
ggagagggtaggggtcctgccc

SEQ ID NO: 7207409 - DNA, 22 bp, Homo sapiens
ggagagggtgtggaaagttatc

SEQ ID NO: 7207410 - DNA, 22 bp, Homo sapiens
ggagagggtgtggaaagttatc

SEQ ID NO: 7207411 - DNA, 22 bp, Homo sapiens
ggagagggtgtggaaagttatc

SEQ ID NO: 7207412 - DNA, 17 bp, Homo sapiens
ggagatctggcagaggg

SEQ ID NO: 7207413 - DNA, 17 bp, Homo sapiens
ggagatctggcagaggg

SEQ ID NO: 7207414 - DNA, 22 bp, Homo sapiens
ggagatcttgcttgaaggcatg

SEQ ID NO: 7207415 - DNA, 22 bp, Homo sapiens
ggagatctttaggagttggact

SEQ ID NO: 7207416 - DNA, 22 bp, Homo sapiens
ggagaggtgcaggtcagtggca

SEQ ID NO: 7207417 - DNA, 22 bp, Homo sapiens
ggagaggtgcaggtcagtggca

SEQ ID NO: 7207418 - DNA, 22 bp, Homo sapiens
ggagaggtgtattcagtgggtc

SEQ ID NO: 7207419 - DNA, 22 bp, Homo sapiens
ggagaggtgaatggctgctcta

SEQ ID NO: 7207420 - DNA, 22 bp, Homo sapiens
ggagatgctatgtagtttggtt

SEQ ID NO: 7207421 - DNA, 22 bp, Homo sapiens
ggagatgctatgtagtttggtt

SEQ ID NO: 7207422 - DNA, 23 bp, Homo sapiens
ggagatgcttaagagtggttgag

SEQ ID NO: 7207423 - DNA, 22 bp, Homo sapiens
ggagatgccagaattgcaaatt

SEQ ID NO: 7207424 - DNA, 20 bp, Homo sapiens
ggagatgcagcccaggtgcc

SEQ ID NO: 7207425 - DNA, 22 bp, Homo sapiens
ggagatctttaggagttggact

SEQ ID NO: 7207426 - DNA, 22 bp, Homo sapiens
ggagatctttgttatcttttga

SEQ ID NO: 7207427 - DNA, 22 bp, Homo sapiens
ggagatctttgttatcttttga

SEQ ID NO: 7207428 - DNA, 22 bp, Homo sapiens
ggagatgacacaatttatttat

SEQ ID NO: 7207429 - DNA, 22 bp, Homo sapiens
ggagatgctttccagtggggat

SEQ ID NO: 7207430 - DNA, 22 bp, Homo sapiens
ggagatgctttccagtggggat

SEQ ID NO: 7207431 - DNA, 22 bp, Homo sapiens
ggagatggaatagattctgact

SEQ ID NO: 7207432 - DNA, 22 bp, Homo sapiens
ggagatggaatagattctgact

SEQ ID NO: 7207433 - DNA, 22 bp, Homo sapiens
ggagcctggttactagagcctg

SEQ ID NO: 7207434 - DNA, 22 bp, Homo sapiens
ggagcctggttactagagcctg

SEQ ID NO: 7207435 - DNA, 22 bp, Homo sapiens
ggagcctggttactagagcctg

SEQ ID NO: 7207436 - DNA, 22 bp, Homo sapiens
ggagcctggttactagagcctg

SEQ ID NO: 7207437 - DNA, 22 bp, Homo sapiens
ggagcctgtgcccaagcccaga

SEQ ID NO: 7207438 - DNA, 22 bp, Homo sapiens
ggagcctgtgggatgagatgtg

SEQ ID NO: 7207439 - DNA, 22 bp, Homo sapiens
ggagcctgtgggatgagatgtg

SEQ ID NO: 7207440 - DNA, 22 bp, Homo sapiens
ggagcctgtgggatgagatgtg

SEQ ID NO: 7207441 - DNA, 22 bp, Homo sapiens
ggagcctgttagttgagtgctc

SEQ ID NO: 7207442 - DNA, 22 bp, Homo sapiens
ggagcctgtgcccaagcccaga

SEQ ID NO: 7207443 - DNA, 22 bp, Homo sapiens
ggagcctgtggccgtcacgact

SEQ ID NO: 7207444 - DNA, 22 bp, Homo sapiens
ggagcctgtggccgtcacgact

SEQ ID NO: 7207445 - DNA, 22 bp, Homo sapiens
ggagcctgtggctgcttgaagc

SEQ ID NO: 7207446 - DNA, 22 bp, Homo sapiens
ggagcggcagatggagtgggag

SEQ ID NO: 7207447 - DNA, 22 bp, Homo sapiens
ggagcgtgcactccaggccctt

SEQ ID NO: 7207448 - DNA, 22 bp, Homo sapiens
ggagctcaccttggagtctctg

SEQ ID NO: 7207449 - DNA, 19 bp, Homo sapiens
ggagaagcccaggaatcct

SEQ ID NO: 7207450 - DNA, 19 bp, Homo sapiens
ggagaagcccaggaatcct

SEQ ID NO: 7207451 - DNA, 22 bp, Homo sapiens
ggagaaggaagaaagctactat

SEQ ID NO: 7207452 - DNA, 22 bp, Homo sapiens
ggagaaggaagaaagctactat

SEQ ID NO: 7207453 - DNA, 22 bp, Homo sapiens
ggagaaggaagaaagctactat

SEQ ID NO: 7207454 - DNA, 22 bp, Homo sapiens
ggagaagccacacattgggtgt

SEQ ID NO: 7207455 - DNA, 19 bp, Homo sapiens
ggagaagcatctagaaata

SEQ ID NO: 7207456 - DNA, 22 bp, Homo sapiens
ggagaagcaggtgctttgggtc

SEQ ID NO: 7207457 - DNA, 22 bp, Homo sapiens
ggaatagtttatgtagctgaat

SEQ ID NO: 7207458 - DNA, 22 bp, Homo sapiens
ggaatactttgttgtcttccaa

SEQ ID NO: 7207459 - DNA, 22 bp, Homo sapiens
ggaatactaaaggaagcaattg

SEQ ID NO: 7207460 - DNA, 22 bp, Homo sapiens
ggaatactaaaggaagcaattg

SEQ ID NO: 7207461 - DNA, 22 bp, Homo sapiens
ggaatagtagttggggaatggc

SEQ ID NO: 7207462 - DNA, 22 bp, Homo sapiens
ggaatagtagttggggaatggc

SEQ ID NO: 7207463 - DNA, 22 bp, Homo sapiens
ggaatagtttatgtagctgaat

SEQ ID NO: 7207464 - DNA, 22 bp, Homo sapiens
ggaatatagccagtaacagtca

SEQ ID NO: 7207465 - DNA, 18 bp, Homo sapiens
ggaaggtgctggagtgca

SEQ ID NO: 7207466 - DNA, 18 bp, Homo sapiens
ggaaggtgctggagtgca

SEQ ID NO: 7207467 - DNA, 18 bp, Homo sapiens
ggaaggtgctggagtgca

SEQ ID NO: 7207468 - DNA, 18 bp, Homo sapiens
ggaaggttatgccaggtc

SEQ ID NO: 7207469 - DNA, 22 bp, Homo sapiens
ggaagtagaggtcattctgaat

SEQ ID NO: 7207470 - DNA, 22 bp, Homo sapiens
ggaagtagaggtcattctgaat

SEQ ID NO: 7207471 - DNA, 18 bp, Homo sapiens
ggaagtaggaagaggaag

SEQ ID NO: 7207472 - DNA, 23 bp, Homo sapiens
ggaagtcagcggagaggtggctg

SEQ ID NO: 7207473 - DNA, 22 bp, Homo sapiens
ggaagtctcagcaacagagtta

SEQ ID NO: 7207474 - DNA, 22 bp, Homo sapiens
ggaagtctcagcaacagagtta

SEQ ID NO: 7207475 - DNA, 22 bp, Homo sapiens
ggaagtgaggaaatattttgtt

SEQ ID NO: 7207476 - DNA, 22 bp, Homo sapiens
ggaagtgaggaattaggtttat

SEQ ID NO: 7207477 - DNA, 22 bp, Homo sapiens
ggaagtggtagagccatgagtg

SEQ ID NO: 7207478 - DNA, 22 bp, Homo sapiens
ggaagtgtagtccgaagttgcg

SEQ ID NO: 7207479 - DNA, 22 bp, Homo sapiens
ggaagtgtgcaatattgggctg

SEQ ID NO: 7207480 - DNA, 22 bp, Homo sapiens
ggaagtgtgcaatattgggctg

SEQ ID NO: 7207481 - DNA, 22 bp, Homo sapiens
ggaagtgtggctaagccaagaa

SEQ ID NO: 7207482 - DNA, 22 bp, Homo sapiens
ggaagtgtttccttgggcagca

SEQ ID NO: 7207483 - DNA, 22 bp, Homo sapiens
ggaagtgtttccttgggcagca

SEQ ID NO: 7207484 - DNA, 22 bp, Homo sapiens
ggaagtgtttccttgggcagca

SEQ ID NO: 7207485 - DNA, 22 bp, Homo sapiens
ggaagtgtttgtgcagatggcc

SEQ ID NO: 7207486 - DNA, 22 bp, Homo sapiens
ggaagtgtttgtgcagatggcc

SEQ ID NO: 7207487 - DNA, 22 bp, Homo sapiens
ggaagttgtatgatcggggaat

SEQ ID NO: 7207488 - DNA, 22 bp, Homo sapiens
ggaagttgtatgatcggggaat

SEQ ID NO: 7207489 - DNA, 22 bp, Homo sapiens
ggaagtttctggtgaggacgag

SEQ ID NO: 7207490 - DNA, 21 bp, Homo sapiens
ggagaaggacaatgttgagta

SEQ ID NO: 7207491 - DNA, 22 bp, Homo sapiens
ggagaaggaatattggagtagg

SEQ ID NO: 7207492 - DNA, 21 bp, Homo sapiens
ggagaaggacaatgttgagta

SEQ ID NO: 7207493 - DNA, 21 bp, Homo sapiens
ggagaaggacaatgttgagta

SEQ ID NO: 7207494 - DNA, 21 bp, Homo sapiens
ggagaaggacaatgttgagta

SEQ ID NO: 7207495 - DNA, 21 bp, Homo sapiens
ggagaaggacaatgttgagta

SEQ ID NO: 7207496 - DNA, 22 bp, Homo sapiens
ggagaaggaatattggagtagg

SEQ ID NO: 7207497 - DNA, 22 bp, Homo sapiens
ggagaaggaatattggagtagg

SEQ ID NO: 7207498 - DNA, 22 bp, Homo sapiens
ggagaaggaatattggagtagg

SEQ ID NO: 7207499 - DNA, 21 bp, Homo sapiens
ggagaaggacaatgttgagta

SEQ ID NO: 7207500 - DNA, 21 bp, Homo sapiens
ggagaaggacaatgttgagta

SEQ ID NO: 7207501 - DNA, 21 bp, Homo sapiens
ggagaaggacaatgttgagta

SEQ ID NO: 7207502 - DNA, 22 bp, Homo sapiens
ggagaaggcacacccacctctg

SEQ ID NO: 7207503 - DNA, 22 bp, Homo sapiens
ggagaaggcacacccacctctg

SEQ ID NO: 7207504 - DNA, 22 bp, Homo sapiens
ggagaaggaatattggagtagg

SEQ ID NO: 7207505 - DNA, 22 bp, Homo sapiens
ggagaaggaagaaagctactat

SEQ ID NO: 7207506 - DNA, 22 bp, Homo sapiens
ggagaaggaatattggagtagg

SEQ ID NO: 7207507 - DNA, 22 bp, Homo sapiens
ggagaaggaatattggagtagg

SEQ ID NO: 7207508 - DNA, 22 bp, Homo sapiens
ggagaaggaatattggagtagg

SEQ ID NO: 7207509 - DNA, 22 bp, Homo sapiens
ggagaaggaatattggagtagg

SEQ ID NO: 7207510 - DNA, 22 bp, Homo sapiens
ggagaaggaatattggagtagg

SEQ ID NO: 7207511 - DNA, 22 bp, Homo sapiens
ggagaaggaagaaagctactat

SEQ ID NO: 7207512 - DNA, 22 bp, Homo sapiens
ggagaaggaagaaagctactat

SEQ ID NO: 7207513 - DNA, 22 bp, Homo sapiens
ggagacaatggaggccaaaaga

SEQ ID NO: 7207514 - DNA, 22 bp, Homo sapiens
ggagacacagagcaacaaaata

SEQ ID NO: 7207515 - DNA, 22 bp, Homo sapiens
ggagaatgattctttgctcact

SEQ ID NO: 7207516 - DNA, 22 bp, Homo sapiens
ggagacaacaatcatgtgtgaa

SEQ ID NO: 7207517 - DNA, 22 bp, Homo sapiens
ggagaaggtggctcagcaaagg

SEQ ID NO: 7207518 - DNA, 22 bp, Homo sapiens
ggagacagcaggaagaaatatc

SEQ ID NO: 7207519 - DNA, 22 bp, Homo sapiens
ggagacagcaggaagaaatatc

SEQ ID NO: 7207520 - DNA, 17 bp, Homo sapiens
ggagacagggtctttaa

SEQ ID NO: 7207521 - DNA, 22 bp, Homo sapiens
ggagacacgggtgctgaggacc

SEQ ID NO: 7207522 - DNA, 22 bp, Homo sapiens
ggagacactggaaagtattaca

SEQ ID NO: 7207523 - DNA, 22 bp, Homo sapiens
ggagacagcaggaagaaatatc

SEQ ID NO: 7207524 - DNA, 22 bp, Homo sapiens
ggagacagggttgaaccacgca

SEQ ID NO: 7207525 - DNA, 22 bp, Homo sapiens
ggagaggcttggcccagcctgg

SEQ ID NO: 7207526 - DNA, 22 bp, Homo sapiens
gcctggcctgaactaggaggtg

SEQ ID NO: 7207527 - DNA, 22 bp, Homo sapiens
gcctggcctgaactaggaggtg

SEQ ID NO: 7207528 - DNA, 22 bp, Homo sapiens
gcctggcctgaactaggaggtg

SEQ ID NO: 7207529 - DNA, 22 bp, Homo sapiens
gcctggcctgaactaggaggtg

SEQ ID NO: 7207530 - DNA, 22 bp, Homo sapiens
gcctggctaagcagaaggaccc

SEQ ID NO: 7207531 - DNA, 22 bp, Homo sapiens
gcctggcttttgcctcatgttc

SEQ ID NO: 7207532 - DNA, 22 bp, Homo sapiens
gcctggcttttgcctcatgttc

SEQ ID NO: 7207533 - DNA, 22 bp, Homo sapiens
gcctgggaaagagtagggaaat

SEQ ID NO: 7207534 - DNA, 22 bp, Homo sapiens
gcctgggaaagagtagggaaat

SEQ ID NO: 7207535 - DNA, 21 bp, Homo sapiens
gcctgggaaatctgggaagcc

SEQ ID NO: 7207536 - DNA, 21 bp, Homo sapiens
gcctgggaaatctgggaagcc

SEQ ID NO: 7207537 - DNA, 21 bp, Homo sapiens
gcctgggaaatctgggaagcc

SEQ ID NO: 7207538 - DNA, 21 bp, Homo sapiens
gcctgggaaatctgggaagcc

SEQ ID NO: 7207539 - DNA, 21 bp, Homo sapiens
gcctgggaaatctgggaagcc

SEQ ID NO: 7207540 - DNA, 22 bp, Homo sapiens
gcctgggaaatggtggggtcag

SEQ ID NO: 7207541 - DNA, 22 bp, Homo sapiens
gcctgggaaatggtggggtcag

SEQ ID NO: 7207542 - DNA, 22 bp, Homo sapiens
gcctgggaaatggtggggtcag

SEQ ID NO: 7207543 - DNA, 22 bp, Homo sapiens
gcctgggaaatggtggggtcag

SEQ ID NO: 7207544 - DNA, 22 bp, Homo sapiens
gcctgggaaatggtggggtcag

SEQ ID NO: 7207545 - DNA, 22 bp, Homo sapiens
gcctgggaaatggtggggtcag

SEQ ID NO: 7207546 - DNA, 22 bp, Homo sapiens
gcctgggaactctgatctcctg

SEQ ID NO: 7207547 - DNA, 22 bp, Homo sapiens
gcctgggaactctgatctcctg

SEQ ID NO: 7207548 - DNA, 22 bp, Homo sapiens
gcctggccgctccgagctccgc

SEQ ID NO: 7207549 - DNA, 22 bp, Homo sapiens
gcctggccgctccgagctccgc

SEQ ID NO: 7207550 - DNA, 22 bp, Homo sapiens
gcctggcccagggctcttgttg

SEQ ID NO: 7207551 - DNA, 17 bp, Homo sapiens
gcctggcccagcctggc

SEQ ID NO: 7207552 - DNA, 17 bp, Homo sapiens
gcctggcccagcctggc

SEQ ID NO: 7207553 - DNA, 17 bp, Homo sapiens
gcctggcccagcctggc

SEQ ID NO: 7207554 - DNA, 22 bp, Homo sapiens
gcctggcattggagccggggca

SEQ ID NO: 7207555 - DNA, 23 bp, Homo sapiens
gcctggccaccccagggctgctt

SEQ ID NO: 7207556 - DNA, 23 bp, Homo sapiens
gcctggccaccccagggctgctt

SEQ ID NO: 7207557 - DNA, 22 bp, Homo sapiens
gcctggcagggagattgtaaga

SEQ ID NO: 7207558 - DNA, 22 bp, Homo sapiens
gcctggcagggcccggacggca

SEQ ID NO: 7207559 - DNA, 22 bp, Homo sapiens
gcctggcagggagattgtaaga

SEQ ID NO: 7207560 - DNA, 22 bp, Homo sapiens
gcctggcagggagattgtaaga

SEQ ID NO: 7207561 - DNA, 22 bp, Homo sapiens
gcctggcaggcctgggccagca

SEQ ID NO: 7207562 - DNA, 22 bp, Homo sapiens
gcctggcaggcctgttggggct

SEQ ID NO: 7207563 - DNA, 22 bp, Homo sapiens
gcctggcaggcctgttggggct

SEQ ID NO: 7207564 - DNA, 22 bp, Homo sapiens
gcctggcaggcctgttggggct

SEQ ID NO: 7207565 - DNA, 22 bp, Homo sapiens
gcctggcaggcctgttggggct

SEQ ID NO: 7207566 - DNA, 22 bp, Homo sapiens
gcctggcaggcctgttggggct

SEQ ID NO: 7207567 - DNA, 22 bp, Homo sapiens
gcctggcaggcctgggccagca

SEQ ID NO: 7207568 - DNA, 22 bp, Homo sapiens
gcctggcaggcctgggccagca

SEQ ID NO: 7207569 - DNA, 22 bp, Homo sapiens
gcctggcaggcctgggccagca

SEQ ID NO: 7207570 - DNA, 22 bp, Homo sapiens
gcctggcaggcctcatgagggg

SEQ ID NO: 7207571 - DNA, 22 bp, Homo sapiens
gcctggcaggcctcatgagggg

SEQ ID NO: 7207572 - DNA, 22 bp, Homo sapiens
gcctggcaggcctgggccagca

SEQ ID NO: 7207573 - DNA, 22 bp, Homo sapiens
gcctggcaggcctgggccagca

SEQ ID NO: 7207574 - DNA, 22 bp, Homo sapiens
gcctggcaggcctgggccagca

SEQ ID NO: 7207575 - DNA, 22 bp, Homo sapiens
gcctggagggttgaggttttgt

SEQ ID NO: 7207576 - DNA, 22 bp, Homo sapiens
gcctggagggttgaggttttgt

SEQ ID NO: 7207577 - DNA, 22 bp, Homo sapiens
gcctggagggttgaggttttgt

SEQ ID NO: 7207578 - DNA, 22 bp, Homo sapiens
gcctggagggttgaggttttgt

SEQ ID NO: 7207579 - DNA, 22 bp, Homo sapiens
gcctggagtactccttgaagtg

SEQ ID NO: 7207580 - DNA, 22 bp, Homo sapiens
gcctggagtactccttgaagtg

SEQ ID NO: 7207581 - DNA, 22 bp, Homo sapiens
gcctggagtactccttgaagtg

SEQ ID NO: 7207582 - DNA, 22 bp, Homo sapiens
gcctggagtactccttgaagtg

SEQ ID NO: 7207583 - DNA, 22 bp, Homo sapiens
gcctggagtactccttgaagtg

SEQ ID NO: 7207584 - DNA, 22 bp, Homo sapiens
gcctggagtactccttgaagtg

SEQ ID NO: 7207585 - DNA, 22 bp, Homo sapiens
gcctggagtagcatggcaagcc

SEQ ID NO: 7207586 - DNA, 22 bp, Homo sapiens
gcctggagtagcatggcaagcc

SEQ ID NO: 7207587 - DNA, 22 bp, Homo sapiens
gcctggagtagcatggcaagcc

SEQ ID NO: 7207588 - DNA, 22 bp, Homo sapiens
gcctggagtagcatggcaagcc

SEQ ID NO: 7207589 - DNA, 22 bp, Homo sapiens
gcctggagtagcatggcaagcc

SEQ ID NO: 7207590 - DNA, 22 bp, Homo sapiens
gcctggcagtgatgtcttttgg

SEQ ID NO: 7207591 - DNA, 22 bp, Homo sapiens
gcctggcagtgatgtcttttgg

SEQ ID NO: 7207592 - DNA, 22 bp, Homo sapiens
gcctggcagtggggccctggga

SEQ ID NO: 7207593 - DNA, 22 bp, Homo sapiens
gcctggcagtggggccctggga

SEQ ID NO: 7207594 - DNA, 22 bp, Homo sapiens
gcctggcagtggggccctggga

SEQ ID NO: 7207595 - DNA, 21 bp, Homo sapiens
gcctggcaggtggaagggctc

SEQ ID NO: 7207596 - DNA, 22 bp, Homo sapiens
gcctggcagtgatgtcttttgg

SEQ ID NO: 7207597 - DNA, 22 bp, Homo sapiens
gcctggcagtgatgtcttttgg

SEQ ID NO: 7207598 - DNA, 21 bp, Homo sapiens
gcctggcaggtggaagggctc

SEQ ID NO: 7207599 - DNA, 21 bp, Homo sapiens
gcctggcaggtggaagggctc

SEQ ID NO: 7207600 - DNA, 21 bp, Homo sapiens
gcctggcaggtggaagggctc

SEQ ID NO: 7207601 - DNA, 21 bp, Homo sapiens
gcctggcaggtggaagggctc

SEQ ID NO: 7207602 - DNA, 21 bp, Homo sapiens
gcctggcaggtggaagggctc

SEQ ID NO: 7207603 - DNA, 22 bp, Homo sapiens
gcctggcaggggcctgggagtg

SEQ ID NO: 7207604 - DNA, 22 bp, Homo sapiens
gcctggcaggggcctgggagtg

SEQ ID NO: 7207605 - DNA, 22 bp, Homo sapiens
gcctggcaggggcctgggagtg

SEQ ID NO: 7207606 - DNA, 22 bp, Homo sapiens
gcctggcaggggcctgggagtg

SEQ ID NO: 7207607 - DNA, 22 bp, Homo sapiens
gcctggcagggcccggacggca

SEQ ID NO: 7207608 - DNA, 22 bp, Homo sapiens
gcctggcagggcccggacggca

SEQ ID NO: 7207609 - DNA, 22 bp, Homo sapiens
gcctggcagggcccggacggca

SEQ ID NO: 7207610 - DNA, 22 bp, Homo sapiens
gcctggcaggggcctgggagtg

SEQ ID NO: 7207611 - DNA, 22 bp, Homo sapiens
gcctggcaggggcctgggagtg

SEQ ID NO: 7207612 - DNA, 22 bp, Homo sapiens
gcctggcagtggggccctggga

SEQ ID NO: 7207613 - DNA, 22 bp, Homo sapiens
gcctggcagtggggccctggga

SEQ ID NO: 7207614 - DNA, 22 bp, Homo sapiens
gcctggcagtggggccctggga

SEQ ID NO: 7207615 - DNA, 22 bp, Homo sapiens
gcctggcagtgtaattcctgtc

SEQ ID NO: 7207616 - DNA, 22 bp, Homo sapiens
gcctggcagtgtaattcctgtc

SEQ ID NO: 7207617 - DNA, 22 bp, Homo sapiens
gcctggcagtgtaattcctgtc

SEQ ID NO: 7207618 - DNA, 19 bp, Homo sapiens
gcctggcagtgtacaaggc

SEQ ID NO: 7207619 - DNA, 19 bp, Homo sapiens
gcctggcagtgtacaaggc

SEQ ID NO: 7207620 - DNA, 19 bp, Homo sapiens
gcctggcagtgtacaaggc

SEQ ID NO: 7207621 - DNA, 19 bp, Homo sapiens
gcctggcagtgtacaaggc

SEQ ID NO: 7207622 - DNA, 22 bp, Homo sapiens
gcctggcagttgacagtttgct

SEQ ID NO: 7207623 - DNA, 22 bp, Homo sapiens
gcctggcagttgacagtttgct

SEQ ID NO: 7207624 - DNA, 22 bp, Homo sapiens
gcctggcagttgacagtttgct

SEQ ID NO: 7207625 - DNA, 22 bp, Homo sapiens
gcctggcatatagtagttgtgc

SEQ ID NO: 7207626 - DNA, 22 bp, Homo sapiens
gcctggcatatagtagttgtgc

SEQ ID NO: 7207627 - DNA, 22 bp, Homo sapiens
gcctggcatatagtagttgtgc

SEQ ID NO: 7207628 - DNA, 22 bp, Homo sapiens
gcctggcatatagtagttgtgc

SEQ ID NO: 7207629 - DNA, 22 bp, Homo sapiens
gcctggcattacagcactcctg

SEQ ID NO: 7207630 - DNA, 22 bp, Homo sapiens
gcctggcattacagcactcctg

SEQ ID NO: 7207631 - DNA, 22 bp, Homo sapiens
gcctggcattacagcactcctg

SEQ ID NO: 7207632 - DNA, 22 bp, Homo sapiens
gcctggcattacagcactcctg

SEQ ID NO: 7207633 - DNA, 22 bp, Homo sapiens
gcctggcattacagcactcctg

SEQ ID NO: 7207634 - DNA, 22 bp, Homo sapiens
gcctggcattggagccggggca

SEQ ID NO: 7207635 - DNA, 22 bp, Homo sapiens
gcctggcattggagccggggca

SEQ ID NO: 7207636 - DNA, 22 bp, Homo sapiens
gcctggcattggagccggggca

SEQ ID NO: 7207637 - DNA, 22 bp, Homo sapiens
gcctggggaacttgatcctgtc

SEQ ID NO: 7207638 - DNA, 22 bp, Homo sapiens
gcctgggattgtgtaagtgaat

SEQ ID NO: 7207639 - DNA, 22 bp, Homo sapiens
gcctggggaacttgatcctgtc

SEQ ID NO: 7207640 - DNA, 22 bp, Homo sapiens
gcctggtgtctccccaaggaag

SEQ ID NO: 7207641 - DNA, 22 bp, Homo sapiens
gcctggtgtgcgccgcgcagct

SEQ ID NO: 7207642 - DNA, 22 bp, Homo sapiens
gcctgtcaattttgtgtacaat

SEQ ID NO: 7207643 - DNA, 22 bp, Homo sapiens
gcctgtgctttcttccctcctg

SEQ ID NO: 7207644 - DNA, 22 bp, Homo sapiens
gcctgtggccgactgagagcct

SEQ ID NO: 7207645 - DNA, 21 bp, Homo sapiens
gcctgtggagcccaagggccc

SEQ ID NO: 7207646 - DNA, 21 bp, Homo sapiens
gcctgtggagcccaagggccc

SEQ ID NO: 7207647 - DNA, 20 bp, Homo sapiens
gcctgtggaggaggacggac

SEQ ID NO: 7207648 - DNA, 22 bp, Homo sapiens
gcctgtggcccaactgtctgtc

SEQ ID NO: 7207649 - DNA, 22 bp, Homo sapiens
gcctgtggggctgaggctgcct

SEQ ID NO: 7207650 - DNA, 22 bp, Homo sapiens
gcctgtggggctgaggctgcct

SEQ ID NO: 7207651 - DNA, 22 bp, Homo sapiens
gcctgtgggttggagcttggcc

SEQ ID NO: 7207652 - DNA, 21 bp, Homo sapiens
gcctgtgtaaattgagtttcc

SEQ ID NO: 7207653 - DNA, 22 bp, Homo sapiens
gcctgtgtcatgtagtagcttc

SEQ ID NO: 7207654 - DNA, 22 bp, Homo sapiens
gcctgtgtcatgtagtagcttc

SEQ ID NO: 7207655 - DNA, 22 bp, Homo sapiens
gcctgtgtctgggtggccagag

SEQ ID NO: 7207656 - DNA, 22 bp, Homo sapiens
gcctgtgtggatgcgccggtgc

SEQ ID NO: 7207657 - DNA, 22 bp, Homo sapiens
gcctgtgtggatgcgccggtgc

SEQ ID NO: 7207658 - DNA, 22 bp, Homo sapiens
gcctgtgtgtgaggactggctg

SEQ ID NO: 7207659 - DNA, 22 bp, Homo sapiens
gcctgtgtgtttagctctgggg

SEQ ID NO: 7207660 - DNA, 18 bp, Homo sapiens
gcctgtgttcagcctttc

SEQ ID NO: 7207661 - DNA, 23 bp, Homo sapiens
gcctgggactcaggaggagctca

SEQ ID NO: 7207662 - DNA, 23 bp, Homo sapiens
gcctgggactcaggaggagctca

SEQ ID NO: 7207663 - DNA, 23 bp, Homo sapiens
gcctgggactcaggaggagctca

SEQ ID NO: 7207664 - DNA, 23 bp, Homo sapiens
gcctgggactcaggaggagctca

SEQ ID NO: 7207665 - DNA, 22 bp, Homo sapiens
gcctgggacccttagctcttgg

SEQ ID NO: 7207666 - DNA, 22 bp, Homo sapiens
gcctgggacccttagctcttgg

SEQ ID NO: 7207667 - DNA, 22 bp, Homo sapiens
gcctgggaagactaagtgggag

SEQ ID NO: 7207668 - DNA, 22 bp, Homo sapiens
gcctgggaagactaagtgggag

SEQ ID NO: 7207669 - DNA, 22 bp, Homo sapiens
gcctgggaagactaagtgggag

SEQ ID NO: 7207670 - DNA, 21 bp, Homo sapiens
gcctgggaagagaaaggtaag

SEQ ID NO: 7207671 - DNA, 23 bp, Homo sapiens
gcctgggactggtagtgtgacct

SEQ ID NO: 7207672 - DNA, 22 bp, Homo sapiens
gcctgggactggatgtgtttgt

SEQ ID NO: 7207673 - DNA, 23 bp, Homo sapiens
gcctgggactggtagtgtgacct

SEQ ID NO: 7207674 - DNA, 18 bp, Homo sapiens
gcctgggagaagtttcac

SEQ ID NO: 7207675 - DNA, 22 bp, Homo sapiens
gcctgggactgcagatccccag

SEQ ID NO: 7207676 - DNA, 19 bp, Homo sapiens
gcctgggatgggcagaact

SEQ ID NO: 7207677 - DNA, 19 bp, Homo sapiens
gcctgggatgggcagaact

SEQ ID NO: 7207678 - DNA, 19 bp, Homo sapiens
gcctgggatgggcagaact

SEQ ID NO: 7207679 - DNA, 19 bp, Homo sapiens
gcctgggatgggcagaact

SEQ ID NO: 7207680 - DNA, 19 bp, Homo sapiens
gcctgggatgggcagaact

SEQ ID NO: 7207681 - DNA, 21 bp, Homo sapiens
gcctgggatagtggcctccgg

SEQ ID NO: 7207682 - DNA, 21 bp, Homo sapiens
gcctgggatagtggcctccgg

SEQ ID NO: 7207683 - DNA, 22 bp, Homo sapiens
gcctgggatagaggcaatgcat

SEQ ID NO: 7207684 - DNA, 22 bp, Homo sapiens
gcctgggagaatgacctccaac

SEQ ID NO: 7207685 - DNA, 22 bp, Homo sapiens
gcctgggagaatgacctccaac

SEQ ID NO: 7207686 - DNA, 22 bp, Homo sapiens
gcctgggagaatgacctccaac

SEQ ID NO: 7207687 - DNA, 22 bp, Homo sapiens
gcctgggattctcaaaggggtg

SEQ ID NO: 7207688 - DNA, 22 bp, Homo sapiens
gcctgggattctcaaaggggtg

SEQ ID NO: 7207689 - DNA, 20 bp, Homo sapiens
gcctgggattatccactggt

SEQ ID NO: 7207690 - DNA, 20 bp, Homo sapiens
gcctgggattatccactggt

SEQ ID NO: 7207691 - DNA, 20 bp, Homo sapiens
gcctgggattatccactggt

SEQ ID NO: 7207692 - DNA, 22 bp, Homo sapiens
gcctgggattcccagaggggca

SEQ ID NO: 7207693 - DNA, 22 bp, Homo sapiens
gcctgcctttgtatgaccctga

SEQ ID NO: 7207694 - DNA, 22 bp, Homo sapiens
gcctgcctttgtatgaccctga

SEQ ID NO: 7207695 - DNA, 22 bp, Homo sapiens
gcctgccttcggtgcgcagcgg

SEQ ID NO: 7207696 - DNA, 22 bp, Homo sapiens
gcctgccttcggtgcgcagcgg

SEQ ID NO: 7207697 - DNA, 22 bp, Homo sapiens
gcctgcctgttggctgaggtgc

SEQ ID NO: 7207698 - DNA, 22 bp, Homo sapiens
gcctgccttcggtgcgcagcgg

SEQ ID NO: 7207699 - DNA, 22 bp, Homo sapiens
gcctgccttcggtgcgcagcgg

SEQ ID NO: 7207700 - DNA, 22 bp, Homo sapiens
gcctgcctgttggctgaggtgc

SEQ ID NO: 7207701 - DNA, 22 bp, Homo sapiens
gcctgcctgttggctgaggtgc

SEQ ID NO: 7207702 - DNA, 22 bp, Homo sapiens
gcctgcctgttggctgaggtgc

SEQ ID NO: 7207703 - DNA, 19 bp, Homo sapiens
gcctgcctgggtttctgag

SEQ ID NO: 7207704 - DNA, 19 bp, Homo sapiens
gcctgcctgggtttctgag

SEQ ID NO: 7207705 - DNA, 19 bp, Homo sapiens
gcctgcctgggtttctgag

SEQ ID NO: 7207706 - DNA, 22 bp, Homo sapiens
gcctgcctggagcttgaggtga

SEQ ID NO: 7207707 - DNA, 22 bp, Homo sapiens
gcctgcctgctgtgtgcaagtt

SEQ ID NO: 7207708 - DNA, 22 bp, Homo sapiens
gcctgcctgctgtgtgcaagtt

SEQ ID NO: 7207709 - DNA, 22 bp, Homo sapiens
gcctgcctgctgtcatctgcct

SEQ ID NO: 7207710 - DNA, 21 bp, Homo sapiens
gcctgcctgcgtgaccctctt

SEQ ID NO: 7207711 - DNA, 22 bp, Homo sapiens
gcctgcctgctgtcatctgcct

SEQ ID NO: 7207712 - DNA, 22 bp, Homo sapiens
gcctgcctgctgtcatctgcct

SEQ ID NO: 7207713 - DNA, 22 bp, Homo sapiens
gcctgcctgctgtcatctgcct

SEQ ID NO: 7207714 - DNA, 21 bp, Homo sapiens
gcctgcctgcgtgaccctctt

SEQ ID NO: 7207715 - DNA, 23 bp, Homo sapiens
gcctgcctgacctgtgcaaagtc

SEQ ID NO: 7207716 - DNA, 23 bp, Homo sapiens
gcctgcctgacctgtgcaaagtc

SEQ ID NO: 7207717 - DNA, 23 bp, Homo sapiens
gcctgcctgacctgtgcaaagtc

SEQ ID NO: 7207718 - DNA, 22 bp, Homo sapiens
gcctgcctgaaggctgtaccag

SEQ ID NO: 7207719 - DNA, 22 bp, Homo sapiens
gcctgcctgaaggctgtaccag

SEQ ID NO: 7207720 - DNA, 20 bp, Homo sapiens
gcctgcctcagctagctgag

SEQ ID NO: 7207721 - DNA, 22 bp, Homo sapiens
gcctgcctgaaggctgtaccag

SEQ ID NO: 7207722 - DNA, 20 bp, Homo sapiens
gcctgcctcagctagctgag

SEQ ID NO: 7207723 - DNA, 20 bp, Homo sapiens
gcctgcctcagctagctgag

SEQ ID NO: 7207724 - DNA, 22 bp, Homo sapiens
gcctgcctcaaaatcccagttc

SEQ ID NO: 7207725 - DNA, 22 bp, Homo sapiens
gcctgcctcaaaatcccagttc

SEQ ID NO: 7207726 - DNA, 22 bp, Homo sapiens
gcctgcctcaaaatcccagttc

SEQ ID NO: 7207727 - DNA, 17 bp, Homo sapiens
gcctctgcttgtgtcat

SEQ ID NO: 7207728 - DNA, 22 bp, Homo sapiens
gcctctggaagtgggaaggggt

SEQ ID NO: 7207729 - DNA, 23 bp, Homo sapiens
gcctctggagccccagtgctcag

SEQ ID NO: 7207730 - DNA, 20 bp, Homo sapiens
gcctctggagccaaggacca

SEQ ID NO: 7207731 - DNA, 22 bp, Homo sapiens
gcctgccaaaagaagctgctgg

SEQ ID NO: 7207732 - DNA, 18 bp, Homo sapiens
gcctgccaactcctgatc

SEQ ID NO: 7207733 - DNA, 18 bp, Homo sapiens
gcctgccaactcctgatc

SEQ ID NO: 7207734 - DNA, 22 bp, Homo sapiens
gcctgccacgcatgcagagtca

SEQ ID NO: 7207735 - DNA, 22 bp, Homo sapiens
gcctgccacgcatgcagagtca

SEQ ID NO: 7207736 - DNA, 22 bp, Homo sapiens
gcctgccacgcatgcagagtca

SEQ ID NO: 7207737 - DNA, 22 bp, Homo sapiens
gcctgccagccacagtggcagc

SEQ ID NO: 7207738 - DNA, 22 bp, Homo sapiens
gcctgccagccacagtggcagc

SEQ ID NO: 7207739 - DNA, 18 bp, Homo sapiens
gcctgccagccgagggac

SEQ ID NO: 7207740 - DNA, 22 bp, Homo sapiens
gcctgccagtgtttgaggattg

SEQ ID NO: 7207741 - DNA, 23 bp, Homo sapiens
gcctgccatatacctggaaacag

SEQ ID NO: 7207742 - DNA, 22 bp, Homo sapiens
gcctggaaacagtgagcgaagg

SEQ ID NO: 7207743 - DNA, 22 bp, Homo sapiens
gcctggaaacagtgagcgaagg

SEQ ID NO: 7207744 - DNA, 22 bp, Homo sapiens
gcctggaaattgaggcacagtt

SEQ ID NO: 7207745 - DNA, 22 bp, Homo sapiens
gcctggaaattgaggcacagtt

SEQ ID NO: 7207746 - DNA, 22 bp, Homo sapiens
gcctggaaattgaggcacagtt

SEQ ID NO: 7207747 - DNA, 22 bp, Homo sapiens
gcctggaagacgtcttggcttc

SEQ ID NO: 7207748 - DNA, 22 bp, Homo sapiens
gcctggaagtccagagtacatt

SEQ ID NO: 7207749 - DNA, 22 bp, Homo sapiens
gcctggaagtccagagtacatt

SEQ ID NO: 7207750 - DNA, 22 bp, Homo sapiens
gcctggaagtgtgtcgtgggaa

SEQ ID NO: 7207751 - DNA, 22 bp, Homo sapiens
gcctggaatcatgcaggggtta

SEQ ID NO: 7207752 - DNA, 22 bp, Homo sapiens
gcctggaatcatgcaggggtta

SEQ ID NO: 7207753 - DNA, 22 bp, Homo sapiens
gcctggaatgcaatgtgacgaa

SEQ ID NO: 7207754 - DNA, 22 bp, Homo sapiens
gcctggaatgcaatgtgacgaa

SEQ ID NO: 7207755 - DNA, 22 bp, Homo sapiens
gcctgctgtcctgattcccatg

SEQ ID NO: 7207756 - DNA, 22 bp, Homo sapiens
gcctgctgttaactgcaggaat

SEQ ID NO: 7207757 - DNA, 22 bp, Homo sapiens
gcctgctgttaactgcaggaat

SEQ ID NO: 7207758 - DNA, 21 bp, Homo sapiens
gcctgctgttcaccctgccac

SEQ ID NO: 7207759 - DNA, 21 bp, Homo sapiens
gcctgctgttcaccctgccac

SEQ ID NO: 7207760 - DNA, 22 bp, Homo sapiens
gcctgctgttgagggaagagct

SEQ ID NO: 7207761 - DNA, 22 bp, Homo sapiens
gcctgctgttgagggaagagct

SEQ ID NO: 7207762 - DNA, 22 bp, Homo sapiens
gcctgctgttgagggaagagct

SEQ ID NO: 7207763 - DNA, 22 bp, Homo sapiens
gcctgctgttgagggaagagct

SEQ ID NO: 7207764 - DNA, 22 bp, Homo sapiens
gcctgcttcacggacaggcctc

SEQ ID NO: 7207765 - DNA, 22 bp, Homo sapiens
gcctgctgtcctgattcccatg

SEQ ID NO: 7207766 - DNA, 22 bp, Homo sapiens
gcctgctctccggatccctgat

SEQ ID NO: 7207767 - DNA, 22 bp, Homo sapiens
gcctgctcagacctagcaggcc

SEQ ID NO: 7207768 - DNA, 22 bp, Homo sapiens
gcctgccttttggaggcacatt

SEQ ID NO: 7207769 - DNA, 22 bp, Homo sapiens
gcctgccttttggaggcacatt

SEQ ID NO: 7207770 - DNA, 22 bp, Homo sapiens
gcctgcctttgtgaggaagcgg

SEQ ID NO: 7207771 - DNA, 22 bp, Homo sapiens
gcctgccttttggaggcacatt

SEQ ID NO: 7207772 - DNA, 22 bp, Homo sapiens
gcctgccttttggaggcacatt

SEQ ID NO: 7207773 - DNA, 22 bp, Homo sapiens
gcctgcctttgtgaggaagcgg

SEQ ID NO: 7207774 - DNA, 22 bp, Homo sapiens
gcctggagggtccctctctgga

SEQ ID NO: 7207775 - DNA, 22 bp, Homo sapiens
gcctggagggtccctctctgga

SEQ ID NO: 7207776 - DNA, 22 bp, Homo sapiens
gcctggagggtccctctctgga

SEQ ID NO: 7207777 - DNA, 22 bp, Homo sapiens
gcctggagggtccctctctgga

SEQ ID NO: 7207778 - DNA, 22 bp, Homo sapiens
gcctggagggtccctctctgga

SEQ ID NO: 7207779 - DNA, 22 bp, Homo sapiens
gcctggagggtccctctctgga

SEQ ID NO: 7207780 - DNA, 22 bp, Homo sapiens
gcctggaggggccagggtggta

SEQ ID NO: 7207781 - DNA, 22 bp, Homo sapiens
gcctggaggggccagggtggta

SEQ ID NO: 7207782 - DNA, 22 bp, Homo sapiens
gcctggaggggccagggtggta

SEQ ID NO: 7207783 - DNA, 22 bp, Homo sapiens
gcctggagggctctagagaggc

SEQ ID NO: 7207784 - DNA, 22 bp, Homo sapiens
gcctggagggctctagagaggc

SEQ ID NO: 7207785 - DNA, 22 bp, Homo sapiens
gcctggagggctctagagaggc

SEQ ID NO: 7207786 - DNA, 22 bp, Homo sapiens
gcctggagggctctagagaggc

SEQ ID NO: 7207787 - DNA, 22 bp, Homo sapiens
gcctggagggctctagagaggc

SEQ ID NO: 7207788 - DNA, 22 bp, Homo sapiens
gcctggaggggacagtctctgg

SEQ ID NO: 7207789 - DNA, 22 bp, Homo sapiens
gcctggaggggacagtctctgg

SEQ ID NO: 7207790 - DNA, 22 bp, Homo sapiens
gcctggaggggacagtctctgg

SEQ ID NO: 7207791 - DNA, 22 bp, Homo sapiens
gcctggaggggacagtctctgg

SEQ ID NO: 7207792 - DNA, 22 bp, Homo sapiens
gcctggaggggacagtctctgg

SEQ ID NO: 7207793 - DNA, 22 bp, Homo sapiens
gcctggaggggacagtctctgg

SEQ ID NO: 7207794 - DNA, 22 bp, Homo sapiens
gcctggaggggacagtctctgg

SEQ ID NO: 7207795 - DNA, 22 bp, Homo sapiens
gcctggaggggccagggtggta

SEQ ID NO: 7207796 - DNA, 22 bp, Homo sapiens
gcctggaggggccagggtggta

SEQ ID NO: 7207797 - DNA, 22 bp, Homo sapiens
gcctggacaccgcccttgcaga

SEQ ID NO: 7207798 - DNA, 22 bp, Homo sapiens
gcctggagcctcagcaaggagg

SEQ ID NO: 7207799 - DNA, 22 bp, Homo sapiens
gcctggagcctcagcaaggagg

SEQ ID NO: 7207800 - DNA, 22 bp, Homo sapiens
gcctggagcctcagcaaggagg

SEQ ID NO: 7207801 - DNA, 22 bp, Homo sapiens
gcctggagcctcagcaaggagg

SEQ ID NO: 7207802 - DNA, 20 bp, Homo sapiens
gcctggaggcaatgggaaga

SEQ ID NO: 7207803 - DNA, 20 bp, Homo sapiens
gcctggaggcaatgggaaga

SEQ ID NO: 7207804 - DNA, 20 bp, Homo sapiens
gcctggaggcaatgggaaga

SEQ ID NO: 7207805 - DNA, 20 bp, Homo sapiens
gcctggaggcaatgggaaga

SEQ ID NO: 7207806 - DNA, 20 bp, Homo sapiens
gcctggaggcagagataaag

SEQ ID NO: 7207807 - DNA, 20 bp, Homo sapiens
gcctggaggcagagataaag

SEQ ID NO: 7207808 - DNA, 20 bp, Homo sapiens
gcctggaggcagagataaag

SEQ ID NO: 7207809 - DNA, 20 bp, Homo sapiens
gcctggaggcagagataaag

SEQ ID NO: 7207810 - DNA, 20 bp, Homo sapiens
gcctggaggcagagataaag

SEQ ID NO: 7207811 - DNA, 22 bp, Homo sapiens
gcctggaggcgagaacccaatg

SEQ ID NO: 7207812 - DNA, 22 bp, Homo sapiens
gcctggaggcgagaacccaatg

SEQ ID NO: 7207813 - DNA, 22 bp, Homo sapiens
gcctggaggcgagaacccaatg

SEQ ID NO: 7207814 - DNA, 22 bp, Homo sapiens
gcctggaggcgagaacccaatg

SEQ ID NO: 7207815 - DNA, 22 bp, Homo sapiens
gcctggaggcgagaacccaatg

SEQ ID NO: 7207816 - DNA, 22 bp, Homo sapiens
gcctggagggatagaatgcaag

SEQ ID NO: 7207817 - DNA, 22 bp, Homo sapiens
gcctggagggatagaatgcaag

SEQ ID NO: 7207818 - DNA, 22 bp, Homo sapiens
gcctggagggatagaatgcaag

SEQ ID NO: 7207819 - DNA, 22 bp, Homo sapiens
gcctggagggctctagagaggc

SEQ ID NO: 7207820 - DNA, 22 bp, Homo sapiens
gcctggagggctctagagaggc

SEQ ID NO: 7207821 - DNA, 22 bp, Homo sapiens
gccgtgtcccgggggccactct

SEQ ID NO: 7207822 - DNA, 22 bp, Homo sapiens
gccgtgggtgtcatggcccata

SEQ ID NO: 7207823 - DNA, 22 bp, Homo sapiens
gccgtggggagagagggtgcgt

SEQ ID NO: 7207824 - DNA, 22 bp, Homo sapiens
gccgtgggtgtcatggcccata

SEQ ID NO: 7207825 - DNA, 22 bp, Homo sapiens
gcctaacttggctttgttcacc

SEQ ID NO: 7207826 - DNA, 22 bp, Homo sapiens
gccgttagataataacaagcat

SEQ ID NO: 7207827 - DNA, 22 bp, Homo sapiens
gcctcctgtcccaggctgagga

SEQ ID NO: 7207828 - DNA, 22 bp, Homo sapiens
gcctcctgtcccaggctgagga

SEQ ID NO: 7207829 - DNA, 22 bp, Homo sapiens
gcctcctgtcccaggctgagga

SEQ ID NO: 7207830 - DNA, 22 bp, Homo sapiens
gcctcctgttatgccatgtgcc

SEQ ID NO: 7207831 - DNA, 22 bp, Homo sapiens
gcctcctgttatgccatgtgcc

SEQ ID NO: 7207832 - DNA, 19 bp, Homo sapiens
gccgggggcgccccgctct

SEQ ID NO: 7207833 - DNA, 22 bp, Homo sapiens
gccgggttcaagccattctcct

SEQ ID NO: 7207834 - DNA, 22 bp, Homo sapiens
gccggtggcttttgtctcccct

SEQ ID NO: 7207835 - DNA, 22 bp, Homo sapiens
gccgtcctacgccatcatagcg

SEQ ID NO: 7207836 - DNA, 22 bp, Homo sapiens
gccgtgcgtgcgcaggtgctgt

SEQ ID NO: 7207837 - DNA, 22 bp, Homo sapiens
gccgtggcttctccagctggct

SEQ ID NO: 7207838 - DNA, 22 bp, Homo sapiens
gccgccgctgtgcaatttagca

SEQ ID NO: 7207839 - DNA, 22 bp, Homo sapiens
gccgcgtcgatgccctctagtt

SEQ ID NO: 7207840 - DNA, 22 bp, Homo sapiens
gccgctggaaggtgagtgacgt

SEQ ID NO: 7207841 - DNA, 22 bp, Homo sapiens
gccgaggctctgcccagctgct

SEQ ID NO: 7207842 - DNA, 22 bp, Homo sapiens
gccgatgaaaagaccaaagact

SEQ ID NO: 7207843 - DNA, 22 bp, Homo sapiens
gccgaagacgctgggcgtgggc

SEQ ID NO: 7207844 - DNA, 22 bp, Homo sapiens
gccgaggaagcattcctaggag

SEQ ID NO: 7207845 - DNA, 22 bp, Homo sapiens
gccgaggctctgcccagctgct

SEQ ID NO: 7207846 - DNA, 22 bp, Homo sapiens
gccggccagcaagcttcaggtg

SEQ ID NO: 7207847 - DNA, 19 bp, Homo sapiens
gccgggcccgggttggccg

SEQ ID NO: 7207848 - DNA, 22 bp, Homo sapiens
gccgggccctgacctcagagtt

SEQ ID NO: 7207849 - DNA, 22 bp, Homo sapiens
gccggggctggggagagacatg

SEQ ID NO: 7207850 - DNA, 22 bp, Homo sapiens
gccggggctggggagagacatg

SEQ ID NO: 7207851 - DNA, 22 bp, Homo sapiens
gccgggccctgacctcagagtt

SEQ ID NO: 7207852 - DNA, 22 bp, Homo sapiens
gccggggctggggagagacatg

SEQ ID NO: 7207853 - DNA, 19 bp, Homo sapiens
gcctctgctggggacaggc

SEQ ID NO: 7207854 - DNA, 19 bp, Homo sapiens
gcctctgctggggacaggc

SEQ ID NO: 7207855 - DNA, 22 bp, Homo sapiens
gcctctgctctcaggtagcctc

SEQ ID NO: 7207856 - DNA, 22 bp, Homo sapiens
gcctctgctgacaagatggaca

SEQ ID NO: 7207857 - DNA, 22 bp, Homo sapiens
gcctctgccctcctgggactgc

SEQ ID NO: 7207858 - DNA, 22 bp, Homo sapiens
gcctctgcgcctcagccgacct

SEQ ID NO: 7207859 - DNA, 22 bp, Homo sapiens
gcctctgcggagctgtacatca

SEQ ID NO: 7207860 - DNA, 22 bp, Homo sapiens
gcctctgcggagctgtacatca

SEQ ID NO: 7207861 - DNA, 22 bp, Homo sapiens
gcctctgcggggcccgagcccg

SEQ ID NO: 7207862 - DNA, 22 bp, Homo sapiens
gcctctgctcggactttgcctc

SEQ ID NO: 7207863 - DNA, 22 bp, Homo sapiens
gcctctgcatgctcagcaccca

SEQ ID NO: 7207864 - DNA, 22 bp, Homo sapiens
gcctctgccaagggggctgcgg

SEQ ID NO: 7207865 - DNA, 22 bp, Homo sapiens
gcctctgccaagggggctgcgg

SEQ ID NO: 7207866 - DNA, 22 bp, Homo sapiens
gcctctgcccatccaccatcag

SEQ ID NO: 7207867 - DNA, 22 bp, Homo sapiens
gcctctgcccatccaccatcag

SEQ ID NO: 7207868 - DNA, 22 bp, Homo sapiens
gcctctgcatcatcactccagc

SEQ ID NO: 7207869 - DNA, 22 bp, Homo sapiens
gcctctgcatcttcgccgcact

SEQ ID NO: 7207870 - DNA, 22 bp, Homo sapiens
gcctctgcatcttcgccgcact

SEQ ID NO: 7207871 - DNA, 22 bp, Homo sapiens
gcctctgcatgctcagcaccca

SEQ ID NO: 7207872 - DNA, 22 bp, Homo sapiens
gcctctgcaattacattgtgcc

SEQ ID NO: 7207873 - DNA, 22 bp, Homo sapiens
gcctctgcaccagtactgtgcc

SEQ ID NO: 7207874 - DNA, 22 bp, Homo sapiens
gcctctgcaactccgccttggt

SEQ ID NO: 7207875 - DNA, 22 bp, Homo sapiens
gcctcctgttatgccatgtgcc

SEQ ID NO: 7207876 - DNA, 22 bp, Homo sapiens
gcctctgcactgtggcacacca

SEQ ID NO: 7207877 - DNA, 22 bp, Homo sapiens
gcctctgcactgtggcacacca

SEQ ID NO: 7207878 - DNA, 22 bp, Homo sapiens
gcctctgcactgtggcacacca

SEQ ID NO: 7207879 - DNA, 22 bp, Homo sapiens
gccctcagtggattcttattgt

SEQ ID NO: 7207880 - DNA, 22 bp, Homo sapiens
gccctcctttgcttctcctagt

SEQ ID NO: 7207881 - DNA, 22 bp, Homo sapiens
gccctcctttgcttctcctagt

SEQ ID NO: 7207882 - DNA, 22 bp, Homo sapiens
gccctcgcttcttcctaggggt

SEQ ID NO: 7207883 - DNA, 22 bp, Homo sapiens
gccctctcttctgcagcctcca

SEQ ID NO: 7207884 - DNA, 22 bp, Homo sapiens
gccctctcggcatagcaggggc

SEQ ID NO: 7207885 - DNA, 22 bp, Homo sapiens
gccctctcggcatagcaggggc

SEQ ID NO: 7207886 - DNA, 22 bp, Homo sapiens
gccctctcttctgcagcctcca

SEQ ID NO: 7207887 - DNA, 22 bp, Homo sapiens
gccctctcttctgcagcctcca

SEQ ID NO: 7207888 - DNA, 23 bp, Homo sapiens
gccctcagtagaaaatgttagaa

SEQ ID NO: 7207889 - DNA, 21 bp, Homo sapiens
gccctcaggggaggatggcct

SEQ ID NO: 7207890 - DNA, 21 bp, Homo sapiens
gccctcaggggaggatggcct

SEQ ID NO: 7207891 - DNA, 20 bp, Homo sapiens
gccctcagtcttgtctttat

SEQ ID NO: 7207892 - DNA, 22 bp, Homo sapiens
gccctcagtgaccactgattca

SEQ ID NO: 7207893 - DNA, 19 bp, Homo sapiens
gccctcaggcagctccatc

SEQ ID NO: 7207894 - DNA, 19 bp, Homo sapiens
gccctcaggcagctccatc

SEQ ID NO: 7207895 - DNA, 19 bp, Homo sapiens
gccctcaggcagctccatc

SEQ ID NO: 7207896 - DNA, 22 bp, Homo sapiens
gccctcaggcagggagtctttc

SEQ ID NO: 7207897 - DNA, 22 bp, Homo sapiens
gccctcaggcagggagtctttc

SEQ ID NO: 7207898 - DNA, 15 bp, Homo sapiens
gccctcaggcgacac

SEQ ID NO: 7207899 - DNA, 21 bp, Homo sapiens
gccctcaggggaggatggcct

SEQ ID NO: 7207900 - DNA, 22 bp, Homo sapiens
gccctcagcttgatgttgttct

SEQ ID NO: 7207901 - DNA, 22 bp, Homo sapiens
gccctcagctcctggacacatg

SEQ ID NO: 7207902 - DNA, 17 bp, Homo sapiens
gccctcagctttaacca

SEQ ID NO: 7207903 - DNA, 22 bp, Homo sapiens
gccctcaggacaaggttacgct

SEQ ID NO: 7207904 - DNA, 22 bp, Homo sapiens
gccctcagcaggaaagatcaac

SEQ ID NO: 7207905 - DNA, 22 bp, Homo sapiens
gccctcagcatcctcagggcca

SEQ ID NO: 7207906 - DNA, 22 bp, Homo sapiens
gccctcagcatcctcagggcca

SEQ ID NO: 7207907 - DNA, 22 bp, Homo sapiens
gccctcagcatcctcagggcca

SEQ ID NO: 7207908 - DNA, 22 bp, Homo sapiens
gccctcagctcctggacacatg

SEQ ID NO: 7207909 - DNA, 22 bp, Homo sapiens
gccctcagagttccccacagtg

SEQ ID NO: 7207910 - DNA, 22 bp, Homo sapiens
gccctcagatgggaaaggaggg

SEQ ID NO: 7207911 - DNA, 22 bp, Homo sapiens
gccctcagcaggaaagatcaac

SEQ ID NO: 7207912 - DNA, 22 bp, Homo sapiens
gcccaggctggagtgcagtggt

SEQ ID NO: 7207913 - DNA, 22 bp, Homo sapiens
gcccaggctggagtgcagtggc

SEQ ID NO: 7207914 - DNA, 22 bp, Homo sapiens
gcccaggctggagtgcagtggt

SEQ ID NO: 7207915 - DNA, 22 bp, Homo sapiens
gcccaggctggagtgcagtggc

SEQ ID NO: 7207916 - DNA, 22 bp, Homo sapiens
gcccaggctggagtgcagtggc

SEQ ID NO: 7207917 - DNA, 16 bp, Homo sapiens
gccctttccttggctg

SEQ ID NO: 7207918 - DNA, 22 bp, Homo sapiens
gccctttagagaaagttttctt

SEQ ID NO: 7207919 - DNA, 22 bp, Homo sapiens
gccctttcttcttctggactgg

SEQ ID NO: 7207920 - DNA, 22 bp, Homo sapiens
gcccttggaagcggcaggtagc

SEQ ID NO: 7207921 - DNA, 22 bp, Homo sapiens
gcccttggaagcggcaggtagc

SEQ ID NO: 7207922 - DNA, 22 bp, Homo sapiens
gcccttggaaagccaaggcagc

SEQ ID NO: 7207923 - DNA, 22 bp, Homo sapiens
gcccttggaacagcctcctgct

SEQ ID NO: 7207924 - DNA, 22 bp, Homo sapiens
gcccttccaacccagagggcaa

SEQ ID NO: 7207925 - DNA, 22 bp, Homo sapiens
gcccttccaacccagagggcaa

SEQ ID NO: 7207926 - DNA, 22 bp, Homo sapiens
gcccttaggtactacttattct

SEQ ID NO: 7207927 - DNA, 22 bp, Homo sapiens
gcccttagtcagcactttcact

SEQ ID NO: 7207928 - DNA, 22 bp, Homo sapiens
gcccttataaacaaggcttcag

SEQ ID NO: 7207929 - DNA, 22 bp, Homo sapiens
gcccttccaacccagagggcaa

SEQ ID NO: 7207930 - DNA, 22 bp, Homo sapiens
gcccttccttagacagcaggat

SEQ ID NO: 7207931 - DNA, 22 bp, Homo sapiens
gcccttccttagacagcaggat

SEQ ID NO: 7207932 - DNA, 22 bp, Homo sapiens
gcccttgagtagcaaaaagggc

SEQ ID NO: 7207933 - DNA, 22 bp, Homo sapiens
gcccttgagtagcaaaaagggc

SEQ ID NO: 7207934 - DNA, 22 bp, Homo sapiens
gcccttacagggtggtcagcca

SEQ ID NO: 7207935 - DNA, 22 bp, Homo sapiens
gccctgttttctgggttccttg

SEQ ID NO: 7207936 - DNA, 22 bp, Homo sapiens
gcccttacagggtggtcagcca

SEQ ID NO: 7207937 - DNA, 22 bp, Homo sapiens
gcccttagccttatagcctcta

SEQ ID NO: 7207938 - DNA, 22 bp, Homo sapiens
gcccttaggcaagcagaagccc

SEQ ID NO: 7207939 - DNA, 22 bp, Homo sapiens
gcccttaggcaagcagaagccc

SEQ ID NO: 7207940 - DNA, 22 bp, Homo sapiens
gcccttagggccactgtcactg

SEQ ID NO: 7207941 - DNA, 22 bp, Homo sapiens
gccctctgctggcctcacctcg

SEQ ID NO: 7207942 - DNA, 22 bp, Homo sapiens
gccctctgctggcctcacctcg

SEQ ID NO: 7207943 - DNA, 22 bp, Homo sapiens
gccctctggcacagagatgcag

SEQ ID NO: 7207944 - DNA, 20 bp, Homo sapiens
gccctctgcctccctcagcg

SEQ ID NO: 7207945 - DNA, 22 bp, Homo sapiens
gccctctgccacaggacgccag

SEQ ID NO: 7207946 - DNA, 22 bp, Homo sapiens
gccctctcttctgcagcctcca

SEQ ID NO: 7207947 - DNA, 22 bp, Homo sapiens
gccctctgatgctcaccgagga

SEQ ID NO: 7207948 - DNA, 22 bp, Homo sapiens
gccctctgcacagctctgagca

SEQ ID NO: 7207949 - DNA, 22 bp, Homo sapiens
gccaggctggttatttaatgag

SEQ ID NO: 7207950 - DNA, 22 bp, Homo sapiens
gccaggctggtgtcacaactct

SEQ ID NO: 7207951 - DNA, 22 bp, Homo sapiens
gccaggctggtgtcacaactct

SEQ ID NO: 7207952 - DNA, 22 bp, Homo sapiens
gccaggctgctccagggaggcc

SEQ ID NO: 7207953 - DNA, 22 bp, Homo sapiens
gccaggctgctggctgctgtcc

SEQ ID NO: 7207954 - DNA, 22 bp, Homo sapiens
gccaggctgctggctgctgtcc

SEQ ID NO: 7207955 - DNA, 22 bp, Homo sapiens
gccaggctgctccagggaggcc

SEQ ID NO: 7207956 - DNA, 22 bp, Homo sapiens
gccaggctgccttatctctagc

SEQ ID NO: 7207957 - DNA, 22 bp, Homo sapiens
gccaggctgaggctctggaaga

SEQ ID NO: 7207958 - DNA, 22 bp, Homo sapiens
gccaggctgactcccccggcct

SEQ ID NO: 7207959 - DNA, 22 bp, Homo sapiens
gccaggctgactcccccggcct

SEQ ID NO: 7207960 - DNA, 22 bp, Homo sapiens
gccaggctgactcccccggcct

SEQ ID NO: 7207961 - DNA, 22 bp, Homo sapiens
gccaggctcttggttatgtttt

SEQ ID NO: 7207962 - DNA, 22 bp, Homo sapiens
gccaggctcttccatttgggtc

SEQ ID NO: 7207963 - DNA, 19 bp, Homo sapiens
gccaggctcttattctgtg

SEQ ID NO: 7207964 - DNA, 22 bp, Homo sapiens
gccaggctctcagtgactgccc

SEQ ID NO: 7207965 - DNA, 22 bp, Homo sapiens
gccagcagggcccaaatgctgg

SEQ ID NO: 7207966 - DNA, 22 bp, Homo sapiens
gccatattcgcattcttcattt

SEQ ID NO: 7207967 - DNA, 22 bp, Homo sapiens
gccatcaaataccagcctgaat

SEQ ID NO: 7207968 - DNA, 22 bp, Homo sapiens
gccatatatattttgcactagg

SEQ ID NO: 7207969 - DNA, 22 bp, Homo sapiens
gccataaattgctggtcaaaat

SEQ ID NO: 7207970 - DNA, 22 bp, Homo sapiens
gccataatagagtgtgaggaat

SEQ ID NO: 7207971 - DNA, 22 bp, Homo sapiens
gccataggcagcgtggccagca

SEQ ID NO: 7207972 - DNA, 22 bp, Homo sapiens
gccataaaatgtggatgaggga

SEQ ID NO: 7207973 - DNA, 22 bp, Homo sapiens
gccataaatgaaggaaaggtat

SEQ ID NO: 7207974 - DNA, 22 bp, Homo sapiens
gccagtggtgagattccctggg

SEQ ID NO: 7207975 - DNA, 22 bp, Homo sapiens
gccagtgtgtcttgcaggctcc

SEQ ID NO: 7207976 - DNA, 22 bp, Homo sapiens
gccaggctgtttttattactgt

SEQ ID NO: 7207977 - DNA, 22 bp, Homo sapiens
gccaggctgtggggaacttgaa

SEQ ID NO: 7207978 - DNA, 22 bp, Homo sapiens
gccaggctgtttttattactgt

SEQ ID NO: 7207979 - DNA, 22 bp, Homo sapiens
gccagggaaactgcagaccagc

SEQ ID NO: 7207980 - DNA, 22 bp, Homo sapiens
gccagtgggacccgctgtgggc

SEQ ID NO: 7207981 - DNA, 22 bp, Homo sapiens
gccagtggtcagtgggagggtg

SEQ ID NO: 7207982 - DNA, 22 bp, Homo sapiens
gccagtggtcagtgggagggtg

SEQ ID NO: 7207983 - DNA, 22 bp, Homo sapiens
gccagtggtcactgaggaagaa

SEQ ID NO: 7207984 - DNA, 22 bp, Homo sapiens
gccagtggtcactgaggaagaa

SEQ ID NO: 7207985 - DNA, 22 bp, Homo sapiens
gccagtggtcactgaggaagaa

SEQ ID NO: 7207986 - DNA, 22 bp, Homo sapiens
gccagtgggtagttggagctgg

SEQ ID NO: 7207987 - DNA, 22 bp, Homo sapiens
gccagtgggtagttggagctgg

SEQ ID NO: 7207988 - DNA, 22 bp, Homo sapiens
gccagtgggtagttggagctgg

SEQ ID NO: 7207989 - DNA, 18 bp, Homo sapiens
gccagtgggtccaggtgc

SEQ ID NO: 7207990 - DNA, 18 bp, Homo sapiens
gccagtgggtccaggtgc

SEQ ID NO: 7207991 - DNA, 22 bp, Homo sapiens
gccagtggtagaggggaggccg

SEQ ID NO: 7207992 - DNA, 18 bp, Homo sapiens
gccagtgggtccaggtgc

SEQ ID NO: 7207993 - DNA, 22 bp, Homo sapiens
gccagtggtagaggggaggccg

SEQ ID NO: 7207994 - DNA, 23 bp, Homo sapiens
gccatggctgccccacaggcctc

SEQ ID NO: 7207995 - DNA, 23 bp, Homo sapiens
gccatcacgttcaaccaaagcct

SEQ ID NO: 7207996 - DNA, 23 bp, Homo sapiens
gccatggctgccccacaggcctc

SEQ ID NO: 7207997 - DNA, 23 bp, Homo sapiens
gccatggctgccccacaggcctc

SEQ ID NO: 7207998 - DNA, 22 bp, Homo sapiens
gccatgggcaaatgcagagctg

SEQ ID NO: 7207999 - DNA, 22 bp, Homo sapiens
gccatgggcaaatgcagagctg

SEQ ID NO: 7208000 - DNA, 22 bp, Homo sapiens
gccatcaaggtgaagccctgag

SEQ ID NO: 7208001 - DNA, 22 bp, Homo sapiens
gccatcacatccaggctacctc

SEQ ID NO: 7208002 - DNA, 21 bp, Homo sapiens
gccatcaccaagctcttcccc

SEQ ID NO: 7208003 - DNA, 23 bp, Homo sapiens
gccatcacgttcaaccaaagcct

SEQ ID NO: 7208004 - DNA, 23 bp, Homo sapiens
gccatcacgttcaaccaaagcct

SEQ ID NO: 7208005 - DNA, 22 bp, Homo sapiens
gccatcatatcccctgtgacct

SEQ ID NO: 7208006 - DNA, 22 bp, Homo sapiens
gccatcatatcccctgtgacct

SEQ ID NO: 7208007 - DNA, 19 bp, Homo sapiens
gccatgggctggcagcaga

SEQ ID NO: 7208008 - DNA, 22 bp, Homo sapiens
gccatgggtctgctggctcagc

SEQ ID NO: 7208009 - DNA, 22 bp, Homo sapiens
gccatggggctcagctgcacta

SEQ ID NO: 7208010 - DNA, 22 bp, Homo sapiens
gccatggggctcagctgcacta

SEQ ID NO: 7208011 - DNA, 22 bp, Homo sapiens
gccatggggagggcagcgcctg

SEQ ID NO: 7208012 - DNA, 22 bp, Homo sapiens
gccatgggtctgctggctcagc

SEQ ID NO: 7208013 - DNA, 22 bp, Homo sapiens
gccatgtcctgggcatctgcca

SEQ ID NO: 7208014 - DNA, 22 bp, Homo sapiens
gccatgtgggcagaggaggctg

SEQ ID NO: 7208015 - DNA, 22 bp, Homo sapiens
gccatgtgggcagaggaggctg

SEQ ID NO: 7208016 - DNA, 22 bp, Homo sapiens
gccattaaagtgcatgttttgc

SEQ ID NO: 7208017 - DNA, 22 bp, Homo sapiens
gcccaggagttggaggctgcag

SEQ ID NO: 7208018 - DNA, 22 bp, Homo sapiens
gcccaggagttggaggctgcag

SEQ ID NO: 7208019 - DNA, 22 bp, Homo sapiens
gcccaggagttggaggctgcag

SEQ ID NO: 7208020 - DNA, 22 bp, Homo sapiens
gcccaggagttggaggctgcag

SEQ ID NO: 7208021 - DNA, 22 bp, Homo sapiens
gcccaggagttggaggctgcag

SEQ ID NO: 7208022 - DNA, 22 bp, Homo sapiens
gcccaggaggtcaagtagctat

SEQ ID NO: 7208023 - DNA, 22 bp, Homo sapiens
gcccaggaggcagaggttgtgg

SEQ ID NO: 7208024 - DNA, 22 bp, Homo sapiens
gcccaggaggtcaagtagctat

SEQ ID NO: 7208025 - DNA, 22 bp, Homo sapiens
gcccaggaggtcaagtagctat

SEQ ID NO: 7208026 - DNA, 22 bp, Homo sapiens
gcccaggaggcagaggttgtgg

SEQ ID NO: 7208027 - DNA, 22 bp, Homo sapiens
gcccaggaggcagaggttgtgg

SEQ ID NO: 7208028 - DNA, 22 bp, Homo sapiens
gccattcaattctacaagtata

SEQ ID NO: 7208029 - DNA, 22 bp, Homo sapiens
gccattgtgaaatgttaatgta

SEQ ID NO: 7208030 - DNA, 21 bp, Homo sapiens
gccattgttttctacctggag

SEQ ID NO: 7208031 - DNA, 22 bp, Homo sapiens
gccatttaagtctctattatgt

SEQ ID NO: 7208032 - DNA, 22 bp, Homo sapiens
gccatttaggaggtggaaagga

SEQ ID NO: 7208033 - DNA, 21 bp, Homo sapiens
gccatttcacacagacatttg

SEQ ID NO: 7208034 - DNA, 22 bp, Homo sapiens
gcccaggaggagaggctgcagt

SEQ ID NO: 7208035 - DNA, 22 bp, Homo sapiens
gcccaggaggagaggctgcagt

SEQ ID NO: 7208036 - DNA, 22 bp, Homo sapiens
gcccaggctggagtgcagtggc

SEQ ID NO: 7208037 - DNA, 22 bp, Homo sapiens
gcccaggctggagtgcagtggc

SEQ ID NO: 7208038 - DNA, 22 bp, Homo sapiens
gcccaggctggagtgcagtagc

SEQ ID NO: 7208039 - DNA, 22 bp, Homo sapiens
gcccaggctggagtgcagtggc

SEQ ID NO: 7208040 - DNA, 22 bp, Homo sapiens
gcccaggctggagtgcagtagc

SEQ ID NO: 7208041 - DNA, 22 bp, Homo sapiens
gcccaggattctttcttcctta

SEQ ID NO: 7208042 - DNA, 22 bp, Homo sapiens
gcccaggattctttcttcctta

SEQ ID NO: 7208043 - DNA, 22 bp, Homo sapiens
gcccaggctagcgtagagtgca

SEQ ID NO: 7208044 - DNA, 22 bp, Homo sapiens
gcccaggctagcgtagagtgca

SEQ ID NO: 7208045 - DNA, 22 bp, Homo sapiens
gcccaggctagcgtagagtgca

SEQ ID NO: 7208046 - DNA, 22 bp, Homo sapiens
gcccaggatggctggaggtgct

SEQ ID NO: 7208047 - DNA, 22 bp, Homo sapiens
gcccaggatggtgtgtagtggt

SEQ ID NO: 7208048 - DNA, 22 bp, Homo sapiens
gcccaggatggtgtgtagtggt

SEQ ID NO: 7208049 - DNA, 22 bp, Homo sapiens
gcccaggatggtgtgtagtggt

SEQ ID NO: 7208050 - DNA, 20 bp, Homo sapiens
gcccaggatctctgaggcat

SEQ ID NO: 7208051 - DNA, 20 bp, Homo sapiens
gcccaggatctctgaggcat

SEQ ID NO: 7208052 - DNA, 22 bp, Homo sapiens
gcccaggataatgctgtccctg

SEQ ID NO: 7208053 - DNA, 22 bp, Homo sapiens
gcccaggataatgctgtccctg

SEQ ID NO: 7208054 - DNA, 20 bp, Homo sapiens
gcccaggatctctgaggcat

SEQ ID NO: 7208055 - DNA, 22 bp, Homo sapiens
gcccaggataatgctgtccctg

SEQ ID NO: 7208056 - DNA, 22 bp, Homo sapiens
gcccaggagtttgcattttaac

SEQ ID NO: 7208057 - DNA, 22 bp, Homo sapiens
gcccaggagtttgcattttaac

SEQ ID NO: 7208058 - DNA, 22 bp, Homo sapiens
gcccaggagttggaggctgcag

SEQ ID NO: 7208059 - DNA, 22 bp, Homo sapiens
gcccaggagttggtggctgcag

SEQ ID NO: 7208060 - DNA, 22 bp, Homo sapiens
gcccaggagttggtggctgcag

SEQ ID NO: 7208061 - DNA, 22 bp, Homo sapiens
gcccaggagttggtggctgcag

SEQ ID NO: 7208062 - DNA, 22 bp, Homo sapiens
gcccaggagttggtggctgcag

SEQ ID NO: 7208063 - DNA, 20 bp, Homo sapiens
gcccaggatctctgaggcat

SEQ ID NO: 7208064 - DNA, 20 bp, Homo sapiens
gcccaggatctctgaggcat

SEQ ID NO: 7208065 - DNA, 22 bp, Homo sapiens
gcccaggatctgctcagatcat

SEQ ID NO: 7208066 - DNA, 22 bp, Homo sapiens
gcccaggatctgctcagatcat

SEQ ID NO: 7208067 - DNA, 22 bp, Homo sapiens
gcccaggatctgctcagatcat

SEQ ID NO: 7208068 - DNA, 22 bp, Homo sapiens
gcccaggatggagaatagtggt

SEQ ID NO: 7208069 - DNA, 22 bp, Homo sapiens
gcccaggatggagaatagtggt

SEQ ID NO: 7208070 - DNA, 22 bp, Homo sapiens
gcccaggatggctggaggtgct

SEQ ID NO: 7208071 - DNA, 22 bp, Homo sapiens
gcccaggatggctggaggtgct

SEQ ID NO: 7208072 - DNA, 22 bp, Homo sapiens
gcccaggatggctggaggtgct

SEQ ID NO: 7208073 - DNA, 22 bp, Homo sapiens
gctgggcaggcctcgtgagggc

SEQ ID NO: 7208074 - DNA, 22 bp, Homo sapiens
gctgggcagctgaggcctctca

SEQ ID NO: 7208075 - DNA, 22 bp, Homo sapiens
gctgggcagctgaggcctctca

SEQ ID NO: 7208076 - DNA, 22 bp, Homo sapiens
gctgggcaggcctcgtgagggc

SEQ ID NO: 7208077 - DNA, 22 bp, Homo sapiens
gctgggcagtgagtgagtcctt

SEQ ID NO: 7208078 - DNA, 22 bp, Homo sapiens
gctgggcaggcctcgtgagggc

SEQ ID NO: 7208079 - DNA, 22 bp, Homo sapiens
gctgggcaggcctcgtgagggc

SEQ ID NO: 7208080 - DNA, 22 bp, Homo sapiens
gctgggcagcccctacagagag

SEQ ID NO: 7208081 - DNA, 22 bp, Homo sapiens
gctgggcagcccctacagagag

SEQ ID NO: 7208082 - DNA, 22 bp, Homo sapiens
gctgggcagcaggctctccggg

SEQ ID NO: 7208083 - DNA, 22 bp, Homo sapiens
gctgggcagcaggctctccggg

SEQ ID NO: 7208084 - DNA, 22 bp, Homo sapiens
gctgggcagcctggccgctgcc

SEQ ID NO: 7208085 - DNA, 22 bp, Homo sapiens
gctgggcagcctggccgctgcc

SEQ ID NO: 7208086 - DNA, 22 bp, Homo sapiens
gctgggcagcctggccgctgcc

SEQ ID NO: 7208087 - DNA, 22 bp, Homo sapiens
gctgggcaacggaagagagaaa

SEQ ID NO: 7208088 - DNA, 22 bp, Homo sapiens
gctgggcaacgggcagaaagat

SEQ ID NO: 7208089 - DNA, 22 bp, Homo sapiens
gctgggcaacgggcagaaagat

SEQ ID NO: 7208090 - DNA, 22 bp, Homo sapiens
gctgggcaaggctgaagctacc

SEQ ID NO: 7208091 - DNA, 22 bp, Homo sapiens
gctgggcaagtgccttgggttt

SEQ ID NO: 7208092 - DNA, 22 bp, Homo sapiens
gctgggcaagtgccttgggttt

SEQ ID NO: 7208093 - DNA, 22 bp, Homo sapiens
gctgggcaatgccagagaggag

SEQ ID NO: 7208094 - DNA, 22 bp, Homo sapiens
gctgggcaatgccagagaggag

SEQ ID NO: 7208095 - DNA, 22 bp, Homo sapiens
gctgggcaatgccagagaggag

SEQ ID NO: 7208096 - DNA, 22 bp, Homo sapiens
gctgggcaccggagagacccca

SEQ ID NO: 7208097 - DNA, 22 bp, Homo sapiens
gctgggcaatgccagagaggag

SEQ ID NO: 7208098 - DNA, 22 bp, Homo sapiens
gctgggcaatgccagagaggag

SEQ ID NO: 7208099 - DNA, 22 bp, Homo sapiens
gctgggcaatgccagagaggag

SEQ ID NO: 7208100 - DNA, 22 bp, Homo sapiens
gctgggcaatgccagagaggag

SEQ ID NO: 7208101 - DNA, 22 bp, Homo sapiens
gctgggcacctctcccagattg

SEQ ID NO: 7208102 - DNA, 22 bp, Homo sapiens
gctgggcacctctcccagattg

SEQ ID NO: 7208103 - DNA, 22 bp, Homo sapiens
gctgggcaccggagagacccca

SEQ ID NO: 7208104 - DNA, 22 bp, Homo sapiens
gctgggcactgtcccataggct

SEQ ID NO: 7208105 - DNA, 22 bp, Homo sapiens
gctgggcactgtcccataggct

SEQ ID NO: 7208106 - DNA, 22 bp, Homo sapiens
gctgggcactgtcccataggct

SEQ ID NO: 7208107 - DNA, 22 bp, Homo sapiens
gctgggagttactgtctccttt

SEQ ID NO: 7208108 - DNA, 22 bp, Homo sapiens
gctggcggcagtggtgtctctg

SEQ ID NO: 7208109 - DNA, 22 bp, Homo sapiens
gctggcctttgaggaagctgcg

SEQ ID NO: 7208110 - DNA, 22 bp, Homo sapiens
gctggcggcagtggtgtctctg

SEQ ID NO: 7208111 - DNA, 22 bp, Homo sapiens
gctgggagtgggcaagatgaga

SEQ ID NO: 7208112 - DNA, 22 bp, Homo sapiens
gctgggagtgggcaagatgaga

SEQ ID NO: 7208113 - DNA, 22 bp, Homo sapiens
gctgggagtttgatttgactgg

SEQ ID NO: 7208114 - DNA, 22 bp, Homo sapiens
gctgggagttactgtctccttt

SEQ ID NO: 7208115 - DNA, 22 bp, Homo sapiens
gctgggagttactgtctccttt

SEQ ID NO: 7208116 - DNA, 22 bp, Homo sapiens
gctgggatgcgtcttcccaggc

SEQ ID NO: 7208117 - DNA, 22 bp, Homo sapiens
gctgggatggagactgcagtga

SEQ ID NO: 7208118 - DNA, 22 bp, Homo sapiens
gctgggcaacggaagagagaaa

SEQ ID NO: 7208119 - DNA, 22 bp, Homo sapiens
gctggcctgggcagaggctatg

SEQ ID NO: 7208120 - DNA, 22 bp, Homo sapiens
gctggcctgggcagaggctatg

SEQ ID NO: 7208121 - DNA, 22 bp, Homo sapiens
gctggcctgggcagaggctatg

SEQ ID NO: 7208122 - DNA, 22 bp, Homo sapiens
gctggcctgggcagcctgtcgg

SEQ ID NO: 7208123 - DNA, 22 bp, Homo sapiens
gctggcctgggctcaagaccag

SEQ ID NO: 7208124 - DNA, 22 bp, Homo sapiens
gctggcctgtctagagccttac

SEQ ID NO: 7208125 - DNA, 22 bp, Homo sapiens
gctggcctgtctagagccttac

SEQ ID NO: 7208126 - DNA, 22 bp, Homo sapiens
gctggccttgaggtgtctttat

SEQ ID NO: 7208127 - DNA, 22 bp, Homo sapiens
gctggccttgtgtctgaggaag

SEQ ID NO: 7208128 - DNA, 22 bp, Homo sapiens
gctggccttgtgtctgaggaag

SEQ ID NO: 7208129 - DNA, 22 bp, Homo sapiens
gctggccttgtgtctgaggaag

SEQ ID NO: 7208130 - DNA, 22 bp, Homo sapiens
gctggcctttgaggaagctgcg

SEQ ID NO: 7208131 - DNA, 22 bp, Homo sapiens
gctggcctttgaggaagctgcg

SEQ ID NO: 7208132 - DNA, 22 bp, Homo sapiens
gctggagctgcagcctgggcct

SEQ ID NO: 7208133 - DNA, 22 bp, Homo sapiens
gctggagctgcagcctgggcct

SEQ ID NO: 7208134 - DNA, 22 bp, Homo sapiens
gctggccagtgtcccagggatc

SEQ ID NO: 7208135 - DNA, 22 bp, Homo sapiens
gctggccagtgtcccagggatc

SEQ ID NO: 7208136 - DNA, 22 bp, Homo sapiens
gctggccagtgtcccagggatc

SEQ ID NO: 7208137 - DNA, 22 bp, Homo sapiens
gctggcccagtgacccacagtg

SEQ ID NO: 7208138 - DNA, 22 bp, Homo sapiens
gctggcccagtgacccacagtg

SEQ ID NO: 7208139 - DNA, 22 bp, Homo sapiens
gctggccccgagtgctacgctc

SEQ ID NO: 7208140 - DNA, 22 bp, Homo sapiens
gctggcctcatcactgacttct

SEQ ID NO: 7208141 - DNA, 22 bp, Homo sapiens
gctggcctcctgctagatggaa

SEQ ID NO: 7208142 - DNA, 22 bp, Homo sapiens
gctggcctcgcaggcaggatgt

SEQ ID NO: 7208143 - DNA, 22 bp, Homo sapiens
gctggcctctacaggccggcca

SEQ ID NO: 7208144 - DNA, 22 bp, Homo sapiens
gctggcctctacaggccggcca

SEQ ID NO: 7208145 - DNA, 22 bp, Homo sapiens
gctggcctctggagaagggctt

SEQ ID NO: 7208146 - DNA, 22 bp, Homo sapiens
gctggcctctggagaagggctt

SEQ ID NO: 7208147 - DNA, 22 bp, Homo sapiens
gctggcctgaccagccacaggc

SEQ ID NO: 7208148 - DNA, 22 bp, Homo sapiens
gctggcctgaccagccacaggc

SEQ ID NO: 7208149 - DNA, 22 bp, Homo sapiens
gctggcctgacctgaggctggg

SEQ ID NO: 7208150 - DNA, 22 bp, Homo sapiens
gctggcctgacctgaggctggg

SEQ ID NO: 7208151 - DNA, 22 bp, Homo sapiens
gctggcctgacctgaggctggg

SEQ ID NO: 7208152 - DNA, 22 bp, Homo sapiens
gctggcctgagggccgaggctc

SEQ ID NO: 7208153 - DNA, 22 bp, Homo sapiens
gctggcctgcaaagcccggctg

SEQ ID NO: 7208154 - DNA, 22 bp, Homo sapiens
gctggcctgcgagggcaggctg

SEQ ID NO: 7208155 - DNA, 22 bp, Homo sapiens
gctggcctgcgagggcaggctg

SEQ ID NO: 7208156 - DNA, 22 bp, Homo sapiens
gctggagctgcagcctgggcct

SEQ ID NO: 7208157 - DNA, 22 bp, Homo sapiens
gctggagctgagttccctgggc

SEQ ID NO: 7208158 - DNA, 22 bp, Homo sapiens
gctggagcgggttcgggccgct

SEQ ID NO: 7208159 - DNA, 22 bp, Homo sapiens
gctggagcgggttcgggccgct

SEQ ID NO: 7208160 - DNA, 22 bp, Homo sapiens
gctggagcgggttcgggccgct

SEQ ID NO: 7208161 - DNA, 22 bp, Homo sapiens
gctggagccattggcttggcct

SEQ ID NO: 7208162 - DNA, 22 bp, Homo sapiens
gctggagccttctgctctgttg

SEQ ID NO: 7208163 - DNA, 22 bp, Homo sapiens
gctggagccaagctgctcttgg

SEQ ID NO: 7208164 - DNA, 22 bp, Homo sapiens
gctggagatgctatgcagaggg

SEQ ID NO: 7208165 - DNA, 22 bp, Homo sapiens
gctggagatgctatgcagaggg

SEQ ID NO: 7208166 - DNA, 22 bp, Homo sapiens
gctggagatgctatgcagaggg

SEQ ID NO: 7208167 - DNA, 22 bp, Homo sapiens
gctggagatgctatgcagaggg

SEQ ID NO: 7208168 - DNA, 22 bp, Homo sapiens
gctggagatagtaggatccata

SEQ ID NO: 7208169 - DNA, 22 bp, Homo sapiens
gctggagatagtaggatccata

SEQ ID NO: 7208170 - DNA, 22 bp, Homo sapiens
gctggagatagtaggatccata

SEQ ID NO: 7208171 - DNA, 22 bp, Homo sapiens
gctggagatagaatggccactg

SEQ ID NO: 7208172 - DNA, 22 bp, Homo sapiens
gctggagatagaatggccactg

SEQ ID NO: 7208173 - DNA, 22 bp, Homo sapiens
gctggagatactgctcagtatc

SEQ ID NO: 7208174 - DNA, 22 bp, Homo sapiens
gctggagatactgctcagtatc

SEQ ID NO: 7208175 - DNA, 22 bp, Homo sapiens
gctggagatagaatggccactg

SEQ ID NO: 7208176 - DNA, 22 bp, Homo sapiens
gctggagatagaatggccactg

SEQ ID NO: 7208177 - DNA, 22 bp, Homo sapiens
gctggagatactgctcagtatc

SEQ ID NO: 7208178 - DNA, 22 bp, Homo sapiens
gctggagagtgaggggagcaag

SEQ ID NO: 7208179 - DNA, 22 bp, Homo sapiens
gctggagagtgaggggagcaag

SEQ ID NO: 7208180 - DNA, 22 bp, Homo sapiens
gctggagagtgaggggagcaag

SEQ ID NO: 7208181 - DNA, 22 bp, Homo sapiens
gctggagagtgaggggagcaag

SEQ ID NO: 7208182 - DNA, 22 bp, Homo sapiens
gctggagagtgaggggagcaag

SEQ ID NO: 7208183 - DNA, 22 bp, Homo sapiens
gctggagagtagtaagcagtta

SEQ ID NO: 7208184 - DNA, 22 bp, Homo sapiens
gctggagagtagtaagcagtta

SEQ ID NO: 7208185 - DNA, 22 bp, Homo sapiens
gctgagctgaggcagggctggg

SEQ ID NO: 7208186 - DNA, 22 bp, Homo sapiens
gctgaggatatagcaggaacaa

SEQ ID NO: 7208187 - DNA, 22 bp, Homo sapiens
gctgaggatatagcaggaacaa

SEQ ID NO: 7208188 - DNA, 22 bp, Homo sapiens
gctgagcaggtgtaaggaaggc

SEQ ID NO: 7208189 - DNA, 22 bp, Homo sapiens
gctgagcaggtgtaaggaaggc

SEQ ID NO: 7208190 - DNA, 22 bp, Homo sapiens
gctgagccacaggcagtgcact

SEQ ID NO: 7208191 - DNA, 22 bp, Homo sapiens
gctgagccacaggcagtgcact

SEQ ID NO: 7208192 - DNA, 22 bp, Homo sapiens
gctgagccacaggcagtgcact

SEQ ID NO: 7208193 - DNA, 22 bp, Homo sapiens
gctgagccatgaggcctcttgc

SEQ ID NO: 7208194 - DNA, 22 bp, Homo sapiens
gctgagcccccctgcgtgggtc

SEQ ID NO: 7208195 - DNA, 22 bp, Homo sapiens
gctgagccctcatccctagttt

SEQ ID NO: 7208196 - DNA, 22 bp, Homo sapiens
gctgagcctagctgtctcctgt

SEQ ID NO: 7208197 - DNA, 22 bp, Homo sapiens
gctgcctgaatgaaccttgttc

SEQ ID NO: 7208198 - DNA, 22 bp, Homo sapiens
gctgaggcagtccacccttgtg

SEQ ID NO: 7208199 - DNA, 22 bp, Homo sapiens
gctgaggcagtccacccttgtg

SEQ ID NO: 7208200 - DNA, 22 bp, Homo sapiens
gctgaggcaagatttgaaccca

SEQ ID NO: 7208201 - DNA, 22 bp, Homo sapiens
gctgaggcaaaccaagaatgta

SEQ ID NO: 7208202 - DNA, 22 bp, Homo sapiens
gctgaggcaaaccaagaatgta

SEQ ID NO: 7208203 - DNA, 22 bp, Homo sapiens
gctgaggattacttgaagtcag

SEQ ID NO: 7208204 - DNA, 22 bp, Homo sapiens
gctgaggatatagcaggaacaa

SEQ ID NO: 7208205 - DNA, 22 bp, Homo sapiens
gctgaggatatagcaggaacaa

SEQ ID NO: 7208206 - DNA, 22 bp, Homo sapiens
gctgcctggagctcagcctgcc

SEQ ID NO: 7208207 - DNA, 22 bp, Homo sapiens
gctgcctggagctcagcctgcc

SEQ ID NO: 7208208 - DNA, 22 bp, Homo sapiens
gctgcctggatttgcaatcctc

SEQ ID NO: 7208209 - DNA, 22 bp, Homo sapiens
gctgcctggctgatgaaaattc

SEQ ID NO: 7208210 - DNA, 22 bp, Homo sapiens
gctgcctggctttagtccactt

SEQ ID NO: 7208211 - DNA, 22 bp, Homo sapiens
gctgcctgggcaggaggcgctg

SEQ ID NO: 7208212 - DNA, 22 bp, Homo sapiens
gctgcctggagctcagcctgcc

SEQ ID NO: 7208213 - DNA, 22 bp, Homo sapiens
gctgcctggagaggcagggatg

SEQ ID NO: 7208214 - DNA, 22 bp, Homo sapiens
gctgcctggagctcagcctgcc

SEQ ID NO: 7208215 - DNA, 22 bp, Homo sapiens
gctgcctggagctcagcctgcc

SEQ ID NO: 7208216 - DNA, 22 bp, Homo sapiens
gctgcctggaataacggctggc

SEQ ID NO: 7208217 - DNA, 22 bp, Homo sapiens
gctgcctggagaggcagggatg

SEQ ID NO: 7208218 - DNA, 22 bp, Homo sapiens
gctgcctggagaggcagggatg

SEQ ID NO: 7208219 - DNA, 22 bp, Homo sapiens
gctgcctgctcggctcctggga

SEQ ID NO: 7208220 - DNA, 22 bp, Homo sapiens
gctgcctgctcggctcctggga

SEQ ID NO: 7208221 - DNA, 22 bp, Homo sapiens
gctgcctgctcggctcctggga

SEQ ID NO: 7208222 - DNA, 22 bp, Homo sapiens
gctgcctgctcggctcctggga

SEQ ID NO: 7208223 - DNA, 22 bp, Homo sapiens
gctgcctgcttcatgtgggaga

SEQ ID NO: 7208224 - DNA, 22 bp, Homo sapiens
gctgcctgcttcatgtgggaga

SEQ ID NO: 7208225 - DNA, 22 bp, Homo sapiens
gctgcctggaataacggctggc

SEQ ID NO: 7208226 - DNA, 22 bp, Homo sapiens
gctgcctggaataacggctggc

SEQ ID NO: 7208227 - DNA, 22 bp, Homo sapiens
gctgcctgctcacccggcctgg

SEQ ID NO: 7208228 - DNA, 22 bp, Homo sapiens
gctgcctgctcacccggcctgg

SEQ ID NO: 7208229 - DNA, 22 bp, Homo sapiens
gctgcctgctcacccggcctgg

SEQ ID NO: 7208230 - DNA, 22 bp, Homo sapiens
gctgcctgctcacccggcctgg

SEQ ID NO: 7208231 - DNA, 22 bp, Homo sapiens
gctgcctgctcacccggcctgg

SEQ ID NO: 7208232 - DNA, 22 bp, Homo sapiens
gctgcctgatgtccagcaggac

SEQ ID NO: 7208233 - DNA, 22 bp, Homo sapiens
gctgctctcatagatggcttca

SEQ ID NO: 7208234 - DNA, 22 bp, Homo sapiens
gctgctctccaagcctccttga

SEQ ID NO: 7208235 - DNA, 22 bp, Homo sapiens
gctgctctccaagcctccttga

SEQ ID NO: 7208236 - DNA, 22 bp, Homo sapiens
gctgctctcatagatggcttca

SEQ ID NO: 7208237 - DNA, 22 bp, Homo sapiens
gctgctctccatggccgtgagt

SEQ ID NO: 7208238 - DNA, 20 bp, Homo sapiens
gctgctctccacggtctgca

SEQ ID NO: 7208239 - DNA, 19 bp, Homo sapiens
gctgctctgggtctcatct

SEQ ID NO: 7208240 - DNA, 22 bp, Homo sapiens
gctgctctggctctgcagtgtc

SEQ ID NO: 7208241 - DNA, 22 bp, Homo sapiens
gctgctctgctgtgtaagcagg

SEQ ID NO: 7208242 - DNA, 22 bp, Homo sapiens
gctgctctggctctgcagtgtc

SEQ ID NO: 7208243 - DNA, 22 bp, Homo sapiens
gctgctctggctctgcagtgtc

SEQ ID NO: 7208244 - DNA, 22 bp, Homo sapiens
gctgctctggctctgcagtgtc

SEQ ID NO: 7208245 - DNA, 22 bp, Homo sapiens
gctgctctacccatgcatctgt

SEQ ID NO: 7208246 - DNA, 22 bp, Homo sapiens
gctgctctcagagctcatgctg

SEQ ID NO: 7208247 - DNA, 22 bp, Homo sapiens
gctgctctcagagctcatgctg

SEQ ID NO: 7208248 - DNA, 22 bp, Homo sapiens
gctgcctgtcccaggatgagga

SEQ ID NO: 7208249 - DNA, 21 bp, Homo sapiens
gctgctcgagatccagtgctt

SEQ ID NO: 7208250 - DNA, 21 bp, Homo sapiens
gctgctcgagatccagtgctt

SEQ ID NO: 7208251 - DNA, 21 bp, Homo sapiens
gctgctcgagatccagtgctt

SEQ ID NO: 7208252 - DNA, 21 bp, Homo sapiens
gctgctcgagatccagtgctt

SEQ ID NO: 7208253 - DNA, 22 bp, Homo sapiens
gctgcctgtcccaggatgagga

SEQ ID NO: 7208254 - DNA, 22 bp, Homo sapiens
gctgcctggtttctcagctgca

SEQ ID NO: 7208255 - DNA, 22 bp, Homo sapiens
gctgcctgggcaggaggcgctg

SEQ ID NO: 7208256 - DNA, 22 bp, Homo sapiens
gctgcctgggctggcattccca

SEQ ID NO: 7208257 - DNA, 22 bp, Homo sapiens
gctgcctgggctggcattccca

SEQ ID NO: 7208258 - DNA, 22 bp, Homo sapiens
gctgctgcaagagccagctctt

SEQ ID NO: 7208259 - DNA, 22 bp, Homo sapiens
gctgctgcatgaacagcggtca

SEQ ID NO: 7208260 - DNA, 21 bp, Homo sapiens
gctgctgcccctagtgaggcc

SEQ ID NO: 7208261 - DNA, 22 bp, Homo sapiens
gctgctgccgcggccgctggga

SEQ ID NO: 7208262 - DNA, 22 bp, Homo sapiens
gctgctgagaattgcaggcaag

SEQ ID NO: 7208263 - DNA, 22 bp, Homo sapiens
gctgctgagaattgcaggcaag

SEQ ID NO: 7208264 - DNA, 22 bp, Homo sapiens
gctgctgagaattgcaggcaag

SEQ ID NO: 7208265 - DNA, 22 bp, Homo sapiens
gctgctcttttcagagatgaga

SEQ ID NO: 7208266 - DNA, 22 bp, Homo sapiens
gctgctgagctgcaggagtagg

SEQ ID NO: 7208267 - DNA, 22 bp, Homo sapiens
gctgctctgttaattgctgtaa

SEQ ID NO: 7208268 - DNA, 22 bp, Homo sapiens
gctgctctgttaattgctgtaa

SEQ ID NO: 7208269 - DNA, 22 bp, Homo sapiens
gctgctcttgaggggctcactg

SEQ ID NO: 7208270 - DNA, 22 bp, Homo sapiens
gctgctcttgaggggctcactg

SEQ ID NO: 7208271 - DNA, 22 bp, Homo sapiens
gctgctctgggtctgcccagct

SEQ ID NO: 7208272 - DNA, 22 bp, Homo sapiens
gctgctctgtgacagcctccgg

SEQ ID NO: 7208273 - DNA, 22 bp, Homo sapiens
gctgctctgggtctgcccagct

SEQ ID NO: 7208274 - DNA, 22 bp, Homo sapiens
gctgctctgggtctgcccagct

SEQ ID NO: 7208275 - DNA, 22 bp, Homo sapiens
gctgctctgggtctgcccagct

SEQ ID NO: 7208276 - DNA, 22 bp, Homo sapiens
gctgctgccgcggccgctggga

SEQ ID NO: 7208277 - DNA, 22 bp, Homo sapiens
gctgctgcctgtagccagggtg

SEQ ID NO: 7208278 - DNA, 21 bp, Homo sapiens
gctggagagccaggcaggggc

SEQ ID NO: 7208279 - DNA, 22 bp, Homo sapiens
gctgctgctggtctggggccac

SEQ ID NO: 7208280 - DNA, 22 bp, Homo sapiens
gctgctgctggtctggggccac

SEQ ID NO: 7208281 - DNA, 21 bp, Homo sapiens
gctggagagccaggcaggggc

SEQ ID NO: 7208282 - DNA, 21 bp, Homo sapiens
gctggagagccaggcaggggc

SEQ ID NO: 7208283 - DNA, 22 bp, Homo sapiens
gctggagaggatcccaaagcca

SEQ ID NO: 7208284 - DNA, 21 bp, Homo sapiens
gctggagagccaggcaggggc

SEQ ID NO: 7208285 - DNA, 22 bp, Homo sapiens
gctggagaggggtcactctgag

SEQ ID NO: 7208286 - DNA, 22 bp, Homo sapiens
gctggagaggggtcactctgag

SEQ ID NO: 7208287 - DNA, 22 bp, Homo sapiens
gctggagaggggtcactctgag

SEQ ID NO: 7208288 - DNA, 22 bp, Homo sapiens
gctggagaggggtcactctgag

SEQ ID NO: 7208289 - DNA, 22 bp, Homo sapiens
gctgagcacagcaaagagacaa

SEQ ID NO: 7208290 - DNA, 22 bp, Homo sapiens
gctgagcacagcaaagagacaa

SEQ ID NO: 7208291 - DNA, 22 bp, Homo sapiens
gctgagcacagcaaagagacaa

SEQ ID NO: 7208292 - DNA, 22 bp, Homo sapiens
gctgagcacacctagggtagag

SEQ ID NO: 7208293 - DNA, 22 bp, Homo sapiens
gctgagcagggtggggaaaggc

SEQ ID NO: 7208294 - DNA, 22 bp, Homo sapiens
gctgagcagggtggggaaaggc

SEQ ID NO: 7208295 - DNA, 22 bp, Homo sapiens
gctgagcagggtggggaaaggc

SEQ ID NO: 7208296 - DNA, 22 bp, Homo sapiens
gctgagcagggtggggaaaggc

SEQ ID NO: 7208297 - DNA, 22 bp, Homo sapiens
gctgagcacagcaaagagacaa

SEQ ID NO: 7208298 - DNA, 22 bp, Homo sapiens
gctgagagtgtgagatcagatt

SEQ ID NO: 7208299 - DNA, 22 bp, Homo sapiens
gctgagatgtcgttagatatct

SEQ ID NO: 7208300 - DNA, 22 bp, Homo sapiens
gctgagcacacctagggtagag

SEQ ID NO: 7208301 - DNA, 22 bp, Homo sapiens
gctgagcacacctagggtagag

SEQ ID NO: 7208302 - DNA, 22 bp, Homo sapiens
gctgagagtgggtgcagtgctt

SEQ ID NO: 7208303 - DNA, 22 bp, Homo sapiens
gctgagagtgggtgcagtgctt

SEQ ID NO: 7208304 - DNA, 22 bp, Homo sapiens
gctgagagtgggtgcagtgctt

SEQ ID NO: 7208305 - DNA, 22 bp, Homo sapiens
gctgagagtgtaggatgtttac

SEQ ID NO: 7208306 - DNA, 22 bp, Homo sapiens
gctgagagtgtaggatgtttac

SEQ ID NO: 7208307 - DNA, 22 bp, Homo sapiens
gctgagagtgtgagatcagatt

SEQ ID NO: 7208308 - DNA, 22 bp, Homo sapiens
gctgagagtgtgagatcagatt

SEQ ID NO: 7208309 - DNA, 22 bp, Homo sapiens
gctgagagtgggtgcagtgctt

SEQ ID NO: 7208310 - DNA, 22 bp, Homo sapiens
gctgaagaccccagctccccag

SEQ ID NO: 7208311 - DNA, 22 bp, Homo sapiens
gctgaagacaatggaattgact

SEQ ID NO: 7208312 - DNA, 22 bp, Homo sapiens
gctgaagacaatggaattgact

SEQ ID NO: 7208313 - DNA, 20 bp, Homo sapiens
gctgaagaagtagcatgtac

SEQ ID NO: 7208314 - DNA, 21 bp, Homo sapiens
gctgaagaactctttattttc

SEQ ID NO: 7208315 - DNA, 21 bp, Homo sapiens
gctgaagacaaattctcttag

SEQ ID NO: 7208316 - DNA, 21 bp, Homo sapiens
gctgaagacaaattctcttag

SEQ ID NO: 7208317 - DNA, 22 bp, Homo sapiens
gctcttgacagctacatctggc

SEQ ID NO: 7208318 - DNA, 22 bp, Homo sapiens
gctcttggaagacaggatgtgt

SEQ ID NO: 7208319 - DNA, 22 bp, Homo sapiens
gctgaaatgggcactgaaggcc

SEQ ID NO: 7208320 - DNA, 19 bp, Homo sapiens
gctgaacaagtcagcaacc

SEQ ID NO: 7208321 - DNA, 19 bp, Homo sapiens
gctgaacaagtcagcaacc

SEQ ID NO: 7208322 - DNA, 21 bp, Homo sapiens
gctgaagaactctttattttc

SEQ ID NO: 7208323 - DNA, 22 bp, Homo sapiens
gctctgtgttgtcagaggcacc

SEQ ID NO: 7208324 - DNA, 22 bp, Homo sapiens
gctctgtgttgtcagaggcacc

SEQ ID NO: 7208325 - DNA, 22 bp, Homo sapiens
gctctgtgttgtcagaggcacc

SEQ ID NO: 7208326 - DNA, 22 bp, Homo sapiens
gctctgtgttgtcagaggcacc

SEQ ID NO: 7208327 - DNA, 22 bp, Homo sapiens
gctctgtgttttgcccaggaga

SEQ ID NO: 7208328 - DNA, 22 bp, Homo sapiens
gctctgtgttttgcccaggaga

SEQ ID NO: 7208329 - DNA, 22 bp, Homo sapiens
gctctgttcatcagtttgttgg

SEQ ID NO: 7208330 - DNA, 22 bp, Homo sapiens
gctctgttgaagtagaatagac

SEQ ID NO: 7208331 - DNA, 22 bp, Homo sapiens
gctctgtttctccatgctgtgg

SEQ ID NO: 7208332 - DNA, 22 bp, Homo sapiens
gctcttatagtcccagcatgtt

SEQ ID NO: 7208333 - DNA, 22 bp, Homo sapiens
gctcttatattgacatcatgct

SEQ ID NO: 7208334 - DNA, 20 bp, Homo sapiens
gctctgccacttagaagctg

SEQ ID NO: 7208335 - DNA, 20 bp, Homo sapiens
gctctgccacttagaagctg

SEQ ID NO: 7208336 - DNA, 22 bp, Homo sapiens
gctctgccagacactgtggcca

SEQ ID NO: 7208337 - DNA, 22 bp, Homo sapiens
gctctgccagacactgtggcca

SEQ ID NO: 7208338 - DNA, 22 bp, Homo sapiens
gctctgccagcccaaggcgcag

SEQ ID NO: 7208339 - DNA, 17 bp, Homo sapiens
gctctgccaggaaagag

SEQ ID NO: 7208340 - DNA, 17 bp, Homo sapiens
gctctgccaggaaagag

SEQ ID NO: 7208341 - DNA, 22 bp, Homo sapiens
gctctgcccaaagctgtggctg

SEQ ID NO: 7208342 - DNA, 22 bp, Homo sapiens
gctctgcccaaagctgtggctg

SEQ ID NO: 7208343 - DNA, 22 bp, Homo sapiens
gctctgcccaatgtccctacac

SEQ ID NO: 7208344 - DNA, 22 bp, Homo sapiens
gctctgtgtccacagctggaaa

SEQ ID NO: 7208345 - DNA, 22 bp, Homo sapiens
gctctgtgttccctccaggctc

SEQ ID NO: 7208346 - DNA, 22 bp, Homo sapiens
gctctgtgttccctccaggctc

SEQ ID NO: 7208347 - DNA, 22 bp, Homo sapiens
gctctgtgttccctccaggctc

SEQ ID NO: 7208348 - DNA, 22 bp, Homo sapiens
gctctgagcccccagaagcaga

SEQ ID NO: 7208349 - DNA, 22 bp, Homo sapiens
gctctgagcccccagaagcaga

SEQ ID NO: 7208350 - DNA, 22 bp, Homo sapiens
gctctgagcagggagaaacagg

SEQ ID NO: 7208351 - DNA, 22 bp, Homo sapiens
gctctgagcagggagaaacagg

SEQ ID NO: 7208352 - DNA, 22 bp, Homo sapiens
gctctgagcactgtgcggctgg

SEQ ID NO: 7208353 - DNA, 22 bp, Homo sapiens
gctctgagcactgtgcggctgg

SEQ ID NO: 7208354 - DNA, 22 bp, Homo sapiens
gctctctttaaactgcatggct

SEQ ID NO: 7208355 - DNA, 22 bp, Homo sapiens
gctctctttcacagaggtagga

SEQ ID NO: 7208356 - DNA, 22 bp, Homo sapiens
gctctctttccatgtggaggat

SEQ ID NO: 7208357 - DNA, 22 bp, Homo sapiens
gctctctttgtgccacttaagg

SEQ ID NO: 7208358 - DNA, 22 bp, Homo sapiens
gctctctttttccagtggtggt

SEQ ID NO: 7208359 - DNA, 22 bp, Homo sapiens
gctctgaaaaatggaggttggc

SEQ ID NO: 7208360 - DNA, 22 bp, Homo sapiens
gctctctttaaactgcatggct

SEQ ID NO: 7208361 - DNA, 22 bp, Homo sapiens
gctcctgggtgtggctgcccct

SEQ ID NO: 7208362 - DNA, 22 bp, Homo sapiens
gctcctggtctggagcttcaag

SEQ ID NO: 7208363 - DNA, 22 bp, Homo sapiens
gctcctgggtgtggctgcccct

SEQ ID NO: 7208364 - DNA, 22 bp, Homo sapiens
gctcctgggctctaccttgcta

SEQ ID NO: 7208365 - DNA, 19 bp, Homo sapiens
gctcctgggcctcactcat

SEQ ID NO: 7208366 - DNA, 19 bp, Homo sapiens
gctcctgggcctcactcat

SEQ ID NO: 7208367 - DNA, 22 bp, Homo sapiens
gctcctgggccctgggctaact

SEQ ID NO: 7208368 - DNA, 19 bp, Homo sapiens
gctcctgggcctcactcat

SEQ ID NO: 7208369 - DNA, 22 bp, Homo sapiens
gctcctgggccctgggctaact

SEQ ID NO: 7208370 - DNA, 16 bp, Homo sapiens
gctcctgggccctcga

SEQ ID NO: 7208371 - DNA, 16 bp, Homo sapiens
gctcctgggccctcga

SEQ ID NO: 7208372 - DNA, 22 bp, Homo sapiens
gctcctgggccctgggctaact

SEQ ID NO: 7208373 - DNA, 22 bp, Homo sapiens
gctcctggcttcactgacatca

SEQ ID NO: 7208374 - DNA, 16 bp, Homo sapiens
gctcctgggccctcga

SEQ ID NO: 7208375 - DNA, 22 bp, Homo sapiens
gctcctggcttcactgacatca

SEQ ID NO: 7208376 - DNA, 22 bp, Homo sapiens
gctcctggctctctgagggctg

SEQ ID NO: 7208377 - DNA, 22 bp, Homo sapiens
gctcctggctctggccaaggga

SEQ ID NO: 7208378 - DNA, 22 bp, Homo sapiens
gctcctggctctggccaaggga

SEQ ID NO: 7208379 - DNA, 22 bp, Homo sapiens
gctcctggctctggccaaggga

SEQ ID NO: 7208380 - DNA, 22 bp, Homo sapiens
gctctgagtaaatgaaagcatt

SEQ ID NO: 7208381 - DNA, 22 bp, Homo sapiens
gctctgagtaaatgaaagcatt

SEQ ID NO: 7208382 - DNA, 22 bp, Homo sapiens
gctctgaggctgtgaggtgctg

SEQ ID NO: 7208383 - DNA, 22 bp, Homo sapiens
gctctgaggagccaagaatgtg

SEQ ID NO: 7208384 - DNA, 22 bp, Homo sapiens
gctctgaggctgggagcactct

SEQ ID NO: 7208385 - DNA, 22 bp, Homo sapiens
gctctgagcccccagaagcaga

SEQ ID NO: 7208386 - DNA, 22 bp, Homo sapiens
gctctgagccgggggcctgtcc

SEQ ID NO: 7208387 - DNA, 22 bp, Homo sapiens
gctctgagccgggggcctgtcc

SEQ ID NO: 7208388 - DNA, 23 bp, Homo sapiens
gctctgaggaagttgggcacggg

SEQ ID NO: 7208389 - DNA, 22 bp, Homo sapiens
gctctgagtgattaaggagctt

SEQ ID NO: 7208390 - DNA, 22 bp, Homo sapiens
gctctgagtcacactgccctgt

SEQ ID NO: 7208391 - DNA, 22 bp, Homo sapiens
gctctgagtcacactgccctgt

SEQ ID NO: 7208392 - DNA, 22 bp, Homo sapiens
gctctgagtgatcagctgggaa

SEQ ID NO: 7208393 - DNA, 18 bp, Homo sapiens
gctctgcagctgaggctt

SEQ ID NO: 7208394 - DNA, 18 bp, Homo sapiens
gctctgcagctgaggctt

SEQ ID NO: 7208395 - DNA, 22 bp, Homo sapiens
gctctgccaacagtttgggcaa

SEQ ID NO: 7208396 - DNA, 22 bp, Homo sapiens
gctctgccaacagtttgggcaa

SEQ ID NO: 7208397 - DNA, 22 bp, Homo sapiens
gctctgccaaggacccattctc

SEQ ID NO: 7208398 - DNA, 22 bp, Homo sapiens
gctctgccaaggacccattctc

SEQ ID NO: 7208399 - DNA, 23 bp, Homo sapiens
gctctgccacttaatagctgtgt

SEQ ID NO: 7208400 - DNA, 23 bp, Homo sapiens
gctctgccacttaatagctgtgt

SEQ ID NO: 7208401 - DNA, 21 bp, Homo sapiens
gctctgccacttaccagattt

SEQ ID NO: 7208402 - DNA, 21 bp, Homo sapiens
gctcatggtggagaaaagcag

SEQ ID NO: 7208403 - DNA, 22 bp, Homo sapiens
gctcattcagccagggcccggt

SEQ ID NO: 7208404 - DNA, 22 bp, Homo sapiens
gctccaagatcattttcccatt

SEQ ID NO: 7208405 - DNA, 20 bp, Homo sapiens
gctccaagcccctttagagg

SEQ ID NO: 7208406 - DNA, 22 bp, Homo sapiens
gctccaaggtatccaccagggt

SEQ ID NO: 7208407 - DNA, 22 bp, Homo sapiens
gctccaaggtatccaccagggt

SEQ ID NO: 7208408 - DNA, 22 bp, Homo sapiens
gctccacaaataatggaacctg

SEQ ID NO: 7208409 - DNA, 22 bp, Homo sapiens
gctccactaggaatctgctctt

SEQ ID NO: 7208410 - DNA, 22 bp, Homo sapiens
gctccactgcccctgggcaccg

SEQ ID NO: 7208411 - DNA, 22 bp, Homo sapiens
gctccactgtcccatgggactt

SEQ ID NO: 7208412 - DNA, 22 bp, Homo sapiens
gctccactgtttattggcagaa

SEQ ID NO: 7208413 - DNA, 22 bp, Homo sapiens
gctccacttccttctgccctca

SEQ ID NO: 7208414 - DNA, 22 bp, Homo sapiens
gctccacttgattgttacagca

SEQ ID NO: 7208415 - DNA, 22 bp, Homo sapiens
gctccacttgcagctaggcttg

SEQ ID NO: 7208416 - DNA, 22 bp, Homo sapiens
gctccagaaatgccgtgatcct

SEQ ID NO: 7208417 - DNA, 21 bp, Homo sapiens
gctccagaactctatgctaac

SEQ ID NO: 7208418 - DNA, 22 bp, Homo sapiens
gctccagagcagagactaggtt

SEQ ID NO: 7208419 - DNA, 22 bp, Homo sapiens
gctccagagtgtggcatctggg

SEQ ID NO: 7208420 - DNA, 22 bp, Homo sapiens
gctccagagtgtggcatctggg

SEQ ID NO: 7208421 - DNA, 22 bp, Homo sapiens
gctccagagtgtggcatctggg

SEQ ID NO: 7208422 - DNA, 22 bp, Homo sapiens
gctccaggagagggaagcagat

SEQ ID NO: 7208423 - DNA, 22 bp, Homo sapiens
gctccaggagagggaagcagat

SEQ ID NO: 7208424 - DNA, 22 bp, Homo sapiens
gctccaggagagggaagcagat

SEQ ID NO: 7208425 - DNA, 22 bp, Homo sapiens
gctccagctccggctccgaagc

SEQ ID NO: 7208426 - DNA, 22 bp, Homo sapiens
gctccagctcgtggctcccagc

SEQ ID NO: 7208427 - DNA, 22 bp, Homo sapiens
gctccagctcgtggctcccagc

SEQ ID NO: 7208428 - DNA, 22 bp, Homo sapiens
gctccagctcgtggctcccagc

SEQ ID NO: 7208429 - DNA, 22 bp, Homo sapiens
gctccagctctgttctggggaa

SEQ ID NO: 7208430 - DNA, 22 bp, Homo sapiens
gctccagctctgttctggggaa

SEQ ID NO: 7208431 - DNA, 22 bp, Homo sapiens
gctccagagtgtggcatctggg

SEQ ID NO: 7208432 - DNA, 22 bp, Homo sapiens
gctccagagtgtggcatctggg

SEQ ID NO: 7208433 - DNA, 22 bp, Homo sapiens
gctccagatgaaaggccagagg

SEQ ID NO: 7208434 - DNA, 22 bp, Homo sapiens
gctccagatgaatgcacttgtt

SEQ ID NO: 7208435 - DNA, 22 bp, Homo sapiens
gctccagatgaatgcacttgtt

SEQ ID NO: 7208436 - DNA, 22 bp, Homo sapiens
gctccagatgaatgcacttgtt

SEQ ID NO: 7208437 - DNA, 22 bp, Homo sapiens
gctccagcacctagagcaggtc

SEQ ID NO: 7208438 - DNA, 22 bp, Homo sapiens
gctccagcacctagagcaggtc

SEQ ID NO: 7208439 - DNA, 22 bp, Homo sapiens
gctccagcacctagagcaggtc

SEQ ID NO: 7208440 - DNA, 22 bp, Homo sapiens
gctccagcacctagagcaggtc

SEQ ID NO: 7208441 - DNA, 22 bp, Homo sapiens
gctccagccacatggtagaagg

SEQ ID NO: 7208442 - DNA, 22 bp, Homo sapiens
gctccagctccggctccgaagc

SEQ ID NO: 7208443 - DNA, 22 bp, Homo sapiens
gctcctctgtcaaatgagagtg

SEQ ID NO: 7208444 - DNA, 22 bp, Homo sapiens
gctcctctgtcaaatgagagtg

SEQ ID NO: 7208445 - DNA, 22 bp, Homo sapiens
gctcctctcctcggagtcgggg

SEQ ID NO: 7208446 - DNA, 22 bp, Homo sapiens
gctcctctcccagagctgcagg

SEQ ID NO: 7208447 - DNA, 22 bp, Homo sapiens
gctcctctcccagagctgcagg

SEQ ID NO: 7208448 - DNA, 22 bp, Homo sapiens
gctcctctgtcaaatgagagtg

SEQ ID NO: 7208449 - DNA, 22 bp, Homo sapiens
gctcctcttatttcatcagggc

SEQ ID NO: 7208450 - DNA, 22 bp, Homo sapiens
gctcctcttatttcatcagggc

SEQ ID NO: 7208451 - DNA, 22 bp, Homo sapiens
gctcctcttatttcatcagggc

SEQ ID NO: 7208452 - DNA, 22 bp, Homo sapiens
gctcctggcaggcagtgtgtgt

SEQ ID NO: 7208453 - DNA, 22 bp, Homo sapiens
gctccaggagagggaagcagat

SEQ ID NO: 7208454 - DNA, 22 bp, Homo sapiens
gctccaggagagggaagcagat

SEQ ID NO: 7208455 - DNA, 22 bp, Homo sapiens
gctccaggagctcacagctcgc

SEQ ID NO: 7208456 - DNA, 22 bp, Homo sapiens
gctccaggagctcacagctcgc

SEQ ID NO: 7208457 - DNA, 22 bp, Homo sapiens
gctccaggaggatgaccttcct

SEQ ID NO: 7208458 - DNA, 22 bp, Homo sapiens
gctccaggaggatgaccttcct

SEQ ID NO: 7208459 - DNA, 22 bp, Homo sapiens
gctcctggctccaggcagccaa

SEQ ID NO: 7208460 - DNA, 22 bp, Homo sapiens
gctcctggctccaggcagccaa

SEQ ID NO: 7208461 - DNA, 22 bp, Homo sapiens
gctcctggctccaggcagccaa

SEQ ID NO: 7208462 - DNA, 22 bp, Homo sapiens
gctcctggctctctgagggctg

SEQ ID NO: 7208463 - DNA, 22 bp, Homo sapiens
gctcctggctctctgagggctg

SEQ ID NO: 7208464 - DNA, 22 bp, Homo sapiens
gctcctggctctctgagggctg

SEQ ID NO: 7208465 - DNA, 22 bp, Homo sapiens
gctcctggctctctgagggctg

SEQ ID NO: 7208466 - DNA, 22 bp, Homo sapiens
gctcctggctctctgagggctg

SEQ ID NO: 7208467 - DNA, 22 bp, Homo sapiens
gctcctggctctctgagggctg

SEQ ID NO: 7208468 - DNA, 22 bp, Homo sapiens
gctcctggcaggcagtgtgtgt

SEQ ID NO: 7208469 - DNA, 22 bp, Homo sapiens
gctcctggcatcctgcttttaa

SEQ ID NO: 7208470 - DNA, 22 bp, Homo sapiens
gctcctggccagcacagggccc

SEQ ID NO: 7208471 - DNA, 22 bp, Homo sapiens
gctcctggccagcacagggccc

SEQ ID NO: 7208472 - DNA, 22 bp, Homo sapiens
gctcctggccagcacagggccc

SEQ ID NO: 7208473 - DNA, 22 bp, Homo sapiens
gctcctggccagcacagggccc

SEQ ID NO: 7208474 - DNA, 22 bp, Homo sapiens
gctcctggccagcacagggccc

SEQ ID NO: 7208475 - DNA, 22 bp, Homo sapiens
gctcctggctccaggcagccaa

SEQ ID NO: 7208476 - DNA, 22 bp, Homo sapiens
gctcactggcctgaagaggacg

SEQ ID NO: 7208477 - DNA, 22 bp, Homo sapiens
gctcactggcctgaagaggacg

SEQ ID NO: 7208478 - DNA, 22 bp, Homo sapiens
gctcactgcctgggcaacaaga

SEQ ID NO: 7208479 - DNA, 22 bp, Homo sapiens
gctcactgccattctctagatg

SEQ ID NO: 7208480 - DNA, 22 bp, Homo sapiens
gctcactgcaagctctgcctcc

SEQ ID NO: 7208481 - DNA, 22 bp, Homo sapiens
gctcactgcaagctctgcctcc

SEQ ID NO: 7208482 - DNA, 22 bp, Homo sapiens
gctcactgcaagctccgcctcc

SEQ ID NO: 7208483 - DNA, 22 bp, Homo sapiens
gctcactgcaacctctgcttcc

SEQ ID NO: 7208484 - DNA, 22 bp, Homo sapiens
gctcactgcaacctctgcctcc

SEQ ID NO: 7208485 - DNA, 22 bp, Homo sapiens
gctcactgcaacctctgcctcc

SEQ ID NO: 7208486 - DNA, 22 bp, Homo sapiens
gctcactgcaacctccgccttc

SEQ ID NO: 7208487 - DNA, 22 bp, Homo sapiens
gccttaattgcagagcaatata

SEQ ID NO: 7208488 - DNA, 22 bp, Homo sapiens
gccttagcatcttaaagctgtg

SEQ ID NO: 7208489 - DNA, 22 bp, Homo sapiens
gcctgtttaagtattctgacat

SEQ ID NO: 7208490 - DNA, 22 bp, Homo sapiens
gcctgtttccatcaacacatgc

SEQ ID NO: 7208491 - DNA, 22 bp, Homo sapiens
gcctgtttccatcaacacatgc

SEQ ID NO: 7208492 - DNA, 22 bp, Homo sapiens
gcctgtttccctgacgcttaca

SEQ ID NO: 7208493 - DNA, 22 bp, Homo sapiens
gcctgtttctaatctcatttct

SEQ ID NO: 7208494 - DNA, 22 bp, Homo sapiens
gcctgtttctcctccttggccc

SEQ ID NO: 7208495 - DNA, 22 bp, Homo sapiens
gcctgtttgactggtctctgct

SEQ ID NO: 7208496 - DNA, 22 bp, Homo sapiens
gcctgtttggaatctgtttaat

SEQ ID NO: 7208497 - DNA, 22 bp, Homo sapiens
gcctgtttggcatcattggttg

SEQ ID NO: 7208498 - DNA, 22 bp, Homo sapiens
gcctgtttggctgctgacattg

SEQ ID NO: 7208499 - DNA, 22 bp, Homo sapiens
gcctgtttgttatgtcatggta

SEQ ID NO: 7208500 - DNA, 22 bp, Homo sapiens
gcctgtttgttatgtcatggta

SEQ ID NO: 7208501 - DNA, 22 bp, Homo sapiens
gcctgtttgtttgcaaaggagc

SEQ ID NO: 7208502 - DNA, 22 bp, Homo sapiens
gcctgtttgtttgcaaaggagc

SEQ ID NO: 7208503 - DNA, 22 bp, Homo sapiens
gcctgttttagatgcattgatg

SEQ ID NO: 7208504 - DNA, 22 bp, Homo sapiens
gcctgttttcctgctgtggttg

SEQ ID NO: 7208505 - DNA, 22 bp, Homo sapiens
gccttaaacaattgcctgttaa

SEQ ID NO: 7208506 - DNA, 19 bp, Homo sapiens
gccttaacctgttaagggg

SEQ ID NO: 7208507 - DNA, 22 bp, Homo sapiens
gctcatgggcccagagcagccc

SEQ ID NO: 7208508 - DNA, 22 bp, Homo sapiens
gctcatgactgtaatcccagca

SEQ ID NO: 7208509 - DNA, 23 bp, Homo sapiens
gctcatctagaatggtttcagct

SEQ ID NO: 7208510 - DNA, 22 bp, Homo sapiens
gctcatctggggctttcagctt

SEQ ID NO: 7208511 - DNA, 22 bp, Homo sapiens
gctcatgactgtaatcccagca

SEQ ID NO: 7208512 - DNA, 22 bp, Homo sapiens
gctcatgactgtaatcccagca

SEQ ID NO: 7208513 - DNA, 22 bp, Homo sapiens
gctcagagcatcccagtgaatg

SEQ ID NO: 7208514 - DNA, 22 bp, Homo sapiens
gctcagagcccgaggcttgcat

SEQ ID NO: 7208515 - DNA, 22 bp, Homo sapiens
gctcagagcatcccagtgaatg

SEQ ID NO: 7208516 - DNA, 22 bp, Homo sapiens
gctcagagcactcagactcagc

SEQ ID NO: 7208517 - DNA, 22 bp, Homo sapiens
gctcagagatgttcagtagctt

SEQ ID NO: 7208518 - DNA, 22 bp, Homo sapiens
gctcagagataaaactgatcag

SEQ ID NO: 7208519 - DNA, 22 bp, Homo sapiens
gctcagagataaaactgatcag

SEQ ID NO: 7208520 - DNA, 22 bp, Homo sapiens
gctcagagatgtctgctgcctt

SEQ ID NO: 7208521 - DNA, 22 bp, Homo sapiens
gctcagagatgtctgctgcctt

SEQ ID NO: 7208522 - DNA, 22 bp, Homo sapiens
gctcagagatgtctgctgcctt

SEQ ID NO: 7208523 - DNA, 22 bp, Homo sapiens
gctcagaaatggcagatggaga

SEQ ID NO: 7208524 - DNA, 22 bp, Homo sapiens
gctcagaaatggcagatggaga

SEQ ID NO: 7208525 - DNA, 22 bp, Homo sapiens
gctcacttaatttcatgctaca

SEQ ID NO: 7208526 - DNA, 19 bp, Homo sapiens
gctcacttcaggttttcac

SEQ ID NO: 7208527 - DNA, 22 bp, Homo sapiens
gctcacttaatttcatgctaca

SEQ ID NO: 7208528 - DNA, 22 bp, Homo sapiens
gctcagaccccaccctggcaga

SEQ ID NO: 7208529 - DNA, 22 bp, Homo sapiens
gctcagactctggcctgatgat

SEQ ID NO: 7208530 - DNA, 19 bp, Homo sapiens
gctcagacattaagcagct

SEQ ID NO: 7208531 - DNA, 22 bp, Homo sapiens
gctcagaccccaccctggcaga

SEQ ID NO: 7208532 - DNA, 22 bp, Homo sapiens
gcatggcttctgccaggcacct

SEQ ID NO: 7208533 - DNA, 22 bp, Homo sapiens
gcatgggaggacagtctgggct

SEQ ID NO: 7208534 - DNA, 22 bp, Homo sapiens
gcagtgttgagtggtggctgaa

SEQ ID NO: 7208535 - DNA, 22 bp, Homo sapiens
gcagtgttgagccagctggggg

SEQ ID NO: 7208536 - DNA, 22 bp, Homo sapiens
gcagtgttgctaggtgcggtga

SEQ ID NO: 7208537 - DNA, 22 bp, Homo sapiens
gcatggcttctgccaggcacct

SEQ ID NO: 7208538 - DNA, 22 bp, Homo sapiens
gcatgggcaagaggactggggg

SEQ ID NO: 7208539 - DNA, 22 bp, Homo sapiens
gcatgggcaccagtctctaggt

SEQ ID NO: 7208540 - DNA, 22 bp, Homo sapiens
gcatgggaggacagtctgggct

SEQ ID NO: 7208541 - DNA, 22 bp, Homo sapiens
gcatgggaggacagtctgggct

SEQ ID NO: 7208542 - DNA, 22 bp, Homo sapiens
gcatgtggaatctctccatggt

SEQ ID NO: 7208543 - DNA, 20 bp, Homo sapiens
gcatgtcagaaatcaatggg

SEQ ID NO: 7208544 - DNA, 20 bp, Homo sapiens
gcatgtcagaaatcaatggg

SEQ ID NO: 7208545 - DNA, 22 bp, Homo sapiens
gcatggtggccttagggtagcc

SEQ ID NO: 7208546 - DNA, 22 bp, Homo sapiens
gcatggtggagtctgagcaggg

SEQ ID NO: 7208547 - DNA, 22 bp, Homo sapiens
gcatggtgacatcatgtgaatg

SEQ ID NO: 7208548 - DNA, 22 bp, Homo sapiens
gcatggtggccttagggtagcc

SEQ ID NO: 7208549 - DNA, 22 bp, Homo sapiens
gcatggtggggagatggcagcc

SEQ ID NO: 7208550 - DNA, 22 bp, Homo sapiens
gcatggtggggagatggcagcc

SEQ ID NO: 7208551 - DNA, 22 bp, Homo sapiens
gcatgtggcccaaggaggctgt

SEQ ID NO: 7208552 - DNA, 22 bp, Homo sapiens
gcatgtggccttcaggctggaa

SEQ ID NO: 7208553 - DNA, 22 bp, Homo sapiens
gcatgtggccttcaggctggaa

SEQ ID NO: 7208554 - DNA, 22 bp, Homo sapiens
gcatgtggccttcaggctggaa

SEQ ID NO: 7208555 - DNA, 22 bp, Homo sapiens
gcatgtgggaacacttaggcac

SEQ ID NO: 7208556 - DNA, 22 bp, Homo sapiens
gcatgtgggagggtcttcccac

SEQ ID NO: 7208557 - DNA, 22 bp, Homo sapiens
gcatgtggtgctgaggctgtcg

SEQ ID NO: 7208558 - DNA, 15 bp, Homo sapiens
gcatgtgtaataggc

SEQ ID NO: 7208559 - DNA, 20 bp, Homo sapiens
gcatgtgtatggaaggggga

SEQ ID NO: 7208560 - DNA, 22 bp, Homo sapiens
gcatgtgtatggtaggaatatt

SEQ ID NO: 7208561 - DNA, 22 bp, Homo sapiens
gcatgtgtcatctgcctttcgt

SEQ ID NO: 7208562 - DNA, 22 bp, Homo sapiens
gcatgtggtgggctggccactc

SEQ ID NO: 7208563 - DNA, 22 bp, Homo sapiens
gcatgtgtccctcagtctgtgc

SEQ ID NO: 7208564 - DNA, 22 bp, Homo sapiens
gcatgtgtccctcagtctgtgc

SEQ ID NO: 7208565 - DNA, 22 bp, Homo sapiens
gcatgtgtccctcagtctgtgc

SEQ ID NO: 7208566 - DNA, 22 bp, Homo sapiens
gcatgtgtctccccagtggagg

SEQ ID NO: 7208567 - DNA, 22 bp, Homo sapiens
gcatgtgtccctcagtctgtgc

SEQ ID NO: 7208568 - DNA, 22 bp, Homo sapiens
gcatgtgtctttatagcagcat

SEQ ID NO: 7208569 - DNA, 22 bp, Homo sapiens
gcatgtgtgagaccttttagca

SEQ ID NO: 7208570 - DNA, 22 bp, Homo sapiens
gcatgtgtggaggagatgtgct

SEQ ID NO: 7208571 - DNA, 22 bp, Homo sapiens
gcatgtgtggaggagatgtgct

SEQ ID NO: 7208572 - DNA, 21 bp, Homo sapiens
gcatgtgtgggactggatcct

SEQ ID NO: 7208573 - DNA, 21 bp, Homo sapiens
gcatgtgtggtgtgctccaca

SEQ ID NO: 7208574 - DNA, 22 bp, Homo sapiens
gcatgtgtgtcactttcctgcc

SEQ ID NO: 7208575 - DNA, 22 bp, Homo sapiens
gcatgtgttagagtgtgcatgc

SEQ ID NO: 7208576 - DNA, 22 bp, Homo sapiens
gcatgtgttagagtgtgcatgc

SEQ ID NO: 7208577 - DNA, 22 bp, Homo sapiens
gcatgtgttagagtgtgcatgc

SEQ ID NO: 7208578 - DNA, 22 bp, Homo sapiens
gcatgtgttatttctctgtggg

SEQ ID NO: 7208579 - DNA, 22 bp, Homo sapiens
gcatgtgttatttctctgtggg

SEQ ID NO: 7208580 - DNA, 22 bp, Homo sapiens
gcatgtgttattttatgtatga

SEQ ID NO: 7208581 - DNA, 22 bp, Homo sapiens
gcatgtgttattttatgtatga

SEQ ID NO: 7208582 - DNA, 22 bp, Homo sapiens
gcatgtgttattttatgtatga

SEQ ID NO: 7208583 - DNA, 22 bp, Homo sapiens
gcatgtgttcttgaaaggccac

SEQ ID NO: 7208584 - DNA, 22 bp, Homo sapiens
gcatgtgttcttgaaaggccac

SEQ ID NO: 7208585 - DNA, 22 bp, Homo sapiens
gcatgtgttggtttatgcatgt

SEQ ID NO: 7208586 - DNA, 22 bp, Homo sapiens
gcatgttatgtatctgcccagc

SEQ ID NO: 7208587 - DNA, 22 bp, Homo sapiens
gccaatttagggtttattgatt

SEQ ID NO: 7208588 - DNA, 23 bp, Homo sapiens
gccaatttagtaaaggcagtggg

SEQ ID NO: 7208589 - DNA, 22 bp, Homo sapiens
gccaatttatagccaaaaatca

SEQ ID NO: 7208590 - DNA, 22 bp, Homo sapiens
gccaatttagggtttattgatt

SEQ ID NO: 7208591 - DNA, 23 bp, Homo sapiens
gccaatttagtaaaggcagtggg

SEQ ID NO: 7208592 - DNA, 22 bp, Homo sapiens
gccaatttatagccaaaaatca

SEQ ID NO: 7208593 - DNA, 22 bp, Homo sapiens
gccaatttatcttactcgtgct

SEQ ID NO: 7208594 - DNA, 22 bp, Homo sapiens
gccaatttcctgaggtaaagct

SEQ ID NO: 7208595 - DNA, 22 bp, Homo sapiens
gccaatttatcttactcgtgct

SEQ ID NO: 7208596 - DNA, 22 bp, Homo sapiens
gccaatttcctgaggtaaagct

SEQ ID NO: 7208597 - DNA, 22 bp, Homo sapiens
gccaatttgaattggttttctg

SEQ ID NO: 7208598 - DNA, 22 bp, Homo sapiens
gccaatttgaattggttttctg

SEQ ID NO: 7208599 - DNA, 22 bp, Homo sapiens
gccaatttgactagacctcttg

SEQ ID NO: 7208600 - DNA, 22 bp, Homo sapiens
gccaatttgactagacctcttg

SEQ ID NO: 7208601 - DNA, 22 bp, Homo sapiens
gccaatttggggagccgtggtg

SEQ ID NO: 7208602 - DNA, 22 bp, Homo sapiens
gccaatttggggagccgtggtg

SEQ ID NO: 7208603 - DNA, 23 bp, Homo sapiens
gccaatttttgactgtcagtagg

SEQ ID NO: 7208604 - DNA, 20 bp, Homo sapiens
gccaatttttctatgtatac

SEQ ID NO: 7208605 - DNA, 20 bp, Homo sapiens
gccaatttttctatgtatac

SEQ ID NO: 7208606 - DNA, 23 bp, Homo sapiens
gccaatttttgactgtcagtagg

SEQ ID NO: 7208607 - DNA, 22 bp, Homo sapiens
gccacactgcttctttgagcct

SEQ ID NO: 7208608 - DNA, 22 bp, Homo sapiens
gccacacttattctcatgcaca

SEQ ID NO: 7208609 - DNA, 22 bp, Homo sapiens
gccacagcaacaataatgcagc

SEQ ID NO: 7208610 - DNA, 22 bp, Homo sapiens
gccacagcaacaataatgcagc

SEQ ID NO: 7208611 - DNA, 22 bp, Homo sapiens
gccacagcagggccctctcagg

SEQ ID NO: 7208612 - DNA, 22 bp, Homo sapiens
gccacagcccgagcaccatgag

SEQ ID NO: 7208613 - DNA, 22 bp, Homo sapiens
gccacagcccgagcaccatgag

SEQ ID NO: 7208614 - DNA, 22 bp, Homo sapiens
gccacagcccgagcaccatgag

SEQ ID NO: 7208615 - DNA, 22 bp, Homo sapiens
gccacagcccgagcaccatgag

SEQ ID NO: 7208616 - DNA, 22 bp, Homo sapiens
gccagcagctgtggggtggcca

SEQ ID NO: 7208617 - DNA, 22 bp, Homo sapiens
gccagcagcttcttctcatcct

SEQ ID NO: 7208618 - DNA, 22 bp, Homo sapiens
gccagcagcttcttctcatcct

SEQ ID NO: 7208619 - DNA, 22 bp, Homo sapiens
gccagcagcttcttctcatcct

SEQ ID NO: 7208620 - DNA, 22 bp, Homo sapiens
gccagcagggaagccttgggct

SEQ ID NO: 7208621 - DNA, 22 bp, Homo sapiens
gccagcagctgtggggtggcca

SEQ ID NO: 7208622 - DNA, 22 bp, Homo sapiens
gccagcagctgtggggtggcca

SEQ ID NO: 7208623 - DNA, 22 bp, Homo sapiens
gccagcagctgtggggtggcca

SEQ ID NO: 7208624 - DNA, 22 bp, Homo sapiens
gccagcagctcttgggcgggca

SEQ ID NO: 7208625 - DNA, 22 bp, Homo sapiens
gccagcagctcttgggcgggca

SEQ ID NO: 7208626 - DNA, 22 bp, Homo sapiens
gccagcagctcttgggcgggca

SEQ ID NO: 7208627 - DNA, 22 bp, Homo sapiens
gccagcagcccagaaggacttt

SEQ ID NO: 7208628 - DNA, 22 bp, Homo sapiens
gccagcagcccagaaggacttt

SEQ ID NO: 7208629 - DNA, 22 bp, Homo sapiens
gccagcagccacagaagtcact

SEQ ID NO: 7208630 - DNA, 22 bp, Homo sapiens
gccagcagcccagaaggacttt

SEQ ID NO: 7208631 - DNA, 22 bp, Homo sapiens
gccagcagcccagaaggacttt

SEQ ID NO: 7208632 - DNA, 22 bp, Homo sapiens
gccagcagccacagaagtcact

SEQ ID NO: 7208633 - DNA, 19 bp, Homo sapiens
gccagcagaatgatgaggc

SEQ ID NO: 7208634 - DNA, 22 bp, Homo sapiens
gccagcagccacagaagtcact

SEQ ID NO: 7208635 - DNA, 22 bp, Homo sapiens
gccagcagccacagaagtcact

SEQ ID NO: 7208636 - DNA, 22 bp, Homo sapiens
gccagcagccacagaagtcact

SEQ ID NO: 7208637 - DNA, 22 bp, Homo sapiens
gccagcagccacagaagtcact

SEQ ID NO: 7208638 - DNA, 19 bp, Homo sapiens
gccagcagaatgatgaggc

SEQ ID NO: 7208639 - DNA, 19 bp, Homo sapiens
gccagcagaatgatgaggc

SEQ ID NO: 7208640 - DNA, 19 bp, Homo sapiens
gccagcagaatgatgaggc

SEQ ID NO: 7208641 - DNA, 19 bp, Homo sapiens
gccagcagaatgatgaggc

SEQ ID NO: 7208642 - DNA, 19 bp, Homo sapiens
gccagcagaatgatgaggc

SEQ ID NO: 7208643 - DNA, 22 bp, Homo sapiens
gccagcaaagcaagttgtcagc

SEQ ID NO: 7208644 - DNA, 22 bp, Homo sapiens
gccagcaagggtccactgtcac

SEQ ID NO: 7208645 - DNA, 20 bp, Homo sapiens
gccagcacagggagcagttc

SEQ ID NO: 7208646 - DNA, 20 bp, Homo sapiens
gccagcacagggagcagttc

SEQ ID NO: 7208647 - DNA, 20 bp, Homo sapiens
gccagcacagggagcagttc

SEQ ID NO: 7208648 - DNA, 19 bp, Homo sapiens
gccagcacatgtcttctag

SEQ ID NO: 7208649 - DNA, 22 bp, Homo sapiens
gccagcaccagctactagtcac

SEQ ID NO: 7208650 - DNA, 22 bp, Homo sapiens
gccagcaccagctactagtcac

SEQ ID NO: 7208651 - DNA, 19 bp, Homo sapiens
gccagcacccagctgtgtc

SEQ ID NO: 7208652 - DNA, 19 bp, Homo sapiens
gccagcacccagctgtgtc

SEQ ID NO: 7208653 - DNA, 22 bp, Homo sapiens
gccagcaccagctactagtcac

SEQ ID NO: 7208654 - DNA, 22 bp, Homo sapiens
gccagcaccttagcatgaatca

SEQ ID NO: 7208655 - DNA, 22 bp, Homo sapiens
gccagcaccttctcatatgttt

SEQ ID NO: 7208656 - DNA, 22 bp, Homo sapiens
gccagcaccttagcatgaatca

SEQ ID NO: 7208657 - DNA, 22 bp, Homo sapiens
gccacagcttagatcacagcct

SEQ ID NO: 7208658 - DNA, 22 bp, Homo sapiens
gccacagctccagtcaggtgac

SEQ ID NO: 7208659 - DNA, 22 bp, Homo sapiens
gccacagcttagatcacagcct

SEQ ID NO: 7208660 - DNA, 22 bp, Homo sapiens
gccacagcttagatcacagcct

SEQ ID NO: 7208661 - DNA, 22 bp, Homo sapiens
gccacagctccagtcaggtgac

SEQ ID NO: 7208662 - DNA, 22 bp, Homo sapiens
gccacagctccagtcaggtgac

SEQ ID NO: 7208663 - DNA, 22 bp, Homo sapiens
gccacagctcacgttccccatt

SEQ ID NO: 7208664 - DNA, 22 bp, Homo sapiens
gccacagcggggccgctagagc

SEQ ID NO: 7208665 - DNA, 22 bp, Homo sapiens
gccacagcggggccgctagagc

SEQ ID NO: 7208666 - DNA, 22 bp, Homo sapiens
gccacagcttagatcacagcct

SEQ ID NO: 7208667 - DNA, 22 bp, Homo sapiens
gccacagcttagatcacagcct

SEQ ID NO: 7208668 - DNA, 22 bp, Homo sapiens
gccacagcttttaacctcgggg

SEQ ID NO: 7208669 - DNA, 22 bp, Homo sapiens
gccacaggaaagcaccctggag

SEQ ID NO: 7208670 - DNA, 22 bp, Homo sapiens
gccacaggaaagcaccctggag

SEQ ID NO: 7208671 - DNA, 22 bp, Homo sapiens
gccacaggaaagcaccctggag

SEQ ID NO: 7208672 - DNA, 22 bp, Homo sapiens
gccacaggaaagcaccctggag

SEQ ID NO: 7208673 - DNA, 19 bp, Homo sapiens
gccacaggatgaagtttgg

SEQ ID NO: 7208674 - DNA, 19 bp, Homo sapiens
gccacaggatgaagtttgg

SEQ ID NO: 7208675 - DNA, 22 bp, Homo sapiens
gccacaggcacttaagggctgg

SEQ ID NO: 7208676 - DNA, 22 bp, Homo sapiens
gccacaggcacttaagggctgg

SEQ ID NO: 7208677 - DNA, 20 bp, Homo sapiens
gccagaggccggcaggggct

SEQ ID NO: 7208678 - DNA, 20 bp, Homo sapiens
gccagaggccggcaggggct

SEQ ID NO: 7208679 - DNA, 20 bp, Homo sapiens
gccagaggccggcaggggct

SEQ ID NO: 7208680 - DNA, 22 bp, Homo sapiens
gccacaggctccagcatcagta

SEQ ID NO: 7208681 - DNA, 22 bp, Homo sapiens
gccacaggctccagcatcagta

SEQ ID NO: 7208682 - DNA, 22 bp, Homo sapiens
gccacaggctccagcatcagta

SEQ ID NO: 7208683 - DNA, 22 bp, Homo sapiens
gccacaggctccagcatcagta

SEQ ID NO: 7208684 - DNA, 22 bp, Homo sapiens
gccacaggctccagcatcagta

SEQ ID NO: 7208685 - DNA, 22 bp, Homo sapiens
gccacaggcacttaagggctgg

SEQ ID NO: 7208686 - DNA, 22 bp, Homo sapiens
gccacaggctccagcatcagta

SEQ ID NO: 7208687 - DNA, 22 bp, Homo sapiens
gccagatttacagatttgccct

SEQ ID NO: 7208688 - DNA, 22 bp, Homo sapiens
gccagatttacagatttgccct

SEQ ID NO: 7208689 - DNA, 22 bp, Homo sapiens
gccagcaaagcaagttgtcagc

SEQ ID NO: 7208690 - DNA, 20 bp, Homo sapiens
gccagaggccggcaggggct

SEQ ID NO: 7208691 - DNA, 20 bp, Homo sapiens
gccagaggccggcaggggct

SEQ ID NO: 7208692 - DNA, 20 bp, Homo sapiens
gccagaggccggcaggggct

SEQ ID NO: 7208693 - DNA, 22 bp, Homo sapiens
gccagaggctcaggttgccatg

SEQ ID NO: 7208694 - DNA, 22 bp, Homo sapiens
gccagaggctcaggttgccatg

SEQ ID NO: 7208695 - DNA, 22 bp, Homo sapiens
gccagatctgacatagtggaag

SEQ ID NO: 7208696 - DNA, 22 bp, Homo sapiens
gcagtggtccagttcacaccca

SEQ ID NO: 7208697 - DNA, 22 bp, Homo sapiens
gcagtggggaatgctggggaga

SEQ ID NO: 7208698 - DNA, 22 bp, Homo sapiens
gcagtggggaatgctggggaga

SEQ ID NO: 7208699 - DNA, 22 bp, Homo sapiens
gcagtggggcaatcatagctca

SEQ ID NO: 7208700 - DNA, 22 bp, Homo sapiens
gcagtggggcaatcatagctca

SEQ ID NO: 7208701 - DNA, 22 bp, Homo sapiens
gcagtgggcctgaggaagggtg

SEQ ID NO: 7208702 - DNA, 22 bp, Homo sapiens
gcagtgggcctgaggaagggtg

SEQ ID NO: 7208703 - DNA, 22 bp, Homo sapiens
gcagtgggcctgaggaagggtg

SEQ ID NO: 7208704 - DNA, 22 bp, Homo sapiens
gcagtggggaatgctggggaga

SEQ ID NO: 7208705 - DNA, 22 bp, Homo sapiens
gcagtggggaatgctggggaga

SEQ ID NO: 7208706 - DNA, 22 bp, Homo sapiens
gcagtgggcaacaagagctgga

SEQ ID NO: 7208707 - DNA, 22 bp, Homo sapiens
gcagtgggcaacaagagctgga

SEQ ID NO: 7208708 - DNA, 22 bp, Homo sapiens
gcagtgggcaacaagagctgga

SEQ ID NO: 7208709 - DNA, 22 bp, Homo sapiens
gcagtgggcctgaggaagggtg

SEQ ID NO: 7208710 - DNA, 22 bp, Homo sapiens
gcagtgttgagccagctggggg

SEQ ID NO: 7208711 - DNA, 22 bp, Homo sapiens
gcagtgttcttgttgcttttat

SEQ ID NO: 7208712 - DNA, 22 bp, Homo sapiens
gcagtgttgactatggtatgag

SEQ ID NO: 7208713 - DNA, 22 bp, Homo sapiens
gcagtgttctaaattgggtgtg

SEQ ID NO: 7208714 - DNA, 22 bp, Homo sapiens
gcagtgttcagtgaagcaggag

SEQ ID NO: 7208715 - DNA, 22 bp, Homo sapiens
gcagtgttccttctactggggc

SEQ ID NO: 7208716 - DNA, 22 bp, Homo sapiens
gcagtgttatgttttctataat

SEQ ID NO: 7208717 - DNA, 22 bp, Homo sapiens
gcagtgttaggaataaaaatga

SEQ ID NO: 7208718 - DNA, 23 bp, Homo sapiens
gcagtgtgaatccagtgtttcag

SEQ ID NO: 7208719 - DNA, 22 bp, Homo sapiens
gcagtgtccagggtggtctgca

SEQ ID NO: 7208720 - DNA, 22 bp, Homo sapiens
gcagtggtggagcttacatatc

SEQ ID NO: 7208721 - DNA, 22 bp, Homo sapiens
gcagtggtgggacagtggaaaa

SEQ ID NO: 7208722 - DNA, 22 bp, Homo sapiens
gcagtgtcagtgcctgggtggt

SEQ ID NO: 7208723 - DNA, 22 bp, Homo sapiens
gcagtgtcagtgcctgggtggt

SEQ ID NO: 7208724 - DNA, 19 bp, Homo sapiens
gcagtgtcatggtaggagc

SEQ ID NO: 7208725 - DNA, 22 bp, Homo sapiens
gcagtacacacatatgtattcg

SEQ ID NO: 7208726 - DNA, 22 bp, Homo sapiens
gcagtacacacatatgtattcg

SEQ ID NO: 7208727 - DNA, 22 bp, Homo sapiens
gcagtagaaatttcattgctct

SEQ ID NO: 7208728 - DNA, 22 bp, Homo sapiens
gcagtagaaatttcattgctct

SEQ ID NO: 7208729 - DNA, 22 bp, Homo sapiens
gcagtagaacgtgttgaatcaa

SEQ ID NO: 7208730 - DNA, 22 bp, Homo sapiens
gcagtagaaatttcattgctct

SEQ ID NO: 7208731 - DNA, 22 bp, Homo sapiens
gcagtagaactgtcatgatgtt

SEQ ID NO: 7208732 - DNA, 22 bp, Homo sapiens
gcagtagaaggtgctttctgga

SEQ ID NO: 7208733 - DNA, 22 bp, Homo sapiens
gcagtagaaggtgctttctgga

SEQ ID NO: 7208734 - DNA, 20 bp, Homo sapiens
gcagtagaccatgcttggaa

SEQ ID NO: 7208735 - DNA, 20 bp, Homo sapiens
gcagtagaccatgcttggaa

SEQ ID NO: 7208736 - DNA, 22 bp, Homo sapiens
gcagtagagaagccaggctgta

SEQ ID NO: 7208737 - DNA, 22 bp, Homo sapiens
gcagtagaactgtcatgatgtt

SEQ ID NO: 7208738 - DNA, 22 bp, Homo sapiens
gcagtagagcagagattttcct

SEQ ID NO: 7208739 - DNA, 22 bp, Homo sapiens
gcagtagagcttcttttgatga

SEQ ID NO: 7208740 - DNA, 23 bp, Homo sapiens
gcaggtggttcgaacagaagttt

SEQ ID NO: 7208741 - DNA, 23 bp, Homo sapiens
gcaggtggttcgaacagaagttt

SEQ ID NO: 7208742 - DNA, 22 bp, Homo sapiens
gcaggtgtcagtccccaaggtg

SEQ ID NO: 7208743 - DNA, 22 bp, Homo sapiens
gcaggtgtcctgggctggcagt

SEQ ID NO: 7208744 - DNA, 22 bp, Homo sapiens
gcaggtgtcctgggctggcagt

SEQ ID NO: 7208745 - DNA, 22 bp, Homo sapiens
gcaggtgtctgactgccttctt

SEQ ID NO: 7208746 - DNA, 22 bp, Homo sapiens
gcaggtgtctgactgccttctt

SEQ ID NO: 7208747 - DNA, 22 bp, Homo sapiens
gcaggtgtcttcagcaggatga

SEQ ID NO: 7208748 - DNA, 22 bp, Homo sapiens
gcaggtgtcttcagcaggatga

SEQ ID NO: 7208749 - DNA, 22 bp, Homo sapiens
gcaggtgtcttcatggaactct

SEQ ID NO: 7208750 - DNA, 22 bp, Homo sapiens
gcaggtgtcttcatggaactct

SEQ ID NO: 7208751 - DNA, 19 bp, Homo sapiens
gcaggtgtgaatccgtaga

SEQ ID NO: 7208752 - DNA, 22 bp, Homo sapiens
gcaggtgtgaatgtgaattaag

SEQ ID NO: 7208753 - DNA, 22 bp, Homo sapiens
gcaggtgtgaatgtgaattaag

SEQ ID NO: 7208754 - DNA, 22 bp, Homo sapiens
gcaggtgtgctgaattacgtga

SEQ ID NO: 7208755 - DNA, 22 bp, Homo sapiens
gcagtagtccataagtactctg

SEQ ID NO: 7208756 - DNA, 22 bp, Homo sapiens
gcagtagtcgctggagatgagg

SEQ ID NO: 7208757 - DNA, 18 bp, Homo sapiens
gcagtaggcgcgcaggac

SEQ ID NO: 7208758 - DNA, 22 bp, Homo sapiens
gcagtagatctggaagagaatt

SEQ ID NO: 7208759 - DNA, 22 bp, Homo sapiens
gcagtagcagtatccagaagca

SEQ ID NO: 7208760 - DNA, 22 bp, Homo sapiens
gcagtgggagcttaggcagtgc

SEQ ID NO: 7208761 - DNA, 22 bp, Homo sapiens
gcagtgggagcttaggcagtgc

SEQ ID NO: 7208762 - DNA, 22 bp, Homo sapiens
gcagtgggagcttaggcagtgc

SEQ ID NO: 7208763 - DNA, 22 bp, Homo sapiens
gcagtgggcaacaagagctgga

SEQ ID NO: 7208764 - DNA, 22 bp, Homo sapiens
gcagtgggcaacaagagctgga

SEQ ID NO: 7208765 - DNA, 22 bp, Homo sapiens
gcagtagtgataaaaatgtatc

SEQ ID NO: 7208766 - DNA, 22 bp, Homo sapiens
gcagtagtgtcagtacagcaaa

SEQ ID NO: 7208767 - DNA, 22 bp, Homo sapiens
gcagtagttatagggaaatata

SEQ ID NO: 7208768 - DNA, 22 bp, Homo sapiens
gcagtagttcgtctgtgttccc

SEQ ID NO: 7208769 - DNA, 22 bp, Homo sapiens
gcagtagttcgtctgtgttccc

SEQ ID NO: 7208770 - DNA, 22 bp, Homo sapiens
gcagtagttctgattggaactt

SEQ ID NO: 7208771 - DNA, 22 bp, Homo sapiens
gcagtagttctgattggaactt

SEQ ID NO: 7208772 - DNA, 22 bp, Homo sapiens
gcagtagttgaaactcctgtag

SEQ ID NO: 7208773 - DNA, 22 bp, Homo sapiens
gcagtagtttatggctaaacct

SEQ ID NO: 7208774 - DNA, 22 bp, Homo sapiens
gcagtagtttatggctaaacct

SEQ ID NO: 7208775 - DNA, 22 bp, Homo sapiens
gcagtagtttcaaaacaagaaa

SEQ ID NO: 7208776 - DNA, 22 bp, Homo sapiens
gcagtatacactgatacatgag

SEQ ID NO: 7208777 - DNA, 22 bp, Homo sapiens
gcaggtggattatcagaagtgc

SEQ ID NO: 7208778 - DNA, 22 bp, Homo sapiens
gcaggtggattatcagaagtgc

SEQ ID NO: 7208779 - DNA, 19 bp, Homo sapiens
gcaggtggatgtggtcagc

SEQ ID NO: 7208780 - DNA, 19 bp, Homo sapiens
gcaggtggatgtggtcagc

SEQ ID NO: 7208781 - DNA, 22 bp, Homo sapiens
gcaggtggagcagtagtctggt

SEQ ID NO: 7208782 - DNA, 22 bp, Homo sapiens
gcaggtggagcagtagtctggt

SEQ ID NO: 7208783 - DNA, 22 bp, Homo sapiens
gcaggtggagcagtagtctggt

SEQ ID NO: 7208784 - DNA, 22 bp, Homo sapiens
gcaggtggagcagtagtctggt

SEQ ID NO: 7208785 - DNA, 22 bp, Homo sapiens
gcaggtggagcagtagtctggt

SEQ ID NO: 7208786 - DNA, 22 bp, Homo sapiens
gcaggtggcagaggtgggatct

SEQ ID NO: 7208787 - DNA, 22 bp, Homo sapiens
gcaggtggcagaggtgggatct

SEQ ID NO: 7208788 - DNA, 22 bp, Homo sapiens
gcaggtggattatcagaagtgc

SEQ ID NO: 7208789 - DNA, 22 bp, Homo sapiens
gcaggtggattatcagaagtgc

SEQ ID NO: 7208790 - DNA, 22 bp, Homo sapiens
gcaggtggcagaggtgggatct

SEQ ID NO: 7208791 - DNA, 22 bp, Homo sapiens
gcaggtggcagaggtgggatct

SEQ ID NO: 7208792 - DNA, 22 bp, Homo sapiens
gcaggtgggagccgctgcctga

SEQ ID NO: 7208793 - DNA, 22 bp, Homo sapiens
gcaggtgggagccgctgcctga

SEQ ID NO: 7208794 - DNA, 22 bp, Homo sapiens
gcaggtgggagccgctgcctga

SEQ ID NO: 7208795 - DNA, 22 bp, Homo sapiens
gcaggtgggagccgctgcctga

SEQ ID NO: 7208796 - DNA, 22 bp, Homo sapiens
gcaggtgggagccgctgcctga

SEQ ID NO: 7208797 - DNA, 22 bp, Homo sapiens
gcaggtggcagaggtgggatct

SEQ ID NO: 7208798 - DNA, 22 bp, Homo sapiens
gcagggtgccgacttcagggat

SEQ ID NO: 7208799 - DNA, 22 bp, Homo sapiens
gcagggtgatagtgaggctcag

SEQ ID NO: 7208800 - DNA, 22 bp, Homo sapiens
gcagggtgatagtgaggctcag

SEQ ID NO: 7208801 - DNA, 22 bp, Homo sapiens
gcagggtgacgttgcccacctc

SEQ ID NO: 7208802 - DNA, 22 bp, Homo sapiens
gcagggtgatagtgaggctcag

SEQ ID NO: 7208803 - DNA, 22 bp, Homo sapiens
gcagggtgatagtgaggctcag

SEQ ID NO: 7208804 - DNA, 22 bp, Homo sapiens
gcagggtgatagtgaggctcag

SEQ ID NO: 7208805 - DNA, 19 bp, Homo sapiens
gcagggtggcagagctctt

SEQ ID NO: 7208806 - DNA, 19 bp, Homo sapiens
gcagggtggcagagctctt

SEQ ID NO: 7208807 - DNA, 19 bp, Homo sapiens
gcagggtggcagagctctt

SEQ ID NO: 7208808 - DNA, 22 bp, Homo sapiens
gcaggtggaagcagcagactca

SEQ ID NO: 7208809 - DNA, 22 bp, Homo sapiens
gcagggtggatggcagggccag

SEQ ID NO: 7208810 - DNA, 22 bp, Homo sapiens
gcagggtggatggcagggccag

SEQ ID NO: 7208811 - DNA, 22 bp, Homo sapiens
gcagggtggatggcagggccag

SEQ ID NO: 7208812 - DNA, 22 bp, Homo sapiens
gcagggtggatggcagggccag

SEQ ID NO: 7208813 - DNA, 22 bp, Homo sapiens
gcagggtggatggcagggccag

SEQ ID NO: 7208814 - DNA, 22 bp, Homo sapiens
gcagggtgccgacttcagggat

SEQ ID NO: 7208815 - DNA, 22 bp, Homo sapiens
gcagggtggatggcagggccag

SEQ ID NO: 7208816 - DNA, 22 bp, Homo sapiens
gcaggtggggctgctaccagaa

SEQ ID NO: 7208817 - DNA, 22 bp, Homo sapiens
gcaggtggggctgctaccagaa

SEQ ID NO: 7208818 - DNA, 16 bp, Homo sapiens
gcaggtggggcgcgca

SEQ ID NO: 7208819 - DNA, 22 bp, Homo sapiens
gcaggtgggagccgctgcctga

SEQ ID NO: 7208820 - DNA, 22 bp, Homo sapiens
gcaggtgggagccgctgcctga

SEQ ID NO: 7208821 - DNA, 22 bp, Homo sapiens
gcaggtgggagccgctgcctga

SEQ ID NO: 7208822 - DNA, 16 bp, Homo sapiens
gcaggtggggcgcgca

SEQ ID NO: 7208823 - DNA, 22 bp, Homo sapiens
gcaggtggggctgctaccagaa

SEQ ID NO: 7208824 - DNA, 22 bp, Homo sapiens
gcaggtggggctgctaccagaa

SEQ ID NO: 7208825 - DNA, 22 bp, Homo sapiens
gcaggtggggctgctaccagaa

SEQ ID NO: 7208826 - DNA, 22 bp, Homo sapiens
gcaggtgggggagaagttgtga

SEQ ID NO: 7208827 - DNA, 22 bp, Homo sapiens
gcaggtggggctgctaccagaa

SEQ ID NO: 7208828 - DNA, 22 bp, Homo sapiens
gcaggtgggggtcggtgcatct

SEQ ID NO: 7208829 - DNA, 22 bp, Homo sapiens
gcaggtgggggtcggtgcatct

SEQ ID NO: 7208830 - DNA, 22 bp, Homo sapiens
gcaggtgggggagaagttgtga

SEQ ID NO: 7208831 - DNA, 22 bp, Homo sapiens
gcaggtgggggtcggtgcatct

SEQ ID NO: 7208832 - DNA, 22 bp, Homo sapiens
gcaggtgggggtcggtgcatct

SEQ ID NO: 7208833 - DNA, 22 bp, Homo sapiens
gcaggtggtcactcatccccag

SEQ ID NO: 7208834 - DNA, 22 bp, Homo sapiens
gcaggtggtcactcatccccag

SEQ ID NO: 7208835 - DNA, 22 bp, Homo sapiens
gcaggtgggggtcggtgcatct

SEQ ID NO: 7208836 - DNA, 22 bp, Homo sapiens
gcaggtgggggtcggtgcatct

SEQ ID NO: 7208837 - DNA, 22 bp, Homo sapiens
gcaggtggtgggggagccgttc

SEQ ID NO: 7208838 - DNA, 22 bp, Homo sapiens
gcaggtggtggggctatgatct

SEQ ID NO: 7208839 - DNA, 22 bp, Homo sapiens
gcaggtggtggggctatgatct

SEQ ID NO: 7208840 - DNA, 22 bp, Homo sapiens
gcaggtggtggcgcgcgccctg

SEQ ID NO: 7208841 - DNA, 22 bp, Homo sapiens
gcaggtggtggcgcgcgccctg

SEQ ID NO: 7208842 - DNA, 22 bp, Homo sapiens
gcaggtggtggggctatgatct

SEQ ID NO: 7208843 - DNA, 22 bp, Homo sapiens
gcaggtggtccccgtggagtgg

SEQ ID NO: 7208844 - DNA, 22 bp, Homo sapiens
gcaggtggtcactcatccccag

SEQ ID NO: 7208845 - DNA, 22 bp, Homo sapiens
gcaggtggtccccgtggagtgg

SEQ ID NO: 7208846 - DNA, 22 bp, Homo sapiens
gcaggtggtccccgtggagtgg

SEQ ID NO: 7208847 - DNA, 22 bp, Homo sapiens
gcaggtggtggcgcgcgccctg

SEQ ID NO: 7208848 - DNA, 22 bp, Homo sapiens
gcaggtggtgggggagccgttc

SEQ ID NO: 7208849 - DNA, 22 bp, Homo sapiens
gcaggtggtgggggagccgttc

SEQ ID NO: 7208850 - DNA, 22 bp, Homo sapiens
gcaggtggttaaggtcccatgt

SEQ ID NO: 7208851 - DNA, 22 bp, Homo sapiens
gcaggtggttaaggtcccatgt

SEQ ID NO: 7208852 - DNA, 22 bp, Homo sapiens
gcaggtggtgggggagccgttc

SEQ ID NO: 7208853 - DNA, 22 bp, Homo sapiens
gcaggtggtgggggagccgttc

SEQ ID NO: 7208854 - DNA, 22 bp, Homo sapiens
gcaggtggtgggggagccgttc

SEQ ID NO: 7208855 - DNA, 22 bp, Homo sapiens
gcaggtggtgggggagccgttc

SEQ ID NO: 7208856 - DNA, 22 bp, Homo sapiens
gcaggtggtgggggagccgttc

SEQ ID NO: 7208857 - DNA, 23 bp, Homo sapiens
gcaggtggttcgaacagaagttt

SEQ ID NO: 7208858 - DNA, 23 bp, Homo sapiens
gcaggtggttcgaacagaagttt

SEQ ID NO: 7208859 - DNA, 22 bp, Homo sapiens
gcaggtggttaaggtcccatgt

SEQ ID NO: 7208860 - DNA, 22 bp, Homo sapiens
gcaggtggttaaggtcccatgt

SEQ ID NO: 7208861 - DNA, 18 bp, Homo sapiens
gcagctgacactggagtt

SEQ ID NO: 7208862 - DNA, 18 bp, Homo sapiens
gcagctgacactggagtt

SEQ ID NO: 7208863 - DNA, 22 bp, Homo sapiens
gcagctgaatgtccattgctgc

SEQ ID NO: 7208864 - DNA, 22 bp, Homo sapiens
gcagctgaatgtccattgctgc

SEQ ID NO: 7208865 - DNA, 22 bp, Homo sapiens
gcagctgacatctggctgggcc

SEQ ID NO: 7208866 - DNA, 22 bp, Homo sapiens
gcagctgaagctgcagttccag

SEQ ID NO: 7208867 - DNA, 22 bp, Homo sapiens
gcagctgaagctgcagttccag

SEQ ID NO: 7208868 - DNA, 22 bp, Homo sapiens
gcagctgaagctgcagttccag

SEQ ID NO: 7208869 - DNA, 20 bp, Homo sapiens
gcagctgaaagtatgacacc

SEQ ID NO: 7208870 - DNA, 22 bp, Homo sapiens
gcagctgaaagggatctctaca

SEQ ID NO: 7208871 - DNA, 22 bp, Homo sapiens
gcagctgaaagggatctctaca

SEQ ID NO: 7208872 - DNA, 22 bp, Homo sapiens
gcagctcctttaggctgcaaag

SEQ ID NO: 7208873 - DNA, 22 bp, Homo sapiens
gcagctctcctctgtgaggaac

SEQ ID NO: 7208874 - DNA, 22 bp, Homo sapiens
gcagctctcctctgtgaggaac

SEQ ID NO: 7208875 - DNA, 22 bp, Homo sapiens
gcagctctctggcctgccctgg

SEQ ID NO: 7208876 - DNA, 22 bp, Homo sapiens
gcagctctctggcctgccctgg

SEQ ID NO: 7208877 - DNA, 22 bp, Homo sapiens
gcagctctctggcctgccctgg

SEQ ID NO: 7208878 - DNA, 22 bp, Homo sapiens
gcagctctgacaatgcctggaa

SEQ ID NO: 7208879 - DNA, 22 bp, Homo sapiens
gcagctctgacaatgcctggaa

SEQ ID NO: 7208880 - DNA, 22 bp, Homo sapiens
gcagctctggggcaggcctgag

SEQ ID NO: 7208881 - DNA, 22 bp, Homo sapiens
gcagctctggggcaggcctgag

SEQ ID NO: 7208882 - DNA, 22 bp, Homo sapiens
gcagctctggggcaggcctgag

SEQ ID NO: 7208883 - DNA, 22 bp, Homo sapiens
gcagctctggggcaggcctgag

SEQ ID NO: 7208884 - DNA, 22 bp, Homo sapiens
gcagctcttcacttactccttt

SEQ ID NO: 7208885 - DNA, 22 bp, Homo sapiens
gcagctcttttcttaaagagat

SEQ ID NO: 7208886 - DNA, 22 bp, Homo sapiens
gcagctcctcctgggctggaga

SEQ ID NO: 7208887 - DNA, 22 bp, Homo sapiens
gcagctcctcctgggctggaga

SEQ ID NO: 7208888 - DNA, 22 bp, Homo sapiens
gcagctcctggcacagtttttt

SEQ ID NO: 7208889 - DNA, 22 bp, Homo sapiens
gcagctccttcaatctcaccat

SEQ ID NO: 7208890 - DNA, 22 bp, Homo sapiens
gcagctccttcaatctcaccat

SEQ ID NO: 7208891 - DNA, 22 bp, Homo sapiens
gcagctcctttaggctgcaaag

SEQ ID NO: 7208892 - DNA, 22 bp, Homo sapiens
gcagctccctggctgcaaatga

SEQ ID NO: 7208893 - DNA, 22 bp, Homo sapiens
gcagctcccttgaacttctcct

SEQ ID NO: 7208894 - DNA, 22 bp, Homo sapiens
gcagctcctcctgggctggaga

SEQ ID NO: 7208895 - DNA, 22 bp, Homo sapiens
gcagctcctcctgggctggaga

SEQ ID NO: 7208896 - DNA, 22 bp, Homo sapiens
gcagctcacagtctccgccatc

SEQ ID NO: 7208897 - DNA, 22 bp, Homo sapiens
gcagctcagggagagggcacca

SEQ ID NO: 7208898 - DNA, 22 bp, Homo sapiens
gcagctcccatcagggcacaga

SEQ ID NO: 7208899 - DNA, 22 bp, Homo sapiens
gcagagccttgcgtcatgtgcc

SEQ ID NO: 7208900 - DNA, 22 bp, Homo sapiens
gcagagccttgcgtcatgtgcc

SEQ ID NO: 7208901 - DNA, 22 bp, Homo sapiens
gcagagcctgggggtctgcgga

SEQ ID NO: 7208902 - DNA, 22 bp, Homo sapiens
gcagagcctgggggtctgcgga

SEQ ID NO: 7208903 - DNA, 22 bp, Homo sapiens
gcagagcctgtgtctgagcaaa

SEQ ID NO: 7208904 - DNA, 22 bp, Homo sapiens
gcagagcctgtgtctgagcaaa

SEQ ID NO: 7208905 - DNA, 22 bp, Homo sapiens
gcagagccctgggggtatggtg

SEQ ID NO: 7208906 - DNA, 21 bp, Homo sapiens
gcagagccggggcgagaaggc

SEQ ID NO: 7208907 - DNA, 21 bp, Homo sapiens
gcagagccggggcgagaaggc

SEQ ID NO: 7208908 - DNA, 21 bp, Homo sapiens
gcagagccggggcgagaaggc

SEQ ID NO: 7208909 - DNA, 20 bp, Homo sapiens
gcagagcctcactgcaaggg

SEQ ID NO: 7208910 - DNA, 20 bp, Homo sapiens
gcagagcctcactgcaaggg

SEQ ID NO: 7208911 - DNA, 22 bp, Homo sapiens
gcagagcctgacgggatttttc

SEQ ID NO: 7208912 - DNA, 22 bp, Homo sapiens
gcagagctcatgcctgcacctc

SEQ ID NO: 7208913 - DNA, 22 bp, Homo sapiens
gcagagctcatgcctgcacctc

SEQ ID NO: 7208914 - DNA, 22 bp, Homo sapiens
gcagagctccccaagacaccaa

SEQ ID NO: 7208915 - DNA, 22 bp, Homo sapiens
gcagcctctgatgatggccgta

SEQ ID NO: 7208916 - DNA, 22 bp, Homo sapiens
gcagcctctgatgatggccgta

SEQ ID NO: 7208917 - DNA, 22 bp, Homo sapiens
gcagagcggtgatcaggcgcag

SEQ ID NO: 7208918 - DNA, 22 bp, Homo sapiens
gcagagctatcttctggatttg

SEQ ID NO: 7208919 - DNA, 22 bp, Homo sapiens
gcagagctcaaggtgttcagct

SEQ ID NO: 7208920 - DNA, 22 bp, Homo sapiens
gcagcctctgcagttcaggagg

SEQ ID NO: 7208921 - DNA, 22 bp, Homo sapiens
gcagcctctgcagttcaggagg

SEQ ID NO: 7208922 - DNA, 22 bp, Homo sapiens
gcagcctctgcagttcaggagg

SEQ ID NO: 7208923 - DNA, 22 bp, Homo sapiens
gcagcgtggggacaggagctca

SEQ ID NO: 7208924 - DNA, 22 bp, Homo sapiens
gcagcgtggggctgagtcagct

SEQ ID NO: 7208925 - DNA, 22 bp, Homo sapiens
gcagcgtggggctgagtcagct

SEQ ID NO: 7208926 - DNA, 18 bp, Homo sapiens
gcagctagccaggggggc

SEQ ID NO: 7208927 - DNA, 22 bp, Homo sapiens
gcaggcaccgcggcggcaggtt

SEQ ID NO: 7208928 - DNA, 22 bp, Homo sapiens
gcaggcaccgcggcggcaggtt

SEQ ID NO: 7208929 - DNA, 22 bp, Homo sapiens
gcaggcaccacggctcaggtct

SEQ ID NO: 7208930 - DNA, 22 bp, Homo sapiens
gcaggcaccacggctcaggtct

SEQ ID NO: 7208931 - DNA, 19 bp, Homo sapiens
gcaggcacagccctgggtg

SEQ ID NO: 7208932 - DNA, 22 bp, Homo sapiens
gcaggcacatgggcgggtctgg

SEQ ID NO: 7208933 - DNA, 19 bp, Homo sapiens
gcaggcacagccctgggtg

SEQ ID NO: 7208934 - DNA, 19 bp, Homo sapiens
gcaggcacagccctgggtg

SEQ ID NO: 7208935 - DNA, 23 bp, Homo sapiens
gcaggagttcctggactccagga

SEQ ID NO: 7208936 - DNA, 22 bp, Homo sapiens
gcaggagttcaattgcccatga

SEQ ID NO: 7208937 - DNA, 22 bp, Homo sapiens
gcaggagttagggtaaaaatga

SEQ ID NO: 7208938 - DNA, 22 bp, Homo sapiens
gcaggagttcaattgcccatga

SEQ ID NO: 7208939 - DNA, 22 bp, Homo sapiens
gcaggagccacttcagggatgc

SEQ ID NO: 7208940 - DNA, 22 bp, Homo sapiens
gcaggagccacttcagggatgc

SEQ ID NO: 7208941 - DNA, 22 bp, Homo sapiens
gcaggagccacttcagggatgc

SEQ ID NO: 7208942 - DNA, 22 bp, Homo sapiens
gcaggagccaggccgagctggt

SEQ ID NO: 7208943 - DNA, 22 bp, Homo sapiens
gcaggagccaggccgagctggt

SEQ ID NO: 7208944 - DNA, 22 bp, Homo sapiens
gcaggagccagggattccagga

SEQ ID NO: 7208945 - DNA, 22 bp, Homo sapiens
gcaggagctgctctcctgacga

SEQ ID NO: 7208946 - DNA, 22 bp, Homo sapiens
gcaggagctcgtttccaggctg

SEQ ID NO: 7208947 - DNA, 22 bp, Homo sapiens
gcaggagttagggtaaaaatga

SEQ ID NO: 7208948 - DNA, 22 bp, Homo sapiens
gcaggagccctggcatgttctt

SEQ ID NO: 7208949 - DNA, 22 bp, Homo sapiens
gcaggagctcgtttccaggctg

SEQ ID NO: 7208950 - DNA, 22 bp, Homo sapiens
gcaggagctcgtttccaggctg

SEQ ID NO: 7208951 - DNA, 22 bp, Homo sapiens
gcaggagctcgtttccaggctg

SEQ ID NO: 7208952 - DNA, 22 bp, Homo sapiens
gcaggagctcgtttccaggctg

SEQ ID NO: 7208953 - DNA, 22 bp, Homo sapiens
gcaggacattcagtgaatgggc

SEQ ID NO: 7208954 - DNA, 22 bp, Homo sapiens
gcaggacattcagtgaatgggc

SEQ ID NO: 7208955 - DNA, 22 bp, Homo sapiens
gcaggacaggcgttggtccagt

SEQ ID NO: 7208956 - DNA, 22 bp, Homo sapiens
gcaggacaggcgttggtccagt

SEQ ID NO: 7208957 - DNA, 22 bp, Homo sapiens
gcaggacaggcgttggtccagt

SEQ ID NO: 7208958 - DNA, 22 bp, Homo sapiens
gcaggacctggcagatggggca

SEQ ID NO: 7208959 - DNA, 22 bp, Homo sapiens
gcaggactcaaatctgaaggca

SEQ ID NO: 7208960 - DNA, 19 bp, Homo sapiens
gcaggactcccagctcctc

SEQ ID NO: 7208961 - DNA, 22 bp, Homo sapiens
gcaggacttgaatccaggcagt

SEQ ID NO: 7208962 - DNA, 22 bp, Homo sapiens
gcaggacaggcgttggtccagt

SEQ ID NO: 7208963 - DNA, 22 bp, Homo sapiens
gcaggacagcaggatgcttaga

SEQ ID NO: 7208964 - DNA, 22 bp, Homo sapiens
gcagctgatggaagtcctattg

SEQ ID NO: 7208965 - DNA, 22 bp, Homo sapiens
gcaggacagacccaagcagtct

SEQ ID NO: 7208966 - DNA, 22 bp, Homo sapiens
gcagctgagcgtgaggaagagt

SEQ ID NO: 7208967 - DNA, 22 bp, Homo sapiens
gcagctgagagaagaacagggc

SEQ ID NO: 7208968 - DNA, 22 bp, Homo sapiens
gcagctgagagaagaacagggc

SEQ ID NO: 7208969 - DNA, 22 bp, Homo sapiens
gcagctgacatctggctgggcc

SEQ ID NO: 7208970 - DNA, 22 bp, Homo sapiens
gcaggagaacaaagcaagctgc

SEQ ID NO: 7208971 - DNA, 22 bp, Homo sapiens
gcaggagaaatgaagattgggt

SEQ ID NO: 7208972 - DNA, 22 bp, Homo sapiens
gcaggagacaactgtaaggaga

SEQ ID NO: 7208973 - DNA, 22 bp, Homo sapiens
gcaggagacaactgtaaggaga

SEQ ID NO: 7208974 - DNA, 22 bp, Homo sapiens
gcaggagaacaaagcaagctgc

SEQ ID NO: 7208975 - DNA, 22 bp, Homo sapiens
gcaggagacaactgtaaggaga

SEQ ID NO: 7208976 - DNA, 22 bp, Homo sapiens
gcaggagactggctgtggtagt

SEQ ID NO: 7208977 - DNA, 22 bp, Homo sapiens
gcaggagactggctgtggtagt

SEQ ID NO: 7208978 - DNA, 22 bp, Homo sapiens
gcaggagagccagcaggcttcc

SEQ ID NO: 7208979 - DNA, 22 bp, Homo sapiens
gcaggagagccagcaggcttcc

SEQ ID NO: 7208980 - DNA, 22 bp, Homo sapiens
gcaggagagccagcaggcttcc

SEQ ID NO: 7208981 - DNA, 22 bp, Homo sapiens
gcagggggatggagttgaaatg

SEQ ID NO: 7208982 - DNA, 22 bp, Homo sapiens
gcagggggtcattcacgctggc

SEQ ID NO: 7208983 - DNA, 22 bp, Homo sapiens
gcagggggtcattcacgctggc

SEQ ID NO: 7208984 - DNA, 22 bp, Homo sapiens
gcagggggtcattcacgctggc

SEQ ID NO: 7208985 - DNA, 22 bp, Homo sapiens
gcagggtgaaggtcacatagaa

SEQ ID NO: 7208986 - DNA, 22 bp, Homo sapiens
gcagggtgaaggtcacatagaa

SEQ ID NO: 7208987 - DNA, 22 bp, Homo sapiens
gcagggtgacgttgcccacctc

SEQ ID NO: 7208988 - DNA, 22 bp, Homo sapiens
gcagggtgacgttgcccacctc

SEQ ID NO: 7208989 - DNA, 22 bp, Homo sapiens
gcagggtgacgttgcccacctc

SEQ ID NO: 7208990 - DNA, 22 bp, Homo sapiens
gcaggggctgagcaccagcggg

SEQ ID NO: 7208991 - DNA, 22 bp, Homo sapiens
gcaggggctgagcaccagcggg

SEQ ID NO: 7208992 - DNA, 22 bp, Homo sapiens
gcaggggctgctgggaactcgg

SEQ ID NO: 7208993 - DNA, 22 bp, Homo sapiens
gcaggggctgagcaccagcggg

SEQ ID NO: 7208994 - DNA, 22 bp, Homo sapiens
gcaggggctgagcaccagcggg

SEQ ID NO: 7208995 - DNA, 21 bp, Homo sapiens
gcaggggatagaaatggtctg

SEQ ID NO: 7208996 - DNA, 21 bp, Homo sapiens
gcaggggatagaaatggtctg

SEQ ID NO: 7208997 - DNA, 22 bp, Homo sapiens
gcagggcagccacaggccccct

SEQ ID NO: 7208998 - DNA, 22 bp, Homo sapiens
gcagggcagccacaggccccct

SEQ ID NO: 7208999 - DNA, 22 bp, Homo sapiens
gcagggcagccacaggccccct

SEQ ID NO: 7209000 - DNA, 22 bp, Homo sapiens
gcaggggcaggagatctcaggc

SEQ ID NO: 7209001 - DNA, 22 bp, Homo sapiens
gcaggggcaggagatctcaggc

SEQ ID NO: 7209002 - DNA, 22 bp, Homo sapiens
gcaggggcaggagatctcaggc

SEQ ID NO: 7209003 - DNA, 21 bp, Homo sapiens
gcaggggatagaaatggtctg

SEQ ID NO: 7209004 - DNA, 22 bp, Homo sapiens
gcaggggcaggagatctcaggc

SEQ ID NO: 7209005 - DNA, 22 bp, Homo sapiens
gcaggggctaaggacacagaga

SEQ ID NO: 7209006 - DNA, 22 bp, Homo sapiens
gcaggggcggctgggtttccag

SEQ ID NO: 7209007 - DNA, 22 bp, Homo sapiens
gcaggggctaaggacacagaga

SEQ ID NO: 7209008 - DNA, 22 bp, Homo sapiens
gcaggggctactctgagcttcc

SEQ ID NO: 7209009 - DNA, 22 bp, Homo sapiens
gcaggggctactctgagcttcc

SEQ ID NO: 7209010 - DNA, 22 bp, Homo sapiens
gcaggggctactctgagcttcc

SEQ ID NO: 7209011 - DNA, 22 bp, Homo sapiens
gcagggcagaaggtgctgagga

SEQ ID NO: 7209012 - DNA, 22 bp, Homo sapiens
gcagggcagaaggtgctgagga

SEQ ID NO: 7209013 - DNA, 22 bp, Homo sapiens
gcagggcagaaggtgctgagga

SEQ ID NO: 7209014 - DNA, 22 bp, Homo sapiens
gcagggcagaaggtgctgagga

SEQ ID NO: 7209015 - DNA, 22 bp, Homo sapiens
gcagggcagaaggtgctgagga

SEQ ID NO: 7209016 - DNA, 22 bp, Homo sapiens
gcagggcagaaggtgctgagga

SEQ ID NO: 7209017 - DNA, 22 bp, Homo sapiens
gcagggcagaaggtgctgagga

SEQ ID NO: 7209018 - DNA, 22 bp, Homo sapiens
gcagggcacagacagtgccaag

SEQ ID NO: 7209019 - DNA, 22 bp, Homo sapiens
gcagggcacagacagtgccaag

SEQ ID NO: 7209020 - DNA, 22 bp, Homo sapiens
gcagggcacagacagtgccaag

SEQ ID NO: 7209021 - DNA, 22 bp, Homo sapiens
gcagggcacagacagtgccaag

SEQ ID NO: 7209022 - DNA, 22 bp, Homo sapiens
gcagggcagaaggtgctgagga

SEQ ID NO: 7209023 - DNA, 22 bp, Homo sapiens
gcagggcagaaggtgctgagga

SEQ ID NO: 7209024 - DNA, 22 bp, Homo sapiens
gcagggcagacctccagcctat

SEQ ID NO: 7209025 - DNA, 22 bp, Homo sapiens
gcagggcagacctccagcctat

SEQ ID NO: 7209026 - DNA, 22 bp, Homo sapiens
gcagggcagacctccagcctat

SEQ ID NO: 7209027 - DNA, 22 bp, Homo sapiens
gcagggcagacctccagcctat

SEQ ID NO: 7209028 - DNA, 22 bp, Homo sapiens
gcagggcagagggagaatctct

SEQ ID NO: 7209029 - DNA, 22 bp, Homo sapiens
gcagggcagagggagaatctct

SEQ ID NO: 7209030 - DNA, 22 bp, Homo sapiens
gcagggcacacaagaatgataa

SEQ ID NO: 7209031 - DNA, 22 bp, Homo sapiens
gcagggcacacaagaatgataa

SEQ ID NO: 7209032 - DNA, 22 bp, Homo sapiens
gcagggcacagacagtgccaag

SEQ ID NO: 7209033 - DNA, 22 bp, Homo sapiens
gcagggcacagacagtgccaag

SEQ ID NO: 7209034 - DNA, 22 bp, Homo sapiens
gcagggcacaaggacgcacagg

SEQ ID NO: 7209035 - DNA, 22 bp, Homo sapiens
gcagggcacacaagaatgataa

SEQ ID NO: 7209036 - DNA, 22 bp, Homo sapiens
gcagggcacacaagaatgataa

SEQ ID NO: 7209037 - DNA, 22 bp, Homo sapiens
gcagggcaatgatcccgagagg

SEQ ID NO: 7209038 - DNA, 22 bp, Homo sapiens
gcagggcaatgatcccgagagg

SEQ ID NO: 7209039 - DNA, 22 bp, Homo sapiens
gcagggcaatgatcccgagagg

SEQ ID NO: 7209040 - DNA, 22 bp, Homo sapiens
gcagggcacaaggacgcacagg

SEQ ID NO: 7209041 - DNA, 22 bp, Homo sapiens
gcagggcacaaggacgcacagg

SEQ ID NO: 7209042 - DNA, 22 bp, Homo sapiens
gcagggcacaaggacgcacagg

SEQ ID NO: 7209043 - DNA, 22 bp, Homo sapiens
gcagggcaaatgtggaaaggag

SEQ ID NO: 7209044 - DNA, 22 bp, Homo sapiens
gcagggcaaatgtggaaaggag

SEQ ID NO: 7209045 - DNA, 22 bp, Homo sapiens
gcagggcaaatgtggaaaggag

SEQ ID NO: 7209046 - DNA, 22 bp, Homo sapiens
gcagggcaaatgtggaaaggag

SEQ ID NO: 7209047 - DNA, 22 bp, Homo sapiens
gcagggcaaatgtggaaaggag

SEQ ID NO: 7209048 - DNA, 22 bp, Homo sapiens
gcagggcaaatgtggaaaggag

SEQ ID NO: 7209049 - DNA, 22 bp, Homo sapiens
gcagggcaaatgtggaaaggag

SEQ ID NO: 7209050 - DNA, 22 bp, Homo sapiens
gcagggcaaatgtggaaaggag

SEQ ID NO: 7209051 - DNA, 20 bp, Homo sapiens
gcagggcaagggatatgaaa

SEQ ID NO: 7209052 - DNA, 20 bp, Homo sapiens
gcagggcaagggatatgaaa

SEQ ID NO: 7209053 - DNA, 20 bp, Homo sapiens
gcagggcaagggatatgaaa

SEQ ID NO: 7209054 - DNA, 21 bp, Homo sapiens
gcaggcactctagaggagctg

SEQ ID NO: 7209055 - DNA, 22 bp, Homo sapiens
gcaggcactcctaggaccatca

SEQ ID NO: 7209056 - DNA, 22 bp, Homo sapiens
gcaggcactcctaggaccatca

SEQ ID NO: 7209057 - DNA, 17 bp, Homo sapiens
gcaggcactgctgcctg

SEQ ID NO: 7209058 - DNA, 21 bp, Homo sapiens
gcaggcactctagaggagctg

SEQ ID NO: 7209059 - DNA, 21 bp, Homo sapiens
gcaggcactctagaggagctg

SEQ ID NO: 7209060 - DNA, 21 bp, Homo sapiens
gcaggcactctagaggagctg

SEQ ID NO: 7209061 - DNA, 21 bp, Homo sapiens
gcaggcactctagaggagctg

SEQ ID NO: 7209062 - DNA, 22 bp, Homo sapiens
gcaggcagaggtggaggagaca

SEQ ID NO: 7209063 - DNA, 22 bp, Homo sapiens
gcaggcagagaggggtttccag

SEQ ID NO: 7209064 - DNA, 22 bp, Homo sapiens
gcaggcagagaaggaacattta

SEQ ID NO: 7209065 - DNA, 17 bp, Homo sapiens
gcaggcactgctgcctg

SEQ ID NO: 7209066 - DNA, 14 bp, Homo sapiens
gcaggcagaccacc

SEQ ID NO: 7209067 - DNA, 22 bp, Homo sapiens
gcaggcagagaaggaacattta

SEQ ID NO: 7209068 - DNA, 22 bp, Homo sapiens
gcaggcagagaaggaacattta

SEQ ID NO: 7209069 - DNA, 22 bp, Homo sapiens
gcaggctggaggctgttctggg

SEQ ID NO: 7209070 - DNA, 22 bp, Homo sapiens
gcaggctggaggctgttctggg

SEQ ID NO: 7209071 - DNA, 22 bp, Homo sapiens
gcaggctggaggctgttctggg

SEQ ID NO: 7209072 - DNA, 22 bp, Homo sapiens
gcaggctggaggctgttctggg

SEQ ID NO: 7209073 - DNA, 22 bp, Homo sapiens
gcaggctgctgagatccttagg

SEQ ID NO: 7209074 - DNA, 22 bp, Homo sapiens
gcaggctgctgagatccttagg

SEQ ID NO: 7209075 - DNA, 22 bp, Homo sapiens
gcaggctgccctcttgtgttga

SEQ ID NO: 7209076 - DNA, 22 bp, Homo sapiens
gcaggctgctgagatccttagg

SEQ ID NO: 7209077 - DNA, 22 bp, Homo sapiens
gcaggcagaggtggaggagaca

SEQ ID NO: 7209078 - DNA, 22 bp, Homo sapiens
gcaggctgccaccttctgagtt

SEQ ID NO: 7209079 - DNA, 22 bp, Homo sapiens
gcaggctgccctcttgtgttga

SEQ ID NO: 7209080 - DNA, 22 bp, Homo sapiens
gcaggctgccctcttgtgttga

SEQ ID NO: 7209081 - DNA, 22 bp, Homo sapiens
gcaggcagaggtggaggagaca

SEQ ID NO: 7209082 - DNA, 22 bp, Homo sapiens
gcaggcagaggtggaggagaca

SEQ ID NO: 7209083 - DNA, 22 bp, Homo sapiens
gcaggcagaggtggaggagaca

SEQ ID NO: 7209084 - DNA, 22 bp, Homo sapiens
gcaggcagagaggggtttccag

SEQ ID NO: 7209085 - DNA, 22 bp, Homo sapiens
gcaggcagaggtggaggagaca

SEQ ID NO: 7209086 - DNA, 22 bp, Homo sapiens
gcaggctggtctgaccatccct

SEQ ID NO: 7209087 - DNA, 22 bp, Homo sapiens
gcaggctggtctgaccatccct

SEQ ID NO: 7209088 - DNA, 21 bp, Homo sapiens
gcaggctggtcaaacctcagt

SEQ ID NO: 7209089 - DNA, 22 bp, Homo sapiens
gcaggctggtctgaccatccct

SEQ ID NO: 7209090 - DNA, 22 bp, Homo sapiens
gcaggctggtctgaccatccct

SEQ ID NO: 7209091 - DNA, 22 bp, Homo sapiens
gcaggctgtggtatgttgggca

SEQ ID NO: 7209092 - DNA, 22 bp, Homo sapiens
gcaggcttatggggagacagag

SEQ ID NO: 7209093 - DNA, 22 bp, Homo sapiens
gcaggcttatggggagacagag

SEQ ID NO: 7209094 - DNA, 22 bp, Homo sapiens
gcaggcttcaagcacagctttt

SEQ ID NO: 7209095 - DNA, 22 bp, Homo sapiens
gcaggcttcccccacacctacg

SEQ ID NO: 7209096 - DNA, 21 bp, Homo sapiens
gcaggctggtcaaacctcagt

SEQ ID NO: 7209097 - DNA, 22 bp, Homo sapiens
gcaggctggggtagccccactt

SEQ ID NO: 7209098 - DNA, 21 bp, Homo sapiens
gcaggctggtcaaacctcagt

SEQ ID NO: 7209099 - DNA, 21 bp, Homo sapiens
gcaggctggtcaaacctcagt

SEQ ID NO: 7209100 - DNA, 22 bp, Homo sapiens
gcaggctggggtagccccactt

SEQ ID NO: 7209101 - DNA, 22 bp, Homo sapiens
gcaggctggggtagccccactt

SEQ ID NO: 7209102 - DNA, 22 bp, Homo sapiens
gcaggctggggtagccccactt

SEQ ID NO: 7209103 - DNA, 22 bp, Homo sapiens
gcaggctggaggctgttctggg

SEQ ID NO: 7209104 - DNA, 22 bp, Homo sapiens
gcagggacgcagcactctccgt

SEQ ID NO: 7209105 - DNA, 22 bp, Homo sapiens
gcagggacgcagcactctccgt

SEQ ID NO: 7209106 - DNA, 22 bp, Homo sapiens
gcagggaagacccggagcagcg

SEQ ID NO: 7209107 - DNA, 22 bp, Homo sapiens
gcagggaagacccggagcagcg

SEQ ID NO: 7209108 - DNA, 22 bp, Homo sapiens
gcagggaagacccggagcagcg

SEQ ID NO: 7209109 - DNA, 22 bp, Homo sapiens
gcagggaccttgcccaccctcc

SEQ ID NO: 7209110 - DNA, 22 bp, Homo sapiens
gcagggaccttgcccaccctcc

SEQ ID NO: 7209111 - DNA, 22 bp, Homo sapiens
gcagggaagacccggagcagcg

SEQ ID NO: 7209112 - DNA, 22 bp, Homo sapiens
gcagggacgcagcactctccgt

SEQ ID NO: 7209113 - DNA, 22 bp, Homo sapiens
gcagggacgccagggacagcaa

SEQ ID NO: 7209114 - DNA, 22 bp, Homo sapiens
gcagggcaaacccaggtgttca

SEQ ID NO: 7209115 - DNA, 22 bp, Homo sapiens
gcagggaaacaggtgctaagga

SEQ ID NO: 7209116 - DNA, 22 bp, Homo sapiens
gcagggaaacaggtgctaagga

SEQ ID NO: 7209117 - DNA, 22 bp, Homo sapiens
gcaggctttgacttggggcaac

SEQ ID NO: 7209118 - DNA, 18 bp, Homo sapiens
gcaggcttttcctgggtc

SEQ ID NO: 7209119 - DNA, 22 bp, Homo sapiens
gcaggctttgacttggggcagc

SEQ ID NO: 7209120 - DNA, 22 bp, Homo sapiens
gcaggcttgggacgagctggag

SEQ ID NO: 7209121 - DNA, 22 bp, Homo sapiens
gcaggcttgggacgagctggag

SEQ ID NO: 7209122 - DNA, 22 bp, Homo sapiens
gcaggcttgggacgagctggag

SEQ ID NO: 7209123 - DNA, 22 bp, Homo sapiens
gcaggcttgggacgagctggag

SEQ ID NO: 7209124 - DNA, 22 bp, Homo sapiens
gcaggcttgggacgagctggag

SEQ ID NO: 7209125 - DNA, 22 bp, Homo sapiens
gattcaaagttaatgaagatgc

SEQ ID NO: 7209126 - DNA, 22 bp, Homo sapiens
gattattttgtgcaataatcgg

SEQ ID NO: 7209127 - DNA, 22 bp, Homo sapiens
gattattttgtgcaataatcgg

SEQ ID NO: 7209128 - DNA, 22 bp, Homo sapiens
gattatggtagaaacaagaagt

SEQ ID NO: 7209129 - DNA, 22 bp, Homo sapiens
gattattttgtgcaataatcgg

SEQ ID NO: 7209130 - DNA, 22 bp, Homo sapiens
gattatggagaagaacaatgaa

SEQ ID NO: 7209131 - DNA, 22 bp, Homo sapiens
gattatggatggacagtggagc

SEQ ID NO: 7209132 - DNA, 22 bp, Homo sapiens
gattatggtaacaatgattaaa

SEQ ID NO: 7209133 - DNA, 22 bp, Homo sapiens
gattatataatggaagctcttg

SEQ ID NO: 7209134 - DNA, 22 bp, Homo sapiens
gattagtagaggaaacagggct

SEQ ID NO: 7209135 - DNA, 22 bp, Homo sapiens
gattagtaggtgagggaggcac

SEQ ID NO: 7209136 - DNA, 22 bp, Homo sapiens
gattagtatccttattaagaga

SEQ ID NO: 7209137 - DNA, 22 bp, Homo sapiens
gattagtatccttattaagaga

SEQ ID NO: 7209138 - DNA, 15 bp, Homo sapiens
gattaggcagctgaa

SEQ ID NO: 7209139 - DNA, 22 bp, Homo sapiens
gattaggcagtcaaggctaaga

SEQ ID NO: 7209140 - DNA, 22 bp, Homo sapiens
gattaggctttgtttatagcaa

SEQ ID NO: 7209141 - DNA, 22 bp, Homo sapiens
gattagtaagagtttacctatt

SEQ ID NO: 7209142 - DNA, 22 bp, Homo sapiens
gattatataatggaagctcttg

SEQ ID NO: 7209143 - DNA, 22 bp, Homo sapiens
gattatggagaaataattagaa

SEQ ID NO: 7209144 - DNA, 22 bp, Homo sapiens
gattagaaatgttaccatacag

SEQ ID NO: 7209145 - DNA, 22 bp, Homo sapiens
gattagctctagatctgggcta

SEQ ID NO: 7209146 - DNA, 22 bp, Homo sapiens
gattctttggcctttattgaca

SEQ ID NO: 7209147 - DNA, 22 bp, Homo sapiens
gattctttggcctttattgaca

SEQ ID NO: 7209148 - DNA, 22 bp, Homo sapiens
gattctttggcctttattgaca

SEQ ID NO: 7209149 - DNA, 22 bp, Homo sapiens
gattctttactcagattttgtt

SEQ ID NO: 7209150 - DNA, 22 bp, Homo sapiens
gattctttactcagattttgtt

SEQ ID NO: 7209151 - DNA, 22 bp, Homo sapiens
gattcaatgttgcagatggaat

SEQ ID NO: 7209152 - DNA, 22 bp, Homo sapiens
gattcacagaacttagtcaagc

SEQ ID NO: 7209153 - DNA, 23 bp, Homo sapiens
gattcacagggtggtttatgggg

SEQ ID NO: 7209154 - DNA, 22 bp, Homo sapiens
gattcacagtttaggctgggct

SEQ ID NO: 7209155 - DNA, 22 bp, Homo sapiens
gattcactcatattttacgttt

SEQ ID NO: 7209156 - DNA, 22 bp, Homo sapiens
gattcactcatattttacgttt

SEQ ID NO: 7209157 - DNA, 22 bp, Homo sapiens
gattcactcatattttacgttt

SEQ ID NO: 7209158 - DNA, 22 bp, Homo sapiens
gattctttacatctctgctgac

SEQ ID NO: 7209159 - DNA, 22 bp, Homo sapiens
gattaagattacatatttaagt

SEQ ID NO: 7209160 - DNA, 22 bp, Homo sapiens
gattaagagaagtttcttatcg

SEQ ID NO: 7209161 - DNA, 22 bp, Homo sapiens
gattaacatttctaagatgcca

SEQ ID NO: 7209162 - DNA, 22 bp, Homo sapiens
gattaagagaagtttcttatcg

SEQ ID NO: 7209163 - DNA, 22 bp, Homo sapiens
gatgttttttaggatctcagca

SEQ ID NO: 7209164 - DNA, 22 bp, Homo sapiens
gattaaaaataacccatgctga

SEQ ID NO: 7209165 - DNA, 21 bp, Homo sapiens
gattaaatttaagctacatgc

SEQ ID NO: 7209166 - DNA, 22 bp, Homo sapiens
gattaatagacacaaccaagct

SEQ ID NO: 7209167 - DNA, 22 bp, Homo sapiens
gattaattcaggatcaggaaat

SEQ ID NO: 7209168 - DNA, 22 bp, Homo sapiens
gattaattcaggatcaggaaat

SEQ ID NO: 7209169 - DNA, 22 bp, Homo sapiens
gattacaaaggtccttttctct

SEQ ID NO: 7209170 - DNA, 22 bp, Homo sapiens
gatgttaaatgtaaatagctgc

SEQ ID NO: 7209171 - DNA, 22 bp, Homo sapiens
gatgtgtttccaggatttgttt

SEQ ID NO: 7209172 - DNA, 22 bp, Homo sapiens
gatgtgtttccaggatttgttt

SEQ ID NO: 7209173 - DNA, 22 bp, Homo sapiens
gatgttaagaaggaattgaagt

SEQ ID NO: 7209174 - DNA, 22 bp, Homo sapiens
gatgttcagactctaggtcaga

SEQ ID NO: 7209175 - DNA, 22 bp, Homo sapiens
gatgttcgagcagaagaccagg

SEQ ID NO: 7209176 - DNA, 22 bp, Homo sapiens
gatgttcgctttggtttgtccc

SEQ ID NO: 7209177 - DNA, 22 bp, Homo sapiens
gatgttcggcgattgggggtgg

SEQ ID NO: 7209178 - DNA, 22 bp, Homo sapiens
gatgttctagaagtgtggtgtt

SEQ ID NO: 7209179 - DNA, 22 bp, Homo sapiens
gatgttctctgattggtggtag

SEQ ID NO: 7209180 - DNA, 22 bp, Homo sapiens
gatgttctctgattggtggtag

SEQ ID NO: 7209181 - DNA, 22 bp, Homo sapiens
gatgttctggggtgtttgtggc

SEQ ID NO: 7209182 - DNA, 22 bp, Homo sapiens
gatgttcttataccattgtggg

SEQ ID NO: 7209183 - DNA, 22 bp, Homo sapiens
gatgttcttcgatgatctgttt

SEQ ID NO: 7209184 - DNA, 22 bp, Homo sapiens
gatgttgagtatcaatgcttta

SEQ ID NO: 7209185 - DNA, 22 bp, Homo sapiens
gatgttttaggtccctgtagct

SEQ ID NO: 7209186 - DNA, 22 bp, Homo sapiens
gatgttttctggaaaatgaatg

SEQ ID NO: 7209187 - DNA, 22 bp, Homo sapiens
gatgttttctggaaaatgaatg

SEQ ID NO: 7209188 - DNA, 22 bp, Homo sapiens
gatgttttttaggatctcagca

SEQ ID NO: 7209189 - DNA, 22 bp, Homo sapiens
gatgttttttaggatctcagca

SEQ ID NO: 7209190 - DNA, 22 bp, Homo sapiens
gatttacagatctaagggtcac

SEQ ID NO: 7209191 - DNA, 22 bp, Homo sapiens
gatttacagatctaagggtcac

SEQ ID NO: 7209192 - DNA, 22 bp, Homo sapiens
gatttacagatctaagggtcac

SEQ ID NO: 7209193 - DNA, 22 bp, Homo sapiens
gatttacaaagctctctagtgt

SEQ ID NO: 7209194 - DNA, 22 bp, Homo sapiens
gatttacaaagctctctagtgt

SEQ ID NO: 7209195 - DNA, 22 bp, Homo sapiens
gatttacaaagctctctagtgt

SEQ ID NO: 7209196 - DNA, 22 bp, Homo sapiens
gatttacaaagctctctagtgt

SEQ ID NO: 7209197 - DNA, 22 bp, Homo sapiens
gatttaaagtagacctttgttt

SEQ ID NO: 7209198 - DNA, 22 bp, Homo sapiens
gatttaaagtagacctttgttt

SEQ ID NO: 7209199 - DNA, 19 bp, Homo sapiens
gatttaaacgtggctctat

SEQ ID NO: 7209200 - DNA, 19 bp, Homo sapiens
gatttaaacgtggctctat

SEQ ID NO: 7209201 - DNA, 22 bp, Homo sapiens
gattgtctgtgatcatgagcaa

SEQ ID NO: 7209202 - DNA, 22 bp, Homo sapiens
gattgtctttattttatggcta

SEQ ID NO: 7209203 - DNA, 22 bp, Homo sapiens
gattgtggaagtcagtggttct

SEQ ID NO: 7209204 - DNA, 22 bp, Homo sapiens
gattgtgtctcactgtgatgct

SEQ ID NO: 7209205 - DNA, 22 bp, Homo sapiens
gattgtgttcataggcatgtta

SEQ ID NO: 7209206 - DNA, 22 bp, Homo sapiens
gattgttgcctggctttgacct

SEQ ID NO: 7209207 - DNA, 22 bp, Homo sapiens
gattgtaaaacagatcattatc

SEQ ID NO: 7209208 - DNA, 21 bp, Homo sapiens
gattggttcactcatgttgac

SEQ ID NO: 7209209 - DNA, 22 bp, Homo sapiens
gattggttgaaagtagaatact

SEQ ID NO: 7209210 - DNA, 22 bp, Homo sapiens
gattggagagtggaacatgctg

SEQ ID NO: 7209211 - DNA, 22 bp, Homo sapiens
gattgggcagaaatttccttaa

SEQ ID NO: 7209212 - DNA, 22 bp, Homo sapiens
gattgggccaaggggttagtag

SEQ ID NO: 7209213 - DNA, 22 bp, Homo sapiens
gattgggcctcattttcaccct

SEQ ID NO: 7209214 - DNA, 22 bp, Homo sapiens
gattggggaaggttttactgac

SEQ ID NO: 7209215 - DNA, 22 bp, Homo sapiens
gattggggggcaggagaagtgt

SEQ ID NO: 7209216 - DNA, 22 bp, Homo sapiens
gattgggggtcaggctcaggtc

SEQ ID NO: 7209217 - DNA, 22 bp, Homo sapiens
gattggggggcaggagaagtgt

SEQ ID NO: 7209218 - DNA, 22 bp, Homo sapiens
gattgggggtcaggctcaggtc

SEQ ID NO: 7209219 - DNA, 22 bp, Homo sapiens
gattgagtctgaggatgctgca

SEQ ID NO: 7209220 - DNA, 22 bp, Homo sapiens
gattgaatcatatgaaattgtg

SEQ ID NO: 7209221 - DNA, 22 bp, Homo sapiens
gattgagtctgaggatgctgca

SEQ ID NO: 7209222 - DNA, 22 bp, Homo sapiens
gattgcttatacacaagatgaa

SEQ ID NO: 7209223 - DNA, 22 bp, Homo sapiens
gatttcaaaggttctgcatgcc

SEQ ID NO: 7209224 - DNA, 22 bp, Homo sapiens
gatttatttttaatcagcaggg

SEQ ID NO: 7209225 - DNA, 22 bp, Homo sapiens
gatttatttttaatcagcaggg

SEQ ID NO: 7209226 - DNA, 22 bp, Homo sapiens
gatttatttttaatcagcaggg

SEQ ID NO: 7209227 - DNA, 22 bp, Homo sapiens
gatttatttttaatcagcaggg

SEQ ID NO: 7209228 - DNA, 22 bp, Homo sapiens
gatttattggtctttcattggt

SEQ ID NO: 7209229 - DNA, 22 bp, Homo sapiens
gatttattgtccctgtcctgct

SEQ ID NO: 7209230 - DNA, 22 bp, Homo sapiens
gatttatagtatgtgctttcag

SEQ ID NO: 7209231 - DNA, 22 bp, Homo sapiens
gatttatgacagagctgactct

SEQ ID NO: 7209232 - DNA, 22 bp, Homo sapiens
gatttattggtctttcattggt

SEQ ID NO: 7209233 - DNA, 22 bp, Homo sapiens
gatttacaggttaggtcctgta

SEQ ID NO: 7209234 - DNA, 22 bp, Homo sapiens
gatttacaggttaggtcctgta

SEQ ID NO: 7209235 - DNA, 22 bp, Homo sapiens
gatttacaggttaggtcctgta

SEQ ID NO: 7209236 - DNA, 22 bp, Homo sapiens
gatttacagctatacccaatgg

SEQ ID NO: 7209237 - DNA, 22 bp, Homo sapiens
gatttacagctatacccaatgg

SEQ ID NO: 7209238 - DNA, 22 bp, Homo sapiens
gatttacagctatacccaatgg

SEQ ID NO: 7209239 - DNA, 21 bp, Homo sapiens
gatttataagccttaagccta

SEQ ID NO: 7209240 - DNA, 22 bp, Homo sapiens
gatttatagtatgtgctttcag

SEQ ID NO: 7209241 - DNA, 22 bp, Homo sapiens
gatttatagtatgtgctttcag

SEQ ID NO: 7209242 - DNA, 22 bp, Homo sapiens
gatttataaaggttgcactgga

SEQ ID NO: 7209243 - DNA, 21 bp, Homo sapiens
gatttataagccttaagccta

SEQ ID NO: 7209244 - DNA, 22 bp, Homo sapiens
gatttataaaggttgcactgga

SEQ ID NO: 7209245 - DNA, 22 bp, Homo sapiens
gatttataaaggttgcactgga

SEQ ID NO: 7209246 - DNA, 22 bp, Homo sapiens
gatggggctggctttgagggtt

SEQ ID NO: 7209247 - DNA, 22 bp, Homo sapiens
gatgggggccagggcctgcttt

SEQ ID NO: 7209248 - DNA, 22 bp, Homo sapiens
gatgggggccagggcctgcttt

SEQ ID NO: 7209249 - DNA, 22 bp, Homo sapiens
gatgggggccagggcctgcttt

SEQ ID NO: 7209250 - DNA, 22 bp, Homo sapiens
gatggggatgagaagtgagcag

SEQ ID NO: 7209251 - DNA, 22 bp, Homo sapiens
gatggggatgagaagtgagcag

SEQ ID NO: 7209252 - DNA, 22 bp, Homo sapiens
gatggggatgagaagtgagcag

SEQ ID NO: 7209253 - DNA, 22 bp, Homo sapiens
gatggggatgagaagtgagcag

SEQ ID NO: 7209254 - DNA, 22 bp, Homo sapiens
gatggggatgagaagtgagcag

SEQ ID NO: 7209255 - DNA, 22 bp, Homo sapiens
gatgggtggtctcagacttgcc

SEQ ID NO: 7209256 - DNA, 21 bp, Homo sapiens
gatggtagcctcatagaagta

SEQ ID NO: 7209257 - DNA, 22 bp, Homo sapiens
gatgggtggtctcagacttgcc

SEQ ID NO: 7209258 - DNA, 22 bp, Homo sapiens
gatggtctttgtctctgataag

SEQ ID NO: 7209259 - DNA, 22 bp, Homo sapiens
gatgggtgccccagacaagctg

SEQ ID NO: 7209260 - DNA, 22 bp, Homo sapiens
gatgggtgccccagacaagctg

SEQ ID NO: 7209261 - DNA, 22 bp, Homo sapiens
gatggggttttgccaggctggt

SEQ ID NO: 7209262 - DNA, 22 bp, Homo sapiens
gatgggtagaagtggaagaggt

SEQ ID NO: 7209263 - DNA, 22 bp, Homo sapiens
gatggtggcaagagccaagtct

SEQ ID NO: 7209264 - DNA, 22 bp, Homo sapiens
gatggtggagtaacattgccta

SEQ ID NO: 7209265 - DNA, 22 bp, Homo sapiens
gatggtggcaagagccaagtct

SEQ ID NO: 7209266 - DNA, 22 bp, Homo sapiens
gatggtgtcccaggctcaggct

SEQ ID NO: 7209267 - DNA, 22 bp, Homo sapiens
gatggtgcaattatcgtgcatg

SEQ ID NO: 7209268 - DNA, 22 bp, Homo sapiens
gatggtgcaggtgaagtgctgg

SEQ ID NO: 7209269 - DNA, 22 bp, Homo sapiens
gatgtaaaaactcctttcgaaa

SEQ ID NO: 7209270 - DNA, 22 bp, Homo sapiens
gatgtaaatggtctttggcaga

SEQ ID NO: 7209271 - DNA, 22 bp, Homo sapiens
gatgtacaaagagaggatttca

SEQ ID NO: 7209272 - DNA, 22 bp, Homo sapiens
gatgtacaagattgtaggaatg

SEQ ID NO: 7209273 - DNA, 22 bp, Homo sapiens
gatgtacaagtaaaatatgtgt

SEQ ID NO: 7209274 - DNA, 22 bp, Homo sapiens
gatgtacaatgtcactatgacc

SEQ ID NO: 7209275 - DNA, 22 bp, Homo sapiens
gatgtacaatgtcactatgacc

SEQ ID NO: 7209276 - DNA, 22 bp, Homo sapiens
gatgtacaatgtcactatgacc

SEQ ID NO: 7209277 - DNA, 22 bp, Homo sapiens
gatgtagacacttggaggctta

SEQ ID NO: 7209278 - DNA, 22 bp, Homo sapiens
gatgtacaggagtttttcaagg

SEQ ID NO: 7209279 - DNA, 21 bp, Homo sapiens
gatgtacatcaagcactttgc

SEQ ID NO: 7209280 - DNA, 22 bp, Homo sapiens
gatgtacatgcaagcacttaga

SEQ ID NO: 7209281 - DNA, 22 bp, Homo sapiens
gatgtacatggattcctttcct

SEQ ID NO: 7209282 - DNA, 22 bp, Homo sapiens
gatgtacatggattcctttcct

SEQ ID NO: 7209283 - DNA, 22 bp, Homo sapiens
gatgtatagctttaactgaccc

SEQ ID NO: 7209284 - DNA, 22 bp, Homo sapiens
gatgtatagggccatgacacca

SEQ ID NO: 7209285 - DNA, 22 bp, Homo sapiens
gatgtatctgagctgcttaggt

SEQ ID NO: 7209286 - DNA, 22 bp, Homo sapiens
gatgtcatcaggctaagacact

SEQ ID NO: 7209287 - DNA, 22 bp, Homo sapiens
gatgtcctatttccatactgta

SEQ ID NO: 7209288 - DNA, 17 bp, Homo sapiens
gatgtcctctggactac

SEQ ID NO: 7209289 - DNA, 22 bp, Homo sapiens
gatgtcctgcagaaacatgaga

SEQ ID NO: 7209290 - DNA, 22 bp, Homo sapiens
gatgtcctttgagggtatctgt

SEQ ID NO: 7209291 - DNA, 19 bp, Homo sapiens
gatgtctcctttcattgag

SEQ ID NO: 7209292 - DNA, 18 bp, Homo sapiens
gatgtctcgaggagacta

SEQ ID NO: 7209293 - DNA, 22 bp, Homo sapiens
gatgtcttaagcccagaagttc

SEQ ID NO: 7209294 - DNA, 22 bp, Homo sapiens
gatgtcttactaactagccttt

SEQ ID NO: 7209295 - DNA, 22 bp, Homo sapiens
gatgtcttaagcccagaagttc

SEQ ID NO: 7209296 - DNA, 22 bp, Homo sapiens
gatgtcttaggtaacattctat

SEQ ID NO: 7209297 - DNA, 22 bp, Homo sapiens
gatgtgtccccagaggattgaa

SEQ ID NO: 7209298 - DNA, 22 bp, Homo sapiens
gatgtgtccccagaggattgaa

SEQ ID NO: 7209299 - DNA, 22 bp, Homo sapiens
gatgtgtccctttcaactcaga

SEQ ID NO: 7209300 - DNA, 22 bp, Homo sapiens
gatgtgtcctagtacgggtggg

SEQ ID NO: 7209301 - DNA, 22 bp, Homo sapiens
gatgtgtccctttcaactcaga

SEQ ID NO: 7209302 - DNA, 22 bp, Homo sapiens
gatgtgtcctagtacgggtggg

SEQ ID NO: 7209303 - DNA, 20 bp, Homo sapiens
gatgtgtcctcagcagtggt

SEQ ID NO: 7209304 - DNA, 20 bp, Homo sapiens
gatgtgtcctcagcagtggt

SEQ ID NO: 7209305 - DNA, 22 bp, Homo sapiens
gatgtgtccttttctccatcca

SEQ ID NO: 7209306 - DNA, 22 bp, Homo sapiens
gatgtgtctattcaacatgaaa

SEQ ID NO: 7209307 - DNA, 22 bp, Homo sapiens
gatgtgtccttttctccatcca

SEQ ID NO: 7209308 - DNA, 22 bp, Homo sapiens
gatgtgtctattcaacatgaaa

SEQ ID NO: 7209309 - DNA, 22 bp, Homo sapiens
gatgtgtctccatacaccaccc

SEQ ID NO: 7209310 - DNA, 22 bp, Homo sapiens
gatgtgtctccgtttcaaggca

SEQ ID NO: 7209311 - DNA, 22 bp, Homo sapiens
gatgtgtctccatacaccaccc

SEQ ID NO: 7209312 - DNA, 22 bp, Homo sapiens
gatgtgtctccgtttcaaggca

SEQ ID NO: 7209313 - DNA, 22 bp, Homo sapiens
gatgtgtctggctcccctgcaa

SEQ ID NO: 7209314 - DNA, 22 bp, Homo sapiens
gatgtgtctggctcccctgcaa

SEQ ID NO: 7209315 - DNA, 22 bp, Homo sapiens
gatgtgtgctgcatagtatatt

SEQ ID NO: 7209316 - DNA, 22 bp, Homo sapiens
gatgtgtgcttttcgcagtgtc

SEQ ID NO: 7209317 - DNA, 22 bp, Homo sapiens
gatggcccagtcttgggacagt

SEQ ID NO: 7209318 - DNA, 22 bp, Homo sapiens
gatggaggagatggcagggtgc

SEQ ID NO: 7209319 - DNA, 22 bp, Homo sapiens
gatggaggaaaagttggaatgc

SEQ ID NO: 7209320 - DNA, 22 bp, Homo sapiens
gatggaggagatggcagggtgc

SEQ ID NO: 7209321 - DNA, 22 bp, Homo sapiens
gatggaggagatggcagggtgc

SEQ ID NO: 7209322 - DNA, 22 bp, Homo sapiens
gatggaggagatggcagggtgc

SEQ ID NO: 7209323 - DNA, 22 bp, Homo sapiens
gatggaggagatggcagggtgc

SEQ ID NO: 7209324 - DNA, 22 bp, Homo sapiens
gatggaggagatggcagggtgc

SEQ ID NO: 7209325 - DNA, 22 bp, Homo sapiens
gatggaatgtcacttctgtggt

SEQ ID NO: 7209326 - DNA, 22 bp, Homo sapiens
gatggacacctcctgaggttct

SEQ ID NO: 7209327 - DNA, 22 bp, Homo sapiens
gatggaatgtcacttctgtggt

SEQ ID NO: 7209328 - DNA, 22 bp, Homo sapiens
gatggcccgctagctggcctct

SEQ ID NO: 7209329 - DNA, 22 bp, Homo sapiens
gatggcccgctagctggcctct

SEQ ID NO: 7209330 - DNA, 22 bp, Homo sapiens
gatggcctcagtgcccaaagga

SEQ ID NO: 7209331 - DNA, 22 bp, Homo sapiens
gatggcctcatggctgcaggcc

SEQ ID NO: 7209332 - DNA, 22 bp, Homo sapiens
gatggcctgggtccccttccgg

SEQ ID NO: 7209333 - DNA, 22 bp, Homo sapiens
gatggcctgtatttgggccaga

SEQ ID NO: 7209334 - DNA, 22 bp, Homo sapiens
gatggccttgttttctcccttc

SEQ ID NO: 7209335 - DNA, 22 bp, Homo sapiens
gatgggctgtctgagcgctgtg

SEQ ID NO: 7209336 - DNA, 22 bp, Homo sapiens
gatgggctgtctgagcgctgtg

SEQ ID NO: 7209337 - DNA, 22 bp, Homo sapiens
gatgggctggggagaaagcatg

SEQ ID NO: 7209338 - DNA, 22 bp, Homo sapiens
gatgggcacggcagtctgagag

SEQ ID NO: 7209339 - DNA, 18 bp, Homo sapiens
gatgggagcaagagaaga

SEQ ID NO: 7209340 - DNA, 18 bp, Homo sapiens
gatgggagcaagagaaga

SEQ ID NO: 7209341 - DNA, 22 bp, Homo sapiens
gatggcttccttctcactgtgt

SEQ ID NO: 7209342 - DNA, 22 bp, Homo sapiens
gatggcttgttttctggctgaa

SEQ ID NO: 7209343 - DNA, 22 bp, Homo sapiens
gatggctttgtgcaccatgatt

SEQ ID NO: 7209344 - DNA, 20 bp, Homo sapiens
gatgggaatcggagctggta

SEQ ID NO: 7209345 - DNA, 20 bp, Homo sapiens
gatgggaatcggagctggta

SEQ ID NO: 7209346 - DNA, 18 bp, Homo sapiens
gatgggagcaagagaaga

SEQ ID NO: 7209347 - DNA, 22 bp, Homo sapiens
gatgcctgtggtgagcacacat

SEQ ID NO: 7209348 - DNA, 22 bp, Homo sapiens
gatgcctgtggtgagcacacat

SEQ ID NO: 7209349 - DNA, 22 bp, Homo sapiens
gatgcctggcacccagcaagga

SEQ ID NO: 7209350 - DNA, 22 bp, Homo sapiens
gatgcctggcacccagcaagga

SEQ ID NO: 7209351 - DNA, 22 bp, Homo sapiens
gatgcattacaaaagtgattat

SEQ ID NO: 7209352 - DNA, 20 bp, Homo sapiens
gatgcattagatgcagggta

SEQ ID NO: 7209353 - DNA, 22 bp, Homo sapiens
gatgcattcgggatgtttactt

SEQ ID NO: 7209354 - DNA, 22 bp, Homo sapiens
gatgcattgcatcgagtagctt

SEQ ID NO: 7209355 - DNA, 22 bp, Homo sapiens
gatgccctgcatgagtcctgct

SEQ ID NO: 7209356 - DNA, 22 bp, Homo sapiens
gatgcctccaaatgagggcaga

SEQ ID NO: 7209357 - DNA, 22 bp, Homo sapiens
gatgcgggcccgctccactgcc

SEQ ID NO: 7209358 - DNA, 22 bp, Homo sapiens
gatgcgggcccgctccactgcc

SEQ ID NO: 7209359 - DNA, 22 bp, Homo sapiens
gatgcgggcccgctccactgcc

SEQ ID NO: 7209360 - DNA, 22 bp, Homo sapiens
gatgctaaaataattattttga

SEQ ID NO: 7209361 - DNA, 18 bp, Homo sapiens
gatggaaagtgtatgagt

SEQ ID NO: 7209362 - DNA, 22 bp, Homo sapiens
gatggaagaaaaatgcatgtct

SEQ ID NO: 7209363 - DNA, 22 bp, Homo sapiens
gatggaagaaaaatgcatgtct

SEQ ID NO: 7209364 - DNA, 22 bp, Homo sapiens
gatgctgtgctatgtctacaga

SEQ ID NO: 7209365 - DNA, 22 bp, Homo sapiens
gatgcttaagatgttggtggca

SEQ ID NO: 7209366 - DNA, 22 bp, Homo sapiens
gatgcttacatagcccaagtgt

SEQ ID NO: 7209367 - DNA, 22 bp, Homo sapiens
gatgctttccaagaaatcctca

SEQ ID NO: 7209368 - DNA, 22 bp, Homo sapiens
gatgctgggaccacagagtgtt

SEQ ID NO: 7209369 - DNA, 22 bp, Homo sapiens
gatgctgataattcatgagaag

SEQ ID NO: 7209370 - DNA, 22 bp, Homo sapiens
gcagaaggatccgcaggtgcaa

SEQ ID NO: 7209371 - DNA, 22 bp, Homo sapiens
gcagagcagtgcttgcccagcg

SEQ ID NO: 7209372 - DNA, 22 bp, Homo sapiens
gcagaaggatccgcaggtgcaa

SEQ ID NO: 7209373 - DNA, 22 bp, Homo sapiens
gcagaagctgttcgaaggccgc

SEQ ID NO: 7209374 - DNA, 22 bp, Homo sapiens
gcagaagctgttcgaaggccgc

SEQ ID NO: 7209375 - DNA, 22 bp, Homo sapiens
gcagaagctgggcagcgaggtg

SEQ ID NO: 7209376 - DNA, 22 bp, Homo sapiens
gcagaagctgggcagcgaggtg

SEQ ID NO: 7209377 - DNA, 22 bp, Homo sapiens
gcagaagctgggcagcgaggtg

SEQ ID NO: 7209378 - DNA, 22 bp, Homo sapiens
gcagagcatttcggttgcttcc

SEQ ID NO: 7209379 - DNA, 22 bp, Homo sapiens
gcagagccagaatggccaggac

SEQ ID NO: 7209380 - DNA, 22 bp, Homo sapiens
gcagagccagaatggccaggac

SEQ ID NO: 7209381 - DNA, 22 bp, Homo sapiens
gcagagcatgtcctcaggacag

SEQ ID NO: 7209382 - DNA, 22 bp, Homo sapiens
gcagagcagtgcttgcccagcg

SEQ ID NO: 7209383 - DNA, 22 bp, Homo sapiens
gcagagcccctcaagccagcct

SEQ ID NO: 7209384 - DNA, 22 bp, Homo sapiens
gcagagccaggctggggcaggt

SEQ ID NO: 7209385 - DNA, 22 bp, Homo sapiens
gcagagccaggctggggcaggt

SEQ ID NO: 7209386 - DNA, 22 bp, Homo sapiens
gcagagccccattgctggcggg

SEQ ID NO: 7209387 - DNA, 22 bp, Homo sapiens
gcagagccccattgctggcggg

SEQ ID NO: 7209388 - DNA, 22 bp, Homo sapiens
gcagagccccattgctggcggg

SEQ ID NO: 7209389 - DNA, 22 bp, Homo sapiens
gcagagccaggagagacccttg

SEQ ID NO: 7209390 - DNA, 22 bp, Homo sapiens
gcagagccaggagcccaggatc

SEQ ID NO: 7209391 - DNA, 22 bp, Homo sapiens
gcagagccaggagcccaggatc

SEQ ID NO: 7209392 - DNA, 22 bp, Homo sapiens
gcagagccaggctggggcaggt

SEQ ID NO: 7209393 - DNA, 22 bp, Homo sapiens
gcagagccaggctggggcaggt

SEQ ID NO: 7209394 - DNA, 22 bp, Homo sapiens
gcagagccaggagagacccttg

SEQ ID NO: 7209395 - DNA, 22 bp, Homo sapiens
gcagagccaggagagacccttg

SEQ ID NO: 7209396 - DNA, 22 bp, Homo sapiens
gcagaagcccggtcagcgcacg

SEQ ID NO: 7209397 - DNA, 22 bp, Homo sapiens
gcagaagcagggcaggggcaaa

SEQ ID NO: 7209398 - DNA, 22 bp, Homo sapiens
gcagaagcagaggagcctatga

SEQ ID NO: 7209399 - DNA, 22 bp, Homo sapiens
gcagaagcagcagatgggcgca

SEQ ID NO: 7209400 - DNA, 22 bp, Homo sapiens
gcagaagcagggcaggggcaaa

SEQ ID NO: 7209401 - DNA, 22 bp, Homo sapiens
gcagaagcccggtcagcgcacg

SEQ ID NO: 7209402 - DNA, 22 bp, Homo sapiens
gcagaagctgggagaagggatt

SEQ ID NO: 7209403 - DNA, 22 bp, Homo sapiens
gcagaagctgggagaagggatt

SEQ ID NO: 7209404 - DNA, 22 bp, Homo sapiens
gcagaagctgggcagcgaggtg

SEQ ID NO: 7209405 - DNA, 22 bp, Homo sapiens
gcagaagaccatggtggaaaga

SEQ ID NO: 7209406 - DNA, 22 bp, Homo sapiens
gcagaagaccatggtggaaaga

SEQ ID NO: 7209407 - DNA, 22 bp, Homo sapiens
gcagaacctgaattgaacattg

SEQ ID NO: 7209408 - DNA, 22 bp, Homo sapiens
gcagaagaccatggtggaaaga

SEQ ID NO: 7209409 - DNA, 22 bp, Homo sapiens
gcagaagcacaggtgacgggcc

SEQ ID NO: 7209410 - DNA, 22 bp, Homo sapiens
gcagaagcacaggtgacgggcc

SEQ ID NO: 7209411 - DNA, 22 bp, Homo sapiens
gcagaacatggaaagagaacta

SEQ ID NO: 7209412 - DNA, 22 bp, Homo sapiens
gcagaacatttcacagtatctt

SEQ ID NO: 7209413 - DNA, 22 bp, Homo sapiens
gcagaacatttcacagtatctt

SEQ ID NO: 7209414 - DNA, 21 bp, Homo sapiens
gcagaaaggaatcttaggtcc

SEQ ID NO: 7209415 - DNA, 21 bp, Homo sapiens
gcagaaaggaatcttaggtcc

SEQ ID NO: 7209416 - DNA, 22 bp, Homo sapiens
gcagaaatatgatgcataaagg

SEQ ID NO: 7209417 - DNA, 22 bp, Homo sapiens
gcagaaatatgatgcataaagg

SEQ ID NO: 7209418 - DNA, 22 bp, Homo sapiens
gcagaaatatgatgcataaagg

SEQ ID NO: 7209419 - DNA, 23 bp, Homo sapiens
gcagaaattctcacactgaggcc

SEQ ID NO: 7209420 - DNA, 22 bp, Homo sapiens
gcagaacaacgtaggagtggag

SEQ ID NO: 7209421 - DNA, 22 bp, Homo sapiens
gcagaaagcttagagggtttgc

SEQ ID NO: 7209422 - DNA, 22 bp, Homo sapiens
gcagaaagctccttgcgatctg

SEQ ID NO: 7209423 - DNA, 22 bp, Homo sapiens
gcagaaagcttagagggtttgc

SEQ ID NO: 7209424 - DNA, 22 bp, Homo sapiens
gcagaaagctccttgcgatctg

SEQ ID NO: 7209425 - DNA, 22 bp, Homo sapiens
gcagaaacttggagaagccagg

SEQ ID NO: 7209426 - DNA, 22 bp, Homo sapiens
gcacttttcaaagcttcctgtg

SEQ ID NO: 7209427 - DNA, 22 bp, Homo sapiens
gcacttttcaaagcttcctgtg

SEQ ID NO: 7209428 - DNA, 17 bp, Homo sapiens
gcagaaaagtcaaggga

SEQ ID NO: 7209429 - DNA, 23 bp, Homo sapiens
gcacttttataggtggggaaaca

SEQ ID NO: 7209430 - DNA, 23 bp, Homo sapiens
gcacttttataggtggggaaaca

SEQ ID NO: 7209431 - DNA, 23 bp, Homo sapiens
gcacttttataggtggggaaaca

SEQ ID NO: 7209432 - DNA, 17 bp, Homo sapiens
gcagaaaagtcaaggga

SEQ ID NO: 7209433 - DNA, 17 bp, Homo sapiens
gcagaaaagtcaaggga

SEQ ID NO: 7209434 - DNA, 22 bp, Homo sapiens
gcagaaacaggagaaagggatc

SEQ ID NO: 7209435 - DNA, 22 bp, Homo sapiens
gcacctggacagtgaccctagc

SEQ ID NO: 7209436 - DNA, 22 bp, Homo sapiens
gcacctggacagtgaccctagc

SEQ ID NO: 7209437 - DNA, 22 bp, Homo sapiens
gcacctgctggggctgatgaga

SEQ ID NO: 7209438 - DNA, 22 bp, Homo sapiens
gcacctggctgcccaggtggag

SEQ ID NO: 7209439 - DNA, 22 bp, Homo sapiens
gcacctggctgcccaggtggag

SEQ ID NO: 7209440 - DNA, 22 bp, Homo sapiens
gcacctggctgcccaggtggag

SEQ ID NO: 7209441 - DNA, 22 bp, Homo sapiens
gcacttggcctttatctgggga

SEQ ID NO: 7209442 - DNA, 20 bp, Homo sapiens
gcacttggctgctgcttctc

SEQ ID NO: 7209443 - DNA, 22 bp, Homo sapiens
gcacttgggcagagacgcacag

SEQ ID NO: 7209444 - DNA, 22 bp, Homo sapiens
gcacttggtaggacttcagtga

SEQ ID NO: 7209445 - DNA, 22 bp, Homo sapiens
gcacctgcaggatgagccaggg

SEQ ID NO: 7209446 - DNA, 22 bp, Homo sapiens
gcacctgcaggatgagccaggg

SEQ ID NO: 7209447 - DNA, 22 bp, Homo sapiens
gcacctgcctgggactgaagat

SEQ ID NO: 7209448 - DNA, 22 bp, Homo sapiens
gcacctgctcacacatgtgact

SEQ ID NO: 7209449 - DNA, 22 bp, Homo sapiens
gcacctgctggaatcagtctgt

SEQ ID NO: 7209450 - DNA, 22 bp, Homo sapiens
gcacctccaggggccgcccacc

SEQ ID NO: 7209451 - DNA, 22 bp, Homo sapiens
gcacctccaggggccgcccacc

SEQ ID NO: 7209452 - DNA, 22 bp, Homo sapiens
gcacctgagcaactatacattg

SEQ ID NO: 7209453 - DNA, 22 bp, Homo sapiens
gcaccgccttggaccgcccgct

SEQ ID NO: 7209454 - DNA, 22 bp, Homo sapiens
gcaccctgctctatccttgcta

SEQ ID NO: 7209455 - DNA, 19 bp, Homo sapiens
gcaccccatcttcctcctg

SEQ ID NO: 7209456 - DNA, 22 bp, Homo sapiens
gcacccctgcgtgccttccctt

SEQ ID NO: 7209457 - DNA, 22 bp, Homo sapiens
gcacccctggacggtagggcca

SEQ ID NO: 7209458 - DNA, 22 bp, Homo sapiens
gcaccctagagttgcctgagga

SEQ ID NO: 7209459 - DNA, 19 bp, Homo sapiens
gcaccctgaggtcatggcc

SEQ ID NO: 7209460 - DNA, 22 bp, Homo sapiens
gcaccctagagttgcctgagga

SEQ ID NO: 7209461 - DNA, 22 bp, Homo sapiens
gcacacactgttttcctcacat

SEQ ID NO: 7209462 - DNA, 22 bp, Homo sapiens
gcacccaggcactttcctttct

SEQ ID NO: 7209463 - DNA, 22 bp, Homo sapiens
gcacccaggcactttcctttct

SEQ ID NO: 7209464 - DNA, 22 bp, Homo sapiens
gcacacacatgtgagtacatgc

SEQ ID NO: 7209465 - DNA, 22 bp, Homo sapiens
gcacacactgttttcctcacat

SEQ ID NO: 7209466 - DNA, 16 bp, Homo sapiens
gcacacacatcaatga

SEQ ID NO: 7209467 - DNA, 16 bp, Homo sapiens
gcacacacatcaatga

SEQ ID NO: 7209468 - DNA, 16 bp, Homo sapiens
gcacacacatcaatga

SEQ ID NO: 7209469 - DNA, 22 bp, Homo sapiens
gcacacacatgtgagtacatgc

SEQ ID NO: 7209470 - DNA, 22 bp, Homo sapiens
gcacaataacagccaaggttat

SEQ ID NO: 7209471 - DNA, 22 bp, Homo sapiens
gcacaataatttttttaagagg

SEQ ID NO: 7209472 - DNA, 22 bp, Homo sapiens
gcacccagggacttggctggcc

SEQ ID NO: 7209473 - DNA, 22 bp, Homo sapiens
gcacccaggcttgggcagcaac

SEQ ID NO: 7209474 - DNA, 22 bp, Homo sapiens
gcacccagggacttggctggcc

SEQ ID NO: 7209475 - DNA, 22 bp, Homo sapiens
gcacccagggacttggctggcc

SEQ ID NO: 7209476 - DNA, 22 bp, Homo sapiens
gcacccaggccggcgactgcag

SEQ ID NO: 7209477 - DNA, 22 bp, Homo sapiens
gcacccaggcttgggcagcaac

SEQ ID NO: 7209478 - DNA, 22 bp, Homo sapiens
gcacccaggcttgggcagcaac

SEQ ID NO: 7209479 - DNA, 22 bp, Homo sapiens
gcacccaggccggcgactgcag

SEQ ID NO: 7209480 - DNA, 22 bp, Homo sapiens
gcacccaggcttgggcagcaac

SEQ ID NO: 7209481 - DNA, 22 bp, Homo sapiens
gcacccaggcttgggcagcaac

SEQ ID NO: 7209482 - DNA, 22 bp, Homo sapiens
gcacccattgtgtgcagctctg

SEQ ID NO: 7209483 - DNA, 22 bp, Homo sapiens
gcacccatgctcttgtctcagg

SEQ ID NO: 7209484 - DNA, 22 bp, Homo sapiens
gcacccagtttgtctcagggtt

SEQ ID NO: 7209485 - DNA, 22 bp, Homo sapiens
gcacccagtttgtctcagggtt

SEQ ID NO: 7209486 - DNA, 22 bp, Homo sapiens
gcacccagggcaggaagtgagg

SEQ ID NO: 7209487 - DNA, 22 bp, Homo sapiens
gcacccagggacttggctggcc

SEQ ID NO: 7209488 - DNA, 22 bp, Homo sapiens
gcacccagggcaggaagtgagg

SEQ ID NO: 7209489 - DNA, 22 bp, Homo sapiens
gcacccagtgggatgcttagca

SEQ ID NO: 7209490 - DNA, 22 bp, Homo sapiens
gcacccagtgggatgcttagca

SEQ ID NO: 7209491 - DNA, 22 bp, Homo sapiens
gcacccagtttgtctcagggtt

SEQ ID NO: 7209492 - DNA, 22 bp, Homo sapiens
gatttggcctttcgcatggtat

SEQ ID NO: 7209493 - DNA, 22 bp, Homo sapiens
gatttgtagcttttcagtctgt

SEQ ID NO: 7209494 - DNA, 22 bp, Homo sapiens
gatttgtagttttatgtgtcag

SEQ ID NO: 7209495 - DNA, 21 bp, Homo sapiens
gatttgtattattggttccaa

SEQ ID NO: 7209496 - DNA, 22 bp, Homo sapiens
gatttcttggcccactctcaga

SEQ ID NO: 7209497 - DNA, 22 bp, Homo sapiens
gatttcttgataattcaaatcc

SEQ ID NO: 7209498 - DNA, 22 bp, Homo sapiens
gatttcttgataattcaaatcc

SEQ ID NO: 7209499 - DNA, 22 bp, Homo sapiens
gatttcttgagcaagttgctta

SEQ ID NO: 7209500 - DNA, 22 bp, Homo sapiens
gatttcttcattcattagatgg

SEQ ID NO: 7209501 - DNA, 22 bp, Homo sapiens
gatttcttgacccctgtctcag

SEQ ID NO: 7209502 - DNA, 22 bp, Homo sapiens
gatttcttcattcattagatgg

SEQ ID NO: 7209503 - DNA, 22 bp, Homo sapiens
gattttcattatagctagtttc

SEQ ID NO: 7209504 - DNA, 22 bp, Homo sapiens
gattttcatgataaacttgtga

SEQ ID NO: 7209505 - DNA, 22 bp, Homo sapiens
gattttcatgataaacttgtga

SEQ ID NO: 7209506 - DNA, 22 bp, Homo sapiens
gattttcatttgcactctagaa

SEQ ID NO: 7209507 - DNA, 22 bp, Homo sapiens
gattttctgagccttcaaattt

SEQ ID NO: 7209508 - DNA, 22 bp, Homo sapiens
gattttcattatagctagtttc

SEQ ID NO: 7209509 - DNA, 22 bp, Homo sapiens
gattttcattatagctagtttc

SEQ ID NO: 7209510 - DNA, 22 bp, Homo sapiens
gattttatatggcatactgtgg

SEQ ID NO: 7209511 - DNA, 22 bp, Homo sapiens
gattttatcgtcatccttctgg

SEQ ID NO: 7209512 - DNA, 22 bp, Homo sapiens
gattttatcgtcatccttctgg

SEQ ID NO: 7209513 - DNA, 22 bp, Homo sapiens
gattttatcgtcatccttctgg

SEQ ID NO: 7209514 - DNA, 22 bp, Homo sapiens
gattttatcgtcatccttctgg

SEQ ID NO: 7209515 - DNA, 22 bp, Homo sapiens
gattttatcgtcatccttctgg

SEQ ID NO: 7209516 - DNA, 22 bp, Homo sapiens
gattttatctttgtgtgcagta

SEQ ID NO: 7209517 - DNA, 22 bp, Homo sapiens
gattttatctttgtgtgcagta

SEQ ID NO: 7209518 - DNA, 22 bp, Homo sapiens
gattttatctttgtgtgcagta

SEQ ID NO: 7209519 - DNA, 22 bp, Homo sapiens
gattttattagcccaaactttg

SEQ ID NO: 7209520 - DNA, 22 bp, Homo sapiens
gattttattagcccaaactttg

SEQ ID NO: 7209521 - DNA, 22 bp, Homo sapiens
gattttatctttgtgtgcagta

SEQ ID NO: 7209522 - DNA, 22 bp, Homo sapiens
gattttatctttgtgtgcagta

SEQ ID NO: 7209523 - DNA, 22 bp, Homo sapiens
gattttattagcccaaactttg

SEQ ID NO: 7209524 - DNA, 22 bp, Homo sapiens
gattttattagcccaaactttg

SEQ ID NO: 7209525 - DNA, 22 bp, Homo sapiens
gattttattagcccaaactttg

SEQ ID NO: 7209526 - DNA, 22 bp, Homo sapiens
gattttaattataggaggtcct

SEQ ID NO: 7209527 - DNA, 21 bp, Homo sapiens
gattttaaagagactgccaca

SEQ ID NO: 7209528 - DNA, 22 bp, Homo sapiens
gatttgtttcaagttagcatct

SEQ ID NO: 7209529 - DNA, 22 bp, Homo sapiens
gatttgtttcaagttagcatct

SEQ ID NO: 7209530 - DNA, 22 bp, Homo sapiens
gatttgtctatattcaaatatg

SEQ ID NO: 7209531 - DNA, 22 bp, Homo sapiens
gattttacaaactgcaggaccc

SEQ ID NO: 7209532 - DNA, 22 bp, Homo sapiens
gattttacatgtcatatctatt

SEQ ID NO: 7209533 - DNA, 22 bp, Homo sapiens
gattttacatgtcatatctatt

SEQ ID NO: 7209534 - DNA, 22 bp, Homo sapiens
gattttatagtcaggaaaaaga

SEQ ID NO: 7209535 - DNA, 22 bp, Homo sapiens
gattttatagtcaggaaaaaga

SEQ ID NO: 7209536 - DNA, 22 bp, Homo sapiens
gattttatagtcaggaaaaaga

SEQ ID NO: 7209537 - DNA, 22 bp, Homo sapiens
gattttactgtctgtgtatctc

SEQ ID NO: 7209538 - DNA, 22 bp, Homo sapiens
gattttatatggcatactgtgg

SEQ ID NO: 7209539 - DNA, 22 bp, Homo sapiens
gattttatatggcatactgtgg

SEQ ID NO: 7209540 - DNA, 22 bp, Homo sapiens
gattttatatggcatactgtgg

SEQ ID NO: 7209541 - DNA, 22 bp, Homo sapiens
gattttatagtcaggaaaaaga

SEQ ID NO: 7209542 - DNA, 22 bp, Homo sapiens
gattttatagtcaggaaaaaga

SEQ ID NO: 7209543 - DNA, 22 bp, Homo sapiens
gattttatatggcatactgtgg

SEQ ID NO: 7209544 - DNA, 22 bp, Homo sapiens
gattttctgagccttcaaattt

SEQ ID NO: 7209545 - DNA, 22 bp, Homo sapiens
gattttcttgggaaacaatgag

SEQ ID NO: 7209546 - DNA, 22 bp, Homo sapiens
gattttctgagccttcaaattt

SEQ ID NO: 7209547 - DNA, 22 bp, Homo sapiens
gatttttatataaagtgagaaa

SEQ ID NO: 7209548 - DNA, 22 bp, Homo sapiens
gattttgaatattaaagaagag

SEQ ID NO: 7209549 - DNA, 22 bp, Homo sapiens
gattttgaatattaaagaagag

SEQ ID NO: 7209550 - DNA, 22 bp, Homo sapiens
gcaaaaaatgcttgttgcttag

SEQ ID NO: 7209551 - DNA, 22 bp, Homo sapiens
gcaaaaaatgcttgttgcttag

SEQ ID NO: 7209552 - DNA, 22 bp, Homo sapiens
gcaaacataatatgaagacact

SEQ ID NO: 7209553 - DNA, 22 bp, Homo sapiens
gcaaacataatatgaagacact

SEQ ID NO: 7209554 - DNA, 22 bp, Homo sapiens
gcaaacatccactgcccttgta

SEQ ID NO: 7209555 - DNA, 22 bp, Homo sapiens
gcaaacatgttgtgagatacca

SEQ ID NO: 7209556 - DNA, 22 bp, Homo sapiens
gcaaacatgtgctcattttgtg

SEQ ID NO: 7209557 - DNA, 22 bp, Homo sapiens
gcaaacatgttgtgagatacca

SEQ ID NO: 7209558 - DNA, 22 bp, Homo sapiens
gcaaacatgttgtgagatacca

SEQ ID NO: 7209559 - DNA, 22 bp, Homo sapiens
gcaaacattcaggagtacagga

SEQ ID NO: 7209560 - DNA, 22 bp, Homo sapiens
gcaaacatcttagccatagagt

SEQ ID NO: 7209561 - DNA, 22 bp, Homo sapiens
gcaaacatcttagccatagagt

SEQ ID NO: 7209562 - DNA, 22 bp, Homo sapiens
gcaaacatctttatttggcaag

SEQ ID NO: 7209563 - DNA, 22 bp, Homo sapiens
gcaaacatgctgagaaataaga

SEQ ID NO: 7209564 - DNA, 22 bp, Homo sapiens
gcaaacatgctgagaaataaga

SEQ ID NO: 7209565 - DNA, 22 bp, Homo sapiens
gcaaacatgctgagaaataaga

SEQ ID NO: 7209566 - DNA, 22 bp, Homo sapiens
gcaaacatgctgagaaataaga

SEQ ID NO: 7209567 - DNA, 22 bp, Homo sapiens
gcaaactggcaaacctgtctgt

SEQ ID NO: 7209568 - DNA, 22 bp, Homo sapiens
gcaatagattatgatctacagt

SEQ ID NO: 7209569 - DNA, 22 bp, Homo sapiens
gcaaacattccacagaaggaag

SEQ ID NO: 7209570 - DNA, 18 bp, Homo sapiens
gcaaacattcttccagtc

SEQ ID NO: 7209571 - DNA, 22 bp, Homo sapiens
gcaaacatttggtctagtgtgt

SEQ ID NO: 7209572 - DNA, 22 bp, Homo sapiens
gcaaactgatttccaagtccgt

SEQ ID NO: 7209573 - DNA, 22 bp, Homo sapiens
gcaaactgcattctatagcttg

SEQ ID NO: 7209574 - DNA, 22 bp, Homo sapiens
gcaatgaggagtggtagggata

SEQ ID NO: 7209575 - DNA, 22 bp, Homo sapiens
gcaatgagcacccagagggcag

SEQ ID NO: 7209576 - DNA, 22 bp, Homo sapiens
gcaatgattgcattagaagatg

SEQ ID NO: 7209577 - DNA, 22 bp, Homo sapiens
gcaatgcaatctttattatatt

SEQ ID NO: 7209578 - DNA, 19 bp, Homo sapiens
gcaatccacccacctcagc

SEQ ID NO: 7209579 - DNA, 17 bp, Homo sapiens
gcaatctcagtctcctt

SEQ ID NO: 7209580 - DNA, 22 bp, Homo sapiens
gcaatatactttctggcagtga

SEQ ID NO: 7209581 - DNA, 20 bp, Homo sapiens
gcaattaatttttggttaca

SEQ ID NO: 7209582 - DNA, 22 bp, Homo sapiens
gcaatgcataacagagtgggcc

SEQ ID NO: 7209583 - DNA, 22 bp, Homo sapiens
gcaatgcatatgtgggtagcat

SEQ ID NO: 7209584 - DNA, 22 bp, Homo sapiens
gcaatgtctagtctgagggctt

SEQ ID NO: 7209585 - DNA, 22 bp, Homo sapiens
gcaatgtctgcaatgggtgtgg

SEQ ID NO: 7209586 - DNA, 22 bp, Homo sapiens
gcaatgtctgtgctaaaaactg

SEQ ID NO: 7209587 - DNA, 20 bp, Homo sapiens
gcaatgttggttcctgtcac

SEQ ID NO: 7209588 - DNA, 20 bp, Homo sapiens
gcaatgttggttcctgtcac

SEQ ID NO: 7209589 - DNA, 22 bp, Homo sapiens
gcaatgttgtgttggcattcta

SEQ ID NO: 7209590 - DNA, 22 bp, Homo sapiens
gcaatgtttttccttccatatt

SEQ ID NO: 7209591 - DNA, 22 bp, Homo sapiens
gcaattgctttagggaaaggta

SEQ ID NO: 7209592 - DNA, 22 bp, Homo sapiens
gcaattgtactagaaaacaata

SEQ ID NO: 7209593 - DNA, 22 bp, Homo sapiens
gcacaaaacacattttgacaat

SEQ ID NO: 7209594 - DNA, 22 bp, Homo sapiens
gcacaaaacacattttgacaat

SEQ ID NO: 7209595 - DNA, 22 bp, Homo sapiens
gcacaaaacacattttgacaat

SEQ ID NO: 7209596 - DNA, 22 bp, Homo sapiens
gcacaaaaggtacttcatgtag

SEQ ID NO: 7209597 - DNA, 22 bp, Homo sapiens
gcacaaaaggtacttcatgtag

SEQ ID NO: 7209598 - DNA, 22 bp, Homo sapiens
gcacaaactgcaattacttttg

SEQ ID NO: 7209599 - DNA, 22 bp, Homo sapiens
gcacaaagatgaatacagaatg

SEQ ID NO: 7209600 - DNA, 22 bp, Homo sapiens
gcacaaagatgaatacagaatg

SEQ ID NO: 7209601 - DNA, 22 bp, Homo sapiens
gcacaaaggtggaaggaggaag

SEQ ID NO: 7209602 - DNA, 22 bp, Homo sapiens
gcacaaaggtggaaggaggaag

SEQ ID NO: 7209603 - DNA, 22 bp, Homo sapiens
gcacaaatacaaagttgagaaa

SEQ ID NO: 7209604 - DNA, 22 bp, Homo sapiens
gcacaacaccaagggaggtatc

SEQ ID NO: 7209605 - DNA, 22 bp, Homo sapiens
gcacaagaaatcatggactgaa

SEQ ID NO: 7209606 - DNA, 22 bp, Homo sapiens
gcacaagaataaccatatttaa

SEQ ID NO: 7209607 - DNA, 23 bp, Homo sapiens
gcacaagacctggcagcttccat

SEQ ID NO: 7209608 - DNA, 22 bp, Homo sapiens
gcacaagcacgagcagcgtgcg

SEQ ID NO: 7209609 - DNA, 22 bp, Homo sapiens
gcacaagcacgagcagcgtgcg

SEQ ID NO: 7209610 - DNA, 22 bp, Homo sapiens
gcacaagcagcccactgacatt

SEQ ID NO: 7209611 - DNA, 22 bp, Homo sapiens
gcacaaggagaattcattagtg

SEQ ID NO: 7209612 - DNA, 22 bp, Homo sapiens
gcacaaggagaattcattagtg

SEQ ID NO: 7209613 - DNA, 22 bp, Homo sapiens
gcacaagggtggtctctggagc

SEQ ID NO: 7209614 - DNA, 22 bp, Homo sapiens
gaggtccaacacaatgggtgtt

SEQ ID NO: 7209615 - DNA, 22 bp, Homo sapiens
gaggtcattacactttgtttgt

SEQ ID NO: 7209616 - DNA, 22 bp, Homo sapiens
gaggtcattacactttgtttgt

SEQ ID NO: 7209617 - DNA, 22 bp, Homo sapiens
gaggtccaacacaatgggtgtt

SEQ ID NO: 7209618 - DNA, 22 bp, Homo sapiens
gaggtccaacacaatgggtgtt

SEQ ID NO: 7209619 - DNA, 22 bp, Homo sapiens
gaggtccactgaggcaacaggg

SEQ ID NO: 7209620 - DNA, 22 bp, Homo sapiens
gaggtcaggcttgcagcagggt

SEQ ID NO: 7209621 - DNA, 22 bp, Homo sapiens
gaggtcaggcttgcagcagggt

SEQ ID NO: 7209622 - DNA, 22 bp, Homo sapiens
gaggtcaggctcaagctgggcc

SEQ ID NO: 7209623 - DNA, 22 bp, Homo sapiens
gaggtcaggcttgcagcagggt

SEQ ID NO: 7209624 - DNA, 22 bp, Homo sapiens
gaggtcaggcttgcagcagggt

SEQ ID NO: 7209625 - DNA, 22 bp, Homo sapiens
gaggtcaggggagaggctgatg

SEQ ID NO: 7209626 - DNA, 22 bp, Homo sapiens
gaggtcaggggagaggctgatg

SEQ ID NO: 7209627 - DNA, 22 bp, Homo sapiens
gaggtccagccaagcggcaagg

SEQ ID NO: 7209628 - DNA, 22 bp, Homo sapiens
gaggtccagagcaggttcagtg

SEQ ID NO: 7209629 - DNA, 22 bp, Homo sapiens
gaggtgggagggcagtccctaa

SEQ ID NO: 7209630 - DNA, 22 bp, Homo sapiens
gaggtgggagggcagtccctaa

SEQ ID NO: 7209631 - DNA, 22 bp, Homo sapiens
gaggtccagggtggggcctgag

SEQ ID NO: 7209632 - DNA, 22 bp, Homo sapiens
gaggtccagggtggggcctgag

SEQ ID NO: 7209633 - DNA, 22 bp, Homo sapiens
gaggtgggcggatcacaaggtc

SEQ ID NO: 7209634 - DNA, 22 bp, Homo sapiens
gaggtgggcggatcacaaggtc

SEQ ID NO: 7209635 - DNA, 22 bp, Homo sapiens
gaggtgggcggatcacaaggtc

SEQ ID NO: 7209636 - DNA, 22 bp, Homo sapiens
gaggtgggcggatcacaaggtc

SEQ ID NO: 7209637 - DNA, 22 bp, Homo sapiens
gaggtgggatgtgtgtgctact

SEQ ID NO: 7209638 - DNA, 22 bp, Homo sapiens
gaggtgggatgtgtgtgctact

SEQ ID NO: 7209639 - DNA, 22 bp, Homo sapiens
gaggtgggatgtgtgtgctact

SEQ ID NO: 7209640 - DNA, 22 bp, Homo sapiens
gaggtgggatgtgtgtgctact

SEQ ID NO: 7209641 - DNA, 22 bp, Homo sapiens
gaggtgggcggatcacaaggtc

SEQ ID NO: 7209642 - DNA, 22 bp, Homo sapiens
gaggtgggcggatcacaaggtc

SEQ ID NO: 7209643 - DNA, 22 bp, Homo sapiens
gaggtgggatgtgtgtgctact

SEQ ID NO: 7209644 - DNA, 23 bp, Homo sapiens
gaggtcaaggctgcagtgattgc

SEQ ID NO: 7209645 - DNA, 22 bp, Homo sapiens
gaggtatcttagagagtgtaga

SEQ ID NO: 7209646 - DNA, 22 bp, Homo sapiens
gaggtatggatatctggagagg

SEQ ID NO: 7209647 - DNA, 23 bp, Homo sapiens
gaggtcaaggctgcagtgattgc

SEQ ID NO: 7209648 - DNA, 22 bp, Homo sapiens
gaggtcaaggtcaagagacaga

SEQ ID NO: 7209649 - DNA, 22 bp, Homo sapiens
gaggtcaataatatgtgcttta

SEQ ID NO: 7209650 - DNA, 22 bp, Homo sapiens
gaggtcaataatatgtgcttta

SEQ ID NO: 7209651 - DNA, 19 bp, Homo sapiens
gaggtcagcaagaagtatt

SEQ ID NO: 7209652 - DNA, 19 bp, Homo sapiens
gaggtcagcaagaagtatt

SEQ ID NO: 7209653 - DNA, 22 bp, Homo sapiens
gaggtcaggctcaagctgggcc

SEQ ID NO: 7209654 - DNA, 22 bp, Homo sapiens
gaggtaggtgtaggaggcctgc

SEQ ID NO: 7209655 - DNA, 22 bp, Homo sapiens
gaggtaggtgtaggaggcctgc

SEQ ID NO: 7209656 - DNA, 22 bp, Homo sapiens
gaggtaggtgtaggaggcctgc

SEQ ID NO: 7209657 - DNA, 22 bp, Homo sapiens
gaggtaggtgtaggaggcctgc

SEQ ID NO: 7209658 - DNA, 22 bp, Homo sapiens
gaggtaggtgtaggaggcctgc

SEQ ID NO: 7209659 - DNA, 22 bp, Homo sapiens
gaggtagtaagcagagtggggt

SEQ ID NO: 7209660 - DNA, 22 bp, Homo sapiens
gaggtaacaactgaaatgagaa

SEQ ID NO: 7209661 - DNA, 22 bp, Homo sapiens
gaggtaacactgttcagtgggc

SEQ ID NO: 7209662 - DNA, 22 bp, Homo sapiens
gaggtaggtgtaggaggcctgc

SEQ ID NO: 7209663 - DNA, 22 bp, Homo sapiens
gaggtaggtgtaggaggcctgc

SEQ ID NO: 7209664 - DNA, 22 bp, Homo sapiens
gaggggcctggcactgagctgg

SEQ ID NO: 7209665 - DNA, 22 bp, Homo sapiens
gaggggcctggcgaggacatgt

SEQ ID NO: 7209666 - DNA, 22 bp, Homo sapiens
gaggggcctggcgaggacatgt

SEQ ID NO: 7209667 - DNA, 22 bp, Homo sapiens
gaggggcctggcactgagctgg

SEQ ID NO: 7209668 - DNA, 22 bp, Homo sapiens
gaggggcctggcgaggacatgt

SEQ ID NO: 7209669 - DNA, 22 bp, Homo sapiens
gaggggcctggcgaggacatgt

SEQ ID NO: 7209670 - DNA, 22 bp, Homo sapiens
gaggggcctggcgaggacatgt

SEQ ID NO: 7209671 - DNA, 22 bp, Homo sapiens
gaggggcctggcgaggacatgt

SEQ ID NO: 7209672 - DNA, 22 bp, Homo sapiens
gaggggcgctgtcgggtcacct

SEQ ID NO: 7209673 - DNA, 22 bp, Homo sapiens
gaggggcagttgattgtgctat

SEQ ID NO: 7209674 - DNA, 22 bp, Homo sapiens
gaggggccggcatgtgcctctc

SEQ ID NO: 7209675 - DNA, 22 bp, Homo sapiens
gaggggccggcatgtgcctctc

SEQ ID NO: 7209676 - DNA, 22 bp, Homo sapiens
gaggggccggcatgtgcctctc

SEQ ID NO: 7209677 - DNA, 22 bp, Homo sapiens
gaggggcctggcactgagctgg

SEQ ID NO: 7209678 - DNA, 22 bp, Homo sapiens
gaggggcgtcctgagtgggcct

SEQ ID NO: 7209679 - DNA, 22 bp, Homo sapiens
gaggggcgtcctgagtgggcct

SEQ ID NO: 7209680 - DNA, 22 bp, Homo sapiens
gaggggcgtcctgagtgggcct

SEQ ID NO: 7209681 - DNA, 22 bp, Homo sapiens
gaggggcgtcctgagtgggcct

SEQ ID NO: 7209682 - DNA, 22 bp, Homo sapiens
gaggggctcttgggcatgaagg

SEQ ID NO: 7209683 - DNA, 22 bp, Homo sapiens
gaggggctcttgggcatgaagg

SEQ ID NO: 7209684 - DNA, 22 bp, Homo sapiens
gagggtgtctgcgtaactggca

SEQ ID NO: 7209685 - DNA, 22 bp, Homo sapiens
gagggtgtgaacactggctgtg

SEQ ID NO: 7209686 - DNA, 22 bp, Homo sapiens
gagggtgtgaacactggctgtg

SEQ ID NO: 7209687 - DNA, 22 bp, Homo sapiens
gagggtgtctggatgctagact

SEQ ID NO: 7209688 - DNA, 22 bp, Homo sapiens
gagggtgtgaacactggctgtg

SEQ ID NO: 7209689 - DNA, 22 bp, Homo sapiens
gagggttggtgcaaatgggatg

SEQ ID NO: 7209690 - DNA, 22 bp, Homo sapiens
gaggtgtcccgcagtccccaag

SEQ ID NO: 7209691 - DNA, 22 bp, Homo sapiens
gaggtgtccctgaccctttgca

SEQ ID NO: 7209692 - DNA, 22 bp, Homo sapiens
gaggtgtcctagaagtattcag

SEQ ID NO: 7209693 - DNA, 22 bp, Homo sapiens
gaggtgtcctagaagtattcag

SEQ ID NO: 7209694 - DNA, 22 bp, Homo sapiens
gaggtgtcatcaggcagctctg

SEQ ID NO: 7209695 - DNA, 22 bp, Homo sapiens
gaggtgtcatgagggcctgctc

SEQ ID NO: 7209696 - DNA, 22 bp, Homo sapiens
gaggtgtcatttagttaatcag

SEQ ID NO: 7209697 - DNA, 22 bp, Homo sapiens
gaggtgtcctcagccaactctg

SEQ ID NO: 7209698 - DNA, 22 bp, Homo sapiens
gaggtgtcctcagccaactctg

SEQ ID NO: 7209699 - DNA, 22 bp, Homo sapiens
gaggtgtcgtagattattctca

SEQ ID NO: 7209700 - DNA, 22 bp, Homo sapiens
gaggtgtctagatctaccagta

SEQ ID NO: 7209701 - DNA, 22 bp, Homo sapiens
gaggtgtctgagtggggacctg

SEQ ID NO: 7209702 - DNA, 22 bp, Homo sapiens
gaggtgtctgctgtgttcaaag

SEQ ID NO: 7209703 - DNA, 22 bp, Homo sapiens
gaggtgtctggcctttgtagga

SEQ ID NO: 7209704 - DNA, 22 bp, Homo sapiens
gagtcacaaagcctttcttatt

SEQ ID NO: 7209705 - DNA, 22 bp, Homo sapiens
gagtcacaaagcctttcttatt

SEQ ID NO: 7209706 - DNA, 20 bp, Homo sapiens
gagtcacagaagaagctgaa

SEQ ID NO: 7209707 - DNA, 22 bp, Homo sapiens
gagtcacattaatttaatttta

SEQ ID NO: 7209708 - DNA, 22 bp, Homo sapiens
gagtcacattaatttaatttta

SEQ ID NO: 7209709 - DNA, 22 bp, Homo sapiens
gaggtgggtgtatcacaggtca

SEQ ID NO: 7209710 - DNA, 22 bp, Homo sapiens
gaggtgggtgtatcacaggtca

SEQ ID NO: 7209711 - DNA, 22 bp, Homo sapiens
gaggtgggtgtatcacaggtca

SEQ ID NO: 7209712 - DNA, 22 bp, Homo sapiens
gaggtggggttttgttcttgaa

SEQ ID NO: 7209713 - DNA, 22 bp, Homo sapiens
gaggtggggttttgttcttgaa

SEQ ID NO: 7209714 - DNA, 19 bp, Homo sapiens
gaggtgggtccccgcagcc

SEQ ID NO: 7209715 - DNA, 19 bp, Homo sapiens
gaggtgggtccccgcagcc

SEQ ID NO: 7209716 - DNA, 19 bp, Homo sapiens
gaggtgggtccccgcagcc

SEQ ID NO: 7209717 - DNA, 19 bp, Homo sapiens
gaggtgggtccccgcagcc

SEQ ID NO: 7209718 - DNA, 22 bp, Homo sapiens
gaggtggttcaggtagagccca

SEQ ID NO: 7209719 - DNA, 22 bp, Homo sapiens
gaggtggtttgtggtgactcat

SEQ ID NO: 7209720 - DNA, 22 bp, Homo sapiens
gaggtggtttgtggtgactcat

SEQ ID NO: 7209721 - DNA, 22 bp, Homo sapiens
gaggtgtcactattttgcttat

SEQ ID NO: 7209722 - DNA, 22 bp, Homo sapiens
gaggtgtcagggtagtcatgat

SEQ ID NO: 7209723 - DNA, 22 bp, Homo sapiens
gaggtgtcagggtagtcatgat

SEQ ID NO: 7209724 - DNA, 22 bp, Homo sapiens
gaggtgggtgtatcacaggtca

SEQ ID NO: 7209725 - DNA, 22 bp, Homo sapiens
gaggtgggtgtatcacaggtca

SEQ ID NO: 7209726 - DNA, 22 bp, Homo sapiens
gaggtgggtgtatcacaggtca

SEQ ID NO: 7209727 - DNA, 22 bp, Homo sapiens
gaggtggtcgaggaggggtacc

SEQ ID NO: 7209728 - DNA, 22 bp, Homo sapiens
gaggtggtggtggaggcatagc

SEQ ID NO: 7209729 - DNA, 22 bp, Homo sapiens
gaggtggtggtggaggcatagc

SEQ ID NO: 7209730 - DNA, 22 bp, Homo sapiens
gaggtggtggtggaggcatagc

SEQ ID NO: 7209731 - DNA, 22 bp, Homo sapiens
gaggtggtggtggaggcatagc

SEQ ID NO: 7209732 - DNA, 22 bp, Homo sapiens
gagtcaggctagggtgacaggc

SEQ ID NO: 7209733 - DNA, 22 bp, Homo sapiens
gagtcaggctagggtgacaggc

SEQ ID NO: 7209734 - DNA, 22 bp, Homo sapiens
gagtcaggctagggtgacaggc

SEQ ID NO: 7209735 - DNA, 22 bp, Homo sapiens
gagtcaggctagaggtgagtct

SEQ ID NO: 7209736 - DNA, 22 bp, Homo sapiens
gagtcaggctagaggtgagtct

SEQ ID NO: 7209737 - DNA, 22 bp, Homo sapiens
gagtcaggctagaggtgagtct

SEQ ID NO: 7209738 - DNA, 22 bp, Homo sapiens
gagtcaggcatgaaggtaatta

SEQ ID NO: 7209739 - DNA, 22 bp, Homo sapiens
gagtcaggcactgctgctgctc

SEQ ID NO: 7209740 - DNA, 22 bp, Homo sapiens
gagtcaggagttatgctccacc

SEQ ID NO: 7209741 - DNA, 22 bp, Homo sapiens
gagtcaggatgcaaggggatgg

SEQ ID NO: 7209742 - DNA, 22 bp, Homo sapiens
gagtcaggatgcaaggggatgg

SEQ ID NO: 7209743 - DNA, 22 bp, Homo sapiens
gagtcagattgcagacagggct

SEQ ID NO: 7209744 - DNA, 22 bp, Homo sapiens
gagtcagattgcagacagggct

SEQ ID NO: 7209745 - DNA, 22 bp, Homo sapiens
gagtcatttgggggcttcttga

SEQ ID NO: 7209746 - DNA, 22 bp, Homo sapiens
gagtccaccacagctcaaagag

SEQ ID NO: 7209747 - DNA, 22 bp, Homo sapiens
gagtccacttaagtatctgcag

SEQ ID NO: 7209748 - DNA, 22 bp, Homo sapiens
gagtccagagattaagcacctc

SEQ ID NO: 7209749 - DNA, 22 bp, Homo sapiens
gagtcaggtccgtggacagtta

SEQ ID NO: 7209750 - DNA, 22 bp, Homo sapiens
gagtcaggtccgtggacagtta

SEQ ID NO: 7209751 - DNA, 22 bp, Homo sapiens
gagtcaggtttctgcctataga

SEQ ID NO: 7209752 - DNA, 22 bp, Homo sapiens
gagtcagtaatggatatgtcat

SEQ ID NO: 7209753 - DNA, 22 bp, Homo sapiens
gagtcattgcacactagctcag

SEQ ID NO: 7209754 - DNA, 22 bp, Homo sapiens
gagtcattgttggtccctcccc

SEQ ID NO: 7209755 - DNA, 22 bp, Homo sapiens
gagtcatttgggggcttcttga

SEQ ID NO: 7209756 - DNA, 22 bp, Homo sapiens
gagtccagttctttccagcagt

SEQ ID NO: 7209757 - DNA, 22 bp, Homo sapiens
gagtccagttgttcacagaggc

SEQ ID NO: 7209758 - DNA, 22 bp, Homo sapiens
gagtccagttgttcacagaggc

SEQ ID NO: 7209759 - DNA, 22 bp, Homo sapiens
gagtccattatatagttcagaa

SEQ ID NO: 7209760 - DNA, 22 bp, Homo sapiens
gagtcccaggatatgtgctgtt

SEQ ID NO: 7209761 - DNA, 22 bp, Homo sapiens
gaggggcacagtaaagggtccc

SEQ ID NO: 7209762 - DNA, 22 bp, Homo sapiens
gaggggcagaatgtgatcaggg

SEQ ID NO: 7209763 - DNA, 22 bp, Homo sapiens
gaggggcagaatgtgatcaggg

SEQ ID NO: 7209764 - DNA, 22 bp, Homo sapiens
gaggggcagaggtagagaacaa

SEQ ID NO: 7209765 - DNA, 22 bp, Homo sapiens
gaggggcacagtaaagggtccc

SEQ ID NO: 7209766 - DNA, 22 bp, Homo sapiens
gaggggcacagtaaagggtccc

SEQ ID NO: 7209767 - DNA, 22 bp, Homo sapiens
gaggggcacagtaaagggtccc

SEQ ID NO: 7209768 - DNA, 22 bp, Homo sapiens
gaggggcacagcagctgttgca

SEQ ID NO: 7209769 - DNA, 22 bp, Homo sapiens
gaggggcacagtaaagggtccc

SEQ ID NO: 7209770 - DNA, 22 bp, Homo sapiens
gaggggcaggattattgggatt

SEQ ID NO: 7209771 - DNA, 22 bp, Homo sapiens
gaggggcagaggtagagaacaa

SEQ ID NO: 7209772 - DNA, 22 bp, Homo sapiens
gaggggcagaggtagagaacaa

SEQ ID NO: 7209773 - DNA, 22 bp, Homo sapiens
gaggggccggcatgtgcctctc

SEQ ID NO: 7209774 - DNA, 22 bp, Homo sapiens
gaggggccggcatgtgcctctc

SEQ ID NO: 7209775 - DNA, 22 bp, Homo sapiens
gaggggcagttgattgtgctat

SEQ ID NO: 7209776 - DNA, 22 bp, Homo sapiens
gaggggcagtgcacccgggccc

SEQ ID NO: 7209777 - DNA, 22 bp, Homo sapiens
gaggggcaggattattgggatt

SEQ ID NO: 7209778 - DNA, 22 bp, Homo sapiens
gaggggcaggattattgggatt

SEQ ID NO: 7209779 - DNA, 22 bp, Homo sapiens
gaggggcaggattattgggatt

SEQ ID NO: 7209780 - DNA, 22 bp, Homo sapiens
gaggggcaatgagggaaagagt

SEQ ID NO: 7209781 - DNA, 22 bp, Homo sapiens
gaggggcaatgagggaaagagt

SEQ ID NO: 7209782 - DNA, 22 bp, Homo sapiens
gaggggcacagcagctgttgca

SEQ ID NO: 7209783 - DNA, 22 bp, Homo sapiens
gaggggcaatgagggaaagagt

SEQ ID NO: 7209784 - DNA, 22 bp, Homo sapiens
gaggggcaatgagggaaagagt

SEQ ID NO: 7209785 - DNA, 22 bp, Homo sapiens
gaggggcaatgagggaaagagt

SEQ ID NO: 7209786 - DNA, 22 bp, Homo sapiens
gaggggattggaaggaacaccc

SEQ ID NO: 7209787 - DNA, 22 bp, Homo sapiens
gaggggcaagaagttggcctct

SEQ ID NO: 7209788 - DNA, 22 bp, Homo sapiens
gaggggagtaaagtcatgttac

SEQ ID NO: 7209789 - DNA, 22 bp, Homo sapiens
gaggggagtgtcctccgggccc

SEQ ID NO: 7209790 - DNA, 22 bp, Homo sapiens
gaggggagtaaagtcatgttac

SEQ ID NO: 7209791 - DNA, 22 bp, Homo sapiens
gaggggagtaaagtcatgttac

SEQ ID NO: 7209792 - DNA, 22 bp, Homo sapiens
gaggggagtgtcctccgggccc

SEQ ID NO: 7209793 - DNA, 22 bp, Homo sapiens
gaggggagtgtcctccgggccc

SEQ ID NO: 7209794 - DNA, 22 bp, Homo sapiens
gaggggatgcagagaggcttat

SEQ ID NO: 7209795 - DNA, 22 bp, Homo sapiens
gaggggatgcagagaggcttat

SEQ ID NO: 7209796 - DNA, 22 bp, Homo sapiens
gaggggagtgtcctccgggccc

SEQ ID NO: 7209797 - DNA, 22 bp, Homo sapiens
gagggcagtagcctcgtaccct

SEQ ID NO: 7209798 - DNA, 22 bp, Homo sapiens
gagggcagtagcctcgtaccct

SEQ ID NO: 7209799 - DNA, 22 bp, Homo sapiens
gagggcagtagcctcgtaccct

SEQ ID NO: 7209800 - DNA, 22 bp, Homo sapiens
gagggcaggggtcttgcacggt

SEQ ID NO: 7209801 - DNA, 22 bp, Homo sapiens
gagggcagtagcctcgtaccct

SEQ ID NO: 7209802 - DNA, 22 bp, Homo sapiens
gagggcagtagcctcgtaccct

SEQ ID NO: 7209803 - DNA, 22 bp, Homo sapiens
gagggcagtgaattttgaagct

SEQ ID NO: 7209804 - DNA, 20 bp, Homo sapiens
gagggcaggcacccatttca

SEQ ID NO: 7209805 - DNA, 20 bp, Homo sapiens
gagggcaggcacccatttca

SEQ ID NO: 7209806 - DNA, 20 bp, Homo sapiens
gagggcaggcacccatttca

SEQ ID NO: 7209807 - DNA, 22 bp, Homo sapiens
gagggcagagtctaatgatgca

SEQ ID NO: 7209808 - DNA, 22 bp, Homo sapiens
gagggcaggggtcttgcacggt

SEQ ID NO: 7209809 - DNA, 22 bp, Homo sapiens
gagggcaggggtcttgcacggt

SEQ ID NO: 7209810 - DNA, 22 bp, Homo sapiens
gagggcaggggtcttgcacggt

SEQ ID NO: 7209811 - DNA, 22 bp, Homo sapiens
gagggccaaagagcaagagcct

SEQ ID NO: 7209812 - DNA, 22 bp, Homo sapiens
gagggccaaagagcaagagcct

SEQ ID NO: 7209813 - DNA, 22 bp, Homo sapiens
gagggccaaagagcaagagcct

SEQ ID NO: 7209814 - DNA, 22 bp, Homo sapiens
gagggccaactagcaccacttt

SEQ ID NO: 7209815 - DNA, 22 bp, Homo sapiens
gagggcagtgaattttgaagct

SEQ ID NO: 7209816 - DNA, 22 bp, Homo sapiens
gagggcagtgaattttgaagct

SEQ ID NO: 7209817 - DNA, 22 bp, Homo sapiens
gagggcatagttaaataggagg

SEQ ID NO: 7209818 - DNA, 22 bp, Homo sapiens
gagggcatctagagcctaatcc

SEQ ID NO: 7209819 - DNA, 22 bp, Homo sapiens
gagggcatctagagcctaatcc

SEQ ID NO: 7209820 - DNA, 22 bp, Homo sapiens
gaggggaagacttctggacagt

SEQ ID NO: 7209821 - DNA, 22 bp, Homo sapiens
gaggggaaagttctgcacaagg

SEQ ID NO: 7209822 - DNA, 22 bp, Homo sapiens
gaggggaaagttctgcacaagg

SEQ ID NO: 7209823 - DNA, 22 bp, Homo sapiens
gaggggaaagtgtgaggctgcg

SEQ ID NO: 7209824 - DNA, 22 bp, Homo sapiens
gaggggaaagtgtgaggctgcg

SEQ ID NO: 7209825 - DNA, 22 bp, Homo sapiens
gaggggaaagtgtgaggctgcg

SEQ ID NO: 7209826 - DNA, 22 bp, Homo sapiens
gaggggaaagtgtgaggctgcg

SEQ ID NO: 7209827 - DNA, 22 bp, Homo sapiens
gagggccaatggatttcaactg

SEQ ID NO: 7209828 - DNA, 22 bp, Homo sapiens
gagggccaatgtgtccctgagc

SEQ ID NO: 7209829 - DNA, 22 bp, Homo sapiens
gagggccaactagcaccacttt

SEQ ID NO: 7209830 - DNA, 22 bp, Homo sapiens
gaggctgcccacacctgcgccg

SEQ ID NO: 7209831 - DNA, 22 bp, Homo sapiens
gaggctgcccacacctgcgccg

SEQ ID NO: 7209832 - DNA, 22 bp, Homo sapiens
gaggctgcccaactggagtgga

SEQ ID NO: 7209833 - DNA, 22 bp, Homo sapiens
gaggctgcccaactggagtgga

SEQ ID NO: 7209834 - DNA, 22 bp, Homo sapiens
gaggctgcccacacctgcgccg

SEQ ID NO: 7209835 - DNA, 22 bp, Homo sapiens
gaggctggacgtgcatttctac

SEQ ID NO: 7209836 - DNA, 22 bp, Homo sapiens
gaggctggaatattagaaatgt

SEQ ID NO: 7209837 - DNA, 22 bp, Homo sapiens
gaggctgccccttcctcagctg

SEQ ID NO: 7209838 - DNA, 22 bp, Homo sapiens
gaggctgccccttcctcagctg

SEQ ID NO: 7209839 - DNA, 22 bp, Homo sapiens
gaggcctggaattccagcctgg

SEQ ID NO: 7209840 - DNA, 22 bp, Homo sapiens
gaggcctgctttggcactctgg

SEQ ID NO: 7209841 - DNA, 22 bp, Homo sapiens
gaggcctgcagcgtggtccctg

SEQ ID NO: 7209842 - DNA, 22 bp, Homo sapiens
gaggcctgctttggcactctgg

SEQ ID NO: 7209843 - DNA, 22 bp, Homo sapiens
gaggcctgctttggcactctgg

SEQ ID NO: 7209844 - DNA, 22 bp, Homo sapiens
gaggcctgcagcgtggtccctg

SEQ ID NO: 7209845 - DNA, 22 bp, Homo sapiens
gaggcctgaggctgcctggagc

SEQ ID NO: 7209846 - DNA, 22 bp, Homo sapiens
gaggcctgaggctgcctggagc

SEQ ID NO: 7209847 - DNA, 16 bp, Homo sapiens
gaggctggcagatgtc

SEQ ID NO: 7209848 - DNA, 22 bp, Homo sapiens
gaggctggcagaaaagcacagg

SEQ ID NO: 7209849 - DNA, 16 bp, Homo sapiens
gaggctggcagatgtc

SEQ ID NO: 7209850 - DNA, 16 bp, Homo sapiens
gaggctggcagatgtc

SEQ ID NO: 7209851 - DNA, 22 bp, Homo sapiens
gaggctggcagaaaagcacagg

SEQ ID NO: 7209852 - DNA, 22 bp, Homo sapiens
gaggctggcagaaaagcacagg

SEQ ID NO: 7209853 - DNA, 22 bp, Homo sapiens
gaggctggcagaaaagcacagg

SEQ ID NO: 7209854 - DNA, 22 bp, Homo sapiens
gaggctggcagaaaagcacagg

SEQ ID NO: 7209855 - DNA, 22 bp, Homo sapiens
gaggctggcagaaaagcacagg

SEQ ID NO: 7209856 - DNA, 22 bp, Homo sapiens
gaggctggaggtcaaagatgaa

SEQ ID NO: 7209857 - DNA, 22 bp, Homo sapiens
gaggctggcagaaaagcacagg

SEQ ID NO: 7209858 - DNA, 22 bp, Homo sapiens
gaggctggaggtcaaagatgaa

SEQ ID NO: 7209859 - DNA, 22 bp, Homo sapiens
gaggctggaggtcaaagatgaa

SEQ ID NO: 7209860 - DNA, 22 bp, Homo sapiens
gaggctggaggtcaaagatgaa

SEQ ID NO: 7209861 - DNA, 22 bp, Homo sapiens
gaggctggaggtcaaagatgaa

SEQ ID NO: 7209862 - DNA, 22 bp, Homo sapiens
gaggctggaggtcaaagatgaa

SEQ ID NO: 7209863 - DNA, 22 bp, Homo sapiens
gaggctggaggtcaaagatgaa

SEQ ID NO: 7209864 - DNA, 22 bp, Homo sapiens
gaggctggagatattccaatct

SEQ ID NO: 7209865 - DNA, 16 bp, Homo sapiens
gagggcagaggcggaa

SEQ ID NO: 7209866 - DNA, 16 bp, Homo sapiens
gagggcagaggcggaa

SEQ ID NO: 7209867 - DNA, 16 bp, Homo sapiens
gagggcagaggcggaa

SEQ ID NO: 7209868 - DNA, 16 bp, Homo sapiens
gagggcagaggcggaa

SEQ ID NO: 7209869 - DNA, 22 bp, Homo sapiens
gagggcagagtctaatgatgca

SEQ ID NO: 7209870 - DNA, 22 bp, Homo sapiens
gagggcagagtctaatgatgca

SEQ ID NO: 7209871 - DNA, 16 bp, Homo sapiens
gagggcagaggcggaa

SEQ ID NO: 7209872 - DNA, 16 bp, Homo sapiens
gagggcagaggcggaa

SEQ ID NO: 7209873 - DNA, 22 bp, Homo sapiens
gagggatgcagaaacagaggcc

SEQ ID NO: 7209874 - DNA, 22 bp, Homo sapiens
gagggatgcagaaacagaggcc

SEQ ID NO: 7209875 - DNA, 22 bp, Homo sapiens
gagggatgcagaaacagaggcc

SEQ ID NO: 7209876 - DNA, 22 bp, Homo sapiens
gaggctggggtctgcctttctg

SEQ ID NO: 7209877 - DNA, 22 bp, Homo sapiens
gaggctggggtctgcctttctg

SEQ ID NO: 7209878 - DNA, 22 bp, Homo sapiens
gagggatctttaggcagcctca

SEQ ID NO: 7209879 - DNA, 22 bp, Homo sapiens
gaggctgggggctgccttcctc

SEQ ID NO: 7209880 - DNA, 22 bp, Homo sapiens
gaggctgggggctgccttcctc

SEQ ID NO: 7209881 - DNA, 22 bp, Homo sapiens
gagggatgcagaaacagaggcc

SEQ ID NO: 7209882 - DNA, 22 bp, Homo sapiens
gagggatggtagttgacactga

SEQ ID NO: 7209883 - DNA, 22 bp, Homo sapiens
gagggcagagacagtgattcac

SEQ ID NO: 7209884 - DNA, 22 bp, Homo sapiens
gaggctgggggctgccttcctc

SEQ ID NO: 7209885 - DNA, 22 bp, Homo sapiens
gaggctgggggctgccttcctc

SEQ ID NO: 7209886 - DNA, 22 bp, Homo sapiens
gaggctgggaagtccaatatca

SEQ ID NO: 7209887 - DNA, 22 bp, Homo sapiens
gaggctgggaagtccaagatca

SEQ ID NO: 7209888 - DNA, 22 bp, Homo sapiens
gaggctgggaagtccaagatca

SEQ ID NO: 7209889 - DNA, 22 bp, Homo sapiens
gaggctgggaagtccaagatca

SEQ ID NO: 7209890 - DNA, 22 bp, Homo sapiens
gaggctgggaagtccaagacca

SEQ ID NO: 7209891 - DNA, 22 bp, Homo sapiens
gaggctgggaagtccaagatca

SEQ ID NO: 7209892 - DNA, 22 bp, Homo sapiens
gaggctgggaagtccaagacca

SEQ ID NO: 7209893 - DNA, 22 bp, Homo sapiens
gaggctgggaagtccaagacca

SEQ ID NO: 7209894 - DNA, 22 bp, Homo sapiens
gaggctgggaagtccaagacca

SEQ ID NO: 7209895 - DNA, 16 bp, Homo sapiens
gaggctggcagatgtc

SEQ ID NO: 7209896 - DNA, 22 bp, Homo sapiens
gaggaaggtcccatcagaattt

SEQ ID NO: 7209897 - DNA, 22 bp, Homo sapiens
gaggaatgggtgtctcgtgatt

SEQ ID NO: 7209898 - DNA, 22 bp, Homo sapiens
gaggaatgggtgtctcgtgatt

SEQ ID NO: 7209899 - DNA, 21 bp, Homo sapiens
gaggaatggtttgcaaagcac

SEQ ID NO: 7209900 - DNA, 21 bp, Homo sapiens
gaggaatggtttgcaaagcac

SEQ ID NO: 7209901 - DNA, 21 bp, Homo sapiens
gaggaatggtttgcaaagcac

SEQ ID NO: 7209902 - DNA, 23 bp, Homo sapiens
gaggacacagcccagacagccgt

SEQ ID NO: 7209903 - DNA, 22 bp, Homo sapiens
gaggaatgttattaaaggagct

SEQ ID NO: 7209904 - DNA, 22 bp, Homo sapiens
gaggaatgttattaaaggagct

SEQ ID NO: 7209905 - DNA, 22 bp, Homo sapiens
gaggaatgttattaaaggagct

SEQ ID NO: 7209906 - DNA, 22 bp, Homo sapiens
gaggaatgtcagcacaggcctc

SEQ ID NO: 7209907 - DNA, 22 bp, Homo sapiens
gaggaatgtcagcacaggcctc

SEQ ID NO: 7209908 - DNA, 22 bp, Homo sapiens
gaggaatgtcagcacaggcctc

SEQ ID NO: 7209909 - DNA, 22 bp, Homo sapiens
gaggacagcttagggcttcctg

SEQ ID NO: 7209910 - DNA, 22 bp, Homo sapiens
gaggacagcttagggcttcctg

SEQ ID NO: 7209911 - DNA, 22 bp, Homo sapiens
gaggacagctctaactaaagtc

SEQ ID NO: 7209912 - DNA, 22 bp, Homo sapiens
gaggacagctctaactaaagtc

SEQ ID NO: 7209913 - DNA, 22 bp, Homo sapiens
gaggacagagccgcctggcaag

SEQ ID NO: 7209914 - DNA, 22 bp, Homo sapiens
gaggacagctctaactaaagtc

SEQ ID NO: 7209915 - DNA, 22 bp, Homo sapiens
gaggacagctctaactaaagtc

SEQ ID NO: 7209916 - DNA, 22 bp, Homo sapiens
gaggacagcttagggcttcctg

SEQ ID NO: 7209917 - DNA, 22 bp, Homo sapiens
gaggacagcttagggcttcctg

SEQ ID NO: 7209918 - DNA, 22 bp, Homo sapiens
gaggacagcttagggcttcctg

SEQ ID NO: 7209919 - DNA, 22 bp, Homo sapiens
gaggacagcttagggcttcctg

SEQ ID NO: 7209920 - DNA, 22 bp, Homo sapiens
gaggacagcttagggcttcctg

SEQ ID NO: 7209921 - DNA, 22 bp, Homo sapiens
gaggacaggagactcactgttt

SEQ ID NO: 7209922 - DNA, 22 bp, Homo sapiens
gaggacaggagactcactgttt

SEQ ID NO: 7209923 - DNA, 22 bp, Homo sapiens
gaggacaggagactcactgttt

SEQ ID NO: 7209924 - DNA, 22 bp, Homo sapiens
gaggaggctgaacaatgccctg

SEQ ID NO: 7209925 - DNA, 22 bp, Homo sapiens
gaggacagagccgcctggcaag

SEQ ID NO: 7209926 - DNA, 22 bp, Homo sapiens
gaggacagagccgcctggcaag

SEQ ID NO: 7209927 - DNA, 22 bp, Homo sapiens
gaggacagagccgcctggcaag

SEQ ID NO: 7209928 - DNA, 22 bp, Homo sapiens
gaggacagagccgcctggcaag

SEQ ID NO: 7209929 - DNA, 22 bp, Homo sapiens
gaggacagagccgcctggcaag

SEQ ID NO: 7209930 - DNA, 22 bp, Homo sapiens
gaggacacctcacagcctcaca

SEQ ID NO: 7209931 - DNA, 22 bp, Homo sapiens
gaggacagagccgcctggcaag

SEQ ID NO: 7209932 - DNA, 22 bp, Homo sapiens
gaggacagagccgcctggcaag

SEQ ID NO: 7209933 - DNA, 22 bp, Homo sapiens
gaggacagagccgcctggcaag

SEQ ID NO: 7209934 - DNA, 22 bp, Homo sapiens
gaggacacatgactccagcagg

SEQ ID NO: 7209935 - DNA, 22 bp, Homo sapiens
gaggacacctcacagcctcaca

SEQ ID NO: 7209936 - DNA, 22 bp, Homo sapiens
gaggacacctcacagcctcaca

SEQ ID NO: 7209937 - DNA, 22 bp, Homo sapiens
gagctgggaggactgggaactt

SEQ ID NO: 7209938 - DNA, 22 bp, Homo sapiens
gagctgggaggactgggaactt

SEQ ID NO: 7209939 - DNA, 22 bp, Homo sapiens
gagctgggaggactgggaactt

SEQ ID NO: 7209940 - DNA, 22 bp, Homo sapiens
gagctgggagttatagcatgtt

SEQ ID NO: 7209941 - DNA, 22 bp, Homo sapiens
gagctgggagttatagcatgtt

SEQ ID NO: 7209942 - DNA, 22 bp, Homo sapiens
gagctgggagttatagcatgtt

SEQ ID NO: 7209943 - DNA, 22 bp, Homo sapiens
gagctgggagttatagcatgtt

SEQ ID NO: 7209944 - DNA, 22 bp, Homo sapiens
gagctgggagctgggatttgga

SEQ ID NO: 7209945 - DNA, 22 bp, Homo sapiens
gagctgggagctgggatttgga

SEQ ID NO: 7209946 - DNA, 22 bp, Homo sapiens
gagctgggagctgggatttgga

SEQ ID NO: 7209947 - DNA, 22 bp, Homo sapiens
gagctgggagctgggatttgga

SEQ ID NO: 7209948 - DNA, 18 bp, Homo sapiens
gagctgggagaaggaagg

SEQ ID NO: 7209949 - DNA, 18 bp, Homo sapiens
gagctgggagaaggaagg

SEQ ID NO: 7209950 - DNA, 18 bp, Homo sapiens
gagctgggagaaggaagg

SEQ ID NO: 7209951 - DNA, 22 bp, Homo sapiens
gagctgggacttggaatccaca

SEQ ID NO: 7209952 - DNA, 22 bp, Homo sapiens
gaggaagggctgcctgccgggc

SEQ ID NO: 7209953 - DNA, 22 bp, Homo sapiens
gaggaagggctgcctgccgggc

SEQ ID NO: 7209954 - DNA, 22 bp, Homo sapiens
gaggaaggtcccatcagaattt

SEQ ID NO: 7209955 - DNA, 22 bp, Homo sapiens
gaggaaggtcccatcagaattt

SEQ ID NO: 7209956 - DNA, 22 bp, Homo sapiens
gaggaagggctgcctgccgggc

SEQ ID NO: 7209957 - DNA, 22 bp, Homo sapiens
gaggaagggctgcctgccgggc

SEQ ID NO: 7209958 - DNA, 22 bp, Homo sapiens
gaggaagggctgcctgccgggc

SEQ ID NO: 7209959 - DNA, 22 bp, Homo sapiens
gaggaagggctgcctgccgggc

SEQ ID NO: 7209960 - DNA, 22 bp, Homo sapiens
gaggaagggactttattatctg

SEQ ID NO: 7209961 - DNA, 22 bp, Homo sapiens
gaggaagatggttgagtggtcc

SEQ ID NO: 7209962 - DNA, 22 bp, Homo sapiens
gaggaagatggttgagtggtcc

SEQ ID NO: 7209963 - DNA, 22 bp, Homo sapiens
gagctgggattcatctatgtct

SEQ ID NO: 7209964 - DNA, 22 bp, Homo sapiens
gagctgggattcatctatgtct

SEQ ID NO: 7209965 - DNA, 23 bp, Homo sapiens
gagctgggatacaggcttactgc

SEQ ID NO: 7209966 - DNA, 23 bp, Homo sapiens
gagctgggatacaggcttactgc

SEQ ID NO: 7209967 - DNA, 22 bp, Homo sapiens
gagctgggagttatagcatgtt

SEQ ID NO: 7209968 - DNA, 22 bp, Homo sapiens
gaggaagagagctctgccttgt

SEQ ID NO: 7209969 - DNA, 22 bp, Homo sapiens
gaggaagagagctctgccttgt

SEQ ID NO: 7209970 - DNA, 22 bp, Homo sapiens
gaggaagagcatggccagtttc

SEQ ID NO: 7209971 - DNA, 22 bp, Homo sapiens
gaggaagagcatggccagtttc

SEQ ID NO: 7209972 - DNA, 22 bp, Homo sapiens
gagatatgttagaaagctattg

SEQ ID NO: 7209973 - DNA, 22 bp, Homo sapiens
gagatatgttggcagctggtat

SEQ ID NO: 7209974 - DNA, 22 bp, Homo sapiens
gagatcatcttttttagattcc

SEQ ID NO: 7209975 - DNA, 22 bp, Homo sapiens
gagatcatggcttctgctgata

SEQ ID NO: 7209976 - DNA, 19 bp, Homo sapiens
gagatactgaagtgaggaa

SEQ ID NO: 7209977 - DNA, 22 bp, Homo sapiens
gagatataagatctagaaagga

SEQ ID NO: 7209978 - DNA, 22 bp, Homo sapiens
gagatatattaacattaatctt

SEQ ID NO: 7209979 - DNA, 22 bp, Homo sapiens
gagatatattaacattaatctt

SEQ ID NO: 7209980 - DNA, 22 bp, Homo sapiens
gagagtgtctggaggaagctaa

SEQ ID NO: 7209981 - DNA, 22 bp, Homo sapiens
gagagttattattatccccatt

SEQ ID NO: 7209982 - DNA, 22 bp, Homo sapiens
gagagttccagtaagtggattc

SEQ ID NO: 7209983 - DNA, 22 bp, Homo sapiens
gagagttccagtaagtggattc

SEQ ID NO: 7209984 - DNA, 22 bp, Homo sapiens
gagagttccagtaagtggattc

SEQ ID NO: 7209985 - DNA, 22 bp, Homo sapiens
gagagtgtctggaggaagctaa

SEQ ID NO: 7209986 - DNA, 22 bp, Homo sapiens
gagagttctacctctgaaggcg

SEQ ID NO: 7209987 - DNA, 22 bp, Homo sapiens
gagagttctacctctgaaggcg

SEQ ID NO: 7209988 - DNA, 22 bp, Homo sapiens
gagagttcttgcctgggtatta

SEQ ID NO: 7209989 - DNA, 22 bp, Homo sapiens
gagataaagctaccatgttgat

SEQ ID NO: 7209990 - DNA, 22 bp, Homo sapiens
gagataaagctaccatgttgat

SEQ ID NO: 7209991 - DNA, 22 bp, Homo sapiens
gagataaatttttgataaatat

SEQ ID NO: 7209992 - DNA, 22 bp, Homo sapiens
gagataaatttttgataaatat

SEQ ID NO: 7209993 - DNA, 22 bp, Homo sapiens
gagataactctaggtcttcgag

SEQ ID NO: 7209994 - DNA, 22 bp, Homo sapiens
gagataataatagtacctatct

SEQ ID NO: 7209995 - DNA, 22 bp, Homo sapiens
gagatacacaggcagaaaaaga

SEQ ID NO: 7209996 - DNA, 22 bp, Homo sapiens
gagatacagttggctgcaggct

SEQ ID NO: 7209997 - DNA, 22 bp, Homo sapiens
gagatacagttggctgcaggct

SEQ ID NO: 7209998 - DNA, 22 bp, Homo sapiens
gagataatgatgctaacccagt

SEQ ID NO: 7209999 - DNA, 22 bp, Homo sapiens
gagagtgctgaacggcaagggt

SEQ ID NO: 7210000 - DNA, 22 bp, Homo sapiens
gagagtggaaagcaagctgagt

SEQ ID NO: 7210001 - DNA, 22 bp, Homo sapiens
gagagtggatggagctgcgaag

SEQ ID NO: 7210002 - DNA, 22 bp, Homo sapiens
gagagtggatggagctgcgaag

SEQ ID NO: 7210003 - DNA, 17 bp, Homo sapiens
gagagtgtattggatgc

SEQ ID NO: 7210004 - DNA, 22 bp, Homo sapiens
gagagtgtcgggggccccagga

SEQ ID NO: 7210005 - DNA, 22 bp, Homo sapiens
gagagtgaggcctgggaatcta

SEQ ID NO: 7210006 - DNA, 22 bp, Homo sapiens
gagagtgaggcatcaggggcag

SEQ ID NO: 7210007 - DNA, 22 bp, Homo sapiens
gagagtgaggcatcaggggcag

SEQ ID NO: 7210008 - DNA, 22 bp, Homo sapiens
gagagtgagatcctcctgggga

SEQ ID NO: 7210009 - DNA, 22 bp, Homo sapiens
gagagtgagatcctcctgggga

SEQ ID NO: 7210010 - DNA, 22 bp, Homo sapiens
gagagtctagtgcacctagttt

SEQ ID NO: 7210011 - DNA, 22 bp, Homo sapiens
gagagtctagtgcacctagttt

SEQ ID NO: 7210012 - DNA, 22 bp, Homo sapiens
gagagtctagtgcacctagttt

SEQ ID NO: 7210013 - DNA, 22 bp, Homo sapiens
gagagtctagtgcacctagttt

SEQ ID NO: 7210014 - DNA, 22 bp, Homo sapiens
gagagtctagtgcacctagttt

SEQ ID NO: 7210015 - DNA, 22 bp, Homo sapiens
gagagtctaggaacctcatata

SEQ ID NO: 7210016 - DNA, 22 bp, Homo sapiens
gagagtctagtgcacctagttt

SEQ ID NO: 7210017 - DNA, 22 bp, Homo sapiens
gagctggaggcagtgctgaggt

SEQ ID NO: 7210018 - DNA, 22 bp, Homo sapiens
gagctggactttcagatacatc

SEQ ID NO: 7210019 - DNA, 22 bp, Homo sapiens
gagctggaggaccaggactggg

SEQ ID NO: 7210020 - DNA, 22 bp, Homo sapiens
gagatcctgtaggcagctaaga

SEQ ID NO: 7210021 - DNA, 22 bp, Homo sapiens
gagctgcttctgtgtgccgggt

SEQ ID NO: 7210022 - DNA, 22 bp, Homo sapiens
gagctgcttgcccagaagcaga

SEQ ID NO: 7210023 - DNA, 22 bp, Homo sapiens
gagctggaagtctgtggtcaga

SEQ ID NO: 7210024 - DNA, 22 bp, Homo sapiens
gagctggactttcagatacatc

SEQ ID NO: 7210025 - DNA, 22 bp, Homo sapiens
gagctggccgcagagagggcag

SEQ ID NO: 7210026 - DNA, 22 bp, Homo sapiens
gagctggcaatgacttgtgtat

SEQ ID NO: 7210027 - DNA, 22 bp, Homo sapiens
gagctggcacagaaggatctta

SEQ ID NO: 7210028 - DNA, 22 bp, Homo sapiens
gagctggctaatactgacttat

SEQ ID NO: 7210029 - DNA, 22 bp, Homo sapiens
gagctggcctcaggcacaggag

SEQ ID NO: 7210030 - DNA, 22 bp, Homo sapiens
gagctggcctcaggcacaggag

SEQ ID NO: 7210031 - DNA, 22 bp, Homo sapiens
gagctggcctcaggcacaggag

SEQ ID NO: 7210032 - DNA, 22 bp, Homo sapiens
gagctggctccgccatgctgct

SEQ ID NO: 7210033 - DNA, 22 bp, Homo sapiens
gagctggctccgccatgctgct

SEQ ID NO: 7210034 - DNA, 22 bp, Homo sapiens
gagctggctccgccatgctgct

SEQ ID NO: 7210035 - DNA, 22 bp, Homo sapiens
gagctgggacatgggtcctctc

SEQ ID NO: 7210036 - DNA, 22 bp, Homo sapiens
gagctgggacatgggtcctctc

SEQ ID NO: 7210037 - DNA, 22 bp, Homo sapiens
gagctgggacatgggtcctctc

SEQ ID NO: 7210038 - DNA, 22 bp, Homo sapiens
gagctgggacatgggtcctctc

SEQ ID NO: 7210039 - DNA, 22 bp, Homo sapiens
gagctgggacatgggtcctctc

SEQ ID NO: 7210040 - DNA, 22 bp, Homo sapiens
gagctgggaagatagcttgagc

SEQ ID NO: 7210041 - DNA, 22 bp, Homo sapiens
gagctgggaagatagcttgagc

SEQ ID NO: 7210042 - DNA, 22 bp, Homo sapiens
gagctgggaagatagcttgagc

SEQ ID NO: 7210043 - DNA, 22 bp, Homo sapiens
gagctgggaagatagcttgagc

SEQ ID NO: 7210044 - DNA, 22 bp, Homo sapiens
gagctgggaagatagcttgagc

SEQ ID NO: 7210045 - DNA, 22 bp, Homo sapiens
gaggagggttggccttaggtag

SEQ ID NO: 7210046 - DNA, 22 bp, Homo sapiens
gaggagggttggccttaggtag

SEQ ID NO: 7210047 - DNA, 22 bp, Homo sapiens
gaggagggttggccttaggtag

SEQ ID NO: 7210048 - DNA, 22 bp, Homo sapiens
gaggaggtcgctgctgagcccc

SEQ ID NO: 7210049 - DNA, 22 bp, Homo sapiens
gaggaggtcgctgctgagcccc

SEQ ID NO: 7210050 - DNA, 22 bp, Homo sapiens
gaggaggtcgctgctgagcccc

SEQ ID NO: 7210051 - DNA, 22 bp, Homo sapiens
gaggagggttggccttaggtag

SEQ ID NO: 7210052 - DNA, 22 bp, Homo sapiens
gaggaggtcccccgacatgcct

SEQ ID NO: 7210053 - DNA, 22 bp, Homo sapiens
gaggaggtcccccgacatgcct

SEQ ID NO: 7210054 - DNA, 22 bp, Homo sapiens
gaggaggtggaattccaggaat

SEQ ID NO: 7210055 - DNA, 22 bp, Homo sapiens
gaggaggtctcctccgcagggg

SEQ ID NO: 7210056 - DNA, 22 bp, Homo sapiens
gaggaggtctcctccgcagggg

SEQ ID NO: 7210057 - DNA, 22 bp, Homo sapiens
gaggaggtctcctccgcagggg

SEQ ID NO: 7210058 - DNA, 22 bp, Homo sapiens
gaggaggtggaattccaggaat

SEQ ID NO: 7210059 - DNA, 22 bp, Homo sapiens
gaggaggtggagtcatgcagag

SEQ ID NO: 7210060 - DNA, 22 bp, Homo sapiens
gaggaggtggagtcatgcagag

SEQ ID NO: 7210061 - DNA, 22 bp, Homo sapiens
gaggaggtggaattccaggaat

SEQ ID NO: 7210062 - DNA, 22 bp, Homo sapiens
gaggaggtggagtcatgcagag

SEQ ID NO: 7210063 - DNA, 22 bp, Homo sapiens
gaggcagaggttgcagtgagct

SEQ ID NO: 7210064 - DNA, 22 bp, Homo sapiens
gaggcagaggttgcagtgagct

SEQ ID NO: 7210065 - DNA, 22 bp, Homo sapiens
gaggcagaggttgcagtgagct

SEQ ID NO: 7210066 - DNA, 22 bp, Homo sapiens
gaggaggtggagtcatgcagag

SEQ ID NO: 7210067 - DNA, 22 bp, Homo sapiens
gaggcagaggttgcagtgagct

SEQ ID NO: 7210068 - DNA, 22 bp, Homo sapiens
gaggcagcagaacatggaagag

SEQ ID NO: 7210069 - DNA, 22 bp, Homo sapiens
gaggcagcagaacatggaagag

SEQ ID NO: 7210070 - DNA, 22 bp, Homo sapiens
gaggcagcagaacatggaagag

SEQ ID NO: 7210071 - DNA, 22 bp, Homo sapiens
gaggcagcaaaatatatcataa

SEQ ID NO: 7210072 - DNA, 22 bp, Homo sapiens
gaggcagcaataaaaagaattt

SEQ ID NO: 7210073 - DNA, 22 bp, Homo sapiens
gaggcagagtcacaaagagtct

SEQ ID NO: 7210074 - DNA, 22 bp, Homo sapiens
gaggcagagtgcaccccaggag

SEQ ID NO: 7210075 - DNA, 22 bp, Homo sapiens
gaggcagagtcacaaagagtct

SEQ ID NO: 7210076 - DNA, 22 bp, Homo sapiens
gaggcagagtcacaaagagtct

SEQ ID NO: 7210077 - DNA, 22 bp, Homo sapiens
gaggcagagtcacaaagagtct

SEQ ID NO: 7210078 - DNA, 22 bp, Homo sapiens
gaggcagaggttgttgcagtga

SEQ ID NO: 7210079 - DNA, 22 bp, Homo sapiens
gaggcagaggttgcagtgagct

SEQ ID NO: 7210080 - DNA, 22 bp, Homo sapiens
gaggcagaggttgttgcagtga

SEQ ID NO: 7210081 - DNA, 22 bp, Homo sapiens
gaggcagaggttgttgcagtga

SEQ ID NO: 7210082 - DNA, 22 bp, Homo sapiens
gaggagggagctggaagctctt

SEQ ID NO: 7210083 - DNA, 23 bp, Homo sapiens
gaggagggtctgacaagtgtagc

SEQ ID NO: 7210084 - DNA, 23 bp, Homo sapiens
gaggagggtctgacaagtgtagc

SEQ ID NO: 7210085 - DNA, 23 bp, Homo sapiens
gaggagggtctgacaagtgtagc

SEQ ID NO: 7210086 - DNA, 23 bp, Homo sapiens
gaggagggtctgacaagtgtagc

SEQ ID NO: 7210087 - DNA, 23 bp, Homo sapiens
gaggagggtctgacaagtgtagc

SEQ ID NO: 7210088 - DNA, 22 bp, Homo sapiens
gaggagggagctggaagctctt

SEQ ID NO: 7210089 - DNA, 22 bp, Homo sapiens
gaggagggagctggaagctctt

SEQ ID NO: 7210090 - DNA, 22 bp, Homo sapiens
gaggagggagctggaagctctt

SEQ ID NO: 7210091 - DNA, 22 bp, Homo sapiens
gaggagggagctggaagctctt

SEQ ID NO: 7210092 - DNA, 22 bp, Homo sapiens
gaggagggagaattaggcttaa

SEQ ID NO: 7210093 - DNA, 22 bp, Homo sapiens
gaggaggcttccgggaggcacg

SEQ ID NO: 7210094 - DNA, 22 bp, Homo sapiens
gaggaggcttccgggaggcacg

SEQ ID NO: 7210095 - DNA, 22 bp, Homo sapiens
gaggagggagaattaggcttaa

SEQ ID NO: 7210096 - DNA, 22 bp, Homo sapiens
gaggagggagaattaggcttaa

SEQ ID NO: 7210097 - DNA, 22 bp, Homo sapiens
gaggaggcttccgggaggcacg

SEQ ID NO: 7210098 - DNA, 22 bp, Homo sapiens
gaggaggcttccgggaggcacg

SEQ ID NO: 7210099 - DNA, 22 bp, Homo sapiens
gaggaggcttccgggaggcacg

SEQ ID NO: 7210100 - DNA, 22 bp, Homo sapiens
gaggaggcttccgggaggcacg

SEQ ID NO: 7210101 - DNA, 22 bp, Homo sapiens
gaggaggcttccgggaggcacg

SEQ ID NO: 7210102 - DNA, 22 bp, Homo sapiens
gaggaggcttccgggaggcacg

SEQ ID NO: 7210103 - DNA, 19 bp, Homo sapiens
gaggaggcttcagctttct

SEQ ID NO: 7210104 - DNA, 19 bp, Homo sapiens
gaggaggcttcagctttct

SEQ ID NO: 7210105 - DNA, 22 bp, Homo sapiens
gaggaggctgtttctctgcatt

SEQ ID NO: 7210106 - DNA, 22 bp, Homo sapiens
gaggaggctgtttctctgcatt

SEQ ID NO: 7210107 - DNA, 22 bp, Homo sapiens
gaggaggctgtttctctgcatt

SEQ ID NO: 7210108 - DNA, 22 bp, Homo sapiens
gaggaggctggcgccgcctgcc

SEQ ID NO: 7210109 - DNA, 22 bp, Homo sapiens
gaggaggctgtttctctgcatt

SEQ ID NO: 7210110 - DNA, 22 bp, Homo sapiens
gaggaggctgtttctctgcatt

SEQ ID NO: 7210111 - DNA, 22 bp, Homo sapiens
gaggaggctggcgccgcctgcc

SEQ ID NO: 7210112 - DNA, 22 bp, Homo sapiens
gaggaggctggcgccgcctgcc

SEQ ID NO: 7210113 - DNA, 22 bp, Homo sapiens
gaggaggctgaacaatgccctg

SEQ ID NO: 7210114 - DNA, 22 bp, Homo sapiens
gaggaggctgaacaatgccctg

SEQ ID NO: 7210115 - DNA, 22 bp, Homo sapiens
gaggcccaggtcaagcagccac

SEQ ID NO: 7210116 - DNA, 22 bp, Homo sapiens
gaggcccaggtcaagcagccac

SEQ ID NO: 7210117 - DNA, 22 bp, Homo sapiens
gaggcccagtcctgcaagcacg

SEQ ID NO: 7210118 - DNA, 22 bp, Homo sapiens
gaggcccagtcctgcaagcacg

SEQ ID NO: 7210119 - DNA, 22 bp, Homo sapiens
gaggcagctgggctggtggttt

SEQ ID NO: 7210120 - DNA, 22 bp, Homo sapiens
gaggcagctgggtccggtcggg

SEQ ID NO: 7210121 - DNA, 22 bp, Homo sapiens
gaggcccagcagcgcaggtctt

SEQ ID NO: 7210122 - DNA, 22 bp, Homo sapiens
gaggcccagcattcagggcagg

SEQ ID NO: 7210123 - DNA, 22 bp, Homo sapiens
gaggcccagcattcagggcagg

SEQ ID NO: 7210124 - DNA, 22 bp, Homo sapiens
gaggcagctgggatacaaggga

SEQ ID NO: 7210125 - DNA, 22 bp, Homo sapiens
gaggcagctgggctggtggttt

SEQ ID NO: 7210126 - DNA, 22 bp, Homo sapiens
gaggcagctgaaggagtgacag

SEQ ID NO: 7210127 - DNA, 22 bp, Homo sapiens
gaggcagctgaaggagtgacag

SEQ ID NO: 7210128 - DNA, 22 bp, Homo sapiens
gaggcagctgaaggagtgacag

SEQ ID NO: 7210129 - DNA, 22 bp, Homo sapiens
gaggcagctgggatacaaggga

SEQ ID NO: 7210130 - DNA, 22 bp, Homo sapiens
gaggcagctgaagcttcaaaga

SEQ ID NO: 7210131 - DNA, 22 bp, Homo sapiens
gaggcagctgaaggagtgacag

SEQ ID NO: 7210132 - DNA, 22 bp, Homo sapiens
gaggcagctgaaggagtgacag

SEQ ID NO: 7210133 - DNA, 22 bp, Homo sapiens
gaggcagctcttctgaatgggg

SEQ ID NO: 7210134 - DNA, 23 bp, Homo sapiens
gaggcagctcctgcagtgccctg

SEQ ID NO: 7210135 - DNA, 22 bp, Homo sapiens
gaggcagctcttctgaatgggg

SEQ ID NO: 7210136 - DNA, 23 bp, Homo sapiens
gaggcagctcctgcagtgccctg

SEQ ID NO: 7210137 - DNA, 23 bp, Homo sapiens
gaggcagctcctgcagtgccctg

SEQ ID NO: 7210138 - DNA, 23 bp, Homo sapiens
gaggcagctcctgcagtgccctg

SEQ ID NO: 7210139 - DNA, 22 bp, Homo sapiens
gaggcagcaggctgaggaggat

SEQ ID NO: 7210140 - DNA, 22 bp, Homo sapiens
gaggcagcgggtcaggaccgtg

SEQ ID NO: 7210141 - DNA, 18 bp, Homo sapiens
gaggcagctagcaatttt

SEQ ID NO: 7210142 - DNA, 18 bp, Homo sapiens
gaggcagctagcaatttt

SEQ ID NO: 7210143 - DNA, 18 bp, Homo sapiens
gaggcagctagcaatttt

SEQ ID NO: 7210144 - DNA, 22 bp, Homo sapiens
gaggcagcaggctgaggaggat

SEQ ID NO: 7210145 - DNA, 22 bp, Homo sapiens
gaggcagcaggctgaggaggat

SEQ ID NO: 7210146 - DNA, 22 bp, Homo sapiens
gaggcagcaggctgaggaggat

SEQ ID NO: 7210147 - DNA, 22 bp, Homo sapiens
gaggcagcaggctgaggaggat

SEQ ID NO: 7210148 - DNA, 22 bp, Homo sapiens
gaggcagcaggctgaggaggat

SEQ ID NO: 7210149 - DNA, 22 bp, Homo sapiens
gaggcagcaggctgaggaggat

SEQ ID NO: 7210150 - DNA, 22 bp, Homo sapiens
gaggcctcctctgagacatctg

SEQ ID NO: 7210151 - DNA, 22 bp, Homo sapiens
gaggcctcctctgagacatctg

SEQ ID NO: 7210152 - DNA, 22 bp, Homo sapiens
gaggcctctgtcccgccaggga

SEQ ID NO: 7210153 - DNA, 22 bp, Homo sapiens
gaggcctctgtcccgccaggga

SEQ ID NO: 7210154 - DNA, 22 bp, Homo sapiens
gaggcctctgtcccaccaggga

SEQ ID NO: 7210155 - DNA, 22 bp, Homo sapiens
gaggcctcatgaggtgagcatt

SEQ ID NO: 7210156 - DNA, 22 bp, Homo sapiens
gaggcctcaggcgtgggaaggg

SEQ ID NO: 7210157 - DNA, 22 bp, Homo sapiens
gaggcctcatgaggtgagcatt

SEQ ID NO: 7210158 - DNA, 22 bp, Homo sapiens
gaggcctcctctgagacatctg

SEQ ID NO: 7210159 - DNA, 18 bp, Homo sapiens
gaggcctgagaaccaggt

SEQ ID NO: 7210160 - DNA, 22 bp, Homo sapiens
gaggcctgaggctgcctggagc

SEQ ID NO: 7210161 - DNA, 22 bp, Homo sapiens
gaggcctgaggctgcctggagc

SEQ ID NO: 7210162 - DNA, 22 bp, Homo sapiens
gaggcctgaggctgcctggagc

SEQ ID NO: 7210163 - DNA, 22 bp, Homo sapiens
gaggcctgaggctgcctggagc

SEQ ID NO: 7210164 - DNA, 22 bp, Homo sapiens
gaggcctcttctttgttaacct

SEQ ID NO: 7210165 - DNA, 22 bp, Homo sapiens
gaggcctgaaaggggacctatg

SEQ ID NO: 7210166 - DNA, 18 bp, Homo sapiens
gaggcctgagaaccaggt

SEQ ID NO: 7210167 - DNA, 18 bp, Homo sapiens
gaggcctgagaaccaggt

SEQ ID NO: 7210168 - DNA, 22 bp, Homo sapiens
gaggcccagtcctgcaagcacg

SEQ ID NO: 7210169 - DNA, 22 bp, Homo sapiens
gaggcccagtggagggccatgg

SEQ ID NO: 7210170 - DNA, 19 bp, Homo sapiens
gaggcccatgagggtgctc

SEQ ID NO: 7210171 - DNA, 19 bp, Homo sapiens
gaggcccatgagggtgctc

SEQ ID NO: 7210172 - DNA, 21 bp, Homo sapiens
gaggcccatgggacaggggct

SEQ ID NO: 7210173 - DNA, 21 bp, Homo sapiens
gaggcccatgggacaggggct

SEQ ID NO: 7210174 - DNA, 21 bp, Homo sapiens
gaggcccatgggacaggggct

SEQ ID NO: 7210175 - DNA, 21 bp, Homo sapiens
gaggcccatgggacaggggct

SEQ ID NO: 7210176 - DNA, 22 bp, Homo sapiens
gaggccctccagctgtcagctg

SEQ ID NO: 7210177 - DNA, 22 bp, Homo sapiens
gaggccctccagctgtcagctg

SEQ ID NO: 7210178 - DNA, 22 bp, Homo sapiens
gaggccctccagctgtcagctg

SEQ ID NO: 7210179 - DNA, 22 bp, Homo sapiens
gaggccctcttgccacaatgaa

SEQ ID NO: 7210180 - DNA, 22 bp, Homo sapiens
gaggccctcttgccacaatgaa

SEQ ID NO: 7210181 - DNA, 22 bp, Homo sapiens
gaggccctgaagacagctgggg

SEQ ID NO: 7210182 - DNA, 22 bp, Homo sapiens
gaggccctgaagacagctgggg

SEQ ID NO: 7210183 - DNA, 22 bp, Homo sapiens
gaggccctgaagacagctgggg

SEQ ID NO: 7210184 - DNA, 22 bp, Homo sapiens
gaggccctgaagacagctgggg

SEQ ID NO: 7210185 - DNA, 22 bp, Homo sapiens
gaggccctgaagacagctgggg

SEQ ID NO: 7210186 - DNA, 22 bp, Homo sapiens
gaggccctgaagacagctgggg

SEQ ID NO: 7210187 - DNA, 22 bp, Homo sapiens
gaggccctgaagacagctgggg

SEQ ID NO: 7210188 - DNA, 22 bp, Homo sapiens
gaggccctggtaggtcagagtg

SEQ ID NO: 7210189 - DNA, 22 bp, Homo sapiens
gaggccctggtaggtcagagtg

SEQ ID NO: 7210190 - DNA, 22 bp, Homo sapiens
gaggccctggtaggtcagagtg

SEQ ID NO: 7210191 - DNA, 20 bp, Homo sapiens
gaggcctcagcctcagctcc

SEQ ID NO: 7210192 - DNA, 20 bp, Homo sapiens
gaggcctcagcctcagctcc

SEQ ID NO: 7210193 - DNA, 20 bp, Homo sapiens
gaggcctcagcctcagctcc

SEQ ID NO: 7210194 - DNA, 21 bp, Homo sapiens
gaggcctcagcctcagctcct

SEQ ID NO: 7210195 - DNA, 22 bp, Homo sapiens
gagtggctgagtaagaggggag

SEQ ID NO: 7210196 - DNA, 22 bp, Homo sapiens
gagtggctgggtgtttgaatcc

SEQ ID NO: 7210197 - DNA, 15 bp, Homo sapiens
gagtggctggtgaaa

SEQ ID NO: 7210198 - DNA, 22 bp, Homo sapiens
gagtggctgtgtacatgcccag

SEQ ID NO: 7210199 - DNA, 22 bp, Homo sapiens
gagtggctgtgtacatgcccag

SEQ ID NO: 7210200 - DNA, 22 bp, Homo sapiens
gagtggctgtgtacatgcccag

SEQ ID NO: 7210201 - DNA, 15 bp, Homo sapiens
gagtggctttcagaa

SEQ ID NO: 7210202 - DNA, 22 bp, Homo sapiens
gagtggctttggagaagtaggg

SEQ ID NO: 7210203 - DNA, 22 bp, Homo sapiens
gagtggccagtggtggcatgtc

SEQ ID NO: 7210204 - DNA, 22 bp, Homo sapiens
gagtggccagtggtggcatgtc

SEQ ID NO: 7210205 - DNA, 22 bp, Homo sapiens
gagtggctaaagtatgtcatgg

SEQ ID NO: 7210206 - DNA, 22 bp, Homo sapiens
gagtggctacaggcagcttaca

SEQ ID NO: 7210207 - DNA, 22 bp, Homo sapiens
gagtggctattgatccgtgatg

SEQ ID NO: 7210208 - DNA, 22 bp, Homo sapiens
gagtggctccaatttggtccta

SEQ ID NO: 7210209 - DNA, 22 bp, Homo sapiens
gagtggctccctgggtttggca

SEQ ID NO: 7210210 - DNA, 22 bp, Homo sapiens
gagtggctccttacaagttcca

SEQ ID NO: 7210211 - DNA, 22 bp, Homo sapiens
gagtggggctttaaaggctcag

SEQ ID NO: 7210212 - DNA, 22 bp, Homo sapiens
gagtggggctttaaaggctcag

SEQ ID NO: 7210213 - DNA, 22 bp, Homo sapiens
gagtgggcaaaagaaagtaggc

SEQ ID NO: 7210214 - DNA, 22 bp, Homo sapiens
gagtgggcaccgtgggcacact

SEQ ID NO: 7210215 - DNA, 21 bp, Homo sapiens
gagtgggacatgggagtggtt

SEQ ID NO: 7210216 - DNA, 22 bp, Homo sapiens
gagtgggcaaaagaaagtaggc

SEQ ID NO: 7210217 - DNA, 22 bp, Homo sapiens
gagtggggctttaaaggctcag

SEQ ID NO: 7210218 - DNA, 21 bp, Homo sapiens
gagtgggacatgggagtggtt

SEQ ID NO: 7210219 - DNA, 21 bp, Homo sapiens
gagtgggacatgggagtggtt

SEQ ID NO: 7210220 - DNA, 21 bp, Homo sapiens
gagtgggacatgggagtggtt

SEQ ID NO: 7210221 - DNA, 22 bp, Homo sapiens
gagtggcttttttatggtaatg

SEQ ID NO: 7210222 - DNA, 21 bp, Homo sapiens
gagtgggacatgggagtggtt

SEQ ID NO: 7210223 - DNA, 21 bp, Homo sapiens
gagtgggacatgggagtggtt

SEQ ID NO: 7210224 - DNA, 22 bp, Homo sapiens
gagtggagcaaaagaggtagat

SEQ ID NO: 7210225 - DNA, 22 bp, Homo sapiens
gagtggagcaaaagaggtagat

SEQ ID NO: 7210226 - DNA, 22 bp, Homo sapiens
gagtggagcaaaagaggtagat

SEQ ID NO: 7210227 - DNA, 22 bp, Homo sapiens
gagtggagcaaaagaggtagat

SEQ ID NO: 7210228 - DNA, 22 bp, Homo sapiens
gagtggcaggcactgtgacgga

SEQ ID NO: 7210229 - DNA, 22 bp, Homo sapiens
gagtggcagaactgggggtcct

SEQ ID NO: 7210230 - DNA, 22 bp, Homo sapiens
gagtggagcaaaagaggtagat

SEQ ID NO: 7210231 - DNA, 22 bp, Homo sapiens
gagtggagcaaaagaggtagat

SEQ ID NO: 7210232 - DNA, 22 bp, Homo sapiens
gagtggagatcgtgccactgca

SEQ ID NO: 7210233 - DNA, 22 bp, Homo sapiens
gagtggagatcgtgccactgca

SEQ ID NO: 7210234 - DNA, 22 bp, Homo sapiens
gagtggagatcgtgccactgca

SEQ ID NO: 7210235 - DNA, 22 bp, Homo sapiens
gagtggagatcgtgccactgca

SEQ ID NO: 7210236 - DNA, 22 bp, Homo sapiens
gagtggagatcgtgccactgca

SEQ ID NO: 7210237 - DNA, 21 bp, Homo sapiens
gagtggaacgctcttcacacc

SEQ ID NO: 7210238 - DNA, 22 bp, Homo sapiens
gagtggagatcgtgccactgca

SEQ ID NO: 7210239 - DNA, 22 bp, Homo sapiens
gagtggagatcgtgccactgca

SEQ ID NO: 7210240 - DNA, 21 bp, Homo sapiens
gagtggaacgctcttcacacc

SEQ ID NO: 7210241 - DNA, 22 bp, Homo sapiens
gagtgctgtatctgagaaagca

SEQ ID NO: 7210242 - DNA, 22 bp, Homo sapiens
gagtgcagttggggtgagggga

SEQ ID NO: 7210243 - DNA, 22 bp, Homo sapiens
gagtgcagtatgagaggctgct

SEQ ID NO: 7210244 - DNA, 22 bp, Homo sapiens
gagtgcagtatgagaggctgct

SEQ ID NO: 7210245 - DNA, 23 bp, Homo sapiens
gagtgcagaatagacatgcagtg

SEQ ID NO: 7210246 - DNA, 23 bp, Homo sapiens
gagtgcagaatagacatgcagtg

SEQ ID NO: 7210247 - DNA, 23 bp, Homo sapiens
gagtgcagaatagacatgcagtg

SEQ ID NO: 7210248 - DNA, 22 bp, Homo sapiens
gagtgcagtatgagaggctgct

SEQ ID NO: 7210249 - DNA, 22 bp, Homo sapiens
gagtgcagtatgagaggctgct

SEQ ID NO: 7210250 - DNA, 22 bp, Homo sapiens
gagtgcagtatgagaggctgct

SEQ ID NO: 7210251 - DNA, 22 bp, Homo sapiens
gagtgcagttggggtgagggga

SEQ ID NO: 7210252 - DNA, 22 bp, Homo sapiens
gagtgcagttggggtgagggga

SEQ ID NO: 7210253 - DNA, 22 bp, Homo sapiens
gagtgcatcgtggccattttaa

SEQ ID NO: 7210254 - DNA, 22 bp, Homo sapiens
gagtgccaagagaagaggctgg

SEQ ID NO: 7210255 - DNA, 22 bp, Homo sapiens
gagtgcgtgtttggggatgtgg

SEQ ID NO: 7210256 - DNA, 22 bp, Homo sapiens
gagtgctcgggtgtcccgcggg

SEQ ID NO: 7210257 - DNA, 22 bp, Homo sapiens
gagtgctgtaggactgagccct

SEQ ID NO: 7210258 - DNA, 22 bp, Homo sapiens
gagtgctgtaggactgagccct

SEQ ID NO: 7210259 - DNA, 17 bp, Homo sapiens
gagtgctggtggagctc

SEQ ID NO: 7210260 - DNA, 22 bp, Homo sapiens
gagtgctgtaggactgagccct

SEQ ID NO: 7210261 - DNA, 17 bp, Homo sapiens
gagtgctggtggagctc

SEQ ID NO: 7210262 - DNA, 22 bp, Homo sapiens
gagtgctggggtgcagagaggt

SEQ ID NO: 7210263 - DNA, 22 bp, Homo sapiens
gagtgctgcttgggatagtgag

SEQ ID NO: 7210264 - DNA, 22 bp, Homo sapiens
gagtgctggaggtgtgagtggg

SEQ ID NO: 7210265 - DNA, 22 bp, Homo sapiens
gagtgctggaggtgtgagtggg

SEQ ID NO: 7210266 - DNA, 22 bp, Homo sapiens
gagtgctggaggtgtgagtggg

SEQ ID NO: 7210267 - DNA, 22 bp, Homo sapiens
gagtgctggggtgcagagaggt

SEQ ID NO: 7210268 - DNA, 22 bp, Homo sapiens
gagtgagggcagcaggggctgc

SEQ ID NO: 7210269 - DNA, 22 bp, Homo sapiens
gagtgaggctggaatcatggct

SEQ ID NO: 7210270 - DNA, 22 bp, Homo sapiens
gagtgagggcagcaggggctgc

SEQ ID NO: 7210271 - DNA, 22 bp, Homo sapiens
gagtgagggcagcaggggctgc

SEQ ID NO: 7210272 - DNA, 22 bp, Homo sapiens
gagtgaggctggaatcatggct

SEQ ID NO: 7210273 - DNA, 22 bp, Homo sapiens
gagtgagggcagcaggggctgc

SEQ ID NO: 7210274 - DNA, 22 bp, Homo sapiens
gagtgagggcagcaggggctgc

SEQ ID NO: 7210275 - DNA, 22 bp, Homo sapiens
gagtgagggccaacatccagct

SEQ ID NO: 7210276 - DNA, 22 bp, Homo sapiens
gagtgagggccaacatccagct

SEQ ID NO: 7210277 - DNA, 22 bp, Homo sapiens
gagtgagggccaacatccagct

SEQ ID NO: 7210278 - DNA, 22 bp, Homo sapiens
gagtgagggccaacatccagct

SEQ ID NO: 7210279 - DNA, 22 bp, Homo sapiens
gagtgagggccaacatccagct

SEQ ID NO: 7210280 - DNA, 22 bp, Homo sapiens
gagtgagtgctgggctgaggct

SEQ ID NO: 7210281 - DNA, 22 bp, Homo sapiens
gagtgagtggccaggaggcaga

SEQ ID NO: 7210282 - DNA, 22 bp, Homo sapiens
gagtgatgtctgtagtgaagaa

SEQ ID NO: 7210283 - DNA, 22 bp, Homo sapiens
gagtctggaatgatgaagacct

SEQ ID NO: 7210284 - DNA, 22 bp, Homo sapiens
gagtctctttgccagtcctaag

SEQ ID NO: 7210285 - DNA, 22 bp, Homo sapiens
gagtctctgggagggaaagaag

SEQ ID NO: 7210286 - DNA, 22 bp, Homo sapiens
gagtctgagagcctaatgacct

SEQ ID NO: 7210287 - DNA, 22 bp, Homo sapiens
gagtctggccctgatgcatcat

SEQ ID NO: 7210288 - DNA, 22 bp, Homo sapiens
gagtctggccctgatgcatcat

SEQ ID NO: 7210289 - DNA, 22 bp, Homo sapiens
gagtctggtcattttctctccc

SEQ ID NO: 7210290 - DNA, 22 bp, Homo sapiens
gagtgaaaaaggaagggccata

SEQ ID NO: 7210291 - DNA, 22 bp, Homo sapiens
gagtgacaggaatatttatctg

SEQ ID NO: 7210292 - DNA, 22 bp, Homo sapiens
gagtgactattggatcagaatt

SEQ ID NO: 7210293 - DNA, 22 bp, Homo sapiens
gagtctgtatgtcttccatgca

SEQ ID NO: 7210294 - DNA, 22 bp, Homo sapiens
gagtcttaggcaaaaataatgg

SEQ ID NO: 7210295 - DNA, 22 bp, Homo sapiens
gagtccttctggctggcaggat

SEQ ID NO: 7210296 - DNA, 22 bp, Homo sapiens
gagtccttctggctggcaggat

SEQ ID NO: 7210297 - DNA, 22 bp, Homo sapiens
gagtccttccagcaggcattta

SEQ ID NO: 7210298 - DNA, 22 bp, Homo sapiens
gagtccttccagcaggcattta

SEQ ID NO: 7210299 - DNA, 22 bp, Homo sapiens
gagtccttgtcataattcagtg

SEQ ID NO: 7210300 - DNA, 22 bp, Homo sapiens
gagtccttttgtgccacaggga

SEQ ID NO: 7210301 - DNA, 22 bp, Homo sapiens
gagtccttttcatagcagtggg

SEQ ID NO: 7210302 - DNA, 22 bp, Homo sapiens
gagtccttttcatagcagtggg

SEQ ID NO: 7210303 - DNA, 22 bp, Homo sapiens
gagtcgagcagaaagccgtcgg

SEQ ID NO: 7210304 - DNA, 22 bp, Homo sapiens
gagtcgagcagaaagccgtcgg

SEQ ID NO: 7210305 - DNA, 22 bp, Homo sapiens
gagtctctgaccagggtgccaa

SEQ ID NO: 7210306 - DNA, 22 bp, Homo sapiens
gagtctctgaccagggtgccaa

SEQ ID NO: 7210307 - DNA, 22 bp, Homo sapiens
gagtcggaggcaggagacctgg

SEQ ID NO: 7210308 - DNA, 21 bp, Homo sapiens
gagtccttccaatgtcctcag

SEQ ID NO: 7210309 - DNA, 22 bp, Homo sapiens
gagtccttaatacactggtgga

SEQ ID NO: 7210310 - DNA, 20 bp, Homo sapiens
gagtccttatgggctgaggt

SEQ ID NO: 7210311 - DNA, 22 bp, Homo sapiens
gagtccttaatacactggtgga

SEQ ID NO: 7210312 - DNA, 19 bp, Homo sapiens
gagtcctgtgctccttgtt

SEQ ID NO: 7210313 - DNA, 22 bp, Homo sapiens
gagtcctgatccttagctctcc

SEQ ID NO: 7210314 - DNA, 22 bp, Homo sapiens
gagtcctgcccttgtgtagtcc

SEQ ID NO: 7210315 - DNA, 22 bp, Homo sapiens
gagtcctggaaccctgaatgct

SEQ ID NO: 7210316 - DNA, 22 bp, Homo sapiens
gagtggggtctgggcatcagtc

SEQ ID NO: 7210317 - DNA, 22 bp, Homo sapiens
gagtggggtctgggcatcagtc

SEQ ID NO: 7210318 - DNA, 22 bp, Homo sapiens
gagtggggggtccgtctcagtg

SEQ ID NO: 7210319 - DNA, 22 bp, Homo sapiens
gagtggggggtccgtctcagtg

SEQ ID NO: 7210320 - DNA, 22 bp, Homo sapiens
gagtggggggtccgtctcagtg

SEQ ID NO: 7210321 - DNA, 22 bp, Homo sapiens
gagtggggtctgggcatcagtc

SEQ ID NO: 7210322 - DNA, 22 bp, Homo sapiens
gagtggggtctgggcatcagtc

SEQ ID NO: 7210323 - DNA, 22 bp, Homo sapiens
gagtggggtctgggcatcagtc

SEQ ID NO: 7210324 - DNA, 22 bp, Homo sapiens
gagtggggctttaaaggctcag

SEQ ID NO: 7210325 - DNA, 22 bp, Homo sapiens
gagtggggctttaaaggctcag

SEQ ID NO: 7210326 - DNA, 22 bp, Homo sapiens
gagtggggggtccgtctcagtg

SEQ ID NO: 7210327 - DNA, 22 bp, Homo sapiens
gagtggggggtccgtctcagtg

SEQ ID NO: 7210328 - DNA, 22 bp, Homo sapiens
gagtggggggtccgtctcagtg

SEQ ID NO: 7210329 - DNA, 22 bp, Homo sapiens
gagtgggtaccggagcaggtgc

SEQ ID NO: 7210330 - DNA, 22 bp, Homo sapiens
gagtgggtaaaggtgcttggct

SEQ ID NO: 7210331 - DNA, 22 bp, Homo sapiens
gagtgggtccacagaggtgaca

SEQ ID NO: 7210332 - DNA, 22 bp, Homo sapiens
gagtgggtccacagaggtgaca

SEQ ID NO: 7210333 - DNA, 22 bp, Homo sapiens
gagtggggtctgggcatcagtc

SEQ ID NO: 7210334 - DNA, 22 bp, Homo sapiens
gagtggggtctgggcatcagtc

SEQ ID NO: 7210335 - DNA, 22 bp, Homo sapiens
gagtggggtctgggcatcagtc

SEQ ID NO: 7210336 - DNA, 22 bp, Homo sapiens
gagtggggtctgggcatcagtc

SEQ ID NO: 7210337 - DNA, 22 bp, Homo sapiens
gagtggggtctgggcatcagtc

SEQ ID NO: 7210338 - DNA, 22 bp, Homo sapiens
gagtgggtaaaggtgcttggct

SEQ ID NO: 7210339 - DNA, 22 bp, Homo sapiens
gagtgtctatgtttagtctttc

SEQ ID NO: 7210340 - DNA, 21 bp, Homo sapiens
gagtgtctaatccaggctgtc

SEQ ID NO: 7210341 - DNA, 22 bp, Homo sapiens
gagtgtctcacagtagcatttt

SEQ ID NO: 7210342 - DNA, 22 bp, Homo sapiens
gagtgtctgaattagagcacaa

SEQ ID NO: 7210343 - DNA, 22 bp, Homo sapiens
gagtgtctgtattttgggcaag

SEQ ID NO: 7210344 - DNA, 22 bp, Homo sapiens
gagtgtctgtattttgggcaag

SEQ ID NO: 7210345 - DNA, 22 bp, Homo sapiens
gagtgtctaatcacgtttcaca

SEQ ID NO: 7210346 - DNA, 22 bp, Homo sapiens
gagtgtcagtgcttggggctac

SEQ ID NO: 7210347 - DNA, 22 bp, Homo sapiens
gagtgtcacttgatgcagggca

SEQ ID NO: 7210348 - DNA, 22 bp, Homo sapiens
gagtgggtgaatgtgctcataa

SEQ ID NO: 7210349 - DNA, 22 bp, Homo sapiens
gagtgggtgacagaaggaggta

SEQ ID NO: 7210350 - DNA, 22 bp, Homo sapiens
gagtgggtgacagaaggaggta

SEQ ID NO: 7210351 - DNA, 22 bp, Homo sapiens
gagtggtaatgagcagattagg

SEQ ID NO: 7210352 - DNA, 22 bp, Homo sapiens
gagtggttagaagtagtgtggc

SEQ ID NO: 7210353 - DNA, 22 bp, Homo sapiens
gagttctgaactgtgaaatgca

SEQ ID NO: 7210354 - DNA, 22 bp, Homo sapiens
gagttctcaagcaatcaaagag

SEQ ID NO: 7210355 - DNA, 22 bp, Homo sapiens
gagttctggccggttcttggac

SEQ ID NO: 7210356 - DNA, 22 bp, Homo sapiens
gagttctggtcagcagggcagc

SEQ ID NO: 7210357 - DNA, 22 bp, Homo sapiens
gagttctgtagggtgaaatagt

SEQ ID NO: 7210358 - DNA, 22 bp, Homo sapiens
gagttctgtgagccatcctagc

SEQ ID NO: 7210359 - DNA, 22 bp, Homo sapiens
gagttaaaggaaaataacttta

SEQ ID NO: 7210360 - DNA, 22 bp, Homo sapiens
gagttaaaggaaaataacttta

SEQ ID NO: 7210361 - DNA, 22 bp, Homo sapiens
gagttaaaggcagttgaggaaa

SEQ ID NO: 7210362 - DNA, 22 bp, Homo sapiens
gagtgtggtgaacaggagcacc

SEQ ID NO: 7210363 - DNA, 22 bp, Homo sapiens
gagtgtggtgaacaggagcacc

SEQ ID NO: 7210364 - DNA, 22 bp, Homo sapiens
gagtgtggtgaacaggagcacc

SEQ ID NO: 7210365 - DNA, 22 bp, Homo sapiens
gagtgtggtgaacaggagcacc

SEQ ID NO: 7210366 - DNA, 22 bp, Homo sapiens
gagtgtgtcggtcagcgtggcg

SEQ ID NO: 7210367 - DNA, 22 bp, Homo sapiens
gagtgtggtgaacaggagcacc

SEQ ID NO: 7210368 - DNA, 22 bp, Homo sapiens
gagtgtgtgacttcactttagc

SEQ ID NO: 7210369 - DNA, 22 bp, Homo sapiens
gagtgtgtgcatgatctcttat

SEQ ID NO: 7210370 - DNA, 22 bp, Homo sapiens
gagtgtgtgcatgatctcttat

SEQ ID NO: 7210371 - DNA, 22 bp, Homo sapiens
gagtgtgttctttatgctgtga

SEQ ID NO: 7210372 - DNA, 22 bp, Homo sapiens
gagtgtgttctttatgctgtga

SEQ ID NO: 7210373 - DNA, 22 bp, Homo sapiens
gagtgtgttctttatgctgtga

SEQ ID NO: 7210374 - DNA, 22 bp, Homo sapiens
gagtgtgttctttatgctgtga

SEQ ID NO: 7210375 - DNA, 22 bp, Homo sapiens
gagtgttttactcaaagaaaga

SEQ ID NO: 7210376 - DNA, 22 bp, Homo sapiens
gagtgtggatcccagaagcaga

SEQ ID NO: 7210377 - DNA, 22 bp, Homo sapiens
gagtgtggatcccagaagcaga

SEQ ID NO: 7210378 - DNA, 22 bp, Homo sapiens
gagtgtggatcccagaagcaga

SEQ ID NO: 7210379 - DNA, 22 bp, Homo sapiens
gagtgtggatcccagaagcaga

SEQ ID NO: 7210380 - DNA, 22 bp, Homo sapiens
gagtgtctgtgacagctcatga

SEQ ID NO: 7210381 - DNA, 22 bp, Homo sapiens
gagtgtctgtggggcatggaca

SEQ ID NO: 7210382 - DNA, 22 bp, Homo sapiens
gagtgtctgtggggcatggaca

SEQ ID NO: 7210383 - DNA, 22 bp, Homo sapiens
gagtgtctgtggggcatggaca

SEQ ID NO: 7210384 - DNA, 18 bp, Homo sapiens
gagtgtggcactgggccc

SEQ ID NO: 7210385 - DNA, 18 bp, Homo sapiens
gagtgtggcactgggccc

SEQ ID NO: 7210386 - DNA, 18 bp, Homo sapiens
gagtgtggcactgggccc

SEQ ID NO: 7210387 - DNA, 18 bp, Homo sapiens
gagtgtggcactgggccc

SEQ ID NO: 7210388 - DNA, 22 bp, Homo sapiens
gagtgtgggcacgggggccttg

SEQ ID NO: 7210389 - DNA, 22 bp, Homo sapiens
gagtgtgggcacgggggccttg

SEQ ID NO: 7210390 - DNA, 22 bp, Homo sapiens
gagtgtggtgaacaggagcacc

SEQ ID NO: 7210391 - DNA, 22 bp, Homo sapiens
gagtgtggtatgctctgaggct

SEQ ID NO: 7210392 - DNA, 22 bp, Homo sapiens
gagtgtggtatgctctgaggct

SEQ ID NO: 7210393 - DNA, 22 bp, Homo sapiens
gagtgtggtgaacaggagcacc

SEQ ID NO: 7210394 - DNA, 22 bp, Homo sapiens
gagtgtggtgaacaggagcacc

SEQ ID NO: 7210395 - DNA, 22 bp, Homo sapiens
gagtgtggtgaacaggagcacc

SEQ ID NO: 7210396 - DNA, 22 bp, Homo sapiens
gagtgtgggtctcagctttaag

SEQ ID NO: 7210397 - DNA, 22 bp, Homo sapiens
gagtgtgggtctcagctttaag

SEQ ID NO: 7210398 - DNA, 22 bp, Homo sapiens
gagtgtgggggtgctgaggaca

SEQ ID NO: 7210399 - DNA, 22 bp, Homo sapiens
gagtgtgggggtgctgaggaca

SEQ ID NO: 7210400 - DNA, 22 bp, Homo sapiens
gagtgtgggcacgggggccttg

SEQ ID NO: 7210401 - DNA, 22 bp, Homo sapiens
gagtgtgggggtgctgaggaca

SEQ ID NO: 7210402 - DNA, 22 bp, Homo sapiens
gagtgtgggggtgctgaggaca

SEQ ID NO: 7210403 - DNA, 19 bp, Homo sapiens
gagtttatctcctagccct

SEQ ID NO: 7210404 - DNA, 22 bp, Homo sapiens
gagtttatgtctttcattgttc

SEQ ID NO: 7210405 - DNA, 22 bp, Homo sapiens
gagtttattcaggaaatagcca

SEQ ID NO: 7210406 - DNA, 22 bp, Homo sapiens
gagtttaatcattgttctatcc

SEQ ID NO: 7210407 - DNA, 22 bp, Homo sapiens
gagttctgtgattatttgggac

SEQ ID NO: 7210408 - DNA, 22 bp, Homo sapiens
gagttctgttacgtgtcaccaa

SEQ ID NO: 7210409 - DNA, 22 bp, Homo sapiens
gagttctgttccttgggagttt

SEQ ID NO: 7210410 - DNA, 22 bp, Homo sapiens
gagttcttaggcaaacaactct

SEQ ID NO: 7210411 - DNA, 22 bp, Homo sapiens
gagttcttaggcaaacaactct

SEQ ID NO: 7210412 - DNA, 22 bp, Homo sapiens
gagttcttctatatagtatgag

SEQ ID NO: 7210413 - DNA, 23 bp, Homo sapiens
gagttgggtgctgaacgaccata

SEQ ID NO: 7210414 - DNA, 22 bp, Homo sapiens
gagtttaaaaagcctggtttgt

SEQ ID NO: 7210415 - DNA, 22 bp, Homo sapiens
gagtttaaaacgcttgtattta

SEQ ID NO: 7210416 - DNA, 22 bp, Homo sapiens
gagtttaaagcatacatatttt

SEQ ID NO: 7210417 - DNA, 22 bp, Homo sapiens
gagtttaaagcatacatatttt

SEQ ID NO: 7210418 - DNA, 22 bp, Homo sapiens
gataaaagaggaaatttgttca

SEQ ID NO: 7210419 - DNA, 22 bp, Homo sapiens
gagtttttccaaggtcacatga

SEQ ID NO: 7210420 - DNA, 22 bp, Homo sapiens
gataaaataactatggaatact

SEQ ID NO: 7210421 - DNA, 22 bp, Homo sapiens
gataaaataactatggaatact

SEQ ID NO: 7210422 - DNA, 22 bp, Homo sapiens
gagtttgggtggaaggagggta

SEQ ID NO: 7210423 - DNA, 22 bp, Homo sapiens
gagtttggcctccccagcagtt

SEQ ID NO: 7210424 - DNA, 22 bp, Homo sapiens
gagtttattgtcttccaggctt

SEQ ID NO: 7210425 - DNA, 22 bp, Homo sapiens
gagtttatttgactggattctc

SEQ ID NO: 7210426 - DNA, 22 bp, Homo sapiens
gagtttctaggatggaggtgag

SEQ ID NO: 7210427 - DNA, 22 bp, Homo sapiens
gagtttctgatttagtaggtct

SEQ ID NO: 7210428 - DNA, 22 bp, Homo sapiens
gagtttctgctctaggtctggt

SEQ ID NO: 7210429 - DNA, 22 bp, Homo sapiens
gagtttcttaacaggtggaagc

SEQ ID NO: 7210430 - DNA, 22 bp, Homo sapiens
gagtttcttcatggtgcagagg

SEQ ID NO: 7210431 - DNA, 22 bp, Homo sapiens
gataaacacaaggtgatttcat

SEQ ID NO: 7210432 - DNA, 22 bp, Homo sapiens
gataaacacaaggtgatttcat

SEQ ID NO: 7210433 - DNA, 22 bp, Homo sapiens
gataaacactaaggtcgctgaa

SEQ ID NO: 7210434 - DNA, 22 bp, Homo sapiens
gataaaattcttattttacccg

SEQ ID NO: 7210435 - DNA, 22 bp, Homo sapiens
gataaacacaaggtgatttcat

SEQ ID NO: 7210436 - DNA, 22 bp, Homo sapiens
gataaacactaaggtcgctgaa

SEQ ID NO: 7210437 - DNA, 22 bp, Homo sapiens
gataaacactgatgatatgggg

SEQ ID NO: 7210438 - DNA, 22 bp, Homo sapiens
gataaacactgatgatatgggg

SEQ ID NO: 7210439 - DNA, 22 bp, Homo sapiens
gataaacatgggagaaaggaat

SEQ ID NO: 7210440 - DNA, 22 bp, Homo sapiens
gataaacatgggagaaaggaat

SEQ ID NO: 7210441 - DNA, 22 bp, Homo sapiens
gataaacattcttgcacatgtg

SEQ ID NO: 7210442 - DNA, 22 bp, Homo sapiens
gataaaataactatggaatact

SEQ ID NO: 7210443 - DNA, 22 bp, Homo sapiens
gataaaataactatggaatact

SEQ ID NO: 7210444 - DNA, 22 bp, Homo sapiens
gataaaataactatggaatact

SEQ ID NO: 7210445 - DNA, 22 bp, Homo sapiens
gataaaatatgtggcctttagt

SEQ ID NO: 7210446 - DNA, 22 bp, Homo sapiens
gataaaatatgtggcctttagt

SEQ ID NO: 7210447 - DNA, 22 bp, Homo sapiens
gataaaatatgtggcctttagt

SEQ ID NO: 7210448 - DNA, 21 bp, Homo sapiens
gataaaatgggccttggtcct

SEQ ID NO: 7210449 - DNA, 21 bp, Homo sapiens
gataaaatgggccttggtcct

SEQ ID NO: 7210450 - DNA, 21 bp, Homo sapiens
gataaaatgggccttggtcct

SEQ ID NO: 7210451 - DNA, 22 bp, Homo sapiens
gataaaattcttattttacccg

SEQ ID NO: 7210452 - DNA, 22 bp, Homo sapiens
gataaaattcttattttacccg

SEQ ID NO: 7210453 - DNA, 21 bp, Homo sapiens
gataaagcagcttgcctaagg

SEQ ID NO: 7210454 - DNA, 21 bp, Homo sapiens
gataaagcagcttgcctaagg

SEQ ID NO: 7210455 - DNA, 22 bp, Homo sapiens
gataaagcaaggatgactgaag

SEQ ID NO: 7210456 - DNA, 22 bp, Homo sapiens
gataaacttgtggagttttggt

SEQ ID NO: 7210457 - DNA, 22 bp, Homo sapiens
gataaacttgtggagttttggt

SEQ ID NO: 7210458 - DNA, 22 bp, Homo sapiens
gataaagtagatttgttctaga

SEQ ID NO: 7210459 - DNA, 22 bp, Homo sapiens
gataaagtagatttgttctaga

SEQ ID NO: 7210460 - DNA, 22 bp, Homo sapiens
gataaagtagatttgttctaga

SEQ ID NO: 7210461 - DNA, 22 bp, Homo sapiens
gataaatggctgaagaaatagt

SEQ ID NO: 7210462 - DNA, 21 bp, Homo sapiens
gatgaagcaatctttctgttg

SEQ ID NO: 7210463 - DNA, 22 bp, Homo sapiens
gatgaagaggcactgacatatt

SEQ ID NO: 7210464 - DNA, 22 bp, Homo sapiens
gatgaagaggcactgacatatt

SEQ ID NO: 7210465 - DNA, 22 bp, Homo sapiens
gatgaaatttgggcaggttaaa

SEQ ID NO: 7210466 - DNA, 22 bp, Homo sapiens
gatgaaatttgggcaggttaaa

SEQ ID NO: 7210467 - DNA, 22 bp, Homo sapiens
gatgaacatttaaagcctcttg

SEQ ID NO: 7210468 - DNA, 22 bp, Homo sapiens
gatgacagcagctgtggctcac

SEQ ID NO: 7210469 - DNA, 22 bp, Homo sapiens
gatgacagttctagcatctgaa

SEQ ID NO: 7210470 - DNA, 22 bp, Homo sapiens
gatgacagttctagcatctgaa

SEQ ID NO: 7210471 - DNA, 22 bp, Homo sapiens
gatgacataaacttaacagtat

SEQ ID NO: 7210472 - DNA, 22 bp, Homo sapiens
gatgacagcagctgtggctcac

SEQ ID NO: 7210473 - DNA, 22 bp, Homo sapiens
gatgaattctggcttggacaga

SEQ ID NO: 7210474 - DNA, 22 bp, Homo sapiens
gatgaattgaaatcattgggca

SEQ ID NO: 7210475 - DNA, 22 bp, Homo sapiens
gatgacaaaacttttgccagca

SEQ ID NO: 7210476 - DNA, 22 bp, Homo sapiens
gatgacataacctaattacagt

SEQ ID NO: 7210477 - DNA, 20 bp, Homo sapiens
gatgacatactcacttaggg

SEQ ID NO: 7210478 - DNA, 20 bp, Homo sapiens
gatgacatactcacttaggg

SEQ ID NO: 7210479 - DNA, 20 bp, Homo sapiens
gatgacatactcacttaggg

SEQ ID NO: 7210480 - DNA, 22 bp, Homo sapiens
gatgacatctcaatttgttctt

SEQ ID NO: 7210481 - DNA, 22 bp, Homo sapiens
gatgacatgatggacactcagt

SEQ ID NO: 7210482 - DNA, 22 bp, Homo sapiens
gatgacatgatggacactcagt

SEQ ID NO: 7210483 - DNA, 22 bp, Homo sapiens
gatgacatggctagcactgtga

SEQ ID NO: 7210484 - DNA, 22 bp, Homo sapiens
gatgacttatgtttacaaatgt

SEQ ID NO: 7210485 - DNA, 22 bp, Homo sapiens
gatgaggaatgctcagctcaat

SEQ ID NO: 7210486 - DNA, 22 bp, Homo sapiens
gatgaggaatttgaggttagaa

SEQ ID NO: 7210487 - DNA, 22 bp, Homo sapiens
gatgatgggcgctgtttactgg

SEQ ID NO: 7210488 - DNA, 22 bp, Homo sapiens
gatgaggaatgctcagctcaat

SEQ ID NO: 7210489 - DNA, 22 bp, Homo sapiens
gatgaggaaaccaaggctcagg

SEQ ID NO: 7210490 - DNA, 22 bp, Homo sapiens
gatgaggaaaccaaggctcagg

SEQ ID NO: 7210491 - DNA, 22 bp, Homo sapiens
gatgaggaaaccaaggctcagg

SEQ ID NO: 7210492 - DNA, 22 bp, Homo sapiens
gatgaggaaaccaaggctcagg

SEQ ID NO: 7210493 - DNA, 20 bp, Homo sapiens
gatgagacccatgcatgaga

SEQ ID NO: 7210494 - DNA, 22 bp, Homo sapiens
gatgagcattgtttcatgtgtt

SEQ ID NO: 7210495 - DNA, 22 bp, Homo sapiens
gatgagacagaatagcccaagg

SEQ ID NO: 7210496 - DNA, 22 bp, Homo sapiens
gatgcaaactgtgacatagagt

SEQ ID NO: 7210497 - DNA, 22 bp, Homo sapiens
gatgcaaagaggaccttcagta

SEQ ID NO: 7210498 - DNA, 22 bp, Homo sapiens
gatgcaaaccttacatggacct

SEQ ID NO: 7210499 - DNA, 22 bp, Homo sapiens
gatgattttgatgcagtaaaga

SEQ ID NO: 7210500 - DNA, 22 bp, Homo sapiens
gatgattttgatgcagtaaaga

SEQ ID NO: 7210501 - DNA, 22 bp, Homo sapiens
gatgattttgttggtgattcaa

SEQ ID NO: 7210502 - DNA, 22 bp, Homo sapiens
gatgatttttgccagtgtgatg

SEQ ID NO: 7210503 - DNA, 22 bp, Homo sapiens
gatgcaaaagtatcattttaat

SEQ ID NO: 7210504 - DNA, 22 bp, Homo sapiens
gatgatgtgtcccaagaagtag

SEQ ID NO: 7210505 - DNA, 22 bp, Homo sapiens
gatgattacacttttaaaacag

SEQ ID NO: 7210506 - DNA, 20 bp, Homo sapiens
gatgattatctgaagccctt

SEQ ID NO: 7210507 - DNA, 22 bp, Homo sapiens
gatgattcctttgttcattgtg

SEQ ID NO: 7210508 - DNA, 22 bp, Homo sapiens
gatgattctgtgtttggaatgc

SEQ ID NO: 7210509 - DNA, 22 bp, Homo sapiens
gatgattgttggctctcttgat

SEQ ID NO: 7210510 - DNA, 22 bp, Homo sapiens
gatgatttaagtggccaaagta

SEQ ID NO: 7210511 - DNA, 22 bp, Homo sapiens
gatgatttaagtggccaaagta

SEQ ID NO: 7210512 - DNA, 22 bp, Homo sapiens
gatgattttagttgactaaact

SEQ ID NO: 7210513 - DNA, 22 bp, Homo sapiens
gatgcaaagataaaacagacgc

SEQ ID NO: 7210514 - DNA, 22 bp, Homo sapiens
gatgcaaagataaaacagacgc

SEQ ID NO: 7210515 - DNA, 22 bp, Homo sapiens
gatgcaaagcatttttgtgtgt

SEQ ID NO: 7210516 - DNA, 22 bp, Homo sapiens
gatgcacaaagcagagggaatc

SEQ ID NO: 7210517 - DNA, 21 bp, Homo sapiens
gatgcacaatgggtaagtaca

SEQ ID NO: 7210518 - DNA, 22 bp, Homo sapiens
gatgcacaggtgagcaggtgca

SEQ ID NO: 7210519 - DNA, 22 bp, Homo sapiens
gatgcactgcagtatatactgt

SEQ ID NO: 7210520 - DNA, 22 bp, Homo sapiens
gatgcatgtatggagtgagggt

SEQ ID NO: 7210521 - DNA, 22 bp, Homo sapiens
gatgcagtgcttaaatcatttg

SEQ ID NO: 7210522 - DNA, 22 bp, Homo sapiens
gatgcagggctggcaggagctt

SEQ ID NO: 7210523 - DNA, 22 bp, Homo sapiens
gatgcagggcagctctgggaca

SEQ ID NO: 7210524 - DNA, 22 bp, Homo sapiens
gatgcacttgcccctcctcaga

SEQ ID NO: 7210525 - DNA, 22 bp, Homo sapiens
gatgcaggatagcttcacccag

SEQ ID NO: 7210526 - DNA, 22 bp, Homo sapiens
gatgcactttcttttcaacagt

SEQ ID NO: 7210527 - DNA, 20 bp, Homo sapiens
gatgaaatcactgggcagcc

SEQ ID NO: 7210528 - DNA, 20 bp, Homo sapiens
gatgaaatcactgggcagcc

SEQ ID NO: 7210529 - DNA, 22 bp, Homo sapiens
gatgaaatagcaaaggcatttg

SEQ ID NO: 7210530 - DNA, 22 bp, Homo sapiens
gatgaaatagcaaaggcatttg

SEQ ID NO: 7210531 - DNA, 22 bp, Homo sapiens
gatgaaatagcaaaggcatttg

SEQ ID NO: 7210532 - DNA, 17 bp, Homo sapiens
gatgaaatgatgcacac

SEQ ID NO: 7210533 - DNA, 17 bp, Homo sapiens
gatgaaatgatgcacac

SEQ ID NO: 7210534 - DNA, 22 bp, Homo sapiens
gatgaaatccagatcacaggtg

SEQ ID NO: 7210535 - DNA, 22 bp, Homo sapiens
gatgaaatccagatcacaggtg

SEQ ID NO: 7210536 - DNA, 22 bp, Homo sapiens
gatgaaatccagatcacaggtg

SEQ ID NO: 7210537 - DNA, 22 bp, Homo sapiens
gatgaaatttgaaaatagtgtt

SEQ ID NO: 7210538 - DNA, 22 bp, Homo sapiens
gatgaaatttgaaaatagtgtt

SEQ ID NO: 7210539 - DNA, 22 bp, Homo sapiens
gatgaaattcagaattgagggg

SEQ ID NO: 7210540 - DNA, 22 bp, Homo sapiens
gatgaaattgttttgatacttt

SEQ ID NO: 7210541 - DNA, 22 bp, Homo sapiens
gatgaaattgttttgatacttt

SEQ ID NO: 7210542 - DNA, 22 bp, Homo sapiens
gatgaaatgctgagcctgagtt

SEQ ID NO: 7210543 - DNA, 22 bp, Homo sapiens
gatgaaatgctgagcctgagtt

SEQ ID NO: 7210544 - DNA, 22 bp, Homo sapiens
gatgaaatgtgaaagttctggg

SEQ ID NO: 7210545 - DNA, 22 bp, Homo sapiens
gatgaaatgtgaaagttctggg

SEQ ID NO: 7210546 - DNA, 22 bp, Homo sapiens
gatgaaatgtgaaagttctggg

SEQ ID NO: 7210547 - DNA, 22 bp, Homo sapiens
gatgaaatgtgaaagttctggg

SEQ ID NO: 7210548 - DNA, 22 bp, Homo sapiens
gatgaaattcagaattgagggg

SEQ ID NO: 7210549 - DNA, 22 bp, Homo sapiens
gatgaaattcagaattgagggg

SEQ ID NO: 7210550 - DNA, 22 bp, Homo sapiens
gatgaaaaattgctgtgtcata

SEQ ID NO: 7210551 - DNA, 22 bp, Homo sapiens
gatgaaaaattgctgtgtcata

SEQ ID NO: 7210552 - DNA, 22 bp, Homo sapiens
gatgaaaaattgctgtgtcata

SEQ ID NO: 7210553 - DNA, 22 bp, Homo sapiens
gatgaaaatcttgagatgtcga

SEQ ID NO: 7210554 - DNA, 22 bp, Homo sapiens
gatgaaaatcttgagatgtcga

SEQ ID NO: 7210555 - DNA, 22 bp, Homo sapiens
gatgaaatagaattaatttagg

SEQ ID NO: 7210556 - DNA, 22 bp, Homo sapiens
gatgaaatagaattaatttagg

SEQ ID NO: 7210557 - DNA, 22 bp, Homo sapiens
gatgaaatagaattaatttagg

SEQ ID NO: 7210558 - DNA, 22 bp, Homo sapiens
gatcttttcaggtttctctagt

SEQ ID NO: 7210559 - DNA, 22 bp, Homo sapiens
gatcttttcagtcttggtagtt

SEQ ID NO: 7210560 - DNA, 22 bp, Homo sapiens
gatcttttcagtcttggtagtt

SEQ ID NO: 7210561 - DNA, 22 bp, Homo sapiens
gatgaaaaaagacgagcatata

SEQ ID NO: 7210562 - DNA, 22 bp, Homo sapiens
gatgaaaaaagacgagcatata

SEQ ID NO: 7210563 - DNA, 22 bp, Homo sapiens
gatgaaaaaagacgagcatata

SEQ ID NO: 7210564 - DNA, 22 bp, Homo sapiens
gatcttttcaggtttctctagt

SEQ ID NO: 7210565 - DNA, 22 bp, Homo sapiens
gatcttttcagaatttatcagt

SEQ ID NO: 7210566 - DNA, 22 bp, Homo sapiens
gatcttttcagaatttatcagt

SEQ ID NO: 7210567 - DNA, 22 bp, Homo sapiens
gatcttctttctctgtagaggt

SEQ ID NO: 7210568 - DNA, 22 bp, Homo sapiens
gatcttgaaatatcttttccta

SEQ ID NO: 7210569 - DNA, 22 bp, Homo sapiens
gatcttgagcaagttgcatccc

SEQ ID NO: 7210570 - DNA, 22 bp, Homo sapiens
gatcttggaatggcacagctga

SEQ ID NO: 7210571 - DNA, 22 bp, Homo sapiens
gatcttggggggatcaccatgg

SEQ ID NO: 7210572 - DNA, 22 bp, Homo sapiens
gatctgttataatctcttttat

SEQ ID NO: 7210573 - DNA, 22 bp, Homo sapiens
gatctgtttcaattgtcttagt

SEQ ID NO: 7210574 - DNA, 22 bp, Homo sapiens
gatctggtctttgattagacac

SEQ ID NO: 7210575 - DNA, 22 bp, Homo sapiens
gatctgggagcctcatggagac

SEQ ID NO: 7210576 - DNA, 22 bp, Homo sapiens
gatcattttgatgcccttttag

SEQ ID NO: 7210577 - DNA, 22 bp, Homo sapiens
gatcattttgtatagcaaaggt

SEQ ID NO: 7210578 - DNA, 22 bp, Homo sapiens
gatcattttgatgcccttttag

SEQ ID NO: 7210579 - DNA, 22 bp, Homo sapiens
gatcatttgcaggaaacattaa

SEQ ID NO: 7210580 - DNA, 22 bp, Homo sapiens
gatcatttgactttataaggct

SEQ ID NO: 7210581 - DNA, 22 bp, Homo sapiens
gatcattttgtatagcaaaggt

SEQ ID NO: 7210582 - DNA, 21 bp, Homo sapiens
gatccactgacctggggatcc

SEQ ID NO: 7210583 - DNA, 22 bp, Homo sapiens
gatccactgtgtttgtgttgag

SEQ ID NO: 7210584 - DNA, 22 bp, Homo sapiens
gatccagatatttgggctggta

SEQ ID NO: 7210585 - DNA, 22 bp, Homo sapiens
gatccagatatttgggctggta

SEQ ID NO: 7210586 - DNA, 22 bp, Homo sapiens
gatccagcttctacacagagct

SEQ ID NO: 7210587 - DNA, 22 bp, Homo sapiens
gatccagtggtttctccatgta

SEQ ID NO: 7210588 - DNA, 22 bp, Homo sapiens
gatccagtggtttctccatgta

SEQ ID NO: 7210589 - DNA, 22 bp, Homo sapiens
gatccccaggactagggggtgg

SEQ ID NO: 7210590 - DNA, 22 bp, Homo sapiens
gatccccaggactagggggtgg

SEQ ID NO: 7210591 - DNA, 22 bp, Homo sapiens
gatccccagggcaggcctcccg

SEQ ID NO: 7210592 - DNA, 22 bp, Homo sapiens
gatccccagggcaggcctcccg

SEQ ID NO: 7210593 - DNA, 22 bp, Homo sapiens
gatccctgccctcagcctggac

SEQ ID NO: 7210594 - DNA, 22 bp, Homo sapiens
gatccctgccctcagcctggac

SEQ ID NO: 7210595 - DNA, 22 bp, Homo sapiens
gataacccccaagaaggtcttt

SEQ ID NO: 7210596 - DNA, 22 bp, Homo sapiens
gataactgaacagattcacaaa

SEQ ID NO: 7210597 - DNA, 22 bp, Homo sapiens
gataagctaacccaagcccttt

SEQ ID NO: 7210598 - DNA, 22 bp, Homo sapiens
gataactgaacagattcacaaa

SEQ ID NO: 7210599 - DNA, 22 bp, Homo sapiens
gataagttatgtaacttgctca

SEQ ID NO: 7210600 - DNA, 22 bp, Homo sapiens
gataatacttattaagcactta

SEQ ID NO: 7210601 - DNA, 22 bp, Homo sapiens
gataatatctggtttattcacc

SEQ ID NO: 7210602 - DNA, 22 bp, Homo sapiens
gataagttatgtaacttgctca

SEQ ID NO: 7210603 - DNA, 22 bp, Homo sapiens
gataataagcacagcaggatgt

SEQ ID NO: 7210604 - DNA, 19 bp, Homo sapiens
gataagtttccaggtaact

SEQ ID NO: 7210605 - DNA, 22 bp, Homo sapiens
gatacacattttagctttgtct

SEQ ID NO: 7210606 - DNA, 22 bp, Homo sapiens
gatacatttcaaggaggactgg

SEQ ID NO: 7210607 - DNA, 22 bp, Homo sapiens
gatacattgagggtggaggacc

SEQ ID NO: 7210608 - DNA, 22 bp, Homo sapiens
gatacatttcaaggaggactgg

SEQ ID NO: 7210609 - DNA, 22 bp, Homo sapiens
gatacattttatctcctaacag

SEQ ID NO: 7210610 - DNA, 22 bp, Homo sapiens
gataccagacagggagggagaa

SEQ ID NO: 7210611 - DNA, 22 bp, Homo sapiens
gataccagacagggagggagaa

SEQ ID NO: 7210612 - DNA, 22 bp, Homo sapiens
gataccagacagggagggagaa

SEQ ID NO: 7210613 - DNA, 22 bp, Homo sapiens
gatacattccatttctacttaa

SEQ ID NO: 7210614 - DNA, 22 bp, Homo sapiens
gatacattccatttctacttaa

SEQ ID NO: 7210615 - DNA, 22 bp, Homo sapiens
gatacattccatttctacttaa

SEQ ID NO: 7210616 - DNA, 22 bp, Homo sapiens
gatacattccgggagggctacc

SEQ ID NO: 7210617 - DNA, 22 bp, Homo sapiens
gatacagacaccactcttttcc

SEQ ID NO: 7210618 - DNA, 21 bp, Homo sapiens
gatacagagggccactgattg

SEQ ID NO: 7210619 - DNA, 21 bp, Homo sapiens
gatacagagggccactgattg

SEQ ID NO: 7210620 - DNA, 21 bp, Homo sapiens
gatacagagggccactgattg

SEQ ID NO: 7210621 - DNA, 22 bp, Homo sapiens
gatacagatctttaactgccct

SEQ ID NO: 7210622 - DNA, 23 bp, Homo sapiens
gatacactccctgctgggcactg

SEQ ID NO: 7210623 - DNA, 22 bp, Homo sapiens
gatacactggccaagtggagga

SEQ ID NO: 7210624 - DNA, 22 bp, Homo sapiens
gatacactggagcttcctgaca

SEQ ID NO: 7210625 - DNA, 22 bp, Homo sapiens
gatacagaaaggctgcattgag

SEQ ID NO: 7210626 - DNA, 19 bp, Homo sapiens
gatataaagagatggtgaa

SEQ ID NO: 7210627 - DNA, 19 bp, Homo sapiens
gatataaagagatggtgaa

SEQ ID NO: 7210628 - DNA, 19 bp, Homo sapiens
gatataaagagatggtgaa

SEQ ID NO: 7210629 - DNA, 22 bp, Homo sapiens
gatagtcacctcccttaacttt

SEQ ID NO: 7210630 - DNA, 19 bp, Homo sapiens
gatataaagagatggtgaa

SEQ ID NO: 7210631 - DNA, 22 bp, Homo sapiens
gatagctgctgggatattttta

SEQ ID NO: 7210632 - DNA, 19 bp, Homo sapiens
gatagctgatgaccatcat

SEQ ID NO: 7210633 - DNA, 19 bp, Homo sapiens
gataggcagccatgagccc

SEQ ID NO: 7210634 - DNA, 22 bp, Homo sapiens
gatagtattacaggaaatcata

SEQ ID NO: 7210635 - DNA, 22 bp, Homo sapiens
gatagtcacctcccttaacttt

SEQ ID NO: 7210636 - DNA, 22 bp, Homo sapiens
gatataaattaatcaagtgcaa

SEQ ID NO: 7210637 - DNA, 22 bp, Homo sapiens
gatataaattaatcaagtgcaa

SEQ ID NO: 7210638 - DNA, 22 bp, Homo sapiens
gatataaattaatcaagtgcaa

SEQ ID NO: 7210639 - DNA, 22 bp, Homo sapiens
gatataaattaatcaagtgcaa

SEQ ID NO: 7210640 - DNA, 22 bp, Homo sapiens
gatataaattaatcaagtgcaa

SEQ ID NO: 7210641 - DNA, 22 bp, Homo sapiens
gatatacagagcattctttgat

SEQ ID NO: 7210642 - DNA, 22 bp, Homo sapiens
gatatacaatccacagttgatt

SEQ ID NO: 7210643 - DNA, 22 bp, Homo sapiens
gatatacaatccacagttgatt

SEQ ID NO: 7210644 - DNA, 22 bp, Homo sapiens
gatagcagctctggggtcagac

SEQ ID NO: 7210645 - DNA, 22 bp, Homo sapiens
gatagagaaacacagataaatg

SEQ ID NO: 7210646 - DNA, 22 bp, Homo sapiens
gatagagaaacacagataaatg

SEQ ID NO: 7210647 - DNA, 22 bp, Homo sapiens
gatagagactataatgctcttt

SEQ ID NO: 7210648 - DNA, 22 bp, Homo sapiens
gatagaaaggtgttgaaatcca

SEQ ID NO: 7210649 - DNA, 22 bp, Homo sapiens
gatagaaaggtgttgaaatcca

SEQ ID NO: 7210650 - DNA, 22 bp, Homo sapiens
gatagaaaggtgttgaaatcca

SEQ ID NO: 7210651 - DNA, 22 bp, Homo sapiens
gatagaaaggtgttgaaatcca

SEQ ID NO: 7210652 - DNA, 22 bp, Homo sapiens
gatagaaaggtgttgaaatcca

SEQ ID NO: 7210653 - DNA, 22 bp, Homo sapiens
gatactgtaggtgaaagtgttt

SEQ ID NO: 7210654 - DNA, 22 bp, Homo sapiens
gatactgtaggtgaaagtgttt

SEQ ID NO: 7210655 - DNA, 22 bp, Homo sapiens
gatactgtatcctaaaagcttt

SEQ ID NO: 7210656 - DNA, 22 bp, Homo sapiens
gatactgttagtaaaaggtact

SEQ ID NO: 7210657 - DNA, 22 bp, Homo sapiens
gatactgttttgtttgtgaggt

SEQ ID NO: 7210658 - DNA, 22 bp, Homo sapiens
gatactttccatccaaatgcat

SEQ ID NO: 7210659 - DNA, 22 bp, Homo sapiens
gatactttctcatttacccaag

SEQ ID NO: 7210660 - DNA, 22 bp, Homo sapiens
gatactttgtggaatcctggat

SEQ ID NO: 7210661 - DNA, 22 bp, Homo sapiens
gatagaaagaatatagattcca

SEQ ID NO: 7210662 - DNA, 22 bp, Homo sapiens
gatagaaagaatatagattcca

SEQ ID NO: 7210663 - DNA, 22 bp, Homo sapiens
gatattttcagtctcctttcaa

SEQ ID NO: 7210664 - DNA, 22 bp, Homo sapiens
gatattttcagtctcctttcaa

SEQ ID NO: 7210665 - DNA, 22 bp, Homo sapiens
gatatttattaagtggttggta

SEQ ID NO: 7210666 - DNA, 22 bp, Homo sapiens
gatatttattaagtggttggta

SEQ ID NO: 7210667 - DNA, 21 bp, Homo sapiens
gatatttatgactcattcctt

SEQ ID NO: 7210668 - DNA, 21 bp, Homo sapiens
gatatttatgactcattcctt

SEQ ID NO: 7210669 - DNA, 22 bp, Homo sapiens
gatatatttggaccagagcatt

SEQ ID NO: 7210670 - DNA, 22 bp, Homo sapiens
gatatttacattaagcacattg

SEQ ID NO: 7210671 - DNA, 22 bp, Homo sapiens
gatatatgtaaaagtagacaga

SEQ ID NO: 7210672 - DNA, 18 bp, Homo sapiens
gatatataggaggaaagt

SEQ ID NO: 7210673 - DNA, 18 bp, Homo sapiens
gatatataggaggaaagt

SEQ ID NO: 7210674 - DNA, 18 bp, Homo sapiens
gatatataggaggaaagt

SEQ ID NO: 7210675 - DNA, 18 bp, Homo sapiens
gatatataggaggaaagt

SEQ ID NO: 7210676 - DNA, 22 bp, Homo sapiens
gatataggttcatagtgttaca

SEQ ID NO: 7210677 - DNA, 22 bp, Homo sapiens
gatataggttcatagtgttaca

SEQ ID NO: 7210678 - DNA, 22 bp, Homo sapiens
gatatactgtctgtattacata

SEQ ID NO: 7210679 - DNA, 22 bp, Homo sapiens
gatatactgtctgtattacata

SEQ ID NO: 7210680 - DNA, 22 bp, Homo sapiens
gatatacataggtttctatgca

SEQ ID NO: 7210681 - DNA, 22 bp, Homo sapiens
gatattttcagtctcctttcaa

SEQ ID NO: 7210682 - DNA, 22 bp, Homo sapiens
gatattttcagtctcctttcaa

SEQ ID NO: 7210683 - DNA, 22 bp, Homo sapiens
gatattttcgcagggagaattc

SEQ ID NO: 7210684 - DNA, 22 bp, Homo sapiens
gatattttcattcggatgctca

SEQ ID NO: 7210685 - DNA, 22 bp, Homo sapiens
gatattttgagaaatcctatga

SEQ ID NO: 7210686 - DNA, 22 bp, Homo sapiens
gatattttgagaaatcctatga

SEQ ID NO: 7210687 - DNA, 22 bp, Homo sapiens
gatattttgagaaatcctatga

SEQ ID NO: 7210688 - DNA, 22 bp, Homo sapiens
gatattttgagaaatcctatga

SEQ ID NO: 7210689 - DNA, 22 bp, Homo sapiens
gatatttttaggtgatgcaggc

SEQ ID NO: 7210690 - DNA, 22 bp, Homo sapiens
gatatttttaggtgatgcaggc

SEQ ID NO: 7210691 - DNA, 22 bp, Homo sapiens
gatatttttaggtgatgcaggc

SEQ ID NO: 7210692 - DNA, 22 bp, Homo sapiens
gatatttttagtatttctgcct

SEQ ID NO: 7210693 - DNA, 22 bp, Homo sapiens
gatcacatgaatggaatagaag

SEQ ID NO: 7210694 - DNA, 22 bp, Homo sapiens
gatcacatgaatggaatagaag

SEQ ID NO: 7210695 - DNA, 22 bp, Homo sapiens
gatcacatctttatgagtattt

SEQ ID NO: 7210696 - DNA, 22 bp, Homo sapiens
gatcacatctttatgagtattt

SEQ ID NO: 7210697 - DNA, 22 bp, Homo sapiens
gatcacagtattttagatgtgt

SEQ ID NO: 7210698 - DNA, 22 bp, Homo sapiens
gatcacataatttggaaacagc

SEQ ID NO: 7210699 - DNA, 22 bp, Homo sapiens
gatcaattcaaactattttcct

SEQ ID NO: 7210700 - DNA, 22 bp, Homo sapiens
gatcacaatttagactttttaa

SEQ ID NO: 7210701 - DNA, 22 bp, Homo sapiens
gatcacagtattttagatgtgt

SEQ ID NO: 7210702 - DNA, 22 bp, Homo sapiens
gatcaatggtgtaacttgtcct

SEQ ID NO: 7210703 - DNA, 22 bp, Homo sapiens
gatcaatggtgtaacttgtcct

SEQ ID NO: 7210704 - DNA, 22 bp, Homo sapiens
gatcaatactattaagatcata

SEQ ID NO: 7210705 - DNA, 22 bp, Homo sapiens
gatatttttagtatttctgcct

SEQ ID NO: 7210706 - DNA, 22 bp, Homo sapiens
gatatttttgcagacacctggg

SEQ ID NO: 7210707 - DNA, 22 bp, Homo sapiens
gatatttttgcagacacctggg

SEQ ID NO: 7210708 - DNA, 22 bp, Homo sapiens
gatcaaaagctgggttctaaaa

SEQ ID NO: 7210709 - DNA, 22 bp, Homo sapiens
gatcaaaagctgggttctaaaa

SEQ ID NO: 7210710 - DNA, 22 bp, Homo sapiens
gatcaaaagctgggttctaaaa

SEQ ID NO: 7210711 - DNA, 22 bp, Homo sapiens
gatcaaagcctagttccaagat

SEQ ID NO: 7210712 - DNA, 22 bp, Homo sapiens
gatcaacaacttttgaatagct

SEQ ID NO: 7210713 - DNA, 22 bp, Homo sapiens
gatcaacatgtatttaagagtt

SEQ ID NO: 7210714 - DNA, 22 bp, Homo sapiens
gatcaagaggaatattggcaaa

SEQ ID NO: 7210715 - DNA, 22 bp, Homo sapiens
gatcatttcagtccagtaaata

SEQ ID NO: 7210716 - DNA, 22 bp, Homo sapiens
gatcatttacttgttctggact

SEQ ID NO: 7210717 - DNA, 22 bp, Homo sapiens
gatcatttacttgttctggact

SEQ ID NO: 7210718 - DNA, 22 bp, Homo sapiens
gatcattgctgcctttttctat

SEQ ID NO: 7210719 - DNA, 22 bp, Homo sapiens
gatcattggcctttctgcagtg

SEQ ID NO: 7210720 - DNA, 22 bp, Homo sapiens
gatcattggcctttctgcagtg

SEQ ID NO: 7210721 - DNA, 22 bp, Homo sapiens
gatcattaacaaccttaccctt

SEQ ID NO: 7210722 - DNA, 22 bp, Homo sapiens
gatcattagcttttcaaaggag

SEQ ID NO: 7210723 - DNA, 22 bp, Homo sapiens
gatcattaacaaccttaccctt

SEQ ID NO: 7210724 - DNA, 22 bp, Homo sapiens
gatcattgaacaggcactggag

SEQ ID NO: 7210725 - DNA, 22 bp, Homo sapiens
gatcattgaacaggcactggag

SEQ ID NO: 7210726 - DNA, 22 bp, Homo sapiens
gatcattgctgcctttttctat

SEQ ID NO: 7210727 - DNA, 22 bp, Homo sapiens
gatcatcaagcaagaacctgat

SEQ ID NO: 7210728 - DNA, 22 bp, Homo sapiens
gatcatcatctttcaggcaagt

SEQ ID NO: 7210729 - DNA, 22 bp, Homo sapiens
gatcatagcgtcttcttgcagc

SEQ ID NO: 7210730 - DNA, 22 bp, Homo sapiens
gatcatcatggctctggagctg

SEQ ID NO: 7210731 - DNA, 22 bp, Homo sapiens
gatcatcttttcctgcttccag

SEQ ID NO: 7210732 - DNA, 22 bp, Homo sapiens
gatcagagagctctttatggcc

SEQ ID NO: 7210733 - DNA, 22 bp, Homo sapiens
gatcagagagttagaaatgtca

SEQ ID NO: 7210734 - DNA, 22 bp, Homo sapiens
gatcagagccagagatgataac

SEQ ID NO: 7210735 - DNA, 22 bp, Homo sapiens
gatcagagtggctagagccttg

SEQ ID NO: 7210736 - DNA, 19 bp, Homo sapiens
gatcagagtgtcagcttgt

SEQ ID NO: 7210737 - DNA, 22 bp, Homo sapiens
gatcaggaatattggaaagtac

SEQ ID NO: 7210738 - DNA, 22 bp, Homo sapiens
gatcaggacatagctataggct

SEQ ID NO: 7210739 - DNA, 22 bp, Homo sapiens
gatcagtaagtgaataatgagt

SEQ ID NO: 7210740 - DNA, 22 bp, Homo sapiens
gatcagtgaactatactgcctc

SEQ ID NO: 7210741 - DNA, 22 bp, Homo sapiens
gatcagtgttttgtgcattctt

SEQ ID NO: 7210742 - DNA, 22 bp, Homo sapiens
ctttgttatctgtaaatggtta

SEQ ID NO: 7210743 - DNA, 22 bp, Homo sapiens
ctttgtttatatttctcctcga

SEQ ID NO: 7210744 - DNA, 22 bp, Homo sapiens
ctttgtttatatttctcctcga

SEQ ID NO: 7210745 - DNA, 22 bp, Homo sapiens
ctttgtttatatttctcctcga

SEQ ID NO: 7210746 - DNA, 22 bp, Homo sapiens
ctttgtttatatttctcctcga

SEQ ID NO: 7210747 - DNA, 22 bp, Homo sapiens
ctttgtctcctaagaactctca

SEQ ID NO: 7210748 - DNA, 22 bp, Homo sapiens
ctttgtctcctaagaactctca

SEQ ID NO: 7210749 - DNA, 22 bp, Homo sapiens
ctttgtgatagtgttaagacca

SEQ ID NO: 7210750 - DNA, 22 bp, Homo sapiens
ctttgtgcaaaccctagaatca

SEQ ID NO: 7210751 - DNA, 22 bp, Homo sapiens
ctttgtgcgtagtgagtggtca

SEQ ID NO: 7210752 - DNA, 22 bp, Homo sapiens
ctttgtgctttgaatgatagct

SEQ ID NO: 7210753 - DNA, 22 bp, Homo sapiens
ctttgtggctcctgcaggccat

SEQ ID NO: 7210754 - DNA, 22 bp, Homo sapiens
ctttgtgtctgttaataattat

SEQ ID NO: 7210755 - DNA, 22 bp, Homo sapiens
ctttgttactgatttcagtggg

SEQ ID NO: 7210756 - DNA, 22 bp, Homo sapiens
ctttgttactgatttcagtggg

SEQ ID NO: 7210757 - DNA, 22 bp, Homo sapiens
ctttgttaggggctcagggtgg

SEQ ID NO: 7210758 - DNA, 23 bp, Homo sapiens
cttttaaccggcatgggagggca

SEQ ID NO: 7210759 - DNA, 23 bp, Homo sapiens
cttttaactagagtatcagctgc

SEQ ID NO: 7210760 - DNA, 22 bp, Homo sapiens
ctttgttttactcagaggcatg

SEQ ID NO: 7210761 - DNA, 22 bp, Homo sapiens
ctttgttttactcagaggcatg

SEQ ID NO: 7210762 - DNA, 22 bp, Homo sapiens
ctttgttttactcagaggcatg

SEQ ID NO: 7210763 - DNA, 23 bp, Homo sapiens
cttttaacttgatctgagaccag

SEQ ID NO: 7210764 - DNA, 22 bp, Homo sapiens
cttttaagggataataagatgt

SEQ ID NO: 7210765 - DNA, 22 bp, Homo sapiens
cttttaatgagcattgctgtct

SEQ ID NO: 7210766 - DNA, 22 bp, Homo sapiens
cttttacactcatctgggaggg

SEQ ID NO: 7210767 - DNA, 22 bp, Homo sapiens
cttttacactcatctgggaggg

SEQ ID NO: 7210768 - DNA, 22 bp, Homo sapiens
cttttacactcatctgggaggg

SEQ ID NO: 7210769 - DNA, 22 bp, Homo sapiens
cttttacactcatctgggaggg

SEQ ID NO: 7210770 - DNA, 22 bp, Homo sapiens
gaaaacatccagagatagacct

SEQ ID NO: 7210771 - DNA, 22 bp, Homo sapiens
gaaaacatccagagatagacct

SEQ ID NO: 7210772 - DNA, 17 bp, Homo sapiens
cttttaatttacttccc

SEQ ID NO: 7210773 - DNA, 17 bp, Homo sapiens
cttttaatttacttccc

SEQ ID NO: 7210774 - DNA, 22 bp, Homo sapiens
cttttaatgggagcagtatttg

SEQ ID NO: 7210775 - DNA, 22 bp, Homo sapiens
gaaaaggcagagttccggggaa

SEQ ID NO: 7210776 - DNA, 22 bp, Homo sapiens
gaaaaggattggtaaaatatct

SEQ ID NO: 7210777 - DNA, 22 bp, Homo sapiens
gaaaaggccactcctaggagct

SEQ ID NO: 7210778 - DNA, 22 bp, Homo sapiens
gaaaaggccactcctaggagct

SEQ ID NO: 7210779 - DNA, 22 bp, Homo sapiens
gaaaaggccactcctaggagct

SEQ ID NO: 7210780 - DNA, 22 bp, Homo sapiens
gaaaaggcctccccataggaat

SEQ ID NO: 7210781 - DNA, 22 bp, Homo sapiens
gaaaaggcctccccataggaat

SEQ ID NO: 7210782 - DNA, 22 bp, Homo sapiens
gaaaaggcctccccataggaat

SEQ ID NO: 7210783 - DNA, 22 bp, Homo sapiens
gaaaaggcctggggcaaagtgt

SEQ ID NO: 7210784 - DNA, 22 bp, Homo sapiens
gaaaaggctctcactccctccg

SEQ ID NO: 7210785 - DNA, 22 bp, Homo sapiens
gaaaaggctctcactccctccg

SEQ ID NO: 7210786 - DNA, 22 bp, Homo sapiens
gaaaaggctgcccacttattga

SEQ ID NO: 7210787 - DNA, 22 bp, Homo sapiens
gaaaaggctgcccacttattga

SEQ ID NO: 7210788 - DNA, 22 bp, Homo sapiens
gaaaagggcaagagagagggca

SEQ ID NO: 7210789 - DNA, 22 bp, Homo sapiens
gaaaagggcaagagagagggca

SEQ ID NO: 7210790 - DNA, 22 bp, Homo sapiens
gaaaagcttactgccacttggc

SEQ ID NO: 7210791 - DNA, 22 bp, Homo sapiens
gaaaaggaaatttatagagatc

SEQ ID NO: 7210792 - DNA, 21 bp, Homo sapiens
gaaaagcaagggagtagaaca

SEQ ID NO: 7210793 - DNA, 21 bp, Homo sapiens
gaaaagcaagggagtagaaca

SEQ ID NO: 7210794 - DNA, 22 bp, Homo sapiens
gaaaagccttctcacataagta

SEQ ID NO: 7210795 - DNA, 22 bp, Homo sapiens
gaaaagctaggccagttcagct

SEQ ID NO: 7210796 - DNA, 22 bp, Homo sapiens
gaaaacatccagagatagacct

SEQ ID NO: 7210797 - DNA, 22 bp, Homo sapiens
gaaaagagacagggtgggtgat

SEQ ID NO: 7210798 - DNA, 22 bp, Homo sapiens
gaaaagagtcctgtgtgaggag

SEQ ID NO: 7210799 - DNA, 21 bp, Homo sapiens
gaaaagcaagggagtagaaca

SEQ ID NO: 7210800 - DNA, 22 bp, Homo sapiens
gaaaagttcatcatatattcag

SEQ ID NO: 7210801 - DNA, 22 bp, Homo sapiens
gaaaagttcatcatatattcag

SEQ ID NO: 7210802 - DNA, 22 bp, Homo sapiens
gaaaatacaaatagccttgaaa

SEQ ID NO: 7210803 - DNA, 21 bp, Homo sapiens
gaaaatacaatgagcttgacc

SEQ ID NO: 7210804 - DNA, 21 bp, Homo sapiens
gaaaatacaatgagcttgacc

SEQ ID NO: 7210805 - DNA, 18 bp, Homo sapiens
gaaaatactctgggctca

SEQ ID NO: 7210806 - DNA, 22 bp, Homo sapiens
gaaaatacttcagtgttctggc

SEQ ID NO: 7210807 - DNA, 22 bp, Homo sapiens
gaaaggcagtacagctgagcct

SEQ ID NO: 7210808 - DNA, 22 bp, Homo sapiens
gaaaggcatcttcagtctctga

SEQ ID NO: 7210809 - DNA, 22 bp, Homo sapiens
gaaaggcatcttcagtctctga

SEQ ID NO: 7210810 - DNA, 22 bp, Homo sapiens
gaaaggctaaaattataagggt

SEQ ID NO: 7210811 - DNA, 22 bp, Homo sapiens
gaaaggctaaaattataagggt

SEQ ID NO: 7210812 - DNA, 22 bp, Homo sapiens
gaaaggctactgtcatcaatta

SEQ ID NO: 7210813 - DNA, 22 bp, Homo sapiens
gaaaggctactgtcatcaatta

SEQ ID NO: 7210814 - DNA, 22 bp, Homo sapiens
gaaaggctactgtcatcaatta

SEQ ID NO: 7210815 - DNA, 22 bp, Homo sapiens
gaaaggctatgagtttggtata

SEQ ID NO: 7210816 - DNA, 22 bp, Homo sapiens
gaaaggctatgagtttggtata

SEQ ID NO: 7210817 - DNA, 22 bp, Homo sapiens
gaaaggctcactttagatcatg

SEQ ID NO: 7210818 - DNA, 22 bp, Homo sapiens
gaaaggctcactttagatcatg

SEQ ID NO: 7210819 - DNA, 22 bp, Homo sapiens
gaaaggctcagaagtttgtatt

SEQ ID NO: 7210820 - DNA, 22 bp, Homo sapiens
gaaaggctcagaagtttgtatt

SEQ ID NO: 7210821 - DNA, 22 bp, Homo sapiens
gaaaggctcagattcccccagg

SEQ ID NO: 7210822 - DNA, 22 bp, Homo sapiens
gaaaggctcagattcccccagg

SEQ ID NO: 7210823 - DNA, 22 bp, Homo sapiens
gaaaggctcagattcccccagg

SEQ ID NO: 7210824 - DNA, 23 bp, Homo sapiens
gaaaggctctgggacccccaact

SEQ ID NO: 7210825 - DNA, 23 bp, Homo sapiens
gaaaggctctgggacccccaact

SEQ ID NO: 7210826 - DNA, 23 bp, Homo sapiens
gaaaggctctgggacccccaact

SEQ ID NO: 7210827 - DNA, 22 bp, Homo sapiens
gaaaggctgcatctcgcctcag

SEQ ID NO: 7210828 - DNA, 22 bp, Homo sapiens
gaaaggctgcatctcgcctcag

SEQ ID NO: 7210829 - DNA, 22 bp, Homo sapiens
gaaaggctgcatctcgcctcag

SEQ ID NO: 7210830 - DNA, 19 bp, Homo sapiens
gaaaggctgctgctacctg

SEQ ID NO: 7210831 - DNA, 19 bp, Homo sapiens
gaaaggctgctgctacctg

SEQ ID NO: 7210832 - DNA, 22 bp, Homo sapiens
gaaaggctgggatttagcgctg

SEQ ID NO: 7210833 - DNA, 22 bp, Homo sapiens
gaaaggctgggatttagcgctg

SEQ ID NO: 7210834 - DNA, 22 bp, Homo sapiens
gaaaggcttaaattgtaagggc

SEQ ID NO: 7210835 - DNA, 22 bp, Homo sapiens
gaaaggcttaaattgtaagggc

SEQ ID NO: 7210836 - DNA, 22 bp, Homo sapiens
gaaaggcttcttaagcttcact

SEQ ID NO: 7210837 - DNA, 22 bp, Homo sapiens
gaaaggcttcttaagcttcact

SEQ ID NO: 7210838 - DNA, 22 bp, Homo sapiens
gaaaggcttcttaagcttcact

SEQ ID NO: 7210839 - DNA, 22 bp, Homo sapiens
gaaaggcttgagacattgatga

SEQ ID NO: 7210840 - DNA, 22 bp, Homo sapiens
gaaaggcttgagacattgatga

SEQ ID NO: 7210841 - DNA, 22 bp, Homo sapiens
gaaaggcttgcttttgctcggt

SEQ ID NO: 7210842 - DNA, 22 bp, Homo sapiens
gaaaggcttgcttttgctcggt

SEQ ID NO: 7210843 - DNA, 22 bp, Homo sapiens
gaaaggcttggttttgaatata

SEQ ID NO: 7210844 - DNA, 22 bp, Homo sapiens
gaaaggcttggttttgaatata

SEQ ID NO: 7210845 - DNA, 22 bp, Homo sapiens
gaaagggagtgaagatggtata

SEQ ID NO: 7210846 - DNA, 22 bp, Homo sapiens
gaaagggagtgaagatggtata

SEQ ID NO: 7210847 - DNA, 22 bp, Homo sapiens
gaaaggttgggtgaatggtgga

SEQ ID NO: 7210848 - DNA, 22 bp, Homo sapiens
gaaaggttgggtgaatggtgga

SEQ ID NO: 7210849 - DNA, 22 bp, Homo sapiens
gaaaggttcttgggagttcaca

SEQ ID NO: 7210850 - DNA, 22 bp, Homo sapiens
gaaagtgcatgtgcccaccatt

SEQ ID NO: 7210851 - DNA, 22 bp, Homo sapiens
gaaagtgcatgtgcccaccatt

SEQ ID NO: 7210852 - DNA, 22 bp, Homo sapiens
gaaagtgccagaataggaggcc

SEQ ID NO: 7210853 - DNA, 22 bp, Homo sapiens
gaaagtgccagaataggaggcc

SEQ ID NO: 7210854 - DNA, 22 bp, Homo sapiens
gaaagtgcctcagtcctcttat

SEQ ID NO: 7210855 - DNA, 22 bp, Homo sapiens
gaaagtgcctcagtcctcttat

SEQ ID NO: 7210856 - DNA, 18 bp, Homo sapiens
gaaagtgcggggcagggg

SEQ ID NO: 7210857 - DNA, 22 bp, Homo sapiens
gaaagggtctttgatttccctc

SEQ ID NO: 7210858 - DNA, 22 bp, Homo sapiens
gaaaggggcatgtagggatcac

SEQ ID NO: 7210859 - DNA, 22 bp, Homo sapiens
gaaaggggcatgtagggatcac

SEQ ID NO: 7210860 - DNA, 17 bp, Homo sapiens
gaaaggtcctagaaatc

SEQ ID NO: 7210861 - DNA, 21 bp, Homo sapiens
gaaaggtcttaacttacagag

SEQ ID NO: 7210862 - DNA, 22 bp, Homo sapiens
gaaaggtcttccggtcttccag

SEQ ID NO: 7210863 - DNA, 22 bp, Homo sapiens
gaaagggagtggacaacaggca

SEQ ID NO: 7210864 - DNA, 22 bp, Homo sapiens
gaaagggagtggacaacaggca

SEQ ID NO: 7210865 - DNA, 22 bp, Homo sapiens
gaaagggagtggacaacaggca

SEQ ID NO: 7210866 - DNA, 22 bp, Homo sapiens
gaaagggagtggacaacaggca

SEQ ID NO: 7210867 - DNA, 22 bp, Homo sapiens
gaaagggagtggacaacaggca

SEQ ID NO: 7210868 - DNA, 22 bp, Homo sapiens
gaaagtttctcacacatgcaga

SEQ ID NO: 7210869 - DNA, 22 bp, Homo sapiens
gaaagtttctcacacatgcaga

SEQ ID NO: 7210870 - DNA, 22 bp, Homo sapiens
gaaagtttataggttatataat

SEQ ID NO: 7210871 - DNA, 22 bp, Homo sapiens
gaaagttgcaatcatggctttt

SEQ ID NO: 7210872 - DNA, 18 bp, Homo sapiens
gaaagtgcggggcagggg

SEQ ID NO: 7210873 - DNA, 22 bp, Homo sapiens
gaaagtgctaggaagtgttaga

SEQ ID NO: 7210874 - DNA, 22 bp, Homo sapiens
gaaagtgctaggaagtgttaga

SEQ ID NO: 7210875 - DNA, 22 bp, Homo sapiens
gaaagtgctctctctatacaca

SEQ ID NO: 7210876 - DNA, 22 bp, Homo sapiens
gaaagtgcttagagtgtggtat

SEQ ID NO: 7210877 - DNA, 22 bp, Homo sapiens
gaaagtgcttagagtgtggtat

SEQ ID NO: 7210878 - DNA, 22 bp, Homo sapiens
gaaagtgcttttgagtgtgtgc

SEQ ID NO: 7210879 - DNA, 22 bp, Homo sapiens
gaaagtgcttttgagtgtgtgc

SEQ ID NO: 7210880 - DNA, 22 bp, Homo sapiens
gaaagtgctctctctatacaca

SEQ ID NO: 7210881 - DNA, 22 bp, Homo sapiens
gaactacagtgcattttcttaa

SEQ ID NO: 7210882 - DNA, 22 bp, Homo sapiens
gaactacagtaagaattgatgt

SEQ ID NO: 7210883 - DNA, 22 bp, Homo sapiens
gaactacagtgcattttcttaa

SEQ ID NO: 7210884 - DNA, 22 bp, Homo sapiens
gaactacagtaagaattgatgt

SEQ ID NO: 7210885 - DNA, 22 bp, Homo sapiens
gaactacaggtgcagcaagtga

SEQ ID NO: 7210886 - DNA, 22 bp, Homo sapiens
gaactaaatttgacagacaaca

SEQ ID NO: 7210887 - DNA, 22 bp, Homo sapiens
gaactaaatttgacagacaaca

SEQ ID NO: 7210888 - DNA, 22 bp, Homo sapiens
gaacgctgtcattgcagcatgg

SEQ ID NO: 7210889 - DNA, 22 bp, Homo sapiens
gaacgggtgcagccatgggccc

SEQ ID NO: 7210890 - DNA, 22 bp, Homo sapiens
gaacgggtgcagccatgggccc

SEQ ID NO: 7210891 - DNA, 22 bp, Homo sapiens
gaactaaatgaaattactggtg

SEQ ID NO: 7210892 - DNA, 22 bp, Homo sapiens
gaacctctatatttgtgacatc

SEQ ID NO: 7210893 - DNA, 22 bp, Homo sapiens
gaacctctcagcagccatgatc

SEQ ID NO: 7210894 - DNA, 20 bp, Homo sapiens
gaacctctcccagcccctgg

SEQ ID NO: 7210895 - DNA, 22 bp, Homo sapiens
gaacctctttaaagaacagaat

SEQ ID NO: 7210896 - DNA, 22 bp, Homo sapiens
gaacctctttagtgcatccttc

SEQ ID NO: 7210897 - DNA, 22 bp, Homo sapiens
gaacctctttgtgcttcagctt

SEQ ID NO: 7210898 - DNA, 22 bp, Homo sapiens
gaacctctttaaagaacagaat

SEQ ID NO: 7210899 - DNA, 22 bp, Homo sapiens
gaacctggaatgtggcgcccaa

SEQ ID NO: 7210900 - DNA, 22 bp, Homo sapiens
gaacctggaatctattacaagg

SEQ ID NO: 7210901 - DNA, 22 bp, Homo sapiens
gaacctggaatgtggcgcccaa

SEQ ID NO: 7210902 - DNA, 22 bp, Homo sapiens
gaacctggcagccctatatctg

SEQ ID NO: 7210903 - DNA, 20 bp, Homo sapiens
gaacctggggaaggagtagg

SEQ ID NO: 7210904 - DNA, 20 bp, Homo sapiens
gaacctggggaaggagtagg

SEQ ID NO: 7210905 - DNA, 22 bp, Homo sapiens
gaacctttttccaagtaaacaa

SEQ ID NO: 7210906 - DNA, 22 bp, Homo sapiens
gaacctttttccaagtaaacaa

SEQ ID NO: 7210907 - DNA, 22 bp, Homo sapiens
gaactatatcttcaagaaaatg

SEQ ID NO: 7210908 - DNA, 22 bp, Homo sapiens
gaactatatcttcaagaaaatg

SEQ ID NO: 7210909 - DNA, 22 bp, Homo sapiens
gaactctgggcaagccaagggc

SEQ ID NO: 7210910 - DNA, 22 bp, Homo sapiens
gaactctgagaggagcacaggc

SEQ ID NO: 7210911 - DNA, 22 bp, Homo sapiens
gaactctaggtaaatgagatat

SEQ ID NO: 7210912 - DNA, 22 bp, Homo sapiens
gaactctctcatctgtcagttg

SEQ ID NO: 7210913 - DNA, 22 bp, Homo sapiens
gaactctctcatctgtcagttg

SEQ ID NO: 7210914 - DNA, 22 bp, Homo sapiens
gaactggtgagagttcacggga

SEQ ID NO: 7210915 - DNA, 22 bp, Homo sapiens
gaactggttacagagggatgtt

SEQ ID NO: 7210916 - DNA, 22 bp, Homo sapiens
gaactggtcagtttagcccact

SEQ ID NO: 7210917 - DNA, 22 bp, Homo sapiens
gaactgggtccttgagtctaga

SEQ ID NO: 7210918 - DNA, 22 bp, Homo sapiens
gaactggtcagtttagcccact

SEQ ID NO: 7210919 - DNA, 22 bp, Homo sapiens
gaactggtcttttaggttttct

SEQ ID NO: 7210920 - DNA, 22 bp, Homo sapiens
gaactggtgaagtgaagggcag

SEQ ID NO: 7210921 - DNA, 22 bp, Homo sapiens
gaactgcattgtggtatatgtt

SEQ ID NO: 7210922 - DNA, 22 bp, Homo sapiens
gaactgcatcttaaataatact

SEQ ID NO: 7210923 - DNA, 22 bp, Homo sapiens
gaactgggaatgctgtcccatc

SEQ ID NO: 7210924 - DNA, 22 bp, Homo sapiens
gaactgaagacttttactgtac

SEQ ID NO: 7210925 - DNA, 22 bp, Homo sapiens
gaacactgagagagatgggcag

SEQ ID NO: 7210926 - DNA, 22 bp, Homo sapiens
gaacactgagagagatgggcag

SEQ ID NO: 7210927 - DNA, 22 bp, Homo sapiens
gaacactgaggacactgagaat

SEQ ID NO: 7210928 - DNA, 22 bp, Homo sapiens
gaacactgaggacactgagaat

SEQ ID NO: 7210929 - DNA, 22 bp, Homo sapiens
gaacactgaggacactgagaat

SEQ ID NO: 7210930 - DNA, 22 bp, Homo sapiens
gaacactgaggacactgagaat

SEQ ID NO: 7210931 - DNA, 22 bp, Homo sapiens
gaacactgctgttgggttctga

SEQ ID NO: 7210932 - DNA, 22 bp, Homo sapiens
gaacactggggtatcattgagc

SEQ ID NO: 7210933 - DNA, 22 bp, Homo sapiens
gaacactggggtatcattgagc

SEQ ID NO: 7210934 - DNA, 22 bp, Homo sapiens
gaacactggggtatcattgagc

SEQ ID NO: 7210935 - DNA, 22 bp, Homo sapiens
gaacactggggtatcattgagc

SEQ ID NO: 7210936 - DNA, 22 bp, Homo sapiens
gaacactgtttcttcgtgaaca

SEQ ID NO: 7210937 - DNA, 22 bp, Homo sapiens
gaacactgtttcttcgtgaaca

SEQ ID NO: 7210938 - DNA, 19 bp, Homo sapiens
gaacacttactatatttct

SEQ ID NO: 7210939 - DNA, 19 bp, Homo sapiens
gaacacttactatatttct

SEQ ID NO: 7210940 - DNA, 22 bp, Homo sapiens
gaacacttgctgttaataagtg

SEQ ID NO: 7210941 - DNA, 22 bp, Homo sapiens
gaacacttggctttggatttaa

SEQ ID NO: 7210942 - DNA, 22 bp, Homo sapiens
gaacactttaacattccttttc

SEQ ID NO: 7210943 - DNA, 22 bp, Homo sapiens
gaacagaagaggctggtgccac

SEQ ID NO: 7210944 - DNA, 22 bp, Homo sapiens
gaacagaagaggctggtgccac

SEQ ID NO: 7210945 - DNA, 22 bp, Homo sapiens
gaacagaagaggctggtgccac

SEQ ID NO: 7210946 - DNA, 22 bp, Homo sapiens
gaacagaattaccgaagatctg

SEQ ID NO: 7210947 - DNA, 22 bp, Homo sapiens
gaacagaattaccgaagatctg

SEQ ID NO: 7210948 - DNA, 22 bp, Homo sapiens
gaacagaattaccgaagatctg

SEQ ID NO: 7210949 - DNA, 22 bp, Homo sapiens
gaacagaattaccgaagatctg

SEQ ID NO: 7210950 - DNA, 22 bp, Homo sapiens
gaacccaggaggttgcagtgag

SEQ ID NO: 7210951 - DNA, 22 bp, Homo sapiens
gaaccccaacttataagacaga

SEQ ID NO: 7210952 - DNA, 22 bp, Homo sapiens
gaaccctagcatgtcctttagg

SEQ ID NO: 7210953 - DNA, 22 bp, Homo sapiens
gaacctctagtttgttctttga

SEQ ID NO: 7210954 - DNA, 17 bp, Homo sapiens
gaacagcagaggggaca

SEQ ID NO: 7210955 - DNA, 18 bp, Homo sapiens
gaacagcaatttcatgtt

SEQ ID NO: 7210956 - DNA, 22 bp, Homo sapiens
gaacagatgggctcagatcctg

SEQ ID NO: 7210957 - DNA, 22 bp, Homo sapiens
gaacagagttgaaacaaggctg

SEQ ID NO: 7210958 - DNA, 22 bp, Homo sapiens
gaacagagctgactacaaggca

SEQ ID NO: 7210959 - DNA, 22 bp, Homo sapiens
gaacagagctgactacaaggca

SEQ ID NO: 7210960 - DNA, 22 bp, Homo sapiens
gaacagagttgaaacaaggctg

SEQ ID NO: 7210961 - DNA, 22 bp, Homo sapiens
gaacagagttgaaacaaggctg

SEQ ID NO: 7210962 - DNA, 22 bp, Homo sapiens
gaacagagaagctttactaaag

SEQ ID NO: 7210963 - DNA, 22 bp, Homo sapiens
gaaataagagtccatgccaggt

SEQ ID NO: 7210964 - DNA, 22 bp, Homo sapiens
gaaataatacagtgctcttctc

SEQ ID NO: 7210965 - DNA, 22 bp, Homo sapiens
gaaataatacagtgctcttctc

SEQ ID NO: 7210966 - DNA, 22 bp, Homo sapiens
gaaataacctcatgcaccatga

SEQ ID NO: 7210967 - DNA, 22 bp, Homo sapiens
gaaataagagtccatgccaggt

SEQ ID NO: 7210968 - DNA, 22 bp, Homo sapiens
gaaataacagctctggaagagt

SEQ ID NO: 7210969 - DNA, 22 bp, Homo sapiens
gaaagttttctcacacagtaat

SEQ ID NO: 7210970 - DNA, 22 bp, Homo sapiens
gaaagttttctcacacagtaat

SEQ ID NO: 7210971 - DNA, 22 bp, Homo sapiens
gaaagttttcatatataccaaa

SEQ ID NO: 7210972 - DNA, 22 bp, Homo sapiens
gaaagttttcatatataccaaa

SEQ ID NO: 7210973 - DNA, 17 bp, Homo sapiens
gaaagtttctctctctt

SEQ ID NO: 7210974 - DNA, 22 bp, Homo sapiens
gaaagtttcttcattaagatgt

SEQ ID NO: 7210975 - DNA, 22 bp, Homo sapiens
gaaagtttcttcattaagatgt

SEQ ID NO: 7210976 - DNA, 22 bp, Homo sapiens
gaaagtttcttcattaagatgt

SEQ ID NO: 7210977 - DNA, 22 bp, Homo sapiens
gaaagtttgcctctctcttgag

SEQ ID NO: 7210978 - DNA, 22 bp, Homo sapiens
gaaagtttgcctctctcttgag

SEQ ID NO: 7210979 - DNA, 22 bp, Homo sapiens
gaaataattctgtgtctgaaca

SEQ ID NO: 7210980 - DNA, 22 bp, Homo sapiens
gaaataattctgtgtctgaaca

SEQ ID NO: 7210981 - DNA, 22 bp, Homo sapiens
gaaataattctgtgtctgaaca

SEQ ID NO: 7210982 - DNA, 22 bp, Homo sapiens
gaaataattctgtgtctgaaca

SEQ ID NO: 7210983 - DNA, 22 bp, Homo sapiens
gaaataatacagtgctcttctc

SEQ ID NO: 7210984 - DNA, 22 bp, Homo sapiens
gaaataatttagaaggtattcc

SEQ ID NO: 7210985 - DNA, 22 bp, Homo sapiens
gaaataatttagaaggtattcc

SEQ ID NO: 7210986 - DNA, 22 bp, Homo sapiens
gaaataatttagaaggtattcc

SEQ ID NO: 7210987 - DNA, 22 bp, Homo sapiens
gaaatacaaagccagccatttt

SEQ ID NO: 7210988 - DNA, 22 bp, Homo sapiens
gaaatacaaagccagccatttt

SEQ ID NO: 7210989 - DNA, 22 bp, Homo sapiens
gaaatacaaagccagccatttt

SEQ ID NO: 7210990 - DNA, 22 bp, Homo sapiens
gaaatacaaagccagccatttt

SEQ ID NO: 7210991 - DNA, 22 bp, Homo sapiens
gaaatacaaatgcctagatcct

SEQ ID NO: 7210992 - DNA, 22 bp, Homo sapiens
gaaatacaaatgcctagatcct

SEQ ID NO: 7210993 - DNA, 22 bp, Homo sapiens
gaaatacaaatgcctagatcct

SEQ ID NO: 7210994 - DNA, 22 bp, Homo sapiens
gaaatacaaatgcctagatcct

SEQ ID NO: 7210995 - DNA, 22 bp, Homo sapiens
gaaatacaaatgcctagatcct

SEQ ID NO: 7210996 - DNA, 22 bp, Homo sapiens
gaacactgagaaagtcagcttt

SEQ ID NO: 7210997 - DNA, 22 bp, Homo sapiens
gaacactgacattttcctgact

SEQ ID NO: 7210998 - DNA, 22 bp, Homo sapiens
gaacacatttctctgactgtag

SEQ ID NO: 7210999 - DNA, 22 bp, Homo sapiens
gaacactgacattttcctgact

SEQ ID NO: 7211000 - DNA, 22 bp, Homo sapiens
gaacactgacattttcctgact

SEQ ID NO: 7211001 - DNA, 22 bp, Homo sapiens
gaacacatttctctgactgtag

SEQ ID NO: 7211002 - DNA, 22 bp, Homo sapiens
gaacacatttctctgactgtag

SEQ ID NO: 7211003 - DNA, 22 bp, Homo sapiens
gaacacatttctctgactgtag

SEQ ID NO: 7211004 - DNA, 22 bp, Homo sapiens
gaacacattagtctgagttggc

SEQ ID NO: 7211005 - DNA, 22 bp, Homo sapiens
gaacacatgtcctccttggatt

SEQ ID NO: 7211006 - DNA, 22 bp, Homo sapiens
gaacacattagtctgagttggc

SEQ ID NO: 7211007 - DNA, 22 bp, Homo sapiens
gaacacatgattataaatgcta

SEQ ID NO: 7211008 - DNA, 22 bp, Homo sapiens
gaacacatgtcctccttggatt

SEQ ID NO: 7211009 - DNA, 22 bp, Homo sapiens
gaacacatgtcctccttggatt

SEQ ID NO: 7211010 - DNA, 22 bp, Homo sapiens
gaacacatcacattttacagtg

SEQ ID NO: 7211011 - DNA, 22 bp, Homo sapiens
gaacacatcacattttacagtg

SEQ ID NO: 7211012 - DNA, 22 bp, Homo sapiens
gaacacatgattataaatgcta

SEQ ID NO: 7211013 - DNA, 22 bp, Homo sapiens
gaacacatcacattttacagtg

SEQ ID NO: 7211014 - DNA, 22 bp, Homo sapiens
gaacacagtttagaaaatgctg

SEQ ID NO: 7211015 - DNA, 22 bp, Homo sapiens
gaacacaggtggcccggcaggg

SEQ ID NO: 7211016 - DNA, 22 bp, Homo sapiens
gaacacagtcaagggctgctgt

SEQ ID NO: 7211017 - DNA, 22 bp, Homo sapiens
gaacacagtcaagggctgctgt

SEQ ID NO: 7211018 - DNA, 22 bp, Homo sapiens
gaacacagcagggataaccact

SEQ ID NO: 7211019 - DNA, 22 bp, Homo sapiens
gaacacaactcagaatgctggt

SEQ ID NO: 7211020 - DNA, 22 bp, Homo sapiens
gaacacaagcgtatgtctttgt

SEQ ID NO: 7211021 - DNA, 22 bp, Homo sapiens
gaaatttacaactttctcatgg

SEQ ID NO: 7211022 - DNA, 22 bp, Homo sapiens
gaaatttattatctacatcatt

SEQ ID NO: 7211023 - DNA, 22 bp, Homo sapiens
gaaatacaattttgtcccagct

SEQ ID NO: 7211024 - DNA, 22 bp, Homo sapiens
gaaatacaattttgtcccagct

SEQ ID NO: 7211025 - DNA, 22 bp, Homo sapiens
gaaatacaattttgtcccagct

SEQ ID NO: 7211026 - DNA, 22 bp, Homo sapiens
gaaatacagaaagggctgaatg

SEQ ID NO: 7211027 - DNA, 22 bp, Homo sapiens
gaaatacagaaagggctgaatg

SEQ ID NO: 7211028 - DNA, 22 bp, Homo sapiens
gaaattgtgcatttagcaacac

SEQ ID NO: 7211029 - DNA, 22 bp, Homo sapiens
gaaatttacaactttctcatgg

SEQ ID NO: 7211030 - DNA, 22 bp, Homo sapiens
cttctttcaagaatggattagg

SEQ ID NO: 7211031 - DNA, 22 bp, Homo sapiens
cttctttcccaggcatgtttta

SEQ ID NO: 7211032 - DNA, 22 bp, Homo sapiens
cttctttcccaggcatgtttta

SEQ ID NO: 7211033 - DNA, 22 bp, Homo sapiens
cttctttccttcctccagtggc

SEQ ID NO: 7211034 - DNA, 22 bp, Homo sapiens
cttctttccttcctccagtggc

SEQ ID NO: 7211035 - DNA, 22 bp, Homo sapiens
cttctttcttttgatcacaggt

SEQ ID NO: 7211036 - DNA, 22 bp, Homo sapiens
cttctttcttttgatcacaggt

SEQ ID NO: 7211037 - DNA, 22 bp, Homo sapiens
cttcttttcatggcttgggaag

SEQ ID NO: 7211038 - DNA, 22 bp, Homo sapiens
cttcttttacaggtcttgggtt

SEQ ID NO: 7211039 - DNA, 22 bp, Homo sapiens
cttctttgtgcctattggtgac

SEQ ID NO: 7211040 - DNA, 22 bp, Homo sapiens
cttgaagacaatggcagattcc

SEQ ID NO: 7211041 - DNA, 18 bp, Homo sapiens
cttgaagaattttgcagt

SEQ ID NO: 7211042 - DNA, 20 bp, Homo sapiens
cttgaactgattctatttcc

SEQ ID NO: 7211043 - DNA, 20 bp, Homo sapiens
cttgaactgattctatttcc

SEQ ID NO: 7211044 - DNA, 22 bp, Homo sapiens
cttgaagaaagtatgttgggat

SEQ ID NO: 7211045 - DNA, 22 bp, Homo sapiens
cttgaagaaatggagacaggat

SEQ ID NO: 7211046 - DNA, 22 bp, Homo sapiens
cttgaactcaatgtgaggaaga

SEQ ID NO: 7211047 - DNA, 22 bp, Homo sapiens
cttgaactcaatgtgaggaaga

SEQ ID NO: 7211048 - DNA, 22 bp, Homo sapiens
cttgaactcaatgtgaggaaga

SEQ ID NO: 7211049 - DNA, 22 bp, Homo sapiens
cttgaaatgacaggagcacatc

SEQ ID NO: 7211050 - DNA, 22 bp, Homo sapiens
cttgaaagaagggtcttttaat

SEQ ID NO: 7211051 - DNA, 22 bp, Homo sapiens
cttgaaagaagggtcttttaat

SEQ ID NO: 7211052 - DNA, 22 bp, Homo sapiens
cttgaaaataagaaagactttc

SEQ ID NO: 7211053 - DNA, 22 bp, Homo sapiens
cttgaaaataagaaagactttc

SEQ ID NO: 7211054 - DNA, 22 bp, Homo sapiens
cttgaaaataagaaagactttc

SEQ ID NO: 7211055 - DNA, 22 bp, Homo sapiens
cttcttttgaagggcgttgtgt

SEQ ID NO: 7211056 - DNA, 22 bp, Homo sapiens
cttgaaaataagaaagactttc

SEQ ID NO: 7211057 - DNA, 22 bp, Homo sapiens
cttctctggcagatgtgtgtcc

SEQ ID NO: 7211058 - DNA, 22 bp, Homo sapiens
cttctctggcatagcaagcagg

SEQ ID NO: 7211059 - DNA, 22 bp, Homo sapiens
cttctctggcatagcaagcagg

SEQ ID NO: 7211060 - DNA, 22 bp, Homo sapiens
cttctctggcatagcaagcagg

SEQ ID NO: 7211061 - DNA, 22 bp, Homo sapiens
cttctctggctcctcagcgccc

SEQ ID NO: 7211062 - DNA, 22 bp, Homo sapiens
cttctctgcccataggaaatgc

SEQ ID NO: 7211063 - DNA, 17 bp, Homo sapiens
cttctctggcagaagat

SEQ ID NO: 7211064 - DNA, 17 bp, Homo sapiens
cttctctggcagaagat

SEQ ID NO: 7211065 - DNA, 22 bp, Homo sapiens
cttctctggcagatgtgtgtcc

SEQ ID NO: 7211066 - DNA, 22 bp, Homo sapiens
cttctctgacagtctgtttcac

SEQ ID NO: 7211067 - DNA, 22 bp, Homo sapiens
cttctctgacagtctgtttcac

SEQ ID NO: 7211068 - DNA, 22 bp, Homo sapiens
cttctctgacagtctgtttcac

SEQ ID NO: 7211069 - DNA, 22 bp, Homo sapiens
cttctctgcaccccacttttgc

SEQ ID NO: 7211070 - DNA, 22 bp, Homo sapiens
cttctctctgcataggcatggg

SEQ ID NO: 7211071 - DNA, 22 bp, Homo sapiens
cttctctctgcataggcatggg

SEQ ID NO: 7211072 - DNA, 22 bp, Homo sapiens
cttctctctgcataggcatggg

SEQ ID NO: 7211073 - DNA, 22 bp, Homo sapiens
cttctctgtgtagagattcaga

SEQ ID NO: 7211074 - DNA, 22 bp, Homo sapiens
cttctctgtgtagagattcaga

SEQ ID NO: 7211075 - DNA, 22 bp, Homo sapiens
cttctcttcccagggacacagg

SEQ ID NO: 7211076 - DNA, 22 bp, Homo sapiens
cttctcttcccagggacacagg

SEQ ID NO: 7211077 - DNA, 22 bp, Homo sapiens
cttctcttcccagggacacagg

SEQ ID NO: 7211078 - DNA, 22 bp, Homo sapiens
cttctcttcccagggacacagg

SEQ ID NO: 7211079 - DNA, 22 bp, Homo sapiens
cttctcttgggtgtggtgtctt

SEQ ID NO: 7211080 - DNA, 22 bp, Homo sapiens
cttctcttgggtgtggtgtctt

SEQ ID NO: 7211081 - DNA, 22 bp, Homo sapiens
cttctcttcctttgtcaactga

SEQ ID NO: 7211082 - DNA, 22 bp, Homo sapiens
cttctcttcctttgtcaactga

SEQ ID NO: 7211083 - DNA, 22 bp, Homo sapiens
cttctcttggtagttcttgttg

SEQ ID NO: 7211084 - DNA, 22 bp, Homo sapiens
cttctcttggtagttcttgttg

SEQ ID NO: 7211085 - DNA, 22 bp, Homo sapiens
cttctcttgggtgtggtgtctt

SEQ ID NO: 7211086 - DNA, 22 bp, Homo sapiens
ctggctgtcttggaggaaggag

SEQ ID NO: 7211087 - DNA, 22 bp, Homo sapiens
ctggctgtcttctgggagctgt

SEQ ID NO: 7211088 - DNA, 22 bp, Homo sapiens
ctggctggtttttaaagctagg

SEQ ID NO: 7211089 - DNA, 22 bp, Homo sapiens
ctggctggtttttaaagctagg

SEQ ID NO: 7211090 - DNA, 22 bp, Homo sapiens
ctggctgtaacattttgccata

SEQ ID NO: 7211091 - DNA, 22 bp, Homo sapiens
ctggctgtatgctggcctcaga

SEQ ID NO: 7211092 - DNA, 22 bp, Homo sapiens
ctggctggttactatttctggt

SEQ ID NO: 7211093 - DNA, 22 bp, Homo sapiens
ctggctggttactatttctggt

SEQ ID NO: 7211094 - DNA, 22 bp, Homo sapiens
ctggctggttccctgctccagg

SEQ ID NO: 7211095 - DNA, 22 bp, Homo sapiens
ctggctggttccctgctccagg

SEQ ID NO: 7211096 - DNA, 22 bp, Homo sapiens
ctggctggttccctgctccagg

SEQ ID NO: 7211097 - DNA, 22 bp, Homo sapiens
ctggctggttggggagaagaca

SEQ ID NO: 7211098 - DNA, 22 bp, Homo sapiens
ctggctggttggggagaagaca

SEQ ID NO: 7211099 - DNA, 22 bp, Homo sapiens
cttctctcggtgcatccctcac

SEQ ID NO: 7211100 - DNA, 22 bp, Homo sapiens
cttctctcggtgcatccctcac

SEQ ID NO: 7211101 - DNA, 22 bp, Homo sapiens
cttctctccctggcactcagac

SEQ ID NO: 7211102 - DNA, 22 bp, Homo sapiens
cttctctatctttggcacatca

SEQ ID NO: 7211103 - DNA, 22 bp, Homo sapiens
cttctctccctggcactcagac

SEQ ID NO: 7211104 - DNA, 22 bp, Homo sapiens
cttctcagttgcaagtgtcaga

SEQ ID NO: 7211105 - DNA, 22 bp, Homo sapiens
cttctcagttgcaagtgtcaga

SEQ ID NO: 7211106 - DNA, 22 bp, Homo sapiens
cttctcagtcttggttagagag

SEQ ID NO: 7211107 - DNA, 22 bp, Homo sapiens
cttctcattcaagcaaaacaga

SEQ ID NO: 7211108 - DNA, 22 bp, Homo sapiens
cttctcggggttcccgcgccct

SEQ ID NO: 7211109 - DNA, 22 bp, Homo sapiens
cttctcggggttcccgcgccct

SEQ ID NO: 7211110 - DNA, 22 bp, Homo sapiens
cttctctacttcctggaagggg

SEQ ID NO: 7211111 - DNA, 22 bp, Homo sapiens
cttctctatctttggcacatca

SEQ ID NO: 7211112 - DNA, 22 bp, Homo sapiens
ctggctggtcatgtcatgagcc

SEQ ID NO: 7211113 - DNA, 22 bp, Homo sapiens
ctggctggtcatgtcatgagcc

SEQ ID NO: 7211114 - DNA, 22 bp, Homo sapiens
ctggctggtcatgtcatgagcc

SEQ ID NO: 7211115 - DNA, 22 bp, Homo sapiens
ctggctggtcatgtcatgagcc

SEQ ID NO: 7211116 - DNA, 22 bp, Homo sapiens
ctggctggtcctcggggacagc

SEQ ID NO: 7211117 - DNA, 22 bp, Homo sapiens
ctggctggtcctcggggacagc

SEQ ID NO: 7211118 - DNA, 22 bp, Homo sapiens
ctggctggtcctcggggacagc

SEQ ID NO: 7211119 - DNA, 22 bp, Homo sapiens
ctggctggtcatcagcagtacg

SEQ ID NO: 7211120 - DNA, 22 bp, Homo sapiens
ctggctggtagaattgtgacct

SEQ ID NO: 7211121 - DNA, 22 bp, Homo sapiens
ctggctgggttccaggattcca

SEQ ID NO: 7211122 - DNA, 22 bp, Homo sapiens
ctggctggtaatggaacgacag

SEQ ID NO: 7211123 - DNA, 22 bp, Homo sapiens
ctggctgggttccaggattcca

SEQ ID NO: 7211124 - DNA, 22 bp, Homo sapiens
ctggctgggttccaggattcca

SEQ ID NO: 7211125 - DNA, 22 bp, Homo sapiens
ctggctgggttccaggattcca

SEQ ID NO: 7211126 - DNA, 22 bp, Homo sapiens
ctggctggggtaccagttgaac

SEQ ID NO: 7211127 - DNA, 22 bp, Homo sapiens
ctggctggggccttagataaga

SEQ ID NO: 7211128 - DNA, 22 bp, Homo sapiens
ctggctggggtaccagttgaac

SEQ ID NO: 7211129 - DNA, 22 bp, Homo sapiens
ctggctgggcagacagaatgct

SEQ ID NO: 7211130 - DNA, 22 bp, Homo sapiens
ctggctgggcagacagaatgct

SEQ ID NO: 7211131 - DNA, 22 bp, Homo sapiens
ctggctggggaagtcatttgat

SEQ ID NO: 7211132 - DNA, 22 bp, Homo sapiens
ctggctggagtgcaggtgagtg

SEQ ID NO: 7211133 - DNA, 22 bp, Homo sapiens
ctggctggagtgcaggtgagtg

SEQ ID NO: 7211134 - DNA, 22 bp, Homo sapiens
ctggctggagtgcaggtgagtg

SEQ ID NO: 7211135 - DNA, 22 bp, Homo sapiens
ctggctggagtgcaggtgagtg

SEQ ID NO: 7211136 - DNA, 22 bp, Homo sapiens
ctggctggaggtgagtcactga

SEQ ID NO: 7211137 - DNA, 22 bp, Homo sapiens
ctggctggaggtgagtcactga

SEQ ID NO: 7211138 - DNA, 22 bp, Homo sapiens
ctggctggaggtgagtcactga

SEQ ID NO: 7211139 - DNA, 22 bp, Homo sapiens
ctggctctgtgggacctggcct

SEQ ID NO: 7211140 - DNA, 22 bp, Homo sapiens
ctttatctgtgtcctcttgcct

SEQ ID NO: 7211141 - DNA, 22 bp, Homo sapiens
ctttatgaaaaccagattgggg

SEQ ID NO: 7211142 - DNA, 22 bp, Homo sapiens
ctttatcatggaggtaaatatg

SEQ ID NO: 7211143 - DNA, 22 bp, Homo sapiens
ctttatcgcaaacactgggtaa

SEQ ID NO: 7211144 - DNA, 20 bp, Homo sapiens
ctttatcaaagggctactag

SEQ ID NO: 7211145 - DNA, 20 bp, Homo sapiens
ctttatcaaagggctactag

SEQ ID NO: 7211146 - DNA, 20 bp, Homo sapiens
ctttatcaaagggctactag

SEQ ID NO: 7211147 - DNA, 22 bp, Homo sapiens
ctttatcagaaaacacattagg

SEQ ID NO: 7211148 - DNA, 22 bp, Homo sapiens
ctttatatccagatgtttggtg

SEQ ID NO: 7211149 - DNA, 22 bp, Homo sapiens
ctttatatccagatgtttggtg

SEQ ID NO: 7211150 - DNA, 22 bp, Homo sapiens
ctttatatccagatgtttggtg

SEQ ID NO: 7211151 - DNA, 22 bp, Homo sapiens
ctttatatattcccaggctgcc

SEQ ID NO: 7211152 - DNA, 22 bp, Homo sapiens
ctttatatattcccaggctgcc

SEQ ID NO: 7211153 - DNA, 22 bp, Homo sapiens
ctttatatattcccaggctgcc

SEQ ID NO: 7211154 - DNA, 22 bp, Homo sapiens
ctttggcagcctcagctgcagg

SEQ ID NO: 7211155 - DNA, 22 bp, Homo sapiens
ctttatgagccttgtgaaggag

SEQ ID NO: 7211156 - DNA, 22 bp, Homo sapiens
ctttatgagccttgtgaaggag

SEQ ID NO: 7211157 - DNA, 22 bp, Homo sapiens
ctttatgactgagttgtcaatt

SEQ ID NO: 7211158 - DNA, 22 bp, Homo sapiens
ctttatgactgagttgtcaatt

SEQ ID NO: 7211159 - DNA, 22 bp, Homo sapiens
ctttatgaaggaacaatgctcc

SEQ ID NO: 7211160 - DNA, 22 bp, Homo sapiens
ctttatgaaggaacaatgctcc

SEQ ID NO: 7211161 - DNA, 22 bp, Homo sapiens
ctttatgaacctgttcagcttg

SEQ ID NO: 7211162 - DNA, 22 bp, Homo sapiens
ctttatgaacctgttcagcttg

SEQ ID NO: 7211163 - DNA, 22 bp, Homo sapiens
ctttatgaaaacctgaattatg

SEQ ID NO: 7211164 - DNA, 22 bp, Homo sapiens
ctttatgaaaaccagattgggg

SEQ ID NO: 7211165 - DNA, 22 bp, Homo sapiens
ctttatgaaaacctgaattatg

SEQ ID NO: 7211166 - DNA, 22 bp, Homo sapiens
ctttatgaacctgttcagcttg

SEQ ID NO: 7211167 - DNA, 22 bp, Homo sapiens
ctttgtatttaatagctgtctt

SEQ ID NO: 7211168 - DNA, 22 bp, Homo sapiens
ctttgtattcatccgtaataat

SEQ ID NO: 7211169 - DNA, 22 bp, Homo sapiens
ctttgtatctaaatatcttgaa

SEQ ID NO: 7211170 - DNA, 22 bp, Homo sapiens
ctttgtaatcattcccttggtt

SEQ ID NO: 7211171 - DNA, 22 bp, Homo sapiens
ctttgtatggtggcacttccgt

SEQ ID NO: 7211172 - DNA, 22 bp, Homo sapiens
ctttggcagcctcagctgcagg

SEQ ID NO: 7211173 - DNA, 22 bp, Homo sapiens
ctttggcagcctcagctgcagg

SEQ ID NO: 7211174 - DNA, 22 bp, Homo sapiens
ctttggcagcctctgctattga

SEQ ID NO: 7211175 - DNA, 17 bp, Homo sapiens
ctttggcaggagggagg

SEQ ID NO: 7211176 - DNA, 20 bp, Homo sapiens
ctttggcaggccttgccacg

SEQ ID NO: 7211177 - DNA, 22 bp, Homo sapiens
ctttggcatggtcctcactata

SEQ ID NO: 7211178 - DNA, 22 bp, Homo sapiens
ctttggcatggtcctcactata

SEQ ID NO: 7211179 - DNA, 22 bp, Homo sapiens
ctttgtaagtctttctccaaga

SEQ ID NO: 7211180 - DNA, 22 bp, Homo sapiens
ctttgtaagtctttctccaaga

SEQ ID NO: 7211181 - DNA, 22 bp, Homo sapiens
ctttagtttgtaagagcaagag

SEQ ID NO: 7211182 - DNA, 22 bp, Homo sapiens
ctttagtttgtaagagcaagag

SEQ ID NO: 7211183 - DNA, 22 bp, Homo sapiens
ctttagtttgtaagagcaagag

SEQ ID NO: 7211184 - DNA, 22 bp, Homo sapiens
ctttagttttcatcaaatctat

SEQ ID NO: 7211185 - DNA, 22 bp, Homo sapiens
ctttagttttcatcaaatctat

SEQ ID NO: 7211186 - DNA, 22 bp, Homo sapiens
ctttagtttaagaacatgatga

SEQ ID NO: 7211187 - DNA, 22 bp, Homo sapiens
ctttagtttaagaacatgatga

SEQ ID NO: 7211188 - DNA, 22 bp, Homo sapiens
ctttagttgtatcagtcaagtt

SEQ ID NO: 7211189 - DNA, 22 bp, Homo sapiens
ctttagttatttagactacagt

SEQ ID NO: 7211190 - DNA, 22 bp, Homo sapiens
ctttagttctaatgcattgaaa

SEQ ID NO: 7211191 - DNA, 22 bp, Homo sapiens
ctttagttctagaaagtgaaac

SEQ ID NO: 7211192 - DNA, 20 bp, Homo sapiens
ctttagttattaacagcact

SEQ ID NO: 7211193 - DNA, 20 bp, Homo sapiens
ctttagttattaacagcact

SEQ ID NO: 7211194 - DNA, 20 bp, Homo sapiens
ctttagttattaacagcact

SEQ ID NO: 7211195 - DNA, 22 bp, Homo sapiens
ctttagtgttgttgtgaggatt

SEQ ID NO: 7211196 - DNA, 18 bp, Homo sapiens
ctttagctgtcatctttg

SEQ ID NO: 7211197 - DNA, 22 bp, Homo sapiens
ctttagatttctatgtatcact

SEQ ID NO: 7211198 - DNA, 22 bp, Homo sapiens
ctttagatttctatgtatcact

SEQ ID NO: 7211199 - DNA, 22 bp, Homo sapiens
ctttagatttctatgtatcact

SEQ ID NO: 7211200 - DNA, 22 bp, Homo sapiens
ctttagatgtgcaaaggagaaa

SEQ ID NO: 7211201 - DNA, 22 bp, Homo sapiens
ctttagaagggtaacggaatta

SEQ ID NO: 7211202 - DNA, 20 bp, Homo sapiens
ctttagaagaacccaagcat

SEQ ID NO: 7211203 - DNA, 22 bp, Homo sapiens
ctttacaacctaagttgaagct

SEQ ID NO: 7211204 - DNA, 22 bp, Homo sapiens
ctttacaattcaagggaactct

SEQ ID NO: 7211205 - DNA, 22 bp, Homo sapiens
ctttagaatttgatataatcaa

SEQ ID NO: 7211206 - DNA, 22 bp, Homo sapiens
ctttagaatttgatataatcaa

SEQ ID NO: 7211207 - DNA, 22 bp, Homo sapiens
ctttagaatttcatgtttggtc

SEQ ID NO: 7211208 - DNA, 22 bp, Homo sapiens
ctttagaatttcatgtttggtc

SEQ ID NO: 7211209 - DNA, 19 bp, Homo sapiens
ctttagacacacctggaca

SEQ ID NO: 7211210 - DNA, 22 bp, Homo sapiens
ctttagatcctggtgtctctct

SEQ ID NO: 7211211 - DNA, 22 bp, Homo sapiens
ctttagacatacagaatttcca

SEQ ID NO: 7211212 - DNA, 22 bp, Homo sapiens
ctttagatgttgctttaactat

SEQ ID NO: 7211213 - DNA, 22 bp, Homo sapiens
ctttagatgttgctttaactat

SEQ ID NO: 7211214 - DNA, 21 bp, Homo sapiens
cttggctgcagtgacaggcat

SEQ ID NO: 7211215 - DNA, 22 bp, Homo sapiens
cttggctgcttttgtgcacatt

SEQ ID NO: 7211216 - DNA, 22 bp, Homo sapiens
cttggctgcttttgtgcacatt

SEQ ID NO: 7211217 - DNA, 18 bp, Homo sapiens
cttggctgatgggggtgt

SEQ ID NO: 7211218 - DNA, 21 bp, Homo sapiens
cttggctgcagtgacaggcat

SEQ ID NO: 7211219 - DNA, 22 bp, Homo sapiens
cttggctgtcataaggtcctgg

SEQ ID NO: 7211220 - DNA, 22 bp, Homo sapiens
cttggctgcttttgtgcacatt

SEQ ID NO: 7211221 - DNA, 22 bp, Homo sapiens
cttggctggaactcctgagaaa

SEQ ID NO: 7211222 - DNA, 22 bp, Homo sapiens
cttggcttttgctcccagatca

SEQ ID NO: 7211223 - DNA, 22 bp, Homo sapiens
cttggcttttgctcccagatca

SEQ ID NO: 7211224 - DNA, 22 bp, Homo sapiens
cttgggaatgctaacagatgac

SEQ ID NO: 7211225 - DNA, 22 bp, Homo sapiens
cttgggaatgctaacagatgac

SEQ ID NO: 7211226 - DNA, 22 bp, Homo sapiens
cttggctgtctataggaaagag

SEQ ID NO: 7211227 - DNA, 22 bp, Homo sapiens
cttggctgtctataggaaagag

SEQ ID NO: 7211228 - DNA, 22 bp, Homo sapiens
cttggctgttgggcattgagaa

SEQ ID NO: 7211229 - DNA, 17 bp, Homo sapiens
cttggcacctctgccat

SEQ ID NO: 7211230 - DNA, 21 bp, Homo sapiens
cttggcacagggaagatgcac

SEQ ID NO: 7211231 - DNA, 22 bp, Homo sapiens
cttggcacattttgttcttctg

SEQ ID NO: 7211232 - DNA, 22 bp, Homo sapiens
cttggatatcactcagaaagat

SEQ ID NO: 7211233 - DNA, 22 bp, Homo sapiens
cttggatgccagcggcctccta

SEQ ID NO: 7211234 - DNA, 22 bp, Homo sapiens
cttgaagagtaaattggtacac

SEQ ID NO: 7211235 - DNA, 22 bp, Homo sapiens
cttgaagacaatggcagattcc

SEQ ID NO: 7211236 - DNA, 22 bp, Homo sapiens
cttgaagagtgggaaggatttg

SEQ ID NO: 7211237 - DNA, 22 bp, Homo sapiens
cttgaagagtgggaaggatttg

SEQ ID NO: 7211238 - DNA, 22 bp, Homo sapiens
cttgaagattgatccagtttga

SEQ ID NO: 7211239 - DNA, 22 bp, Homo sapiens
cttgaagtaagacagctctgga

SEQ ID NO: 7211240 - DNA, 22 bp, Homo sapiens
cttgaagtgcctgagtcttatc

SEQ ID NO: 7211241 - DNA, 22 bp, Homo sapiens
cttgaagtggagcttttgaaat

SEQ ID NO: 7211242 - DNA, 22 bp, Homo sapiens
cttgaagtggatgttggtataa

SEQ ID NO: 7211243 - DNA, 22 bp, Homo sapiens
cttgaagttgcaaaacattaat

SEQ ID NO: 7211244 - DNA, 22 bp, Homo sapiens
cttgaagtttgcttagattcct

SEQ ID NO: 7211245 - DNA, 22 bp, Homo sapiens
cttgggagtagaggcaggagca

SEQ ID NO: 7211246 - DNA, 22 bp, Homo sapiens
cttgggagtagaggcaggagca

SEQ ID NO: 7211247 - DNA, 22 bp, Homo sapiens
cttgggagtagaggcaggagca

SEQ ID NO: 7211248 - DNA, 22 bp, Homo sapiens
cttgggagtagaggcaggagca

SEQ ID NO: 7211249 - DNA, 22 bp, Homo sapiens
cttgggagtagaggcaggagca

SEQ ID NO: 7211250 - DNA, 22 bp, Homo sapiens
cttgggaggggagcattggcct

SEQ ID NO: 7211251 - DNA, 22 bp, Homo sapiens
cttgggaccctcacatttgatg

SEQ ID NO: 7211252 - DNA, 22 bp, Homo sapiens
cttgggccttgagaatgttctg

SEQ ID NO: 7211253 - DNA, 23 bp, Homo sapiens
cttgggctagagacttagcagtg

SEQ ID NO: 7211254 - DNA, 23 bp, Homo sapiens
cttgggctagagacttagcagtg

SEQ ID NO: 7211255 - DNA, 19 bp, Homo sapiens
cttgggcatatctgaggca

SEQ ID NO: 7211256 - DNA, 22 bp, Homo sapiens
cttgggccacctggagggactg

SEQ ID NO: 7211257 - DNA, 22 bp, Homo sapiens
cttgggccagcccagggggcat

SEQ ID NO: 7211258 - DNA, 22 bp, Homo sapiens
cttgggccagcccagggggcat

SEQ ID NO: 7211259 - DNA, 22 bp, Homo sapiens
cttgggagtagaggcaggagca

SEQ ID NO: 7211260 - DNA, 22 bp, Homo sapiens
cttgggatgtaacctttgttcc

SEQ ID NO: 7211261 - DNA, 22 bp, Homo sapiens
cttgggatgtaacctttgttcc

SEQ ID NO: 7211262 - DNA, 22 bp, Homo sapiens
cttgggatttgagatctggata

SEQ ID NO: 7211263 - DNA, 22 bp, Homo sapiens
cttggggatgcaaagccagtgt

SEQ ID NO: 7211264 - DNA, 22 bp, Homo sapiens
cttggggattttaaagacctct

SEQ ID NO: 7211265 - DNA, 22 bp, Homo sapiens
cttggggatgcaaagccagtgt

SEQ ID NO: 7211266 - DNA, 22 bp, Homo sapiens
cttggggacacagagcccaggg

SEQ ID NO: 7211267 - DNA, 22 bp, Homo sapiens
cttggggacacagagcccaggg

SEQ ID NO: 7211268 - DNA, 22 bp, Homo sapiens
cttgggctataaatataaccat

SEQ ID NO: 7211269 - DNA, 22 bp, Homo sapiens
cttgggctcagacttgaggaca

SEQ ID NO: 7211270 - DNA, 22 bp, Homo sapiens
cttgggctcagacttgaggaca

SEQ ID NO: 7211271 - DNA, 22 bp, Homo sapiens
cttgggctcagcaccgtgtgga

SEQ ID NO: 7211272 - DNA, 22 bp, Homo sapiens
cttgggctctaaatgccagtga

SEQ ID NO: 7211273 - DNA, 22 bp, Homo sapiens
cttgggctctgtgggccttagt

SEQ ID NO: 7211274 - DNA, 22 bp, Homo sapiens
cttgggctgtgccttaaattct

SEQ ID NO: 7211275 - DNA, 22 bp, Homo sapiens
cttgggcttagaaggtaagtga

SEQ ID NO: 7211276 - DNA, 21 bp, Homo sapiens
cttgggcttgtagatggtgga

SEQ ID NO: 7211277 - DNA, 22 bp, Homo sapiens
cttggggctttgtgtgtaggat

SEQ ID NO: 7211278 - DNA, 22 bp, Homo sapiens
cttgggggccattaaggggcct

SEQ ID NO: 7211279 - DNA, 22 bp, Homo sapiens
cttgggggccattaaggggcct

SEQ ID NO: 7211280 - DNA, 22 bp, Homo sapiens
cttgggggccattaaggggcct

SEQ ID NO: 7211281 - DNA, 22 bp, Homo sapiens
ctttacaacctaagttgaagct

SEQ ID NO: 7211282 - DNA, 22 bp, Homo sapiens
cttggggctgtcactctggcat

SEQ ID NO: 7211283 - DNA, 22 bp, Homo sapiens
cttggggctttgtgtgtaggat

SEQ ID NO: 7211284 - DNA, 22 bp, Homo sapiens
cttggggctgtcactctggcat

SEQ ID NO: 7211285 - DNA, 22 bp, Homo sapiens
cttggggctgtcactctggcat

SEQ ID NO: 7211286 - DNA, 22 bp, Homo sapiens
cttggggcagcccaggctgagc

SEQ ID NO: 7211287 - DNA, 22 bp, Homo sapiens
cttggggcagtgcttggcacat

SEQ ID NO: 7211288 - DNA, 22 bp, Homo sapiens
cttggggcagtgcttggcacat

SEQ ID NO: 7211289 - DNA, 22 bp, Homo sapiens
gacacagagctcacagtctcct

SEQ ID NO: 7211290 - DNA, 22 bp, Homo sapiens
gacacagagggcaccagatatg

SEQ ID NO: 7211291 - DNA, 22 bp, Homo sapiens
gacacagatatctctgagatta

SEQ ID NO: 7211292 - DNA, 22 bp, Homo sapiens
gacacagatgatcaggtgtgga

SEQ ID NO: 7211293 - DNA, 22 bp, Homo sapiens
gacacagatgatcaggtgtgga

SEQ ID NO: 7211294 - DNA, 22 bp, Homo sapiens
gacacagcactgtacaaggaat

SEQ ID NO: 7211295 - DNA, 22 bp, Homo sapiens
gacacagcactgtacaaggaat

SEQ ID NO: 7211296 - DNA, 22 bp, Homo sapiens
gacacagcactgtacaaggaat

SEQ ID NO: 7211297 - DNA, 22 bp, Homo sapiens
gacacagcttgatgagggcttt

SEQ ID NO: 7211298 - DNA, 22 bp, Homo sapiens
gacacagcttgatgagggcttt

SEQ ID NO: 7211299 - DNA, 22 bp, Homo sapiens
gacacagctttctgaagagcat

SEQ ID NO: 7211300 - DNA, 22 bp, Homo sapiens
gacacagggacgtgctctgcct

SEQ ID NO: 7211301 - DNA, 20 bp, Homo sapiens
gacacaggcagtcctcagag

SEQ ID NO: 7211302 - DNA, 22 bp, Homo sapiens
gacacaggattcctggctctgc

SEQ ID NO: 7211303 - DNA, 22 bp, Homo sapiens
gacacaggattcctggctctgc

SEQ ID NO: 7211304 - DNA, 23 bp, Homo sapiens
gacacaggagcacccagctgagc

SEQ ID NO: 7211305 - DNA, 22 bp, Homo sapiens
gacacaggattcctggctctgc

SEQ ID NO: 7211306 - DNA, 23 bp, Homo sapiens
gacacaggagcacccagctgagc

SEQ ID NO: 7211307 - DNA, 22 bp, Homo sapiens
gacacaggaaaagctccagccc

SEQ ID NO: 7211308 - DNA, 22 bp, Homo sapiens
gacacaggaaaagctccagccc

SEQ ID NO: 7211309 - DNA, 22 bp, Homo sapiens
gacacaggaatcaccttggatg

SEQ ID NO: 7211310 - DNA, 22 bp, Homo sapiens
gacacaggaatcaccttggatg

SEQ ID NO: 7211311 - DNA, 18 bp, Homo sapiens
gacacaggagagagtccc

SEQ ID NO: 7211312 - DNA, 23 bp, Homo sapiens
gacacaggagcacccagctgagc

SEQ ID NO: 7211313 - DNA, 22 bp, Homo sapiens
gacaggacttcactgtgttgcc

SEQ ID NO: 7211314 - DNA, 19 bp, Homo sapiens
gacaggacgaagggaagtt

SEQ ID NO: 7211315 - DNA, 19 bp, Homo sapiens
gacaggacgaagggaagtt

SEQ ID NO: 7211316 - DNA, 19 bp, Homo sapiens
gacaggacgaagggaagtt

SEQ ID NO: 7211317 - DNA, 19 bp, Homo sapiens
gacaggacgaagggaagtt

SEQ ID NO: 7211318 - DNA, 21 bp, Homo sapiens
gacaggactagaccagagctc

SEQ ID NO: 7211319 - DNA, 22 bp, Homo sapiens
gacaggaagtctgaaggaggga

SEQ ID NO: 7211320 - DNA, 19 bp, Homo sapiens
gacaggaaggctaccagta

SEQ ID NO: 7211321 - DNA, 19 bp, Homo sapiens
gacaggaaggctaccagta

SEQ ID NO: 7211322 - DNA, 22 bp, Homo sapiens
gacaggaacataaatgtaggag

SEQ ID NO: 7211323 - DNA, 19 bp, Homo sapiens
gacaggaaggctaccagta

SEQ ID NO: 7211324 - DNA, 19 bp, Homo sapiens
gacaggaaggctaccagta

SEQ ID NO: 7211325 - DNA, 19 bp, Homo sapiens
gacaggaaggctaccagta

SEQ ID NO: 7211326 - DNA, 22 bp, Homo sapiens
gacagcttaggaagtttctatt

SEQ ID NO: 7211327 - DNA, 22 bp, Homo sapiens
gacagctgtggagaggcatgtg

SEQ ID NO: 7211328 - DNA, 22 bp, Homo sapiens
gacagctgtggagaggcatgtg

SEQ ID NO: 7211329 - DNA, 22 bp, Homo sapiens
gacagctgtggagaggcatgtg

SEQ ID NO: 7211330 - DNA, 22 bp, Homo sapiens
gacagctgtggagaggcatgtg

SEQ ID NO: 7211331 - DNA, 22 bp, Homo sapiens
gacagctgtggagaggcatgtg

SEQ ID NO: 7211332 - DNA, 22 bp, Homo sapiens
gacagctgtgcaggagaagggg

SEQ ID NO: 7211333 - DNA, 22 bp, Homo sapiens
gacacaggtagaataaagtact

SEQ ID NO: 7211334 - DNA, 22 bp, Homo sapiens
gacagctgtgcaggagaagggg

SEQ ID NO: 7211335 - DNA, 22 bp, Homo sapiens
gacagctgtgcaggagaagggg

SEQ ID NO: 7211336 - DNA, 22 bp, Homo sapiens
gacagctgtgcaggagaagggg

SEQ ID NO: 7211337 - DNA, 22 bp, Homo sapiens
gacacagggggatgtgtggacg

SEQ ID NO: 7211338 - DNA, 22 bp, Homo sapiens
gacacagggacgtgctctgcct

SEQ ID NO: 7211339 - DNA, 22 bp, Homo sapiens
gacacagggggatgtgtggacg

SEQ ID NO: 7211340 - DNA, 22 bp, Homo sapiens
gacacagggacgtgctctgcct

SEQ ID NO: 7211341 - DNA, 22 bp, Homo sapiens
gacacagggggatgtgtggacg

SEQ ID NO: 7211342 - DNA, 22 bp, Homo sapiens
gacacagggggatgtgtggacg

SEQ ID NO: 7211343 - DNA, 22 bp, Homo sapiens
gacacaggggggcgctagaaga

SEQ ID NO: 7211344 - DNA, 22 bp, Homo sapiens
gaagttatttgctatctactga

SEQ ID NO: 7211345 - DNA, 22 bp, Homo sapiens
gaagttattgcctgtgatgaaa

SEQ ID NO: 7211346 - DNA, 22 bp, Homo sapiens
gaagttattttacctgttaaag

SEQ ID NO: 7211347 - DNA, 22 bp, Homo sapiens
gaagttatcaggattaaagttg

SEQ ID NO: 7211348 - DNA, 22 bp, Homo sapiens
gaagttatcaggattaaagttg

SEQ ID NO: 7211349 - DNA, 22 bp, Homo sapiens
gaagttatcaaagatgtattct

SEQ ID NO: 7211350 - DNA, 22 bp, Homo sapiens
gaagttagtcattgaagcccca

SEQ ID NO: 7211351 - DNA, 22 bp, Homo sapiens
gaagttagtgtggatgcaggga

SEQ ID NO: 7211352 - DNA, 22 bp, Homo sapiens
gaagttctcaaggatcacagaa

SEQ ID NO: 7211353 - DNA, 22 bp, Homo sapiens
gaagttcacatagctggcaggt

SEQ ID NO: 7211354 - DNA, 22 bp, Homo sapiens
gaagttcaatgtcagcatctat

SEQ ID NO: 7211355 - DNA, 22 bp, Homo sapiens
gaagttcaactgccatgcttgg

SEQ ID NO: 7211356 - DNA, 22 bp, Homo sapiens
gaattataaactagtgacttca

SEQ ID NO: 7211357 - DNA, 22 bp, Homo sapiens
gaattataggcaaagcagtcat

SEQ ID NO: 7211358 - DNA, 22 bp, Homo sapiens
gaattagtgttgaaatcagggc

SEQ ID NO: 7211359 - DNA, 22 bp, Homo sapiens
gaattagtgttgaaatcagggc

SEQ ID NO: 7211360 - DNA, 22 bp, Homo sapiens
gaattataaactagtgacttca

SEQ ID NO: 7211361 - DNA, 22 bp, Homo sapiens
gaattacatgaccctgagtaga

SEQ ID NO: 7211362 - DNA, 22 bp, Homo sapiens
gaattacatttgtgttactgca

SEQ ID NO: 7211363 - DNA, 22 bp, Homo sapiens
gaattcagttatctaattcaag

SEQ ID NO: 7211364 - DNA, 22 bp, Homo sapiens
gaattcatcgtcttagctgcca

SEQ ID NO: 7211365 - DNA, 22 bp, Homo sapiens
gaattataggtttgcatgctaa

SEQ ID NO: 7211366 - DNA, 22 bp, Homo sapiens
gaattcattagggaagctatct

SEQ ID NO: 7211367 - DNA, 22 bp, Homo sapiens
gaattctaaccattaagccaag

SEQ ID NO: 7211368 - DNA, 22 bp, Homo sapiens
gacacagagataggcctgtgtt

SEQ ID NO: 7211369 - DNA, 22 bp, Homo sapiens
gaatttaaggaccaagcatttt

SEQ ID NO: 7211370 - DNA, 22 bp, Homo sapiens
gaatttaaggaccaagcatttt

SEQ ID NO: 7211371 - DNA, 22 bp, Homo sapiens
gaatttaagaggatgaatctgt

SEQ ID NO: 7211372 - DNA, 22 bp, Homo sapiens
gaatttaagaggatgaatctgt

SEQ ID NO: 7211373 - DNA, 22 bp, Homo sapiens
gaatttaagaggatgaatctgt

SEQ ID NO: 7211374 - DNA, 22 bp, Homo sapiens
gaatttaaatttaaatctacca

SEQ ID NO: 7211375 - DNA, 22 bp, Homo sapiens
gaatttaaaggccagacctgag

SEQ ID NO: 7211376 - DNA, 22 bp, Homo sapiens
gaatttaaaggccagacctgag

SEQ ID NO: 7211377 - DNA, 22 bp, Homo sapiens
gaatttaaatttaaatctacca

SEQ ID NO: 7211378 - DNA, 22 bp, Homo sapiens
gaatttaaatttaaatctacca

SEQ ID NO: 7211379 - DNA, 22 bp, Homo sapiens
gaatttaaatttaaatctacca

SEQ ID NO: 7211380 - DNA, 22 bp, Homo sapiens
gaattgggggttttgcaaggca

SEQ ID NO: 7211381 - DNA, 22 bp, Homo sapiens
gaattgggggttttgcaaggca

SEQ ID NO: 7211382 - DNA, 22 bp, Homo sapiens
gaattgtaagtaccagcatgct

SEQ ID NO: 7211383 - DNA, 22 bp, Homo sapiens
gaattgtacgctttacataggt

SEQ ID NO: 7211384 - DNA, 22 bp, Homo sapiens
gaattgtactgcaatcagggga

SEQ ID NO: 7211385 - DNA, 22 bp, Homo sapiens
gaattgtagagggaacagaagc

SEQ ID NO: 7211386 - DNA, 22 bp, Homo sapiens
gaattgtatgcagttacttgga

SEQ ID NO: 7211387 - DNA, 22 bp, Homo sapiens
gaattgtattgatttttcagag

SEQ ID NO: 7211388 - DNA, 21 bp, Homo sapiens
gaattgtgccccttggtgttg

SEQ ID NO: 7211389 - DNA, 21 bp, Homo sapiens
gaattgtgccccttggtgttg

SEQ ID NO: 7211390 - DNA, 18 bp, Homo sapiens
gaattgtgctaaggtgat

SEQ ID NO: 7211391 - DNA, 22 bp, Homo sapiens
gaatttaaaggccagacctgag

SEQ ID NO: 7211392 - DNA, 22 bp, Homo sapiens
gaattctagtcacacacattca

SEQ ID NO: 7211393 - DNA, 22 bp, Homo sapiens
gaattctagggtaaatatccta

SEQ ID NO: 7211394 - DNA, 22 bp, Homo sapiens
gaattctggtcctgtccaaggt

SEQ ID NO: 7211395 - DNA, 22 bp, Homo sapiens
gaattcttttctttctgaaagt

SEQ ID NO: 7211396 - DNA, 22 bp, Homo sapiens
gaattcttctgtctttaactga

SEQ ID NO: 7211397 - DNA, 22 bp, Homo sapiens
gaaggaagtcattagtgcagac

SEQ ID NO: 7211398 - DNA, 22 bp, Homo sapiens
gaaggaagtcattagtgcagac

SEQ ID NO: 7211399 - DNA, 22 bp, Homo sapiens
gaaggaagtcattagtgcagac

SEQ ID NO: 7211400 - DNA, 22 bp, Homo sapiens
gaaggaagtcattagtgcagac

SEQ ID NO: 7211401 - DNA, 20 bp, Homo sapiens
gaaggaagggggcaaggtga

SEQ ID NO: 7211402 - DNA, 20 bp, Homo sapiens
gaaggaagggggcaaggtga

SEQ ID NO: 7211403 - DNA, 20 bp, Homo sapiens
gaaggaagggggcaaggtga

SEQ ID NO: 7211404 - DNA, 22 bp, Homo sapiens
gaaggaagtcattagtgcagac

SEQ ID NO: 7211405 - DNA, 22 bp, Homo sapiens
gaaggaagtcattagtgcagac

SEQ ID NO: 7211406 - DNA, 22 bp, Homo sapiens
gaaggaagtcattagtgcagac

SEQ ID NO: 7211407 - DNA, 22 bp, Homo sapiens
gaaggaagtcattagtgcagac

SEQ ID NO: 7211408 - DNA, 20 bp, Homo sapiens
gaaggaagggggcaaggtga

SEQ ID NO: 7211409 - DNA, 20 bp, Homo sapiens
gaaggaagggggcaaggtga

SEQ ID NO: 7211410 - DNA, 20 bp, Homo sapiens
gaaggaagggggcaaggtga

SEQ ID NO: 7211411 - DNA, 21 bp, Homo sapiens
gaaggagaaagcaagtgctgc

SEQ ID NO: 7211412 - DNA, 21 bp, Homo sapiens
gaaggagaaagcaagtgctgc

SEQ ID NO: 7211413 - DNA, 21 bp, Homo sapiens
gaaggagaaagcaagtgctgc

SEQ ID NO: 7211414 - DNA, 21 bp, Homo sapiens
gaaggagaaagcaagtgctgc

SEQ ID NO: 7211415 - DNA, 21 bp, Homo sapiens
gaaggagaaagcaagtgctgc

SEQ ID NO: 7211416 - DNA, 22 bp, Homo sapiens
gaaggacctgtccgtggtgctg

SEQ ID NO: 7211417 - DNA, 22 bp, Homo sapiens
gaaggaccctctggggtctcag

SEQ ID NO: 7211418 - DNA, 22 bp, Homo sapiens
gaaggaagtttattttagaaga

SEQ ID NO: 7211419 - DNA, 22 bp, Homo sapiens
gaaggacccacgaagtcactgg

SEQ ID NO: 7211420 - DNA, 22 bp, Homo sapiens
gaaggaagtttattttagaaga

SEQ ID NO: 7211421 - DNA, 22 bp, Homo sapiens
gaaggaagtcattagtgcagac

SEQ ID NO: 7211422 - DNA, 22 bp, Homo sapiens
gaaggaagtgctcatactagtt

SEQ ID NO: 7211423 - DNA, 22 bp, Homo sapiens
gaaggaagtgctcatactagtt

SEQ ID NO: 7211424 - DNA, 22 bp, Homo sapiens
gaaggaagtgctcatactagtt

SEQ ID NO: 7211425 - DNA, 22 bp, Homo sapiens
gaaggaagtgctcatactagtt

SEQ ID NO: 7211426 - DNA, 22 bp, Homo sapiens
gaaggaagctgtctggatgtgt

SEQ ID NO: 7211427 - DNA, 22 bp, Homo sapiens
gaaggaagctgtctggatgtgt

SEQ ID NO: 7211428 - DNA, 22 bp, Homo sapiens
gaaggaagccgtttctctccag

SEQ ID NO: 7211429 - DNA, 22 bp, Homo sapiens
gaaggaagccgtttctctccag

SEQ ID NO: 7211430 - DNA, 22 bp, Homo sapiens
gaaggaaggaaaaatatattta

SEQ ID NO: 7211431 - DNA, 22 bp, Homo sapiens
gaaggaagggctggctgtcttg

SEQ ID NO: 7211432 - DNA, 20 bp, Homo sapiens
gaactgtgcactggtcacag

SEQ ID NO: 7211433 - DNA, 22 bp, Homo sapiens
gaactgtttctggtgaaagagt

SEQ ID NO: 7211434 - DNA, 22 bp, Homo sapiens
gaacttaacggcaactatttaa

SEQ ID NO: 7211435 - DNA, 22 bp, Homo sapiens
gaaggagagggtcaaggataat

SEQ ID NO: 7211436 - DNA, 22 bp, Homo sapiens
gaaggagagggtcaaggataat

SEQ ID NO: 7211437 - DNA, 22 bp, Homo sapiens
gaaggagagggtcaaggataat

SEQ ID NO: 7211438 - DNA, 22 bp, Homo sapiens
gaaggagagggtcaaggataat

SEQ ID NO: 7211439 - DNA, 22 bp, Homo sapiens
gaaggagagggtcaaggataat

SEQ ID NO: 7211440 - DNA, 22 bp, Homo sapiens
gaaggagagggtcaaggataat

SEQ ID NO: 7211441 - DNA, 22 bp, Homo sapiens
gaaggagagggtcaaggataat

SEQ ID NO: 7211442 - DNA, 22 bp, Homo sapiens
gaaggagagggtcaaggataat

SEQ ID NO: 7211443 - DNA, 22 bp, Homo sapiens
gaaggagaggattgtgaggctg

SEQ ID NO: 7211444 - DNA, 22 bp, Homo sapiens
gaaggagaggattgtgaggctg

SEQ ID NO: 7211445 - DNA, 22 bp, Homo sapiens
gaaggcctaggaaggaagcctt

SEQ ID NO: 7211446 - DNA, 22 bp, Homo sapiens
gaaggcccgccctgagcaaggg

SEQ ID NO: 7211447 - DNA, 22 bp, Homo sapiens
gaaggcccgccctgagcaaggg

SEQ ID NO: 7211448 - DNA, 22 bp, Homo sapiens
gaaggccctggtattcttgagg

SEQ ID NO: 7211449 - DNA, 22 bp, Homo sapiens
gaaggcctcactctgcagcata

SEQ ID NO: 7211450 - DNA, 22 bp, Homo sapiens
gaaggagaggattgtgaggctg

SEQ ID NO: 7211451 - DNA, 22 bp, Homo sapiens
gaaggagaggattgtgaggctg

SEQ ID NO: 7211452 - DNA, 22 bp, Homo sapiens
gaaggagaggattgtgaggctg

SEQ ID NO: 7211453 - DNA, 22 bp, Homo sapiens
gaaggagaggattgtgaggctg

SEQ ID NO: 7211454 - DNA, 22 bp, Homo sapiens
gaaggagaggattgtgaggctg

SEQ ID NO: 7211455 - DNA, 22 bp, Homo sapiens
gaaggagagagacatcgtccct

SEQ ID NO: 7211456 - DNA, 19 bp, Homo sapiens
gaaggagagctgagttagg

SEQ ID NO: 7211457 - DNA, 19 bp, Homo sapiens
gaaggagagctgagttagg

SEQ ID NO: 7211458 - DNA, 22 bp, Homo sapiens
gaaggagagagacatcgtccct

SEQ ID NO: 7211459 - DNA, 22 bp, Homo sapiens
gaaggagagagacatcgtccct

SEQ ID NO: 7211460 - DNA, 19 bp, Homo sapiens
gaaggagagctgagttagg

SEQ ID NO: 7211461 - DNA, 21 bp, Homo sapiens
gaaggagaaagcaagtgctgc

SEQ ID NO: 7211462 - DNA, 21 bp, Homo sapiens
gaaggagaaagcaagtgctgc

SEQ ID NO: 7211463 - DNA, 22 bp, Homo sapiens
gaaggagaccctgaagatgctg

SEQ ID NO: 7211464 - DNA, 22 bp, Homo sapiens
gaaggagaccctgaagatgctg

SEQ ID NO: 7211465 - DNA, 22 bp, Homo sapiens
gaaggagaccctgaagatgctg

SEQ ID NO: 7211466 - DNA, 22 bp, Homo sapiens
gaaggagaccctgaagatgctg

SEQ ID NO: 7211467 - DNA, 22 bp, Homo sapiens
gaaggagaccctgaagatgctg

SEQ ID NO: 7211468 - DNA, 22 bp, Homo sapiens
gaaggagaccctgaagatgctg

SEQ ID NO: 7211469 - DNA, 22 bp, Homo sapiens
gaaggagagaaaggcaattctg

SEQ ID NO: 7211470 - DNA, 22 bp, Homo sapiens
gaaggagagaaaggcaattctg

SEQ ID NO: 7211471 - DNA, 22 bp, Homo sapiens
gaaggagagagacatcgtccct

SEQ ID NO: 7211472 - DNA, 22 bp, Homo sapiens
gaaggagagagacatcgtccct

SEQ ID NO: 7211473 - DNA, 22 bp, Homo sapiens
gaaggagagagacatcgtccct

SEQ ID NO: 7211474 - DNA, 22 bp, Homo sapiens
gaagttactctcgttaaatatg

SEQ ID NO: 7211475 - DNA, 22 bp, Homo sapiens
gaagttacttctttgtgcctca

SEQ ID NO: 7211476 - DNA, 22 bp, Homo sapiens
gaagttactttagaggaggctg

SEQ ID NO: 7211477 - DNA, 22 bp, Homo sapiens
gaagttagagaaggcagccagg

SEQ ID NO: 7211478 - DNA, 22 bp, Homo sapiens
gaagtgtttaagtcttctttgt

SEQ ID NO: 7211479 - DNA, 17 bp, Homo sapiens
gaagtgtttcttcatga

SEQ ID NO: 7211480 - DNA, 17 bp, Homo sapiens
gaagtgtttcttcatga

SEQ ID NO: 7211481 - DNA, 22 bp, Homo sapiens
gaagttaccgaacctctccatg

SEQ ID NO: 7211482 - DNA, 22 bp, Homo sapiens
gaagtgttgtatctttttaata

SEQ ID NO: 7211483 - DNA, 22 bp, Homo sapiens
gaagtgttgacttctgtgaatt

SEQ ID NO: 7211484 - DNA, 22 bp, Homo sapiens
gaagtgttgacttctgtgaatt

SEQ ID NO: 7211485 - DNA, 22 bp, Homo sapiens
gaagtgtgcacatcttacaagt

SEQ ID NO: 7211486 - DNA, 20 bp, Homo sapiens
gaagtgtggagttgggaagc

SEQ ID NO: 7211487 - DNA, 22 bp, Homo sapiens
gaagtgtgaaggtgatgtggag

SEQ ID NO: 7211488 - DNA, 22 bp, Homo sapiens
gaagtgggctttgtggtcagct

SEQ ID NO: 7211489 - DNA, 22 bp, Homo sapiens
gaagtgggctttgtggtcagct

SEQ ID NO: 7211490 - DNA, 22 bp, Homo sapiens
gaagtgggctttgtggtcagct

SEQ ID NO: 7211491 - DNA, 22 bp, Homo sapiens
gaagtggaattactgggtcata

SEQ ID NO: 7211492 - DNA, 22 bp, Homo sapiens
gaagtgcctcggtgtccaaggc

SEQ ID NO: 7211493 - DNA, 22 bp, Homo sapiens
gaagtggaagccatcggcagtc

SEQ ID NO: 7211494 - DNA, 22 bp, Homo sapiens
gaagtggaattactgggtcata

SEQ ID NO: 7211495 - DNA, 22 bp, Homo sapiens
gaagtggcctgaagtgaatgct

SEQ ID NO: 7211496 - DNA, 22 bp, Homo sapiens
gaagtgggctttgtggtcagct

SEQ ID NO: 7211497 - DNA, 22 bp, Homo sapiens
gaagtgggctttgtggtcagct

SEQ ID NO: 7211498 - DNA, 22 bp, Homo sapiens
gaagtggggaagcaacaggaga

SEQ ID NO: 7211499 - DNA, 22 bp, Homo sapiens
gaagtgggtggtgatatcactg

SEQ ID NO: 7211500 - DNA, 22 bp, Homo sapiens
gaagtgtagtcttgagccccca

SEQ ID NO: 7211501 - DNA, 22 bp, Homo sapiens
gaagtgtagtcttgagccccca

SEQ ID NO: 7211502 - DNA, 22 bp, Homo sapiens
gaagtggaagccatcggcagtc

SEQ ID NO: 7211503 - DNA, 22 bp, Homo sapiens
gaagtgcaaaaccacatggtaa

SEQ ID NO: 7211504 - DNA, 22 bp, Homo sapiens
gaagtgatgacgctgtgttttt

SEQ ID NO: 7211505 - DNA, 22 bp, Homo sapiens
gaagtgatgctggttgagatct

SEQ ID NO: 7211506 - DNA, 22 bp, Homo sapiens
gaagtgcaaaaccacatggtaa

SEQ ID NO: 7211507 - DNA, 22 bp, Homo sapiens
gaagtgaagagattagaaatca

SEQ ID NO: 7211508 - DNA, 22 bp, Homo sapiens
gaagtgaagagattagaaatca

SEQ ID NO: 7211509 - DNA, 22 bp, Homo sapiens
gaagtgaaggttactctagatt

SEQ ID NO: 7211510 - DNA, 18 bp, Homo sapiens
gaagtgaagtgactcaat

SEQ ID NO: 7211511 - DNA, 18 bp, Homo sapiens
gaagtgaagtgactcaat

SEQ ID NO: 7211512 - DNA, 22 bp, Homo sapiens
gaaggttttgtttgcaaatcat

SEQ ID NO: 7211513 - DNA, 22 bp, Homo sapiens
gaaggttttgattccactgaat

SEQ ID NO: 7211514 - DNA, 22 bp, Homo sapiens
gaagtacaaaggacatggaaac

SEQ ID NO: 7211515 - DNA, 22 bp, Homo sapiens
gaagggaaattcagatcttcag

SEQ ID NO: 7211516 - DNA, 22 bp, Homo sapiens
gaagggaaggaaagaaccagca

SEQ ID NO: 7211517 - DNA, 22 bp, Homo sapiens
gaagggaaggaaagaaccagca

SEQ ID NO: 7211518 - DNA, 22 bp, Homo sapiens
gaaggttttcaggagcctagtc

SEQ ID NO: 7211519 - DNA, 22 bp, Homo sapiens
gaagggaaggaaagaaccagca

SEQ ID NO: 7211520 - DNA, 22 bp, Homo sapiens
gaaggttttcaggagcctagtc

SEQ ID NO: 7211521 - DNA, 22 bp, Homo sapiens
gaaggctgcgaggggagtgccg

SEQ ID NO: 7211522 - DNA, 22 bp, Homo sapiens
gaaggctgcatggaggctgtgg

SEQ ID NO: 7211523 - DNA, 22 bp, Homo sapiens
gaaggctgcgaggggagtgccg

SEQ ID NO: 7211524 - DNA, 22 bp, Homo sapiens
gaaggctgatgacagattctgc

SEQ ID NO: 7211525 - DNA, 22 bp, Homo sapiens
gaaggctgcatggaggctgtgg

SEQ ID NO: 7211526 - DNA, 22 bp, Homo sapiens
gaaggctgcatggaggctgtgg

SEQ ID NO: 7211527 - DNA, 22 bp, Homo sapiens
gaaggctgagtgggtacggagg

SEQ ID NO: 7211528 - DNA, 22 bp, Homo sapiens
gaaggctgagtgggtacggagg

SEQ ID NO: 7211529 - DNA, 22 bp, Homo sapiens
gaaggctgagcagacaggccaa

SEQ ID NO: 7211530 - DNA, 22 bp, Homo sapiens
gaaggctgagcagacaggccaa

SEQ ID NO: 7211531 - DNA, 19 bp, Homo sapiens
gaaggctgaaatgaagcac

SEQ ID NO: 7211532 - DNA, 19 bp, Homo sapiens
gaaggctgaaatgaagcac

SEQ ID NO: 7211533 - DNA, 19 bp, Homo sapiens
gaaggctgaaatgaagcac

SEQ ID NO: 7211534 - DNA, 22 bp, Homo sapiens
gaaggctctgatttcttgcaaa

SEQ ID NO: 7211535 - DNA, 22 bp, Homo sapiens
gaaggctaaaggggcagaggtt

SEQ ID NO: 7211536 - DNA, 22 bp, Homo sapiens
gaaggctatatgactcagccct

SEQ ID NO: 7211537 - DNA, 22 bp, Homo sapiens
gaaggctcctcaacctctcggg

SEQ ID NO: 7211538 - DNA, 22 bp, Homo sapiens
gaaggctctgatttcttgcaaa

SEQ ID NO: 7211539 - DNA, 22 bp, Homo sapiens
gaaggctgctgggaagtgtggt

SEQ ID NO: 7211540 - DNA, 22 bp, Homo sapiens
gaaggctgcgaggggagtgccg

SEQ ID NO: 7211541 - DNA, 22 bp, Homo sapiens
gaaggctgcgaggggagtgccg

SEQ ID NO: 7211542 - DNA, 20 bp, Homo sapiens
gaaggcttggacagtgacag

SEQ ID NO: 7211543 - DNA, 22 bp, Homo sapiens
gactttataaatgagaggcgga

SEQ ID NO: 7211544 - DNA, 22 bp, Homo sapiens
gactttattactaaccctgtga

SEQ ID NO: 7211545 - DNA, 22 bp, Homo sapiens
gactttattatagtggcaatag

SEQ ID NO: 7211546 - DNA, 22 bp, Homo sapiens
gactttggttcagggctcagag

SEQ ID NO: 7211547 - DNA, 22 bp, Homo sapiens
gagaaacaacacttgatgcctt

SEQ ID NO: 7211548 - DNA, 22 bp, Homo sapiens
gagacacaagaagacatgcaca

SEQ ID NO: 7211549 - DNA, 22 bp, Homo sapiens
gagacacaagaagacatgcaca

SEQ ID NO: 7211550 - DNA, 22 bp, Homo sapiens
gagacacaagaagacatgcaca

SEQ ID NO: 7211551 - DNA, 22 bp, Homo sapiens
gagaaacaacacttgatgcctt

SEQ ID NO: 7211552 - DNA, 22 bp, Homo sapiens
gagaaacaacacttgatgcctt

SEQ ID NO: 7211553 - DNA, 22 bp, Homo sapiens
gagaaaatgtcagacttggtcg

SEQ ID NO: 7211554 - DNA, 22 bp, Homo sapiens
gagaaaatgtcagacttggtcg

SEQ ID NO: 7211555 - DNA, 22 bp, Homo sapiens
gagaaaatgtcagacttggtcg

SEQ ID NO: 7211556 - DNA, 22 bp, Homo sapiens
gagaaaatagcatgtgtagtat

SEQ ID NO: 7211557 - DNA, 22 bp, Homo sapiens
gagaaaatcttgggtcaagaat

SEQ ID NO: 7211558 - DNA, 22 bp, Homo sapiens
gagaaaagcgaaggacctggag

SEQ ID NO: 7211559 - DNA, 22 bp, Homo sapiens
gacttttagaatggtgaggaat

SEQ ID NO: 7211560 - DNA, 22 bp, Homo sapiens
gacttttagaatggtgaggaat

SEQ ID NO: 7211561 - DNA, 22 bp, Homo sapiens
gactttgtaggtaattgtgtct

SEQ ID NO: 7211562 - DNA, 22 bp, Homo sapiens
gagacagagaggtactcaacat

SEQ ID NO: 7211563 - DNA, 22 bp, Homo sapiens
gagacagagaggtactcaacat

SEQ ID NO: 7211564 - DNA, 22 bp, Homo sapiens
gagacacttgctgtgaggtcgc

SEQ ID NO: 7211565 - DNA, 22 bp, Homo sapiens
gagacacttgctgtgaggtcgc

SEQ ID NO: 7211566 - DNA, 22 bp, Homo sapiens
gagacactcaacaaagatatga

SEQ ID NO: 7211567 - DNA, 22 bp, Homo sapiens
gagacactcaacaaagatatga

SEQ ID NO: 7211568 - DNA, 21 bp, Homo sapiens
gagacagactttcgtcccctg

SEQ ID NO: 7211569 - DNA, 22 bp, Homo sapiens
gagacactcaacaaagatatga

SEQ ID NO: 7211570 - DNA, 22 bp, Homo sapiens
gagacacagttatcaggcatac

SEQ ID NO: 7211571 - DNA, 22 bp, Homo sapiens
gagacacagttatcaggcatac

SEQ ID NO: 7211572 - DNA, 22 bp, Homo sapiens
gagacacagttatcaggcatac

SEQ ID NO: 7211573 - DNA, 22 bp, Homo sapiens
gagacacagcagatattcaatc

SEQ ID NO: 7211574 - DNA, 22 bp, Homo sapiens
gagacacagcagatattcaatc

SEQ ID NO: 7211575 - DNA, 22 bp, Homo sapiens
gagacacagcagatattcaatc

SEQ ID NO: 7211576 - DNA, 22 bp, Homo sapiens
gagacacagcagatattcaatc

SEQ ID NO: 7211577 - DNA, 22 bp, Homo sapiens
gagacacaggcacagaagaggc

SEQ ID NO: 7211578 - DNA, 22 bp, Homo sapiens
gagacacaggcacagaagaggc

SEQ ID NO: 7211579 - DNA, 22 bp, Homo sapiens
gagacacaggcacagaagaggc

SEQ ID NO: 7211580 - DNA, 22 bp, Homo sapiens
gagacacaggcacagaagaggc

SEQ ID NO: 7211581 - DNA, 22 bp, Homo sapiens
gagacacaggcacagaagaggc

SEQ ID NO: 7211582 - DNA, 22 bp, Homo sapiens
gagacacaggcacagaagaggc

SEQ ID NO: 7211583 - DNA, 22 bp, Homo sapiens
gagacacaggtggttcctgtca

SEQ ID NO: 7211584 - DNA, 22 bp, Homo sapiens
gagacacaggtggttcctgtca

SEQ ID NO: 7211585 - DNA, 22 bp, Homo sapiens
gagacacaggtggttcctgtca

SEQ ID NO: 7211586 - DNA, 22 bp, Homo sapiens
gagacacagttatcaggcatac

SEQ ID NO: 7211587 - DNA, 22 bp, Homo sapiens
gagacacagttatcaggcatac

SEQ ID NO: 7211588 - DNA, 22 bp, Homo sapiens
gagacacagttatcaggcatac

SEQ ID NO: 7211589 - DNA, 22 bp, Homo sapiens
gagacacacacaggaggtggca

SEQ ID NO: 7211590 - DNA, 22 bp, Homo sapiens
gagacacacacaggaggtggca

SEQ ID NO: 7211591 - DNA, 22 bp, Homo sapiens
gagacacacacaggaggtggca

SEQ ID NO: 7211592 - DNA, 22 bp, Homo sapiens
gagacacacacaggaggtggca

SEQ ID NO: 7211593 - DNA, 22 bp, Homo sapiens
gagacacacacaggaggtggca

SEQ ID NO: 7211594 - DNA, 22 bp, Homo sapiens
gagacacacattctggagagaa

SEQ ID NO: 7211595 - DNA, 22 bp, Homo sapiens
gagacacacattctggagagaa

SEQ ID NO: 7211596 - DNA, 22 bp, Homo sapiens
gagacacacattctggagagaa

SEQ ID NO: 7211597 - DNA, 22 bp, Homo sapiens
gagacacacattctggagagaa

SEQ ID NO: 7211598 - DNA, 22 bp, Homo sapiens
gagacacacattctggagagaa

SEQ ID NO: 7211599 - DNA, 22 bp, Homo sapiens
gagacacacccaaggttatgag

SEQ ID NO: 7211600 - DNA, 22 bp, Homo sapiens
gagacacacccaaggttatgag

SEQ ID NO: 7211601 - DNA, 22 bp, Homo sapiens
gagacacacccaaggttatgag

SEQ ID NO: 7211602 - DNA, 22 bp, Homo sapiens
gagacacagagaggctgtgtga

SEQ ID NO: 7211603 - DNA, 22 bp, Homo sapiens
gagacacagagaggctgtgtga

SEQ ID NO: 7211604 - DNA, 22 bp, Homo sapiens
gagacacagagaggctgtgtga

SEQ ID NO: 7211605 - DNA, 22 bp, Homo sapiens
gagacacaatttccccatccta

SEQ ID NO: 7211606 - DNA, 22 bp, Homo sapiens
gagacacaatttccccatccta

SEQ ID NO: 7211607 - DNA, 22 bp, Homo sapiens
gagacacaatctcatttacatt

SEQ ID NO: 7211608 - DNA, 18 bp, Homo sapiens
gagacacaagggcctgga

SEQ ID NO: 7211609 - DNA, 22 bp, Homo sapiens
gagacacaatctcatttacatt

SEQ ID NO: 7211610 - DNA, 22 bp, Homo sapiens
gagacacaatctcatttacatt

SEQ ID NO: 7211611 - DNA, 22 bp, Homo sapiens
gagacacaatctcatttacatt

SEQ ID NO: 7211612 - DNA, 22 bp, Homo sapiens
gagacacaagacgcaactctgt

SEQ ID NO: 7211613 - DNA, 18 bp, Homo sapiens
gagacacaagggcctgga

SEQ ID NO: 7211614 - DNA, 22 bp, Homo sapiens
gagacacaagaagacatgcaca

SEQ ID NO: 7211615 - DNA, 22 bp, Homo sapiens
gagacacaagacgcaactctgt

SEQ ID NO: 7211616 - DNA, 22 bp, Homo sapiens
gagacacaagacgcaactctgt

SEQ ID NO: 7211617 - DNA, 22 bp, Homo sapiens
gagagctgcaaggtagggcggg

SEQ ID NO: 7211618 - DNA, 22 bp, Homo sapiens
gagagctgcagccgagaggggg

SEQ ID NO: 7211619 - DNA, 17 bp, Homo sapiens
gagagctgctgcttccg

SEQ ID NO: 7211620 - DNA, 20 bp, Homo sapiens
gagagctggaaataaagtcc

SEQ ID NO: 7211621 - DNA, 17 bp, Homo sapiens
gagagctgctgcttccg

SEQ ID NO: 7211622 - DNA, 18 bp, Homo sapiens
gagagctgctacctagct

SEQ ID NO: 7211623 - DNA, 18 bp, Homo sapiens
gagagctgctacctagct

SEQ ID NO: 7211624 - DNA, 22 bp, Homo sapiens
gagagctgcagccgagaggggg

SEQ ID NO: 7211625 - DNA, 22 bp, Homo sapiens
gagagctgcattctcagacaca

SEQ ID NO: 7211626 - DNA, 22 bp, Homo sapiens
gagagctgcattctcagacaca

SEQ ID NO: 7211627 - DNA, 22 bp, Homo sapiens
gagagctgcattctcagacaca

SEQ ID NO: 7211628 - DNA, 22 bp, Homo sapiens
gagagctgcattctcagacaca

SEQ ID NO: 7211629 - DNA, 22 bp, Homo sapiens
gagacagatctcggctccatgc

SEQ ID NO: 7211630 - DNA, 22 bp, Homo sapiens
gagacagatctcggctccatgc

SEQ ID NO: 7211631 - DNA, 22 bp, Homo sapiens
gagacagagtttcactcttgtt

SEQ ID NO: 7211632 - DNA, 22 bp, Homo sapiens
gagacagagtttcactcttgtt

SEQ ID NO: 7211633 - DNA, 22 bp, Homo sapiens
gagacagagatcttgctgagtc

SEQ ID NO: 7211634 - DNA, 22 bp, Homo sapiens
gagacagagtgttttttaaggt

SEQ ID NO: 7211635 - DNA, 22 bp, Homo sapiens
gagacagagaggtactcaacat

SEQ ID NO: 7211636 - DNA, 22 bp, Homo sapiens
gagacagagatcttgctgagtc

SEQ ID NO: 7211637 - DNA, 22 bp, Homo sapiens
gagacagagatcttgctgagtc

SEQ ID NO: 7211638 - DNA, 22 bp, Homo sapiens
gagacagatctcggctccatgc

SEQ ID NO: 7211639 - DNA, 22 bp, Homo sapiens
gagacagatctcggctccatgc

SEQ ID NO: 7211640 - DNA, 22 bp, Homo sapiens
gagagcctttgaagggaagtga

SEQ ID NO: 7211641 - DNA, 21 bp, Homo sapiens
gagagctaacagtgacagctc

SEQ ID NO: 7211642 - DNA, 22 bp, Homo sapiens
gagagctaactacctggaaatg

SEQ ID NO: 7211643 - DNA, 22 bp, Homo sapiens
gagagctaggccactggggctt

SEQ ID NO: 7211644 - DNA, 22 bp, Homo sapiens
gagagctatttggcaagcattt

SEQ ID NO: 7211645 - DNA, 22 bp, Homo sapiens
gagagctccatgttcatgctgt

SEQ ID NO: 7211646 - DNA, 23 bp, Homo sapiens
gagagctgactgtcaagactgtt

SEQ ID NO: 7211647 - DNA, 23 bp, Homo sapiens
gagagctgactgtcaagactgtt

SEQ ID NO: 7211648 - DNA, 22 bp, Homo sapiens
gagagctgaggggcctggcact

SEQ ID NO: 7211649 - DNA, 22 bp, Homo sapiens
gagagctggattctggataggt

SEQ ID NO: 7211650 - DNA, 20 bp, Homo sapiens
gagagctggaaataaagtcc

SEQ ID NO: 7211651 - DNA, 22 bp, Homo sapiens
gagagctggagttatttctctg

SEQ ID NO: 7211652 - DNA, 22 bp, Homo sapiens
gagagctggagttatttctctg

SEQ ID NO: 7211653 - DNA, 22 bp, Homo sapiens
gagagctggattctggataggt

SEQ ID NO: 7211654 - DNA, 22 bp, Homo sapiens
gagagctggattctggataggt

SEQ ID NO: 7211655 - DNA, 22 bp, Homo sapiens
gagagctggccagcttcagtat

SEQ ID NO: 7211656 - DNA, 22 bp, Homo sapiens
gagagctggccagcttcagtat

SEQ ID NO: 7211657 - DNA, 22 bp, Homo sapiens
gagagctggattctggataggt

SEQ ID NO: 7211658 - DNA, 22 bp, Homo sapiens
gagagctgggctttgggtgaag

SEQ ID NO: 7211659 - DNA, 22 bp, Homo sapiens
gagagctgggctttgggtgaag

SEQ ID NO: 7211660 - DNA, 22 bp, Homo sapiens
gagagctgggctttgggtgaag

SEQ ID NO: 7211661 - DNA, 22 bp, Homo sapiens
gagagctgggctttgggtgaag

SEQ ID NO: 7211662 - DNA, 22 bp, Homo sapiens
gagagctgggctttgggtgaag

SEQ ID NO: 7211663 - DNA, 20 bp, Homo sapiens
gagagctggggatgaggctg

SEQ ID NO: 7211664 - DNA, 20 bp, Homo sapiens
gagagctggggatgaggctg

SEQ ID NO: 7211665 - DNA, 20 bp, Homo sapiens
gagagctggggatgaggctg

SEQ ID NO: 7211666 - DNA, 22 bp, Homo sapiens
gagagctgggggactgtggatg

SEQ ID NO: 7211667 - DNA, 22 bp, Homo sapiens
gagagctgggggactgtggatg

SEQ ID NO: 7211668 - DNA, 22 bp, Homo sapiens
gagaggtaatttgaagtgcaaa

SEQ ID NO: 7211669 - DNA, 22 bp, Homo sapiens
gagagctgtaatagtcatgtct

SEQ ID NO: 7211670 - DNA, 22 bp, Homo sapiens
gagagctgtaatagtcatgtct

SEQ ID NO: 7211671 - DNA, 22 bp, Homo sapiens
gagagtctaggaacctcatata

SEQ ID NO: 7211672 - DNA, 22 bp, Homo sapiens
gagagtctaggaacctcatata

SEQ ID NO: 7211673 - DNA, 22 bp, Homo sapiens
gagagtctaggaacctcatata

SEQ ID NO: 7211674 - DNA, 22 bp, Homo sapiens
gagagtccttagtttgcaggta

SEQ ID NO: 7211675 - DNA, 22 bp, Homo sapiens
gagaggtagaggctctgcttaa

SEQ ID NO: 7211676 - DNA, 22 bp, Homo sapiens
gagagtccttagtttgcaggta

SEQ ID NO: 7211677 - DNA, 22 bp, Homo sapiens
gagaggtacggaaagagcgtgg

SEQ ID NO: 7211678 - DNA, 22 bp, Homo sapiens
gagaggtacaccctttaaactt

SEQ ID NO: 7211679 - DNA, 22 bp, Homo sapiens
gagaggtaatttgaagtgcaaa

SEQ ID NO: 7211680 - DNA, 22 bp, Homo sapiens
gagaggtacggaaagagcgtgg

SEQ ID NO: 7211681 - DNA, 22 bp, Homo sapiens
gacaggcagttttccagatcag

SEQ ID NO: 7211682 - DNA, 22 bp, Homo sapiens
gacaggcaggccagggctgtgg

SEQ ID NO: 7211683 - DNA, 22 bp, Homo sapiens
gacaggcaggccagggctgtgg

SEQ ID NO: 7211684 - DNA, 22 bp, Homo sapiens
gacaggcaggccagggctgtgg

SEQ ID NO: 7211685 - DNA, 22 bp, Homo sapiens
gaccaggctgttccagtctaac

SEQ ID NO: 7211686 - DNA, 22 bp, Homo sapiens
gacaggccagacaggagactga

SEQ ID NO: 7211687 - DNA, 22 bp, Homo sapiens
gacaggcatgctttcaggacta

SEQ ID NO: 7211688 - DNA, 22 bp, Homo sapiens
gaccatcctggccaacgtggta

SEQ ID NO: 7211689 - DNA, 22 bp, Homo sapiens
gaccagttttctgctttggaag

SEQ ID NO: 7211690 - DNA, 22 bp, Homo sapiens
gaccatcctggccaacgtggta

SEQ ID NO: 7211691 - DNA, 22 bp, Homo sapiens
gaccagggtcactcacagggct

SEQ ID NO: 7211692 - DNA, 22 bp, Homo sapiens
gaccaggtccaaagctactgtc

SEQ ID NO: 7211693 - DNA, 22 bp, Homo sapiens
gaccaggtccaaagctactgtc

SEQ ID NO: 7211694 - DNA, 22 bp, Homo sapiens
gaccagtcattactcatgccct

SEQ ID NO: 7211695 - DNA, 22 bp, Homo sapiens
gaccagtaaccagtgaccagtg

SEQ ID NO: 7211696 - DNA, 22 bp, Homo sapiens
gacaggcagacctgtgccctgg

SEQ ID NO: 7211697 - DNA, 22 bp, Homo sapiens
gacaggcacgaaattgggctgg

SEQ ID NO: 7211698 - DNA, 22 bp, Homo sapiens
gacaggcacgaaattgggctgg

SEQ ID NO: 7211699 - DNA, 21 bp, Homo sapiens
gacaggcaaggagtcacttag

SEQ ID NO: 7211700 - DNA, 22 bp, Homo sapiens
gacaggcaattaccagcgccca

SEQ ID NO: 7211701 - DNA, 22 bp, Homo sapiens
gacaggatgtattggcaagagg

SEQ ID NO: 7211702 - DNA, 22 bp, Homo sapiens
gacaggatattatgatagattc

SEQ ID NO: 7211703 - DNA, 22 bp, Homo sapiens
gacaggatgtattggcaagagg

SEQ ID NO: 7211704 - DNA, 22 bp, Homo sapiens
gacaggaggcagagctcaggtg

SEQ ID NO: 7211705 - DNA, 20 bp, Homo sapiens
gacaggagagttaggtaggt

SEQ ID NO: 7211706 - DNA, 22 bp, Homo sapiens
gacaggaggcagagctcaggtg

SEQ ID NO: 7211707 - DNA, 22 bp, Homo sapiens
gacaggaggcagagctcaggtg

SEQ ID NO: 7211708 - DNA, 22 bp, Homo sapiens
gacaggaggcagagctcaggtg

SEQ ID NO: 7211709 - DNA, 22 bp, Homo sapiens
gacaggaggcagagctcaggtg

SEQ ID NO: 7211710 - DNA, 22 bp, Homo sapiens
gacaggaggcagagctcaggtg

SEQ ID NO: 7211711 - DNA, 22 bp, Homo sapiens
gacaggaggcagagctcaggtg

SEQ ID NO: 7211712 - DNA, 22 bp, Homo sapiens
gacaggatattatgatagattc

SEQ ID NO: 7211713 - DNA, 22 bp, Homo sapiens
gacccagggtatccagagctgc

SEQ ID NO: 7211714 - DNA, 22 bp, Homo sapiens
gacccagggtatccagagctgc

SEQ ID NO: 7211715 - DNA, 22 bp, Homo sapiens
gacccaggggcagggagaaagt

SEQ ID NO: 7211716 - DNA, 22 bp, Homo sapiens
gacccagggtatccagagctgc

SEQ ID NO: 7211717 - DNA, 22 bp, Homo sapiens
gacccagggtatccagagctgc

SEQ ID NO: 7211718 - DNA, 22 bp, Homo sapiens
gacccagggtggtcacctgaaa

SEQ ID NO: 7211719 - DNA, 22 bp, Homo sapiens
gacccaggagagagggttgcat

SEQ ID NO: 7211720 - DNA, 22 bp, Homo sapiens
gacccaggagagagggttgcat

SEQ ID NO: 7211721 - DNA, 22 bp, Homo sapiens
gacccaggagtgcagagagtgg

SEQ ID NO: 7211722 - DNA, 22 bp, Homo sapiens
gacccaggagtgcagagagtgg

SEQ ID NO: 7211723 - DNA, 22 bp, Homo sapiens
gacccaggagtgcagagagtgg

SEQ ID NO: 7211724 - DNA, 22 bp, Homo sapiens
gacccaggcccaaggctgccag

SEQ ID NO: 7211725 - DNA, 22 bp, Homo sapiens
gacccaggcccaaggctgccag

SEQ ID NO: 7211726 - DNA, 22 bp, Homo sapiens
gacccaggcccaaggctgccag

SEQ ID NO: 7211727 - DNA, 22 bp, Homo sapiens
gacccaggctcgtgggacggct

SEQ ID NO: 7211728 - DNA, 22 bp, Homo sapiens
gacccaggctcgtgggacggct

SEQ ID NO: 7211729 - DNA, 22 bp, Homo sapiens
gacccacctcaccaagcatgtg

SEQ ID NO: 7211730 - DNA, 22 bp, Homo sapiens
gacccagaggcctgacagtgtg

SEQ ID NO: 7211731 - DNA, 22 bp, Homo sapiens
gaccatttctaggaatcagact

SEQ ID NO: 7211732 - DNA, 22 bp, Homo sapiens
gaccatttcaggggcagggact

SEQ ID NO: 7211733 - DNA, 22 bp, Homo sapiens
gaccatttccaccatgggcaca

SEQ ID NO: 7211734 - DNA, 22 bp, Homo sapiens
gaccattagctgctattcagta

SEQ ID NO: 7211735 - DNA, 22 bp, Homo sapiens
gacccaggaagctacttctggt

SEQ ID NO: 7211736 - DNA, 18 bp, Homo sapiens
gacccaggaaagagtcct

SEQ ID NO: 7211737 - DNA, 18 bp, Homo sapiens
gacccaggaaagagtcct

SEQ ID NO: 7211738 - DNA, 18 bp, Homo sapiens
gacccagcagatgggctt

SEQ ID NO: 7211739 - DNA, 22 bp, Homo sapiens
gacccagcctggtttttatagg

SEQ ID NO: 7211740 - DNA, 22 bp, Homo sapiens
gacccagctaaccaggtgggga

SEQ ID NO: 7211741 - DNA, 22 bp, Homo sapiens
gacccagcttaagtcacatgtt

SEQ ID NO: 7211742 - DNA, 22 bp, Homo sapiens
gacccagcttaagtcacatgtt

SEQ ID NO: 7211743 - DNA, 22 bp, Homo sapiens
gacccagggtttctgcacaggg

SEQ ID NO: 7211744 - DNA, 22 bp, Homo sapiens
gacccagggtttctgcacaggg

SEQ ID NO: 7211745 - DNA, 22 bp, Homo sapiens
gacccagggtttctgcacaggg

SEQ ID NO: 7211746 - DNA, 22 bp, Homo sapiens
gacccagggtttctgcacaggg

SEQ ID NO: 7211747 - DNA, 22 bp, Homo sapiens
gacccagggtttctgcacaggg

SEQ ID NO: 7211748 - DNA, 22 bp, Homo sapiens
gactgcttaaatatatgatgtt

SEQ ID NO: 7211749 - DNA, 22 bp, Homo sapiens
gactgcttatatgttaaagata

SEQ ID NO: 7211750 - DNA, 22 bp, Homo sapiens
gactgcttatatgttaaagata

SEQ ID NO: 7211751 - DNA, 22 bp, Homo sapiens
gactgcttcccagtaagggttt

SEQ ID NO: 7211752 - DNA, 22 bp, Homo sapiens
gactgcttccctgggattgctc

SEQ ID NO: 7211753 - DNA, 22 bp, Homo sapiens
gactgcttctccttggtaggtt

SEQ ID NO: 7211754 - DNA, 22 bp, Homo sapiens
gactgcttgagaaggaacaaat

SEQ ID NO: 7211755 - DNA, 22 bp, Homo sapiens
gactgctttaaccaagaaagca

SEQ ID NO: 7211756 - DNA, 22 bp, Homo sapiens
gactgctttgacaaatgatacc

SEQ ID NO: 7211757 - DNA, 22 bp, Homo sapiens
gactgctttgaccaatagcaca

SEQ ID NO: 7211758 - DNA, 22 bp, Homo sapiens
gactgctttggtttgtaaatgt

SEQ ID NO: 7211759 - DNA, 22 bp, Homo sapiens
gactgggtcctctgcttatggt

SEQ ID NO: 7211760 - DNA, 22 bp, Homo sapiens
gactggggtaaggtgaggaggt

SEQ ID NO: 7211761 - DNA, 22 bp, Homo sapiens
gactggtcttttgtgatggatg

SEQ ID NO: 7211762 - DNA, 22 bp, Homo sapiens
gactggtcttttgtgatggatg

SEQ ID NO: 7211763 - DNA, 22 bp, Homo sapiens
gactggttatccccagcacaca

SEQ ID NO: 7211764 - DNA, 22 bp, Homo sapiens
gactggttgaactcaggacaga

SEQ ID NO: 7211765 - DNA, 22 bp, Homo sapiens
gactggttgctaagcacagctt

SEQ ID NO: 7211766 - DNA, 22 bp, Homo sapiens
gactggggtaaggtgaggaggt

SEQ ID NO: 7211767 - DNA, 22 bp, Homo sapiens
gactggggtaaggtgaggaggt

SEQ ID NO: 7211768 - DNA, 22 bp, Homo sapiens
gactgcttttctagtctaaaat

SEQ ID NO: 7211769 - DNA, 22 bp, Homo sapiens
gactggaaagcctgtcctcaga

SEQ ID NO: 7211770 - DNA, 22 bp, Homo sapiens
gactggaaagcctgtcctcaga

SEQ ID NO: 7211771 - DNA, 22 bp, Homo sapiens
gactggtttctagcctcatagt

SEQ ID NO: 7211772 - DNA, 22 bp, Homo sapiens
gactggtttgccaccgacagat

SEQ ID NO: 7211773 - DNA, 22 bp, Homo sapiens
gactgtacttgagagaggaact

SEQ ID NO: 7211774 - DNA, 22 bp, Homo sapiens
gactgtattacaattggcagca

SEQ ID NO: 7211775 - DNA, 22 bp, Homo sapiens
gactgtctcctgtcatgaggga

SEQ ID NO: 7211776 - DNA, 22 bp, Homo sapiens
gactgtcttgtttctaagatga

SEQ ID NO: 7211777 - DNA, 22 bp, Homo sapiens
gactgtgccagtcagtgggcgg

SEQ ID NO: 7211778 - DNA, 22 bp, Homo sapiens
gactgtggactctcatgataga

SEQ ID NO: 7211779 - DNA, 22 bp, Homo sapiens
gactgtggactctcatgataga

SEQ ID NO: 7211780 - DNA, 22 bp, Homo sapiens
gactgtgacttctgaagcaata

SEQ ID NO: 7211781 - DNA, 22 bp, Homo sapiens
gactgtggatagaacactgcag

SEQ ID NO: 7211782 - DNA, 22 bp, Homo sapiens
gactgtggcaggctcagcactg

SEQ ID NO: 7211783 - DNA, 22 bp, Homo sapiens
gactgtggccttggaccatggg

SEQ ID NO: 7211784 - DNA, 22 bp, Homo sapiens
gactgtggccttggaccatggg

SEQ ID NO: 7211785 - DNA, 22 bp, Homo sapiens
gactgtgggaagactgtaggtt

SEQ ID NO: 7211786 - DNA, 22 bp, Homo sapiens
gactgtgggaagactgtaggtt

SEQ ID NO: 7211787 - DNA, 22 bp, Homo sapiens
gactgtggggaagcagatgcca

SEQ ID NO: 7211788 - DNA, 22 bp, Homo sapiens
gactgtggggggcggacacaag

SEQ ID NO: 7211789 - DNA, 22 bp, Homo sapiens
gactgtggggggcggacacaag

SEQ ID NO: 7211790 - DNA, 22 bp, Homo sapiens
gacttctgcctcaggggaaggt

SEQ ID NO: 7211791 - DNA, 22 bp, Homo sapiens
gacttcttcatgtcttttccac

SEQ ID NO: 7211792 - DNA, 22 bp, Homo sapiens
gacttgggagtcttctgagatg

SEQ ID NO: 7211793 - DNA, 21 bp, Homo sapiens
gactttaatttgagagcaaaa

SEQ ID NO: 7211794 - DNA, 21 bp, Homo sapiens
gactttaatttgagagcaaaa

SEQ ID NO: 7211795 - DNA, 21 bp, Homo sapiens
gactttaatttgagagcaaaa

SEQ ID NO: 7211796 - DNA, 22 bp, Homo sapiens
gactttaaaatgctagaacagg

SEQ ID NO: 7211797 - DNA, 22 bp, Homo sapiens
gactttaaaatgctagaacagg

SEQ ID NO: 7211798 - DNA, 22 bp, Homo sapiens
gactttaaagcctgacatttta

SEQ ID NO: 7211799 - DNA, 22 bp, Homo sapiens
gacttgggtgtcggggcagtct

SEQ ID NO: 7211800 - DNA, 18 bp, Homo sapiens
gactttaaaacactgctc

SEQ ID NO: 7211801 - DNA, 21 bp, Homo sapiens
gacttcatgggtcaaccaatt

SEQ ID NO: 7211802 - DNA, 22 bp, Homo sapiens
gacttctcatgaggggaggtca

SEQ ID NO: 7211803 - DNA, 22 bp, Homo sapiens
gacttcagatattttttaagtt

SEQ ID NO: 7211804 - DNA, 22 bp, Homo sapiens
gacttctgagctatccagctgt

SEQ ID NO: 7211805 - DNA, 19 bp, Homo sapiens
gacttctgatgtccagatg

SEQ ID NO: 7211806 - DNA, 22 bp, Homo sapiens
gacttctctgcatgagataagt

SEQ ID NO: 7211807 - DNA, 22 bp, Homo sapiens
gacttctgaattcctatcaggt

SEQ ID NO: 7211808 - DNA, 22 bp, Homo sapiens
gacttctcggcaccctttggca

SEQ ID NO: 7211809 - DNA, 22 bp, Homo sapiens
gacttctccgtcatctccagtg

SEQ ID NO: 7211810 - DNA, 22 bp, Homo sapiens
gacttctccagactgcctggta

SEQ ID NO: 7211811 - DNA, 22 bp, Homo sapiens
gacttctcccaaccatcagagg

SEQ ID NO: 7211812 - DNA, 22 bp, Homo sapiens
gactgtttaatactgtgagttc

SEQ ID NO: 7211813 - DNA, 22 bp, Homo sapiens
gactgtttaatactgtgagttc

SEQ ID NO: 7211814 - DNA, 21 bp, Homo sapiens
gacttatctatattctattta

SEQ ID NO: 7211815 - DNA, 22 bp, Homo sapiens
gacttatctatgagtgggtttt

SEQ ID NO: 7211816 - DNA, 22 bp, Homo sapiens
gacttattcacgcagctatact

SEQ ID NO: 7211817 - DNA, 22 bp, Homo sapiens
ttccaaagaaattgaccaagac

SEQ ID NO: 7211818 - DNA, 22 bp, Homo sapiens
ttccaaagcacttgatgtaaag

SEQ ID NO: 7211819 - DNA, 22 bp, Homo sapiens
ttccaaagctgctttatttagt

SEQ ID NO: 7211820 - DNA, 22 bp, Homo sapiens
ttccaaagcacttgatgtaaag

SEQ ID NO: 7211821 - DNA, 22 bp, Homo sapiens
ttccaaaggaatggggagctat

SEQ ID NO: 7211822 - DNA, 22 bp, Homo sapiens
ttccaaagtcatgttgctgata

SEQ ID NO: 7211823 - DNA, 22 bp, Homo sapiens
ttccaaagttagttattagaaa

SEQ ID NO: 7211824 - DNA, 22 bp, Homo sapiens
ttccaaagttagttattagaaa

SEQ ID NO: 7211825 - DNA, 22 bp, Homo sapiens
ttccaaatgagttccatcgaat

SEQ ID NO: 7211826 - DNA, 22 bp, Homo sapiens
ttcccacaacagatctgtatta

SEQ ID NO: 7211827 - DNA, 22 bp, Homo sapiens
ttcccacaatctgcgtgtgtat

SEQ ID NO: 7211828 - DNA, 22 bp, Homo sapiens
ttcccacacaattaagtcattt

SEQ ID NO: 7211829 - DNA, 22 bp, Homo sapiens
ttcccaaagctttgtctgtgaa

SEQ ID NO: 7211830 - DNA, 22 bp, Homo sapiens
ttccatttttctaactctcaga

SEQ ID NO: 7211831 - DNA, 22 bp, Homo sapiens
ttcccaaaatataacagttaac

SEQ ID NO: 7211832 - DNA, 22 bp, Homo sapiens
ttcccaaaatataacagttaac

SEQ ID NO: 7211833 - DNA, 22 bp, Homo sapiens
ttccatttggcacttcactgag

SEQ ID NO: 7211834 - DNA, 22 bp, Homo sapiens
ttccatttttctaactctcaga

SEQ ID NO: 7211835 - DNA, 22 bp, Homo sapiens
ttccatttttctaactctcaga

SEQ ID NO: 7211836 - DNA, 22 bp, Homo sapiens
ttccaggcaaaggaagcagctt

SEQ ID NO: 7211837 - DNA, 22 bp, Homo sapiens
ttccatttattcttgtccagat

SEQ ID NO: 7211838 - DNA, 22 bp, Homo sapiens
ttccaggcacatcccaactcca

SEQ ID NO: 7211839 - DNA, 22 bp, Homo sapiens
ttccatttggcacttcactgag

SEQ ID NO: 7211840 - DNA, 22 bp, Homo sapiens
ttccatttggcacttcactgag

SEQ ID NO: 7211841 - DNA, 22 bp, Homo sapiens
ttccgagggctcggcggccgcc

SEQ ID NO: 7211842 - DNA, 22 bp, Homo sapiens
ttccgagtctccaaggggttgt

SEQ ID NO: 7211843 - DNA, 22 bp, Homo sapiens
ttccgagtctccaaggggttgt

SEQ ID NO: 7211844 - DNA, 21 bp, Homo sapiens
ttcccttctggttttgagaga

SEQ ID NO: 7211845 - DNA, 22 bp, Homo sapiens
ttcccttctagttttgagagac

SEQ ID NO: 7211846 - DNA, 22 bp, Homo sapiens
ttcccttctagttttgagagac

SEQ ID NO: 7211847 - DNA, 22 bp, Homo sapiens
ttccgctgtttagttgaagttt

SEQ ID NO: 7211848 - DNA, 22 bp, Homo sapiens
ttccgctgtttagttgaagttt

SEQ ID NO: 7211849 - DNA, 22 bp, Homo sapiens
ttccggaaggttctctagaatt

SEQ ID NO: 7211850 - DNA, 22 bp, Homo sapiens
ttccggggatagtgtttcccat

SEQ ID NO: 7211851 - DNA, 22 bp, Homo sapiens
ctaaggatgcatatgttttgtt

SEQ ID NO: 7211852 - DNA, 22 bp, Homo sapiens
ttcccacttttacagttgtctg

SEQ ID NO: 7211853 - DNA, 22 bp, Homo sapiens
ttcccagaatgaatggatggag

SEQ ID NO: 7211854 - DNA, 22 bp, Homo sapiens
ttcccagaatgaatggatggag

SEQ ID NO: 7211855 - DNA, 22 bp, Homo sapiens
ttcccttaaattatggcatcta

SEQ ID NO: 7211856 - DNA, 22 bp, Homo sapiens
ttcccttcaaggtggcctaaag

SEQ ID NO: 7211857 - DNA, 22 bp, Homo sapiens
ttcccacattctttacattcat

SEQ ID NO: 7211858 - DNA, 22 bp, Homo sapiens
ttcccacagtgactccagagaa

SEQ ID NO: 7211859 - DNA, 22 bp, Homo sapiens
ttcccacagtgttgaatcctct

SEQ ID NO: 7211860 - DNA, 22 bp, Homo sapiens
ttcccacaggatgagagctgag

SEQ ID NO: 7211861 - DNA, 22 bp, Homo sapiens
ttcccacagtcactgggagaag

SEQ ID NO: 7211862 - DNA, 22 bp, Homo sapiens
ttcccacacccatattgtgatt

SEQ ID NO: 7211863 - DNA, 22 bp, Homo sapiens
ctaatcatctttctcttaaagc

SEQ ID NO: 7211864 - DNA, 22 bp, Homo sapiens
ctaatgcagtatcagaatagca

SEQ ID NO: 7211865 - DNA, 22 bp, Homo sapiens
ctaataatagaggtggcatttg

SEQ ID NO: 7211866 - DNA, 20 bp, Homo sapiens
ctaatattctactctaagga

SEQ ID NO: 7211867 - DNA, 20 bp, Homo sapiens
ctaatattctactctaagga

SEQ ID NO: 7211868 - DNA, 22 bp, Homo sapiens
ctaatatttttagaaatcacga

SEQ ID NO: 7211869 - DNA, 22 bp, Homo sapiens
ctaagggcacagccaatcatca

SEQ ID NO: 7211870 - DNA, 17 bp, Homo sapiens
ctaagggcccactcttc

SEQ ID NO: 7211871 - DNA, 22 bp, Homo sapiens
ctaagggcttaatgtgtgtcag

SEQ ID NO: 7211872 - DNA, 22 bp, Homo sapiens
ctaagggcttgctggagccagg

SEQ ID NO: 7211873 - DNA, 22 bp, Homo sapiens
ctaagggcttgctggagccagg

SEQ ID NO: 7211874 - DNA, 22 bp, Homo sapiens
ctaagggttgaaacagcaagaa

SEQ ID NO: 7211875 - DNA, 22 bp, Homo sapiens
ctaagttaattttctaaaacta

SEQ ID NO: 7211876 - DNA, 22 bp, Homo sapiens
ctaataacatgaactactttct

SEQ ID NO: 7211877 - DNA, 22 bp, Homo sapiens
ctaataatagaggtggcatttg

SEQ ID NO: 7211878 - DNA, 22 bp, Homo sapiens
ctaatttaatgaatgagtctta

SEQ ID NO: 7211879 - DNA, 22 bp, Homo sapiens
ctaattgtttgtgttgtcacct

SEQ ID NO: 7211880 - DNA, 22 bp, Homo sapiens
ctaattgtaccagatttctctt

SEQ ID NO: 7211881 - DNA, 22 bp, Homo sapiens
ctaattgttaggtgtctgatgt

SEQ ID NO: 7211882 - DNA, 22 bp, Homo sapiens
ctaattgtaagctccttgaggg

SEQ ID NO: 7211883 - DNA, 22 bp, Homo sapiens
ctaattctgtatttggtcattg

SEQ ID NO: 7211884 - DNA, 22 bp, Homo sapiens
ctaatgtatcatggctctcagc

SEQ ID NO: 7211885 - DNA, 22 bp, Homo sapiens
ctaatgtggactctatcaaagt

SEQ ID NO: 7211886 - DNA, 22 bp, Homo sapiens
ctaattatgttgttataatcaa

SEQ ID NO: 7211887 - DNA, 22 bp, Homo sapiens
ctaattctgtacctggcacata

SEQ ID NO: 7211888 - DNA, 22 bp, Homo sapiens
ctaattctgtacctggcacata

SEQ ID NO: 7211889 - DNA, 22 bp, Homo sapiens
ctaattctcagcatgaactggt

SEQ ID NO: 7211890 - DNA, 22 bp, Homo sapiens
ctaattctgaaacagtgtcaat

SEQ ID NO: 7211891 - DNA, 22 bp, Homo sapiens
ctaatttaatgaatgagtctta

SEQ ID NO: 7211892 - DNA, 22 bp, Homo sapiens
ctaatttaatgaatgagtctta

SEQ ID NO: 7211893 - DNA, 22 bp, Homo sapiens
ctaatttaatgaatgagtctta

SEQ ID NO: 7211894 - DNA, 22 bp, Homo sapiens
ctaattttcccaaggccttcta

SEQ ID NO: 7211895 - DNA, 22 bp, Homo sapiens
ctaatttttgttctgcattgaa

SEQ ID NO: 7211896 - DNA, 22 bp, Homo sapiens
ctacaaaagtaattgtggtttt

SEQ ID NO: 7211897 - DNA, 22 bp, Homo sapiens
ctacaaaagtaattgtggtttt

SEQ ID NO: 7211898 - DNA, 22 bp, Homo sapiens
ctacaaaagtaattgtggtttt

SEQ ID NO: 7211899 - DNA, 22 bp, Homo sapiens
ttccttctaatattctgcctgt

SEQ ID NO: 7211900 - DNA, 22 bp, Homo sapiens
ttccttctaatattctgcctgt

SEQ ID NO: 7211901 - DNA, 22 bp, Homo sapiens
ttccttcctgtcttccttactg

SEQ ID NO: 7211902 - DNA, 22 bp, Homo sapiens
ttccttcctgtcttccttactg

SEQ ID NO: 7211903 - DNA, 22 bp, Homo sapiens
ttccttcctggggatttatcat

SEQ ID NO: 7211904 - DNA, 22 bp, Homo sapiens
ttccttcctggggatttatcat

SEQ ID NO: 7211905 - DNA, 22 bp, Homo sapiens
ttccttcctggggatttatcat

SEQ ID NO: 7211906 - DNA, 22 bp, Homo sapiens
ttccttccgggcaccaggcact

SEQ ID NO: 7211907 - DNA, 22 bp, Homo sapiens
ttccttcctcctccagttctgg

SEQ ID NO: 7211908 - DNA, 22 bp, Homo sapiens
ttccttcctcctccagttctgg

SEQ ID NO: 7211909 - DNA, 22 bp, Homo sapiens
ttccttcctctttcacaacagc

SEQ ID NO: 7211910 - DNA, 22 bp, Homo sapiens
ttccttccctcagtggctgaag

SEQ ID NO: 7211911 - DNA, 22 bp, Homo sapiens
ttccttcccctagctgagaaac

SEQ ID NO: 7211912 - DNA, 22 bp, Homo sapiens
ttccttcccctagctgagaaac

SEQ ID NO: 7211913 - DNA, 22 bp, Homo sapiens
ttccttccgggcaccaggcact

SEQ ID NO: 7211914 - DNA, 22 bp, Homo sapiens
ttccttccgggcaccaggcact

SEQ ID NO: 7211915 - DNA, 22 bp, Homo sapiens
ttccttccacttcaggattttg

SEQ ID NO: 7211916 - DNA, 22 bp, Homo sapiens
ttccttccacttcaggattttg

SEQ ID NO: 7211917 - DNA, 22 bp, Homo sapiens
ttccttccagcttgtgacagtc

SEQ ID NO: 7211918 - DNA, 22 bp, Homo sapiens
ttccttccagcttgtgacagtc

SEQ ID NO: 7211919 - DNA, 22 bp, Homo sapiens
ttccttccatagcaaaacatgc

SEQ ID NO: 7211920 - DNA, 22 bp, Homo sapiens
ctacaaaagtaattgtggtttt

SEQ ID NO: 7211921 - DNA, 22 bp, Homo sapiens
ctacaaaagtaattgtggtttt

SEQ ID NO: 7211922 - DNA, 22 bp, Homo sapiens
ctacaaaagtaattgtggtttt

SEQ ID NO: 7211923 - DNA, 22 bp, Homo sapiens
ctacaaagaaagtatactggac

SEQ ID NO: 7211924 - DNA, 22 bp, Homo sapiens
ctacaaagaaagtatactggac

SEQ ID NO: 7211925 - DNA, 22 bp, Homo sapiens
ctacaaagaatttctctagctc

SEQ ID NO: 7211926 - DNA, 22 bp, Homo sapiens
ctacaaagaaagctgaggggaa

SEQ ID NO: 7211927 - DNA, 22 bp, Homo sapiens
ctacaaatataaaacacagata

SEQ ID NO: 7211928 - DNA, 22 bp, Homo sapiens
ctacaaagctcttctacaggca

SEQ ID NO: 7211929 - DNA, 22 bp, Homo sapiens
ctacaaagctcttctacaggca

SEQ ID NO: 7211930 - DNA, 22 bp, Homo sapiens
ctacaaagtaccacagactggg

SEQ ID NO: 7211931 - DNA, 21 bp, Homo sapiens
ttcctggggaaggagctgcct

SEQ ID NO: 7211932 - DNA, 23 bp, Homo sapiens
ctacaaagtatgagaagacccct

SEQ ID NO: 7211933 - DNA, 22 bp, Homo sapiens
ctacaaatataaaacacagata

SEQ ID NO: 7211934 - DNA, 21 bp, Homo sapiens
ttcctggggacttccgtggga

SEQ ID NO: 7211935 - DNA, 22 bp, Homo sapiens
ttccttccacttcaggattttg

SEQ ID NO: 7211936 - DNA, 22 bp, Homo sapiens
ttccttccacttcaggattttg

SEQ ID NO: 7211937 - DNA, 20 bp, Homo sapiens
ttcctggggaatgatagaag

SEQ ID NO: 7211938 - DNA, 22 bp, Homo sapiens
ttcctggggacttaccgtcatt

SEQ ID NO: 7211939 - DNA, 22 bp, Homo sapiens
ttcacagactttccatagattg

SEQ ID NO: 7211940 - DNA, 22 bp, Homo sapiens
ttcacagactgcagactttttg

SEQ ID NO: 7211941 - DNA, 22 bp, Homo sapiens
ttcacagaccaggaggctgtga

SEQ ID NO: 7211942 - DNA, 22 bp, Homo sapiens
ttcacagtggcttaggctatgg

SEQ ID NO: 7211943 - DNA, 22 bp, Homo sapiens
ttcacagtggtaagggttgtga

SEQ ID NO: 7211944 - DNA, 22 bp, Homo sapiens
ttcacagtggtagtgcatttag

SEQ ID NO: 7211945 - DNA, 22 bp, Homo sapiens
ttcacagtgtgatctatgggca

SEQ ID NO: 7211946 - DNA, 22 bp, Homo sapiens
ttcacagtgttgtgccttttgt

SEQ ID NO: 7211947 - DNA, 22 bp, Homo sapiens
ttcacagtgtttctcacggtta

SEQ ID NO: 7211948 - DNA, 22 bp, Homo sapiens
cctgggtggttccggcaaggag

SEQ ID NO: 7211949 - DNA, 22 bp, Homo sapiens
cctgggtggttccggcaaggag

SEQ ID NO: 7211950 - DNA, 22 bp, Homo sapiens
cctgggtgtcatgggcagctgg

SEQ ID NO: 7211951 - DNA, 22 bp, Homo sapiens
cctgggtgtcatgggcagctgg

SEQ ID NO: 7211952 - DNA, 22 bp, Homo sapiens
cctgggtgtcatgggcagctgg

SEQ ID NO: 7211953 - DNA, 22 bp, Homo sapiens
ttcacagacattgcagactgaa

SEQ ID NO: 7211954 - DNA, 22 bp, Homo sapiens
ttcacagaccaggaggctgtga

SEQ ID NO: 7211955 - DNA, 22 bp, Homo sapiens
cctgggtggcagaggttgcagt

SEQ ID NO: 7211956 - DNA, 22 bp, Homo sapiens
cctgggtggctgcctgcctttc

SEQ ID NO: 7211957 - DNA, 22 bp, Homo sapiens
cctgggtggctgcctgcctttc

SEQ ID NO: 7211958 - DNA, 21 bp, Homo sapiens
cctgggtgggacccctcttcc

SEQ ID NO: 7211959 - DNA, 22 bp, Homo sapiens
cctgggtggttccggcaaggag

SEQ ID NO: 7211960 - DNA, 22 bp, Homo sapiens
cctgggtggttccggcaaggag

SEQ ID NO: 7211961 - DNA, 22 bp, Homo sapiens
ttcacagttcctgggaaaacag

SEQ ID NO: 7211962 - DNA, 22 bp, Homo sapiens
ttcacagttgggcaggttgtgt

SEQ ID NO: 7211963 - DNA, 22 bp, Homo sapiens
ttcacagttgggcaggttgtgt

SEQ ID NO: 7211964 - DNA, 22 bp, Homo sapiens
ttcacagtttaatggcaaggat

SEQ ID NO: 7211965 - DNA, 22 bp, Homo sapiens
ttcacagtttgctgggacagga

SEQ ID NO: 7211966 - DNA, 22 bp, Homo sapiens
ttcacataaatagatcacatca

SEQ ID NO: 7211967 - DNA, 22 bp, Homo sapiens
ttcacataaatagatcacatca

SEQ ID NO: 7211968 - DNA, 22 bp, Homo sapiens
ttcacataaatagatcacatca

SEQ ID NO: 7211969 - DNA, 22 bp, Homo sapiens
ttcacataaatagatcacatca

SEQ ID NO: 7211970 - DNA, 22 bp, Homo sapiens
ttcacatataatgtctttaaaa

SEQ ID NO: 7211971 - DNA, 22 bp, Homo sapiens
ttcacatataatgtctttaaaa

SEQ ID NO: 7211972 - DNA, 22 bp, Homo sapiens
ttcacatctcagcactgcctct

SEQ ID NO: 7211973 - DNA, 22 bp, Homo sapiens
ttcacatgaaagtaggaaagga

SEQ ID NO: 7211974 - DNA, 22 bp, Homo sapiens
ttcacatgacagggtgaagcat

SEQ ID NO: 7211975 - DNA, 22 bp, Homo sapiens
cgctgggggaacagcgagggtg

SEQ ID NO: 7211976 - DNA, 22 bp, Homo sapiens
cgctgggggaacagcgagggtg

SEQ ID NO: 7211977 - DNA, 22 bp, Homo sapiens
cgctgggggaacagcgagggtg

SEQ ID NO: 7211978 - DNA, 22 bp, Homo sapiens
cgctgggggaacttcagccaat

SEQ ID NO: 7211979 - DNA, 22 bp, Homo sapiens
cgctggggctttttgcttgaga

SEQ ID NO: 7211980 - DNA, 22 bp, Homo sapiens
cgctgggggaacagcgagggtg

SEQ ID NO: 7211981 - DNA, 22 bp, Homo sapiens
cgctgggcgcgctccgaacccg

SEQ ID NO: 7211982 - DNA, 22 bp, Homo sapiens
cgctggggctttttgcttgaga

SEQ ID NO: 7211983 - DNA, 22 bp, Homo sapiens
cgctgggcatggtgccttattt

SEQ ID NO: 7211984 - DNA, 22 bp, Homo sapiens
cgctgggcgccgacctgctggc

SEQ ID NO: 7211985 - DNA, 22 bp, Homo sapiens
ttcacatggcaatagagaggga

SEQ ID NO: 7211986 - DNA, 22 bp, Homo sapiens
ttcacatgttggacatagagga

SEQ ID NO: 7211987 - DNA, 22 bp, Homo sapiens
ttcacattaagcctcctcctac

SEQ ID NO: 7211988 - DNA, 22 bp, Homo sapiens
ttcacattacaaggccatattt

SEQ ID NO: 7211989 - DNA, 22 bp, Homo sapiens
ttcacattacaaggccatattt

SEQ ID NO: 7211990 - DNA, 22 bp, Homo sapiens
cgctgggggaacttcagccaat

SEQ ID NO: 7211991 - DNA, 22 bp, Homo sapiens
cgctgggggaacttcagccaat

SEQ ID NO: 7211992 - DNA, 22 bp, Homo sapiens
cgctggtcaccatggcgtcctg

SEQ ID NO: 7211993 - DNA, 22 bp, Homo sapiens
cgctggtgaaggctaggctagc

SEQ ID NO: 7211994 - DNA, 22 bp, Homo sapiens
cgctgtgtgcagactgaaaatg

SEQ ID NO: 7211995 - DNA, 20 bp, Homo sapiens
cgctttcctcaaactctgtt

SEQ ID NO: 7211996 - DNA, 21 bp, Homo sapiens
cggaaactcggctctggttcc

SEQ ID NO: 7211997 - DNA, 21 bp, Homo sapiens
cggaaaggactagggctcaga

SEQ ID NO: 7211998 - DNA, 22 bp, Homo sapiens
cggaatgtcccaggtcctgatc

SEQ ID NO: 7211999 - DNA, 22 bp, Homo sapiens
cggaatgtcccaggtcctgatc

SEQ ID NO: 7212000 - DNA, 22 bp, Homo sapiens
cggaatgtccttcttaaggtgt

SEQ ID NO: 7212001 - DNA, 22 bp, Homo sapiens
cggaatgtccttcttaaggtgt

SEQ ID NO: 7212002 - DNA, 21 bp, Homo sapiens
cggacacctgtgatgtgcctg

SEQ ID NO: 7212003 - DNA, 22 bp, Homo sapiens
cggacaggctcctggagctcct

SEQ ID NO: 7212004 - DNA, 22 bp, Homo sapiens
cggacaggctcctggagctcct

SEQ ID NO: 7212005 - DNA, 22 bp, Homo sapiens
cggacaggctcctggagctcct

SEQ ID NO: 7212006 - DNA, 22 bp, Homo sapiens
cggacaggctcctggagctcct

SEQ ID NO: 7212007 - DNA, 22 bp, Homo sapiens
cggacaggctcctggagctcct

SEQ ID NO: 7212008 - DNA, 22 bp, Homo sapiens
cggcatccccacttcctcctgc

SEQ ID NO: 7212009 - DNA, 22 bp, Homo sapiens
cggcatgggcgtccccctcact

SEQ ID NO: 7212010 - DNA, 22 bp, Homo sapiens
cggcatccccacttcctcctgc

SEQ ID NO: 7212011 - DNA, 22 bp, Homo sapiens
cggcatccccacttcctcctgc

SEQ ID NO: 7212012 - DNA, 22 bp, Homo sapiens
cggctcaggccacaggacggca

SEQ ID NO: 7212013 - DNA, 22 bp, Homo sapiens
cggcatgggcgtccccctcact

SEQ ID NO: 7212014 - DNA, 22 bp, Homo sapiens
cggctcaggccacaggacggca

SEQ ID NO: 7212015 - DNA, 22 bp, Homo sapiens
cggctcaggccacaggacggca

SEQ ID NO: 7212016 - DNA, 21 bp, Homo sapiens
cggctcagtgcctgctccttc

SEQ ID NO: 7212017 - DNA, 22 bp, Homo sapiens
ttcagaaacatcagtggatgga

SEQ ID NO: 7212018 - DNA, 22 bp, Homo sapiens
ttcagaaacccattgggtctct

SEQ ID NO: 7212019 - DNA, 22 bp, Homo sapiens
ttcagaaacagagtgagtgagt

SEQ ID NO: 7212020 - DNA, 22 bp, Homo sapiens
ttcagaaaaagaccattgcaat

SEQ ID NO: 7212021 - DNA, 22 bp, Homo sapiens
ttcacttatttcttgagtagca

SEQ ID NO: 7212022 - DNA, 22 bp, Homo sapiens
ttcacttatagggatgttattg

SEQ ID NO: 7212023 - DNA, 22 bp, Homo sapiens
ttcacttatagggatgttattg

SEQ ID NO: 7212024 - DNA, 21 bp, Homo sapiens
ttcacttgaagatcttgcccc

SEQ ID NO: 7212025 - DNA, 22 bp, Homo sapiens
ttcagaaaaaacttcaataagt

SEQ ID NO: 7212026 - DNA, 22 bp, Homo sapiens
ttcacttatagggatgttattg

SEQ ID NO: 7212027 - DNA, 22 bp, Homo sapiens
ttcacttaaaggttttagcatc

SEQ ID NO: 7212028 - DNA, 22 bp, Homo sapiens
ttcacttaaaggttttagcatc

SEQ ID NO: 7212029 - DNA, 22 bp, Homo sapiens
ttcacttaacatcatatcatga

SEQ ID NO: 7212030 - DNA, 22 bp, Homo sapiens
ttcacttaacatcatatcatga

SEQ ID NO: 7212031 - DNA, 22 bp, Homo sapiens
ttcacttaacatcatatcatga

SEQ ID NO: 7212032 - DNA, 22 bp, Homo sapiens
cggctggggctgtccccatgac

SEQ ID NO: 7212033 - DNA, 22 bp, Homo sapiens
cggctgggtagaggtgccgggt

SEQ ID NO: 7212034 - DNA, 22 bp, Homo sapiens
cggctgggtagaggtgccgggt

SEQ ID NO: 7212035 - DNA, 22 bp, Homo sapiens
cggctgggtagaggtgccgggt

SEQ ID NO: 7212036 - DNA, 22 bp, Homo sapiens
cggctgggtagaggtgccgggt

SEQ ID NO: 7212037 - DNA, 22 bp, Homo sapiens
cggctgctgcctgagtcgctgt

SEQ ID NO: 7212038 - DNA, 22 bp, Homo sapiens
cggctgcttctgagccccggcg

SEQ ID NO: 7212039 - DNA, 22 bp, Homo sapiens
cggctgcttctgagccccggcg

SEQ ID NO: 7212040 - DNA, 22 bp, Homo sapiens
cggctggaagctggacaggccg

SEQ ID NO: 7212041 - DNA, 22 bp, Homo sapiens
cggctggggctgtccccatgac

SEQ ID NO: 7212042 - DNA, 22 bp, Homo sapiens
cggctggggctgtccccatgac

SEQ ID NO: 7212043 - DNA, 22 bp, Homo sapiens
cggctggggctgtccccatgac

SEQ ID NO: 7212044 - DNA, 23 bp, Homo sapiens
cggctgctcggccgagtcctcgg

SEQ ID NO: 7212045 - DNA, 22 bp, Homo sapiens
cggctgaggatctccaggcctg

SEQ ID NO: 7212046 - DNA, 22 bp, Homo sapiens
cggctgagcagtgctgatggaa

SEQ ID NO: 7212047 - DNA, 22 bp, Homo sapiens
cggctgagacggccatagacac

SEQ ID NO: 7212048 - DNA, 22 bp, Homo sapiens
cggctctgtcctcagcactgct

SEQ ID NO: 7212049 - DNA, 21 bp, Homo sapiens
cggctcagtgcctgctccttc

SEQ ID NO: 7212050 - DNA, 21 bp, Homo sapiens
cggctcagtgcctgctccttc

SEQ ID NO: 7212051 - DNA, 21 bp, Homo sapiens
cggctcagtgcctgctccttc

SEQ ID NO: 7212052 - DNA, 22 bp, Homo sapiens
cggctcctccgcccttgctcac

SEQ ID NO: 7212053 - DNA, 22 bp, Homo sapiens
cggctcctccgcccttgctcac

SEQ ID NO: 7212054 - DNA, 22 bp, Homo sapiens
ttcagaaaggttaatctggatt

SEQ ID NO: 7212055 - DNA, 20 bp, Homo sapiens
ttcattcattccacaacttc

SEQ ID NO: 7212056 - DNA, 22 bp, Homo sapiens
ttcattcccaagagtaaacata

SEQ ID NO: 7212057 - DNA, 22 bp, Homo sapiens
ttcattcccttatattagcatt

SEQ ID NO: 7212058 - DNA, 22 bp, Homo sapiens
ttcattcctgagcccatattta

SEQ ID NO: 7212059 - DNA, 22 bp, Homo sapiens
ttcattccttccctaagcaact

SEQ ID NO: 7212060 - DNA, 22 bp, Homo sapiens
ttcattccttctgtaccttgcc

SEQ ID NO: 7212061 - DNA, 22 bp, Homo sapiens
ttccaaaatgccttgatatgat

SEQ ID NO: 7212062 - DNA, 22 bp, Homo sapiens
ttcattcttgtctttgtatagt

SEQ ID NO: 7212063 - DNA, 22 bp, Homo sapiens
ttcattcttgggatcagagagt

SEQ ID NO: 7212064 - DNA, 22 bp, Homo sapiens
ttcattcttgggatcagagagt

SEQ ID NO: 7212065 - DNA, 22 bp, Homo sapiens
ttcattctgcagttctcagctc

SEQ ID NO: 7212066 - DNA, 22 bp, Homo sapiens
ttcattctgcagttctcagctc

SEQ ID NO: 7212067 - DNA, 22 bp, Homo sapiens
ttcattctgcagttctcagctc

SEQ ID NO: 7212068 - DNA, 22 bp, Homo sapiens
ttcattctcttagcatagtcct

SEQ ID NO: 7212069 - DNA, 19 bp, Homo sapiens
ttcattctcttattgttgt

SEQ ID NO: 7212070 - DNA, 19 bp, Homo sapiens
ttcattctcttattgttgt

SEQ ID NO: 7212071 - DNA, 19 bp, Homo sapiens
ttcattctcttattgttgt

SEQ ID NO: 7212072 - DNA, 22 bp, Homo sapiens
ctattcaattttgctattgtag

SEQ ID NO: 7212073 - DNA, 22 bp, Homo sapiens
ctattcaattttgctattgtag

SEQ ID NO: 7212074 - DNA, 22 bp, Homo sapiens
ctattcactgtggcagagggag

SEQ ID NO: 7212075 - DNA, 22 bp, Homo sapiens
ctatttattgtgggtatccagg

SEQ ID NO: 7212076 - DNA, 22 bp, Homo sapiens
ctatttatgtgctattttgtat

SEQ ID NO: 7212077 - DNA, 23 bp, Homo sapiens
ctagggcagtatttcacagacac

SEQ ID NO: 7212078 - DNA, 22 bp, Homo sapiens
ctagggccaaaggctgtgatgc

SEQ ID NO: 7212079 - DNA, 22 bp, Homo sapiens
ctagggccaaaggctgtgatgc

SEQ ID NO: 7212080 - DNA, 22 bp, Homo sapiens
ctagggagtggcagagctggga

SEQ ID NO: 7212081 - DNA, 22 bp, Homo sapiens
ctagggagtggcagagctggga

SEQ ID NO: 7212082 - DNA, 22 bp, Homo sapiens
ctagggagtggcagagctggga

SEQ ID NO: 7212083 - DNA, 22 bp, Homo sapiens
ctatttcattgtgctgagtctg

SEQ ID NO: 7212084 - DNA, 22 bp, Homo sapiens
ctatttcaaggcccagatatga

SEQ ID NO: 7212085 - DNA, 22 bp, Homo sapiens
ctatttcagcagaagccggaga

SEQ ID NO: 7212086 - DNA, 22 bp, Homo sapiens
ctatttcagctgcctttgactg

SEQ ID NO: 7212087 - DNA, 22 bp, Homo sapiens
ctatttgaaaccaagaatgccg

SEQ ID NO: 7212088 - DNA, 22 bp, Homo sapiens
ctatttgaagttgcagagatga

SEQ ID NO: 7212089 - DNA, 22 bp, Homo sapiens
ctatttgaattatgaagcactg

SEQ ID NO: 7212090 - DNA, 22 bp, Homo sapiens
ctatttgaattgtcacaggcta

SEQ ID NO: 7212091 - DNA, 22 bp, Homo sapiens
ctatttgagaacaatggctgaa

SEQ ID NO: 7212092 - DNA, 22 bp, Homo sapiens
ctatttgagaggtgaaggaatt

SEQ ID NO: 7212093 - DNA, 22 bp, Homo sapiens
ctattttaacttgattacctct

SEQ ID NO: 7212094 - DNA, 22 bp, Homo sapiens
ttctgtactctttgagaagaat

SEQ ID NO: 7212095 - DNA, 22 bp, Homo sapiens
ttctgtaggcatggaacaggga

SEQ ID NO: 7212096 - DNA, 22 bp, Homo sapiens
ctattttaacttgattacctct

SEQ ID NO: 7212097 - DNA, 22 bp, Homo sapiens
ctattttaacttgattacctct

SEQ ID NO: 7212098 - DNA, 22 bp, Homo sapiens
ctatttgtcacaactggtgttt

SEQ ID NO: 7212099 - DNA, 22 bp, Homo sapiens
ttctgtatattgtaaagactca

SEQ ID NO: 7212100 - DNA, 22 bp, Homo sapiens
ttctgtatctctgtgtttcttg

SEQ ID NO: 7212101 - DNA, 22 bp, Homo sapiens
ttctgtatcttcagtgcccagc

SEQ ID NO: 7212102 - DNA, 22 bp, Homo sapiens
ttctgtatctttcttcaagatt

SEQ ID NO: 7212103 - DNA, 22 bp, Homo sapiens
ttctgtatgtacatatgtgtat

SEQ ID NO: 7212104 - DNA, 22 bp, Homo sapiens
ttctgtcaaatgccagtagaga

SEQ ID NO: 7212105 - DNA, 22 bp, Homo sapiens
ttctgtcacttttttggaatct

SEQ ID NO: 7212106 - DNA, 22 bp, Homo sapiens
ttcttggagataaattcttaca

SEQ ID NO: 7212107 - DNA, 22 bp, Homo sapiens
ttcttggatgccctcatgcctt

SEQ ID NO: 7212108 - DNA, 22 bp, Homo sapiens
ttcttggagataaattcttaca

SEQ ID NO: 7212109 - DNA, 22 bp, Homo sapiens
ttcttcctcacactctcaccca

SEQ ID NO: 7212110 - DNA, 22 bp, Homo sapiens
ttcttggaaatacattcaataa

SEQ ID NO: 7212111 - DNA, 22 bp, Homo sapiens
ttctgtccactgctggggcctc

SEQ ID NO: 7212112 - DNA, 21 bp, Homo sapiens
ttcttcctaaatacagatctc

SEQ ID NO: 7212113 - DNA, 21 bp, Homo sapiens
ttcttcctaaatacagatctc

SEQ ID NO: 7212114 - DNA, 22 bp, Homo sapiens
ctagggagactcgcaggactca

SEQ ID NO: 7212115 - DNA, 22 bp, Homo sapiens
ctagggagactcgcaggactca

SEQ ID NO: 7212116 - DNA, 22 bp, Homo sapiens
ctagggagactcgcaggactca

SEQ ID NO: 7212117 - DNA, 22 bp, Homo sapiens
ctagggagcactagctgccttg

SEQ ID NO: 7212118 - DNA, 22 bp, Homo sapiens
ctagggagcactagctgccttg

SEQ ID NO: 7212119 - DNA, 22 bp, Homo sapiens
ctagggaagtctgtattttgtg

SEQ ID NO: 7212120 - DNA, 22 bp, Homo sapiens
ctaggctgttcatgctcagacc

SEQ ID NO: 7212121 - DNA, 22 bp, Homo sapiens
ctaggctgtgcattgcatgaca

SEQ ID NO: 7212122 - DNA, 22 bp, Homo sapiens
ctaggctgcagatgcatggaat

SEQ ID NO: 7212123 - DNA, 22 bp, Homo sapiens
ctaggccacagggcaaaaagga

SEQ ID NO: 7212124 - DNA, 22 bp, Homo sapiens
ctaggccagagagacctcatga

SEQ ID NO: 7212125 - DNA, 22 bp, Homo sapiens
ctaggccagttaggaagagaag

SEQ ID NO: 7212126 - DNA, 23 bp, Homo sapiens
ctaggcaggattgtaggcgggta

SEQ ID NO: 7212127 - DNA, 22 bp, Homo sapiens
ctaggcagctttgggtgtgaag

SEQ ID NO: 7212128 - DNA, 23 bp, Homo sapiens
ctaggcaggattgtaggcgggta

SEQ ID NO: 7212129 - DNA, 22 bp, Homo sapiens
ctaggcagctttgggtgtgaag

SEQ ID NO: 7212130 - DNA, 22 bp, Homo sapiens
ctaggcagctttgggtgtgaag

SEQ ID NO: 7212131 - DNA, 22 bp, Homo sapiens
ctaggctcttctggaaggttgt

SEQ ID NO: 7212132 - DNA, 22 bp, Homo sapiens
ctaggctctgccagcactgtcg

SEQ ID NO: 7212133 - DNA, 22 bp, Homo sapiens
ctaggccagttaggaagagaag

SEQ ID NO: 7212134 - DNA, 22 bp, Homo sapiens
ctaggccatattttgagaactg

SEQ ID NO: 7212135 - DNA, 22 bp, Homo sapiens
ctaggcccatgaggtttgctgg

SEQ ID NO: 7212136 - DNA, 22 bp, Homo sapiens
ctaggccttcataggcatggaa

SEQ ID NO: 7212137 - DNA, 22 bp, Homo sapiens
ttccttctaattttacacctga

SEQ ID NO: 7212138 - DNA, 22 bp, Homo sapiens
ttccttctaatattctgcctgt

SEQ ID NO: 7212139 - DNA, 22 bp, Homo sapiens
ttcctttcacgttttaatgcac

SEQ ID NO: 7212140 - DNA, 22 bp, Homo sapiens
ttcctttcacgttttaatgcac

SEQ ID NO: 7212141 - DNA, 22 bp, Homo sapiens
ttccttctaattttacacctga

SEQ ID NO: 7212142 - DNA, 22 bp, Homo sapiens
ttcctttccctcacagcctcgg

SEQ ID NO: 7212143 - DNA, 22 bp, Homo sapiens
ttcctttcccttgcttctgtgc

SEQ ID NO: 7212144 - DNA, 22 bp, Homo sapiens
ttcctttctctggactgcagcc

SEQ ID NO: 7212145 - DNA, 22 bp, Homo sapiens
ttcctttctctggactgcagcc

SEQ ID NO: 7212146 - DNA, 22 bp, Homo sapiens
ttcctttgggaaatcactaagg

SEQ ID NO: 7212147 - DNA, 22 bp, Homo sapiens
ttcctttgggttaagacatctg

SEQ ID NO: 7212148 - DNA, 22 bp, Homo sapiens
ttcctttctctggactgcagcc

SEQ ID NO: 7212149 - DNA, 22 bp, Homo sapiens
ttcctttccctcacagcctcgg

SEQ ID NO: 7212150 - DNA, 22 bp, Homo sapiens
ttcctttctgtcagcctgagtg

SEQ ID NO: 7212151 - DNA, 22 bp, Homo sapiens
ttcctttctgtcagcctgagtg

SEQ ID NO: 7212152 - DNA, 22 bp, Homo sapiens
ttccttttagaatcatgaagac

SEQ ID NO: 7212153 - DNA, 22 bp, Homo sapiens
ttccttttatttgtccaggctt

SEQ ID NO: 7212154 - DNA, 22 bp, Homo sapiens
ctaggcagactgagctctaggg

SEQ ID NO: 7212155 - DNA, 22 bp, Homo sapiens
ctaggcagatggagaagtggct

SEQ ID NO: 7212156 - DNA, 20 bp, Homo sapiens
ctaggcagcgagtgactgag

SEQ ID NO: 7212157 - DNA, 22 bp, Homo sapiens
ctagcccactgcaaatgttggc

SEQ ID NO: 7212158 - DNA, 22 bp, Homo sapiens
ctagcccactgcaaatgttggc

SEQ ID NO: 7212159 - DNA, 22 bp, Homo sapiens
ctagcccaggaatgccgtggcc

SEQ ID NO: 7212160 - DNA, 22 bp, Homo sapiens
ctagcccaggaatgccgtggcc

SEQ ID NO: 7212161 - DNA, 22 bp, Homo sapiens
ctagcccaggaatgccgtggcc

SEQ ID NO: 7212162 - DNA, 22 bp, Homo sapiens
ctagcccagttcttctcattag

SEQ ID NO: 7212163 - DNA, 22 bp, Homo sapiens
ttccttttgcaaggtcctctag

SEQ ID NO: 7212164 - DNA, 22 bp, Homo sapiens
ttccttttcttctaccacatgt

SEQ ID NO: 7212165 - DNA, 22 bp, Homo sapiens
ttccttttcttatgcatcatta

SEQ ID NO: 7212166 - DNA, 22 bp, Homo sapiens
ttccttttcttatgcatcatta

SEQ ID NO: 7212167 - DNA, 22 bp, Homo sapiens
ttccttttctcacggggatcca

SEQ ID NO: 7212168 - DNA, 22 bp, Homo sapiens
ttccttttcttaaacatatgtg

SEQ ID NO: 7212169 - DNA, 22 bp, Homo sapiens
ttccttttcttaaacatatgtg

SEQ ID NO: 7212170 - DNA, 22 bp, Homo sapiens
ttgaccttggcttttaaaatat

SEQ ID NO: 7212171 - DNA, 22 bp, Homo sapiens
ttgacctttgtttttacagagt

SEQ ID NO: 7212172 - DNA, 19 bp, Homo sapiens
ttgacgttgtggaattaac

SEQ ID NO: 7212173 - DNA, 22 bp, Homo sapiens
ttgactctaaatttacttttcc

SEQ ID NO: 7212174 - DNA, 22 bp, Homo sapiens
ttgactctggaggtcactgaag

SEQ ID NO: 7212175 - DNA, 22 bp, Homo sapiens
ttgacccagttgtaaaagagct

SEQ ID NO: 7212176 - DNA, 22 bp, Homo sapiens
ctcagcagtatactctgaagat

SEQ ID NO: 7212177 - DNA, 22 bp, Homo sapiens
ctcagcagtatactctgaagat

SEQ ID NO: 7212178 - DNA, 22 bp, Homo sapiens
ttgacccagctttccccacaat

SEQ ID NO: 7212179 - DNA, 22 bp, Homo sapiens
ttgactgttgctgccattctgg

SEQ ID NO: 7212180 - DNA, 22 bp, Homo sapiens
ttgacttcagaatgttgatggt

SEQ ID NO: 7212181 - DNA, 22 bp, Homo sapiens
ttgacttgaagctgtggaaaaa

SEQ ID NO: 7212182 - DNA, 22 bp, Homo sapiens
ttgactttacagttttcttagg

SEQ ID NO: 7212183 - DNA, 22 bp, Homo sapiens
ttgagctgtaaggtgggatgtg

SEQ ID NO: 7212184 - DNA, 22 bp, Homo sapiens
ttgagctgtaaggtgggatgtg

SEQ ID NO: 7212185 - DNA, 22 bp, Homo sapiens
ttgagcttgaggagttatttga

SEQ ID NO: 7212186 - DNA, 22 bp, Homo sapiens
ttgagctttgaagttcaatatt

SEQ ID NO: 7212187 - DNA, 20 bp, Homo sapiens
ttgagcttttagtacagaca

SEQ ID NO: 7212188 - DNA, 20 bp, Homo sapiens
ttgagcttttagtacagaca

SEQ ID NO: 7212189 - DNA, 22 bp, Homo sapiens
ttgagaaacatctaatctttgt

SEQ ID NO: 7212190 - DNA, 22 bp, Homo sapiens
ttgagaaacctggcagtagaga

SEQ ID NO: 7212191 - DNA, 22 bp, Homo sapiens
ttgagaaacctggcagtagaga

SEQ ID NO: 7212192 - DNA, 22 bp, Homo sapiens
ttgagctcccgcttcttctttg

SEQ ID NO: 7212193 - DNA, 22 bp, Homo sapiens
ttgagctctgatgcttttcaga

SEQ ID NO: 7212194 - DNA, 22 bp, Homo sapiens
ttgagctgcctggctgtggctc

SEQ ID NO: 7212195 - DNA, 22 bp, Homo sapiens
ttgagaaaacacagagtttatt

SEQ ID NO: 7212196 - DNA, 22 bp, Homo sapiens
ttgagaaaacacagagtttatt

SEQ ID NO: 7212197 - DNA, 22 bp, Homo sapiens
ttgagaaaacattgagggccat

SEQ ID NO: 7212198 - DNA, 22 bp, Homo sapiens
ttgagaaaacattgagggccat

SEQ ID NO: 7212199 - DNA, 22 bp, Homo sapiens
ttgagaaaaccatcgtaagaat

SEQ ID NO: 7212200 - DNA, 22 bp, Homo sapiens
ttgagaaaatagttcgaatgtt

SEQ ID NO: 7212201 - DNA, 22 bp, Homo sapiens
ttgagaaacagattggcaccgt

SEQ ID NO: 7212202 - DNA, 22 bp, Homo sapiens
ttgagaaacatctaatctttgt

SEQ ID NO: 7212203 - DNA, 22 bp, Homo sapiens
ttgagaaaagctgtgtaaggat

SEQ ID NO: 7212204 - DNA, 22 bp, Homo sapiens
ttgagaaaagctgtgtaaggat

SEQ ID NO: 7212205 - DNA, 22 bp, Homo sapiens
ttgagaaaagctgtgtaaggat

SEQ ID NO: 7212206 - DNA, 22 bp, Homo sapiens
ttgagaaaatagttcgaatgtt

SEQ ID NO: 7212207 - DNA, 23 bp, Homo sapiens
ttgatacagaagaatcagtttgt

SEQ ID NO: 7212208 - DNA, 22 bp, Homo sapiens
ttgatacacaatggaacaatgt

SEQ ID NO: 7212209 - DNA, 22 bp, Homo sapiens
ttgataaaatgatgaaatcact

SEQ ID NO: 7212210 - DNA, 18 bp, Homo sapiens
ttgataaacaatttcatt

SEQ ID NO: 7212211 - DNA, 18 bp, Homo sapiens
ttgataaacaatttcatt

SEQ ID NO: 7212212 - DNA, 18 bp, Homo sapiens
ttgataaacaatttcatt

SEQ ID NO: 7212213 - DNA, 18 bp, Homo sapiens
ttgataaacaatttcatt

SEQ ID NO: 7212214 - DNA, 18 bp, Homo sapiens
ttgataaacaatttcatt

SEQ ID NO: 7212215 - DNA, 22 bp, Homo sapiens
ttgatacacaatggaacaatgt

SEQ ID NO: 7212216 - DNA, 22 bp, Homo sapiens
ttgataaaatgatgaaatcact

SEQ ID NO: 7212217 - DNA, 22 bp, Homo sapiens
ttgataaaatgatgaaatcact

SEQ ID NO: 7212218 - DNA, 22 bp, Homo sapiens
ttgataaaatgatatcttcttt

SEQ ID NO: 7212219 - DNA, 22 bp, Homo sapiens
ttgataaaatgatatcttcttt

SEQ ID NO: 7212220 - DNA, 22 bp, Homo sapiens
ttgataaaatgatatcttcttt

SEQ ID NO: 7212221 - DNA, 22 bp, Homo sapiens
ttgataaaatgatgaaatcact

SEQ ID NO: 7212222 - DNA, 21 bp, Homo sapiens
ttgaggagtgagagtgggttt

SEQ ID NO: 7212223 - DNA, 21 bp, Homo sapiens
ttgaggagtgagagtgggttt

SEQ ID NO: 7212224 - DNA, 23 bp, Homo sapiens
ttgaggagtgctttttctatcca

SEQ ID NO: 7212225 - DNA, 22 bp, Homo sapiens
ttgaggagtggcgctggactta

SEQ ID NO: 7212226 - DNA, 22 bp, Homo sapiens
ttgaggagtgtgaggtctccca

SEQ ID NO: 7212227 - DNA, 22 bp, Homo sapiens
ttgagttctggtcttttaaaag

SEQ ID NO: 7212228 - DNA, 22 bp, Homo sapiens
ttgataaaatgatatcttcttt

SEQ ID NO: 7212229 - DNA, 22 bp, Homo sapiens
ttgaggaggtagtacagagtat

SEQ ID NO: 7212230 - DNA, 22 bp, Homo sapiens
ttgaggaggaaaagggggtacc

SEQ ID NO: 7212231 - DNA, 22 bp, Homo sapiens
ttgaggaggaactgtgaggcaa

SEQ ID NO: 7212232 - DNA, 22 bp, Homo sapiens
ttgaggagtacaaagcatgctt

SEQ ID NO: 7212233 - DNA, 22 bp, Homo sapiens
ttgaggagcaggatgggaggct

SEQ ID NO: 7212234 - DNA, 22 bp, Homo sapiens
ttgaggagaagactttgcttcc

SEQ ID NO: 7212235 - DNA, 20 bp, Homo sapiens
ttgagcttttagtacagaca

SEQ ID NO: 7212236 - DNA, 22 bp, Homo sapiens
ttgaggaaagagtgcaaagagg

SEQ ID NO: 7212237 - DNA, 22 bp, Homo sapiens
ttgaggaaagagtgcaaagagg

SEQ ID NO: 7212238 - DNA, 22 bp, Homo sapiens
ttgaggaaaggaatttatttta

SEQ ID NO: 7212239 - DNA, 22 bp, Homo sapiens
ttcttgggtgtgaccagtctga

SEQ ID NO: 7212240 - DNA, 22 bp, Homo sapiens
ttcttgggtgtgaccagtctga

SEQ ID NO: 7212241 - DNA, 22 bp, Homo sapiens
ttcttgtaatttggagaaatga

SEQ ID NO: 7212242 - DNA, 22 bp, Homo sapiens
ttcttgggaatttttccaacac

SEQ ID NO: 7212243 - DNA, 22 bp, Homo sapiens
ttcttgggctccaccccagact

SEQ ID NO: 7212244 - DNA, 22 bp, Homo sapiens
ttcttggggttccacaatggga

SEQ ID NO: 7212245 - DNA, 22 bp, Homo sapiens
ttcttgggtcctgtcgttgccc

SEQ ID NO: 7212246 - DNA, 22 bp, Homo sapiens
ttcttgtctttgttatgtagga

SEQ ID NO: 7212247 - DNA, 22 bp, Homo sapiens
ttcttgttctcctcatttagag

SEQ ID NO: 7212248 - DNA, 22 bp, Homo sapiens
ttcttgttctggttctgttagc

SEQ ID NO: 7212249 - DNA, 22 bp, Homo sapiens
ttcttgttctggttctgttagc

SEQ ID NO: 7212250 - DNA, 22 bp, Homo sapiens
ttcttgttctggttctgttagc

SEQ ID NO: 7212251 - DNA, 22 bp, Homo sapiens
ttcttgttggcctcaggtttgc

SEQ ID NO: 7212252 - DNA, 22 bp, Homo sapiens
ttcttgtttattaagatataaa

SEQ ID NO: 7212253 - DNA, 22 bp, Homo sapiens
ttcttgtttattaagatataaa

SEQ ID NO: 7212254 - DNA, 22 bp, Homo sapiens
ttctttaaaatagtgagaaaga

SEQ ID NO: 7212255 - DNA, 22 bp, Homo sapiens
ttcttgttttgcccaagttgta

SEQ ID NO: 7212256 - DNA, 22 bp, Homo sapiens
ctattttaacttgattacctct

SEQ ID NO: 7212257 - DNA, 22 bp, Homo sapiens
ctattttaacttgattacctct

SEQ ID NO: 7212258 - DNA, 22 bp, Homo sapiens
ctattttaagaggccattaggt

SEQ ID NO: 7212259 - DNA, 22 bp, Homo sapiens
ctattttaagaggccattaggt

SEQ ID NO: 7212260 - DNA, 22 bp, Homo sapiens
ctattttaagaggccattaggt

SEQ ID NO: 7212261 - DNA, 22 bp, Homo sapiens
ctattttaagaggccattaggt

SEQ ID NO: 7212262 - DNA, 22 bp, Homo sapiens
ctattttctgtctctatagagt

SEQ ID NO: 7212263 - DNA, 22 bp, Homo sapiens
ctattttccgcagcaggaagta

SEQ ID NO: 7212264 - DNA, 22 bp, Homo sapiens
ctattttctgtctctatagagt

SEQ ID NO: 7212265 - DNA, 22 bp, Homo sapiens
ctattttgcctgcctagaaatc

SEQ ID NO: 7212266 - DNA, 22 bp, Homo sapiens
ctcagaggggatgcttggagaa

SEQ ID NO: 7212267 - DNA, 22 bp, Homo sapiens
ctcagcaccccgacaggacatt

SEQ ID NO: 7212268 - DNA, 22 bp, Homo sapiens
ctcagaggggatgcaatcttgc

SEQ ID NO: 7212269 - DNA, 22 bp, Homo sapiens
ctcagaggggatgcttggagaa

SEQ ID NO: 7212270 - DNA, 22 bp, Homo sapiens
ctcagcactgacccaggagatg

SEQ ID NO: 7212271 - DNA, 22 bp, Homo sapiens
ctcagcactgacccaggagatg

SEQ ID NO: 7212272 - DNA, 22 bp, Homo sapiens
ctcagcactttggaaggctgat

SEQ ID NO: 7212273 - DNA, 22 bp, Homo sapiens
ctcagcactttggaaggctgat

SEQ ID NO: 7212274 - DNA, 19 bp, Homo sapiens
ctcagcacttttacacagg

SEQ ID NO: 7212275 - DNA, 19 bp, Homo sapiens
ctcagcacttttacacagg

SEQ ID NO: 7212276 - DNA, 17 bp, Homo sapiens
ctattttggagattaaa

SEQ ID NO: 7212277 - DNA, 17 bp, Homo sapiens
ctattttggagattaaa

SEQ ID NO: 7212278 - DNA, 22 bp, Homo sapiens
ctattttgtccttagtgcaggg

SEQ ID NO: 7212279 - DNA, 22 bp, Homo sapiens
ctatttttctgtaccctaattt

SEQ ID NO: 7212280 - DNA, 22 bp, Homo sapiens
ctatttttctgtaccctaattt

SEQ ID NO: 7212281 - DNA, 22 bp, Homo sapiens
ctatttttctgtaccctaattt

SEQ ID NO: 7212282 - DNA, 22 bp, Homo sapiens
ctatttttctgtaccctaattt

SEQ ID NO: 7212283 - DNA, 22 bp, Homo sapiens
ctatttttctgtaccctaattt

SEQ ID NO: 7212284 - DNA, 22 bp, Homo sapiens
ctcagagggaggactgggctgg

SEQ ID NO: 7212285 - DNA, 22 bp, Homo sapiens
ctcagagggaggactgggctgg

SEQ ID NO: 7212286 - DNA, 22 bp, Homo sapiens
ctcagcagaggcagtattcagt

SEQ ID NO: 7212287 - DNA, 22 bp, Homo sapiens
ctcagcagaggcagtattcagt

SEQ ID NO: 7212288 - DNA, 20 bp, Homo sapiens
ctcagcagattcttctagaa

SEQ ID NO: 7212289 - DNA, 20 bp, Homo sapiens
ctcagcagattcttctagaa

SEQ ID NO: 7212290 - DNA, 22 bp, Homo sapiens
ctcagcagctgctgctggtggg

SEQ ID NO: 7212291 - DNA, 22 bp, Homo sapiens
ctcagcagctgctgctggtggg

SEQ ID NO: 7212292 - DNA, 22 bp, Homo sapiens
ctcagcagctgctgctggtggg

SEQ ID NO: 7212293 - DNA, 22 bp, Homo sapiens
ctcagcagctgctgctggtggg

SEQ ID NO: 7212294 - DNA, 22 bp, Homo sapiens
ctcagcaggcactgtgccttac

SEQ ID NO: 7212295 - DNA, 22 bp, Homo sapiens
ctcagcaggcactgtgccttac

SEQ ID NO: 7212296 - DNA, 17 bp, Homo sapiens
ctcagcagggctcactt

SEQ ID NO: 7212297 - DNA, 17 bp, Homo sapiens
ctcagcagggctcactt

SEQ ID NO: 7212298 - DNA, 17 bp, Homo sapiens
ctcagcagggctcactt

SEQ ID NO: 7212299 - DNA, 22 bp, Homo sapiens
ctcagcaggtaccacatgatct

SEQ ID NO: 7212300 - DNA, 22 bp, Homo sapiens
ctcagcaggtaccacatgatct

SEQ ID NO: 7212301 - DNA, 23 bp, Homo sapiens
ctcagcaggtcaggccccttcct

SEQ ID NO: 7212302 - DNA, 22 bp, Homo sapiens
ctcagcaggtcttgggtagggg

SEQ ID NO: 7212303 - DNA, 22 bp, Homo sapiens
ctcagcaggtcttgggtagggg

SEQ ID NO: 7212304 - DNA, 20 bp, Homo sapiens
ttggatcttatgggaggggg

SEQ ID NO: 7212305 - DNA, 22 bp, Homo sapiens
ttggaaaaacacgatagtggtt

SEQ ID NO: 7212306 - DNA, 22 bp, Homo sapiens
ttggaaaaacacgatagtggtt

SEQ ID NO: 7212307 - DNA, 22 bp, Homo sapiens
ttgctttttaattaggaggcag

SEQ ID NO: 7212308 - DNA, 22 bp, Homo sapiens
ttggaaaaattgcctgatgtct

SEQ ID NO: 7212309 - DNA, 22 bp, Homo sapiens
ttggaaaacttacacagagctg

SEQ ID NO: 7212310 - DNA, 22 bp, Homo sapiens
ttggaaaacttacacagagctg

SEQ ID NO: 7212311 - DNA, 22 bp, Homo sapiens
ttggaaaacttacacagagctg

SEQ ID NO: 7212312 - DNA, 22 bp, Homo sapiens
ttggaaaagcgttctctgtagc

SEQ ID NO: 7212313 - DNA, 20 bp, Homo sapiens
ttggatctaaaatgtgggga

SEQ ID NO: 7212314 - DNA, 22 bp, Homo sapiens
ttggatctgtactctaggggat

SEQ ID NO: 7212315 - DNA, 22 bp, Homo sapiens
ttggatctcatctaagtgcgtg

SEQ ID NO: 7212316 - DNA, 22 bp, Homo sapiens
ttggatcttatgaaggtggcat

SEQ ID NO: 7212317 - DNA, 22 bp, Homo sapiens
ttgcttttaattaatcattgct

SEQ ID NO: 7212318 - DNA, 22 bp, Homo sapiens
ttgcttttgggaaaacatgcct

SEQ ID NO: 7212319 - DNA, 22 bp, Homo sapiens
ttgcttttgtctcgggtttgga

SEQ ID NO: 7212320 - DNA, 22 bp, Homo sapiens
ttgctttgtggtggttcttcca

SEQ ID NO: 7212321 - DNA, 22 bp, Homo sapiens
ttgctttgtggtggttcttcca

SEQ ID NO: 7212322 - DNA, 22 bp, Homo sapiens
ttgctttgccaccagaagtcta

SEQ ID NO: 7212323 - DNA, 22 bp, Homo sapiens
ttgcttttaatctttgtacatc

SEQ ID NO: 7212324 - DNA, 22 bp, Homo sapiens
ttgcttttaatctttgtacatc

SEQ ID NO: 7212325 - DNA, 22 bp, Homo sapiens
ttgcttttaatctttgtacatc

SEQ ID NO: 7212326 - DNA, 22 bp, Homo sapiens
ttgcttttaatctttgtacatc

SEQ ID NO: 7212327 - DNA, 22 bp, Homo sapiens
ctcagtgctttggatcctggat

SEQ ID NO: 7212328 - DNA, 22 bp, Homo sapiens
ttgatattctgagaagctgaag

SEQ ID NO: 7212329 - DNA, 22 bp, Homo sapiens
ctcagttgttagtattttgcct

SEQ ID NO: 7212330 - DNA, 22 bp, Homo sapiens
ctcagtttcctcaactgcaaaa

SEQ ID NO: 7212331 - DNA, 22 bp, Homo sapiens
ttgatacaggctctatttcatc

SEQ ID NO: 7212332 - DNA, 22 bp, Homo sapiens
ttgatacatagcacagtttagg

SEQ ID NO: 7212333 - DNA, 22 bp, Homo sapiens
ttgatacatgctctagagttga

SEQ ID NO: 7212334 - DNA, 22 bp, Homo sapiens
ttgatacccaagtgttatgggt

SEQ ID NO: 7212335 - DNA, 22 bp, Homo sapiens
ttgatacatttttaggataaac

SEQ ID NO: 7212336 - DNA, 22 bp, Homo sapiens
ttgatactattaagcactgggc

SEQ ID NO: 7212337 - DNA, 22 bp, Homo sapiens
ttgatatgttaggaagactgat

SEQ ID NO: 7212338 - DNA, 22 bp, Homo sapiens
ttgatatgttaggaagactgat

SEQ ID NO: 7212339 - DNA, 22 bp, Homo sapiens
ttgatattagagtatttgtttg

SEQ ID NO: 7212340 - DNA, 22 bp, Homo sapiens
ttgatattagagtatttgtttg

SEQ ID NO: 7212341 - DNA, 22 bp, Homo sapiens
ttgatattagagtatttgtttg

SEQ ID NO: 7212342 - DNA, 22 bp, Homo sapiens
ttgatattagagtatttgtttg

SEQ ID NO: 7212343 - DNA, 22 bp, Homo sapiens
ttgatattcccgatttaaggta

SEQ ID NO: 7212344 - DNA, 22 bp, Homo sapiens
ttgatattcccgatttaaggta

SEQ ID NO: 7212345 - DNA, 22 bp, Homo sapiens
ttgatattctgagaagctgaag

SEQ ID NO: 7212346 - DNA, 22 bp, Homo sapiens
ctcagtttcttactctgtataa

SEQ ID NO: 7212347 - DNA, 22 bp, Homo sapiens
ttgggataagacagggacaggg

SEQ ID NO: 7212348 - DNA, 22 bp, Homo sapiens
ttgggatacatcttgctgagcc

SEQ ID NO: 7212349 - DNA, 22 bp, Homo sapiens
ttgggatctacatagctatgta

SEQ ID NO: 7212350 - DNA, 22 bp, Homo sapiens
ttgggatctcaaatccagctat

SEQ ID NO: 7212351 - DNA, 22 bp, Homo sapiens
ttgggatctcaaatccagctat

SEQ ID NO: 7212352 - DNA, 21 bp, Homo sapiens
ttgggatctgagaagtgaaaa

SEQ ID NO: 7212353 - DNA, 21 bp, Homo sapiens
ttgggatctgagaagtgaaaa

SEQ ID NO: 7212354 - DNA, 22 bp, Homo sapiens
ttgggcaaagtgtttctggagc

SEQ ID NO: 7212355 - DNA, 22 bp, Homo sapiens
ttgggaggtcataaatctgttc

SEQ ID NO: 7212356 - DNA, 22 bp, Homo sapiens
ttgggaggtcataaatctgttc

SEQ ID NO: 7212357 - DNA, 22 bp, Homo sapiens
ctcatctgactgtaaggtaatg

SEQ ID NO: 7212358 - DNA, 22 bp, Homo sapiens
ctcatctgataaatcactctta

SEQ ID NO: 7212359 - DNA, 20 bp, Homo sapiens
ctcatctctgagcctcctgg

SEQ ID NO: 7212360 - DNA, 22 bp, Homo sapiens
ctcatctgataaatcactctta

SEQ ID NO: 7212361 - DNA, 22 bp, Homo sapiens
ctcatctgctcttattatctta

SEQ ID NO: 7212362 - DNA, 20 bp, Homo sapiens
ctcatctctgagcctcctgg

SEQ ID NO: 7212363 - DNA, 22 bp, Homo sapiens
ctcatctcccacctgcgtgcag

SEQ ID NO: 7212364 - DNA, 22 bp, Homo sapiens
ctcatctcccacctgcgtgcag

SEQ ID NO: 7212365 - DNA, 22 bp, Homo sapiens
ctcatccaccgcagcccctcag

SEQ ID NO: 7212366 - DNA, 22 bp, Homo sapiens
ctcatccacgtgcttttctagt

SEQ ID NO: 7212367 - DNA, 22 bp, Homo sapiens
ctcatccagtcaagcttttaga

SEQ ID NO: 7212368 - DNA, 22 bp, Homo sapiens
ctcatccatgaccgtgtttccc

SEQ ID NO: 7212369 - DNA, 22 bp, Homo sapiens
ttgggcacactttgctggggag

SEQ ID NO: 7212370 - DNA, 22 bp, Homo sapiens
ttgggcaccagtgcactgacag

SEQ ID NO: 7212371 - DNA, 22 bp, Homo sapiens
ttgggcaccagtgcactgacag

SEQ ID NO: 7212372 - DNA, 22 bp, Homo sapiens
ttgggcacggacaggtggggat

SEQ ID NO: 7212373 - DNA, 22 bp, Homo sapiens
ttgggcagaggccaggaggatg

SEQ ID NO: 7212374 - DNA, 22 bp, Homo sapiens
ttgggcagaggccaggaggatg

SEQ ID NO: 7212375 - DNA, 22 bp, Homo sapiens
ttgggcagaggccaggaggatg

SEQ ID NO: 7212376 - DNA, 22 bp, Homo sapiens
ttgggcagaggccaggaggatg

SEQ ID NO: 7212377 - DNA, 22 bp, Homo sapiens
ttgggcactgtgggttgtctgt

SEQ ID NO: 7212378 - DNA, 22 bp, Homo sapiens
ttgggcagaggccaggaggatg

SEQ ID NO: 7212379 - DNA, 22 bp, Homo sapiens
ttgggcagaggctgtgcagagg

SEQ ID NO: 7212380 - DNA, 22 bp, Homo sapiens
ttgggcagaggctgtgcagagg

SEQ ID NO: 7212381 - DNA, 22 bp, Homo sapiens
ttgggcagaggctgtgcagagg

SEQ ID NO: 7212382 - DNA, 22 bp, Homo sapiens
ttgggcagaggctgtgcagagg

SEQ ID NO: 7212383 - DNA, 22 bp, Homo sapiens
ttgggcagatgtttcctgtgga

SEQ ID NO: 7212384 - DNA, 22 bp, Homo sapiens
ttgggcagatgtttcctgtgga

SEQ ID NO: 7212385 - DNA, 22 bp, Homo sapiens
ttgggcagggaaaggacaggca

SEQ ID NO: 7212386 - DNA, 22 bp, Homo sapiens
ttgggcagggaaaggacaggca

SEQ ID NO: 7212387 - DNA, 22 bp, Homo sapiens
ttgggcaggctggcagactgct

SEQ ID NO: 7212388 - DNA, 22 bp, Homo sapiens
ttgggcagggaaaggacaggca

SEQ ID NO: 7212389 - DNA, 22 bp, Homo sapiens
ttgggcaggctggcagactgct

SEQ ID NO: 7212390 - DNA, 22 bp, Homo sapiens
ttgggcaggctggcagactgct

SEQ ID NO: 7212391 - DNA, 22 bp, Homo sapiens
ttgggcaggctggcagactgct

SEQ ID NO: 7212392 - DNA, 22 bp, Homo sapiens
ttgggcaggcacatagagttta

SEQ ID NO: 7212393 - DNA, 22 bp, Homo sapiens
ttgggcaggatgacaccacttg

SEQ ID NO: 7212394 - DNA, 22 bp, Homo sapiens
ttgggcaggcacatagagttta

SEQ ID NO: 7212395 - DNA, 23 bp, Homo sapiens
ttgggcaggagagtaatgtgatc

SEQ ID NO: 7212396 - DNA, 23 bp, Homo sapiens
ttgggcaggagagtaatgtgatc

SEQ ID NO: 7212397 - DNA, 22 bp, Homo sapiens
ttgggcaggaacagatgcttga

SEQ ID NO: 7212398 - DNA, 23 bp, Homo sapiens
ttgggcaggagagtaatgtgatc

SEQ ID NO: 7212399 - DNA, 23 bp, Homo sapiens
ttgggcaggagagtaatgtgatc

SEQ ID NO: 7212400 - DNA, 22 bp, Homo sapiens
ttgggcaggaacagatgcttga

SEQ ID NO: 7212401 - DNA, 22 bp, Homo sapiens
ttgggcaggaacagatgcttga

SEQ ID NO: 7212402 - DNA, 22 bp, Homo sapiens
ttgggcagatgtttcctgtgga

SEQ ID NO: 7212403 - DNA, 22 bp, Homo sapiens
ttgggcagcattgcagttccct

SEQ ID NO: 7212404 - DNA, 22 bp, Homo sapiens
ttgggcagcattgcagttccct

SEQ ID NO: 7212405 - DNA, 22 bp, Homo sapiens
ttgggcagcattgcagttccct

SEQ ID NO: 7212406 - DNA, 22 bp, Homo sapiens
ctcataatgtgactgtatttga

SEQ ID NO: 7212407 - DNA, 22 bp, Homo sapiens
ctcataatgtgactgtatttga

SEQ ID NO: 7212408 - DNA, 22 bp, Homo sapiens
ctcatatatttctgcattcaat

SEQ ID NO: 7212409 - DNA, 22 bp, Homo sapiens
ctcatcataaccctgtgaggat

SEQ ID NO: 7212410 - DNA, 22 bp, Homo sapiens
ctcatccaccctcactaggaaa

SEQ ID NO: 7212411 - DNA, 22 bp, Homo sapiens
ctcataaagtgagaatatgacc

SEQ ID NO: 7212412 - DNA, 22 bp, Homo sapiens
ctcataatgtgactgtatttga

SEQ ID NO: 7212413 - DNA, 22 bp, Homo sapiens
ctcataatgtgactgtatttga

SEQ ID NO: 7212414 - DNA, 22 bp, Homo sapiens
ctcataaaagctttgtttacac

SEQ ID NO: 7212415 - DNA, 22 bp, Homo sapiens
ctcataaacattattcattatt

SEQ ID NO: 7212416 - DNA, 22 bp, Homo sapiens
ttggccaaaggaaagactactg

SEQ ID NO: 7212417 - DNA, 22 bp, Homo sapiens
ttggccaaggaagtagcaacgg

SEQ ID NO: 7212418 - DNA, 22 bp, Homo sapiens
ttggccaagtcactggttaatg

SEQ ID NO: 7212419 - DNA, 22 bp, Homo sapiens
ttggccaagtggttaatctcca

SEQ ID NO: 7212420 - DNA, 22 bp, Homo sapiens
ttggccacaatccaagccttgg

SEQ ID NO: 7212421 - DNA, 22 bp, Homo sapiens
ttggccagacactacccccctt

SEQ ID NO: 7212422 - DNA, 22 bp, Homo sapiens
ttggccagactgaggtgctggg

SEQ ID NO: 7212423 - DNA, 22 bp, Homo sapiens
ttggccacaatccaagccttgg

SEQ ID NO: 7212424 - DNA, 22 bp, Homo sapiens
ttggccagagaccagagcaggg

SEQ ID NO: 7212425 - DNA, 22 bp, Homo sapiens
ttggccagaggtttctctcatg

SEQ ID NO: 7212426 - DNA, 22 bp, Homo sapiens
ctccagggaggagcacgggttc

SEQ ID NO: 7212427 - DNA, 22 bp, Homo sapiens
ctccaggcgccgcttttgcagt

SEQ ID NO: 7212428 - DNA, 22 bp, Homo sapiens
ctccaggcgcttaccaagcgct

SEQ ID NO: 7212429 - DNA, 22 bp, Homo sapiens
ctccaggcgcttaccaagcgct

SEQ ID NO: 7212430 - DNA, 22 bp, Homo sapiens
ctccaggcgcttaccaagcgct

SEQ ID NO: 7212431 - DNA, 22 bp, Homo sapiens
ttggtagaagaatatgagtatt

SEQ ID NO: 7212432 - DNA, 22 bp, Homo sapiens
ttggtagaagaatatgagtatt

SEQ ID NO: 7212433 - DNA, 22 bp, Homo sapiens
ttggtaggggactagagtccag

SEQ ID NO: 7212434 - DNA, 22 bp, Homo sapiens
ttggtatattgtgctactttat

SEQ ID NO: 7212435 - DNA, 22 bp, Homo sapiens
ttggtatattgtgctactttat

SEQ ID NO: 7212436 - DNA, 22 bp, Homo sapiens
ttggtattttacaatgtcagtg

SEQ ID NO: 7212437 - DNA, 22 bp, Homo sapiens
ttggtcaaggacattacagttt

SEQ ID NO: 7212438 - DNA, 22 bp, Homo sapiens
ttggtcaagtcttaaagaaaaa

SEQ ID NO: 7212439 - DNA, 22 bp, Homo sapiens
ctccaggcgccgcttttgcagt

SEQ ID NO: 7212440 - DNA, 22 bp, Homo sapiens
ttgggtaggattcagcagtgtg

SEQ ID NO: 7212441 - DNA, 22 bp, Homo sapiens
ttgggtcctaaccccagagtct

SEQ ID NO: 7212442 - DNA, 22 bp, Homo sapiens
ttgggtctacgtagaaagaaca

SEQ ID NO: 7212443 - DNA, 22 bp, Homo sapiens
ttgggtctgtttagctgagaag

SEQ ID NO: 7212444 - DNA, 22 bp, Homo sapiens
ttgggtgggtcaggactcggag

SEQ ID NO: 7212445 - DNA, 22 bp, Homo sapiens
ttgggtgggtcaggactcggag

SEQ ID NO: 7212446 - DNA, 22 bp, Homo sapiens
ttgggtgggtcaggactcggag

SEQ ID NO: 7212447 - DNA, 22 bp, Homo sapiens
ttgggtggtggggagagttcag

SEQ ID NO: 7212448 - DNA, 22 bp, Homo sapiens
ttgggtgttgtgtcaaggaagg

SEQ ID NO: 7212449 - DNA, 22 bp, Homo sapiens
ttggtaaacttgacagagaatc

SEQ ID NO: 7212450 - DNA, 22 bp, Homo sapiens
ttggtaaatactataatcaaat

SEQ ID NO: 7212451 - DNA, 22 bp, Homo sapiens
ttggtaaatccccttacacaaa

SEQ ID NO: 7212452 - DNA, 22 bp, Homo sapiens
ttggtaaattatttcttccaat

SEQ ID NO: 7212453 - DNA, 20 bp, Homo sapiens
ttggtaaggatgaagagcaa

SEQ ID NO: 7212454 - DNA, 22 bp, Homo sapiens
ttggtacatgttaaggaagagt

SEQ ID NO: 7212455 - DNA, 22 bp, Homo sapiens
ctccagggaggtctgcaggact

SEQ ID NO: 7212456 - DNA, 22 bp, Homo sapiens
ctccagggaggtctgcaggact

SEQ ID NO: 7212457 - DNA, 22 bp, Homo sapiens
ctccagggaggtctgcaggact

SEQ ID NO: 7212458 - DNA, 22 bp, Homo sapiens
ctccagggatgagacagagtag

SEQ ID NO: 7212459 - DNA, 22 bp, Homo sapiens
ctccagggcagcatggcagtgg

SEQ ID NO: 7212460 - DNA, 22 bp, Homo sapiens
ctccagggctaccaggttttag

SEQ ID NO: 7212461 - DNA, 22 bp, Homo sapiens
ctccaggggccagaagcctggc

SEQ ID NO: 7212462 - DNA, 22 bp, Homo sapiens
ctccagggggcatccacacagc

SEQ ID NO: 7212463 - DNA, 22 bp, Homo sapiens
ttgtatttgattgtcatatcgt

SEQ ID NO: 7212464 - DNA, 22 bp, Homo sapiens
ttgtatttgattgtcatatcgt

SEQ ID NO: 7212465 - DNA, 22 bp, Homo sapiens
ttgtatttctccactttctgtt

SEQ ID NO: 7212466 - DNA, 22 bp, Homo sapiens
ttgtatttctccactttctgtt

SEQ ID NO: 7212467 - DNA, 22 bp, Homo sapiens
ttgtatttctccactttctgtt

SEQ ID NO: 7212468 - DNA, 22 bp, Homo sapiens
ttgtatttcttccggtctcatt

SEQ ID NO: 7212469 - DNA, 22 bp, Homo sapiens
ttgtatttcttccggtctcatt

SEQ ID NO: 7212470 - DNA, 22 bp, Homo sapiens
ttgtatttctccactttctgtt

SEQ ID NO: 7212471 - DNA, 22 bp, Homo sapiens
ttgtatttctccactttctgtt

SEQ ID NO: 7212472 - DNA, 22 bp, Homo sapiens
ttgtatttctccactttctgtt

SEQ ID NO: 7212473 - DNA, 22 bp, Homo sapiens
ttgtattttgttatgctactgc

SEQ ID NO: 7212474 - DNA, 22 bp, Homo sapiens
ttgtatttgggtagtatagaga

SEQ ID NO: 7212475 - DNA, 22 bp, Homo sapiens
ttgtatttgggtagtatagaga

SEQ ID NO: 7212476 - DNA, 22 bp, Homo sapiens
ttgtatttgggtagtatagaga

SEQ ID NO: 7212477 - DNA, 22 bp, Homo sapiens
ttgtatttgggtagtatagaga

SEQ ID NO: 7212478 - DNA, 22 bp, Homo sapiens
ttgtatttgattgtcatatcgt

SEQ ID NO: 7212479 - DNA, 22 bp, Homo sapiens
ttgtatttgattgtcatatcgt

SEQ ID NO: 7212480 - DNA, 22 bp, Homo sapiens
ttgtatttgggtagtatagaga

SEQ ID NO: 7212481 - DNA, 22 bp, Homo sapiens
ttgttaaaatgcatattctggt

SEQ ID NO: 7212482 - DNA, 22 bp, Homo sapiens
ttgttaaaatgcatattctggt

SEQ ID NO: 7212483 - DNA, 22 bp, Homo sapiens
ttgttaaagatgcagattccat

SEQ ID NO: 7212484 - DNA, 22 bp, Homo sapiens
ttgttaaaatattggagaaagg

SEQ ID NO: 7212485 - DNA, 22 bp, Homo sapiens
ttgttaaaatgaggtcattctg

SEQ ID NO: 7212486 - DNA, 22 bp, Homo sapiens
ttgttaaaactccattggtttg

SEQ ID NO: 7212487 - DNA, 22 bp, Homo sapiens
ttgtgtaccttgggtacttgct

SEQ ID NO: 7212488 - DNA, 22 bp, Homo sapiens
ttgtattttgttatgctactgc

SEQ ID NO: 7212489 - DNA, 22 bp, Homo sapiens
ttgtgtacaggtgtttccaagt

SEQ ID NO: 7212490 - DNA, 22 bp, Homo sapiens
ttgtattttgttatgctactgc

SEQ ID NO: 7212491 - DNA, 22 bp, Homo sapiens
ttgttaagttcatggaggtcaa

SEQ ID NO: 7212492 - DNA, 23 bp, Homo sapiens
ttgttaactttcctgcccctaca

SEQ ID NO: 7212493 - DNA, 22 bp, Homo sapiens
ttgttaagggttatgcagcttt

SEQ ID NO: 7212494 - DNA, 22 bp, Homo sapiens
ttgttaaatggatgcagaataa

SEQ ID NO: 7212495 - DNA, 22 bp, Homo sapiens
ttgttaaatggatgcagaataa

SEQ ID NO: 7212496 - DNA, 22 bp, Homo sapiens
ttgttaaaggcaaaacaagcac

SEQ ID NO: 7212497 - DNA, 22 bp, Homo sapiens
ttgttaaaggcaaaacaagcac

SEQ ID NO: 7212498 - DNA, 22 bp, Homo sapiens
ttgttaaaggcaaaacaagcac

SEQ ID NO: 7212499 - DNA, 22 bp, Homo sapiens
ttgttacagcagcaatagaaaa

SEQ ID NO: 7212500 - DNA, 22 bp, Homo sapiens
ctccaggtagctaagtcctggg

SEQ ID NO: 7212501 - DNA, 22 bp, Homo sapiens
ctccaggtagctaagtcctggg

SEQ ID NO: 7212502 - DNA, 22 bp, Homo sapiens
ttgttacagcacttaacctttt

SEQ ID NO: 7212503 - DNA, 22 bp, Homo sapiens
ctccaggtgcagaaggactcag

SEQ ID NO: 7212504 - DNA, 22 bp, Homo sapiens
ctccaggtattactgttttccc

SEQ ID NO: 7212505 - DNA, 22 bp, Homo sapiens
ctccaggttacttagcctagct

SEQ ID NO: 7212506 - DNA, 22 bp, Homo sapiens
ctccaggttacttagcctagct

SEQ ID NO: 7212507 - DNA, 22 bp, Homo sapiens
ctccaggttacttagcctagct

SEQ ID NO: 7212508 - DNA, 22 bp, Homo sapiens
ctccagtatctgtaggaaaagg

SEQ ID NO: 7212509 - DNA, 22 bp, Homo sapiens
ctccagtcatagcctcttgagt

SEQ ID NO: 7212510 - DNA, 22 bp, Homo sapiens
ctccagtcatagcctcttgagt

SEQ ID NO: 7212511 - DNA, 22 bp, Homo sapiens
ctccagtcatagcctcttgagt

SEQ ID NO: 7212512 - DNA, 22 bp, Homo sapiens
ctccagtcatagtctgtcttgt

SEQ ID NO: 7212513 - DNA, 22 bp, Homo sapiens
ctccagtcatgtttactgtgca

SEQ ID NO: 7212514 - DNA, 22 bp, Homo sapiens
ctccagtcatgtttactgtgca

SEQ ID NO: 7212515 - DNA, 22 bp, Homo sapiens
ctccagtcctagtctcttgctt

SEQ ID NO: 7212516 - DNA, 22 bp, Homo sapiens
ctccagtctaggtcctacttat

SEQ ID NO: 7212517 - DNA, 22 bp, Homo sapiens
ctccagtctaggtcctacttat

SEQ ID NO: 7212518 - DNA, 22 bp, Homo sapiens
ctccagtctaggtcctacttat

SEQ ID NO: 7212519 - DNA, 22 bp, Homo sapiens
ctccagtctagtagagcctgct

SEQ ID NO: 7212520 - DNA, 22 bp, Homo sapiens
ctccagtctagtagagcctgct

SEQ ID NO: 7212521 - DNA, 22 bp, Homo sapiens
ctccagtctagtagagcctgct

SEQ ID NO: 7212522 - DNA, 22 bp, Homo sapiens
ctccagtctctttcggagacac

SEQ ID NO: 7212523 - DNA, 22 bp, Homo sapiens
ctccagtctctttcggagacac

SEQ ID NO: 7212524 - DNA, 22 bp, Homo sapiens
ctccagtctttcagatgtccct

SEQ ID NO: 7212525 - DNA, 22 bp, Homo sapiens
ctccagtgcgcaggacagcccc

SEQ ID NO: 7212526 - DNA, 22 bp, Homo sapiens
ttgtttcagctgtatgctatgt

SEQ ID NO: 7212527 - DNA, 22 bp, Homo sapiens
ttgtttcagctgtatgctatgt

SEQ ID NO: 7212528 - DNA, 22 bp, Homo sapiens
ttgtttcagctgtatgctatgt

SEQ ID NO: 7212529 - DNA, 22 bp, Homo sapiens
ttgtttcaggatggtttgttac

SEQ ID NO: 7212530 - DNA, 22 bp, Homo sapiens
ctccagtgcacccagaggattt

SEQ ID NO: 7212531 - DNA, 22 bp, Homo sapiens
ctccagtgcactggtcttttca

SEQ ID NO: 7212532 - DNA, 22 bp, Homo sapiens
tttaaaaaactagtctgagtct

SEQ ID NO: 7212533 - DNA, 22 bp, Homo sapiens
tttaaaaaactagtctgagtct

SEQ ID NO: 7212534 - DNA, 22 bp, Homo sapiens
ttgtttcatggggatgtttatt

SEQ ID NO: 7212535 - DNA, 22 bp, Homo sapiens
ttgtttcatggggatgtttatt

SEQ ID NO: 7212536 - DNA, 22 bp, Homo sapiens
ttgtttcaggatggtttgttac

SEQ ID NO: 7212537 - DNA, 22 bp, Homo sapiens
ttgtttcatgagtgtaaaggga

SEQ ID NO: 7212538 - DNA, 22 bp, Homo sapiens
ttgtttcatggggatgtttatt

SEQ ID NO: 7212539 - DNA, 22 bp, Homo sapiens
ttgtttcatggggatgtttatt

SEQ ID NO: 7212540 - DNA, 22 bp, Homo sapiens
tttaaaaaactagtctgagtct

SEQ ID NO: 7212541 - DNA, 22 bp, Homo sapiens
ctctccctatgcctcccaggag

SEQ ID NO: 7212542 - DNA, 22 bp, Homo sapiens
ctctccctatgcctcccaggag

SEQ ID NO: 7212543 - DNA, 22 bp, Homo sapiens
ctctccctatgcctcccaggag

SEQ ID NO: 7212544 - DNA, 22 bp, Homo sapiens
ctctccctaggttagcggtcag

SEQ ID NO: 7212545 - DNA, 22 bp, Homo sapiens
ctctccctggccagctgtgcag

SEQ ID NO: 7212546 - DNA, 22 bp, Homo sapiens
ctctccctggccagctgtgcag

SEQ ID NO: 7212547 - DNA, 22 bp, Homo sapiens
ctctccctatgcctcccaggag

SEQ ID NO: 7212548 - DNA, 22 bp, Homo sapiens
ctctccctaggttagcggtcag

SEQ ID NO: 7212549 - DNA, 22 bp, Homo sapiens
ctctccctaggttagcggtcag

SEQ ID NO: 7212550 - DNA, 22 bp, Homo sapiens
ctctccccggtacgagcggccg

SEQ ID NO: 7212551 - DNA, 22 bp, Homo sapiens
ctctccccggtacgagcggccg

SEQ ID NO: 7212552 - DNA, 22 bp, Homo sapiens
ctctcccccacagcagccttct

SEQ ID NO: 7212553 - DNA, 22 bp, Homo sapiens
ctctcccccacagcagccttct

SEQ ID NO: 7212554 - DNA, 23 bp, Homo sapiens
ctctccccctttgatgttagctc

SEQ ID NO: 7212555 - DNA, 22 bp, Homo sapiens
ctctcctccaggaactcacagt

SEQ ID NO: 7212556 - DNA, 22 bp, Homo sapiens
ctctcctccaggaactcacagt

SEQ ID NO: 7212557 - DNA, 22 bp, Homo sapiens
ctctcctccaggaactcacagt

SEQ ID NO: 7212558 - DNA, 22 bp, Homo sapiens
ctctcctccaggaactcacagt

SEQ ID NO: 7212559 - DNA, 22 bp, Homo sapiens
ctctcctccaggaactcacagt

SEQ ID NO: 7212560 - DNA, 22 bp, Homo sapiens
ctctcctccaggaactcacagt

SEQ ID NO: 7212561 - DNA, 22 bp, Homo sapiens
ctctcctccaggaactcacagt

SEQ ID NO: 7212562 - DNA, 22 bp, Homo sapiens
ctctcctcccatgtaggagatg

SEQ ID NO: 7212563 - DNA, 22 bp, Homo sapiens
ctctcctcagaacaggccctct

SEQ ID NO: 7212564 - DNA, 22 bp, Homo sapiens
ctctcctccaacagccctgccg

SEQ ID NO: 7212565 - DNA, 22 bp, Homo sapiens
ctctcctccaacagccctgccg

SEQ ID NO: 7212566 - DNA, 22 bp, Homo sapiens
ctctcctcagaacaggccctct

SEQ ID NO: 7212567 - DNA, 22 bp, Homo sapiens
ctctcctccaacagccctgccg

SEQ ID NO: 7212568 - DNA, 22 bp, Homo sapiens
ctctcctccaacagccctgccg

SEQ ID NO: 7212569 - DNA, 20 bp, Homo sapiens
ctctcctcacccgtgtcagg

SEQ ID NO: 7212570 - DNA, 22 bp, Homo sapiens
ctctcctcagaacaggccctct

SEQ ID NO: 7212571 - DNA, 22 bp, Homo sapiens
ctctcctacatttcattcacaa

SEQ ID NO: 7212572 - DNA, 22 bp, Homo sapiens
ctctcctattgtgtggtaagga

SEQ ID NO: 7212573 - DNA, 20 bp, Homo sapiens
ctctcctcacccgtgtcagg

SEQ ID NO: 7212574 - DNA, 20 bp, Homo sapiens
ctctcctcacccgtgtcagg

SEQ ID NO: 7212575 - DNA, 22 bp, Homo sapiens
ctctcctacatttcattcacaa

SEQ ID NO: 7212576 - DNA, 22 bp, Homo sapiens
ctctcccttgggtgggctttgg

SEQ ID NO: 7212577 - DNA, 22 bp, Homo sapiens
ctctccctggccagctgtgcag

SEQ ID NO: 7212578 - DNA, 22 bp, Homo sapiens
ctctccctggccagctgtgcag

SEQ ID NO: 7212579 - DNA, 22 bp, Homo sapiens
ctctccaggactttggcccaat

SEQ ID NO: 7212580 - DNA, 22 bp, Homo sapiens
ctctccaggactttggcccaat

SEQ ID NO: 7212581 - DNA, 22 bp, Homo sapiens
ctctccaggactttggcccaat

SEQ ID NO: 7212582 - DNA, 19 bp, Homo sapiens
ctctccagctccagtagct

SEQ ID NO: 7212583 - DNA, 19 bp, Homo sapiens
ctctccagctccagtagct

SEQ ID NO: 7212584 - DNA, 19 bp, Homo sapiens
ctctccagctccagtagct

SEQ ID NO: 7212585 - DNA, 22 bp, Homo sapiens
ctctccaggactttggcccaat

SEQ ID NO: 7212586 - DNA, 22 bp, Homo sapiens
ctctccaggactttggcccaat

SEQ ID NO: 7212587 - DNA, 22 bp, Homo sapiens
ctctccaggagagcactttgag

SEQ ID NO: 7212588 - DNA, 22 bp, Homo sapiens
ctctccaggagagcactttgag

SEQ ID NO: 7212589 - DNA, 22 bp, Homo sapiens
tttcagttcagtttattatatc

SEQ ID NO: 7212590 - DNA, 22 bp, Homo sapiens
tttcagttcatctgtgaagatt

SEQ ID NO: 7212591 - DNA, 22 bp, Homo sapiens
tttcagttactgctatatcatt

SEQ ID NO: 7212592 - DNA, 22 bp, Homo sapiens
tttcagtgttatgactttcatt

SEQ ID NO: 7212593 - DNA, 21 bp, Homo sapiens
ctctccagtggttcctgattc

SEQ ID NO: 7212594 - DNA, 22 bp, Homo sapiens
tttcagtttagactaaaggtag

SEQ ID NO: 7212595 - DNA, 22 bp, Homo sapiens
ctctccagttacctaggtctga

SEQ ID NO: 7212596 - DNA, 22 bp, Homo sapiens
tttcagttgttttagctctgtg

SEQ ID NO: 7212597 - DNA, 22 bp, Homo sapiens
tttcagttgttttagctctgtg

SEQ ID NO: 7212598 - DNA, 20 bp, Homo sapiens
tttcagttggttaatggcat

SEQ ID NO: 7212599 - DNA, 22 bp, Homo sapiens
tttcagttctgtacaagtccag

SEQ ID NO: 7212600 - DNA, 23 bp, Homo sapiens
tttcagttccagaaaaggggagc

SEQ ID NO: 7212601 - DNA, 22 bp, Homo sapiens
ctctccagaatatgccgccgtg

SEQ ID NO: 7212602 - DNA, 22 bp, Homo sapiens
ctctccactcagcgtcatgtcc

SEQ ID NO: 7212603 - DNA, 22 bp, Homo sapiens
ctctccactgtcctttgctggt

SEQ ID NO: 7212604 - DNA, 22 bp, Homo sapiens
ctctccagaattattactatta

SEQ ID NO: 7212605 - DNA, 22 bp, Homo sapiens
ctctccagaattattactatta

SEQ ID NO: 7212606 - DNA, 22 bp, Homo sapiens
ctctccagaattattactatta

SEQ ID NO: 7212607 - DNA, 22 bp, Homo sapiens
ctctccagaattattactatta

SEQ ID NO: 7212608 - DNA, 19 bp, Homo sapiens
ctctcactcgccacatcct

SEQ ID NO: 7212609 - DNA, 22 bp, Homo sapiens
ctcctgggctgtcggcgctctg

SEQ ID NO: 7212610 - DNA, 22 bp, Homo sapiens
ctctcagaagtagcacgtgggc

SEQ ID NO: 7212611 - DNA, 22 bp, Homo sapiens
ctcctgggctgtcggcgctctg

SEQ ID NO: 7212612 - DNA, 22 bp, Homo sapiens
ctcctgggctgtcggcgctctg

SEQ ID NO: 7212613 - DNA, 18 bp, Homo sapiens
ctcctgggctgcagatgc

SEQ ID NO: 7212614 - DNA, 18 bp, Homo sapiens
ctcctgggctgcagatgc

SEQ ID NO: 7212615 - DNA, 18 bp, Homo sapiens
ctcctgggctgcagatgc

SEQ ID NO: 7212616 - DNA, 18 bp, Homo sapiens
ctcctgggctgcagatgc

SEQ ID NO: 7212617 - DNA, 22 bp, Homo sapiens
ctcctgggctgggaactcagcc

SEQ ID NO: 7212618 - DNA, 22 bp, Homo sapiens
ctctccagcctttagcccacgc

SEQ ID NO: 7212619 - DNA, 19 bp, Homo sapiens
ctctccagctccagtagct

SEQ ID NO: 7212620 - DNA, 19 bp, Homo sapiens
ctctccagctccagtagct

SEQ ID NO: 7212621 - DNA, 22 bp, Homo sapiens
ctctccagccaggggcttcctg

SEQ ID NO: 7212622 - DNA, 22 bp, Homo sapiens
ctctccagccaggggcttcctg

SEQ ID NO: 7212623 - DNA, 22 bp, Homo sapiens
ctctccagccaggggcttcctg

SEQ ID NO: 7212624 - DNA, 22 bp, Homo sapiens
ctctccagatctgctgagccag

SEQ ID NO: 7212625 - DNA, 22 bp, Homo sapiens
ctctccagatctgctgagccag

SEQ ID NO: 7212626 - DNA, 22 bp, Homo sapiens
ctctccagatctgctgagccag

SEQ ID NO: 7212627 - DNA, 22 bp, Homo sapiens
ctctccagcagatgtagtctgt

SEQ ID NO: 7212628 - DNA, 22 bp, Homo sapiens
ctctccagcagatgtagtctgt

SEQ ID NO: 7212629 - DNA, 22 bp, Homo sapiens
ctctccagcagatgtagtctgt

SEQ ID NO: 7212630 - DNA, 22 bp, Homo sapiens
ctctccagccacagaagctgct

SEQ ID NO: 7212631 - DNA, 22 bp, Homo sapiens
ctctccagatctgctgagccag

SEQ ID NO: 7212632 - DNA, 22 bp, Homo sapiens
ctctccagatctgctgagccag

SEQ ID NO: 7212633 - DNA, 22 bp, Homo sapiens
ctctccagatctgctgagccag

SEQ ID NO: 7212634 - DNA, 22 bp, Homo sapiens
ctcctgggctcatatcattcag

SEQ ID NO: 7212635 - DNA, 18 bp, Homo sapiens
ctcctgggctgcagatgc

SEQ ID NO: 7212636 - DNA, 22 bp, Homo sapiens
ctcctgggctcaagtgatcctc

SEQ ID NO: 7212637 - DNA, 22 bp, Homo sapiens
ctcctgggctcaagtgatcctc

SEQ ID NO: 7212638 - DNA, 22 bp, Homo sapiens
ctcctgggctcaagtgatcctc

SEQ ID NO: 7212639 - DNA, 22 bp, Homo sapiens
ctcctgggctatgtctgcttgg

SEQ ID NO: 7212640 - DNA, 22 bp, Homo sapiens
ctcctgggctatgtctgcttgg

SEQ ID NO: 7212641 - DNA, 22 bp, Homo sapiens
ctcctgggctatgtctgcttgg

SEQ ID NO: 7212642 - DNA, 22 bp, Homo sapiens
ctcctgggctatgtctgcttgg

SEQ ID NO: 7212643 - DNA, 21 bp, Homo sapiens
ctcctgggctaagatatagtg

SEQ ID NO: 7212644 - DNA, 22 bp, Homo sapiens
ctcctgggatgactctttcttt

SEQ ID NO: 7212645 - DNA, 22 bp, Homo sapiens
ctcctgggatgactctttcttt

SEQ ID NO: 7212646 - DNA, 22 bp, Homo sapiens
ctcctgggagtcttcctggatg

SEQ ID NO: 7212647 - DNA, 22 bp, Homo sapiens
ctcctgggagtcttcctggatg

SEQ ID NO: 7212648 - DNA, 22 bp, Homo sapiens
ctcctgggagtcttcctggatg

SEQ ID NO: 7212649 - DNA, 22 bp, Homo sapiens
ctcctgggagtcttcctggatg

SEQ ID NO: 7212650 - DNA, 22 bp, Homo sapiens
ctcctgggagctgtggcagagc

SEQ ID NO: 7212651 - DNA, 22 bp, Homo sapiens
ctcctgggagctgtggcagagc

SEQ ID NO: 7212652 - DNA, 22 bp, Homo sapiens
ctcctgggaggatgcggacccg

SEQ ID NO: 7212653 - DNA, 22 bp, Homo sapiens
ctcctgggagcagggatggatg

SEQ ID NO: 7212654 - DNA, 22 bp, Homo sapiens
ctcctgggagctgtggcagagc

SEQ ID NO: 7212655 - DNA, 22 bp, Homo sapiens
ctcctgggagctgtggcagagc

SEQ ID NO: 7212656 - DNA, 22 bp, Homo sapiens
ctcctgggagcagggatggatg

SEQ ID NO: 7212657 - DNA, 22 bp, Homo sapiens
ctcctgggagcagggatggatg

SEQ ID NO: 7212658 - DNA, 22 bp, Homo sapiens
ctcctgggagcagggatggatg

SEQ ID NO: 7212659 - DNA, 22 bp, Homo sapiens
ctcctgagaaataagcaagtaa

SEQ ID NO: 7212660 - DNA, 22 bp, Homo sapiens
ctcctgacacagtccacacttg

SEQ ID NO: 7212661 - DNA, 22 bp, Homo sapiens
ctcctgacttgtgagcccctcc

SEQ ID NO: 7212662 - DNA, 22 bp, Homo sapiens
ctcctctttagccccagctgga

SEQ ID NO: 7212663 - DNA, 22 bp, Homo sapiens
ctcctctttagccccagctgga

SEQ ID NO: 7212664 - DNA, 22 bp, Homo sapiens
ctcctctttagccccagctgga

SEQ ID NO: 7212665 - DNA, 22 bp, Homo sapiens
ctcctctttagccccagctgga

SEQ ID NO: 7212666 - DNA, 22 bp, Homo sapiens
ctcctggctatgactacatttc

SEQ ID NO: 7212667 - DNA, 22 bp, Homo sapiens
ctcctggctcgcccccagctga

SEQ ID NO: 7212668 - DNA, 22 bp, Homo sapiens
ctcctggctcgcccccagctga

SEQ ID NO: 7212669 - DNA, 22 bp, Homo sapiens
ctcctggctcgcccccagctga

SEQ ID NO: 7212670 - DNA, 22 bp, Homo sapiens
ctcctgagaattttcagttgga

SEQ ID NO: 7212671 - DNA, 22 bp, Homo sapiens
ctcctgagaattttcagttgga

SEQ ID NO: 7212672 - DNA, 22 bp, Homo sapiens
ctcctgagaggatctctgttgt

SEQ ID NO: 7212673 - DNA, 22 bp, Homo sapiens
ctcctgagaggatctctgttgt

SEQ ID NO: 7212674 - DNA, 22 bp, Homo sapiens
ctcctgagaggatctctgttgt

SEQ ID NO: 7212675 - DNA, 22 bp, Homo sapiens
ctcctgagctctgaggaagctt

SEQ ID NO: 7212676 - DNA, 22 bp, Homo sapiens
ctcctgagctctgaggaagctt

SEQ ID NO: 7212677 - DNA, 22 bp, Homo sapiens
ctcctctgtctggccctgagcc

SEQ ID NO: 7212678 - DNA, 22 bp, Homo sapiens
ctcctctgtctggccctgagcc

SEQ ID NO: 7212679 - DNA, 22 bp, Homo sapiens
ctcctctgtctggccctgagcc

SEQ ID NO: 7212680 - DNA, 22 bp, Homo sapiens
ctcctctgtctggccctgagcc

SEQ ID NO: 7212681 - DNA, 22 bp, Homo sapiens
ctcctctgtctggccctgagcc

SEQ ID NO: 7212682 - DNA, 22 bp, Homo sapiens
ctcctctgtctggccctgagcc

SEQ ID NO: 7212683 - DNA, 22 bp, Homo sapiens
ctcctctgtctaccacgagggt

SEQ ID NO: 7212684 - DNA, 22 bp, Homo sapiens
ctcctctgtctaccacgagggt

SEQ ID NO: 7212685 - DNA, 22 bp, Homo sapiens
ctcctctgtctaccacgagggt

SEQ ID NO: 7212686 - DNA, 22 bp, Homo sapiens
ctcctctgtattgattgggact

SEQ ID NO: 7212687 - DNA, 22 bp, Homo sapiens
ctcctctgggtcctggtggcca

SEQ ID NO: 7212688 - DNA, 22 bp, Homo sapiens
ctcctctgggtcctggtggcca

SEQ ID NO: 7212689 - DNA, 22 bp, Homo sapiens
tttagacacactttgtatattt

SEQ ID NO: 7212690 - DNA, 22 bp, Homo sapiens
tttagacaagatccttctgaat

SEQ ID NO: 7212691 - DNA, 17 bp, Homo sapiens
tttagaatacaatgttt

SEQ ID NO: 7212692 - DNA, 22 bp, Homo sapiens
tttagacagcatctggtgactt

SEQ ID NO: 7212693 - DNA, 22 bp, Homo sapiens
tttagacactagggatgcagtg

SEQ ID NO: 7212694 - DNA, 22 bp, Homo sapiens
tttagacagatgtgaggtgggt

SEQ ID NO: 7212695 - DNA, 22 bp, Homo sapiens
tttagacagcggctctgaacca

SEQ ID NO: 7212696 - DNA, 22 bp, Homo sapiens
tttagacagcggctctgaacca

SEQ ID NO: 7212697 - DNA, 22 bp, Homo sapiens
tttagacagcggctctgaacca

SEQ ID NO: 7212698 - DNA, 22 bp, Homo sapiens
tttagacaggggcaaaataagg

SEQ ID NO: 7212699 - DNA, 22 bp, Homo sapiens
tttagacatctataattgctaa

SEQ ID NO: 7212700 - DNA, 22 bp, Homo sapiens
tttagacatagctgaaatcatt

SEQ ID NO: 7212701 - DNA, 22 bp, Homo sapiens
tttagacatagctgaaatcatt

SEQ ID NO: 7212702 - DNA, 22 bp, Homo sapiens
tttagacatagctgaaatcatt

SEQ ID NO: 7212703 - DNA, 22 bp, Homo sapiens
tttagacatagctgaaatcatt

SEQ ID NO: 7212704 - DNA, 22 bp, Homo sapiens
tttagacatagctgaaatcatt

SEQ ID NO: 7212705 - DNA, 22 bp, Homo sapiens
ctcctctggcttcctggaggca

SEQ ID NO: 7212706 - DNA, 22 bp, Homo sapiens
ctcctctggcttcctggaggca

SEQ ID NO: 7212707 - DNA, 22 bp, Homo sapiens
ctcctctggcttcctggaggca

SEQ ID NO: 7212708 - DNA, 22 bp, Homo sapiens
ctcctctggcttcctggaggca

SEQ ID NO: 7212709 - DNA, 22 bp, Homo sapiens
ctcctctggcttcctggaggca

SEQ ID NO: 7212710 - DNA, 22 bp, Homo sapiens
ctcctctggaaattcctctgcc

SEQ ID NO: 7212711 - DNA, 22 bp, Homo sapiens
ctcctctggaaattcctctgcc

SEQ ID NO: 7212712 - DNA, 22 bp, Homo sapiens
ctcctctggaaattcctctgcc

SEQ ID NO: 7212713 - DNA, 22 bp, Homo sapiens
ctcctctgcccaaatttgtata

SEQ ID NO: 7212714 - DNA, 22 bp, Homo sapiens
ctcctctggaaattcctctgcc

SEQ ID NO: 7212715 - DNA, 22 bp, Homo sapiens
ctcctctggaaattcctctgcc

SEQ ID NO: 7212716 - DNA, 17 bp, Homo sapiens
ctcctctctgggttact

SEQ ID NO: 7212717 - DNA, 17 bp, Homo sapiens
ctcctctctgggttact

SEQ ID NO: 7212718 - DNA, 17 bp, Homo sapiens
ctcctctctgggttact

SEQ ID NO: 7212719 - DNA, 16 bp, Homo sapiens
ctcctctccttcagga

SEQ ID NO: 7212720 - DNA, 16 bp, Homo sapiens
ctcctctccttcagga

SEQ ID NO: 7212721 - DNA, 22 bp, Homo sapiens
ctcctctctggagttatgcaga

SEQ ID NO: 7212722 - DNA, 22 bp, Homo sapiens
ctcctctctggagttatgcaga

SEQ ID NO: 7212723 - DNA, 22 bp, Homo sapiens
ctcctctctggagttatgcaga

SEQ ID NO: 7212724 - DNA, 22 bp, Homo sapiens
ctcctctctggagttatgcaga

SEQ ID NO: 7212725 - DNA, 22 bp, Homo sapiens
ctcctcccaattgccaagtgct

SEQ ID NO: 7212726 - DNA, 22 bp, Homo sapiens
ctcctctccatcagcgccaccc

SEQ ID NO: 7212727 - DNA, 22 bp, Homo sapiens
ctcctctccatcagcgccaccc

SEQ ID NO: 7212728 - DNA, 22 bp, Homo sapiens
ctcctcccaattgccaagtgct

SEQ ID NO: 7212729 - DNA, 22 bp, Homo sapiens
tttacatctcaccagattcata

SEQ ID NO: 7212730 - DNA, 22 bp, Homo sapiens
tttacatctcaccagattcata

SEQ ID NO: 7212731 - DNA, 22 bp, Homo sapiens
tttacatgagtagcagatgttc

SEQ ID NO: 7212732 - DNA, 22 bp, Homo sapiens
tttacatgagtagcagatgttc

SEQ ID NO: 7212733 - DNA, 22 bp, Homo sapiens
tttacagttaagaaatgttacc

SEQ ID NO: 7212734 - DNA, 22 bp, Homo sapiens
tttacagttccatgtgataggc

SEQ ID NO: 7212735 - DNA, 22 bp, Homo sapiens
tttacagttccatgtgataggc

SEQ ID NO: 7212736 - DNA, 22 bp, Homo sapiens
tttacacatacctctttaaagt

SEQ ID NO: 7212737 - DNA, 22 bp, Homo sapiens
tttaacagatgctatgtctacc

SEQ ID NO: 7212738 - DNA, 22 bp, Homo sapiens
tttacagttaagaaatgttacc

SEQ ID NO: 7212739 - DNA, 22 bp, Homo sapiens
tttacagttaagaaatgttacc

SEQ ID NO: 7212740 - DNA, 22 bp, Homo sapiens
tttacagttaagaaatgttacc

SEQ ID NO: 7212741 - DNA, 22 bp, Homo sapiens
tttacagttaagaaatgttacc

SEQ ID NO: 7212742 - DNA, 22 bp, Homo sapiens
tttacagttaagaaatgttacc

SEQ ID NO: 7212743 - DNA, 17 bp, Homo sapiens
tttagaatacaatgttt

SEQ ID NO: 7212744 - DNA, 22 bp, Homo sapiens
tttacatttccctctgtcagtt

SEQ ID NO: 7212745 - DNA, 22 bp, Homo sapiens
tttacattgcattaggtattat

SEQ ID NO: 7212746 - DNA, 22 bp, Homo sapiens
tttacattgcattaggtattat

SEQ ID NO: 7212747 - DNA, 17 bp, Homo sapiens
tttacattgctcgcagt

SEQ ID NO: 7212748 - DNA, 17 bp, Homo sapiens
tttacattgctcgcagt

SEQ ID NO: 7212749 - DNA, 17 bp, Homo sapiens
tttacattgctcgcagt

SEQ ID NO: 7212750 - DNA, 22 bp, Homo sapiens
tttacatttccctctgtcagtt

SEQ ID NO: 7212751 - DNA, 22 bp, Homo sapiens
tttacatttccctctgtcagtt

SEQ ID NO: 7212752 - DNA, 22 bp, Homo sapiens
tttacatgtaatgttatacaaa

SEQ ID NO: 7212753 - DNA, 22 bp, Homo sapiens
tttacatggaatattgtcttgt

SEQ ID NO: 7212754 - DNA, 22 bp, Homo sapiens
tttacatgtaatgttatacaaa

SEQ ID NO: 7212755 - DNA, 22 bp, Homo sapiens
tttacatgtaatgttatacaaa

SEQ ID NO: 7212756 - DNA, 22 bp, Homo sapiens
tttacatgtcaagactggcagt

SEQ ID NO: 7212757 - DNA, 22 bp, Homo sapiens
tttacatgtcaagactggcagt

SEQ ID NO: 7212758 - DNA, 22 bp, Homo sapiens
tttacatgtccttcaagagcag

SEQ ID NO: 7212759 - DNA, 22 bp, Homo sapiens
tttacatgtccttcaagagcag

SEQ ID NO: 7212760 - DNA, 22 bp, Homo sapiens
tttaaaaaactagtctgagtct

SEQ ID NO: 7212761 - DNA, 22 bp, Homo sapiens
tttaaaaaactagtctgagtct

SEQ ID NO: 7212762 - DNA, 22 bp, Homo sapiens
tttaaaaaactagtctgagtct

SEQ ID NO: 7212763 - DNA, 22 bp, Homo sapiens
tttaaaaaactagtctgagtct

SEQ ID NO: 7212764 - DNA, 22 bp, Homo sapiens
tttaaaaaactagtctgagtct

SEQ ID NO: 7212765 - DNA, 22 bp, Homo sapiens
tttaaaaaactagtctgagtct

SEQ ID NO: 7212766 - DNA, 22 bp, Homo sapiens
tttaaaaccaaagaaagcctct

SEQ ID NO: 7212767 - DNA, 22 bp, Homo sapiens
tttaaaaggggtattaagtcca

SEQ ID NO: 7212768 - DNA, 22 bp, Homo sapiens
tttaaaagttatcatctgtcca

SEQ ID NO: 7212769 - DNA, 22 bp, Homo sapiens
tttaaaagttatcatctgtcca

SEQ ID NO: 7212770 - DNA, 22 bp, Homo sapiens
tttaaaaggggtattaagtcca

SEQ ID NO: 7212771 - DNA, 22 bp, Homo sapiens
tttaaaaggggtattaagtcca

SEQ ID NO: 7212772 - DNA, 22 bp, Homo sapiens
tttaaaaggcagcttcttttgt

SEQ ID NO: 7212773 - DNA, 22 bp, Homo sapiens
tttaaatttagaagaaacactg

SEQ ID NO: 7212774 - DNA, 22 bp, Homo sapiens
tttaaatttagaagaaacactg

SEQ ID NO: 7212775 - DNA, 22 bp, Homo sapiens
tttaaatttagaagaaacactg

SEQ ID NO: 7212776 - DNA, 22 bp, Homo sapiens
tttaaattctgtctgccgctta

SEQ ID NO: 7212777 - DNA, 22 bp, Homo sapiens
tttaaattctgtctgccgctta

SEQ ID NO: 7212778 - DNA, 22 bp, Homo sapiens
tttaaatttgtgtttagagggt

SEQ ID NO: 7212779 - DNA, 22 bp, Homo sapiens
tttaaatttgtgtttagagggt

SEQ ID NO: 7212780 - DNA, 22 bp, Homo sapiens
tttaaatttgtgtttagagggt

SEQ ID NO: 7212781 - DNA, 22 bp, Homo sapiens
tttaaatttgtgtttagagggt

SEQ ID NO: 7212782 - DNA, 22 bp, Homo sapiens
tttaacagatagtttcttctgt

SEQ ID NO: 7212783 - DNA, 22 bp, Homo sapiens
tttaacagatgaggaggtgagg

SEQ ID NO: 7212784 - DNA, 22 bp, Homo sapiens
ttttattctcaagacaatggga

SEQ ID NO: 7212785 - DNA, 22 bp, Homo sapiens
ttttattcaaatagttcacact

SEQ ID NO: 7212786 - DNA, 23 bp, Homo sapiens
ttttattgatatgtagctgttgt

SEQ ID NO: 7212787 - DNA, 23 bp, Homo sapiens
ttttattgatatgtagctgttgt

SEQ ID NO: 7212788 - DNA, 23 bp, Homo sapiens
ttttattgatatgtagctgttgt

SEQ ID NO: 7212789 - DNA, 23 bp, Homo sapiens
ttttattgatatgtagctgttgt

SEQ ID NO: 7212790 - DNA, 23 bp, Homo sapiens
ttttattgatatgtagctgttgt

SEQ ID NO: 7212791 - DNA, 23 bp, Homo sapiens
ttttattgatatgtagctgttgt

SEQ ID NO: 7212792 - DNA, 22 bp, Homo sapiens
ttttattatctttgaatgggac

SEQ ID NO: 7212793 - DNA, 22 bp, Homo sapiens
ttttattatctttgaatgggac

SEQ ID NO: 7212794 - DNA, 22 bp, Homo sapiens
ttttagttgtagttggtgagga

SEQ ID NO: 7212795 - DNA, 22 bp, Homo sapiens
ttttagtttggatttctaaagc

SEQ ID NO: 7212796 - DNA, 22 bp, Homo sapiens
ttttagttgctcaggtattctc

SEQ ID NO: 7212797 - DNA, 22 bp, Homo sapiens
ttttagttgtactgtcaacagt

SEQ ID NO: 7212798 - DNA, 22 bp, Homo sapiens
ctctgggctccttcagcccttt

SEQ ID NO: 7212799 - DNA, 22 bp, Homo sapiens
ctctgggctccttcagcccttt

SEQ ID NO: 7212800 - DNA, 22 bp, Homo sapiens
ctctgggctccttcagcccttt

SEQ ID NO: 7212801 - DNA, 21 bp, Homo sapiens
ctctgggccattttcttccac

SEQ ID NO: 7212802 - DNA, 21 bp, Homo sapiens
ctctgggccattttcttccac

SEQ ID NO: 7212803 - DNA, 22 bp, Homo sapiens
ctctgggcccacttaaatctgg

SEQ ID NO: 7212804 - DNA, 21 bp, Homo sapiens
ctctgggccattttcttccac

SEQ ID NO: 7212805 - DNA, 21 bp, Homo sapiens
ctctgggccattttcttccac

SEQ ID NO: 7212806 - DNA, 22 bp, Homo sapiens
ctctgggccaccgctggtgtat

SEQ ID NO: 7212807 - DNA, 22 bp, Homo sapiens
ctctgggccatgctactgctct

SEQ ID NO: 7212808 - DNA, 22 bp, Homo sapiens
ctctgggccatgctactgctct

SEQ ID NO: 7212809 - DNA, 22 bp, Homo sapiens
ctctgggcggcccaggccaacc

SEQ ID NO: 7212810 - DNA, 23 bp, Homo sapiens
ctctgggcgggcaggtcagcctc

SEQ ID NO: 7212811 - DNA, 23 bp, Homo sapiens
ctctgggcgggcaggtcagcctc

SEQ ID NO: 7212812 - DNA, 23 bp, Homo sapiens
ctctgggcgggcaggtcagcctc

SEQ ID NO: 7212813 - DNA, 22 bp, Homo sapiens
ctctgggctccttcagcccttt

SEQ ID NO: 7212814 - DNA, 19 bp, Homo sapiens
ctctgggcaagtcacttaa

SEQ ID NO: 7212815 - DNA, 19 bp, Homo sapiens
ctctgggcaagtcacttaa

SEQ ID NO: 7212816 - DNA, 22 bp, Homo sapiens
ctctgggcaagtttcttcatga

SEQ ID NO: 7212817 - DNA, 22 bp, Homo sapiens
ctctgggcacattttccaggac

SEQ ID NO: 7212818 - DNA, 22 bp, Homo sapiens
ctctgggcacattttccaggac

SEQ ID NO: 7212819 - DNA, 22 bp, Homo sapiens
ctctgggcaaagatgcctcatc

SEQ ID NO: 7212820 - DNA, 22 bp, Homo sapiens
ctctgggaggtgttactatctg

SEQ ID NO: 7212821 - DNA, 22 bp, Homo sapiens
ctctgggagtggccacttctca

SEQ ID NO: 7212822 - DNA, 22 bp, Homo sapiens
ctctgggatagagcctcggtct

SEQ ID NO: 7212823 - DNA, 22 bp, Homo sapiens
ctctgggatgaggcctaggcac

SEQ ID NO: 7212824 - DNA, 22 bp, Homo sapiens
ctctgggatgaggcctaggcac

SEQ ID NO: 7212825 - DNA, 22 bp, Homo sapiens
ctctgggcaaagatgcctcatc

SEQ ID NO: 7212826 - DNA, 22 bp, Homo sapiens
ctctgggcaggaccagtggacc

SEQ ID NO: 7212827 - DNA, 22 bp, Homo sapiens
ctctgggcaggaccagtggacc

SEQ ID NO: 7212828 - DNA, 22 bp, Homo sapiens
ctctgggcaggaccagtggacc

SEQ ID NO: 7212829 - DNA, 22 bp, Homo sapiens
ctctgggcaggaccagtggacc

SEQ ID NO: 7212830 - DNA, 22 bp, Homo sapiens
ctctgggcaggaccagtggacc

SEQ ID NO: 7212831 - DNA, 22 bp, Homo sapiens
ctctgggcaggacgccaggcct

SEQ ID NO: 7212832 - DNA, 22 bp, Homo sapiens
ctctgggcaggacgccaggcct

SEQ ID NO: 7212833 - DNA, 22 bp, Homo sapiens
ctctgggcaggacgccaggcct

SEQ ID NO: 7212834 - DNA, 22 bp, Homo sapiens
ctctgggcaggacgccaggcct

SEQ ID NO: 7212835 - DNA, 22 bp, Homo sapiens
ctctgggccaccgctggtgtat

SEQ ID NO: 7212836 - DNA, 22 bp, Homo sapiens
ctctgggccaccgctggtgtat

SEQ ID NO: 7212837 - DNA, 22 bp, Homo sapiens
ctctgggcacattttccaggac

SEQ ID NO: 7212838 - DNA, 22 bp, Homo sapiens
ctctgggcaccaaagagcagct

SEQ ID NO: 7212839 - DNA, 22 bp, Homo sapiens
ctctgggcaccaaagagcagct

SEQ ID NO: 7212840 - DNA, 22 bp, Homo sapiens
ctctgggcaccaaagagcagct

SEQ ID NO: 7212841 - DNA, 22 bp, Homo sapiens
ctctgggcaccaaagagcagct

SEQ ID NO: 7212842 - DNA, 22 bp, Homo sapiens
ctctgggcactgtatgggttct

SEQ ID NO: 7212843 - DNA, 22 bp, Homo sapiens
ctctgggcactgtatgggttct

SEQ ID NO: 7212844 - DNA, 17 bp, Homo sapiens
ctctgggcagcctgggg

SEQ ID NO: 7212845 - DNA, 17 bp, Homo sapiens
ctctgggcagcctgggg

SEQ ID NO: 7212846 - DNA, 22 bp, Homo sapiens
ctctcctgggctgaccgtccga

SEQ ID NO: 7212847 - DNA, 22 bp, Homo sapiens
ctctcctgggctgaccgtccga

SEQ ID NO: 7212848 - DNA, 22 bp, Homo sapiens
ctctcctgggctgaccgtccga

SEQ ID NO: 7212849 - DNA, 23 bp, Homo sapiens
ctctcctgaaggacaagctgccg

SEQ ID NO: 7212850 - DNA, 23 bp, Homo sapiens
ctctcctgaaggacaagctgccg

SEQ ID NO: 7212851 - DNA, 23 bp, Homo sapiens
ctctcctgaaggacaagctgccg

SEQ ID NO: 7212852 - DNA, 23 bp, Homo sapiens
ctctcctgaaggacaagctgccg

SEQ ID NO: 7212853 - DNA, 22 bp, Homo sapiens
ctctcctctgaagtggtgaccc

SEQ ID NO: 7212854 - DNA, 23 bp, Homo sapiens
ctctcctgaaggacaagctgccg

SEQ ID NO: 7212855 - DNA, 23 bp, Homo sapiens
ctctcctgaaggacaagctgccg

SEQ ID NO: 7212856 - DNA, 23 bp, Homo sapiens
ctctcctgaaggacaagctgccg

SEQ ID NO: 7212857 - DNA, 22 bp, Homo sapiens
ctctcctcccatgtaggagatg

SEQ ID NO: 7212858 - DNA, 22 bp, Homo sapiens
ctctcctctgaagtggtgaccc

SEQ ID NO: 7212859 - DNA, 22 bp, Homo sapiens
ctctcctctgaagtggtgaccc

SEQ ID NO: 7212860 - DNA, 22 bp, Homo sapiens
tttgtacatcctaattctgagt

SEQ ID NO: 7212861 - DNA, 22 bp, Homo sapiens
ctctcctgggctgaccgtccga

SEQ ID NO: 7212862 - DNA, 22 bp, Homo sapiens
ctctcctggggagcacacacac

SEQ ID NO: 7212863 - DNA, 22 bp, Homo sapiens
ctctcctggggagcacacacac

SEQ ID NO: 7212864 - DNA, 22 bp, Homo sapiens
tttgtcttgtaagttaaattca

SEQ ID NO: 7212865 - DNA, 22 bp, Homo sapiens
tttgtcttggccaaggttctga

SEQ ID NO: 7212866 - DNA, 22 bp, Homo sapiens
tttgtcttggcctcagttttct

SEQ ID NO: 7212867 - DNA, 22 bp, Homo sapiens
tttgtcttggcctcagttttct

SEQ ID NO: 7212868 - DNA, 22 bp, Homo sapiens
tttgtcttggcctcagttttct

SEQ ID NO: 7212869 - DNA, 22 bp, Homo sapiens
tttgtgaacttaggcaattagg

SEQ ID NO: 7212870 - DNA, 22 bp, Homo sapiens
tttgtgaacttaggcaattagg

SEQ ID NO: 7212871 - DNA, 19 bp, Homo sapiens
tttgtgaagaaaatgatgc

SEQ ID NO: 7212872 - DNA, 19 bp, Homo sapiens
tttgtgaagaaaatgatgc

SEQ ID NO: 7212873 - DNA, 19 bp, Homo sapiens
tttgtgaagaaaatgatgc

SEQ ID NO: 7212874 - DNA, 22 bp, Homo sapiens
tttgtgaacactgcgcagaact

SEQ ID NO: 7212875 - DNA, 22 bp, Homo sapiens
tttgtgaagggaacagaagtgt

SEQ ID NO: 7212876 - DNA, 22 bp, Homo sapiens
tttgtgaagggaacagaagtgt

SEQ ID NO: 7212877 - DNA, 22 bp, Homo sapiens
tttgtgaataagagaatgacag

SEQ ID NO: 7212878 - DNA, 22 bp, Homo sapiens
tttgtgaataggttggcttcca

SEQ ID NO: 7212879 - DNA, 22 bp, Homo sapiens
tttgtcttgtaagttaaattca

SEQ ID NO: 7212880 - DNA, 22 bp, Homo sapiens
tttgtcttgtgtccttaggacc

SEQ ID NO: 7212881 - DNA, 22 bp, Homo sapiens
tttgtctttcccctcctcattg

SEQ ID NO: 7212882 - DNA, 22 bp, Homo sapiens
tttgtctttcccctcctcattg

SEQ ID NO: 7212883 - DNA, 22 bp, Homo sapiens
tttgtctttcccctcctcattg

SEQ ID NO: 7212884 - DNA, 22 bp, Homo sapiens
tttgtctttcccctcctcattg

SEQ ID NO: 7212885 - DNA, 23 bp, Homo sapiens
tttgtgaaagtgttgagaggaga

SEQ ID NO: 7212886 - DNA, 23 bp, Homo sapiens
tttgtgaaagtgttgagaggaga

SEQ ID NO: 7212887 - DNA, 22 bp, Homo sapiens
tttgtgaacaaacatgaagatg

SEQ ID NO: 7212888 - DNA, 22 bp, Homo sapiens
ctctggctgtttgcagctcaag

SEQ ID NO: 7212889 - DNA, 22 bp, Homo sapiens
ctctggctgtttgcagctcaag

SEQ ID NO: 7212890 - DNA, 22 bp, Homo sapiens
ctctggctggctgggcctcagt

SEQ ID NO: 7212891 - DNA, 22 bp, Homo sapiens
ctctggctgtcccgatgagcag

SEQ ID NO: 7212892 - DNA, 22 bp, Homo sapiens
ctctggctggcattgctggact

SEQ ID NO: 7212893 - DNA, 22 bp, Homo sapiens
ctctggctggcattgctggact

SEQ ID NO: 7212894 - DNA, 22 bp, Homo sapiens
ctctggctggcattgctggact

SEQ ID NO: 7212895 - DNA, 22 bp, Homo sapiens
ctctggctggcattgctggact

SEQ ID NO: 7212896 - DNA, 22 bp, Homo sapiens
ctctggctggcattgctggact

SEQ ID NO: 7212897 - DNA, 22 bp, Homo sapiens
ctctggctggctgggcctcagt

SEQ ID NO: 7212898 - DNA, 22 bp, Homo sapiens
ctctggcttagtatgctccaaa

SEQ ID NO: 7212899 - DNA, 22 bp, Homo sapiens
ctctggcttagtatgctccaaa

SEQ ID NO: 7212900 - DNA, 19 bp, Homo sapiens
ctctggcttccaaagcatc

SEQ ID NO: 7212901 - DNA, 22 bp, Homo sapiens
ctctggcttctaccttgcagtt

SEQ ID NO: 7212902 - DNA, 22 bp, Homo sapiens
ctctggcttctaccttgcagtt

SEQ ID NO: 7212903 - DNA, 22 bp, Homo sapiens
ctctggcttctaccttgcagtt

SEQ ID NO: 7212904 - DNA, 22 bp, Homo sapiens
ctctggctggcacctgatctga

SEQ ID NO: 7212905 - DNA, 22 bp, Homo sapiens
ctctggctggcacctgatctga

SEQ ID NO: 7212906 - DNA, 22 bp, Homo sapiens
ctctggctggcacctgatctga

SEQ ID NO: 7212907 - DNA, 22 bp, Homo sapiens
ctctggctctgacagttgatcc

SEQ ID NO: 7212908 - DNA, 22 bp, Homo sapiens
ctctggctctgttgagatttgt

SEQ ID NO: 7212909 - DNA, 22 bp, Homo sapiens
ctctggctcttgggaaacaggt

SEQ ID NO: 7212910 - DNA, 22 bp, Homo sapiens
ctctggctgcctctcaggcctg

SEQ ID NO: 7212911 - DNA, 22 bp, Homo sapiens
ctctggctgcctctcaggcctg

SEQ ID NO: 7212912 - DNA, 22 bp, Homo sapiens
ctctggctgcctctcaggcctg

SEQ ID NO: 7212913 - DNA, 22 bp, Homo sapiens
tttgtgaataggttggcttcca

SEQ ID NO: 7212914 - DNA, 22 bp, Homo sapiens
tttgtgaatggaatccacagac

SEQ ID NO: 7212915 - DNA, 22 bp, Homo sapiens
tttgtgaattcttggaagattg

SEQ ID NO: 7212916 - DNA, 19 bp, Homo sapiens
ctctggctcctgggctgcc

SEQ ID NO: 7212917 - DNA, 19 bp, Homo sapiens
ctctggctcctgggctgcc

SEQ ID NO: 7212918 - DNA, 22 bp, Homo sapiens
ctgaagagcaaaccaactggac

SEQ ID NO: 7212919 - DNA, 22 bp, Homo sapiens
ctgaagagcaaaccaactggac

SEQ ID NO: 7212920 - DNA, 20 bp, Homo sapiens
ctgaagagactggaggggca

SEQ ID NO: 7212921 - DNA, 22 bp, Homo sapiens
ctgaagagactggagggggcat

SEQ ID NO: 7212922 - DNA, 22 bp, Homo sapiens
ctgaagagaaagggagctcttc

SEQ ID NO: 7212923 - DNA, 22 bp, Homo sapiens
ctgaagactgctgagaagttac

SEQ ID NO: 7212924 - DNA, 22 bp, Homo sapiens
ctgaagagaaagggagctcttc

SEQ ID NO: 7212925 - DNA, 22 bp, Homo sapiens
ctgaagagaaatgtacacatgg

SEQ ID NO: 7212926 - DNA, 22 bp, Homo sapiens
ctgaagagaaatgtacacatgg

SEQ ID NO: 7212927 - DNA, 20 bp, Homo sapiens
ctgaagagactggaggggca

SEQ ID NO: 7212928 - DNA, 22 bp, Homo sapiens
ctgaagaagctgcagcctggag

SEQ ID NO: 7212929 - DNA, 22 bp, Homo sapiens
ctgaagaatgacagtgctttga

SEQ ID NO: 7212930 - DNA, 22 bp, Homo sapiens
ctgaacttattgagtgcttgct

SEQ ID NO: 7212931 - DNA, 22 bp, Homo sapiens
ctgaacttattgagtgcttgct

SEQ ID NO: 7212932 - DNA, 22 bp, Homo sapiens
ctgaacttattgagtgcttgct

SEQ ID NO: 7212933 - DNA, 22 bp, Homo sapiens
ctgaagaaatatgattgcttaa

SEQ ID NO: 7212934 - DNA, 22 bp, Homo sapiens
ctgaactaggattggaatgaga

SEQ ID NO: 7212935 - DNA, 22 bp, Homo sapiens
ctgaactatgtaaaagtaagct

SEQ ID NO: 7212936 - DNA, 22 bp, Homo sapiens
ctgaactcatgatatgcttttg

SEQ ID NO: 7212937 - DNA, 15 bp, Homo sapiens
ctgaactctaaacca

SEQ ID NO: 7212938 - DNA, 22 bp, Homo sapiens
ctgaactctttatgacagcttg

SEQ ID NO: 7212939 - DNA, 22 bp, Homo sapiens
ctgaacattcttgaacatctgt

SEQ ID NO: 7212940 - DNA, 22 bp, Homo sapiens
ctgaaattctttggagttttct

SEQ ID NO: 7212941 - DNA, 22 bp, Homo sapiens
ctgaacaaagttcttttgagct

SEQ ID NO: 7212942 - DNA, 20 bp, Homo sapiens
ctgaacacagaataagcaca

SEQ ID NO: 7212943 - DNA, 22 bp, Homo sapiens
ctgaacatcccgcagtgcacga

SEQ ID NO: 7212944 - DNA, 22 bp, Homo sapiens
ctgaaaggcagtgggtagtgtg

SEQ ID NO: 7212945 - DNA, 20 bp, Homo sapiens
ctgaaaggagtcgggatgtc

SEQ ID NO: 7212946 - DNA, 22 bp, Homo sapiens
ctgaaattctgcctctgcacaa

SEQ ID NO: 7212947 - DNA, 22 bp, Homo sapiens
ctgaaattgatgacagggatgg

SEQ ID NO: 7212948 - DNA, 22 bp, Homo sapiens
ctgaaaggagagctgcaaggat

SEQ ID NO: 7212949 - DNA, 22 bp, Homo sapiens
ctgaaaggagagctgcaaggat

SEQ ID NO: 7212950 - DNA, 22 bp, Homo sapiens
ctgaaaggaataaggctctttg

SEQ ID NO: 7212951 - DNA, 22 bp, Homo sapiens
ctgaaagcattaactccacttc

SEQ ID NO: 7212952 - DNA, 19 bp, Homo sapiens
tttttaatgggctggagca

SEQ ID NO: 7212953 - DNA, 19 bp, Homo sapiens
tttttaatgggctggagca

SEQ ID NO: 7212954 - DNA, 19 bp, Homo sapiens
tttttaatgggctggagca

SEQ ID NO: 7212955 - DNA, 22 bp, Homo sapiens
ctgaagaggacgcagcagcaag

SEQ ID NO: 7212956 - DNA, 22 bp, Homo sapiens
ctgaagaggctccgcccacaag

SEQ ID NO: 7212957 - DNA, 22 bp, Homo sapiens
ctgaagaggttgttgaggaata

SEQ ID NO: 7212958 - DNA, 17 bp, Homo sapiens
ctgaagagtcctggcta

SEQ ID NO: 7212959 - DNA, 22 bp, Homo sapiens
ctgaagaggacgcagcagcaag

SEQ ID NO: 7212960 - DNA, 22 bp, Homo sapiens
ctgaagaggacgcagcagcaag

SEQ ID NO: 7212961 - DNA, 22 bp, Homo sapiens
ctgaagagcactgtggccagtt

SEQ ID NO: 7212962 - DNA, 23 bp, Homo sapiens
ctgaagagccaacaaaaagcttg

SEQ ID NO: 7212963 - DNA, 17 bp, Homo sapiens
ctgaagataatggcaac

SEQ ID NO: 7212964 - DNA, 22 bp, Homo sapiens
ctgaagatgatgatactaagga

SEQ ID NO: 7212965 - DNA, 22 bp, Homo sapiens
ctgaagatagtgtctgatcatg

SEQ ID NO: 7212966 - DNA, 22 bp, Homo sapiens
ctgaagatagtgtctgatcatg

SEQ ID NO: 7212967 - DNA, 17 bp, Homo sapiens
ctgaagataatggcaac

SEQ ID NO: 7212968 - DNA, 22 bp, Homo sapiens
ctgactgtgagagcaggaatgg

SEQ ID NO: 7212969 - DNA, 22 bp, Homo sapiens
ctgaagatgtctgagatgctca

SEQ ID NO: 7212970 - DNA, 22 bp, Homo sapiens
ctgacttcagggataaaaagta

SEQ ID NO: 7212971 - DNA, 22 bp, Homo sapiens
ctgagaaagtttatgtttattt

SEQ ID NO: 7212972 - DNA, 22 bp, Homo sapiens
ctgagaaatacccaagtctggt

SEQ ID NO: 7212973 - DNA, 22 bp, Homo sapiens
ctgagaaatacccaagtctggt

SEQ ID NO: 7212974 - DNA, 22 bp, Homo sapiens
ctgagaaatgcatttttccagc

SEQ ID NO: 7212975 - DNA, 22 bp, Homo sapiens
ctgagaaattctttctttcact

SEQ ID NO: 7212976 - DNA, 22 bp, Homo sapiens
ctgagaaattctttctttcact

SEQ ID NO: 7212977 - DNA, 22 bp, Homo sapiens
ctgagaaggaagcctccactct

SEQ ID NO: 7212978 - DNA, 22 bp, Homo sapiens
ctgagaaggtgtggagatgggc

SEQ ID NO: 7212979 - DNA, 22 bp, Homo sapiens
ctgagaaggtgtggagatgggc

SEQ ID NO: 7212980 - DNA, 22 bp, Homo sapiens
ctgagaaatttattggttggaa

SEQ ID NO: 7212981 - DNA, 20 bp, Homo sapiens
ctgagaactatgactgtctt

SEQ ID NO: 7212982 - DNA, 22 bp, Homo sapiens
ctgagaagcaaagaactgcact

SEQ ID NO: 7212983 - DNA, 22 bp, Homo sapiens
ctgagaagcaaagaactgcact

SEQ ID NO: 7212984 - DNA, 22 bp, Homo sapiens
ctgagaagcactgtctgcaaga

SEQ ID NO: 7212985 - DNA, 22 bp, Homo sapiens
ctgagaagcactgtctgcaaga

SEQ ID NO: 7212986 - DNA, 21 bp, Homo sapiens
ttttattgatgaatggccact

SEQ ID NO: 7212987 - DNA, 22 bp, Homo sapiens
ctctgggttcactgaggctctg

SEQ ID NO: 7212988 - DNA, 23 bp, Homo sapiens
ttttattgatatgtagctgttgt

SEQ ID NO: 7212989 - DNA, 21 bp, Homo sapiens
ttttattgatgaatggccact

SEQ ID NO: 7212990 - DNA, 21 bp, Homo sapiens
ttttattgatgaatggccact

SEQ ID NO: 7212991 - DNA, 21 bp, Homo sapiens
ttttattgatgaatggccact

SEQ ID NO: 7212992 - DNA, 21 bp, Homo sapiens
ttttattgatgaatggccact

SEQ ID NO: 7212993 - DNA, 21 bp, Homo sapiens
ttttattgatgaatggccact

SEQ ID NO: 7212994 - DNA, 22 bp, Homo sapiens
ctctgggttctggcctgcaccc

SEQ ID NO: 7212995 - DNA, 22 bp, Homo sapiens
ctctgggttttgtcagctgagg

SEQ ID NO: 7212996 - DNA, 22 bp, Homo sapiens
ctctgggttttgtcagctgagg

SEQ ID NO: 7212997 - DNA, 22 bp, Homo sapiens
ctctggtcatttggaagagcat

SEQ ID NO: 7212998 - DNA, 22 bp, Homo sapiens
ctctggtcatttggaagagcat

SEQ ID NO: 7212999 - DNA, 21 bp, Homo sapiens
ctctggtcctgtctggcaggc

SEQ ID NO: 7213000 - DNA, 21 bp, Homo sapiens
ctctggtcctgtctggcaggc

SEQ ID NO: 7213001 - DNA, 22 bp, Homo sapiens
ctctggttcagggctccctggc

SEQ ID NO: 7213002 - DNA, 22 bp, Homo sapiens
ctctggttcaaagtagtataat

SEQ ID NO: 7213003 - DNA, 22 bp, Homo sapiens
ctctggttcagggctccctggc

SEQ ID NO: 7213004 - DNA, 22 bp, Homo sapiens
ctctggttcagggctccctggc

SEQ ID NO: 7213005 - DNA, 22 bp, Homo sapiens
ctctggttcgtggtagatttta

SEQ ID NO: 7213006 - DNA, 22 bp, Homo sapiens
ctctggttgagtgagaaccaag

SEQ ID NO: 7213007 - DNA, 22 bp, Homo sapiens
ctctggtcttcaaggccacctc

SEQ ID NO: 7213008 - DNA, 22 bp, Homo sapiens
ctctggtgtctcccctaagcta

SEQ ID NO: 7213009 - DNA, 23 bp, Homo sapiens
ctctggttagatatcatatgctg

SEQ ID NO: 7213010 - DNA, 22 bp, Homo sapiens
ctctttgtgctattatgatcct

SEQ ID NO: 7213011 - DNA, 22 bp, Homo sapiens
ctctttgtcactcatacagtca

SEQ ID NO: 7213012 - DNA, 22 bp, Homo sapiens
ctctttgtagcctttgcatatt

SEQ ID NO: 7213013 - DNA, 22 bp, Homo sapiens
ctctttgtatttctttgggcca

SEQ ID NO: 7213014 - DNA, 22 bp, Homo sapiens
ctctttgtaaagaagtggtagg

SEQ ID NO: 7213015 - DNA, 22 bp, Homo sapiens
ctctttgtaaagaagtggtagg

SEQ ID NO: 7213016 - DNA, 22 bp, Homo sapiens
ctctttggcgttggcagagcca

SEQ ID NO: 7213017 - DNA, 22 bp, Homo sapiens
ctctttgtagcctttgcatatt

SEQ ID NO: 7213018 - DNA, 22 bp, Homo sapiens
ctctttgtagcctttgcatatt

SEQ ID NO: 7213019 - DNA, 22 bp, Homo sapiens
ctctttgtggccacctaatctt

SEQ ID NO: 7213020 - DNA, 20 bp, Homo sapiens
ctctttgttggcaaactctt

SEQ ID NO: 7213021 - DNA, 21 bp, Homo sapiens
ctctttgtggcaatgtatttt

SEQ ID NO: 7213022 - DNA, 22 bp, Homo sapiens
ctcttttagagatgaaaattgg

SEQ ID NO: 7213023 - DNA, 22 bp, Homo sapiens
ctcttttcaaaatttcactgca

SEQ ID NO: 7213024 - DNA, 22 bp, Homo sapiens
ctcttttcaaacctgtttatgg

SEQ ID NO: 7213025 - DNA, 20 bp, Homo sapiens
ctcttttcactctcagtggt

SEQ ID NO: 7213026 - DNA, 22 bp, Homo sapiens
ctcttttcaaacctgtttatgg

SEQ ID NO: 7213027 - DNA, 17 bp, Homo sapiens
ctcttttgtcttcttcc

SEQ ID NO: 7213028 - DNA, 22 bp, Homo sapiens
ctctttttcagccttaccaaag

SEQ ID NO: 7213029 - DNA, 22 bp, Homo sapiens
ctctttttcagccttaccaaag

SEQ ID NO: 7213030 - DNA, 22 bp, Homo sapiens
ctctttttcagccttaccaaag

SEQ ID NO: 7213031 - DNA, 22 bp, Homo sapiens
ctctttttcacctctgtcagcg

SEQ ID NO: 7213032 - DNA, 22 bp, Homo sapiens
ctctttttcagccttaccaaag

SEQ ID NO: 7213033 - DNA, 22 bp, Homo sapiens
ctctttttcacctctgtcagcg

SEQ ID NO: 7213034 - DNA, 22 bp, Homo sapiens
ctcttttcaaacctgtttatgg

SEQ ID NO: 7213035 - DNA, 22 bp, Homo sapiens
ctctttttcacctctgtcagcg

SEQ ID NO: 7213036 - DNA, 22 bp, Homo sapiens
ttttgttttcttagaaacctgg

SEQ ID NO: 7213037 - DNA, 22 bp, Homo sapiens
ttttgttttcttagaaacctgg

SEQ ID NO: 7213038 - DNA, 22 bp, Homo sapiens
ttttgttttcttagaaacctgg

SEQ ID NO: 7213039 - DNA, 22 bp, Homo sapiens
ttttgttttcttagaaacctgg

SEQ ID NO: 7213040 - DNA, 19 bp, Homo sapiens
ctgaaaaacattctcagga

SEQ ID NO: 7213041 - DNA, 19 bp, Homo sapiens
ctgaaaaacattctcagga

SEQ ID NO: 7213042 - DNA, 22 bp, Homo sapiens
ttttgttttcttagaaacctgg

SEQ ID NO: 7213043 - DNA, 22 bp, Homo sapiens
tttttaacctaccttaagagca

SEQ ID NO: 7213044 - DNA, 22 bp, Homo sapiens
tttttaacctaccttaagagca

SEQ ID NO: 7213045 - DNA, 22 bp, Homo sapiens
tttttaacctaccttaagagca

SEQ ID NO: 7213046 - DNA, 22 bp, Homo sapiens
tttttaagctcctttgatgtca

SEQ ID NO: 7213047 - DNA, 22 bp, Homo sapiens
tttttaatgcagtctgagacat

SEQ ID NO: 7213048 - DNA, 22 bp, Homo sapiens
ctgattgagaaggaaggggatc

SEQ ID NO: 7213049 - DNA, 21 bp, Homo sapiens
ctgattgtgaaagtcatcatt

SEQ ID NO: 7213050 - DNA, 22 bp, Homo sapiens
ctgattccaaagccaaagctat

SEQ ID NO: 7213051 - DNA, 22 bp, Homo sapiens
ctgattccaaagccaaagctat

SEQ ID NO: 7213052 - DNA, 22 bp, Homo sapiens
ctgattccagagtctgtgttct

SEQ ID NO: 7213053 - DNA, 22 bp, Homo sapiens
ctgattccctggtgcctccgtt

SEQ ID NO: 7213054 - DNA, 22 bp, Homo sapiens
ctgattcctgattcatgctctt

SEQ ID NO: 7213055 - DNA, 22 bp, Homo sapiens
ctgattcctgattcatgctctt

SEQ ID NO: 7213056 - DNA, 22 bp, Homo sapiens
ctgatttacatatacaaaagat

SEQ ID NO: 7213057 - DNA, 22 bp, Homo sapiens
ctgatttagatttcacacgtga

SEQ ID NO: 7213058 - DNA, 22 bp, Homo sapiens
ctgattttcaaaatgtgttaaa

SEQ ID NO: 7213059 - DNA, 22 bp, Homo sapiens
ctgcaaaagtaattgcaggttt

SEQ ID NO: 7213060 - DNA, 22 bp, Homo sapiens
ctgcaaaagtaattgcaggttt

SEQ ID NO: 7213061 - DNA, 22 bp, Homo sapiens
ctgcagaaagctgagatgatta

SEQ ID NO: 7213062 - DNA, 22 bp, Homo sapiens
ctgcagaaatatggatgtgata

SEQ ID NO: 7213063 - DNA, 22 bp, Homo sapiens
ctgcagaatggggccaagtgga

SEQ ID NO: 7213064 - DNA, 22 bp, Homo sapiens
ctgcagacctctgaggtccatg

SEQ ID NO: 7213065 - DNA, 22 bp, Homo sapiens
ctgcagacctctgaggtccatg

SEQ ID NO: 7213066 - DNA, 22 bp, Homo sapiens
ctgcagacctctgaggtccatg

SEQ ID NO: 7213067 - DNA, 22 bp, Homo sapiens
ctgcaaaagtaattgcaggttt

SEQ ID NO: 7213068 - DNA, 22 bp, Homo sapiens
ctgcaaaagtaattgcaggttt

SEQ ID NO: 7213069 - DNA, 22 bp, Homo sapiens
ctgcaaaagtaattggggcttt

SEQ ID NO: 7213070 - DNA, 22 bp, Homo sapiens
ctgcaaaagtcattgtggtttt

SEQ ID NO: 7213071 - DNA, 22 bp, Homo sapiens
ctgcaaaagtcattgtggtttt

SEQ ID NO: 7213072 - DNA, 23 bp, Homo sapiens
ctgcagagaactgagggacagcc

SEQ ID NO: 7213073 - DNA, 22 bp, Homo sapiens
ctgcagagcataaatctgaata

SEQ ID NO: 7213074 - DNA, 22 bp, Homo sapiens
ctgcagagcatgaggaggtctg

SEQ ID NO: 7213075 - DNA, 22 bp, Homo sapiens
ctgcagagcatgaggaggtctg

SEQ ID NO: 7213076 - DNA, 22 bp, Homo sapiens
ctgcagagcatgaggaggtctg

SEQ ID NO: 7213077 - DNA, 17 bp, Homo sapiens
ctgatggattttttcca

SEQ ID NO: 7213078 - DNA, 22 bp, Homo sapiens
ctgatggatggacaggggtagt

SEQ ID NO: 7213079 - DNA, 22 bp, Homo sapiens
ctgatggatgctacgtaagagg

SEQ ID NO: 7213080 - DNA, 19 bp, Homo sapiens
ctgatgttccagagaagct

SEQ ID NO: 7213081 - DNA, 19 bp, Homo sapiens
ctgatgttccagagaagct

SEQ ID NO: 7213082 - DNA, 20 bp, Homo sapiens
ctgatgttcgtgcttcctgg

SEQ ID NO: 7213083 - DNA, 22 bp, Homo sapiens
ctgattagagtgttaatgagga

SEQ ID NO: 7213084 - DNA, 22 bp, Homo sapiens
ctgattaggctaagcaagaggg

SEQ ID NO: 7213085 - DNA, 22 bp, Homo sapiens
ctgattaactgaactgaattta

SEQ ID NO: 7213086 - DNA, 22 bp, Homo sapiens
ctgatggagtgatggagaaatt

SEQ ID NO: 7213087 - DNA, 22 bp, Homo sapiens
ctgatggagagtgtgatttggg

SEQ ID NO: 7213088 - DNA, 22 bp, Homo sapiens
ctgatggagactccactgtgat

SEQ ID NO: 7213089 - DNA, 22 bp, Homo sapiens
ctgatgcctctcttcttggctt

SEQ ID NO: 7213090 - DNA, 22 bp, Homo sapiens
ctgatgatagtgatttattgag

SEQ ID NO: 7213091 - DNA, 22 bp, Homo sapiens
ctgatgatagtgatttattgag

SEQ ID NO: 7213092 - DNA, 22 bp, Homo sapiens
ctgatgcaaccagcatatggaa

SEQ ID NO: 7213093 - DNA, 22 bp, Homo sapiens
ctgatctatttacaggaaccaa

SEQ ID NO: 7213094 - DNA, 22 bp, Homo sapiens
ctgatcttaagtaacattattt

SEQ ID NO: 7213095 - DNA, 22 bp, Homo sapiens
ctgatccctccatagggcacag

SEQ ID NO: 7213096 - DNA, 22 bp, Homo sapiens
ctgatcctcctttaagtagctg

SEQ ID NO: 7213097 - DNA, 22 bp, Homo sapiens
ctgatcctcctttaagtagctg

SEQ ID NO: 7213098 - DNA, 22 bp, Homo sapiens
ctgatcctcctttaagtagctg

SEQ ID NO: 7213099 - DNA, 22 bp, Homo sapiens
ctgagtccagggacagaggcgt

SEQ ID NO: 7213100 - DNA, 22 bp, Homo sapiens
ctgaggtttgtccatccttggt

SEQ ID NO: 7213101 - DNA, 19 bp, Homo sapiens
ctgagtcaaaggttgtggg

SEQ ID NO: 7213102 - DNA, 22 bp, Homo sapiens
ctgagtcattgcagatgtggag

SEQ ID NO: 7213103 - DNA, 22 bp, Homo sapiens
ctgaggcagaaaaagcaagggt

SEQ ID NO: 7213104 - DNA, 22 bp, Homo sapiens
ctgaggcagaaaaagcaagggt

SEQ ID NO: 7213105 - DNA, 22 bp, Homo sapiens
ctgaggcagaaaaagcaagggt

SEQ ID NO: 7213106 - DNA, 22 bp, Homo sapiens
ctgaggcagaaaaagcaagggt

SEQ ID NO: 7213107 - DNA, 22 bp, Homo sapiens
ctgaggcactgtcagctgaggc

SEQ ID NO: 7213108 - DNA, 22 bp, Homo sapiens
ctgaggcactgtcagctgaggc

SEQ ID NO: 7213109 - DNA, 22 bp, Homo sapiens
ctgaggcactgtcagctgaggc

SEQ ID NO: 7213110 - DNA, 22 bp, Homo sapiens
ctgaggcactggtaatgggcat

SEQ ID NO: 7213111 - DNA, 22 bp, Homo sapiens
ctgaggcactggtaatgggcat

SEQ ID NO: 7213112 - DNA, 22 bp, Homo sapiens
ctgaggcactaacaaggacaag

SEQ ID NO: 7213113 - DNA, 22 bp, Homo sapiens
ctgaggcactaacaaggacaag

SEQ ID NO: 7213114 - DNA, 22 bp, Homo sapiens
ctgaggcacctacagtctcggg

SEQ ID NO: 7213115 - DNA, 19 bp, Homo sapiens
ctgaggcaagtggtggtca

SEQ ID NO: 7213116 - DNA, 22 bp, Homo sapiens
ctgaggatggtgtggtcttctc

SEQ ID NO: 7213117 - DNA, 17 bp, Homo sapiens
ctgaggattatggttgt

SEQ ID NO: 7213118 - DNA, 22 bp, Homo sapiens
ctgaggatctaattattgggtc

SEQ ID NO: 7213119 - DNA, 22 bp, Homo sapiens
ctgaggatctactgtgggctca

SEQ ID NO: 7213120 - DNA, 22 bp, Homo sapiens
ctgaggatctactgtgggctca

SEQ ID NO: 7213121 - DNA, 22 bp, Homo sapiens
ctgaggagtgggtgggcagtga

SEQ ID NO: 7213122 - DNA, 22 bp, Homo sapiens
ctgaggagtgggtgggcagtga

SEQ ID NO: 7213123 - DNA, 22 bp, Homo sapiens
ctgaggagtgggtgggcagtga

SEQ ID NO: 7213124 - DNA, 22 bp, Homo sapiens
ctgaggagtgggtgggcagtga

SEQ ID NO: 7213125 - DNA, 22 bp, Homo sapiens
ctgaggagttggtgaataagcc

SEQ ID NO: 7213126 - DNA, 22 bp, Homo sapiens
ctgaggagtcagcttactcact

SEQ ID NO: 7213127 - DNA, 22 bp, Homo sapiens
ctgaggagtcagttccactcag

SEQ ID NO: 7213128 - DNA, 22 bp, Homo sapiens
ctgaggaccccacaggaggccc

SEQ ID NO: 7213129 - DNA, 22 bp, Homo sapiens
ctgaggaccccacaggaggccc

SEQ ID NO: 7213130 - DNA, 22 bp, Homo sapiens
ctgagagagtaaagtagaatta

SEQ ID NO: 7213131 - DNA, 22 bp, Homo sapiens
ctgagagatcaagccacaggat

SEQ ID NO: 7213132 - DNA, 22 bp, Homo sapiens
ctgaggagaaagatggtccaag

SEQ ID NO: 7213133 - DNA, 22 bp, Homo sapiens
ctgaggagaaagatggtccaag

SEQ ID NO: 7213134 - DNA, 22 bp, Homo sapiens
ctgagagaatcatgctgcaggt

SEQ ID NO: 7213135 - DNA, 22 bp, Homo sapiens
ctgagagactgtttgtaatatt

SEQ ID NO: 7213136 - DNA, 22 bp, Homo sapiens
ctgaggaggggcctgagtgaga

SEQ ID NO: 7213137 - DNA, 22 bp, Homo sapiens
ctgaggaggggcctgagtgaga

SEQ ID NO: 7213138 - DNA, 22 bp, Homo sapiens
ctgaggaggctaatttgaggat

SEQ ID NO: 7213139 - DNA, 22 bp, Homo sapiens
ctgaggagctgaaggccctcca

SEQ ID NO: 7213140 - DNA, 22 bp, Homo sapiens
ctgaggagaaagatggtccaag

SEQ ID NO: 7213141 - DNA, 22 bp, Homo sapiens
ctgaggagaaatgggatggttc

SEQ ID NO: 7213142 - DNA, 22 bp, Homo sapiens
ctgaggagaacaatgagatcaa

SEQ ID NO: 7213143 - DNA, 22 bp, Homo sapiens
ctgagagaaacatgactcagga

SEQ ID NO: 7213144 - DNA, 22 bp, Homo sapiens
ctgagagaaacatgactcagga

SEQ ID NO: 7213145 - DNA, 22 bp, Homo sapiens
ctgagagaaacatgactcagga

SEQ ID NO: 7213146 - DNA, 22 bp, Homo sapiens
ctgagagaagagcgcagtttgt

SEQ ID NO: 7213147 - DNA, 22 bp, Homo sapiens
ctgagagaatcatgctgcaggt

SEQ ID NO: 7213148 - DNA, 22 bp, Homo sapiens
ctgagacattatgacaagtgga

SEQ ID NO: 7213149 - DNA, 22 bp, Homo sapiens
ctgagacattatgacaagtgga

SEQ ID NO: 7213150 - DNA, 22 bp, Homo sapiens
ctgagaattactctgatgagta

SEQ ID NO: 7213151 - DNA, 22 bp, Homo sapiens
ctgagaatgttttctgattgat

SEQ ID NO: 7213152 - DNA, 22 bp, Homo sapiens
ctgagaattactctgatgagta

SEQ ID NO: 7213153 - DNA, 22 bp, Homo sapiens
ctgagacacagtggctgaaaag

SEQ ID NO: 7213154 - DNA, 22 bp, Homo sapiens
ctgagacaggagaatggcgtga

SEQ ID NO: 7213155 - DNA, 22 bp, Homo sapiens
ctgagacacggagaggctgtgt

SEQ ID NO: 7213156 - DNA, 22 bp, Homo sapiens
ctgcctgcgttgcctcgtgcct

SEQ ID NO: 7213157 - DNA, 22 bp, Homo sapiens
ctgcctcctggctgatgggtag

SEQ ID NO: 7213158 - DNA, 22 bp, Homo sapiens
ctgcctctataggagtccacca

SEQ ID NO: 7213159 - DNA, 22 bp, Homo sapiens
ctgcctcctgccgtgcagcttc

SEQ ID NO: 7213160 - DNA, 22 bp, Homo sapiens
ctgcctcctgccgtgcagcttc

SEQ ID NO: 7213161 - DNA, 22 bp, Homo sapiens
ctgcctcctcacgtccacagtg

SEQ ID NO: 7213162 - DNA, 22 bp, Homo sapiens
ctgcctcctcacgtccacagtg

SEQ ID NO: 7213163 - DNA, 22 bp, Homo sapiens
ctgcctcctcacgtccacagtg

SEQ ID NO: 7213164 - DNA, 22 bp, Homo sapiens
ctgcctccaggctcaccttgac

SEQ ID NO: 7213165 - DNA, 22 bp, Homo sapiens
ctgcctccaggctcaccttgac

SEQ ID NO: 7213166 - DNA, 22 bp, Homo sapiens
ctgcctccaggctcaccttgac

SEQ ID NO: 7213167 - DNA, 22 bp, Homo sapiens
ctgcctcctcacgtccacagtg

SEQ ID NO: 7213168 - DNA, 22 bp, Homo sapiens
ctgcctcctcacgtccacagtg

SEQ ID NO: 7213169 - DNA, 22 bp, Homo sapiens
ctgcctcctcacgtccacagtg

SEQ ID NO: 7213170 - DNA, 22 bp, Homo sapiens
ctgcctcatgctgcctgcagcc

SEQ ID NO: 7213171 - DNA, 22 bp, Homo sapiens
ctgcctccaggctcaccttgac

SEQ ID NO: 7213172 - DNA, 22 bp, Homo sapiens
ctgcctccaggctcaccttgac

SEQ ID NO: 7213173 - DNA, 22 bp, Homo sapiens
ctgcctcatgctgcctgcagcc

SEQ ID NO: 7213174 - DNA, 22 bp, Homo sapiens
ctgcctcatgctgcctgcagcc

SEQ ID NO: 7213175 - DNA, 22 bp, Homo sapiens
ctgcctcatgctgcctgcagcc

SEQ ID NO: 7213176 - DNA, 22 bp, Homo sapiens
ctgcctcatgctgcctgcagcc

SEQ ID NO: 7213177 - DNA, 22 bp, Homo sapiens
ctgcctcagcgttgtggcccta

SEQ ID NO: 7213178 - DNA, 22 bp, Homo sapiens
ctgcctcatgctgcctgcagcc

SEQ ID NO: 7213179 - DNA, 22 bp, Homo sapiens
ctgcctcatgctgcctgcagcc

SEQ ID NO: 7213180 - DNA, 22 bp, Homo sapiens
ctgcctcagcgttgtggcccta

SEQ ID NO: 7213181 - DNA, 22 bp, Homo sapiens
ctgcctagggtctggtaccaca

SEQ ID NO: 7213182 - DNA, 22 bp, Homo sapiens
ctgcctagatttgaatcctggc

SEQ ID NO: 7213183 - DNA, 22 bp, Homo sapiens
ctgcctagcgccatctgcctct

SEQ ID NO: 7213184 - DNA, 22 bp, Homo sapiens
ctgcctagggtctggtaccaca

SEQ ID NO: 7213185 - DNA, 22 bp, Homo sapiens
ctgcctagggtctggtaccaca

SEQ ID NO: 7213186 - DNA, 22 bp, Homo sapiens
ctgcctataaactgcctcaaat

SEQ ID NO: 7213187 - DNA, 22 bp, Homo sapiens
ctgccatcctcaccagagcagc

SEQ ID NO: 7213188 - DNA, 20 bp, Homo sapiens
ctgccatgattgatagagtg

SEQ ID NO: 7213189 - DNA, 22 bp, Homo sapiens
ctgccagtctatgctgctcggc

SEQ ID NO: 7213190 - DNA, 22 bp, Homo sapiens
ctgccagtgaaattgtgtcagt

SEQ ID NO: 7213191 - DNA, 22 bp, Homo sapiens
ctgccagtgaaattgtgtcagt

SEQ ID NO: 7213192 - DNA, 17 bp, Homo sapiens
ctgccagtggggaggca

SEQ ID NO: 7213193 - DNA, 18 bp, Homo sapiens
ctgccagtgtgctctccg

SEQ ID NO: 7213194 - DNA, 22 bp, Homo sapiens
ctgccatcctcaccagagcagc

SEQ ID NO: 7213195 - DNA, 22 bp, Homo sapiens
ctgccaggttggcgctcgctct

SEQ ID NO: 7213196 - DNA, 22 bp, Homo sapiens
ctgccaggttggcgctcgctct

SEQ ID NO: 7213197 - DNA, 22 bp, Homo sapiens
ctgccaggtgcctttgtgcagt

SEQ ID NO: 7213198 - DNA, 22 bp, Homo sapiens
ctgccaggtgagctccaggcct

SEQ ID NO: 7213199 - DNA, 22 bp, Homo sapiens
ctgccaggtgccagggcgcggc

SEQ ID NO: 7213200 - DNA, 22 bp, Homo sapiens
ctgccatgctcttttatgaaga

SEQ ID NO: 7213201 - DNA, 22 bp, Homo sapiens
ctgccatggtgtcccttttgca

SEQ ID NO: 7213202 - DNA, 22 bp, Homo sapiens
ctgccatgtagtctatggggcg

SEQ ID NO: 7213203 - DNA, 22 bp, Homo sapiens
ctgccctggggggcctccttgc

SEQ ID NO: 7213204 - DNA, 22 bp, Homo sapiens
ctgccctggggggcctccttgc

SEQ ID NO: 7213205 - DNA, 22 bp, Homo sapiens
ctgccctggggggcctccttgc

SEQ ID NO: 7213206 - DNA, 22 bp, Homo sapiens
ctgccctgggtgctggggatcc

SEQ ID NO: 7213207 - DNA, 22 bp, Homo sapiens
ctgccctgggtgctggggatcc

SEQ ID NO: 7213208 - DNA, 22 bp, Homo sapiens
ctgccctggtcccatggctgat

SEQ ID NO: 7213209 - DNA, 22 bp, Homo sapiens
ctgccgagtgggtcatgaggca

SEQ ID NO: 7213210 - DNA, 22 bp, Homo sapiens
ctgccctgggttttatgggagt

SEQ ID NO: 7213211 - DNA, 22 bp, Homo sapiens
ctgccgtccatctacgtctcag

SEQ ID NO: 7213212 - DNA, 22 bp, Homo sapiens
ctgccgtgtttttcatgttaaa

SEQ ID NO: 7213213 - DNA, 22 bp, Homo sapiens
ctgccgtgtttttcatgttaaa

SEQ ID NO: 7213214 - DNA, 22 bp, Homo sapiens
ctgccgtgtttttcatgttaaa

SEQ ID NO: 7213215 - DNA, 22 bp, Homo sapiens
ctgccgttgtgaagctcttaga

SEQ ID NO: 7213216 - DNA, 22 bp, Homo sapiens
ctgccgttgtgaagctcttaga

SEQ ID NO: 7213217 - DNA, 22 bp, Homo sapiens
ctgccgttgtgaagctcttaga

SEQ ID NO: 7213218 - DNA, 22 bp, Homo sapiens
ctgcctagaaaaccaggctcct

SEQ ID NO: 7213219 - DNA, 22 bp, Homo sapiens
ctgcctagatttgaatcctggc

SEQ ID NO: 7213220 - DNA, 22 bp, Homo sapiens
ctgccaggggcctcacaggcca

SEQ ID NO: 7213221 - DNA, 22 bp, Homo sapiens
ctgccaggggcctcacaggcca

SEQ ID NO: 7213222 - DNA, 22 bp, Homo sapiens
ctgccaggggcctcacaggcca

SEQ ID NO: 7213223 - DNA, 22 bp, Homo sapiens
ctgccaggggcctcacaggcca

SEQ ID NO: 7213224 - DNA, 22 bp, Homo sapiens
ctgccaggtaaactgcaggaat

SEQ ID NO: 7213225 - DNA, 22 bp, Homo sapiens
ctgccagggcatcctgtggtgg

SEQ ID NO: 7213226 - DNA, 22 bp, Homo sapiens
ctgccagggaggctgggaagtt

SEQ ID NO: 7213227 - DNA, 22 bp, Homo sapiens
ctgccagggcatcctgtggtgg

SEQ ID NO: 7213228 - DNA, 22 bp, Homo sapiens
ctgccaggcctggggtgctgtc

SEQ ID NO: 7213229 - DNA, 22 bp, Homo sapiens
ctgccaggcctggggtgctgtc

SEQ ID NO: 7213230 - DNA, 22 bp, Homo sapiens
ctgccaggcgatggattggctg

SEQ ID NO: 7213231 - DNA, 22 bp, Homo sapiens
ctgccaggcgatggattggctg

SEQ ID NO: 7213232 - DNA, 22 bp, Homo sapiens
ctgccaggcgatggattggctg

SEQ ID NO: 7213233 - DNA, 22 bp, Homo sapiens
ctgccaggctgtcccaggtccg

SEQ ID NO: 7213234 - DNA, 22 bp, Homo sapiens
ctgccaggctgtcccaggtccg

SEQ ID NO: 7213235 - DNA, 22 bp, Homo sapiens
ctgccagggaggctgggaagtt

SEQ ID NO: 7213236 - DNA, 22 bp, Homo sapiens
ctgccagggaggctgggaagtt

SEQ ID NO: 7213237 - DNA, 22 bp, Homo sapiens
ctgccagggaggctgggaagtt

SEQ ID NO: 7213238 - DNA, 22 bp, Homo sapiens
ctgccaggcctccgctgtcccc

SEQ ID NO: 7213239 - DNA, 22 bp, Homo sapiens
ctgccaggcctggggtgctgtc

SEQ ID NO: 7213240 - DNA, 22 bp, Homo sapiens
ctgccaggcctggggtgctgtc

SEQ ID NO: 7213241 - DNA, 22 bp, Homo sapiens
ctgccaggactgacgtcttcag

SEQ ID NO: 7213242 - DNA, 22 bp, Homo sapiens
ctgccagctggagaccaaggaa

SEQ ID NO: 7213243 - DNA, 22 bp, Homo sapiens
ctgccaggcctccgctgtcccc

SEQ ID NO: 7213244 - DNA, 22 bp, Homo sapiens
ctgcagcagtactcagcagcca

SEQ ID NO: 7213245 - DNA, 22 bp, Homo sapiens
ctgcagcagtagtccccaagtg

SEQ ID NO: 7213246 - DNA, 22 bp, Homo sapiens
ctgcagccacgagtcacagccc

SEQ ID NO: 7213247 - DNA, 22 bp, Homo sapiens
ctgcagccacgagtcacagccc

SEQ ID NO: 7213248 - DNA, 22 bp, Homo sapiens
ctgcagccacgagtcacagccc

SEQ ID NO: 7213249 - DNA, 22 bp, Homo sapiens
ctgcagatggtattgttctggt

SEQ ID NO: 7213250 - DNA, 22 bp, Homo sapiens
ctgcagatgtctcaattttatt

SEQ ID NO: 7213251 - DNA, 22 bp, Homo sapiens
ctgcagattggcctgatgttca

SEQ ID NO: 7213252 - DNA, 22 bp, Homo sapiens
ctgcagattggcctgatgttca

SEQ ID NO: 7213253 - DNA, 22 bp, Homo sapiens
ctgcagatttggtgtctggtga

SEQ ID NO: 7213254 - DNA, 22 bp, Homo sapiens
ctgcagatggtattgttctggt

SEQ ID NO: 7213255 - DNA, 22 bp, Homo sapiens
ctgcagaggtcttgctgatggt

SEQ ID NO: 7213256 - DNA, 22 bp, Homo sapiens
ctgcagaggttggttctaagat

SEQ ID NO: 7213257 - DNA, 22 bp, Homo sapiens
ctgcagagtggagcctcggctg

SEQ ID NO: 7213258 - DNA, 22 bp, Homo sapiens
ctgcagaggttggttctaagat

SEQ ID NO: 7213259 - DNA, 22 bp, Homo sapiens
ctgcagcaagagaagtgctgac

SEQ ID NO: 7213260 - DNA, 22 bp, Homo sapiens
ctgcagcaggaggctcctgcag

SEQ ID NO: 7213261 - DNA, 22 bp, Homo sapiens
ctgcagcagggcttgcccacct

SEQ ID NO: 7213262 - DNA, 22 bp, Homo sapiens
ctgcagcagtactcagcagcca

SEQ ID NO: 7213263 - DNA, 22 bp, Homo sapiens
ctgcagagcttgtctggatgtg

SEQ ID NO: 7213264 - DNA, 22 bp, Homo sapiens
ctgcagagcttgtctggatgtg

SEQ ID NO: 7213265 - DNA, 22 bp, Homo sapiens
ctgcagagctttctgaatgaag

SEQ ID NO: 7213266 - DNA, 22 bp, Homo sapiens
ctgcagagctaggctgagtgaa

SEQ ID NO: 7213267 - DNA, 22 bp, Homo sapiens
ctgcagagctaggctgagtgaa

SEQ ID NO: 7213268 - DNA, 22 bp, Homo sapiens
ctgcagagctaggctgagtgaa

SEQ ID NO: 7213269 - DNA, 22 bp, Homo sapiens
ctgcagagcttgtctggatgtg

SEQ ID NO: 7213270 - DNA, 22 bp, Homo sapiens
ctgcagaggcctcgcctcctct

SEQ ID NO: 7213271 - DNA, 22 bp, Homo sapiens
ctgcagaggcctcgcctcctct

SEQ ID NO: 7213272 - DNA, 22 bp, Homo sapiens
ctgcagagggtttgagcatcct

SEQ ID NO: 7213273 - DNA, 22 bp, Homo sapiens
ctgcagaggggttgaagggtcc

SEQ ID NO: 7213274 - DNA, 22 bp, Homo sapiens
ctgcagagggtttgagcatcct

SEQ ID NO: 7213275 - DNA, 22 bp, Homo sapiens
ctgcagagggtttgagcatcct

SEQ ID NO: 7213276 - DNA, 22 bp, Homo sapiens
ctggaggcacccttagagaggc

SEQ ID NO: 7213277 - DNA, 22 bp, Homo sapiens
ctggaggcaaagcagaggcatg

SEQ ID NO: 7213278 - DNA, 22 bp, Homo sapiens
ctggaggcaaagcagaggcatg

SEQ ID NO: 7213279 - DNA, 22 bp, Homo sapiens
ctggaggcaaagcagaggcatg

SEQ ID NO: 7213280 - DNA, 22 bp, Homo sapiens
ctggaggagcatggactggagt

SEQ ID NO: 7213281 - DNA, 22 bp, Homo sapiens
ctggaggagcatggactggagt

SEQ ID NO: 7213282 - DNA, 22 bp, Homo sapiens
ctggaggagcatggactggagt

SEQ ID NO: 7213283 - DNA, 22 bp, Homo sapiens
ctggaggaggaagtctacaatg

SEQ ID NO: 7213284 - DNA, 22 bp, Homo sapiens
ctggaggcaaagcagaggcatg

SEQ ID NO: 7213285 - DNA, 22 bp, Homo sapiens
ctggaggagaacttgaggaagg

SEQ ID NO: 7213286 - DNA, 22 bp, Homo sapiens
ctggaggagagtctgaatgaca

SEQ ID NO: 7213287 - DNA, 22 bp, Homo sapiens
ctggaggagagtctgaatgaca

SEQ ID NO: 7213288 - DNA, 22 bp, Homo sapiens
ctggaggagagtctgaatgaca

SEQ ID NO: 7213289 - DNA, 22 bp, Homo sapiens
ctggaggagcaatatggttagg

SEQ ID NO: 7213290 - DNA, 22 bp, Homo sapiens
ctggaggagcaatatggttagg

SEQ ID NO: 7213291 - DNA, 22 bp, Homo sapiens
ctggaggagaacttgaggaagg

SEQ ID NO: 7213292 - DNA, 22 bp, Homo sapiens
ctggaggagaacttgaggaagg

SEQ ID NO: 7213293 - DNA, 22 bp, Homo sapiens
ctggaggacccctgcctggaag

SEQ ID NO: 7213294 - DNA, 22 bp, Homo sapiens
ctggaggacccctgcctggaag

SEQ ID NO: 7213295 - DNA, 22 bp, Homo sapiens
ctggaggaccacagaagctggt

SEQ ID NO: 7213296 - DNA, 22 bp, Homo sapiens
ctggaggacccctgcctggaag

SEQ ID NO: 7213297 - DNA, 22 bp, Homo sapiens
ctggaggacccctgcctggaag

SEQ ID NO: 7213298 - DNA, 22 bp, Homo sapiens
ctggagggacaaggtatgcatt

SEQ ID NO: 7213299 - DNA, 22 bp, Homo sapiens
ctggaggctggcttcccctggc

SEQ ID NO: 7213300 - DNA, 22 bp, Homo sapiens
ctggagggacaaggtatgcatt

SEQ ID NO: 7213301 - DNA, 22 bp, Homo sapiens
ctggaggctggcttcccctggc

SEQ ID NO: 7213302 - DNA, 22 bp, Homo sapiens
ctggaggctgagttgggtctcc

SEQ ID NO: 7213303 - DNA, 22 bp, Homo sapiens
ctggaggctggcttcccctggc

SEQ ID NO: 7213304 - DNA, 22 bp, Homo sapiens
ctggaggctggcttcccctggc

SEQ ID NO: 7213305 - DNA, 22 bp, Homo sapiens
ctggaggctggcttcccctggc

SEQ ID NO: 7213306 - DNA, 22 bp, Homo sapiens
ctggaggccactgtacagattg

SEQ ID NO: 7213307 - DNA, 22 bp, Homo sapiens
ctggaggctgagttgggtctcc

SEQ ID NO: 7213308 - DNA, 22 bp, Homo sapiens
ctggaggctgagttgggtctcc

SEQ ID NO: 7213309 - DNA, 21 bp, Homo sapiens
ctggaggcaggtggtgccagg

SEQ ID NO: 7213310 - DNA, 21 bp, Homo sapiens
ctggaggcaggtggtgccagg

SEQ ID NO: 7213311 - DNA, 22 bp, Homo sapiens
ctggaggcagttgccccagtca

SEQ ID NO: 7213312 - DNA, 21 bp, Homo sapiens
ctggaggcaggtggtgccagg

SEQ ID NO: 7213313 - DNA, 21 bp, Homo sapiens
ctggaggcaggtggtgccagg

SEQ ID NO: 7213314 - DNA, 21 bp, Homo sapiens
ctggaggcaggtggtgccagg

SEQ ID NO: 7213315 - DNA, 22 bp, Homo sapiens
ctggaggcacccttagagaggc

SEQ ID NO: 7213316 - DNA, 22 bp, Homo sapiens
ctggaggaccacagaagctggt

SEQ ID NO: 7213317 - DNA, 22 bp, Homo sapiens
ctggaggacagaggccatgtct

SEQ ID NO: 7213318 - DNA, 22 bp, Homo sapiens
ctggaggaccacagaagctggt

SEQ ID NO: 7213319 - DNA, 22 bp, Homo sapiens
ctggaggaccacagaagctggt

SEQ ID NO: 7213320 - DNA, 22 bp, Homo sapiens
ctggaggaccacagaagctggt

SEQ ID NO: 7213321 - DNA, 22 bp, Homo sapiens
ctggaggaatcacagaaggctt

SEQ ID NO: 7213322 - DNA, 22 bp, Homo sapiens
ctggaggaatcacagaaggctt

SEQ ID NO: 7213323 - DNA, 22 bp, Homo sapiens
ctggaggaatcacagaaggctt

SEQ ID NO: 7213324 - DNA, 22 bp, Homo sapiens
ctggaggaatcacagaaggctt

SEQ ID NO: 7213325 - DNA, 22 bp, Homo sapiens
ctggaggaatcacagaaggctt

SEQ ID NO: 7213326 - DNA, 22 bp, Homo sapiens
ctggaggaatcacagaaggctt

SEQ ID NO: 7213327 - DNA, 22 bp, Homo sapiens
ctggaggaataatctcctaccc

SEQ ID NO: 7213328 - DNA, 22 bp, Homo sapiens
ctggaggaataatctcctaccc

SEQ ID NO: 7213329 - DNA, 22 bp, Homo sapiens
ctggaggaataatggcatcttg

SEQ ID NO: 7213330 - DNA, 22 bp, Homo sapiens
ctggaggaataatggcatcttg

SEQ ID NO: 7213331 - DNA, 22 bp, Homo sapiens
ctggagctcttctgagtgtgct

SEQ ID NO: 7213332 - DNA, 22 bp, Homo sapiens
ctggagctcttctgagtgtgct

SEQ ID NO: 7213333 - DNA, 22 bp, Homo sapiens
ctggagctctgtgtgttcctga

SEQ ID NO: 7213334 - DNA, 22 bp, Homo sapiens
ctggagaaaatccatgtgtatg

SEQ ID NO: 7213335 - DNA, 23 bp, Homo sapiens
ctggactcaggggatgtgaagga

SEQ ID NO: 7213336 - DNA, 23 bp, Homo sapiens
ctggactcaggggatgtgaagga

SEQ ID NO: 7213337 - DNA, 23 bp, Homo sapiens
ctggactcaggggatgtgaagga

SEQ ID NO: 7213338 - DNA, 22 bp, Homo sapiens
ctggactcagggtgctccagcg

SEQ ID NO: 7213339 - DNA, 22 bp, Homo sapiens
ctggactcagggtgctccagcg

SEQ ID NO: 7213340 - DNA, 22 bp, Homo sapiens
ctggactcagggtgctccagcg

SEQ ID NO: 7213341 - DNA, 22 bp, Homo sapiens
ctggactcatccatagaggtga

SEQ ID NO: 7213342 - DNA, 22 bp, Homo sapiens
ctggactctgcagagaaaagta

SEQ ID NO: 7213343 - DNA, 22 bp, Homo sapiens
ctggacagtgggcagaggagac

SEQ ID NO: 7213344 - DNA, 22 bp, Homo sapiens
ctggacatcagtgtgcctggct

SEQ ID NO: 7213345 - DNA, 22 bp, Homo sapiens
ctggacatcagtgtgcctggct

SEQ ID NO: 7213346 - DNA, 22 bp, Homo sapiens
ctggaccagaaaggacatggct

SEQ ID NO: 7213347 - DNA, 22 bp, Homo sapiens
ctggaccagaaaggacatggct

SEQ ID NO: 7213348 - DNA, 22 bp, Homo sapiens
ctggaccctgtttccctaggtc

SEQ ID NO: 7213349 - DNA, 22 bp, Homo sapiens
ctggactaggcgctggcgggcg

SEQ ID NO: 7213350 - DNA, 22 bp, Homo sapiens
ctggactaataacttcagtggg

SEQ ID NO: 7213351 - DNA, 22 bp, Homo sapiens
ctggactcactatggcttcaga

SEQ ID NO: 7213352 - DNA, 22 bp, Homo sapiens
ctggagtgtaaagagcatagaa

SEQ ID NO: 7213353 - DNA, 22 bp, Homo sapiens
ctggagtctcttctgtagctac

SEQ ID NO: 7213354 - DNA, 20 bp, Homo sapiens
ctggagtctaggagtactgg

SEQ ID NO: 7213355 - DNA, 22 bp, Homo sapiens
ctggagtgtaaagagcatagaa

SEQ ID NO: 7213356 - DNA, 20 bp, Homo sapiens
ctggagtgtagcagtggctg

SEQ ID NO: 7213357 - DNA, 20 bp, Homo sapiens
ctggagtgtagcagtggctg

SEQ ID NO: 7213358 - DNA, 20 bp, Homo sapiens
ctggagtgtagcagtggctg

SEQ ID NO: 7213359 - DNA, 22 bp, Homo sapiens
ctggagttctatgtgcttgtga

SEQ ID NO: 7213360 - DNA, 22 bp, Homo sapiens
ctggagttttggaaaaatgctt

SEQ ID NO: 7213361 - DNA, 22 bp, Homo sapiens
ctggagttagagtagacactga

SEQ ID NO: 7213362 - DNA, 22 bp, Homo sapiens
ctggagttcagtggcgtgaaca

SEQ ID NO: 7213363 - DNA, 22 bp, Homo sapiens
ctggagtctccccaggagcgtg

SEQ ID NO: 7213364 - DNA, 22 bp, Homo sapiens
ctggagtcctgcatttgctctt

SEQ ID NO: 7213365 - DNA, 22 bp, Homo sapiens
ctggagtcagcaaggacgaggc

SEQ ID NO: 7213366 - DNA, 21 bp, Homo sapiens
ctggagtcattttctgagtag

SEQ ID NO: 7213367 - DNA, 21 bp, Homo sapiens
ctggagtcattttctgagtag

SEQ ID NO: 7213368 - DNA, 22 bp, Homo sapiens
ctggagtcagcaaggacgaggc

SEQ ID NO: 7213369 - DNA, 22 bp, Homo sapiens
ctggagtcactcatgtagctgc

SEQ ID NO: 7213370 - DNA, 22 bp, Homo sapiens
ctggagtcacacacaccaaggt

SEQ ID NO: 7213371 - DNA, 22 bp, Homo sapiens
ctggaggtgcctagatgagctc

SEQ ID NO: 7213372 - DNA, 22 bp, Homo sapiens
ctggaggtgcctagatgagctc

SEQ ID NO: 7213373 - DNA, 22 bp, Homo sapiens
ctggaggtgcctagatgagctc

SEQ ID NO: 7213374 - DNA, 22 bp, Homo sapiens
ctggaggtgcttcgctggccac

SEQ ID NO: 7213375 - DNA, 22 bp, Homo sapiens
ctggaggttgggtccaggccag

SEQ ID NO: 7213376 - DNA, 22 bp, Homo sapiens
ctggagtaagttaagatgttcc

SEQ ID NO: 7213377 - DNA, 22 bp, Homo sapiens
ctggagtagccggacgggtctg

SEQ ID NO: 7213378 - DNA, 22 bp, Homo sapiens
ctggagggtgagcctcatctct

SEQ ID NO: 7213379 - DNA, 22 bp, Homo sapiens
ctggagggtgagcctcatctct

SEQ ID NO: 7213380 - DNA, 22 bp, Homo sapiens
ctggagggtggagagaagtctc

SEQ ID NO: 7213381 - DNA, 22 bp, Homo sapiens
ctggagggtggagagaagtctc

SEQ ID NO: 7213382 - DNA, 22 bp, Homo sapiens
ctggagggtggagagaagtctc

SEQ ID NO: 7213383 - DNA, 22 bp, Homo sapiens
ctggaggtaagaggccctgggc

SEQ ID NO: 7213384 - DNA, 22 bp, Homo sapiens
ctggaggtctacagtggtagct

SEQ ID NO: 7213385 - DNA, 21 bp, Homo sapiens
ctggagggtagagttgggctg

SEQ ID NO: 7213386 - DNA, 22 bp, Homo sapiens
ctggagggtgagcctcatctct

SEQ ID NO: 7213387 - DNA, 21 bp, Homo sapiens
ctggagggtagagttgggctg

SEQ ID NO: 7213388 - DNA, 22 bp, Homo sapiens
ctggagggtgagcctcatctct

SEQ ID NO: 7213389 - DNA, 21 bp, Homo sapiens
ctggagggtagagttgggctg

SEQ ID NO: 7213390 - DNA, 21 bp, Homo sapiens
ctggagggtagagttgggctg

SEQ ID NO: 7213391 - DNA, 21 bp, Homo sapiens
ctggagggtagagttgggctg

SEQ ID NO: 7213392 - DNA, 22 bp, Homo sapiens
ctggagggggaaatgttcattg

SEQ ID NO: 7213393 - DNA, 22 bp, Homo sapiens
ctggagggggaaatgttcattg

SEQ ID NO: 7213394 - DNA, 21 bp, Homo sapiens
ctggagggtagagttgggctg

SEQ ID NO: 7213395 - DNA, 21 bp, Homo sapiens
ctggagggtagagttgggctg

SEQ ID NO: 7213396 - DNA, 21 bp, Homo sapiens
ctggagggtagagttgggctg

SEQ ID NO: 7213397 - DNA, 22 bp, Homo sapiens
ctggaggggccatccacagtct

SEQ ID NO: 7213398 - DNA, 22 bp, Homo sapiens
ctggaggggccatccacagtct

SEQ ID NO: 7213399 - DNA, 22 bp, Homo sapiens
ctggagggcttctgcaggttac

SEQ ID NO: 7213400 - DNA, 22 bp, Homo sapiens
ctggagggcttctgcaggttac

SEQ ID NO: 7213401 - DNA, 22 bp, Homo sapiens
ctggaggggccatccacagtct

SEQ ID NO: 7213402 - DNA, 22 bp, Homo sapiens
ctggaggggccatccacagtct

SEQ ID NO: 7213403 - DNA, 22 bp, Homo sapiens
ctggaggggccatccacagtct

SEQ ID NO: 7213404 - DNA, 22 bp, Homo sapiens
ctggaggggctggcatggtagc

SEQ ID NO: 7213405 - DNA, 22 bp, Homo sapiens
ctggaggggctggcatggtagc

SEQ ID NO: 7213406 - DNA, 22 bp, Homo sapiens
ctggaggggctggcatggtagc

SEQ ID NO: 7213407 - DNA, 22 bp, Homo sapiens
ctggagggggaaatgttcattg

SEQ ID NO: 7213408 - DNA, 22 bp, Homo sapiens
ctggaggggctggcatggtagc

SEQ ID NO: 7213409 - DNA, 22 bp, Homo sapiens
ctggagggcttctgcaggttac

SEQ ID NO: 7213410 - DNA, 22 bp, Homo sapiens
ctggagggcttctgcaggttac

SEQ ID NO: 7213411 - DNA, 22 bp, Homo sapiens
ctggagggctggactaaggaaa

SEQ ID NO: 7213412 - DNA, 22 bp, Homo sapiens
ctggagggcttctgcaggttac

SEQ ID NO: 7213413 - DNA, 22 bp, Homo sapiens
ctggagggctggactaaggaaa

SEQ ID NO: 7213414 - DNA, 22 bp, Homo sapiens
ctggagggactttctcacggat

SEQ ID NO: 7213415 - DNA, 22 bp, Homo sapiens
ctggagggactttctcacggat

SEQ ID NO: 7213416 - DNA, 22 bp, Homo sapiens
ctggagggactttctcacggat

SEQ ID NO: 7213417 - DNA, 22 bp, Homo sapiens
ctggagggactttctcacggat

SEQ ID NO: 7213418 - DNA, 22 bp, Homo sapiens
ctggagggactttctcacggat

SEQ ID NO: 7213419 - DNA, 22 bp, Homo sapiens
ctggagggactttctcacggat

SEQ ID NO: 7213420 - DNA, 22 bp, Homo sapiens
ctggagggacaaggtatgcatt

SEQ ID NO: 7213421 - DNA, 22 bp, Homo sapiens
ctggagggacaaggtatgcatt

SEQ ID NO: 7213422 - DNA, 22 bp, Homo sapiens
ctggagggactttctcacggat

SEQ ID NO: 7213423 - DNA, 22 bp, Homo sapiens
ctggagggactttctcacggat

SEQ ID NO: 7213424 - DNA, 22 bp, Homo sapiens
ctggaatgttctccagcatggc

SEQ ID NO: 7213425 - DNA, 22 bp, Homo sapiens
ctggaatgttctccagcatggc

SEQ ID NO: 7213426 - DNA, 22 bp, Homo sapiens
ctggacagaaaaggccactgga

SEQ ID NO: 7213427 - DNA, 16 bp, Homo sapiens
ctggacagaaaaacct

SEQ ID NO: 7213428 - DNA, 23 bp, Homo sapiens
ctggaagtgcttttatagctttg

SEQ ID NO: 7213429 - DNA, 22 bp, Homo sapiens
ctggaagtataggggagatgat

SEQ ID NO: 7213430 - DNA, 22 bp, Homo sapiens
ctggaaagtacagtgtgtcaca

SEQ ID NO: 7213431 - DNA, 22 bp, Homo sapiens
ctggaaagtacagtgtgtcaca

SEQ ID NO: 7213432 - DNA, 22 bp, Homo sapiens
ctggaaagtagacaatctaaaa

SEQ ID NO: 7213433 - DNA, 22 bp, Homo sapiens
ctggaaagtagatgtactaagg

SEQ ID NO: 7213434 - DNA, 22 bp, Homo sapiens
ctggacagaaagggctgctgtg

SEQ ID NO: 7213435 - DNA, 22 bp, Homo sapiens
ctggacagaaaccagtcctggg

SEQ ID NO: 7213436 - DNA, 22 bp, Homo sapiens
ctggacagaaagggctgctgtg

SEQ ID NO: 7213437 - DNA, 22 bp, Homo sapiens
ctggacagaaaccagtcctggg

SEQ ID NO: 7213438 - DNA, 22 bp, Homo sapiens
ctggacagaaaccagtcctggg

SEQ ID NO: 7213439 - DNA, 22 bp, Homo sapiens
ctggacagaagtggctgggcag

SEQ ID NO: 7213440 - DNA, 22 bp, Homo sapiens
ctggacagaagtggctgggcag

SEQ ID NO: 7213441 - DNA, 22 bp, Homo sapiens
ctggacagaaagggctgctgtg

SEQ ID NO: 7213442 - DNA, 22 bp, Homo sapiens
ctggacagaaagggctgctgtg

SEQ ID NO: 7213443 - DNA, 22 bp, Homo sapiens
ctggacagaaagggctgctgtg

SEQ ID NO: 7213444 - DNA, 22 bp, Homo sapiens
ctggacagaagtggctgggcag

SEQ ID NO: 7213445 - DNA, 22 bp, Homo sapiens
ctggacagaagtggctgggcag

SEQ ID NO: 7213446 - DNA, 22 bp, Homo sapiens
ctggacagaagtggctgggcag

SEQ ID NO: 7213447 - DNA, 22 bp, Homo sapiens
ctggacaggctggggactgcaa

SEQ ID NO: 7213448 - DNA, 22 bp, Homo sapiens
ctggacaggctggggactgcaa

SEQ ID NO: 7213449 - DNA, 22 bp, Homo sapiens
ctggacaggctggggactgcaa

SEQ ID NO: 7213450 - DNA, 22 bp, Homo sapiens
ctggacagtgctgcttgagatg

SEQ ID NO: 7213451 - DNA, 22 bp, Homo sapiens
ctggacagtgctgcttgagatg

SEQ ID NO: 7213452 - DNA, 22 bp, Homo sapiens
ctggacagtgggcagaggagac

SEQ ID NO: 7213453 - DNA, 22 bp, Homo sapiens
ctggacagtgggcagaggagac

SEQ ID NO: 7213454 - DNA, 22 bp, Homo sapiens
ctggacagtgggcagaggagac

SEQ ID NO: 7213455 - DNA, 22 bp, Homo sapiens
ctggacagaagtggctgggcag

SEQ ID NO: 7213456 - DNA, 22 bp, Homo sapiens
ctggacagatcccttgtagctt

SEQ ID NO: 7213457 - DNA, 22 bp, Homo sapiens
ctggacagatcccttgtagctt

SEQ ID NO: 7213458 - DNA, 22 bp, Homo sapiens
ctggacagccctcactgtgtgc

SEQ ID NO: 7213459 - DNA, 22 bp, Homo sapiens
ctggacagccctcactgtgtgc

SEQ ID NO: 7213460 - DNA, 22 bp, Homo sapiens
ctggacagccctcactgtgtgc

SEQ ID NO: 7213461 - DNA, 22 bp, Homo sapiens
ctggacaggaagaattgggagc

SEQ ID NO: 7213462 - DNA, 22 bp, Homo sapiens
ctggacaggctggggactgcaa

SEQ ID NO: 7213463 - DNA, 22 bp, Homo sapiens
ctggaaagatttctttggagtc

SEQ ID NO: 7213464 - DNA, 22 bp, Homo sapiens
ctggaaagatttctttggagtc

SEQ ID NO: 7213465 - DNA, 22 bp, Homo sapiens
ctggaaagctgcaggacccaga

SEQ ID NO: 7213466 - DNA, 16 bp, Homo sapiens
ctggaaaggctagctc

SEQ ID NO: 7213467 - DNA, 22 bp, Homo sapiens
ctggaaagggtcctcattctgt

SEQ ID NO: 7213468 - DNA, 22 bp, Homo sapiens
ctggaaagggtcctcattctgt

SEQ ID NO: 7213469 - DNA, 22 bp, Homo sapiens
ctggaaagggtcctcattctgt

SEQ ID NO: 7213470 - DNA, 22 bp, Homo sapiens
ctggaaagacagagggcatggg

SEQ ID NO: 7213471 - DNA, 22 bp, Homo sapiens
ctggaaagacagagggcatggg

SEQ ID NO: 7213472 - DNA, 22 bp, Homo sapiens
ctggaaagacctgcttgctttt

SEQ ID NO: 7213473 - DNA, 22 bp, Homo sapiens
ctggaaagagatggcagggttt

SEQ ID NO: 7213474 - DNA, 22 bp, Homo sapiens
ctggaaagagatggcagggttt

SEQ ID NO: 7213475 - DNA, 22 bp, Homo sapiens
ctggaaagagatggcagggttt

SEQ ID NO: 7213476 - DNA, 22 bp, Homo sapiens
ctggaaagatttacacggggaa

SEQ ID NO: 7213477 - DNA, 22 bp, Homo sapiens
ctggaaagatttacacggggaa

SEQ ID NO: 7213478 - DNA, 22 bp, Homo sapiens
ctgctttgtgtggtccctccag

SEQ ID NO: 7213479 - DNA, 22 bp, Homo sapiens
ctgcttttgagcccagtgctca

SEQ ID NO: 7213480 - DNA, 22 bp, Homo sapiens
ctgctttttctaggaggacaat

SEQ ID NO: 7213481 - DNA, 22 bp, Homo sapiens
ctgctttttctaggaggacaat

SEQ ID NO: 7213482 - DNA, 22 bp, Homo sapiens
ctgctttttgtaggtcccagag

SEQ ID NO: 7213483 - DNA, 22 bp, Homo sapiens
ctggaaaatgaagaagcagagg

SEQ ID NO: 7213484 - DNA, 20 bp, Homo sapiens
ctggaaaccctgctgatggt

SEQ ID NO: 7213485 - DNA, 22 bp, Homo sapiens
ctggaaagacagagggcatggg

SEQ ID NO: 7213486 - DNA, 17 bp, Homo sapiens
ctgctttgtgcaacgct

SEQ ID NO: 7213487 - DNA, 17 bp, Homo sapiens
ctgctttgtgcaacgct

SEQ ID NO: 7213488 - DNA, 22 bp, Homo sapiens
ctgctttgtaaaatagacataa

SEQ ID NO: 7213489 - DNA, 17 bp, Homo sapiens
ctgctttgtgcaacgct

SEQ ID NO: 7213490 - DNA, 22 bp, Homo sapiens
ctgctttgtggaatcacactgg

SEQ ID NO: 7213491 - DNA, 22 bp, Homo sapiens
ctgctttgtggaatcacactgg

SEQ ID NO: 7213492 - DNA, 22 bp, Homo sapiens
ctgctttgtggaatcacactgg

SEQ ID NO: 7213493 - DNA, 22 bp, Homo sapiens
ctgctttggctcagtgacatca

SEQ ID NO: 7213494 - DNA, 18 bp, Homo sapiens
ctgctttgccttcattcc

SEQ ID NO: 7213495 - DNA, 18 bp, Homo sapiens
ctgctttgccttcattcc

SEQ ID NO: 7213496 - DNA, 18 bp, Homo sapiens
ctgctttgccttcattcc

SEQ ID NO: 7213497 - DNA, 22 bp, Homo sapiens
ctgctttggacaactattcttg

SEQ ID NO: 7213498 - DNA, 22 bp, Homo sapiens
ctgctttcttgttgcatcttaa

SEQ ID NO: 7213499 - DNA, 22 bp, Homo sapiens
ctgctttcttgttgcatcttaa

SEQ ID NO: 7213500 - DNA, 22 bp, Homo sapiens
ctgctttgaaaataaacttgtc

SEQ ID NO: 7213501 - DNA, 22 bp, Homo sapiens
ctgctttgaaaataaacttgtc

SEQ ID NO: 7213502 - DNA, 22 bp, Homo sapiens
ctgctttgactgttaagaacca

SEQ ID NO: 7213503 - DNA, 22 bp, Homo sapiens
ctgctttgactgttaagaacca

SEQ ID NO: 7213504 - DNA, 22 bp, Homo sapiens
ctgctttgaggggctctgtata

SEQ ID NO: 7213505 - DNA, 22 bp, Homo sapiens
ctgctttgaggggctctgtata

SEQ ID NO: 7213506 - DNA, 22 bp, Homo sapiens
ctgctttgaggggctctgtata

SEQ ID NO: 7213507 - DNA, 22 bp, Homo sapiens
ctgctttgattagaagagtaca

SEQ ID NO: 7213508 - DNA, 22 bp, Homo sapiens
ctgctttgattagaagagtaca

SEQ ID NO: 7213509 - DNA, 22 bp, Homo sapiens
ctgctttgcatagctgccagag

SEQ ID NO: 7213510 - DNA, 22 bp, Homo sapiens
ctgctttgcatagctgccagag

SEQ ID NO: 7213511 - DNA, 22 bp, Homo sapiens
ctgcctgctcaccagggctctg

SEQ ID NO: 7213512 - DNA, 22 bp, Homo sapiens
ctgcctgctcaccagggctctg

SEQ ID NO: 7213513 - DNA, 22 bp, Homo sapiens
ctgcctgctcaccagggctctg

SEQ ID NO: 7213514 - DNA, 22 bp, Homo sapiens
ctgcctgctcaccagggctctg

SEQ ID NO: 7213515 - DNA, 22 bp, Homo sapiens
ctgcctgctacctgaaatgcca

SEQ ID NO: 7213516 - DNA, 22 bp, Homo sapiens
ctgcctgctacctgaaatgcca

SEQ ID NO: 7213517 - DNA, 22 bp, Homo sapiens
ctgcctgcgttgcctcgtgcct

SEQ ID NO: 7213518 - DNA, 22 bp, Homo sapiens
ctgcctggaatgccagcttctc

SEQ ID NO: 7213519 - DNA, 22 bp, Homo sapiens
ctgcctggaaggagcaagggga

SEQ ID NO: 7213520 - DNA, 22 bp, Homo sapiens
ctgcctgctcaccagggctctg

SEQ ID NO: 7213521 - DNA, 22 bp, Homo sapiens
ctgcctgctctatccaggcctg

SEQ ID NO: 7213522 - DNA, 22 bp, Homo sapiens
ctgcctgctctatccaggcctg

SEQ ID NO: 7213523 - DNA, 22 bp, Homo sapiens
ctgcctggagcattctgaaggt

SEQ ID NO: 7213524 - DNA, 22 bp, Homo sapiens
ctgcctggaccggcagccctcc

SEQ ID NO: 7213525 - DNA, 22 bp, Homo sapiens
ctgcctggaccggcagccctcc

SEQ ID NO: 7213526 - DNA, 22 bp, Homo sapiens
ctgcctggagcattctgaaggt

SEQ ID NO: 7213527 - DNA, 22 bp, Homo sapiens
ctgcctggagcattctgaaggt

SEQ ID NO: 7213528 - DNA, 22 bp, Homo sapiens
ctgcctggaccggcagccctcc

SEQ ID NO: 7213529 - DNA, 22 bp, Homo sapiens
ctgcctggatgaatggcgcctt

SEQ ID NO: 7213530 - DNA, 22 bp, Homo sapiens
ctgcctggatgaatggcgcctt

SEQ ID NO: 7213531 - DNA, 22 bp, Homo sapiens
ctgcctggatgaatggcgcctt

SEQ ID NO: 7213532 - DNA, 20 bp, Homo sapiens
ctgcctggaggcctctacct

SEQ ID NO: 7213533 - DNA, 20 bp, Homo sapiens
ctgcctggaggcctctacct

SEQ ID NO: 7213534 - DNA, 17 bp, Homo sapiens
ctgcctggagtcccatc

SEQ ID NO: 7213535 - DNA, 22 bp, Homo sapiens
ctgcctggcatggagaagagaa

SEQ ID NO: 7213536 - DNA, 22 bp, Homo sapiens
ctgcctggcatggagaagagaa

SEQ ID NO: 7213537 - DNA, 22 bp, Homo sapiens
ctgcctggccacaacccagggt

SEQ ID NO: 7213538 - DNA, 22 bp, Homo sapiens
ctgcctggcatggagaagagaa

SEQ ID NO: 7213539 - DNA, 22 bp, Homo sapiens
ctgcctggcatagtctggtcga

SEQ ID NO: 7213540 - DNA, 23 bp, Homo sapiens
ctgctttcccactccatgctctt

SEQ ID NO: 7213541 - DNA, 23 bp, Homo sapiens
ctgctttcccactccatgctctt

SEQ ID NO: 7213542 - DNA, 22 bp, Homo sapiens
ctgctttatagggcttccatgt

SEQ ID NO: 7213543 - DNA, 22 bp, Homo sapiens
ctgctttaggtggaatgttcta

SEQ ID NO: 7213544 - DNA, 22 bp, Homo sapiens
ctgctttagtgtggtgttagag

SEQ ID NO: 7213545 - DNA, 21 bp, Homo sapiens
ctgctttacttcagaggatct

SEQ ID NO: 7213546 - DNA, 22 bp, Homo sapiens
ctgctttagagctgagcctcag

SEQ ID NO: 7213547 - DNA, 22 bp, Homo sapiens
ctgcttctaagaacctgcagct

SEQ ID NO: 7213548 - DNA, 22 bp, Homo sapiens
ctgcttctaagaacctgcagct

SEQ ID NO: 7213549 - DNA, 23 bp, Homo sapiens
ctgcttccttgcttcattgctgg

SEQ ID NO: 7213550 - DNA, 22 bp, Homo sapiens
ctgcttctaagaacctgcagct

SEQ ID NO: 7213551 - DNA, 22 bp, Homo sapiens
ctgcttctaagaacctgcagct

SEQ ID NO: 7213552 - DNA, 22 bp, Homo sapiens
ctgcctgggccggccaccctct

SEQ ID NO: 7213553 - DNA, 19 bp, Homo sapiens
ctgcttccttccctcactg

SEQ ID NO: 7213554 - DNA, 22 bp, Homo sapiens
ctgcctggggaatgtgaggatt

SEQ ID NO: 7213555 - DNA, 22 bp, Homo sapiens
ctgcctgggccatgcccagtcc

SEQ ID NO: 7213556 - DNA, 22 bp, Homo sapiens
ctgcctggcccagggatgggcc

SEQ ID NO: 7213557 - DNA, 22 bp, Homo sapiens
ctgcctggcccagggatgggcc

SEQ ID NO: 7213558 - DNA, 22 bp, Homo sapiens
ctgcctggccacaacccagggt

SEQ ID NO: 7213559 - DNA, 22 bp, Homo sapiens
ctgcctggcctgatctccacgc

SEQ ID NO: 7213560 - DNA, 22 bp, Homo sapiens
ctgcctggcctgatctccacgc

SEQ ID NO: 7213561 - DNA, 22 bp, Homo sapiens
ctgcctgggccatgcccagtcc

SEQ ID NO: 7213562 - DNA, 22 bp, Homo sapiens
ctgcctgggccatgcccagtcc

SEQ ID NO: 7213563 - DNA, 22 bp, Homo sapiens
ctgcctgggccatgcccagtcc

SEQ ID NO: 7213564 - DNA, 22 bp, Homo sapiens
ctggcccagagagcagagctta

SEQ ID NO: 7213565 - DNA, 22 bp, Homo sapiens
ctggcccagagagcagagctta

SEQ ID NO: 7213566 - DNA, 22 bp, Homo sapiens
ctggccatgttgcctctgagac

SEQ ID NO: 7213567 - DNA, 22 bp, Homo sapiens
ctggccagttgtcctggcttgg

SEQ ID NO: 7213568 - DNA, 22 bp, Homo sapiens
ctggccataggttctcagtgtg

SEQ ID NO: 7213569 - DNA, 22 bp, Homo sapiens
ctggccagttgtcctggcttgg

SEQ ID NO: 7213570 - DNA, 22 bp, Homo sapiens
ctggccagttgccttcctgggt

SEQ ID NO: 7213571 - DNA, 17 bp, Homo sapiens
ctggccagtgtacttgg

SEQ ID NO: 7213572 - DNA, 22 bp, Homo sapiens
ctggccagtgtggctctgatct

SEQ ID NO: 7213573 - DNA, 22 bp, Homo sapiens
ctggccagtgtggctctgatct

SEQ ID NO: 7213574 - DNA, 22 bp, Homo sapiens
ctggcccaggagagcaggcatt

SEQ ID NO: 7213575 - DNA, 22 bp, Homo sapiens
ctggcccaggagagcaggcatt

SEQ ID NO: 7213576 - DNA, 22 bp, Homo sapiens
ctggcccagagagcagagctta

SEQ ID NO: 7213577 - DNA, 22 bp, Homo sapiens
ctggcccagagctctggccttt

SEQ ID NO: 7213578 - DNA, 22 bp, Homo sapiens
ctggcccagagctctggccttt

SEQ ID NO: 7213579 - DNA, 22 bp, Homo sapiens
ctggcccagagctctggccttt

SEQ ID NO: 7213580 - DNA, 22 bp, Homo sapiens
ctggcccaggctcctggggcac

SEQ ID NO: 7213581 - DNA, 22 bp, Homo sapiens
ctggcccaggctcctggggcac

SEQ ID NO: 7213582 - DNA, 21 bp, Homo sapiens
ctggcccagggatctgcattt

SEQ ID NO: 7213583 - DNA, 21 bp, Homo sapiens
ctggcccagggatctgcattt

SEQ ID NO: 7213584 - DNA, 22 bp, Homo sapiens
ctggcctgaggccgccttcaga

SEQ ID NO: 7213585 - DNA, 22 bp, Homo sapiens
ctggcctgaggccgccttcaga

SEQ ID NO: 7213586 - DNA, 22 bp, Homo sapiens
ctggcctgaggccgccttcaga

SEQ ID NO: 7213587 - DNA, 22 bp, Homo sapiens
ctggcctgaggtcggctgtagg

SEQ ID NO: 7213588 - DNA, 22 bp, Homo sapiens
ctggcctgaggtcggctgtagg

SEQ ID NO: 7213589 - DNA, 22 bp, Homo sapiens
ctggcctgagcacagcggctgc

SEQ ID NO: 7213590 - DNA, 22 bp, Homo sapiens
ctggcctgagcacagcggctgc

SEQ ID NO: 7213591 - DNA, 22 bp, Homo sapiens
ctggcctgagcacagcggctgc

SEQ ID NO: 7213592 - DNA, 22 bp, Homo sapiens
ctggcctgagcacagcggctgc

SEQ ID NO: 7213593 - DNA, 22 bp, Homo sapiens
ctggccctgtggaggcaggaac

SEQ ID NO: 7213594 - DNA, 22 bp, Homo sapiens
ctggccctgtggaggcaggaac

SEQ ID NO: 7213595 - DNA, 22 bp, Homo sapiens
ctggccctgtggaggcaggaac

SEQ ID NO: 7213596 - DNA, 22 bp, Homo sapiens
ctggccctgtggcctaaggact

SEQ ID NO: 7213597 - DNA, 22 bp, Homo sapiens
ctggccctgtggcctaaggact

SEQ ID NO: 7213598 - DNA, 22 bp, Homo sapiens
ctggccctgtggcctaaggact

SEQ ID NO: 7213599 - DNA, 22 bp, Homo sapiens
ctggccctgtggcctaaggact

SEQ ID NO: 7213600 - DNA, 22 bp, Homo sapiens
ctggcccttaggaaaacaaagt

SEQ ID NO: 7213601 - DNA, 22 bp, Homo sapiens
ctggcccttctcttgcttcctg

SEQ ID NO: 7213602 - DNA, 22 bp, Homo sapiens
ctggcctgagaatgctaccctt

SEQ ID NO: 7213603 - DNA, 22 bp, Homo sapiens
ctggcctgagaatgctaccctt

SEQ ID NO: 7213604 - DNA, 22 bp, Homo sapiens
ctggcctgagaatgctaccctt

SEQ ID NO: 7213605 - DNA, 22 bp, Homo sapiens
ctggcctgcctgccggttgtcg

SEQ ID NO: 7213606 - DNA, 22 bp, Homo sapiens
ctggcctgcctgccggttgtcg

SEQ ID NO: 7213607 - DNA, 22 bp, Homo sapiens
ctggcctgcagatcccagggtc

SEQ ID NO: 7213608 - DNA, 22 bp, Homo sapiens
ctggcctgatctcatgctgtcc

SEQ ID NO: 7213609 - DNA, 22 bp, Homo sapiens
ctggcctgatctcatgctgtcc

SEQ ID NO: 7213610 - DNA, 22 bp, Homo sapiens
ctggcctgatctcatgctgtcc

SEQ ID NO: 7213611 - DNA, 22 bp, Homo sapiens
ctggcctgcagatcccagggtc

SEQ ID NO: 7213612 - DNA, 22 bp, Homo sapiens
ctggcctgcagatcccagggtc

SEQ ID NO: 7213613 - DNA, 22 bp, Homo sapiens
ctggcctgcagatcccagggtc

SEQ ID NO: 7213614 - DNA, 22 bp, Homo sapiens
ctggcctggcagggagggcatg

SEQ ID NO: 7213615 - DNA, 22 bp, Homo sapiens
ctggcctggcagggagggcatg

SEQ ID NO: 7213616 - DNA, 22 bp, Homo sapiens
ctggcctgctgggtgaggtcct

SEQ ID NO: 7213617 - DNA, 22 bp, Homo sapiens
ctggcctggagcctctgggtgg

SEQ ID NO: 7213618 - DNA, 22 bp, Homo sapiens
ctggcctggagcctctgggtgg

SEQ ID NO: 7213619 - DNA, 22 bp, Homo sapiens
ctggcctggagcctctgggtgg

SEQ ID NO: 7213620 - DNA, 22 bp, Homo sapiens
ctggcctggcagggagggcatg

SEQ ID NO: 7213621 - DNA, 22 bp, Homo sapiens
ctggcctggcaggggacctcta

SEQ ID NO: 7213622 - DNA, 22 bp, Homo sapiens
ctggcctggcaggggacctcta

SEQ ID NO: 7213623 - DNA, 22 bp, Homo sapiens
ctggctcgcattatattttggg

SEQ ID NO: 7213624 - DNA, 22 bp, Homo sapiens
ctggctcgcattatattttggg

SEQ ID NO: 7213625 - DNA, 22 bp, Homo sapiens
ctggctctaagtgtcagctccc

SEQ ID NO: 7213626 - DNA, 22 bp, Homo sapiens
ctggctctaagtgtcagctccc

SEQ ID NO: 7213627 - DNA, 22 bp, Homo sapiens
ctggctctatctccaaggctgg

SEQ ID NO: 7213628 - DNA, 22 bp, Homo sapiens
ctggctctaagtgtcagctccc

SEQ ID NO: 7213629 - DNA, 22 bp, Homo sapiens
ctggctcgcattatattttggg

SEQ ID NO: 7213630 - DNA, 22 bp, Homo sapiens
ctggctcctctacacacccaaa

SEQ ID NO: 7213631 - DNA, 22 bp, Homo sapiens
ctggctcctctacacacccaaa

SEQ ID NO: 7213632 - DNA, 22 bp, Homo sapiens
ctggctcctgaggcttggcccc

SEQ ID NO: 7213633 - DNA, 22 bp, Homo sapiens
ctggctcctgaggcttggcccc

SEQ ID NO: 7213634 - DNA, 22 bp, Homo sapiens
ctggctcctgaggcttggcccc

SEQ ID NO: 7213635 - DNA, 22 bp, Homo sapiens
ctggctctatctccaaggctgg

SEQ ID NO: 7213636 - DNA, 22 bp, Homo sapiens
ctggctctatctccaaggctgg

SEQ ID NO: 7213637 - DNA, 22 bp, Homo sapiens
ctggctctatctccaaggctgg

SEQ ID NO: 7213638 - DNA, 22 bp, Homo sapiens
ctggctctattccctaaggatg

SEQ ID NO: 7213639 - DNA, 22 bp, Homo sapiens
ctggctctcaggctggtcccca

SEQ ID NO: 7213640 - DNA, 22 bp, Homo sapiens
ctggctctcgctgggagtactt

SEQ ID NO: 7213641 - DNA, 22 bp, Homo sapiens
ctggctctcgctgggagtactt

SEQ ID NO: 7213642 - DNA, 22 bp, Homo sapiens
ctggctctctgagatattgagt

SEQ ID NO: 7213643 - DNA, 22 bp, Homo sapiens
ctggctctctgatttcacattc

SEQ ID NO: 7213644 - DNA, 22 bp, Homo sapiens
ctggctctctgatttcacattc

SEQ ID NO: 7213645 - DNA, 22 bp, Homo sapiens
ctggctctgagtggtatcttga

SEQ ID NO: 7213646 - DNA, 22 bp, Homo sapiens
ctggctctgagtggctctaatt

SEQ ID NO: 7213647 - DNA, 22 bp, Homo sapiens
ctggctctgcaacccccacaca

SEQ ID NO: 7213648 - DNA, 22 bp, Homo sapiens
ctggctctgggcctcagacact

SEQ ID NO: 7213649 - DNA, 22 bp, Homo sapiens
ctggctctgaccgcgctggcct

SEQ ID NO: 7213650 - DNA, 22 bp, Homo sapiens
ctggctctgaccgcgctggcct

SEQ ID NO: 7213651 - DNA, 22 bp, Homo sapiens
ctggctctgagcccacctccag

SEQ ID NO: 7213652 - DNA, 22 bp, Homo sapiens
ctggctctgactccgcatattt

SEQ ID NO: 7213653 - DNA, 22 bp, Homo sapiens
ctggctctgagcccacctccag

SEQ ID NO: 7213654 - DNA, 22 bp, Homo sapiens
ctggctctgagcccacctccag

SEQ ID NO: 7213655 - DNA, 22 bp, Homo sapiens
ctggctctgagcccacctccag

SEQ ID NO: 7213656 - DNA, 22 bp, Homo sapiens
ctggctctgagtggctctaatt

SEQ ID NO: 7213657 - DNA, 22 bp, Homo sapiens
ctggctctgggctaagctccca

SEQ ID NO: 7213658 - DNA, 22 bp, Homo sapiens
ctggctctgggctaagctccca

SEQ ID NO: 7213659 - DNA, 23 bp, Homo sapiens
ctggctctgtaggtggcatcctt

SEQ ID NO: 7213660 - DNA, 22 bp, Homo sapiens
ctggctctgtcaccctttctcc

SEQ ID NO: 7213661 - DNA, 23 bp, Homo sapiens
ctggctctgtaggtggcatcctt

SEQ ID NO: 7213662 - DNA, 22 bp, Homo sapiens
ctggctctgtcaccctttctcc

SEQ ID NO: 7213663 - DNA, 22 bp, Homo sapiens
ctggctctgtcaccctttctcc

SEQ ID NO: 7213664 - DNA, 22 bp, Homo sapiens
ctggctctgtggcttccttcat

SEQ ID NO: 7213665 - DNA, 22 bp, Homo sapiens
ctggctctgtggcttccttcat

SEQ ID NO: 7213666 - DNA, 22 bp, Homo sapiens
ctggctctgtgggacctggcct

SEQ ID NO: 7213667 - DNA, 22 bp, Homo sapiens
ctggctcctcaggactgcggga

SEQ ID NO: 7213668 - DNA, 22 bp, Homo sapiens
ctggctcctcagtattccactt

SEQ ID NO: 7213669 - DNA, 22 bp, Homo sapiens
ctggctcctccaaggcctggag

SEQ ID NO: 7213670 - DNA, 22 bp, Homo sapiens
ctggctccctggacatggggcc

SEQ ID NO: 7213671 - DNA, 22 bp, Homo sapiens
ctggctccctggacatggggcc

SEQ ID NO: 7213672 - DNA, 22 bp, Homo sapiens
ctggctccctggacatggggcc

SEQ ID NO: 7213673 - DNA, 22 bp, Homo sapiens
ctggctccctggacatggggcc

SEQ ID NO: 7213674 - DNA, 22 bp, Homo sapiens
ctggctccaggtcatgcactca

SEQ ID NO: 7213675 - DNA, 22 bp, Homo sapiens
ctggctccctcgctgaggtgct

SEQ ID NO: 7213676 - DNA, 22 bp, Homo sapiens
ctggctccctctccctgagtca

SEQ ID NO: 7213677 - DNA, 22 bp, Homo sapiens
ctggctccctctccctgagtca

SEQ ID NO: 7213678 - DNA, 22 bp, Homo sapiens
ctggctccactccctgcctgac

SEQ ID NO: 7213679 - DNA, 22 bp, Homo sapiens
ctggctccactccctgcctgac

SEQ ID NO: 7213680 - DNA, 22 bp, Homo sapiens
ctggctccaggtcatgcactca

SEQ ID NO: 7213681 - DNA, 22 bp, Homo sapiens
ctggctccaggtcatgcactca

SEQ ID NO: 7213682 - DNA, 22 bp, Homo sapiens
ctggctccaggtcatgcactca

SEQ ID NO: 7213683 - DNA, 22 bp, Homo sapiens
ctggcctggggcctcagctgct

SEQ ID NO: 7213684 - DNA, 22 bp, Homo sapiens
ctggcctggggcctcagctgct

SEQ ID NO: 7213685 - DNA, 22 bp, Homo sapiens
ctggcctggggggacacatccc

SEQ ID NO: 7213686 - DNA, 22 bp, Homo sapiens
ctggcctggggggacacatccc

SEQ ID NO: 7213687 - DNA, 22 bp, Homo sapiens
ctggcctggtctggcctctcca

SEQ ID NO: 7213688 - DNA, 22 bp, Homo sapiens
ctggcctggtctggcctctcca

SEQ ID NO: 7213689 - DNA, 22 bp, Homo sapiens
ctggcctggtctggcctctcca

SEQ ID NO: 7213690 - DNA, 22 bp, Homo sapiens
ctggctccactccctgcctgac

SEQ ID NO: 7213691 - DNA, 22 bp, Homo sapiens
ctggctccactccctgcctgac

SEQ ID NO: 7213692 - DNA, 22 bp, Homo sapiens
ctggcctggcgcagtggctcac

SEQ ID NO: 7213693 - DNA, 22 bp, Homo sapiens
ctggcctggcgcagtggctcac

SEQ ID NO: 7213694 - DNA, 22 bp, Homo sapiens
ctggcctggcgcagtggctcac

SEQ ID NO: 7213695 - DNA, 22 bp, Homo sapiens
ctggcctggcgcagtggctcac

SEQ ID NO: 7213696 - DNA, 22 bp, Homo sapiens
ctggcctggcgcagtggctcac

SEQ ID NO: 7213697 - DNA, 22 bp, Homo sapiens
ctggcctgggagctgctagcgt

SEQ ID NO: 7213698 - DNA, 22 bp, Homo sapiens
ctggcctgggagctgctagcgt

SEQ ID NO: 7213699 - DNA, 22 bp, Homo sapiens
ctggcctgggagctgctagcgt

SEQ ID NO: 7213700 - DNA, 22 bp, Homo sapiens
ctggcaagaaatatatatctta

SEQ ID NO: 7213701 - DNA, 22 bp, Homo sapiens
ctggattttatcattgtagttt

SEQ ID NO: 7213702 - DNA, 22 bp, Homo sapiens
ctggatgtaacgaaggtttcac

SEQ ID NO: 7213703 - DNA, 22 bp, Homo sapiens
ctggatgtccttcccctgaagc

SEQ ID NO: 7213704 - DNA, 22 bp, Homo sapiens
ctggatgtcttggggactcctg

SEQ ID NO: 7213705 - DNA, 22 bp, Homo sapiens
ctggatgtcttggggactcctg

SEQ ID NO: 7213706 - DNA, 22 bp, Homo sapiens
ctggatgtttatgaaggaccca

SEQ ID NO: 7213707 - DNA, 22 bp, Homo sapiens
ctggatgttttgctaaggactc

SEQ ID NO: 7213708 - DNA, 22 bp, Homo sapiens
ctggatggtcccatgagcagct

SEQ ID NO: 7213709 - DNA, 22 bp, Homo sapiens
ctggatggtcccatgagcagct

SEQ ID NO: 7213710 - DNA, 22 bp, Homo sapiens
ctggatgcttcctctctgctag

SEQ ID NO: 7213711 - DNA, 22 bp, Homo sapiens
ctggataaatgctttagttgga

SEQ ID NO: 7213712 - DNA, 22 bp, Homo sapiens
ctggatcatgcattgcttgtcc

SEQ ID NO: 7213713 - DNA, 22 bp, Homo sapiens
ctggatcatgggaaagggatca

SEQ ID NO: 7213714 - DNA, 22 bp, Homo sapiens
ctggatccatcgggtcccgagt

SEQ ID NO: 7213715 - DNA, 22 bp, Homo sapiens
ctggatcccgtctgagcctcct

SEQ ID NO: 7213716 - DNA, 22 bp, Homo sapiens
ctggatcccgtctgagcctcct

SEQ ID NO: 7213717 - DNA, 22 bp, Homo sapiens
ctggcacctccagctcatggcc

SEQ ID NO: 7213718 - DNA, 22 bp, Homo sapiens
ctggcacattgtaatatataca

SEQ ID NO: 7213719 - DNA, 22 bp, Homo sapiens
ctggcacattgtaatatataca

SEQ ID NO: 7213720 - DNA, 22 bp, Homo sapiens
ctggcaccaggcatgctgggag

SEQ ID NO: 7213721 - DNA, 22 bp, Homo sapiens
ctggcaccccacactgtccacg

SEQ ID NO: 7213722 - DNA, 22 bp, Homo sapiens
ctggcaagtactgggccagctc

SEQ ID NO: 7213723 - DNA, 22 bp, Homo sapiens
ctggcacatagtcagcactcaa

SEQ ID NO: 7213724 - DNA, 22 bp, Homo sapiens
ctggcacatagtcagcactcaa

SEQ ID NO: 7213725 - DNA, 22 bp, Homo sapiens
ctggcacatagtcagcactcaa

SEQ ID NO: 7213726 - DNA, 22 bp, Homo sapiens
ctggcacatcactcctagttta

SEQ ID NO: 7213727 - DNA, 22 bp, Homo sapiens
ctggcacatgctccctgagtgg

SEQ ID NO: 7213728 - DNA, 22 bp, Homo sapiens
ctggcacatgtgagccacatca

SEQ ID NO: 7213729 - DNA, 22 bp, Homo sapiens
ctggcacatgtgagccacatca

SEQ ID NO: 7213730 - DNA, 22 bp, Homo sapiens
ctggcagatatttgcagacatg

SEQ ID NO: 7213731 - DNA, 22 bp, Homo sapiens
ctggcagatatttgcagacatg

SEQ ID NO: 7213732 - DNA, 22 bp, Homo sapiens
ctggcagatatttgcagacatg

SEQ ID NO: 7213733 - DNA, 22 bp, Homo sapiens
ctggcagatagtaagtgatcaa

SEQ ID NO: 7213734 - DNA, 22 bp, Homo sapiens
ctggcagatagccacgcctgtc

SEQ ID NO: 7213735 - DNA, 22 bp, Homo sapiens
ctggcagacttaccatcagaca

SEQ ID NO: 7213736 - DNA, 22 bp, Homo sapiens
ctggcagaggatggggacccag

SEQ ID NO: 7213737 - DNA, 22 bp, Homo sapiens
ctggcagagtctgctgtctgca

SEQ ID NO: 7213738 - DNA, 22 bp, Homo sapiens
ctggcagagtctgctgtctgca

SEQ ID NO: 7213739 - DNA, 22 bp, Homo sapiens
ctggcagagtctgctgtctgca

SEQ ID NO: 7213740 - DNA, 22 bp, Homo sapiens
ctggcagatatttgcagacatg

SEQ ID NO: 7213741 - DNA, 22 bp, Homo sapiens
ctggcagcagcttctggatcga

SEQ ID NO: 7213742 - DNA, 22 bp, Homo sapiens
ctggcagcagcttctggatcga

SEQ ID NO: 7213743 - DNA, 22 bp, Homo sapiens
ctggcagcagcttctggatcga

SEQ ID NO: 7213744 - DNA, 22 bp, Homo sapiens
ctggcagcaggtcacacgcaga

SEQ ID NO: 7213745 - DNA, 22 bp, Homo sapiens
ctggcagcattaacagagagca

SEQ ID NO: 7213746 - DNA, 22 bp, Homo sapiens
ctggcagcattaacagagagca

SEQ ID NO: 7213747 - DNA, 22 bp, Homo sapiens
ctggcagcatggagcctgtgct

SEQ ID NO: 7213748 - DNA, 22 bp, Homo sapiens
ctggcagcatggagcctgtgct

SEQ ID NO: 7213749 - DNA, 22 bp, Homo sapiens
ctggcagtcacggccatgtgct

SEQ ID NO: 7213750 - DNA, 22 bp, Homo sapiens
ctggcaggtccagctggactca

SEQ ID NO: 7213751 - DNA, 22 bp, Homo sapiens
ctggcaggtccagctggactca

SEQ ID NO: 7213752 - DNA, 22 bp, Homo sapiens
ctggcaggtccagctggactca

SEQ ID NO: 7213753 - DNA, 22 bp, Homo sapiens
ctggcaggtccagctggactca

SEQ ID NO: 7213754 - DNA, 22 bp, Homo sapiens
ctggcaggtatctaaagttgtc

SEQ ID NO: 7213755 - DNA, 22 bp, Homo sapiens
ctggcaggtatctaaagttgtc

SEQ ID NO: 7213756 - DNA, 22 bp, Homo sapiens
ctggcaggtatctaaagttgtc

SEQ ID NO: 7213757 - DNA, 22 bp, Homo sapiens
ctggcagggtgggctttgcttt

SEQ ID NO: 7213758 - DNA, 22 bp, Homo sapiens
ctggcagggtgggctttgcttt

SEQ ID NO: 7213759 - DNA, 22 bp, Homo sapiens
ctggcagggctctttgggtgct

SEQ ID NO: 7213760 - DNA, 22 bp, Homo sapiens
ctggcagggctctttgggtgct

SEQ ID NO: 7213761 - DNA, 22 bp, Homo sapiens
ctggcagggctctttgggtgct

SEQ ID NO: 7213762 - DNA, 22 bp, Homo sapiens
ctggcagggctggtattcaaaa

SEQ ID NO: 7213763 - DNA, 22 bp, Homo sapiens
ctggcagtggggcctcagtgtt

SEQ ID NO: 7213764 - DNA, 22 bp, Homo sapiens
ctggcagtgcccagtcactgtt

SEQ ID NO: 7213765 - DNA, 22 bp, Homo sapiens
ctggcagtgacattgcaggtgc

SEQ ID NO: 7213766 - DNA, 22 bp, Homo sapiens
ctggcagtgagctggccactca

SEQ ID NO: 7213767 - DNA, 22 bp, Homo sapiens
ctggcagtgcccagtcactgtt

SEQ ID NO: 7213768 - DNA, 22 bp, Homo sapiens
ctggcagtgtgaccctggacag

SEQ ID NO: 7213769 - DNA, 22 bp, Homo sapiens
ctggcatgaaatggcatctcat

SEQ ID NO: 7213770 - DNA, 21 bp, Homo sapiens
ctggcatgaggagctttgttt

SEQ ID NO: 7213771 - DNA, 21 bp, Homo sapiens
ctggcatgaggagctttgttt

SEQ ID NO: 7213772 - DNA, 22 bp, Homo sapiens
ctggcatgcccagggtatgtgg

SEQ ID NO: 7213773 - DNA, 22 bp, Homo sapiens
ctggcatgccttgggtgcctct

SEQ ID NO: 7213774 - DNA, 22 bp, Homo sapiens
ctggcatgccttgggtgcctct

SEQ ID NO: 7213775 - DNA, 22 bp, Homo sapiens
ctggcatgccttgggtgcctct

SEQ ID NO: 7213776 - DNA, 22 bp, Homo sapiens
ctggcatgctaatacagcctgt

SEQ ID NO: 7213777 - DNA, 22 bp, Homo sapiens
ctggcatgctaatacagcctgt

SEQ ID NO: 7213778 - DNA, 22 bp, Homo sapiens
ctggcatggaggactactgagc

SEQ ID NO: 7213779 - DNA, 22 bp, Homo sapiens
ctggcatggtgtatttgttcaa

SEQ ID NO: 7213780 - DNA, 22 bp, Homo sapiens
ctggcatggtgtatttgttcaa

SEQ ID NO: 7213781 - DNA, 22 bp, Homo sapiens
ctggcatgtgtttggctcctgt

SEQ ID NO: 7213782 - DNA, 22 bp, Homo sapiens
ctggcatgtgtttggctcctgt

SEQ ID NO: 7213783 - DNA, 22 bp, Homo sapiens
ctggcatgtgtttggctcctgt

SEQ ID NO: 7213784 - DNA, 22 bp, Homo sapiens
ctggcattgagggtcacaaggc

SEQ ID NO: 7213785 - DNA, 22 bp, Homo sapiens
ctggccaatatagggaaatctt

SEQ ID NO: 7213786 - DNA, 22 bp, Homo sapiens
ctggccaatccattaatttgtt

SEQ ID NO: 7213787 - DNA, 22 bp, Homo sapiens
ctggccacaactagcccaggac

SEQ ID NO: 7213788 - DNA, 19 bp, Homo sapiens
ctggccacacctgctggtt

SEQ ID NO: 7213789 - DNA, 19 bp, Homo sapiens
ctggccacacctgctggtt

SEQ ID NO: 7213790 - DNA, 19 bp, Homo sapiens
ctggccacacctgctggtt

SEQ ID NO: 7213791 - DNA, 22 bp, Homo sapiens
ctggccacatgtgtgctgagca

SEQ ID NO: 7213792 - DNA, 22 bp, Homo sapiens
ctggccaccaagagcttgctca

SEQ ID NO: 7213793 - DNA, 23 bp, Homo sapiens
ctggccaccatctttctggcttc

SEQ ID NO: 7213794 - DNA, 23 bp, Homo sapiens
ctggccaccatctttctggcttc

SEQ ID NO: 7213795 - DNA, 23 bp, Homo sapiens
ctggccaccatctttctggcttc

SEQ ID NO: 7213796 - DNA, 23 bp, Homo sapiens
ctggccaccatctttctggcttc

SEQ ID NO: 7213797 - DNA, 22 bp, Homo sapiens
ctggccacccatgcctccctga

SEQ ID NO: 7213798 - DNA, 22 bp, Homo sapiens
ctggccaggccccttgcagggc

SEQ ID NO: 7213799 - DNA, 22 bp, Homo sapiens
ctggccaggcggcccctgcatg

SEQ ID NO: 7213800 - DNA, 22 bp, Homo sapiens
ctggccaggcggcccctgcatg

SEQ ID NO: 7213801 - DNA, 22 bp, Homo sapiens
ctggccaggcggcccctgcatg

SEQ ID NO: 7213802 - DNA, 17 bp, Homo sapiens
ctggccagtgtacttgg

SEQ ID NO: 7213803 - DNA, 22 bp, Homo sapiens
tgcagggacaggctctggggat

SEQ ID NO: 7213804 - DNA, 22 bp, Homo sapiens
tgcagggacaggctctggggat

SEQ ID NO: 7213805 - DNA, 22 bp, Homo sapiens
tgcagggagctctggggtgcag

SEQ ID NO: 7213806 - DNA, 22 bp, Homo sapiens
tgcagggagctctggggtgcag

SEQ ID NO: 7213807 - DNA, 22 bp, Homo sapiens
tgcagggagctctggggtgcag

SEQ ID NO: 7213808 - DNA, 22 bp, Homo sapiens
tgcagggagggcccagcaatct

SEQ ID NO: 7213809 - DNA, 22 bp, Homo sapiens
tgcagggaggccccgcagccct

SEQ ID NO: 7213810 - DNA, 22 bp, Homo sapiens
cccagctcttcaagtcaccccc

SEQ ID NO: 7213811 - DNA, 22 bp, Homo sapiens
cccagctcttcaagtcaccccc

SEQ ID NO: 7213812 - DNA, 22 bp, Homo sapiens
cccagctccgagctccgagccg

SEQ ID NO: 7213813 - DNA, 22 bp, Homo sapiens
cccagctccgagctccgagccg

SEQ ID NO: 7213814 - DNA, 22 bp, Homo sapiens
cccagctccttacagggccgaa

SEQ ID NO: 7213815 - DNA, 22 bp, Homo sapiens
tgcagggacacgaagacaaata

SEQ ID NO: 7213816 - DNA, 22 bp, Homo sapiens
tgcagggacacgaagacaaata

SEQ ID NO: 7213817 - DNA, 22 bp, Homo sapiens
tgcagggacacgaagacaaata

SEQ ID NO: 7213818 - DNA, 22 bp, Homo sapiens
tgcagggaatgcttgcagcatg

SEQ ID NO: 7213819 - DNA, 22 bp, Homo sapiens
tgcagggaatgcttgcagcatg

SEQ ID NO: 7213820 - DNA, 22 bp, Homo sapiens
tgcagggaatgcttgcagcatg

SEQ ID NO: 7213821 - DNA, 22 bp, Homo sapiens
tgcagggaatgcttgcagcatg

SEQ ID NO: 7213822 - DNA, 22 bp, Homo sapiens
tgcagggaatgcttgcagcatg

SEQ ID NO: 7213823 - DNA, 22 bp, Homo sapiens
tgcagggaatgcttgcagcatg

SEQ ID NO: 7213824 - DNA, 22 bp, Homo sapiens
tgcagggaatgcttgcagcatg

SEQ ID NO: 7213825 - DNA, 22 bp, Homo sapiens
tgcagggaatgcttgcagcatg

SEQ ID NO: 7213826 - DNA, 22 bp, Homo sapiens
tgcagggaatctgtggctggac

SEQ ID NO: 7213827 - DNA, 22 bp, Homo sapiens
cccagcgagtttgccggtgaac

SEQ ID NO: 7213828 - DNA, 22 bp, Homo sapiens
cccagcgagtttgccggtgaac

SEQ ID NO: 7213829 - DNA, 23 bp, Homo sapiens
cccagcgctgagccctgcaggca

SEQ ID NO: 7213830 - DNA, 23 bp, Homo sapiens
cccagcgctgagccctgcaggca

SEQ ID NO: 7213831 - DNA, 23 bp, Homo sapiens
cccagcgctgagccctgcaggca

SEQ ID NO: 7213832 - DNA, 22 bp, Homo sapiens
cccagctcaagcagagagctaa

SEQ ID NO: 7213833 - DNA, 22 bp, Homo sapiens
cccagctcaagcagagagctaa

SEQ ID NO: 7213834 - DNA, 22 bp, Homo sapiens
cccagctcaagcagagagctaa

SEQ ID NO: 7213835 - DNA, 22 bp, Homo sapiens
tgcagggaatccagtctagggt

SEQ ID NO: 7213836 - DNA, 23 bp, Homo sapiens
cccagcgctgagccctgcaggca

SEQ ID NO: 7213837 - DNA, 22 bp, Homo sapiens
cccagcctttgcttcctggttc

SEQ ID NO: 7213838 - DNA, 22 bp, Homo sapiens
cccagcctttgcttcctggttc

SEQ ID NO: 7213839 - DNA, 22 bp, Homo sapiens
cccagcctttgcttcctggttc

SEQ ID NO: 7213840 - DNA, 22 bp, Homo sapiens
cccagccttccaccctggacta

SEQ ID NO: 7213841 - DNA, 22 bp, Homo sapiens
cccagccttccaccctggacta

SEQ ID NO: 7213842 - DNA, 22 bp, Homo sapiens
cccagccttccaccctggacta

SEQ ID NO: 7213843 - DNA, 22 bp, Homo sapiens
cccagcctttgcttcctggttc

SEQ ID NO: 7213844 - DNA, 22 bp, Homo sapiens
cccagcctttgcttcctggttc

SEQ ID NO: 7213845 - DNA, 22 bp, Homo sapiens
cccagcctttgcttcctggttc

SEQ ID NO: 7213846 - DNA, 22 bp, Homo sapiens
cccagcctgtctttcccaatga

SEQ ID NO: 7213847 - DNA, 22 bp, Homo sapiens
cccagcctgtctttcccaatga

SEQ ID NO: 7213848 - DNA, 22 bp, Homo sapiens
cccagcctgtctttcccaatga

SEQ ID NO: 7213849 - DNA, 22 bp, Homo sapiens
cccagcctgtgacagccgtcct

SEQ ID NO: 7213850 - DNA, 22 bp, Homo sapiens
cccagcctgtgacagccgtcct

SEQ ID NO: 7213851 - DNA, 22 bp, Homo sapiens
cccagcctgtgacagccgtcct

SEQ ID NO: 7213852 - DNA, 22 bp, Homo sapiens
cccagcctgtgacagccgtcct

SEQ ID NO: 7213853 - DNA, 22 bp, Homo sapiens
cccagccttccaccctggacta

SEQ ID NO: 7213854 - DNA, 22 bp, Homo sapiens
tctgtggcccaagtgatggctg

SEQ ID NO: 7213855 - DNA, 22 bp, Homo sapiens
tctgtggcatgttgcacttgta

SEQ ID NO: 7213856 - DNA, 20 bp, Homo sapiens
tctgtggcaggtggcgcttg

SEQ ID NO: 7213857 - DNA, 20 bp, Homo sapiens
tctgtggcaggtggcgcttg

SEQ ID NO: 7213858 - DNA, 22 bp, Homo sapiens
tctgtggcatagtgcttgggaa

SEQ ID NO: 7213859 - DNA, 22 bp, Homo sapiens
tctgtggcatagtgcttgggaa

SEQ ID NO: 7213860 - DNA, 21 bp, Homo sapiens
tctgtggcggactctaggccc

SEQ ID NO: 7213861 - DNA, 22 bp, Homo sapiens
cccagcctactctgccatagca

SEQ ID NO: 7213862 - DNA, 22 bp, Homo sapiens
cccagcctactctgccatagca

SEQ ID NO: 7213863 - DNA, 22 bp, Homo sapiens
cccagctgtggcagaggccggg

SEQ ID NO: 7213864 - DNA, 22 bp, Homo sapiens
cccagcttctgagggggccttg

SEQ ID NO: 7213865 - DNA, 19 bp, Homo sapiens
cccagcttgaccacctgct

SEQ ID NO: 7213866 - DNA, 22 bp, Homo sapiens
cccagcttgcaaatgggttgct

SEQ ID NO: 7213867 - DNA, 22 bp, Homo sapiens
cccagcttgcaaatgggttgct

SEQ ID NO: 7213868 - DNA, 22 bp, Homo sapiens
cccagcttgcccaggactgagg

SEQ ID NO: 7213869 - DNA, 22 bp, Homo sapiens
cccagcttgcgggcggcaggag

SEQ ID NO: 7213870 - DNA, 22 bp, Homo sapiens
cccagcttgcgggcggcaggag

SEQ ID NO: 7213871 - DNA, 23 bp, Homo sapiens
cccagctttcccactgccgagag

SEQ ID NO: 7213872 - DNA, 22 bp, Homo sapiens
cccaggaaaagcagtgccagca

SEQ ID NO: 7213873 - DNA, 22 bp, Homo sapiens
cccaggaaaagcagtgccagca

SEQ ID NO: 7213874 - DNA, 22 bp, Homo sapiens
cccaggaaagaaagtatatggt

SEQ ID NO: 7213875 - DNA, 22 bp, Homo sapiens
cccaggaaagaatttagagcca

SEQ ID NO: 7213876 - DNA, 22 bp, Homo sapiens
cccaggaaagagactgctgggt

SEQ ID NO: 7213877 - DNA, 22 bp, Homo sapiens
cccaggaaagagactgctgggt

SEQ ID NO: 7213878 - DNA, 22 bp, Homo sapiens
cccaggaaaggaaatgaatggg

SEQ ID NO: 7213879 - DNA, 22 bp, Homo sapiens
cccaggaaagtgaatctaattg

SEQ ID NO: 7213880 - DNA, 22 bp, Homo sapiens
cccaggaaagtggaggcggctg

SEQ ID NO: 7213881 - DNA, 22 bp, Homo sapiens
cccaggaaagtggaggcggctg

SEQ ID NO: 7213882 - DNA, 23 bp, Homo sapiens
tgcatcaataaagccagggtttg

SEQ ID NO: 7213883 - DNA, 22 bp, Homo sapiens
tgcatgtttctgtatgttaatg

SEQ ID NO: 7213884 - DNA, 22 bp, Homo sapiens
tgcatgtttctgtatgttaatg

SEQ ID NO: 7213885 - DNA, 22 bp, Homo sapiens
tgcatgtttgtaggttcttcta

SEQ ID NO: 7213886 - DNA, 22 bp, Homo sapiens
tgcatgtttgtaggttcttcta

SEQ ID NO: 7213887 - DNA, 22 bp, Homo sapiens
tgcatgtttgtgtctgagaact

SEQ ID NO: 7213888 - DNA, 22 bp, Homo sapiens
tgcatgttttataccaaagctt

SEQ ID NO: 7213889 - DNA, 22 bp, Homo sapiens
tgcattaaaaccatcgaccatc

SEQ ID NO: 7213890 - DNA, 22 bp, Homo sapiens
tgcattaaaatgtgcctctctt

SEQ ID NO: 7213891 - DNA, 22 bp, Homo sapiens
tgcattaaggccattgaaattt

SEQ ID NO: 7213892 - DNA, 22 bp, Homo sapiens
tgcattaaggtaattgtataat

SEQ ID NO: 7213893 - DNA, 20 bp, Homo sapiens
tgcattaagtggcattgagc

SEQ ID NO: 7213894 - DNA, 22 bp, Homo sapiens
cccagctgatttttgcagagat

SEQ ID NO: 7213895 - DNA, 22 bp, Homo sapiens
cccagctgatttttgcagagat

SEQ ID NO: 7213896 - DNA, 22 bp, Homo sapiens
cccagctgcacctctatggcct

SEQ ID NO: 7213897 - DNA, 22 bp, Homo sapiens
cccagctgatttttgcagagat

SEQ ID NO: 7213898 - DNA, 22 bp, Homo sapiens
cccagctgatttttgcagagat

SEQ ID NO: 7213899 - DNA, 22 bp, Homo sapiens
cccagctgaacttgcattccaa

SEQ ID NO: 7213900 - DNA, 23 bp, Homo sapiens
cccagctgagacttcctgaactc

SEQ ID NO: 7213901 - DNA, 22 bp, Homo sapiens
cccagctcttttagcggcatct

SEQ ID NO: 7213902 - DNA, 22 bp, Homo sapiens
cccagctcttttagcggcatct

SEQ ID NO: 7213903 - DNA, 22 bp, Homo sapiens
cccagctcttttagcggcatct

SEQ ID NO: 7213904 - DNA, 22 bp, Homo sapiens
cccagctgaacttgcattccaa

SEQ ID NO: 7213905 - DNA, 22 bp, Homo sapiens
cccagctgaacttgcattccaa

SEQ ID NO: 7213906 - DNA, 22 bp, Homo sapiens
cccagctcttcctgggagctaa

SEQ ID NO: 7213907 - DNA, 22 bp, Homo sapiens
cccagctcttcctgggagctaa

SEQ ID NO: 7213908 - DNA, 22 bp, Homo sapiens
cccagctcttcctgggagctaa

SEQ ID NO: 7213909 - DNA, 22 bp, Homo sapiens
cccagctcttcctgggagctaa

SEQ ID NO: 7213910 - DNA, 22 bp, Homo sapiens
cccagctcttcctgggagctaa

SEQ ID NO: 7213911 - DNA, 22 bp, Homo sapiens
cccagctcttcaagtcaccccc

SEQ ID NO: 7213912 - DNA, 22 bp, Homo sapiens
cccagctcttcaagtcaccccc

SEQ ID NO: 7213913 - DNA, 22 bp, Homo sapiens
cccagctcttcaagtcaccccc

SEQ ID NO: 7213914 - DNA, 22 bp, Homo sapiens
cccagctcttcaagtcaccccc

SEQ ID NO: 7213915 - DNA, 17 bp, Homo sapiens
cccagctggcagtgccg

SEQ ID NO: 7213916 - DNA, 23 bp, Homo sapiens
cccagctggaagttagaggacca

SEQ ID NO: 7213917 - DNA, 17 bp, Homo sapiens
cccagctggcagtgccg

SEQ ID NO: 7213918 - DNA, 17 bp, Homo sapiens
cccagctgcgtctgagg

SEQ ID NO: 7213919 - DNA, 23 bp, Homo sapiens
cccagctgcagacaagggagggt

SEQ ID NO: 7213920 - DNA, 23 bp, Homo sapiens
cccagctgcagacaagggagggt

SEQ ID NO: 7213921 - DNA, 23 bp, Homo sapiens
cccagctgcagacaagggagggt

SEQ ID NO: 7213922 - DNA, 17 bp, Homo sapiens
cccagctgcgtctgagg

SEQ ID NO: 7213923 - DNA, 23 bp, Homo sapiens
cccagctgcagacaagggagggt

SEQ ID NO: 7213924 - DNA, 23 bp, Homo sapiens
cccagctgcagacaagggagggt

SEQ ID NO: 7213925 - DNA, 23 bp, Homo sapiens
cccagctgcagacaagggagggt

SEQ ID NO: 7213926 - DNA, 22 bp, Homo sapiens
cccagctgtaacgggtctgcac

SEQ ID NO: 7213927 - DNA, 18 bp, Homo sapiens
cccagctggtgggtcagt

SEQ ID NO: 7213928 - DNA, 22 bp, Homo sapiens
cccagctgtaacgggtctgcac

SEQ ID NO: 7213929 - DNA, 17 bp, Homo sapiens
cccagctggcagtgccg

SEQ ID NO: 7213930 - DNA, 17 bp, Homo sapiens
cccagctggcagtgccg

SEQ ID NO: 7213931 - DNA, 18 bp, Homo sapiens
cccagctggtgggtcagt

SEQ ID NO: 7213932 - DNA, 18 bp, Homo sapiens
cccagctggtgggtcagt

SEQ ID NO: 7213933 - DNA, 22 bp, Homo sapiens
cccagctggccaggtggctttg

SEQ ID NO: 7213934 - DNA, 22 bp, Homo sapiens
cccagctggccaggtggctttg

SEQ ID NO: 7213935 - DNA, 22 bp, Homo sapiens
tgccacactcccctgctgcagt

SEQ ID NO: 7213936 - DNA, 22 bp, Homo sapiens
tgccacactcccctgctgcagt

SEQ ID NO: 7213937 - DNA, 22 bp, Homo sapiens
tgccacagacaggacagaacag

SEQ ID NO: 7213938 - DNA, 22 bp, Homo sapiens
tgccacagagactttcattgta

SEQ ID NO: 7213939 - DNA, 22 bp, Homo sapiens
tgccacagagactttcattgta

SEQ ID NO: 7213940 - DNA, 22 bp, Homo sapiens
tgccacagagactttcattgta

SEQ ID NO: 7213941 - DNA, 22 bp, Homo sapiens
tgccacacaattactgctgcta

SEQ ID NO: 7213942 - DNA, 22 bp, Homo sapiens
tgccacacagctgtatgaggga

SEQ ID NO: 7213943 - DNA, 22 bp, Homo sapiens
tgccacacagctgtatgaggga

SEQ ID NO: 7213944 - DNA, 22 bp, Homo sapiens
tgccacacagtctggtagaata

SEQ ID NO: 7213945 - DNA, 22 bp, Homo sapiens
tgccacacattgtcaggttagt

SEQ ID NO: 7213946 - DNA, 22 bp, Homo sapiens
tgccacacattgtcaggttagt

SEQ ID NO: 7213947 - DNA, 22 bp, Homo sapiens
tgccacaccaacatctttcagc

SEQ ID NO: 7213948 - DNA, 22 bp, Homo sapiens
tgccacactcacttctgtggac

SEQ ID NO: 7213949 - DNA, 22 bp, Homo sapiens
tgccacactcccctgctgcagt

SEQ ID NO: 7213950 - DNA, 22 bp, Homo sapiens
tgccacacaattactgctgcta

SEQ ID NO: 7213951 - DNA, 22 bp, Homo sapiens
tgccaattgtgtgaatccttaa

SEQ ID NO: 7213952 - DNA, 22 bp, Homo sapiens
tgccaatttgcccctttgctga

SEQ ID NO: 7213953 - DNA, 22 bp, Homo sapiens
tgccaattagagacatccatct

SEQ ID NO: 7213954 - DNA, 16 bp, Homo sapiens
tgccaattattgtgtc

SEQ ID NO: 7213955 - DNA, 22 bp, Homo sapiens
tgccaattcgcagtgagtattt

SEQ ID NO: 7213956 - DNA, 22 bp, Homo sapiens
tgccaattgtgtgaatccttaa

SEQ ID NO: 7213957 - DNA, 22 bp, Homo sapiens
tgccaatgatgctttgatatgt

SEQ ID NO: 7213958 - DNA, 22 bp, Homo sapiens
tgccaattagagacatccatct

SEQ ID NO: 7213959 - DNA, 22 bp, Homo sapiens
tgccaagtgcttacttggccct

SEQ ID NO: 7213960 - DNA, 22 bp, Homo sapiens
tgccaagggtatgggcaagata

SEQ ID NO: 7213961 - DNA, 22 bp, Homo sapiens
tgccaaggagctggatcagggc

SEQ ID NO: 7213962 - DNA, 22 bp, Homo sapiens
tgccaagggtatgggcaagata

SEQ ID NO: 7213963 - DNA, 20 bp, Homo sapiens
tgccaagctctttagatcga

SEQ ID NO: 7213964 - DNA, 22 bp, Homo sapiens
tgccaagcacagaggggccact

SEQ ID NO: 7213965 - DNA, 22 bp, Homo sapiens
tgccaagctagaacgttcccag

SEQ ID NO: 7213966 - DNA, 22 bp, Homo sapiens
tgccaagattatcgaagtctta

SEQ ID NO: 7213967 - DNA, 22 bp, Homo sapiens
tgcattcaatacagtaagaata

SEQ ID NO: 7213968 - DNA, 22 bp, Homo sapiens
tgcattcacgtgattggggtag

SEQ ID NO: 7213969 - DNA, 22 bp, Homo sapiens
tgcattcaaatcctgatcctgc

SEQ ID NO: 7213970 - DNA, 22 bp, Homo sapiens
tgccacagagcaattctgctga

SEQ ID NO: 7213971 - DNA, 22 bp, Homo sapiens
tgccacagagcaattctgctga

SEQ ID NO: 7213972 - DNA, 22 bp, Homo sapiens
tgccacagagcaattctgctga

SEQ ID NO: 7213973 - DNA, 22 bp, Homo sapiens
cccaggagggtggcctctgccc

SEQ ID NO: 7213974 - DNA, 22 bp, Homo sapiens
cccaggaggtggaggctgcagt

SEQ ID NO: 7213975 - DNA, 22 bp, Homo sapiens
cccaggaggtggaggctgcagt

SEQ ID NO: 7213976 - DNA, 22 bp, Homo sapiens
cccaggagggtggcctctgccc

SEQ ID NO: 7213977 - DNA, 22 bp, Homo sapiens
cccaggagggtggcctctgccc

SEQ ID NO: 7213978 - DNA, 22 bp, Homo sapiens
cccaggaggtggaggctgcagt

SEQ ID NO: 7213979 - DNA, 22 bp, Homo sapiens
cccaggaggtggaggctgcagt

SEQ ID NO: 7213980 - DNA, 22 bp, Homo sapiens
cccaggaggtggaggttgcagc

SEQ ID NO: 7213981 - DNA, 22 bp, Homo sapiens
cccaggaggtggaggctgcagt

SEQ ID NO: 7213982 - DNA, 22 bp, Homo sapiens
cccaggaggtggaggctgcagt

SEQ ID NO: 7213983 - DNA, 22 bp, Homo sapiens
cccaggaggtggaggctgcagt

SEQ ID NO: 7213984 - DNA, 22 bp, Homo sapiens
cccaggaggtggaggctgcagt

SEQ ID NO: 7213985 - DNA, 22 bp, Homo sapiens
cccaggaggtggaggttgcagt

SEQ ID NO: 7213986 - DNA, 22 bp, Homo sapiens
cccaggaggtggaggttgcagc

SEQ ID NO: 7213987 - DNA, 22 bp, Homo sapiens
cccaggaggtggaggttgcagc

SEQ ID NO: 7213988 - DNA, 22 bp, Homo sapiens
cccaggaggtggaggttgcagc

SEQ ID NO: 7213989 - DNA, 22 bp, Homo sapiens
cccaggaggtggagttcacagt

SEQ ID NO: 7213990 - DNA, 22 bp, Homo sapiens
cccaggaggtggagttcacagt

SEQ ID NO: 7213991 - DNA, 22 bp, Homo sapiens
cccaggaggtgtgcccaactcg

SEQ ID NO: 7213992 - DNA, 22 bp, Homo sapiens
cccaggaggtgtgcccaactcg

SEQ ID NO: 7213993 - DNA, 22 bp, Homo sapiens
cccaggaggtgtagctgcgtgg

SEQ ID NO: 7213994 - DNA, 22 bp, Homo sapiens
cccaggaggtgtagctgcgtgg

SEQ ID NO: 7213995 - DNA, 22 bp, Homo sapiens
cccaggaggtggaggttgcggt

SEQ ID NO: 7213996 - DNA, 22 bp, Homo sapiens
cccaggaggtggaggttgcggt

SEQ ID NO: 7213997 - DNA, 22 bp, Homo sapiens
cccaggaggtggaggttgcagt

SEQ ID NO: 7213998 - DNA, 22 bp, Homo sapiens
cccaggaggtggaggttgcagt

SEQ ID NO: 7213999 - DNA, 22 bp, Homo sapiens
cccaggaggtggaggttgcagt

SEQ ID NO: 7214000 - DNA, 22 bp, Homo sapiens
tgccaggcctcaggagtctcca

SEQ ID NO: 7214001 - DNA, 22 bp, Homo sapiens
tgccaggcctcaggagtctcca

SEQ ID NO: 7214002 - DNA, 22 bp, Homo sapiens
tgccaggcctcaggagtctcca

SEQ ID NO: 7214003 - DNA, 22 bp, Homo sapiens
tgccaggcctcaggagtctcca

SEQ ID NO: 7214004 - DNA, 22 bp, Homo sapiens
cccaggaggttgaggctgcagt

SEQ ID NO: 7214005 - DNA, 22 bp, Homo sapiens
cccaggaggtgtgcccaactcg

SEQ ID NO: 7214006 - DNA, 22 bp, Homo sapiens
cccaggaggttgaggctgcagt

SEQ ID NO: 7214007 - DNA, 22 bp, Homo sapiens
cccaggaggttgaggctgcagt

SEQ ID NO: 7214008 - DNA, 22 bp, Homo sapiens
cccaggaggttgaggctgcagt

SEQ ID NO: 7214009 - DNA, 22 bp, Homo sapiens
cccaggaggttgaggctgcagt

SEQ ID NO: 7214010 - DNA, 22 bp, Homo sapiens
tgccaggcgtggtggtgcgcac

SEQ ID NO: 7214011 - DNA, 22 bp, Homo sapiens
tgccaggcgattgctatcagca

SEQ ID NO: 7214012 - DNA, 22 bp, Homo sapiens
tgccaggcgtggtggtgcgcac

SEQ ID NO: 7214013 - DNA, 22 bp, Homo sapiens
tgccaggcgattgctatcagca

SEQ ID NO: 7214014 - DNA, 22 bp, Homo sapiens
tgccaggcgattgctatcagca

SEQ ID NO: 7214015 - DNA, 21 bp, Homo sapiens
tgccaggcctgagctggggtc

SEQ ID NO: 7214016 - DNA, 22 bp, Homo sapiens
tgccaggcgattgctatcagca

SEQ ID NO: 7214017 - DNA, 21 bp, Homo sapiens
tgccaggcctgagctggggtc

SEQ ID NO: 7214018 - DNA, 22 bp, Homo sapiens
tgccaggcctcaggagtctcca

SEQ ID NO: 7214019 - DNA, 21 bp, Homo sapiens
tgccaggcctgagctggggtc

SEQ ID NO: 7214020 - DNA, 21 bp, Homo sapiens
tgccaggcctgagctggggtc

SEQ ID NO: 7214021 - DNA, 22 bp, Homo sapiens
tgccaggctaagtggaggactt

SEQ ID NO: 7214022 - DNA, 22 bp, Homo sapiens
tgccaggcgtggtggtgcgcac

SEQ ID NO: 7214023 - DNA, 22 bp, Homo sapiens
cccaggagttagaggttgtggt

SEQ ID NO: 7214024 - DNA, 22 bp, Homo sapiens
cccaggagttagaggttgtggt

SEQ ID NO: 7214025 - DNA, 22 bp, Homo sapiens
tgccaggcgtggtggtgcgcac

SEQ ID NO: 7214026 - DNA, 22 bp, Homo sapiens
tgccaggcgtggtggtgcgcac

SEQ ID NO: 7214027 - DNA, 15 bp, Homo sapiens
cccaggagttcgaga

SEQ ID NO: 7214028 - DNA, 22 bp, Homo sapiens
cccaggagttcgaggctgtagt

SEQ ID NO: 7214029 - DNA, 22 bp, Homo sapiens
cccaggagttcgaggctgtagt

SEQ ID NO: 7214030 - DNA, 22 bp, Homo sapiens
cccaggagttcgaggctgtagt

SEQ ID NO: 7214031 - DNA, 22 bp, Homo sapiens
cccaggagttcgaggctgtagt

SEQ ID NO: 7214032 - DNA, 22 bp, Homo sapiens
cccaggatgtcgaggctgcagt

SEQ ID NO: 7214033 - DNA, 22 bp, Homo sapiens
cccaggcacactgaagtgacat

SEQ ID NO: 7214034 - DNA, 22 bp, Homo sapiens
cccaggcacactgaagtgacat

SEQ ID NO: 7214035 - DNA, 22 bp, Homo sapiens
cccaggcagagagctggtgagc

SEQ ID NO: 7214036 - DNA, 22 bp, Homo sapiens
cccaggcagagagctggtgagc

SEQ ID NO: 7214037 - DNA, 22 bp, Homo sapiens
cccaggcagagagctggtgagc

SEQ ID NO: 7214038 - DNA, 22 bp, Homo sapiens
cccaggcagcctgcagggaagg

SEQ ID NO: 7214039 - DNA, 22 bp, Homo sapiens
cccaggcagcggggtctccttg

SEQ ID NO: 7214040 - DNA, 22 bp, Homo sapiens
cccaggcagcggggtctccttg

SEQ ID NO: 7214041 - DNA, 22 bp, Homo sapiens
cccaggcagcggggtctccttg

SEQ ID NO: 7214042 - DNA, 22 bp, Homo sapiens
cccaggcagcggggtctccttg

SEQ ID NO: 7214043 - DNA, 20 bp, Homo sapiens
cccaggcagagctagcggca

SEQ ID NO: 7214044 - DNA, 20 bp, Homo sapiens
cccaggcagagctagcggca

SEQ ID NO: 7214045 - DNA, 22 bp, Homo sapiens
cccaggcagccccagaagcttg

SEQ ID NO: 7214046 - DNA, 22 bp, Homo sapiens
cccaggcagccccagaagcttg

SEQ ID NO: 7214047 - DNA, 22 bp, Homo sapiens
cccaggcagccccagaagcttg

SEQ ID NO: 7214048 - DNA, 22 bp, Homo sapiens
cccaggcagggacgtgctctgg

SEQ ID NO: 7214049 - DNA, 22 bp, Homo sapiens
cccaggcagggacgtgctctgg

SEQ ID NO: 7214050 - DNA, 22 bp, Homo sapiens
cccaggcagtagaaagaagagg

SEQ ID NO: 7214051 - DNA, 22 bp, Homo sapiens
cccaggcagtctggctctaaag

SEQ ID NO: 7214052 - DNA, 22 bp, Homo sapiens
cccaggcagtgctgatccctca

SEQ ID NO: 7214053 - DNA, 22 bp, Homo sapiens
tgcctgctctgtgccacagttg

SEQ ID NO: 7214054 - DNA, 22 bp, Homo sapiens
tgctgcagacgaagcccatgcc

SEQ ID NO: 7214055 - DNA, 22 bp, Homo sapiens
tgctgcagacgaagcccatgcc

SEQ ID NO: 7214056 - DNA, 22 bp, Homo sapiens
tgctgcagctaaggtgaggtgc

SEQ ID NO: 7214057 - DNA, 22 bp, Homo sapiens
tgctgcagattgcagattaact

SEQ ID NO: 7214058 - DNA, 22 bp, Homo sapiens
tgctgcagctttgtcacatgca

SEQ ID NO: 7214059 - DNA, 22 bp, Homo sapiens
tgctgcagctttgtcacatgca

SEQ ID NO: 7214060 - DNA, 22 bp, Homo sapiens
tgctgcaggaattctcaaggga

SEQ ID NO: 7214061 - DNA, 22 bp, Homo sapiens
ccccaccttgcaattgttccct

SEQ ID NO: 7214062 - DNA, 22 bp, Homo sapiens
ccccagcagcacctggggcagt

SEQ ID NO: 7214063 - DNA, 22 bp, Homo sapiens
ccccagcagcacctggggcagt

SEQ ID NO: 7214064 - DNA, 22 bp, Homo sapiens
ccccagcagcacctggggcagt

SEQ ID NO: 7214065 - DNA, 22 bp, Homo sapiens
ccccagcaggaatacaggggtc

SEQ ID NO: 7214066 - DNA, 18 bp, Homo sapiens
ccccagcagtgtggtgcc

SEQ ID NO: 7214067 - DNA, 22 bp, Homo sapiens
ccccagcatatcatggtttcgt

SEQ ID NO: 7214068 - DNA, 22 bp, Homo sapiens
ccccagccagcaggacctctga

SEQ ID NO: 7214069 - DNA, 22 bp, Homo sapiens
ccccagccagcaggacctctga

SEQ ID NO: 7214070 - DNA, 22 bp, Homo sapiens
ccccagccagcaggacctctga

SEQ ID NO: 7214071 - DNA, 22 bp, Homo sapiens
ccccagccagcaggacctctga

SEQ ID NO: 7214072 - DNA, 22 bp, Homo sapiens
ccccagccagcttgtagtagaa

SEQ ID NO: 7214073 - DNA, 22 bp, Homo sapiens
ccccagctcagtgcagggacat

SEQ ID NO: 7214074 - DNA, 22 bp, Homo sapiens
ccccagctcagtgcagggacat

SEQ ID NO: 7214075 - DNA, 22 bp, Homo sapiens
ccccagccttccatgggaattg

SEQ ID NO: 7214076 - DNA, 23 bp, Homo sapiens
tgctggagacaagtgtgagaagg

SEQ ID NO: 7214077 - DNA, 22 bp, Homo sapiens
ccccagctcagtgcagggacat

SEQ ID NO: 7214078 - DNA, 22 bp, Homo sapiens
ccccagcccacaagcatattaa

SEQ ID NO: 7214079 - DNA, 22 bp, Homo sapiens
ccccagcccacaagcatattaa

SEQ ID NO: 7214080 - DNA, 22 bp, Homo sapiens
ccccagccttccatgggaattg

SEQ ID NO: 7214081 - DNA, 22 bp, Homo sapiens
ccccagccttccatgggaattg

SEQ ID NO: 7214082 - DNA, 23 bp, Homo sapiens
tgctggagacaagtgtgagaagg

SEQ ID NO: 7214083 - DNA, 22 bp, Homo sapiens
tgctggagacatagcaggcagc

SEQ ID NO: 7214084 - DNA, 22 bp, Homo sapiens
tgctggagacatagcaggcagc

SEQ ID NO: 7214085 - DNA, 22 bp, Homo sapiens
tgctggagacatagcaggcagc

SEQ ID NO: 7214086 - DNA, 22 bp, Homo sapiens
tgctggagacctgcttgcacca

SEQ ID NO: 7214087 - DNA, 22 bp, Homo sapiens
tgctggagactcactcaggtgc

SEQ ID NO: 7214088 - DNA, 22 bp, Homo sapiens
tgctggagactcactcaggtgc

SEQ ID NO: 7214089 - DNA, 22 bp, Homo sapiens
tgctggagagccttggccaagg

SEQ ID NO: 7214090 - DNA, 22 bp, Homo sapiens
tgctggagaggaaggtggggtc

SEQ ID NO: 7214091 - DNA, 22 bp, Homo sapiens
tgctggagatcattaatgttca

SEQ ID NO: 7214092 - DNA, 22 bp, Homo sapiens
tgctggagatcattaatgttca

SEQ ID NO: 7214093 - DNA, 22 bp, Homo sapiens
tgctggagatgaaagggccctg

SEQ ID NO: 7214094 - DNA, 22 bp, Homo sapiens
tgctggagagccttggccaagg

SEQ ID NO: 7214095 - DNA, 22 bp, Homo sapiens
tgctggagagctagttctgcag

SEQ ID NO: 7214096 - DNA, 22 bp, Homo sapiens
tgctggagaggaaggtggggtc

SEQ ID NO: 7214097 - DNA, 22 bp, Homo sapiens
tgctggagatgaaagggccctg

SEQ ID NO: 7214098 - DNA, 22 bp, Homo sapiens
tgctggagcatctgagagcatc

SEQ ID NO: 7214099 - DNA, 22 bp, Homo sapiens
tgctggagcatctgagagcatc

SEQ ID NO: 7214100 - DNA, 22 bp, Homo sapiens
tgctggagcatctgagagcatc

SEQ ID NO: 7214101 - DNA, 22 bp, Homo sapiens
ccccaggcagggcctaacagag

SEQ ID NO: 7214102 - DNA, 22 bp, Homo sapiens
ccccaggcctgttggatggcgc

SEQ ID NO: 7214103 - DNA, 22 bp, Homo sapiens
ccccaggcctgttggatggcgc

SEQ ID NO: 7214104 - DNA, 22 bp, Homo sapiens
ccccagggaagctttgcttact

SEQ ID NO: 7214105 - DNA, 22 bp, Homo sapiens
cccccagtctgaacagcagctg

SEQ ID NO: 7214106 - DNA, 22 bp, Homo sapiens
ccccctctgccggggtccttca

SEQ ID NO: 7214107 - DNA, 22 bp, Homo sapiens
ccccctgcgcccggcacgtcat

SEQ ID NO: 7214108 - DNA, 22 bp, Homo sapiens
cccccaggctctgacacaggag

SEQ ID NO: 7214109 - DNA, 22 bp, Homo sapiens
cccccaggctctgacacaggag

SEQ ID NO: 7214110 - DNA, 22 bp, Homo sapiens
cccccaggggctccgcctcgtg

SEQ ID NO: 7214111 - DNA, 22 bp, Homo sapiens
cccctcaggtacccgtgcagca

SEQ ID NO: 7214112 - DNA, 22 bp, Homo sapiens
cccctcaggtacccgtgcagca

SEQ ID NO: 7214113 - DNA, 22 bp, Homo sapiens
cccctcataggtcagacacgca

SEQ ID NO: 7214114 - DNA, 22 bp, Homo sapiens
cccctcattacaggcggggagc

SEQ ID NO: 7214115 - DNA, 22 bp, Homo sapiens
cccctcattcatgtccttgctt

SEQ ID NO: 7214116 - DNA, 22 bp, Homo sapiens
ccccgaggctggagtgcagtgg

SEQ ID NO: 7214117 - DNA, 22 bp, Homo sapiens
cccctaggaggcgatggtggaa

SEQ ID NO: 7214118 - DNA, 16 bp, Homo sapiens
cccctcaggaagtaca

SEQ ID NO: 7214119 - DNA, 22 bp, Homo sapiens
cccccagccagcagtgctcagc

SEQ ID NO: 7214120 - DNA, 22 bp, Homo sapiens
cccccagatgcgagccatagcc

SEQ ID NO: 7214121 - DNA, 18 bp, Homo sapiens
cccccagccaaattctct

SEQ ID NO: 7214122 - DNA, 22 bp, Homo sapiens
cccccacctgaggacagtctta

SEQ ID NO: 7214123 - DNA, 22 bp, Homo sapiens
cccccactaagttgagggccct

SEQ ID NO: 7214124 - DNA, 22 bp, Homo sapiens
cccccactaagttgagggccct

SEQ ID NO: 7214125 - DNA, 22 bp, Homo sapiens
cccccagctctgctgggtcccg

SEQ ID NO: 7214126 - DNA, 22 bp, Homo sapiens
cccccaggctctgacacaggag

SEQ ID NO: 7214127 - DNA, 22 bp, Homo sapiens
cccccaccgtgttcctgctcgg

SEQ ID NO: 7214128 - DNA, 22 bp, Homo sapiens
cccccaccgtgttcctgctcgg

SEQ ID NO: 7214129 - DNA, 22 bp, Homo sapiens
cccccacctgaggacagtctta

SEQ ID NO: 7214130 - DNA, 22 bp, Homo sapiens
cccccacctgaggacagtctta

SEQ ID NO: 7214131 - DNA, 22 bp, Homo sapiens
cccccacctgaggacagtctta

SEQ ID NO: 7214132 - DNA, 22 bp, Homo sapiens
ccccagggaagctttgcttact

SEQ ID NO: 7214133 - DNA, 22 bp, Homo sapiens
ccccatttgaactccttcaact

SEQ ID NO: 7214134 - DNA, 22 bp, Homo sapiens
cccccaaagtttgcacggataa

SEQ ID NO: 7214135 - DNA, 22 bp, Homo sapiens
cccccaaggccaggctgagacc

SEQ ID NO: 7214136 - DNA, 22 bp, Homo sapiens
cccccaccgtgttcctgctcgg

SEQ ID NO: 7214137 - DNA, 22 bp, Homo sapiens
cccccaccgtgttcctgctcgg

SEQ ID NO: 7214138 - DNA, 22 bp, Homo sapiens
cccccaccgtgttcctgctcgg

SEQ ID NO: 7214139 - DNA, 22 bp, Homo sapiens
cccctcctgcagcacctttctt

SEQ ID NO: 7214140 - DNA, 22 bp, Homo sapiens
cccctcctgcagcacctttctt

SEQ ID NO: 7214141 - DNA, 22 bp, Homo sapiens
cccctcctgcagcacctttctt

SEQ ID NO: 7214142 - DNA, 22 bp, Homo sapiens
cccctcctggccacactgtcag

SEQ ID NO: 7214143 - DNA, 22 bp, Homo sapiens
cccctccctgacctggttgggc

SEQ ID NO: 7214144 - DNA, 22 bp, Homo sapiens
cccctccctgacctggttgggc

SEQ ID NO: 7214145 - DNA, 22 bp, Homo sapiens
cccctccctgacctggttgggc

SEQ ID NO: 7214146 - DNA, 22 bp, Homo sapiens
cccctctccctcacttatcaat

SEQ ID NO: 7214147 - DNA, 22 bp, Homo sapiens
cccctcctggccacactgtcag

SEQ ID NO: 7214148 - DNA, 22 bp, Homo sapiens
cccctcctggccacactgtcag

SEQ ID NO: 7214149 - DNA, 22 bp, Homo sapiens
cccctcctggccacactgtcag

SEQ ID NO: 7214150 - DNA, 22 bp, Homo sapiens
cccctctgcaaatagccaggct

SEQ ID NO: 7214151 - DNA, 22 bp, Homo sapiens
cccctctggtcaaccagtcaca

SEQ ID NO: 7214152 - DNA, 23 bp, Homo sapiens
cccctctggtggctcagctcctg

SEQ ID NO: 7214153 - DNA, 23 bp, Homo sapiens
cccctctggtggctcagctcctg

SEQ ID NO: 7214154 - DNA, 20 bp, Homo sapiens
ccctaggaacgcagcaggag

SEQ ID NO: 7214155 - DNA, 22 bp, Homo sapiens
ccctaggaattctatggccaag

SEQ ID NO: 7214156 - DNA, 22 bp, Homo sapiens
ccctcagggaccactgacttca

SEQ ID NO: 7214157 - DNA, 19 bp, Homo sapiens
ccctcaggtctgagcagtc

SEQ ID NO: 7214158 - DNA, 19 bp, Homo sapiens
ccctcaggtctgagcagtc

SEQ ID NO: 7214159 - DNA, 19 bp, Homo sapiens
ccctcaggtctgagcagtc

SEQ ID NO: 7214160 - DNA, 22 bp, Homo sapiens
ccctcaggagatgtcagctgga

SEQ ID NO: 7214161 - DNA, 22 bp, Homo sapiens
ccctcaggatgcagtggaagtg

SEQ ID NO: 7214162 - DNA, 22 bp, Homo sapiens
ccctaggcccaaagggtgacat

SEQ ID NO: 7214163 - DNA, 22 bp, Homo sapiens
ccctcagctccaccctcagcag

SEQ ID NO: 7214164 - DNA, 22 bp, Homo sapiens
ccctcagcttctccctgcagct

SEQ ID NO: 7214165 - DNA, 21 bp, Homo sapiens
ccctcaggaaacagaatgcac

SEQ ID NO: 7214166 - DNA, 22 bp, Homo sapiens
ccctcaggagatgtcagctgga

SEQ ID NO: 7214167 - DNA, 22 bp, Homo sapiens
ccctcaggagatgtcagctgga

SEQ ID NO: 7214168 - DNA, 22 bp, Homo sapiens
cccaggctcctactgtattctg

SEQ ID NO: 7214169 - DNA, 22 bp, Homo sapiens
cccaggctcctagaggcccaga

SEQ ID NO: 7214170 - DNA, 22 bp, Homo sapiens
cccaggctcctagaggcccaga

SEQ ID NO: 7214171 - DNA, 22 bp, Homo sapiens
cccaggctcctagaggcccaga

SEQ ID NO: 7214172 - DNA, 22 bp, Homo sapiens
tgcctgggatctgtgccctttg

SEQ ID NO: 7214173 - DNA, 22 bp, Homo sapiens
tgcctgggcctctgaggaaggc

SEQ ID NO: 7214174 - DNA, 22 bp, Homo sapiens
tgcctgggcctctgaggaaggc

SEQ ID NO: 7214175 - DNA, 22 bp, Homo sapiens
tgcctgggcctctgaggaaggc

SEQ ID NO: 7214176 - DNA, 22 bp, Homo sapiens
tgcctgggcctctgaggaaggc

SEQ ID NO: 7214177 - DNA, 22 bp, Homo sapiens
tgcctgggcctctgaggaaggc

SEQ ID NO: 7214178 - DNA, 22 bp, Homo sapiens
tgcctgggccttcccacctctg

SEQ ID NO: 7214179 - DNA, 22 bp, Homo sapiens
tgcctgggccttcccacctctg

SEQ ID NO: 7214180 - DNA, 22 bp, Homo sapiens
tgcctgggagtgaccaagactc

SEQ ID NO: 7214181 - DNA, 22 bp, Homo sapiens
tgcctgggagtgaccaagactc

SEQ ID NO: 7214182 - DNA, 22 bp, Homo sapiens
tgcctgggactgtactaaattt

SEQ ID NO: 7214183 - DNA, 22 bp, Homo sapiens
tgcctgctctgtgccacagttg

SEQ ID NO: 7214184 - DNA, 22 bp, Homo sapiens
tgcctgctcttaccactctccc

SEQ ID NO: 7214185 - DNA, 22 bp, Homo sapiens
tgcctgggacatgctgtggact

SEQ ID NO: 7214186 - DNA, 20 bp, Homo sapiens
tgcctgggaaggcgtggagg

SEQ ID NO: 7214187 - DNA, 20 bp, Homo sapiens
tgcctgggaaggcgtggagg

SEQ ID NO: 7214188 - DNA, 22 bp, Homo sapiens
cccaggctcctgactcattcta

SEQ ID NO: 7214189 - DNA, 22 bp, Homo sapiens
cccaggctcctagaggcccaga

SEQ ID NO: 7214190 - DNA, 22 bp, Homo sapiens
cccaggctcctgactcattcta

SEQ ID NO: 7214191 - DNA, 22 bp, Homo sapiens
cccaggctcctgactcattcta

SEQ ID NO: 7214192 - DNA, 22 bp, Homo sapiens
cccaggctcctgctgtgttgac

SEQ ID NO: 7214193 - DNA, 22 bp, Homo sapiens
cccaggctcctgctgtgttgac

SEQ ID NO: 7214194 - DNA, 22 bp, Homo sapiens
cccaggctcttatgtgacttgc

SEQ ID NO: 7214195 - DNA, 22 bp, Homo sapiens
cccaggctcttatgtgacttgc

SEQ ID NO: 7214196 - DNA, 22 bp, Homo sapiens
cccaggctcttatgtgacttgc

SEQ ID NO: 7214197 - DNA, 21 bp, Homo sapiens
cccaggctgaattaaaaatat

SEQ ID NO: 7214198 - DNA, 21 bp, Homo sapiens
cccaggctgaattaaaaatat

SEQ ID NO: 7214199 - DNA, 22 bp, Homo sapiens
cccaggctgagttagaggtgtc

SEQ ID NO: 7214200 - DNA, 22 bp, Homo sapiens
tgctcagtaagtaaacagtaac

SEQ ID NO: 7214201 - DNA, 22 bp, Homo sapiens
tgctccagggctgccagaccct

SEQ ID NO: 7214202 - DNA, 22 bp, Homo sapiens
tgctccagggctgccagaccct

SEQ ID NO: 7214203 - DNA, 22 bp, Homo sapiens
tgctccagggctgccagaccct

SEQ ID NO: 7214204 - DNA, 23 bp, Homo sapiens
tgctccaggtacagaactccagg

SEQ ID NO: 7214205 - DNA, 23 bp, Homo sapiens
tgctccaggtacagaactccagg

SEQ ID NO: 7214206 - DNA, 22 bp, Homo sapiens
tgctccaggtgtgcctctcatg

SEQ ID NO: 7214207 - DNA, 22 bp, Homo sapiens
tgctccaggtgtgcctctcatg

SEQ ID NO: 7214208 - DNA, 22 bp, Homo sapiens
tgctccagtgagctggccatcc

SEQ ID NO: 7214209 - DNA, 22 bp, Homo sapiens
tgctccagtgagctggccatcc

SEQ ID NO: 7214210 - DNA, 22 bp, Homo sapiens
tgctccagtgcctgccccacag

SEQ ID NO: 7214211 - DNA, 22 bp, Homo sapiens
tgctccatgcgctcggccggcg

SEQ ID NO: 7214212 - DNA, 22 bp, Homo sapiens
tgctccatgcgctcggccggcg

SEQ ID NO: 7214213 - DNA, 22 bp, Homo sapiens
tgctccatgcgctcggccggcg

SEQ ID NO: 7214214 - DNA, 22 bp, Homo sapiens
tgctccatgcgctcggccggcg

SEQ ID NO: 7214215 - DNA, 22 bp, Homo sapiens
tgctccatgcgctcggccggcg

SEQ ID NO: 7214216 - DNA, 22 bp, Homo sapiens
tgctgaagttactagagactat

SEQ ID NO: 7214217 - DNA, 22 bp, Homo sapiens
tgctgaagttactagagactat

SEQ ID NO: 7214218 - DNA, 22 bp, Homo sapiens
tgctgaagtccatctgtttgac

SEQ ID NO: 7214219 - DNA, 23 bp, Homo sapiens
tgctgaagtgttggccctgccca

SEQ ID NO: 7214220 - DNA, 22 bp, Homo sapiens
tgctgaagtccatctgtttgac

SEQ ID NO: 7214221 - DNA, 22 bp, Homo sapiens
tgctgaagtccatctgtttgac

SEQ ID NO: 7214222 - DNA, 22 bp, Homo sapiens
tgctctggctggagcaatgact

SEQ ID NO: 7214223 - DNA, 22 bp, Homo sapiens
tgctctggctggagcaatgact

SEQ ID NO: 7214224 - DNA, 22 bp, Homo sapiens
tgctgaagtccaagagctccaa

SEQ ID NO: 7214225 - DNA, 22 bp, Homo sapiens
tgctctggagtggcttgtgcac

SEQ ID NO: 7214226 - DNA, 22 bp, Homo sapiens
cccagggattataaaggtgaaa

SEQ ID NO: 7214227 - DNA, 22 bp, Homo sapiens
tgctctggagtggcttgtgcac

SEQ ID NO: 7214228 - DNA, 22 bp, Homo sapiens
cccagggatgtggcagatgtta

SEQ ID NO: 7214229 - DNA, 22 bp, Homo sapiens
cccagggatgtggcagatgtta

SEQ ID NO: 7214230 - DNA, 22 bp, Homo sapiens
cccagggatgtggcagatgtta

SEQ ID NO: 7214231 - DNA, 22 bp, Homo sapiens
cccagggaggtagcaggagaaa

SEQ ID NO: 7214232 - DNA, 22 bp, Homo sapiens
cccagggaggcccaggctctgc

SEQ ID NO: 7214233 - DNA, 22 bp, Homo sapiens
cccagggaggtagcaggagaaa

SEQ ID NO: 7214234 - DNA, 22 bp, Homo sapiens
tgctcccacactactcggaggc

SEQ ID NO: 7214235 - DNA, 22 bp, Homo sapiens
tgctcccacactactcggaggc

SEQ ID NO: 7214236 - DNA, 22 bp, Homo sapiens
tgctcccagctgtaggaatgtt

SEQ ID NO: 7214237 - DNA, 20 bp, Homo sapiens
cccagggacctgagctccat

SEQ ID NO: 7214238 - DNA, 20 bp, Homo sapiens
cccagggacctgagctccat

SEQ ID NO: 7214239 - DNA, 20 bp, Homo sapiens
cccagggacctgagctccat

SEQ ID NO: 7214240 - DNA, 22 bp, Homo sapiens
cccagggactcgggattctagg

SEQ ID NO: 7214241 - DNA, 22 bp, Homo sapiens
cccagggagagcgcggaggcgg

SEQ ID NO: 7214242 - DNA, 22 bp, Homo sapiens
cccagggagagcgcggaggcgg

SEQ ID NO: 7214243 - DNA, 22 bp, Homo sapiens
cccagggagagcgcggaggcgg

SEQ ID NO: 7214244 - DNA, 22 bp, Homo sapiens
cccagggagagcgcggaggcgg

SEQ ID NO: 7214245 - DNA, 22 bp, Homo sapiens
cccagggagcttggagaacggg

SEQ ID NO: 7214246 - DNA, 22 bp, Homo sapiens
cccagggaggcccaggctctgc

SEQ ID NO: 7214247 - DNA, 22 bp, Homo sapiens
cccagggaggcccaggctctgc

SEQ ID NO: 7214248 - DNA, 22 bp, Homo sapiens
cccagggaggcccaggctctgc

SEQ ID NO: 7214249 - DNA, 22 bp, Homo sapiens
cccagggaggcccaggctctgc

SEQ ID NO: 7214250 - DNA, 19 bp, Homo sapiens
tgctgaagttgtcagtctg

SEQ ID NO: 7214251 - DNA, 19 bp, Homo sapiens
tgctgaagttgtcagtctg

SEQ ID NO: 7214252 - DNA, 22 bp, Homo sapiens
tgctgaagttactagagactat

SEQ ID NO: 7214253 - DNA, 22 bp, Homo sapiens
tgctgaagttcttcccctaatg

SEQ ID NO: 7214254 - DNA, 22 bp, Homo sapiens
tgctgaataaagatatattttc

SEQ ID NO: 7214255 - DNA, 22 bp, Homo sapiens
tgctgaataaataaagtctatt

SEQ ID NO: 7214256 - DNA, 22 bp, Homo sapiens
tgctgaataagacgtggcttgt

SEQ ID NO: 7214257 - DNA, 22 bp, Homo sapiens
tgctgaataataagattactca

SEQ ID NO: 7214258 - DNA, 22 bp, Homo sapiens
tgctgaatgaatggatggttgc

SEQ ID NO: 7214259 - DNA, 21 bp, Homo sapiens
tgctgaatctgccatattttc

SEQ ID NO: 7214260 - DNA, 22 bp, Homo sapiens
tgctgaatcccaccctccagtg

SEQ ID NO: 7214261 - DNA, 22 bp, Homo sapiens
tgctgaataataagattactca

SEQ ID NO: 7214262 - DNA, 22 bp, Homo sapiens
tgctgaatatagagcaagaagt

SEQ ID NO: 7214263 - DNA, 22 bp, Homo sapiens
tgctgaatcaaaacaaaggttt

SEQ ID NO: 7214264 - DNA, 22 bp, Homo sapiens
tgctgaatcaaaacaaaggttt

SEQ ID NO: 7214265 - DNA, 22 bp, Homo sapiens
tgctgaatcatatggtaattct

SEQ ID NO: 7214266 - DNA, 22 bp, Homo sapiens
tgctgaattaaactctatgtgg

SEQ ID NO: 7214267 - DNA, 22 bp, Homo sapiens
tgctgaatgtgctcccttttaa

SEQ ID NO: 7214268 - DNA, 22 bp, Homo sapiens
tgctgaattaaactctatgtgg

SEQ ID NO: 7214269 - DNA, 22 bp, Homo sapiens
tgctgaattccagggccccact

SEQ ID NO: 7214270 - DNA, 22 bp, Homo sapiens
tgctgaattctaccatccattt

SEQ ID NO: 7214271 - DNA, 22 bp, Homo sapiens
tgctgaatgggtgattttggag

SEQ ID NO: 7214272 - DNA, 22 bp, Homo sapiens
tgctgaatggtaaagaagtata

SEQ ID NO: 7214273 - DNA, 22 bp, Homo sapiens
tgctgaatgctgcatgccgtat

SEQ ID NO: 7214274 - DNA, 22 bp, Homo sapiens
tgctgaatgggatatgttgagc

SEQ ID NO: 7214275 - DNA, 22 bp, Homo sapiens
tgctgaattctcattccctgga

SEQ ID NO: 7214276 - DNA, 22 bp, Homo sapiens
tgctgaattggtagtactgttg

SEQ ID NO: 7214277 - DNA, 22 bp, Homo sapiens
tgctgaatttacatttttgtag

SEQ ID NO: 7214278 - DNA, 21 bp, Homo sapiens
tgctgacatcaggtctgctat

SEQ ID NO: 7214279 - DNA, 22 bp, Homo sapiens
tgctgagaagagggccgaccca

SEQ ID NO: 7214280 - DNA, 22 bp, Homo sapiens
tgctgacctaaattgaggaaga

SEQ ID NO: 7214281 - DNA, 22 bp, Homo sapiens
tgctgaccttgttctgtgagga

SEQ ID NO: 7214282 - DNA, 22 bp, Homo sapiens
tgctgaccttgttctgtgagga

SEQ ID NO: 7214283 - DNA, 22 bp, Homo sapiens
tgctgaccttgttctgtgagga

SEQ ID NO: 7214284 - DNA, 22 bp, Homo sapiens
tgctgacgtcaatgagaacata

SEQ ID NO: 7214285 - DNA, 22 bp, Homo sapiens
tgctgagagatttaaagggcca

SEQ ID NO: 7214286 - DNA, 22 bp, Homo sapiens
tgctgagagatttaaagggcca

SEQ ID NO: 7214287 - DNA, 22 bp, Homo sapiens
tgctgagaggaaagaatgcaca

SEQ ID NO: 7214288 - DNA, 22 bp, Homo sapiens
tgctgagaggaaggtgcactgg

SEQ ID NO: 7214289 - DNA, 22 bp, Homo sapiens
tgctgagataagctatgaccag

SEQ ID NO: 7214290 - DNA, 22 bp, Homo sapiens
tgctgagataagctatgaccag

SEQ ID NO: 7214291 - DNA, 22 bp, Homo sapiens
tgctgcagaaattctgtgagga

SEQ ID NO: 7214292 - DNA, 20 bp, Homo sapiens
tgctgcagacagggccattg

SEQ ID NO: 7214293 - DNA, 22 bp, Homo sapiens
tgctgcactaggatttgctttc

SEQ ID NO: 7214294 - DNA, 22 bp, Homo sapiens
tgctgcacttatggctctgagg

SEQ ID NO: 7214295 - DNA, 22 bp, Homo sapiens
tgctgcagaaattctgtgagga

SEQ ID NO: 7214296 - DNA, 22 bp, Homo sapiens
tgctgagatagctgactaggca

SEQ ID NO: 7214297 - DNA, 22 bp, Homo sapiens
tgctgcacactattgtttagct

SEQ ID NO: 7214298 - DNA, 22 bp, Homo sapiens
tgctgcacagcccgctggccca

SEQ ID NO: 7214299 - DNA, 22 bp, Homo sapiens
tgctgcacagcccgctggccca

SEQ ID NO: 7214300 - DNA, 22 bp, Homo sapiens
tgctgcacagattgccttttac

SEQ ID NO: 7214301 - DNA, 22 bp, Homo sapiens
tgctgcacagcccacttccctg

SEQ ID NO: 7214302 - DNA, 22 bp, Homo sapiens
tgctgcacccctaagtgtctct

SEQ ID NO: 7214303 - DNA, 17 bp, Homo sapiens
tggcaagacagctcagg

SEQ ID NO: 7214304 - DNA, 17 bp, Homo sapiens
tggcaagaatggaaatg

SEQ ID NO: 7214305 - DNA, 17 bp, Homo sapiens
tggcaagacagctcagg

SEQ ID NO: 7214306 - DNA, 22 bp, Homo sapiens
tggcaagagcaaaatgtacagt

SEQ ID NO: 7214307 - DNA, 22 bp, Homo sapiens
tggcaagagggatgcaaggttt

SEQ ID NO: 7214308 - DNA, 22 bp, Homo sapiens
tggcaagagggatgcaaggttt

SEQ ID NO: 7214309 - DNA, 22 bp, Homo sapiens
tggcaagagggatgcaaggttt

SEQ ID NO: 7214310 - DNA, 22 bp, Homo sapiens
tggcaagctcgtttgggtcaga

SEQ ID NO: 7214311 - DNA, 22 bp, Homo sapiens
tggcaaggaaattagttctcct

SEQ ID NO: 7214312 - DNA, 22 bp, Homo sapiens
tggcaaggaaattagttctcct

SEQ ID NO: 7214313 - DNA, 22 bp, Homo sapiens
tggcaaggaaattagttctcct

SEQ ID NO: 7214314 - DNA, 22 bp, Homo sapiens
tggcaaggaagagcctggtgca

SEQ ID NO: 7214315 - DNA, 22 bp, Homo sapiens
tggcaaggaagagcctggtgca

SEQ ID NO: 7214316 - DNA, 22 bp, Homo sapiens
tggcaaggaagagcctggtgca

SEQ ID NO: 7214317 - DNA, 23 bp, Homo sapiens
tggcaaggaatgggatggagact

SEQ ID NO: 7214318 - DNA, 22 bp, Homo sapiens
tggcaagaatattggaccagaa

SEQ ID NO: 7214319 - DNA, 22 bp, Homo sapiens
tggcaagaatattggaccagaa

SEQ ID NO: 7214320 - DNA, 22 bp, Homo sapiens
tggcaagaaccgcaattacttt

SEQ ID NO: 7214321 - DNA, 23 bp, Homo sapiens
tggcaactccttagcacctgtgg

SEQ ID NO: 7214322 - DNA, 22 bp, Homo sapiens
tggcaagaaactgaggcctgct

SEQ ID NO: 7214323 - DNA, 22 bp, Homo sapiens
tggcaagaaactgaggcctgct

SEQ ID NO: 7214324 - DNA, 22 bp, Homo sapiens
tggatgcctgggcctccttcca

SEQ ID NO: 7214325 - DNA, 22 bp, Homo sapiens
tggatgagttcaatgaggcaga

SEQ ID NO: 7214326 - DNA, 22 bp, Homo sapiens
tggatgagattaaagtgaggtt

SEQ ID NO: 7214327 - DNA, 22 bp, Homo sapiens
tggatgagggctgagcactggg

SEQ ID NO: 7214328 - DNA, 22 bp, Homo sapiens
tggatctcggcaatgcgggact

SEQ ID NO: 7214329 - DNA, 22 bp, Homo sapiens
tggatcatgtgatgtcaggagt

SEQ ID NO: 7214330 - DNA, 22 bp, Homo sapiens
tggatccagctgctcctatgag

SEQ ID NO: 7214331 - DNA, 22 bp, Homo sapiens
tggatcctcttaatgtgtaagg

SEQ ID NO: 7214332 - DNA, 22 bp, Homo sapiens
tggatcctcttaatgtgtaagg

SEQ ID NO: 7214333 - DNA, 22 bp, Homo sapiens
tggatctcggcaatgcgggact

SEQ ID NO: 7214334 - DNA, 22 bp, Homo sapiens
ccctggcaaaatccctggtaca

SEQ ID NO: 7214335 - DNA, 22 bp, Homo sapiens
ccctggcaaaatccctggtaca

SEQ ID NO: 7214336 - DNA, 18 bp, Homo sapiens
tggagctgagggcaatgc

SEQ ID NO: 7214337 - DNA, 22 bp, Homo sapiens
tggagctgagcacctccagggc

SEQ ID NO: 7214338 - DNA, 22 bp, Homo sapiens
ccctggcctccaggcagtcctg

SEQ ID NO: 7214339 - DNA, 20 bp, Homo sapiens
ccctggcctgtttcatgccc

SEQ ID NO: 7214340 - DNA, 20 bp, Homo sapiens
ccctggcctgtttcatgccc

SEQ ID NO: 7214341 - DNA, 20 bp, Homo sapiens
ccctggcctgtttcatgccc

SEQ ID NO: 7214342 - DNA, 22 bp, Homo sapiens
ccctggcctacaggcccagaga

SEQ ID NO: 7214343 - DNA, 22 bp, Homo sapiens
ccctggcctccaggcagtcctg

SEQ ID NO: 7214344 - DNA, 22 bp, Homo sapiens
ccctggcctacaggcccagaga

SEQ ID NO: 7214345 - DNA, 22 bp, Homo sapiens
ccctggctgccagtcaccagac

SEQ ID NO: 7214346 - DNA, 22 bp, Homo sapiens
tggatcatatggataggcagta

SEQ ID NO: 7214347 - DNA, 22 bp, Homo sapiens
ccctggctgataccggaaaggc

SEQ ID NO: 7214348 - DNA, 22 bp, Homo sapiens
ccctggctgataccggaaaggc

SEQ ID NO: 7214349 - DNA, 22 bp, Homo sapiens
ccctggctcttcaccacctgcc

SEQ ID NO: 7214350 - DNA, 22 bp, Homo sapiens
ccctggctcttcaccacctgcc

SEQ ID NO: 7214351 - DNA, 22 bp, Homo sapiens
ccctggctctgcctcagagccc

SEQ ID NO: 7214352 - DNA, 22 bp, Homo sapiens
ccctggctctgcctcagagccc

SEQ ID NO: 7214353 - DNA, 23 bp, Homo sapiens
ccctggccttggggcacaggctg

SEQ ID NO: 7214354 - DNA, 22 bp, Homo sapiens
ccctggctatttttacgcaagg

SEQ ID NO: 7214355 - DNA, 22 bp, Homo sapiens
ccctggctcaggcagctttgtt

SEQ ID NO: 7214356 - DNA, 22 bp, Homo sapiens
ccctggctcaggcagctttgtt

SEQ ID NO: 7214357 - DNA, 17 bp, Homo sapiens
ccctggctctaggtgga

SEQ ID NO: 7214358 - DNA, 17 bp, Homo sapiens
ccctggctctaggtgga

SEQ ID NO: 7214359 - DNA, 17 bp, Homo sapiens
ccctggctctaggtgga

SEQ ID NO: 7214360 - DNA, 19 bp, Homo sapiens
ccctcaggtctgagcagtc

SEQ ID NO: 7214361 - DNA, 22 bp, Homo sapiens
ccctcaggtgaaaggaaaaatt

SEQ ID NO: 7214362 - DNA, 22 bp, Homo sapiens
ccctcatgtcagtccctgccca

SEQ ID NO: 7214363 - DNA, 22 bp, Homo sapiens
ccctccagagcttgacctgctg

SEQ ID NO: 7214364 - DNA, 22 bp, Homo sapiens
ccctccagagcttgacctgctg

SEQ ID NO: 7214365 - DNA, 22 bp, Homo sapiens
ccctccagagcctggacattct

SEQ ID NO: 7214366 - DNA, 22 bp, Homo sapiens
ccctccagccatggacccaggt

SEQ ID NO: 7214367 - DNA, 20 bp, Homo sapiens
ccctccagcaaccaggactt

SEQ ID NO: 7214368 - DNA, 22 bp, Homo sapiens
ccctccagccatggacccaggt

SEQ ID NO: 7214369 - DNA, 22 bp, Homo sapiens
ccctccagccatggacccaggt

SEQ ID NO: 7214370 - DNA, 22 bp, Homo sapiens
ccctccagggagccatgctggg

SEQ ID NO: 7214371 - DNA, 22 bp, Homo sapiens
ccctccagggagccatgctggg

SEQ ID NO: 7214372 - DNA, 22 bp, Homo sapiens
ccctccagggagccatgctggg

SEQ ID NO: 7214373 - DNA, 22 bp, Homo sapiens
ccctccagtgtcccagtgggga

SEQ ID NO: 7214374 - DNA, 22 bp, Homo sapiens
ccctgctgatgccttgattttg

SEQ ID NO: 7214375 - DNA, 22 bp, Homo sapiens
ccctgctgcagagagctttcca

SEQ ID NO: 7214376 - DNA, 22 bp, Homo sapiens
ccctgctgcagagagctttcca

SEQ ID NO: 7214377 - DNA, 22 bp, Homo sapiens
ccctggactgttcagggcctga

SEQ ID NO: 7214378 - DNA, 22 bp, Homo sapiens
ccctggagaaggggacgcggag

SEQ ID NO: 7214379 - DNA, 22 bp, Homo sapiens
ccctggagaaggggacgcggag

SEQ ID NO: 7214380 - DNA, 19 bp, Homo sapiens
ccctggagaataccctgga

SEQ ID NO: 7214381 - DNA, 22 bp, Homo sapiens
ccctccaggcctgtcatgttcc

SEQ ID NO: 7214382 - DNA, 22 bp, Homo sapiens
ccctccaggcctgtcatgttcc

SEQ ID NO: 7214383 - DNA, 22 bp, Homo sapiens
ccctccaggcactgccctcttc

SEQ ID NO: 7214384 - DNA, 22 bp, Homo sapiens
ccctccagggagccatgctggg

SEQ ID NO: 7214385 - DNA, 22 bp, Homo sapiens
ccctccaggcactgccctcttc

SEQ ID NO: 7214386 - DNA, 22 bp, Homo sapiens
ccctccagctcaaagcaaccgg

SEQ ID NO: 7214387 - DNA, 22 bp, Homo sapiens
ccctccaggcactgccctcttc

SEQ ID NO: 7214388 - DNA, 22 bp, Homo sapiens
ccctccaggcactgccctcttc

SEQ ID NO: 7214389 - DNA, 22 bp, Homo sapiens
ccctggagcatctctgctgtct

SEQ ID NO: 7214390 - DNA, 22 bp, Homo sapiens
ccctggagcatctctgctgtct

SEQ ID NO: 7214391 - DNA, 22 bp, Homo sapiens
ccctggagatcgggagaggaag

SEQ ID NO: 7214392 - DNA, 22 bp, Homo sapiens
ccctggagatcgggagaggaag

SEQ ID NO: 7214393 - DNA, 22 bp, Homo sapiens
ccctggagatcgggagaggaag

SEQ ID NO: 7214394 - DNA, 22 bp, Homo sapiens
ccctggagatcgggagaggaag

SEQ ID NO: 7214395 - DNA, 22 bp, Homo sapiens
ccctggagcatctctgctgtct

SEQ ID NO: 7214396 - DNA, 22 bp, Homo sapiens
ccctggagctagtctgagcaga

SEQ ID NO: 7214397 - DNA, 22 bp, Homo sapiens
ccctggagctagtctgagcaga

SEQ ID NO: 7214398 - DNA, 22 bp, Homo sapiens
ccctggagctagtctgagcaga

SEQ ID NO: 7214399 - DNA, 22 bp, Homo sapiens
ccctggagaggactcacccctg

SEQ ID NO: 7214400 - DNA, 22 bp, Homo sapiens
ccctggagaggactcacccctg

SEQ ID NO: 7214401 - DNA, 20 bp, Homo sapiens
ccctggagagaagctccacg

SEQ ID NO: 7214402 - DNA, 19 bp, Homo sapiens
ccctggagaataccctgga

SEQ ID NO: 7214403 - DNA, 19 bp, Homo sapiens
ccctggagaataccctgga

SEQ ID NO: 7214404 - DNA, 20 bp, Homo sapiens
ccctggagagaagctccacg

SEQ ID NO: 7214405 - DNA, 20 bp, Homo sapiens
ccctggagagaagctccacg

SEQ ID NO: 7214406 - DNA, 20 bp, Homo sapiens
ccctggagagaagctccacg

SEQ ID NO: 7214407 - DNA, 22 bp, Homo sapiens
tggagctgagaagtggagctct

SEQ ID NO: 7214408 - DNA, 22 bp, Homo sapiens
tggagctgagagccaggctggc

SEQ ID NO: 7214409 - DNA, 22 bp, Homo sapiens
tggagctgagagccaggctggc

SEQ ID NO: 7214410 - DNA, 22 bp, Homo sapiens
tggagctgagagccaggctggc

SEQ ID NO: 7214411 - DNA, 22 bp, Homo sapiens
tggagctgagaagtggagctct

SEQ ID NO: 7214412 - DNA, 22 bp, Homo sapiens
tggagctgagaagtggagctct

SEQ ID NO: 7214413 - DNA, 22 bp, Homo sapiens
tggagctgagaagtggagctct

SEQ ID NO: 7214414 - DNA, 22 bp, Homo sapiens
ccctggagctagtctgagcaga

SEQ ID NO: 7214415 - DNA, 23 bp, Homo sapiens
tggagctgacagtcagagggagg

SEQ ID NO: 7214416 - DNA, 23 bp, Homo sapiens
tggagctgacagtcagagggagg

SEQ ID NO: 7214417 - DNA, 22 bp, Homo sapiens
tggcacagtcctgggtgcctgc

SEQ ID NO: 7214418 - DNA, 22 bp, Homo sapiens
tggcacagtcctgggtgcctgc

SEQ ID NO: 7214419 - DNA, 22 bp, Homo sapiens
tggcacagggcttggtcgctca

SEQ ID NO: 7214420 - DNA, 22 bp, Homo sapiens
tggcacagggcttggtcgctca

SEQ ID NO: 7214421 - DNA, 22 bp, Homo sapiens
tggcacagtcctgggtgcctgc

SEQ ID NO: 7214422 - DNA, 22 bp, Homo sapiens
tggcacagtcctgggtgcctgc

SEQ ID NO: 7214423 - DNA, 22 bp, Homo sapiens
tggcagaggtaattcaaatccc

SEQ ID NO: 7214424 - DNA, 22 bp, Homo sapiens
tggcacaggagcactgccctgg

SEQ ID NO: 7214425 - DNA, 22 bp, Homo sapiens
tggcacaggagcactgccctgg

SEQ ID NO: 7214426 - DNA, 22 bp, Homo sapiens
tggcacaggatctcagcggcca

SEQ ID NO: 7214427 - DNA, 22 bp, Homo sapiens
tggcacaggatctcagcggcca

SEQ ID NO: 7214428 - DNA, 22 bp, Homo sapiens
tggcacaggatctcagcggcca

SEQ ID NO: 7214429 - DNA, 22 bp, Homo sapiens
tggcacaggatctcagcggcca

SEQ ID NO: 7214430 - DNA, 22 bp, Homo sapiens
tggcacaggcggtaagggtgtg

SEQ ID NO: 7214431 - DNA, 22 bp, Homo sapiens
tggcacaggcggtaagggtgtg

SEQ ID NO: 7214432 - DNA, 22 bp, Homo sapiens
tggcacaggaatttagatgcag

SEQ ID NO: 7214433 - DNA, 22 bp, Homo sapiens
tggcaagttcatatggtttaag

SEQ ID NO: 7214434 - DNA, 22 bp, Homo sapiens
tggcacaggaatttagatgcag

SEQ ID NO: 7214435 - DNA, 22 bp, Homo sapiens
tggcaagggattgtggagaact

SEQ ID NO: 7214436 - DNA, 23 bp, Homo sapiens
tggcaagtcatttctagtaacct

SEQ ID NO: 7214437 - DNA, 22 bp, Homo sapiens
tggcaagtggcttgtatacgcc

SEQ ID NO: 7214438 - DNA, 23 bp, Homo sapiens
tggcaaggaatgggatggagact

SEQ ID NO: 7214439 - DNA, 23 bp, Homo sapiens
tggcaaggaatgggatggagact

SEQ ID NO: 7214440 - DNA, 22 bp, Homo sapiens
tggcaaggccacaggtgcagtt

SEQ ID NO: 7214441 - DNA, 22 bp, Homo sapiens
tggcaaggccacaggtgcagtt

SEQ ID NO: 7214442 - DNA, 22 bp, Homo sapiens
tggcaaggctgtgggggcagag

SEQ ID NO: 7214443 - DNA, 22 bp, Homo sapiens
tggcaaggctgtgggggcagag

SEQ ID NO: 7214444 - DNA, 22 bp, Homo sapiens
tggcagcactaggtactgagct

SEQ ID NO: 7214445 - DNA, 22 bp, Homo sapiens
tggcagctggagggcaatggcc

SEQ ID NO: 7214446 - DNA, 22 bp, Homo sapiens
tggcagctggatcccaaggcag

SEQ ID NO: 7214447 - DNA, 22 bp, Homo sapiens
tggcagctggctctgcgcaggc

SEQ ID NO: 7214448 - DNA, 21 bp, Homo sapiens
tggcagcacccacaccctctg

SEQ ID NO: 7214449 - DNA, 22 bp, Homo sapiens
tggcagcacggcatccactctc

SEQ ID NO: 7214450 - DNA, 22 bp, Homo sapiens
tggcagcacggcatccactctc

SEQ ID NO: 7214451 - DNA, 22 bp, Homo sapiens
tggcagcacggcatccactctc

SEQ ID NO: 7214452 - DNA, 22 bp, Homo sapiens
tggcagcacaaggtggcccatg

SEQ ID NO: 7214453 - DNA, 22 bp, Homo sapiens
tggcagcacaaggtggcccatg

SEQ ID NO: 7214454 - DNA, 22 bp, Homo sapiens
tggcagcacaaggtggcccatg

SEQ ID NO: 7214455 - DNA, 22 bp, Homo sapiens
tggcagcacaaggtggcccatg

SEQ ID NO: 7214456 - DNA, 22 bp, Homo sapiens
tggcagcacattgacccgggct

SEQ ID NO: 7214457 - DNA, 22 bp, Homo sapiens
tggcagcaccagcagtgtcctt

SEQ ID NO: 7214458 - DNA, 22 bp, Homo sapiens
tggcagcaccagcagtgtcctt

SEQ ID NO: 7214459 - DNA, 22 bp, Homo sapiens
tggcagcaccagcagtgtcctt

SEQ ID NO: 7214460 - DNA, 21 bp, Homo sapiens
tggcagcacccacaccctctg

SEQ ID NO: 7214461 - DNA, 21 bp, Homo sapiens
tggcagcacccacaccctctg

SEQ ID NO: 7214462 - DNA, 21 bp, Homo sapiens
tggcagcacccacaccctctg

SEQ ID NO: 7214463 - DNA, 22 bp, Homo sapiens
tggcagcaaaaccagaatcaga

SEQ ID NO: 7214464 - DNA, 22 bp, Homo sapiens
tggcagcaaaaccagaatcaga

SEQ ID NO: 7214465 - DNA, 22 bp, Homo sapiens
tggcagcaagttcttgggaggt

SEQ ID NO: 7214466 - DNA, 22 bp, Homo sapiens
tggcagcaagttcttgggaggt

SEQ ID NO: 7214467 - DNA, 22 bp, Homo sapiens
tggcagcaattagctagagctg

SEQ ID NO: 7214468 - DNA, 22 bp, Homo sapiens
tggcagcaattagctagagctg

SEQ ID NO: 7214469 - DNA, 22 bp, Homo sapiens
tggcagcaattagctagagctg

SEQ ID NO: 7214470 - DNA, 22 bp, Homo sapiens
tggcagcaattagctagagctg

SEQ ID NO: 7214471 - DNA, 22 bp, Homo sapiens
tggcagaggtatattgggagga

SEQ ID NO: 7214472 - DNA, 22 bp, Homo sapiens
tggcagaggtatattgggagga

SEQ ID NO: 7214473 - DNA, 22 bp, Homo sapiens
tggcacagtatgggattaaaga

SEQ ID NO: 7214474 - DNA, 22 bp, Homo sapiens
tggcagatgtggcatagagcat

SEQ ID NO: 7214475 - DNA, 22 bp, Homo sapiens
tggcagatttaacattggaact

SEQ ID NO: 7214476 - DNA, 22 bp, Homo sapiens
tggcagctgtgtccaggtagaa

SEQ ID NO: 7214477 - DNA, 22 bp, Homo sapiens
tggcagctgtgtccaggtagaa

SEQ ID NO: 7214478 - DNA, 22 bp, Homo sapiens
tggcagctgtgtccaggtagaa

SEQ ID NO: 7214479 - DNA, 22 bp, Homo sapiens
tggcagctgttaatgttttgtt

SEQ ID NO: 7214480 - DNA, 22 bp, Homo sapiens
tggcagcttgaatgcagtcttt

SEQ ID NO: 7214481 - DNA, 22 bp, Homo sapiens
tggcagctggtacagtgggtct

SEQ ID NO: 7214482 - DNA, 22 bp, Homo sapiens
tggcagctggctctgcgcaggc

SEQ ID NO: 7214483 - DNA, 22 bp, Homo sapiens
tggcagctgtctgtggggtctc

SEQ ID NO: 7214484 - DNA, 22 bp, Homo sapiens
tggcagctgtgcttcattcttt

SEQ ID NO: 7214485 - DNA, 22 bp, Homo sapiens
tggcagcttgaatgcagtcttt

SEQ ID NO: 7214486 - DNA, 22 bp, Homo sapiens
tggcagcttgaatgcagtcttt

SEQ ID NO: 7214487 - DNA, 22 bp, Homo sapiens
tggcagctttttgtttcaggct

SEQ ID NO: 7214488 - DNA, 22 bp, Homo sapiens
tggccacaaagagaacgaggtc

SEQ ID NO: 7214489 - DNA, 22 bp, Homo sapiens
tggccacacccacctagaggag

SEQ ID NO: 7214490 - DNA, 22 bp, Homo sapiens
tggccacacccacctagaggag

SEQ ID NO: 7214491 - DNA, 22 bp, Homo sapiens
tggccacacccacctagaggag

SEQ ID NO: 7214492 - DNA, 22 bp, Homo sapiens
tggccacacccacctagaggag

SEQ ID NO: 7214493 - DNA, 22 bp, Homo sapiens
tggccacacccacctagaggag

SEQ ID NO: 7214494 - DNA, 22 bp, Homo sapiens
tggccagctgtaggttgtgcag

SEQ ID NO: 7214495 - DNA, 22 bp, Homo sapiens
tggccaggcaggtagaacggcc

SEQ ID NO: 7214496 - DNA, 22 bp, Homo sapiens
tggccaggcaggtagaacggcc

SEQ ID NO: 7214497 - DNA, 22 bp, Homo sapiens
tggccaggcaggtagaacggcc

SEQ ID NO: 7214498 - DNA, 22 bp, Homo sapiens
tggccaggaggctgcttctgac

SEQ ID NO: 7214499 - DNA, 22 bp, Homo sapiens
tggccaggaggctgcttctgac

SEQ ID NO: 7214500 - DNA, 22 bp, Homo sapiens
tggccaggaggctgcttctgac

SEQ ID NO: 7214501 - DNA, 22 bp, Homo sapiens
tggccagctttttgtagtgctc

SEQ ID NO: 7214502 - DNA, 22 bp, Homo sapiens
tggccagctttttgtagtgctc

SEQ ID NO: 7214503 - DNA, 22 bp, Homo sapiens
tggccagctttttgtagtgctc

SEQ ID NO: 7214504 - DNA, 23 bp, Homo sapiens
tggccaggcataaaggtgggtgg

SEQ ID NO: 7214505 - DNA, 22 bp, Homo sapiens
tggccaggcattcagataagac

SEQ ID NO: 7214506 - DNA, 22 bp, Homo sapiens
tggccaggcattcagataagac

SEQ ID NO: 7214507 - DNA, 23 bp, Homo sapiens
tggccaggcataaaggtgggtgg

SEQ ID NO: 7214508 - DNA, 22 bp, Homo sapiens
tggccaggcattcagataagac

SEQ ID NO: 7214509 - DNA, 22 bp, Homo sapiens
tggccaggcattcagataagac

SEQ ID NO: 7214510 - DNA, 22 bp, Homo sapiens
cctaggccctaggcttccatca

SEQ ID NO: 7214511 - DNA, 22 bp, Homo sapiens
cctaggccctcaaagagcataa

SEQ ID NO: 7214512 - DNA, 22 bp, Homo sapiens
cctaggccctcaaagagcataa

SEQ ID NO: 7214513 - DNA, 22 bp, Homo sapiens
cctaggccctcaaagagcataa

SEQ ID NO: 7214514 - DNA, 20 bp, Homo sapiens
cctaggccctccggctgccc

SEQ ID NO: 7214515 - DNA, 22 bp, Homo sapiens
cctaggccgcccggtgcgtggg

SEQ ID NO: 7214516 - DNA, 23 bp, Homo sapiens
tggccaggcataaaggtgggtgg

SEQ ID NO: 7214517 - DNA, 23 bp, Homo sapiens
tggccaggcataaaggtgggtgg

SEQ ID NO: 7214518 - DNA, 23 bp, Homo sapiens
tggccaggcataaaggtgggtgg

SEQ ID NO: 7214519 - DNA, 23 bp, Homo sapiens
tggccaggcataaaggtgggtgg

SEQ ID NO: 7214520 - DNA, 23 bp, Homo sapiens
tggccaggcataaaggtgggtgg

SEQ ID NO: 7214521 - DNA, 23 bp, Homo sapiens
tggccaggcataaaggtgggtgg

SEQ ID NO: 7214522 - DNA, 22 bp, Homo sapiens
tggccaggcaggtagaacggcc

SEQ ID NO: 7214523 - DNA, 22 bp, Homo sapiens
tggccaggcaggtagaacggcc

SEQ ID NO: 7214524 - DNA, 22 bp, Homo sapiens
tggccaggcaggtagaacggcc

SEQ ID NO: 7214525 - DNA, 22 bp, Homo sapiens
cctaggccttactttcctgtgc

SEQ ID NO: 7214526 - DNA, 20 bp, Homo sapiens
cctagggcaagtgggtgggc

SEQ ID NO: 7214527 - DNA, 22 bp, Homo sapiens
cctagggatacagcagagtaca

SEQ ID NO: 7214528 - DNA, 22 bp, Homo sapiens
cctatgaaacgtaatggaatgt

SEQ ID NO: 7214529 - DNA, 22 bp, Homo sapiens
cctatattcagggaactgaccc

SEQ ID NO: 7214530 - DNA, 22 bp, Homo sapiens
cctatattacaggcttgctcta

SEQ ID NO: 7214531 - DNA, 22 bp, Homo sapiens
cctatattacaggcttgctcta

SEQ ID NO: 7214532 - DNA, 22 bp, Homo sapiens
cctatgcctgtcactctgcgct

SEQ ID NO: 7214533 - DNA, 22 bp, Homo sapiens
cctagtcttccgcgtccccacc

SEQ ID NO: 7214534 - DNA, 22 bp, Homo sapiens
cctagtcttccgcgtccccacc

SEQ ID NO: 7214535 - DNA, 22 bp, Homo sapiens
cctagtcttccgcgtccccacc

SEQ ID NO: 7214536 - DNA, 21 bp, Homo sapiens
cctagtgttaaaacagtttaa

SEQ ID NO: 7214537 - DNA, 22 bp, Homo sapiens
cctagtttcttaattttgagaa

SEQ ID NO: 7214538 - DNA, 22 bp, Homo sapiens
cctagttttcattcagcagcct

SEQ ID NO: 7214539 - DNA, 20 bp, Homo sapiens
cctagttttctgagcgtgac

SEQ ID NO: 7214540 - DNA, 22 bp, Homo sapiens
cctagttttggacattcctgca

SEQ ID NO: 7214541 - DNA, 22 bp, Homo sapiens
cctagtttttcacttgtgctgt

SEQ ID NO: 7214542 - DNA, 22 bp, Homo sapiens
cctctcagcgattcctcttgga

SEQ ID NO: 7214543 - DNA, 22 bp, Homo sapiens
cctctcagcgattcctcttgga

SEQ ID NO: 7214544 - DNA, 22 bp, Homo sapiens
cctctcagccggactgtcaggc

SEQ ID NO: 7214545 - DNA, 22 bp, Homo sapiens
cctctcagccggactgtcaggc

SEQ ID NO: 7214546 - DNA, 23 bp, Homo sapiens
cctctccagacactgggccttgt

SEQ ID NO: 7214547 - DNA, 23 bp, Homo sapiens
cctctccagacactgggccttgt

SEQ ID NO: 7214548 - DNA, 23 bp, Homo sapiens
cctctccagacactgggccttgt

SEQ ID NO: 7214549 - DNA, 23 bp, Homo sapiens
cctctccagacactgggccttgt

SEQ ID NO: 7214550 - DNA, 23 bp, Homo sapiens
cctctccagacactgggccttgt

SEQ ID NO: 7214551 - DNA, 22 bp, Homo sapiens
cctctccagcggcctcagggcc

SEQ ID NO: 7214552 - DNA, 22 bp, Homo sapiens
cctctccagcggcctcagggcc

SEQ ID NO: 7214553 - DNA, 22 bp, Homo sapiens
cctctcaaaagcacaacattga

SEQ ID NO: 7214554 - DNA, 22 bp, Homo sapiens
cctctcagccggactgtcaggc

SEQ ID NO: 7214555 - DNA, 22 bp, Homo sapiens
cctctatagatgtgtgcatcta

SEQ ID NO: 7214556 - DNA, 22 bp, Homo sapiens
cctctacttaccactcagccag

SEQ ID NO: 7214557 - DNA, 22 bp, Homo sapiens
cctctaggatgtggctggagga

SEQ ID NO: 7214558 - DNA, 22 bp, Homo sapiens
cctctaaattgtttgaagttgg

SEQ ID NO: 7214559 - DNA, 22 bp, Homo sapiens
cctctacagggcatagcccaaa

SEQ ID NO: 7214560 - DNA, 22 bp, Homo sapiens
cctctacagggcatagcccaaa

SEQ ID NO: 7214561 - DNA, 18 bp, Homo sapiens
cctctacctacccctaga

SEQ ID NO: 7214562 - DNA, 22 bp, Homo sapiens
cctctacttaccactcagccag

SEQ ID NO: 7214563 - DNA, 22 bp, Homo sapiens
cctctacttaccactcagccag

SEQ ID NO: 7214564 - DNA, 21 bp, Homo sapiens
tggctgcctacatgctgcagg

SEQ ID NO: 7214565 - DNA, 22 bp, Homo sapiens
tggctgcctagtccctcagcct

SEQ ID NO: 7214566 - DNA, 22 bp, Homo sapiens
tggctgcctagtccctcagcct

SEQ ID NO: 7214567 - DNA, 22 bp, Homo sapiens
tggctgcctagtccctcagcct

SEQ ID NO: 7214568 - DNA, 22 bp, Homo sapiens
tggctgccgactggctcttggc

SEQ ID NO: 7214569 - DNA, 21 bp, Homo sapiens
tggctgcctacatgctgcagg

SEQ ID NO: 7214570 - DNA, 22 bp, Homo sapiens
tggctgccctcatgggcctgat

SEQ ID NO: 7214571 - DNA, 22 bp, Homo sapiens
tggctgccctcatgggcctgat

SEQ ID NO: 7214572 - DNA, 22 bp, Homo sapiens
tggctgccctcatgggcctgat

SEQ ID NO: 7214573 - DNA, 21 bp, Homo sapiens
tggctgcctggctctgtggtt

SEQ ID NO: 7214574 - DNA, 22 bp, Homo sapiens
tggctgcctgatcgagcaggtg

SEQ ID NO: 7214575 - DNA, 21 bp, Homo sapiens
tggctgcctggctctgtggtt

SEQ ID NO: 7214576 - DNA, 21 bp, Homo sapiens
tggctgcctggctctgtggtt

SEQ ID NO: 7214577 - DNA, 22 bp, Homo sapiens
tggctgccttccctgctggagg

SEQ ID NO: 7214578 - DNA, 22 bp, Homo sapiens
tggctgcctagtgtctgagcag

SEQ ID NO: 7214579 - DNA, 22 bp, Homo sapiens
tggctgcctagtgtctgagcag

SEQ ID NO: 7214580 - DNA, 22 bp, Homo sapiens
tggctgcctcagtgtccctgca

SEQ ID NO: 7214581 - DNA, 22 bp, Homo sapiens
tggctgcctgaatgcaagacag

SEQ ID NO: 7214582 - DNA, 22 bp, Homo sapiens
tggctgcctgaatgcaagacag

SEQ ID NO: 7214583 - DNA, 22 bp, Homo sapiens
tggctgcctgatcgagcaggtg

SEQ ID NO: 7214584 - DNA, 22 bp, Homo sapiens
cctctctcttgtagtccctgcc

SEQ ID NO: 7214585 - DNA, 22 bp, Homo sapiens
cctctctcttgtagtccctgcc

SEQ ID NO: 7214586 - DNA, 22 bp, Homo sapiens
cctctcctggctgtaggacctc

SEQ ID NO: 7214587 - DNA, 22 bp, Homo sapiens
cctctcccgggtgccgctgggc

SEQ ID NO: 7214588 - DNA, 19 bp, Homo sapiens
cctctccgcccaccagccc

SEQ ID NO: 7214589 - DNA, 19 bp, Homo sapiens
cctctccgcccaccagccc

SEQ ID NO: 7214590 - DNA, 19 bp, Homo sapiens
cctctccgcccaccagccc

SEQ ID NO: 7214591 - DNA, 22 bp, Homo sapiens
cctctcctggctgtaggacctc

SEQ ID NO: 7214592 - DNA, 22 bp, Homo sapiens
tggctgcctttcacctcatctc

SEQ ID NO: 7214593 - DNA, 22 bp, Homo sapiens
tggctgctactgagggggtctg

SEQ ID NO: 7214594 - DNA, 20 bp, Homo sapiens
cctctctgcatgctccctga

SEQ ID NO: 7214595 - DNA, 20 bp, Homo sapiens
cctctctgcatgctccctga

SEQ ID NO: 7214596 - DNA, 20 bp, Homo sapiens
cctctctgcatgctccctga

SEQ ID NO: 7214597 - DNA, 20 bp, Homo sapiens
cctctctgccctgcaaggcc

SEQ ID NO: 7214598 - DNA, 20 bp, Homo sapiens
cctctctgcatgctccctga

SEQ ID NO: 7214599 - DNA, 20 bp, Homo sapiens
cctctctgcatgctccctga

SEQ ID NO: 7214600 - DNA, 20 bp, Homo sapiens
cctctctgaagaggtcatct

SEQ ID NO: 7214601 - DNA, 20 bp, Homo sapiens
cctctctgaagaggtcatct

SEQ ID NO: 7214602 - DNA, 20 bp, Homo sapiens
cctctctgaagaggtcatct

SEQ ID NO: 7214603 - DNA, 22 bp, Homo sapiens
cctctctgtgtggcctctccat

SEQ ID NO: 7214604 - DNA, 22 bp, Homo sapiens
cctctctgtgtggcctctccat

SEQ ID NO: 7214605 - DNA, 16 bp, Homo sapiens
cctctcttattcctcc

SEQ ID NO: 7214606 - DNA, 22 bp, Homo sapiens
cctctcttggatgtggatgggt

SEQ ID NO: 7214607 - DNA, 22 bp, Homo sapiens
cctctctgtgtggcctctccat

SEQ ID NO: 7214608 - DNA, 22 bp, Homo sapiens
cctctctgtgtggcctctccat

SEQ ID NO: 7214609 - DNA, 22 bp, Homo sapiens
cctctctgtcacaccagtggcc

SEQ ID NO: 7214610 - DNA, 22 bp, Homo sapiens
cctctctgtgtggcctctccat

SEQ ID NO: 7214611 - DNA, 22 bp, Homo sapiens
cctctctgtagcagcccccagt

SEQ ID NO: 7214612 - DNA, 22 bp, Homo sapiens
cctctctgtcacaccagtggcc

SEQ ID NO: 7214613 - DNA, 22 bp, Homo sapiens
cctctctgtcacaccagtggcc

SEQ ID NO: 7214614 - DNA, 22 bp, Homo sapiens
cctctctgtaagggtccctccc

SEQ ID NO: 7214615 - DNA, 22 bp, Homo sapiens
cctctctgtaagggtccctccc

SEQ ID NO: 7214616 - DNA, 22 bp, Homo sapiens
cctctctgtagcagcccccagt

SEQ ID NO: 7214617 - DNA, 22 bp, Homo sapiens
cctctctgtaagggtccctccc

SEQ ID NO: 7214618 - DNA, 22 bp, Homo sapiens
cctctggggcatcagacaaagg

SEQ ID NO: 7214619 - DNA, 22 bp, Homo sapiens
cctctgggggcttccttaccct

SEQ ID NO: 7214620 - DNA, 22 bp, Homo sapiens
cctctgggggcttccttaccct

SEQ ID NO: 7214621 - DNA, 22 bp, Homo sapiens
cctctgggctgcctgcacgggt

SEQ ID NO: 7214622 - DNA, 22 bp, Homo sapiens
cctctgggctgcctgcacgggt

SEQ ID NO: 7214623 - DNA, 22 bp, Homo sapiens
cctctgggctggaaaattaatg

SEQ ID NO: 7214624 - DNA, 22 bp, Homo sapiens
cctctggctgtaccactggcac

SEQ ID NO: 7214625 - DNA, 22 bp, Homo sapiens
cctctgaggtgagcccagctgg

SEQ ID NO: 7214626 - DNA, 22 bp, Homo sapiens
cctctgagctggcctgtggggc

SEQ ID NO: 7214627 - DNA, 22 bp, Homo sapiens
cctctgaggtcatggacttggc

SEQ ID NO: 7214628 - DNA, 22 bp, Homo sapiens
cctctgagctggcctgtggggc

SEQ ID NO: 7214629 - DNA, 22 bp, Homo sapiens
cctctgagaccagctctgcacc

SEQ ID NO: 7214630 - DNA, 22 bp, Homo sapiens
cctctgagaccagctctgcacc

SEQ ID NO: 7214631 - DNA, 22 bp, Homo sapiens
cctctgacttctctttattggc

SEQ ID NO: 7214632 - DNA, 22 bp, Homo sapiens
cctctgagaacacctggcgtcc

SEQ ID NO: 7214633 - DNA, 22 bp, Homo sapiens
cctctgagagaaggccttcagc

SEQ ID NO: 7214634 - DNA, 22 bp, Homo sapiens
cctctgagagaaggccttcagc

SEQ ID NO: 7214635 - DNA, 22 bp, Homo sapiens
cctctgagaggccatctctcct

SEQ ID NO: 7214636 - DNA, 22 bp, Homo sapiens
cctctgagaggccatctctcct

SEQ ID NO: 7214637 - DNA, 22 bp, Homo sapiens
cctctgagccagcgtcttctct

SEQ ID NO: 7214638 - DNA, 22 bp, Homo sapiens
cctctgagcctgtgtgcggcac

SEQ ID NO: 7214639 - DNA, 23 bp, Homo sapiens
cctctctttttaggtggtgtttg

SEQ ID NO: 7214640 - DNA, 22 bp, Homo sapiens
cctctgaattttggctatgtag

SEQ ID NO: 7214641 - DNA, 23 bp, Homo sapiens
cctctgacaatgatgtcacctgc

SEQ ID NO: 7214642 - DNA, 22 bp, Homo sapiens
cctctgacacttgtcccacaca

SEQ ID NO: 7214643 - DNA, 22 bp, Homo sapiens
cctctgaccctggtggtggcca

SEQ ID NO: 7214644 - DNA, 22 bp, Homo sapiens
cctctgactccacacttgaact

SEQ ID NO: 7214645 - DNA, 22 bp, Homo sapiens
cctctgactccagaaactccag

SEQ ID NO: 7214646 - DNA, 22 bp, Homo sapiens
cctctgactcctggacttgggg

SEQ ID NO: 7214647 - DNA, 23 bp, Homo sapiens
cctctctttttaggtggtgtttg

SEQ ID NO: 7214648 - DNA, 23 bp, Homo sapiens
cctctctttttaggtggtgtttg

SEQ ID NO: 7214649 - DNA, 22 bp, Homo sapiens
cctctctttcctacaccttgga

SEQ ID NO: 7214650 - DNA, 22 bp, Homo sapiens
cctctctttcctacaccttgga

SEQ ID NO: 7214651 - DNA, 22 bp, Homo sapiens
cctctctttcctacaccttgga

SEQ ID NO: 7214652 - DNA, 22 bp, Homo sapiens
cctctcttggccgcagtcttct

SEQ ID NO: 7214653 - DNA, 22 bp, Homo sapiens
cctctcttggccgcagtcttct

SEQ ID NO: 7214654 - DNA, 22 bp, Homo sapiens
cctctgggtgacagactcttgg

SEQ ID NO: 7214655 - DNA, 22 bp, Homo sapiens
cctctgggtatctgtggaagta

SEQ ID NO: 7214656 - DNA, 22 bp, Homo sapiens
cctctgggtgggaggccgggcg

SEQ ID NO: 7214657 - DNA, 22 bp, Homo sapiens
cctctgggtgggaggccgggcg

SEQ ID NO: 7214658 - DNA, 22 bp, Homo sapiens
cctctggggtctagcaatagca

SEQ ID NO: 7214659 - DNA, 22 bp, Homo sapiens
cctctggggtctagcaatagca

SEQ ID NO: 7214660 - DNA, 22 bp, Homo sapiens
cctctgggggtcctcagagtct

SEQ ID NO: 7214661 - DNA, 22 bp, Homo sapiens
cctctgggggtcctcagagtct

SEQ ID NO: 7214662 - DNA, 22 bp, Homo sapiens
cctctgggggtcctcagagtct

SEQ ID NO: 7214663 - DNA, 22 bp, Homo sapiens
cctctgggggtcctcagagtct

SEQ ID NO: 7214664 - DNA, 22 bp, Homo sapiens
cctctggggtgagtgggccact

SEQ ID NO: 7214665 - DNA, 22 bp, Homo sapiens
cctctggggtgagtgggccact

SEQ ID NO: 7214666 - DNA, 22 bp, Homo sapiens
cctctggggtgagtgggccact

SEQ ID NO: 7214667 - DNA, 22 bp, Homo sapiens
cctctgggtatctgtggaagta

SEQ ID NO: 7214668 - DNA, 22 bp, Homo sapiens
cctctgtaatgattcactgaat

SEQ ID NO: 7214669 - DNA, 22 bp, Homo sapiens
cctctgtagtaagagaacatat

SEQ ID NO: 7214670 - DNA, 22 bp, Homo sapiens
cctctgggtgggaggccgggcg

SEQ ID NO: 7214671 - DNA, 22 bp, Homo sapiens
cctctgggtgggaggccgggcg

SEQ ID NO: 7214672 - DNA, 22 bp, Homo sapiens
cctctgggttagtttagggagc

SEQ ID NO: 7214673 - DNA, 22 bp, Homo sapiens
cctctgggttagtttagggagc

SEQ ID NO: 7214674 - DNA, 18 bp, Homo sapiens
cctctgggttttgttccc

SEQ ID NO: 7214675 - DNA, 22 bp, Homo sapiens
cctctgtccccagtgcaggcct

SEQ ID NO: 7214676 - DNA, 22 bp, Homo sapiens
cctctgtgacaaacagtcctgg

SEQ ID NO: 7214677 - DNA, 22 bp, Homo sapiens
cctctgtgacttctaccttcac

SEQ ID NO: 7214678 - DNA, 22 bp, Homo sapiens
cctctgtgacttctaccttcac

SEQ ID NO: 7214679 - DNA, 22 bp, Homo sapiens
cctctgtgatttctgagccaat

SEQ ID NO: 7214680 - DNA, 22 bp, Homo sapiens
tggctcatctttttagacttat

SEQ ID NO: 7214681 - DNA, 22 bp, Homo sapiens
tggctcatgcatcttttctaca

SEQ ID NO: 7214682 - DNA, 22 bp, Homo sapiens
tggctcatgcctgtaatcttag

SEQ ID NO: 7214683 - DNA, 22 bp, Homo sapiens
tggctcagtttgggggattgaa

SEQ ID NO: 7214684 - DNA, 22 bp, Homo sapiens
tggctcatattgagtgatttct

SEQ ID NO: 7214685 - DNA, 22 bp, Homo sapiens
tggctcagtttctgcccagctg

SEQ ID NO: 7214686 - DNA, 22 bp, Homo sapiens
tggctcagtttctgcccagctg

SEQ ID NO: 7214687 - DNA, 22 bp, Homo sapiens
tggctcagtttgggggattgaa

SEQ ID NO: 7214688 - DNA, 22 bp, Homo sapiens
tggctcagtttgggggattgaa

SEQ ID NO: 7214689 - DNA, 22 bp, Homo sapiens
tggctcagtttgggggattgaa

SEQ ID NO: 7214690 - DNA, 22 bp, Homo sapiens
tggctcagtttcagtcctggtt

SEQ ID NO: 7214691 - DNA, 22 bp, Homo sapiens
tggctcagtttcagtcctggtt

SEQ ID NO: 7214692 - DNA, 22 bp, Homo sapiens
tggctcagtttctgcccagctg

SEQ ID NO: 7214693 - DNA, 22 bp, Homo sapiens
tggctcagtttctgcccagctg

SEQ ID NO: 7214694 - DNA, 22 bp, Homo sapiens
tggctcagtttagcagctcagt

SEQ ID NO: 7214695 - DNA, 22 bp, Homo sapiens
tggctcagtttagcagctcagt

SEQ ID NO: 7214696 - DNA, 22 bp, Homo sapiens
tggctcagtttcagtcctggtt

SEQ ID NO: 7214697 - DNA, 22 bp, Homo sapiens
tggctcagtttcagtcctggtt

SEQ ID NO: 7214698 - DNA, 22 bp, Homo sapiens
tggctcagtttcagtcctggtt

SEQ ID NO: 7214699 - DNA, 22 bp, Homo sapiens
tggccctgctgggtcagagctg

SEQ ID NO: 7214700 - DNA, 22 bp, Homo sapiens
tggccctgctggccaaaggcta

SEQ ID NO: 7214701 - DNA, 22 bp, Homo sapiens
tggccctgctgggtcagagctg

SEQ ID NO: 7214702 - DNA, 22 bp, Homo sapiens
tggccctgctgggtcagagctg

SEQ ID NO: 7214703 - DNA, 22 bp, Homo sapiens
tggccctgctgtatcatctgct

SEQ ID NO: 7214704 - DNA, 22 bp, Homo sapiens
tggccctgctgtatcatctgct

SEQ ID NO: 7214705 - DNA, 22 bp, Homo sapiens
tggccctgctgtatcatctgct

SEQ ID NO: 7214706 - DNA, 22 bp, Homo sapiens
tggccctgcttatgtctctctt

SEQ ID NO: 7214707 - DNA, 22 bp, Homo sapiens
tggctcagctgactcggcttct

SEQ ID NO: 7214708 - DNA, 22 bp, Homo sapiens
tggctcagctgactcggcttct

SEQ ID NO: 7214709 - DNA, 22 bp, Homo sapiens
tggctcagctgtcacagcctgg

SEQ ID NO: 7214710 - DNA, 22 bp, Homo sapiens
tggctcagctgtcacagcctgg

SEQ ID NO: 7214711 - DNA, 22 bp, Homo sapiens
tggctcagctgtcacagcctgg

SEQ ID NO: 7214712 - DNA, 22 bp, Homo sapiens
tggctcagctgtcacagcctgg

SEQ ID NO: 7214713 - DNA, 21 bp, Homo sapiens
tggctcagttgctgggcacag

SEQ ID NO: 7214714 - DNA, 22 bp, Homo sapiens
tggctcagctgtcacagcctgg

SEQ ID NO: 7214715 - DNA, 21 bp, Homo sapiens
tggctcagttgctgggcacag

SEQ ID NO: 7214716 - DNA, 22 bp, Homo sapiens
tggctcagtttagcagctcagt

SEQ ID NO: 7214717 - DNA, 22 bp, Homo sapiens
tggctcagtttagcagctcagt

SEQ ID NO: 7214718 - DNA, 22 bp, Homo sapiens
tggctcagtttagcagctcagt

SEQ ID NO: 7214719 - DNA, 22 bp, Homo sapiens
tggccctgctggccaaaggcta

SEQ ID NO: 7214720 - DNA, 22 bp, Homo sapiens
tggccctgctggacacgcctgc

SEQ ID NO: 7214721 - DNA, 22 bp, Homo sapiens
tggccctgctggacacgcctgc

SEQ ID NO: 7214722 - DNA, 22 bp, Homo sapiens
tggccctgctggacacgcctgc

SEQ ID NO: 7214723 - DNA, 22 bp, Homo sapiens
tggccctgctatgatcctgcaa

SEQ ID NO: 7214724 - DNA, 22 bp, Homo sapiens
tggccctgctatgatcctgcaa

SEQ ID NO: 7214725 - DNA, 22 bp, Homo sapiens
tggccctgctatgatcctgcaa

SEQ ID NO: 7214726 - DNA, 22 bp, Homo sapiens
tggcccctggcacacggaggat

SEQ ID NO: 7214727 - DNA, 22 bp, Homo sapiens
tggcccgaagatccgagggtca

SEQ ID NO: 7214728 - DNA, 22 bp, Homo sapiens
tggcccgaagatccgagggtca

SEQ ID NO: 7214729 - DNA, 22 bp, Homo sapiens
tggcccgaagatccgagggtca

SEQ ID NO: 7214730 - DNA, 22 bp, Homo sapiens
tggccccattttacagatgaaa

SEQ ID NO: 7214731 - DNA, 22 bp, Homo sapiens
tggccccccagagctggaggac

SEQ ID NO: 7214732 - DNA, 22 bp, Homo sapiens
tggccccccagagctggaggac

SEQ ID NO: 7214733 - DNA, 22 bp, Homo sapiens
tggccccctgattgtcaccttt

SEQ ID NO: 7214734 - DNA, 22 bp, Homo sapiens
tggcccctgaggagcatcagcc

SEQ ID NO: 7214735 - DNA, 22 bp, Homo sapiens
tggcccctgaggagcgtcagcc

SEQ ID NO: 7214736 - DNA, 20 bp, Homo sapiens
tggcccagtggggcagggtg

SEQ ID NO: 7214737 - DNA, 20 bp, Homo sapiens
tggcccagtggggcagggtg

SEQ ID NO: 7214738 - DNA, 20 bp, Homo sapiens
tggcccagtggggcagggtg

SEQ ID NO: 7214739 - DNA, 20 bp, Homo sapiens
tggcccagtggggcagggtg

SEQ ID NO: 7214740 - DNA, 20 bp, Homo sapiens
tggcccagtggggcagggtg

SEQ ID NO: 7214741 - DNA, 22 bp, Homo sapiens
tggccccacagggccttttcag

SEQ ID NO: 7214742 - DNA, 22 bp, Homo sapiens
tggccccatcaagggatgagtt

SEQ ID NO: 7214743 - DNA, 22 bp, Homo sapiens
tggccccatcaagggatgagtt

SEQ ID NO: 7214744 - DNA, 22 bp, Homo sapiens
tggccccatcaagggatgagtt

SEQ ID NO: 7214745 - DNA, 22 bp, Homo sapiens
tggccccattttacagatgaaa

SEQ ID NO: 7214746 - DNA, 22 bp, Homo sapiens
tggccccattttacagatgaaa

SEQ ID NO: 7214747 - DNA, 22 bp, Homo sapiens
tggccccatcaagggatgagtt

SEQ ID NO: 7214748 - DNA, 22 bp, Homo sapiens
tggcccagtgcttatgctctga

SEQ ID NO: 7214749 - DNA, 22 bp, Homo sapiens
tggcccagtgcttatgctctga

SEQ ID NO: 7214750 - DNA, 22 bp, Homo sapiens
tggcccagtgcttatgctctga

SEQ ID NO: 7214751 - DNA, 22 bp, Homo sapiens
tggcccagtgcttatgctctga

SEQ ID NO: 7214752 - DNA, 22 bp, Homo sapiens
tggcccagccctgctctagggc

SEQ ID NO: 7214753 - DNA, 22 bp, Homo sapiens
tggcccagccctgctctagggc

SEQ ID NO: 7214754 - DNA, 22 bp, Homo sapiens
tggcccagccctgctctagggc

SEQ ID NO: 7214755 - DNA, 22 bp, Homo sapiens
tggcccagcagttctgccccag

SEQ ID NO: 7214756 - DNA, 22 bp, Homo sapiens
cctccagcattactggcccatg

SEQ ID NO: 7214757 - DNA, 22 bp, Homo sapiens
cctccagcattactggcccatg

SEQ ID NO: 7214758 - DNA, 22 bp, Homo sapiens
cctccagcattactggcccatg

SEQ ID NO: 7214759 - DNA, 22 bp, Homo sapiens
cctccagagggtttcccatgaa

SEQ ID NO: 7214760 - DNA, 22 bp, Homo sapiens
cctccagcattactggcccatg

SEQ ID NO: 7214761 - DNA, 22 bp, Homo sapiens
cctccactgcttcccagctttg

SEQ ID NO: 7214762 - DNA, 20 bp, Homo sapiens
cctccactgtcactgacctg

SEQ ID NO: 7214763 - DNA, 20 bp, Homo sapiens
cctccactgtcactgacctg

SEQ ID NO: 7214764 - DNA, 22 bp, Homo sapiens
cctccagagggaagtactttct

SEQ ID NO: 7214765 - DNA, 22 bp, Homo sapiens
cctccaagtttgactcaggaca

SEQ ID NO: 7214766 - DNA, 22 bp, Homo sapiens
cctccacaggagctgcagtgct

SEQ ID NO: 7214767 - DNA, 22 bp, Homo sapiens
cctccaagtttgactcaggaca

SEQ ID NO: 7214768 - DNA, 22 bp, Homo sapiens
cctccactctggcctctcaggt

SEQ ID NO: 7214769 - DNA, 22 bp, Homo sapiens
cctccactctggcctctcaggt

SEQ ID NO: 7214770 - DNA, 22 bp, Homo sapiens
cctccactctggcctctcaggt

SEQ ID NO: 7214771 - DNA, 22 bp, Homo sapiens
cctccactctggcctctcaggt

SEQ ID NO: 7214772 - DNA, 22 bp, Homo sapiens
cctccactctggcctctcaggt

SEQ ID NO: 7214773 - DNA, 22 bp, Homo sapiens
cctccactctggcctctcaggt

SEQ ID NO: 7214774 - DNA, 22 bp, Homo sapiens
cctccactgcttcccagctttg

SEQ ID NO: 7214775 - DNA, 22 bp, Homo sapiens
tggctgagggggcagttcagga

SEQ ID NO: 7214776 - DNA, 22 bp, Homo sapiens
tggctgagggggcagttcagga

SEQ ID NO: 7214777 - DNA, 22 bp, Homo sapiens
tggctgagggggcagttcagga

SEQ ID NO: 7214778 - DNA, 22 bp, Homo sapiens
tggctgagagcaattgactctg

SEQ ID NO: 7214779 - DNA, 22 bp, Homo sapiens
cctccagcgcgatccactccgg

SEQ ID NO: 7214780 - DNA, 22 bp, Homo sapiens
cctccagcgcgatccactccgg

SEQ ID NO: 7214781 - DNA, 22 bp, Homo sapiens
cctccagcgcgatccactccgg

SEQ ID NO: 7214782 - DNA, 22 bp, Homo sapiens
cctccagcgcgatccactccgg

SEQ ID NO: 7214783 - DNA, 22 bp, Homo sapiens
cctccagccttcctgaagagcc

SEQ ID NO: 7214784 - DNA, 22 bp, Homo sapiens
cctccagcgcgatccactccgg

SEQ ID NO: 7214785 - DNA, 22 bp, Homo sapiens
cctccagccttcctgaagagcc

SEQ ID NO: 7214786 - DNA, 22 bp, Homo sapiens
tggctgagggggctctgctcag

SEQ ID NO: 7214787 - DNA, 22 bp, Homo sapiens
tggctgagggggctctgctcag

SEQ ID NO: 7214788 - DNA, 22 bp, Homo sapiens
tggctgaggtaactatgaataa

SEQ ID NO: 7214789 - DNA, 22 bp, Homo sapiens
tggctgaggtaactatgaataa

SEQ ID NO: 7214790 - DNA, 22 bp, Homo sapiens
tggctgaggtctggggcttctg

SEQ ID NO: 7214791 - DNA, 23 bp, Homo sapiens
tggctgaggtccaggtagtttca

SEQ ID NO: 7214792 - DNA, 23 bp, Homo sapiens
tggctgaggtccaggtagtttca

SEQ ID NO: 7214793 - DNA, 22 bp, Homo sapiens
cctcctagaggaaccccagggc

SEQ ID NO: 7214794 - DNA, 22 bp, Homo sapiens
cctccctgtctacctgttgtgg

SEQ ID NO: 7214795 - DNA, 22 bp, Homo sapiens
cctcccttcagtagagcccaat

SEQ ID NO: 7214796 - DNA, 22 bp, Homo sapiens
cctccctgggtgacgggctcct

SEQ ID NO: 7214797 - DNA, 22 bp, Homo sapiens
cctccctgggtgacgggctcct

SEQ ID NO: 7214798 - DNA, 22 bp, Homo sapiens
cctccctgggtgctgggattgc

SEQ ID NO: 7214799 - DNA, 22 bp, Homo sapiens
cctccctggtggctctggtcta

SEQ ID NO: 7214800 - DNA, 22 bp, Homo sapiens
cctccctggccagagcagcagc

SEQ ID NO: 7214801 - DNA, 22 bp, Homo sapiens
cctccctggccagagcagcagc

SEQ ID NO: 7214802 - DNA, 22 bp, Homo sapiens
cctccctggccagagcagcagc

SEQ ID NO: 7214803 - DNA, 22 bp, Homo sapiens
cctcctggtccagcatctcttt

SEQ ID NO: 7214804 - DNA, 22 bp, Homo sapiens
cctcctctgggaagattcagag

SEQ ID NO: 7214805 - DNA, 22 bp, Homo sapiens
cctcctggtccagcatctcttt

SEQ ID NO: 7214806 - DNA, 22 bp, Homo sapiens
cctcctctgggaagattcagag

SEQ ID NO: 7214807 - DNA, 22 bp, Homo sapiens
cctcctctgggaagattcagag

SEQ ID NO: 7214808 - DNA, 22 bp, Homo sapiens
cctcctccttatggtggcccag

SEQ ID NO: 7214809 - DNA, 22 bp, Homo sapiens
cctcctagaggaaccccagggc

SEQ ID NO: 7214810 - DNA, 23 bp, Homo sapiens
cctcctcatatctttgactagtg

SEQ ID NO: 7214811 - DNA, 23 bp, Homo sapiens
cctcctcatatctttgactagtg

SEQ ID NO: 7214812 - DNA, 22 bp, Homo sapiens
cctcggagaaaggcagctccac

SEQ ID NO: 7214813 - DNA, 22 bp, Homo sapiens
cctcctggtccagcatctcttt

SEQ ID NO: 7214814 - DNA, 18 bp, Homo sapiens
cctcggagcctccgtgtc

SEQ ID NO: 7214815 - DNA, 18 bp, Homo sapiens
cctcggagcctccgtgtc

SEQ ID NO: 7214816 - DNA, 22 bp, Homo sapiens
cctcggaggcggaggctgcagt

SEQ ID NO: 7214817 - DNA, 22 bp, Homo sapiens
cctcggctgcccagcccagctg

SEQ ID NO: 7214818 - DNA, 22 bp, Homo sapiens
cctcggctgcccagcccagctg

SEQ ID NO: 7214819 - DNA, 22 bp, Homo sapiens
cctcggggcaccgcggcctgct

SEQ ID NO: 7214820 - DNA, 22 bp, Homo sapiens
cctcggtttccacatctgtaca

SEQ ID NO: 7214821 - DNA, 22 bp, Homo sapiens
cctcgtccacaatccttgcaca

SEQ ID NO: 7214822 - DNA, 22 bp, Homo sapiens
cctggccatagggcccaggaaa

SEQ ID NO: 7214823 - DNA, 22 bp, Homo sapiens
cctggccatagggcccaggaaa

SEQ ID NO: 7214824 - DNA, 22 bp, Homo sapiens
cctggccatagggcccaggaaa

SEQ ID NO: 7214825 - DNA, 22 bp, Homo sapiens
cctggccagggtctgggctgct

SEQ ID NO: 7214826 - DNA, 22 bp, Homo sapiens
cctggccagggtctgggctgct

SEQ ID NO: 7214827 - DNA, 22 bp, Homo sapiens
cctggccagggtctgggctgct

SEQ ID NO: 7214828 - DNA, 22 bp, Homo sapiens
cctggccagggtctgggctgct

SEQ ID NO: 7214829 - DNA, 22 bp, Homo sapiens
cctggccagtttccaggccctg

SEQ ID NO: 7214830 - DNA, 22 bp, Homo sapiens
cctggccagtttccaggccctg

SEQ ID NO: 7214831 - DNA, 22 bp, Homo sapiens
cctggccagctaattgcccatc

SEQ ID NO: 7214832 - DNA, 22 bp, Homo sapiens
cctggccaggcatggagtcaca

SEQ ID NO: 7214833 - DNA, 22 bp, Homo sapiens
cctggccaggcatggagtcaca

SEQ ID NO: 7214834 - DNA, 22 bp, Homo sapiens
cctggccaggcatggagtcaca

SEQ ID NO: 7214835 - DNA, 22 bp, Homo sapiens
cctggccaggcatggagtcaca

SEQ ID NO: 7214836 - DNA, 22 bp, Homo sapiens
cctggccaggcatggagtcaca

SEQ ID NO: 7214837 - DNA, 22 bp, Homo sapiens
cctggccaggctccaagtactg

SEQ ID NO: 7214838 - DNA, 22 bp, Homo sapiens
cctggccaggctctcagcactg

SEQ ID NO: 7214839 - DNA, 22 bp, Homo sapiens
cctggccagggtctgggctgct

SEQ ID NO: 7214840 - DNA, 22 bp, Homo sapiens
cctggcagttttgcccaggatt

SEQ ID NO: 7214841 - DNA, 22 bp, Homo sapiens
cctggcagttttgcccaggatt

SEQ ID NO: 7214842 - DNA, 22 bp, Homo sapiens
cctggcagttttgcccaggatt

SEQ ID NO: 7214843 - DNA, 22 bp, Homo sapiens
cctggcagttttgcccaggatt

SEQ ID NO: 7214844 - DNA, 22 bp, Homo sapiens
cctggcagttcatcaaatggca

SEQ ID NO: 7214845 - DNA, 22 bp, Homo sapiens
cctggcagttcatcaaatggca

SEQ ID NO: 7214846 - DNA, 22 bp, Homo sapiens
cctggcagttcatcaaatggca

SEQ ID NO: 7214847 - DNA, 22 bp, Homo sapiens
cctggcagtggtgaagaagagg

SEQ ID NO: 7214848 - DNA, 22 bp, Homo sapiens
cctggcagtggtgaagaagagg

SEQ ID NO: 7214849 - DNA, 22 bp, Homo sapiens
cctggcagttttgcccaggatt

SEQ ID NO: 7214850 - DNA, 22 bp, Homo sapiens
cctggcatataaatagaagatg

SEQ ID NO: 7214851 - DNA, 22 bp, Homo sapiens
cctggcatataaatagaagatg

SEQ ID NO: 7214852 - DNA, 22 bp, Homo sapiens
cctggcatccctctccttacgc

SEQ ID NO: 7214853 - DNA, 22 bp, Homo sapiens
cctggcatccggaacctggaaa

SEQ ID NO: 7214854 - DNA, 22 bp, Homo sapiens
cctggcatctgagcctggcctg

SEQ ID NO: 7214855 - DNA, 22 bp, Homo sapiens
cctggcatgaggagcatgaggt

SEQ ID NO: 7214856 - DNA, 22 bp, Homo sapiens
cctggcatggggtctccagcca

SEQ ID NO: 7214857 - DNA, 22 bp, Homo sapiens
cctggcatggggtctccagcca

SEQ ID NO: 7214858 - DNA, 22 bp, Homo sapiens
cctggcatgtcctcctggcatg

SEQ ID NO: 7214859 - DNA, 22 bp, Homo sapiens
cctggcatgtcctcctggcatg

SEQ ID NO: 7214860 - DNA, 22 bp, Homo sapiens
cctggcattctctccagagaga

SEQ ID NO: 7214861 - DNA, 22 bp, Homo sapiens
cctggccagccagggctggggt

SEQ ID NO: 7214862 - DNA, 22 bp, Homo sapiens
cctggccagcgccggctgctcg

SEQ ID NO: 7214863 - DNA, 22 bp, Homo sapiens
cctggccagcgccggctgctcg

SEQ ID NO: 7214864 - DNA, 22 bp, Homo sapiens
cctggccagcgccggctgctcg

SEQ ID NO: 7214865 - DNA, 22 bp, Homo sapiens
tgtcctcatcctccagtctgtc

SEQ ID NO: 7214866 - DNA, 22 bp, Homo sapiens
tgtcctcatcctccagtctgtc

SEQ ID NO: 7214867 - DNA, 22 bp, Homo sapiens
tgtcctcatcttttccagaaat

SEQ ID NO: 7214868 - DNA, 22 bp, Homo sapiens
tgtcctcatcttttccagaaat

SEQ ID NO: 7214869 - DNA, 22 bp, Homo sapiens
tgtcctcgctgagcatcttata

SEQ ID NO: 7214870 - DNA, 22 bp, Homo sapiens
tgtcccagacataagtggacat

SEQ ID NO: 7214871 - DNA, 23 bp, Homo sapiens
tgtcccagagggagggataggct

SEQ ID NO: 7214872 - DNA, 23 bp, Homo sapiens
tgtcccagagggagggataggct

SEQ ID NO: 7214873 - DNA, 22 bp, Homo sapiens
tgtcccagatactggacataga

SEQ ID NO: 7214874 - DNA, 22 bp, Homo sapiens
tgtcccagatcacaggagggga

SEQ ID NO: 7214875 - DNA, 22 bp, Homo sapiens
tgtccattgcttatttctactt

SEQ ID NO: 7214876 - DNA, 22 bp, Homo sapiens
tgtccatggggaaggggaagtg

SEQ ID NO: 7214877 - DNA, 22 bp, Homo sapiens
cctggcccacatggcttctccc

SEQ ID NO: 7214878 - DNA, 22 bp, Homo sapiens
cctggcaggcaagaggaaggga

SEQ ID NO: 7214879 - DNA, 22 bp, Homo sapiens
cctggcaggcaagaggaaggga

SEQ ID NO: 7214880 - DNA, 22 bp, Homo sapiens
cctggcaggactgttgtaagaa

SEQ ID NO: 7214881 - DNA, 22 bp, Homo sapiens
cctggcaggactgttgtaagaa

SEQ ID NO: 7214882 - DNA, 22 bp, Homo sapiens
cctggcaggcccctcctggatt

SEQ ID NO: 7214883 - DNA, 22 bp, Homo sapiens
cctggcaggcccctcctggatt

SEQ ID NO: 7214884 - DNA, 22 bp, Homo sapiens
cctggcaggcaagaggaaggga

SEQ ID NO: 7214885 - DNA, 22 bp, Homo sapiens
cctggcaggcccctcctggatt

SEQ ID NO: 7214886 - DNA, 22 bp, Homo sapiens
cctggcaggctggggacagtgc

SEQ ID NO: 7214887 - DNA, 22 bp, Homo sapiens
cctggcaggctggggacagtgc

SEQ ID NO: 7214888 - DNA, 22 bp, Homo sapiens
cctggcaggctggggacagtgc

SEQ ID NO: 7214889 - DNA, 22 bp, Homo sapiens
cctggcaggctggggacagtgc

SEQ ID NO: 7214890 - DNA, 20 bp, Homo sapiens
cctggcaggcgggttactta

SEQ ID NO: 7214891 - DNA, 20 bp, Homo sapiens
cctggcaggcgggttactta

SEQ ID NO: 7214892 - DNA, 20 bp, Homo sapiens
cctggcaggcgggttactta

SEQ ID NO: 7214893 - DNA, 22 bp, Homo sapiens
cctggcagtcaggggagtcctt

SEQ ID NO: 7214894 - DNA, 22 bp, Homo sapiens
cctggcagtcaggggagtcctt

SEQ ID NO: 7214895 - DNA, 22 bp, Homo sapiens
cctggcagtcaggggagtcctt

SEQ ID NO: 7214896 - DNA, 22 bp, Homo sapiens
cctggcagtcaggggagtcctt

SEQ ID NO: 7214897 - DNA, 22 bp, Homo sapiens
cctggcaggttacaaccagtta

SEQ ID NO: 7214898 - DNA, 22 bp, Homo sapiens
cctggcagtcaggggagtcctt

SEQ ID NO: 7214899 - DNA, 22 bp, Homo sapiens
cctggcagtcaggggagtcctt

SEQ ID NO: 7214900 - DNA, 22 bp, Homo sapiens
cctggcagtcaggggagtcctt

SEQ ID NO: 7214901 - DNA, 22 bp, Homo sapiens
cctggcaggttacaaccagtta

SEQ ID NO: 7214902 - DNA, 22 bp, Homo sapiens
cctggcaggtggcgccctcggc

SEQ ID NO: 7214903 - DNA, 22 bp, Homo sapiens
cctggcaggtggcgccctcggc

SEQ ID NO: 7214904 - DNA, 22 bp, Homo sapiens
cctggcaggtggcgccctcggc

SEQ ID NO: 7214905 - DNA, 22 bp, Homo sapiens
cctggcaggtggaggttgcagt

SEQ ID NO: 7214906 - DNA, 22 bp, Homo sapiens
cctggcaggtggaggttgcagt

SEQ ID NO: 7214907 - DNA, 22 bp, Homo sapiens
cctggcaggtggaggttgcagt

SEQ ID NO: 7214908 - DNA, 22 bp, Homo sapiens
cctggcaggtagcattgaggag

SEQ ID NO: 7214909 - DNA, 22 bp, Homo sapiens
cctggcaggtagcattgaggag

SEQ ID NO: 7214910 - DNA, 22 bp, Homo sapiens
cctggcagggctgcagtaatgg

SEQ ID NO: 7214911 - DNA, 22 bp, Homo sapiens
cctggcagggctgcagtaatgg

SEQ ID NO: 7214912 - DNA, 22 bp, Homo sapiens
cctggcaggtagcattgaggag

SEQ ID NO: 7214913 - DNA, 22 bp, Homo sapiens
cctggcaggtagcattgaggag

SEQ ID NO: 7214914 - DNA, 22 bp, Homo sapiens
cctggcaggtggaggttgcagt

SEQ ID NO: 7214915 - DNA, 22 bp, Homo sapiens
cctggcaggtggaggttgcagt

SEQ ID NO: 7214916 - DNA, 22 bp, Homo sapiens
cctggcagactgtgagggcagg

SEQ ID NO: 7214917 - DNA, 22 bp, Homo sapiens
tgtcattatttgaggatagact

SEQ ID NO: 7214918 - DNA, 22 bp, Homo sapiens
cctggcagactgtgagggcagg

SEQ ID NO: 7214919 - DNA, 23 bp, Homo sapiens
cctggcagcaaacgaggaggtta

SEQ ID NO: 7214920 - DNA, 23 bp, Homo sapiens
cctggcagcaaacgaggaggtta

SEQ ID NO: 7214921 - DNA, 22 bp, Homo sapiens
tgtcatgtttcatgtttgtagg

SEQ ID NO: 7214922 - DNA, 22 bp, Homo sapiens
tgtcattatttgcctactgact

SEQ ID NO: 7214923 - DNA, 23 bp, Homo sapiens
cctggcagcaaacgaggaggtta

SEQ ID NO: 7214924 - DNA, 22 bp, Homo sapiens
cctggcagcagcacatgccttc

SEQ ID NO: 7214925 - DNA, 22 bp, Homo sapiens
cctggcagcaggtgggcccgtg

SEQ ID NO: 7214926 - DNA, 22 bp, Homo sapiens
cctggcagcaggtgggcccgtg

SEQ ID NO: 7214927 - DNA, 22 bp, Homo sapiens
cctggcagcaggtgggcccgtg

SEQ ID NO: 7214928 - DNA, 22 bp, Homo sapiens
cctggcagcaggtgggcccgtg

SEQ ID NO: 7214929 - DNA, 22 bp, Homo sapiens
cctggcagcaggtgggcccgtg

SEQ ID NO: 7214930 - DNA, 22 bp, Homo sapiens
cctggcagcccagagcgccgct

SEQ ID NO: 7214931 - DNA, 22 bp, Homo sapiens
cctggcagctgtttggcttggc

SEQ ID NO: 7214932 - DNA, 18 bp, Homo sapiens
cctggcagccatgcgcgc

SEQ ID NO: 7214933 - DNA, 18 bp, Homo sapiens
cctggcagccatgcgcgc

SEQ ID NO: 7214934 - DNA, 18 bp, Homo sapiens
cctggcagccatgcgcgc

SEQ ID NO: 7214935 - DNA, 18 bp, Homo sapiens
cctggcagccatgcgcgc

SEQ ID NO: 7214936 - DNA, 22 bp, Homo sapiens
cctggcagcattggtagagatt

SEQ ID NO: 7214937 - DNA, 22 bp, Homo sapiens
cctggcagcattggtagagatt

SEQ ID NO: 7214938 - DNA, 22 bp, Homo sapiens
cctggcagcattggtagagatt

SEQ ID NO: 7214939 - DNA, 22 bp, Homo sapiens
cctggcagcattggtagagatt

SEQ ID NO: 7214940 - DNA, 22 bp, Homo sapiens
tgtcctggatcatgcctctgaa

SEQ ID NO: 7214941 - DNA, 22 bp, Homo sapiens
tgtcctggatcatgcctctgaa

SEQ ID NO: 7214942 - DNA, 22 bp, Homo sapiens
tgtcctggagttataatgcctg

SEQ ID NO: 7214943 - DNA, 22 bp, Homo sapiens
tgtcctggatcatgcctctgaa

SEQ ID NO: 7214944 - DNA, 22 bp, Homo sapiens
tgtcctggagacacaaggtggt

SEQ ID NO: 7214945 - DNA, 22 bp, Homo sapiens
tgtcctggagtgcttgggggaa

SEQ ID NO: 7214946 - DNA, 22 bp, Homo sapiens
tgtcctggaaaaatggagagtt

SEQ ID NO: 7214947 - DNA, 22 bp, Homo sapiens
tgtcctggacaacagcccctag

SEQ ID NO: 7214948 - DNA, 22 bp, Homo sapiens
tgtcctggacaacagcccctag

SEQ ID NO: 7214949 - DNA, 22 bp, Homo sapiens
tgtcctggacaacagcccctag

SEQ ID NO: 7214950 - DNA, 22 bp, Homo sapiens
tgtcctcttccagtgctccttc

SEQ ID NO: 7214951 - DNA, 22 bp, Homo sapiens
tgtcctcttccagtgctccttc

SEQ ID NO: 7214952 - DNA, 22 bp, Homo sapiens
tgtcctctaattggcctcttgc

SEQ ID NO: 7214953 - DNA, 22 bp, Homo sapiens
tgtcctctaattggcctcttgc

SEQ ID NO: 7214954 - DNA, 22 bp, Homo sapiens
tgtcctctccaacagcctctgt

SEQ ID NO: 7214955 - DNA, 22 bp, Homo sapiens
tgtcctctccaacagcctctgt

SEQ ID NO: 7214956 - DNA, 22 bp, Homo sapiens
tgtcctctccaacagcctctgt

SEQ ID NO: 7214957 - DNA, 22 bp, Homo sapiens
tgtcctctccaacagcctctgt

SEQ ID NO: 7214958 - DNA, 22 bp, Homo sapiens
tgtcctgcaattaaggaagaca

SEQ ID NO: 7214959 - DNA, 22 bp, Homo sapiens
tgtcctgcggactatcaggctt

SEQ ID NO: 7214960 - DNA, 22 bp, Homo sapiens
tgtcctggaaaaatggagagtt

SEQ ID NO: 7214961 - DNA, 22 bp, Homo sapiens
tgtcctggccaaggccttgctt

SEQ ID NO: 7214962 - DNA, 22 bp, Homo sapiens
tgtcctggccaaggccttgctt

SEQ ID NO: 7214963 - DNA, 22 bp, Homo sapiens
tgtctatgtatacatgtgtata

SEQ ID NO: 7214964 - DNA, 22 bp, Homo sapiens
tgtctattcccccacctccgtt

SEQ ID NO: 7214965 - DNA, 21 bp, Homo sapiens
tgtctcaagaaaggcctctcc

SEQ ID NO: 7214966 - DNA, 22 bp, Homo sapiens
tgtctcaaggttactctatgat

SEQ ID NO: 7214967 - DNA, 22 bp, Homo sapiens
tgtctcaaggttactctatgat

SEQ ID NO: 7214968 - DNA, 21 bp, Homo sapiens
tgtctcaatcagaagtcatta

SEQ ID NO: 7214969 - DNA, 21 bp, Homo sapiens
tgtctcaatcagaagtcatta

SEQ ID NO: 7214970 - DNA, 21 bp, Homo sapiens
tgtctcaatcagaagtcatta

SEQ ID NO: 7214971 - DNA, 22 bp, Homo sapiens
tgtctcagagtgttgtattaga

SEQ ID NO: 7214972 - DNA, 22 bp, Homo sapiens
tgtctcagagtgttgtattaga

SEQ ID NO: 7214973 - DNA, 22 bp, Homo sapiens
tgtctcagatacgccatcaagg

SEQ ID NO: 7214974 - DNA, 22 bp, Homo sapiens
tgtctcagaatggctcataata

SEQ ID NO: 7214975 - DNA, 22 bp, Homo sapiens
tgtctcagatacgccatcaagg

SEQ ID NO: 7214976 - DNA, 22 bp, Homo sapiens
tgtctcaggcccaagccagtaa

SEQ ID NO: 7214977 - DNA, 22 bp, Homo sapiens
tgtctcaggcccaagccagtaa

SEQ ID NO: 7214978 - DNA, 18 bp, Homo sapiens
tgtctcaggctgaaacag

SEQ ID NO: 7214979 - DNA, 22 bp, Homo sapiens
tgtctcaggggcattgaaataa

SEQ ID NO: 7214980 - DNA, 22 bp, Homo sapiens
tgtctcttggattgcttgctct

SEQ ID NO: 7214981 - DNA, 22 bp, Homo sapiens
tgtctcttggctctatcactta

SEQ ID NO: 7214982 - DNA, 22 bp, Homo sapiens
tgtctcttggctctatcactta

SEQ ID NO: 7214983 - DNA, 22 bp, Homo sapiens
tgtctcttctgcctccagctgt

SEQ ID NO: 7214984 - DNA, 22 bp, Homo sapiens
tgtctcttgagctgcctgatgc

SEQ ID NO: 7214985 - DNA, 22 bp, Homo sapiens
tgtctcttgagctgcctgatgc

SEQ ID NO: 7214986 - DNA, 22 bp, Homo sapiens
tgtctcttcccactcagacccc

SEQ ID NO: 7214987 - DNA, 22 bp, Homo sapiens
tgtctcttcagcccatggcttc

SEQ ID NO: 7214988 - DNA, 22 bp, Homo sapiens
tgtctcttactttgattcttgg

SEQ ID NO: 7214989 - DNA, 22 bp, Homo sapiens
tgtctctgtgcatttgtgcttc

SEQ ID NO: 7214990 - DNA, 22 bp, Homo sapiens
tgtctctgtgcatttgtgcttc

SEQ ID NO: 7214991 - DNA, 22 bp, Homo sapiens
tgtctctgtgcatttgtgcttc

SEQ ID NO: 7214992 - DNA, 22 bp, Homo sapiens
tgtctctgtcttccagggctgt

SEQ ID NO: 7214993 - DNA, 22 bp, Homo sapiens
tgtctctgggtgattcagtcct

SEQ ID NO: 7214994 - DNA, 22 bp, Homo sapiens
tgtctctggcccatgagcagag

SEQ ID NO: 7214995 - DNA, 22 bp, Homo sapiens
tgtctctggctgcagcctgttc

SEQ ID NO: 7214996 - DNA, 22 bp, Homo sapiens
tgtctcatctcttaaccccact

SEQ ID NO: 7214997 - DNA, 22 bp, Homo sapiens
tgtctcatctcttaaccccact

SEQ ID NO: 7214998 - DNA, 19 bp, Homo sapiens
tgtctcagtgtcccttcct

SEQ ID NO: 7214999 - DNA, 22 bp, Homo sapiens
cctggctctagaggccactcct

SEQ ID NO: 7215000 - DNA, 22 bp, Homo sapiens
cctggctctctgcagatcctgg

SEQ ID NO: 7215001 - DNA, 22 bp, Homo sapiens
cctggctctctgcagatcctgg

SEQ ID NO: 7215002 - DNA, 22 bp, Homo sapiens
cctggctctctgcagatcctgg

SEQ ID NO: 7215003 - DNA, 22 bp, Homo sapiens
cctggctctctgcagatcctgg

SEQ ID NO: 7215004 - DNA, 22 bp, Homo sapiens
cctggctcgctgacctcagggg

SEQ ID NO: 7215005 - DNA, 22 bp, Homo sapiens
cctggctctagaggccactcct

SEQ ID NO: 7215006 - DNA, 22 bp, Homo sapiens
cctggctctagaggccactcct

SEQ ID NO: 7215007 - DNA, 22 bp, Homo sapiens
cctggctcctgcctctgcaggg

SEQ ID NO: 7215008 - DNA, 22 bp, Homo sapiens
cctggctcctgcctctgcaggg

SEQ ID NO: 7215009 - DNA, 22 bp, Homo sapiens
cctggctcgctgacctcagggg

SEQ ID NO: 7215010 - DNA, 22 bp, Homo sapiens
cctggctcgctgacctcagggg

SEQ ID NO: 7215011 - DNA, 22 bp, Homo sapiens
cctggctcccggaacagggtct

SEQ ID NO: 7215012 - DNA, 22 bp, Homo sapiens
cctggctccctgcacagggctc

SEQ ID NO: 7215013 - DNA, 22 bp, Homo sapiens
cctggctccctgcacagggctc

SEQ ID NO: 7215014 - DNA, 22 bp, Homo sapiens
cctggctcccggaacagggtct

SEQ ID NO: 7215015 - DNA, 22 bp, Homo sapiens
cctggctccctgcacagggctc

SEQ ID NO: 7215016 - DNA, 22 bp, Homo sapiens
cctggctccctgcacagggctc

SEQ ID NO: 7215017 - DNA, 22 bp, Homo sapiens
cctggctccctgcacagggctc

SEQ ID NO: 7215018 - DNA, 22 bp, Homo sapiens
cctggctccctggacctcatta

SEQ ID NO: 7215019 - DNA, 22 bp, Homo sapiens
cctggctccggttcaagggaaa

SEQ ID NO: 7215020 - DNA, 22 bp, Homo sapiens
cctggctccggttcaagggaaa

SEQ ID NO: 7215021 - DNA, 22 bp, Homo sapiens
cctggctccggttcaagggaaa

SEQ ID NO: 7215022 - DNA, 22 bp, Homo sapiens
cctggctccgtgtcacgtgccc

SEQ ID NO: 7215023 - DNA, 22 bp, Homo sapiens
cctggctccgtgtcacgtgccc

SEQ ID NO: 7215024 - DNA, 22 bp, Homo sapiens
cctggctccgtgtcacgtgccc

SEQ ID NO: 7215025 - DNA, 22 bp, Homo sapiens
cctggctcctacgggtattttg

SEQ ID NO: 7215026 - DNA, 22 bp, Homo sapiens
cctggctcctacgggtattttg

SEQ ID NO: 7215027 - DNA, 22 bp, Homo sapiens
cctggctcctgcacagatcttt

SEQ ID NO: 7215028 - DNA, 22 bp, Homo sapiens
cctggctcctgcacagatcttt

SEQ ID NO: 7215029 - DNA, 22 bp, Homo sapiens
cctggctcctgcacagatcttt

SEQ ID NO: 7215030 - DNA, 22 bp, Homo sapiens
cctggctcctgcctctgcaggg

SEQ ID NO: 7215031 - DNA, 22 bp, Homo sapiens
cctggctcctgcctctgcaggg

SEQ ID NO: 7215032 - DNA, 22 bp, Homo sapiens
cctggctcccccatcatagctg

SEQ ID NO: 7215033 - DNA, 22 bp, Homo sapiens
cctggctcccggaacagggtct

SEQ ID NO: 7215034 - DNA, 22 bp, Homo sapiens
cctggctcccggaacagggtct

SEQ ID NO: 7215035 - DNA, 22 bp, Homo sapiens
cctggctcccccatcatagctg

SEQ ID NO: 7215036 - DNA, 22 bp, Homo sapiens
cctggctccaaagctgtgactc

SEQ ID NO: 7215037 - DNA, 21 bp, Homo sapiens
cctggctccagaacttccggt

SEQ ID NO: 7215038 - DNA, 21 bp, Homo sapiens
cctggctccagaacttccggt

SEQ ID NO: 7215039 - DNA, 22 bp, Homo sapiens
cctggctccagctgcctgtcct

SEQ ID NO: 7215040 - DNA, 22 bp, Homo sapiens
cctggcctggcactccctctgc

SEQ ID NO: 7215041 - DNA, 22 bp, Homo sapiens
cctggcctggcactccctctgc

SEQ ID NO: 7215042 - DNA, 22 bp, Homo sapiens
cctggcctctccgagtaacctg

SEQ ID NO: 7215043 - DNA, 22 bp, Homo sapiens
cctggcctgctcggctcttaag

SEQ ID NO: 7215044 - DNA, 22 bp, Homo sapiens
cctggcctgtgaatctgagagc

SEQ ID NO: 7215045 - DNA, 22 bp, Homo sapiens
cctggcctgtgaatctgagagc

SEQ ID NO: 7215046 - DNA, 22 bp, Homo sapiens
cctggccttaagggcagggagc

SEQ ID NO: 7215047 - DNA, 22 bp, Homo sapiens
cctggctccaaagctgtgactc

SEQ ID NO: 7215048 - DNA, 22 bp, Homo sapiens
cctggccctggaatagggcagg

SEQ ID NO: 7215049 - DNA, 22 bp, Homo sapiens
cctggccctggaatagggcagg

SEQ ID NO: 7215050 - DNA, 19 bp, Homo sapiens
cctggccctgctgcgcggg

SEQ ID NO: 7215051 - DNA, 22 bp, Homo sapiens
cctggcccacatggcttctccc

SEQ ID NO: 7215052 - DNA, 22 bp, Homo sapiens
cctggcccagggactttcgcct

SEQ ID NO: 7215053 - DNA, 22 bp, Homo sapiens
cctggcccagggactttcgcct

SEQ ID NO: 7215054 - DNA, 22 bp, Homo sapiens
cctggcctcctggccttctcat

SEQ ID NO: 7215055 - DNA, 22 bp, Homo sapiens
cctggcctcctggccttctcat

SEQ ID NO: 7215056 - DNA, 22 bp, Homo sapiens
cctggcctcctggccttctcat

SEQ ID NO: 7215057 - DNA, 22 bp, Homo sapiens
cctggcctcctggccttctcat

SEQ ID NO: 7215058 - DNA, 22 bp, Homo sapiens
cctggccctggaatagggcagg

SEQ ID NO: 7215059 - DNA, 22 bp, Homo sapiens
cctggccgcggagcccttccag

SEQ ID NO: 7215060 - DNA, 22 bp, Homo sapiens
cctggcctcagacagagggtgg

SEQ ID NO: 7215061 - DNA, 22 bp, Homo sapiens
cctggcctcagcctagggctga

SEQ ID NO: 7215062 - DNA, 22 bp, Homo sapiens
tgtcatggggaaaataacagac

SEQ ID NO: 7215063 - DNA, 22 bp, Homo sapiens
tgtcatggggttgttttgtaca

SEQ ID NO: 7215064 - DNA, 22 bp, Homo sapiens
tgtcaggagccaccagcactcc

SEQ ID NO: 7215065 - DNA, 22 bp, Homo sapiens
tgtcaggagccaccagcactcc

SEQ ID NO: 7215066 - DNA, 22 bp, Homo sapiens
tgtcatgccaggaaatagtccc

SEQ ID NO: 7215067 - DNA, 22 bp, Homo sapiens
tgtcatgccatttaaaatgttt

SEQ ID NO: 7215068 - DNA, 22 bp, Homo sapiens
tgtcatgcccaggagcaaggta

SEQ ID NO: 7215069 - DNA, 22 bp, Homo sapiens
tgtcatgtggcaattaaagcag

SEQ ID NO: 7215070 - DNA, 22 bp, Homo sapiens
tgtcatgtgttcttaaatacat

SEQ ID NO: 7215071 - DNA, 22 bp, Homo sapiens
tgtcatgtgagggaacttgttc

SEQ ID NO: 7215072 - DNA, 22 bp, Homo sapiens
tgtcatgggtctaaacattgat

SEQ ID NO: 7215073 - DNA, 22 bp, Homo sapiens
tgtcagctggagatggcatggg

SEQ ID NO: 7215074 - DNA, 22 bp, Homo sapiens
tgtcaggacattttatgaatca

SEQ ID NO: 7215075 - DNA, 22 bp, Homo sapiens
tgtattcagggacatatatgta

SEQ ID NO: 7215076 - DNA, 22 bp, Homo sapiens
tgtattcagtgatttcacaata

SEQ ID NO: 7215077 - DNA, 22 bp, Homo sapiens
tgtattatgattgttgttcatg

SEQ ID NO: 7215078 - DNA, 22 bp, Homo sapiens
tgtattcaacttcttaaaaatt

SEQ ID NO: 7215079 - DNA, 22 bp, Homo sapiens
tgtatgtttctaaatgattgct

SEQ ID NO: 7215080 - DNA, 22 bp, Homo sapiens
tgtattaacattaataaaatgg

SEQ ID NO: 7215081 - DNA, 22 bp, Homo sapiens
tgtattacaaagaagaggctgg

SEQ ID NO: 7215082 - DNA, 22 bp, Homo sapiens
tgtattagagcagtagaattat

SEQ ID NO: 7215083 - DNA, 22 bp, Homo sapiens
tgtattagagcatataatttga

SEQ ID NO: 7215084 - DNA, 22 bp, Homo sapiens
tgtattagagcatataatttga

SEQ ID NO: 7215085 - DNA, 22 bp, Homo sapiens
cctggcagacagcactgaagct

SEQ ID NO: 7215086 - DNA, 22 bp, Homo sapiens
cctggcagacagcactgaagct

SEQ ID NO: 7215087 - DNA, 22 bp, Homo sapiens
cctggcagaatattaaagtgca

SEQ ID NO: 7215088 - DNA, 22 bp, Homo sapiens
cctggcagacagcactgaagct

SEQ ID NO: 7215089 - DNA, 22 bp, Homo sapiens
cctggcagacagcactgaagct

SEQ ID NO: 7215090 - DNA, 22 bp, Homo sapiens
cctggcagactgtgagggcagg

SEQ ID NO: 7215091 - DNA, 22 bp, Homo sapiens
cctggcagactgtgagggcagg

SEQ ID NO: 7215092 - DNA, 22 bp, Homo sapiens
cctggcagactgtgagggcagg

SEQ ID NO: 7215093 - DNA, 22 bp, Homo sapiens
tgtatgtctgtgaattcatatt

SEQ ID NO: 7215094 - DNA, 22 bp, Homo sapiens
tgtatgtgcaatgtttatatgt

SEQ ID NO: 7215095 - DNA, 22 bp, Homo sapiens
tgtatgtgtatgtacatatgca

SEQ ID NO: 7215096 - DNA, 22 bp, Homo sapiens
tgtatgtgtcctaattcaagca

SEQ ID NO: 7215097 - DNA, 22 bp, Homo sapiens
cctggcacgaagggctgaggtt

SEQ ID NO: 7215098 - DNA, 22 bp, Homo sapiens
cctggcaccttcacagactact

SEQ ID NO: 7215099 - DNA, 22 bp, Homo sapiens
cctggcacatagtgggcatgca

SEQ ID NO: 7215100 - DNA, 22 bp, Homo sapiens
cctggcacatgatagatgctca

SEQ ID NO: 7215101 - DNA, 22 bp, Homo sapiens
cctggcagaaagagttacacct

SEQ ID NO: 7215102 - DNA, 22 bp, Homo sapiens
cctggcagaaagagttacacct

SEQ ID NO: 7215103 - DNA, 22 bp, Homo sapiens
cctggcagaaagagttacacct

SEQ ID NO: 7215104 - DNA, 21 bp, Homo sapiens
cctggcagaagcctgatatgc

SEQ ID NO: 7215105 - DNA, 21 bp, Homo sapiens
cctggcagaagcctgatatgc

SEQ ID NO: 7215106 - DNA, 21 bp, Homo sapiens
cctggcagaagcctgatatgc

SEQ ID NO: 7215107 - DNA, 22 bp, Homo sapiens
cctggcagaatattaaagtgca

SEQ ID NO: 7215108 - DNA, 22 bp, Homo sapiens
cctggcagaatattaaagtgca

SEQ ID NO: 7215109 - DNA, 22 bp, Homo sapiens
tgtagtagcattcacgaagtgt

SEQ ID NO: 7215110 - DNA, 22 bp, Homo sapiens
tgtagtaagtgcgcaataaata

SEQ ID NO: 7215111 - DNA, 22 bp, Homo sapiens
tgtagtaagtgcgcaataaata

SEQ ID NO: 7215112 - DNA, 22 bp, Homo sapiens
tgtagtcacaaaaactgtaagc

SEQ ID NO: 7215113 - DNA, 22 bp, Homo sapiens
tgtagtccaggaattgtgtctg

SEQ ID NO: 7215114 - DNA, 22 bp, Homo sapiens
tgtagtctcagggagctgcttc

SEQ ID NO: 7215115 - DNA, 22 bp, Homo sapiens
tgtagtgtgacataggtgtcca

SEQ ID NO: 7215116 - DNA, 22 bp, Homo sapiens
cctggagaggagaaagggccca

SEQ ID NO: 7215117 - DNA, 22 bp, Homo sapiens
cctggagaggagaaagggccca

SEQ ID NO: 7215118 - DNA, 22 bp, Homo sapiens
cctggagaggagaaagggccca

SEQ ID NO: 7215119 - DNA, 22 bp, Homo sapiens
cctggagaggcgctgcagagga

SEQ ID NO: 7215120 - DNA, 22 bp, Homo sapiens
cctggagaggcgctgcagagga

SEQ ID NO: 7215121 - DNA, 22 bp, Homo sapiens
cctggagaggcgctgcagagga

SEQ ID NO: 7215122 - DNA, 22 bp, Homo sapiens
cctggagaggcgctgcagagga

SEQ ID NO: 7215123 - DNA, 22 bp, Homo sapiens
cctggagaggcgctgcagagga

SEQ ID NO: 7215124 - DNA, 22 bp, Homo sapiens
cctggagaggcgctgcagagga

SEQ ID NO: 7215125 - DNA, 22 bp, Homo sapiens
cctggagattatttggtccaat

SEQ ID NO: 7215126 - DNA, 22 bp, Homo sapiens
cctggcacatagtgggcatgca

SEQ ID NO: 7215127 - DNA, 19 bp, Homo sapiens
cctggaggtgaaggttctc

SEQ ID NO: 7215128 - DNA, 22 bp, Homo sapiens
cctggaggtggaggttgcagtg

SEQ ID NO: 7215129 - DNA, 22 bp, Homo sapiens
cctggaggtggaggttgcagtg

SEQ ID NO: 7215130 - DNA, 22 bp, Homo sapiens
cctggagcacatggcaggaggc

SEQ ID NO: 7215131 - DNA, 22 bp, Homo sapiens
cctggagcacatggcaggaggc

SEQ ID NO: 7215132 - DNA, 22 bp, Homo sapiens
cctggagcacatggcaggaggc

SEQ ID NO: 7215133 - DNA, 22 bp, Homo sapiens
cctggagcacatggcaggaggc

SEQ ID NO: 7215134 - DNA, 22 bp, Homo sapiens
cctggagcacatggcaggaggc

SEQ ID NO: 7215135 - DNA, 22 bp, Homo sapiens
cctggagcacatggcaggaggc

SEQ ID NO: 7215136 - DNA, 22 bp, Homo sapiens
cctggagcacagcccagtccca

SEQ ID NO: 7215137 - DNA, 22 bp, Homo sapiens
cctggagcacagcccagtccca

SEQ ID NO: 7215138 - DNA, 22 bp, Homo sapiens
cctggagcaaaaatctaaggag

SEQ ID NO: 7215139 - DNA, 22 bp, Homo sapiens
cctggagattatttggtccaat

SEQ ID NO: 7215140 - DNA, 22 bp, Homo sapiens
cctggagattatttggtccaat

SEQ ID NO: 7215141 - DNA, 22 bp, Homo sapiens
cctggagatttcttcaagcttt

SEQ ID NO: 7215142 - DNA, 22 bp, Homo sapiens
tgtaaacatatgtatgtatgta

SEQ ID NO: 7215143 - DNA, 22 bp, Homo sapiens
tgtaaactgcttctcaccaagg

SEQ ID NO: 7215144 - DNA, 22 bp, Homo sapiens
tgtaaactccttggtgtgtgaa

SEQ ID NO: 7215145 - DNA, 20 bp, Homo sapiens
tgtaaactgcagagtgagaa

SEQ ID NO: 7215146 - DNA, 22 bp, Homo sapiens
tgtaaactagggctgataaggg

SEQ ID NO: 7215147 - DNA, 22 bp, Homo sapiens
tgtaaactcagtatgttttact

SEQ ID NO: 7215148 - DNA, 22 bp, Homo sapiens
tgtaaaccagggtcatccttag

SEQ ID NO: 7215149 - DNA, 23 bp, Homo sapiens
tgtaaaccattttgcatcccatg

SEQ ID NO: 7215150 - DNA, 22 bp, Homo sapiens
tgtaaactagggctgataaggg

SEQ ID NO: 7215151 - DNA, 22 bp, Homo sapiens
tgtaaactagggctgataaggg

SEQ ID NO: 7215152 - DNA, 22 bp, Homo sapiens
tgtaaactgtagaaaatacttt

SEQ ID NO: 7215153 - DNA, 22 bp, Homo sapiens
tgtaaactgtagaaaatacttt

SEQ ID NO: 7215154 - DNA, 22 bp, Homo sapiens
tgtaaactgagggtagctgatt

SEQ ID NO: 7215155 - DNA, 22 bp, Homo sapiens
tgtaaacttttgcatactgctt

SEQ ID NO: 7215156 - DNA, 22 bp, Homo sapiens
tgtaaactgcttctcaccaagg

SEQ ID NO: 7215157 - DNA, 22 bp, Homo sapiens
tgtaaactgcttctcaccaagg

SEQ ID NO: 7215158 - DNA, 22 bp, Homo sapiens
tgtaaactggatttgagggtgg

SEQ ID NO: 7215159 - DNA, 22 bp, Homo sapiens
tgtaaagaaatagcatttgtag

SEQ ID NO: 7215160 - DNA, 22 bp, Homo sapiens
tgtaccaagacaaatcagaaac

SEQ ID NO: 7215161 - DNA, 22 bp, Homo sapiens
tgtaccaaacccatcataacta

SEQ ID NO: 7215162 - DNA, 22 bp, Homo sapiens
tgtaggaatggattctagaagg

SEQ ID NO: 7215163 - DNA, 22 bp, Homo sapiens
tgtaggaatgtttttaagttgg

SEQ ID NO: 7215164 - DNA, 20 bp, Homo sapiens
tgtaggtgtacagtaaggag

SEQ ID NO: 7215165 - DNA, 22 bp, Homo sapiens
tgtaggtaaaagcatctagtgt

SEQ ID NO: 7215166 - DNA, 22 bp, Homo sapiens
tgtaggtaagttcgtagatttg

SEQ ID NO: 7215167 - DNA, 22 bp, Homo sapiens
tgtaggtagatcccatgtaaga

SEQ ID NO: 7215168 - DNA, 22 bp, Homo sapiens
tgtaggtcaagtccattgtgct

SEQ ID NO: 7215169 - DNA, 22 bp, Homo sapiens
tgtagggactgaggctggagag

SEQ ID NO: 7215170 - DNA, 22 bp, Homo sapiens
tgtagggagaagagaggcacct

SEQ ID NO: 7215171 - DNA, 22 bp, Homo sapiens
tgtagggactgaggctggagag

SEQ ID NO: 7215172 - DNA, 22 bp, Homo sapiens
tgtagggagaagagaggcacct

SEQ ID NO: 7215173 - DNA, 22 bp, Homo sapiens
tgtagggagaagagaggcacct

SEQ ID NO: 7215174 - DNA, 22 bp, Homo sapiens
tgtagggagaagagaggcacct

SEQ ID NO: 7215175 - DNA, 22 bp, Homo sapiens
tgtagggaggaaagggctcttg

SEQ ID NO: 7215176 - DNA, 22 bp, Homo sapiens
tgtagggaggaagggttggaaa

SEQ ID NO: 7215177 - DNA, 22 bp, Homo sapiens
tgtagggactgaggctggagag

SEQ ID NO: 7215178 - DNA, 22 bp, Homo sapiens
tgtaggattttcaccagacctt

SEQ ID NO: 7215179 - DNA, 22 bp, Homo sapiens
tgtaggcatattcatagagttg

SEQ ID NO: 7215180 - DNA, 22 bp, Homo sapiens
tgtaggaattccagtgacttca

SEQ ID NO: 7215181 - DNA, 22 bp, Homo sapiens
tgtaggacatgtacttgtaaca

SEQ ID NO: 7215182 - DNA, 22 bp, Homo sapiens
tgtaggacatgtacttgtaaca

SEQ ID NO: 7215183 - DNA, 22 bp, Homo sapiens
tgtaggagtccaatcaggagac

SEQ ID NO: 7215184 - DNA, 16 bp, Homo sapiens
tgtaggataaccatac

SEQ ID NO: 7215185 - DNA, 22 bp, Homo sapiens
tgtaggatgtaaggcaggcatc

SEQ ID NO: 7215186 - DNA, 22 bp, Homo sapiens
cctctgtgcctcagtttcatgt

SEQ ID NO: 7215187 - DNA, 22 bp, Homo sapiens
cctctgtgcctcagtttcatgt

SEQ ID NO: 7215188 - DNA, 22 bp, Homo sapiens
cctctgtgcctcgtgtcctctg

SEQ ID NO: 7215189 - DNA, 22 bp, Homo sapiens
cctctgtgctttgtccagcctc

SEQ ID NO: 7215190 - DNA, 21 bp, Homo sapiens
cctctgtgctaaagggctccc

SEQ ID NO: 7215191 - DNA, 22 bp, Homo sapiens
tggtagggacactatgcagaaa

SEQ ID NO: 7215192 - DNA, 21 bp, Homo sapiens
tggtaggatccaggaatctgc

SEQ ID NO: 7215193 - DNA, 17 bp, Homo sapiens
tggtccaggtggagcca

SEQ ID NO: 7215194 - DNA, 22 bp, Homo sapiens
tggtaggagatatggtctccga

SEQ ID NO: 7215195 - DNA, 22 bp, Homo sapiens
tggtaggagggaaatgcgggtt

SEQ ID NO: 7215196 - DNA, 22 bp, Homo sapiens
tggtaggagggaaatgcgggtt

SEQ ID NO: 7215197 - DNA, 22 bp, Homo sapiens
tggtaggatagtgacttatatg

SEQ ID NO: 7215198 - DNA, 21 bp, Homo sapiens
tggtaggatccaggaatctgc

SEQ ID NO: 7215199 - DNA, 22 bp, Homo sapiens
tggtccagtagcagggatacca

SEQ ID NO: 7215200 - DNA, 22 bp, Homo sapiens
tggtccctgagacctttgggag

SEQ ID NO: 7215201 - DNA, 22 bp, Homo sapiens
tggtccatgtcctccatctctc

SEQ ID NO: 7215202 - DNA, 22 bp, Homo sapiens
tggtccatgcccacggaatgtg

SEQ ID NO: 7215203 - DNA, 22 bp, Homo sapiens
tggtccatgctccaggcacatt

SEQ ID NO: 7215204 - DNA, 22 bp, Homo sapiens
tggtccatgttcccagaagaca

SEQ ID NO: 7215205 - DNA, 22 bp, Homo sapiens
tggtccatgttcccagaagaca

SEQ ID NO: 7215206 - DNA, 22 bp, Homo sapiens
tggtccattatcccgctttcca

SEQ ID NO: 7215207 - DNA, 22 bp, Homo sapiens
tggtccattcttgttcagcatt

SEQ ID NO: 7215208 - DNA, 19 bp, Homo sapiens
tggtcccatactgctggcc

SEQ ID NO: 7215209 - DNA, 22 bp, Homo sapiens
tggtcccattgttctgcccagg

SEQ ID NO: 7215210 - DNA, 18 bp, Homo sapiens
tggtgaagggtggaggag

SEQ ID NO: 7215211 - DNA, 19 bp, Homo sapiens
tggtgcgcccggcccttct

SEQ ID NO: 7215212 - DNA, 22 bp, Homo sapiens
tggtgctcccaagattgttcta

SEQ ID NO: 7215213 - DNA, 22 bp, Homo sapiens
tggtgctcttatgttttcatca

SEQ ID NO: 7215214 - DNA, 22 bp, Homo sapiens
tggtgctcttatgttttcatca

SEQ ID NO: 7215215 - DNA, 22 bp, Homo sapiens
tggtgctgacagttctgagtgc

SEQ ID NO: 7215216 - DNA, 22 bp, Homo sapiens
tggtgctgagatgaagtgctcc

SEQ ID NO: 7215217 - DNA, 22 bp, Homo sapiens
tggtgctgataatggcaggatt

SEQ ID NO: 7215218 - DNA, 22 bp, Homo sapiens
tggtcttagctggaaggaggga

SEQ ID NO: 7215219 - DNA, 22 bp, Homo sapiens
tggtcttctaaccctcagtcca

SEQ ID NO: 7215220 - DNA, 22 bp, Homo sapiens
cctgcccagagcccctttcact

SEQ ID NO: 7215221 - DNA, 17 bp, Homo sapiens
cctgcccagagacagat

SEQ ID NO: 7215222 - DNA, 17 bp, Homo sapiens
cctgcccagagacagat

SEQ ID NO: 7215223 - DNA, 22 bp, Homo sapiens
cctgcccactgcccggtcagcc

SEQ ID NO: 7215224 - DNA, 22 bp, Homo sapiens
cctgcccactccaggagcaact

SEQ ID NO: 7215225 - DNA, 22 bp, Homo sapiens
cctgcccactccaggagcaact

SEQ ID NO: 7215226 - DNA, 22 bp, Homo sapiens
cctgcccactgcccggtcagcc

SEQ ID NO: 7215227 - DNA, 22 bp, Homo sapiens
cctgcccacagagagggtgcat

SEQ ID NO: 7215228 - DNA, 22 bp, Homo sapiens
cctgccatgccagcatgcccgt

SEQ ID NO: 7215229 - DNA, 22 bp, Homo sapiens
cctgccatggtagacttccagg

SEQ ID NO: 7215230 - DNA, 22 bp, Homo sapiens
cctgcccacacagcaattttaa

SEQ ID NO: 7215231 - DNA, 22 bp, Homo sapiens
cctgcccacacagcaattttaa

SEQ ID NO: 7215232 - DNA, 22 bp, Homo sapiens
cctgcccacagagagggtgcat

SEQ ID NO: 7215233 - DNA, 22 bp, Homo sapiens
cctgccagtgcctcccactggt

SEQ ID NO: 7215234 - DNA, 22 bp, Homo sapiens
tggtccgggatggacgcgggct

SEQ ID NO: 7215235 - DNA, 22 bp, Homo sapiens
tggtcctagccagggctctgct

SEQ ID NO: 7215236 - DNA, 22 bp, Homo sapiens
tggtcctatgttggtgaggtgc

SEQ ID NO: 7215237 - DNA, 20 bp, Homo sapiens
tggtcctcacaggtcctccc

SEQ ID NO: 7215238 - DNA, 20 bp, Homo sapiens
tggtcctcacatgccatctt

SEQ ID NO: 7215239 - DNA, 18 bp, Homo sapiens
cctgccagtctggagcag

SEQ ID NO: 7215240 - DNA, 22 bp, Homo sapiens
cctgccagtgaagctgacgggc

SEQ ID NO: 7215241 - DNA, 22 bp, Homo sapiens
tggtggccgaagccctctctca

SEQ ID NO: 7215242 - DNA, 22 bp, Homo sapiens
tggtggccccctcaagtctttg

SEQ ID NO: 7215243 - DNA, 22 bp, Homo sapiens
tggtgctgtggaggggcagaag

SEQ ID NO: 7215244 - DNA, 22 bp, Homo sapiens
tggtgctgtggaggggcagaag

SEQ ID NO: 7215245 - DNA, 22 bp, Homo sapiens
tggtgctgcctcagatgcctta

SEQ ID NO: 7215246 - DNA, 22 bp, Homo sapiens
tggtgctgtgatacgaggcact

SEQ ID NO: 7215247 - DNA, 22 bp, Homo sapiens
tggtgctgataatggcaggatt

SEQ ID NO: 7215248 - DNA, 22 bp, Homo sapiens
tggtgctgcaggtgggcacagt

SEQ ID NO: 7215249 - DNA, 22 bp, Homo sapiens
tggtgctgccaggctcctgcca

SEQ ID NO: 7215250 - DNA, 22 bp, Homo sapiens
tggtgctgcctcagatgcctta

SEQ ID NO: 7215251 - DNA, 23 bp, Homo sapiens
tggtggcttgtggtggccaccag

SEQ ID NO: 7215252 - DNA, 23 bp, Homo sapiens
tggtggcttgtggtggccaccag

SEQ ID NO: 7215253 - DNA, 22 bp, Homo sapiens
tggtggcttctgaggatggcga

SEQ ID NO: 7215254 - DNA, 17 bp, Homo sapiens
tggtggctggagtcagg

SEQ ID NO: 7215255 - DNA, 22 bp, Homo sapiens
tggtggctgtaagggagagaag

SEQ ID NO: 7215256 - DNA, 22 bp, Homo sapiens
tggtggctgtaagggagagaag

SEQ ID NO: 7215257 - DNA, 22 bp, Homo sapiens
tggtggctgttgcagaactgag

SEQ ID NO: 7215258 - DNA, 22 bp, Homo sapiens
tggtggccgaagccctctctca

SEQ ID NO: 7215259 - DNA, 22 bp, Homo sapiens
tggtggccttgatggcatctgc

SEQ ID NO: 7215260 - DNA, 22 bp, Homo sapiens
tggtggccccctcaagtctttg

SEQ ID NO: 7215261 - DNA, 22 bp, Homo sapiens
tggtggccttgatggcatctgc

SEQ ID NO: 7215262 - DNA, 22 bp, Homo sapiens
tggtggccgaagccctctctca

SEQ ID NO: 7215263 - DNA, 22 bp, Homo sapiens
tggtggcgggcagggccgtcac

SEQ ID NO: 7215264 - DNA, 22 bp, Homo sapiens
tggtggctaccaggtcctgggg

SEQ ID NO: 7215265 - DNA, 22 bp, Homo sapiens
tggtggctaccaggtcctgggg

SEQ ID NO: 7215266 - DNA, 22 bp, Homo sapiens
tggtggctcacacctgtaatcc

SEQ ID NO: 7215267 - DNA, 22 bp, Homo sapiens
tggtggctcacgtctgtaatct

SEQ ID NO: 7215268 - DNA, 22 bp, Homo sapiens
tggtggctgctccctgccttga

SEQ ID NO: 7215269 - DNA, 17 bp, Homo sapiens
tggtggctggagtcagg

SEQ ID NO: 7215270 - DNA, 22 bp, Homo sapiens
tggtggctgctccctgccttga

SEQ ID NO: 7215271 - DNA, 22 bp, Homo sapiens
tggtgggacatctgaggagagg

SEQ ID NO: 7215272 - DNA, 22 bp, Homo sapiens
cctggaaaatgccactttcaca

SEQ ID NO: 7215273 - DNA, 23 bp, Homo sapiens
tggtggcttgtggtggccaccag

SEQ ID NO: 7215274 - DNA, 22 bp, Homo sapiens
tggtgggacatctgaggagagg

SEQ ID NO: 7215275 - DNA, 22 bp, Homo sapiens
cctggaaaatgccactttcaca

SEQ ID NO: 7215276 - DNA, 22 bp, Homo sapiens
cctggaaagagaatgaatgagc

SEQ ID NO: 7215277 - DNA, 22 bp, Homo sapiens
cctggaaagaggaaggaagcct

SEQ ID NO: 7215278 - DNA, 22 bp, Homo sapiens
cctggactcaggctgtgggcac

SEQ ID NO: 7215279 - DNA, 21 bp, Homo sapiens
cctggactgggagcagcactg

SEQ ID NO: 7215280 - DNA, 21 bp, Homo sapiens
cctggactgggagcagcactg

SEQ ID NO: 7215281 - DNA, 22 bp, Homo sapiens
cctggagacccacttctgccaa

SEQ ID NO: 7215282 - DNA, 22 bp, Homo sapiens
cctggagacccacttctgccaa

SEQ ID NO: 7215283 - DNA, 21 bp, Homo sapiens
cctggagacaaagacagggtg

SEQ ID NO: 7215284 - DNA, 22 bp, Homo sapiens
cctggagaccagaggatacttc

SEQ ID NO: 7215285 - DNA, 22 bp, Homo sapiens
cctggactttcatttccccttg

SEQ ID NO: 7215286 - DNA, 21 bp, Homo sapiens
cctggagacaaagacagggtg

SEQ ID NO: 7215287 - DNA, 21 bp, Homo sapiens
cctggagacaaagacagggtg

SEQ ID NO: 7215288 - DNA, 21 bp, Homo sapiens
cctggagacaaagacagggtg

SEQ ID NO: 7215289 - DNA, 21 bp, Homo sapiens
cctggagacaaagacagggtg

SEQ ID NO: 7215290 - DNA, 21 bp, Homo sapiens
cctggagacaaagacagggtg

SEQ ID NO: 7215291 - DNA, 22 bp, Homo sapiens
tgtaaacagtaggactaaagag

SEQ ID NO: 7215292 - DNA, 22 bp, Homo sapiens
cctggagagagaggccaactgc

SEQ ID NO: 7215293 - DNA, 22 bp, Homo sapiens
cctggagagctcgggccaggca

SEQ ID NO: 7215294 - DNA, 22 bp, Homo sapiens
cctggagagctcgggccaggca

SEQ ID NO: 7215295 - DNA, 22 bp, Homo sapiens
cctggagagctcgggccaggca

SEQ ID NO: 7215296 - DNA, 22 bp, Homo sapiens
cctggagagctcgggccaggca

SEQ ID NO: 7215297 - DNA, 22 bp, Homo sapiens
cctggagacctgatggcagcgg

SEQ ID NO: 7215298 - DNA, 22 bp, Homo sapiens
cctggagacctgatggcagcgg

SEQ ID NO: 7215299 - DNA, 22 bp, Homo sapiens
cctggagacctgatggcagcgg

SEQ ID NO: 7215300 - DNA, 22 bp, Homo sapiens
cctggagacctgatggcagcgg

SEQ ID NO: 7215301 - DNA, 22 bp, Homo sapiens
cctggagacctgatggcagcgg

SEQ ID NO: 7215302 - DNA, 22 bp, Homo sapiens
cctggagacctgatggcagcgg

SEQ ID NO: 7215303 - DNA, 22 bp, Homo sapiens
cctggagacctgatggcagcgg

SEQ ID NO: 7215304 - DNA, 22 bp, Homo sapiens
cctggagacgaggctggaccat

SEQ ID NO: 7215305 - DNA, 22 bp, Homo sapiens
cctggagacgaggctggaccat

SEQ ID NO: 7215306 - DNA, 22 bp, Homo sapiens
cctggagacgaggctggaccat

SEQ ID NO: 7215307 - DNA, 22 bp, Homo sapiens
cctggagacgaggctggaccat

SEQ ID NO: 7215308 - DNA, 22 bp, Homo sapiens
cctggagagagaggccaactgc

SEQ ID NO: 7215309 - DNA, 22 bp, Homo sapiens
cctggggaatagagtcaagggg

SEQ ID NO: 7215310 - DNA, 22 bp, Homo sapiens
cctggggaagtcacttctcttt

SEQ ID NO: 7215311 - DNA, 22 bp, Homo sapiens
cctggggaatagagtcaagggg

SEQ ID NO: 7215312 - DNA, 22 bp, Homo sapiens
cctggggaatagagtcaagggg

SEQ ID NO: 7215313 - DNA, 22 bp, Homo sapiens
cctggggaagtcacttctcttt

SEQ ID NO: 7215314 - DNA, 22 bp, Homo sapiens
cctggggaatagagtcaagggg

SEQ ID NO: 7215315 - DNA, 22 bp, Homo sapiens
cctggggaatagagtcaagggg

SEQ ID NO: 7215316 - DNA, 22 bp, Homo sapiens
cctggggaatagagtcaagggg

SEQ ID NO: 7215317 - DNA, 22 bp, Homo sapiens
cctggggaatagagtcaagggg

SEQ ID NO: 7215318 - DNA, 22 bp, Homo sapiens
cctggggaatagagtcaagggg

SEQ ID NO: 7215319 - DNA, 22 bp, Homo sapiens
cctggggaatcttgcaggggaa

SEQ ID NO: 7215320 - DNA, 22 bp, Homo sapiens
cctggggaatcttgcaggggaa

SEQ ID NO: 7215321 - DNA, 22 bp, Homo sapiens
cctggggaatcttgcaggggaa

SEQ ID NO: 7215322 - DNA, 22 bp, Homo sapiens
cctggggaatcttgcaggggaa

SEQ ID NO: 7215323 - DNA, 22 bp, Homo sapiens
cctggggaagtcacttctcttt

SEQ ID NO: 7215324 - DNA, 22 bp, Homo sapiens
cctggggaaaagcaggcattta

SEQ ID NO: 7215325 - DNA, 22 bp, Homo sapiens
cctggggaaaagcaggcattta

SEQ ID NO: 7215326 - DNA, 22 bp, Homo sapiens
cctggggaaaagcaggcattta

SEQ ID NO: 7215327 - DNA, 22 bp, Homo sapiens
cctggggaaaagcaggcattta

SEQ ID NO: 7215328 - DNA, 22 bp, Homo sapiens
cctgggctttgctggcaaggcc

SEQ ID NO: 7215329 - DNA, 22 bp, Homo sapiens
cctgggctttgctggcaaggcc

SEQ ID NO: 7215330 - DNA, 22 bp, Homo sapiens
cctgggctttggaacagtactt

SEQ ID NO: 7215331 - DNA, 22 bp, Homo sapiens
cctgggctttggaacagtactt

SEQ ID NO: 7215332 - DNA, 22 bp, Homo sapiens
cctgggctcaagcgatcttgtc

SEQ ID NO: 7215333 - DNA, 22 bp, Homo sapiens
cctgggctcaagtgatcctcct

SEQ ID NO: 7215334 - DNA, 22 bp, Homo sapiens
cctgggcttccacgagcagagg

SEQ ID NO: 7215335 - DNA, 22 bp, Homo sapiens
cctgggctttgctggcaaggcc

SEQ ID NO: 7215336 - DNA, 22 bp, Homo sapiens
cctgggctttgctggcaaggcc

SEQ ID NO: 7215337 - DNA, 22 bp, Homo sapiens
cctgggcttctgtctagatgtt

SEQ ID NO: 7215338 - DNA, 22 bp, Homo sapiens
cctgggcttctgtctagatgtt

SEQ ID NO: 7215339 - DNA, 22 bp, Homo sapiens
cctgggctttgctggcaaggcc

SEQ ID NO: 7215340 - DNA, 22 bp, Homo sapiens
cctgggccttgacctcgtgggc

SEQ ID NO: 7215341 - DNA, 20 bp, Homo sapiens
cctgggctcaaagcatcctc

SEQ ID NO: 7215342 - DNA, 22 bp, Homo sapiens
cctgggccttgacctcgtgggc

SEQ ID NO: 7215343 - DNA, 22 bp, Homo sapiens
cctgggccttgacctcgtgggc

SEQ ID NO: 7215344 - DNA, 22 bp, Homo sapiens
cctgggccttgacctcgtgggc

SEQ ID NO: 7215345 - DNA, 22 bp, Homo sapiens
tgtgtgtataataatgtctgca

SEQ ID NO: 7215346 - DNA, 22 bp, Homo sapiens
tgtgtgtataataatgtctgca

SEQ ID NO: 7215347 - DNA, 22 bp, Homo sapiens
tgtgtgtatatgcatttatcta

SEQ ID NO: 7215348 - DNA, 22 bp, Homo sapiens
tgtgtgtactctccagtcctga

SEQ ID NO: 7215349 - DNA, 22 bp, Homo sapiens
tgtgtgtataataatgtctgca

SEQ ID NO: 7215350 - DNA, 22 bp, Homo sapiens
tgtgtgtataataatgtctgca

SEQ ID NO: 7215351 - DNA, 22 bp, Homo sapiens
tgtgtgtataataatgtctgca

SEQ ID NO: 7215352 - DNA, 22 bp, Homo sapiens
tgtgtgggtggtaaggaaggcc

SEQ ID NO: 7215353 - DNA, 22 bp, Homo sapiens
tgtgtgggtggtaaggaaggcc

SEQ ID NO: 7215354 - DNA, 19 bp, Homo sapiens
tgtgtgggtttagagtagt

SEQ ID NO: 7215355 - DNA, 22 bp, Homo sapiens
tgtgtggtgaagcagagatgct

SEQ ID NO: 7215356 - DNA, 22 bp, Homo sapiens
tgtgtgtaaggaagctttatgg

SEQ ID NO: 7215357 - DNA, 22 bp, Homo sapiens
tgtgtgtaatgtttctctcttc

SEQ ID NO: 7215358 - DNA, 22 bp, Homo sapiens
tgtgtgtatatgcatttatcta

SEQ ID NO: 7215359 - DNA, 22 bp, Homo sapiens
tgtgtgtcactgaaagaaatct

SEQ ID NO: 7215360 - DNA, 19 bp, Homo sapiens
tgtgtgtatttcagttctt

SEQ ID NO: 7215361 - DNA, 22 bp, Homo sapiens
tgtgtgtcagagtctccatggt

SEQ ID NO: 7215362 - DNA, 22 bp, Homo sapiens
tgtgtgtcagagtctccatggt

SEQ ID NO: 7215363 - DNA, 22 bp, Homo sapiens
tgtgtgtcagcccaagggcctt

SEQ ID NO: 7215364 - DNA, 22 bp, Homo sapiens
tgtgtgtcagcccaagggcctt

SEQ ID NO: 7215365 - DNA, 22 bp, Homo sapiens
tgtgtgtcagtcttgtttaggg

SEQ ID NO: 7215366 - DNA, 22 bp, Homo sapiens
tgtgtgtcagtcttgtttaggg

SEQ ID NO: 7215367 - DNA, 22 bp, Homo sapiens
tgtgtgtcagtcttgtttaggg

SEQ ID NO: 7215368 - DNA, 22 bp, Homo sapiens
tgtgtgtcagtcttgtttaggg

SEQ ID NO: 7215369 - DNA, 19 bp, Homo sapiens
cctgggcctccatcacccc

SEQ ID NO: 7215370 - DNA, 22 bp, Homo sapiens
cctgggcctcacccagctcttg

SEQ ID NO: 7215371 - DNA, 22 bp, Homo sapiens
tgtgtgtctggaagctcaggga

SEQ ID NO: 7215372 - DNA, 22 bp, Homo sapiens
tgtgtgtcatttagggtggagc

SEQ ID NO: 7215373 - DNA, 22 bp, Homo sapiens
tgtgtgtccttgacctcagtgg

SEQ ID NO: 7215374 - DNA, 22 bp, Homo sapiens
tgtgtgtccttgacctcagtgg

SEQ ID NO: 7215375 - DNA, 22 bp, Homo sapiens
tgtgtgtctgcacatgtataat

SEQ ID NO: 7215376 - DNA, 22 bp, Homo sapiens
tgtgtgtctgcacatgtataat

SEQ ID NO: 7215377 - DNA, 22 bp, Homo sapiens
tgtgtgtctgcacatgtataat

SEQ ID NO: 7215378 - DNA, 22 bp, Homo sapiens
tgtgtgtctgcacatgtataat

SEQ ID NO: 7215379 - DNA, 22 bp, Homo sapiens
cctgggcctggcgggtcggctc

SEQ ID NO: 7215380 - DNA, 22 bp, Homo sapiens
cctgggcctggcgggtcggctc

SEQ ID NO: 7215381 - DNA, 22 bp, Homo sapiens
cctgggcctgaaaacatttctc

SEQ ID NO: 7215382 - DNA, 22 bp, Homo sapiens
cctgggcctctcaaagtgctgg

SEQ ID NO: 7215383 - DNA, 22 bp, Homo sapiens
cctgggcctctcaaagtgctgg

SEQ ID NO: 7215384 - DNA, 22 bp, Homo sapiens
cctgggcctctcaaagtgctgg

SEQ ID NO: 7215385 - DNA, 22 bp, Homo sapiens
cctggggctccagagcagcgga

SEQ ID NO: 7215386 - DNA, 22 bp, Homo sapiens
cctggggctccagagcagcgga

SEQ ID NO: 7215387 - DNA, 23 bp, Homo sapiens
tgtgttctcacacagatgcagta

SEQ ID NO: 7215388 - DNA, 22 bp, Homo sapiens
tgtgttctccaactgtagattt

SEQ ID NO: 7215389 - DNA, 22 bp, Homo sapiens
cctggggctcaagatggcgccg

SEQ ID NO: 7215390 - DNA, 22 bp, Homo sapiens
cctggggctccagagcagcgga

SEQ ID NO: 7215391 - DNA, 22 bp, Homo sapiens
tgtgttcattagcattgccttg

SEQ ID NO: 7215392 - DNA, 23 bp, Homo sapiens
tgtgttctcacacagatgcagta

SEQ ID NO: 7215393 - DNA, 23 bp, Homo sapiens
tgtgttctcacacagatgcagta

SEQ ID NO: 7215394 - DNA, 23 bp, Homo sapiens
tgtgttctcacacagatgcagta

SEQ ID NO: 7215395 - DNA, 22 bp, Homo sapiens
cctggggaatcttgcaggggaa

SEQ ID NO: 7215396 - DNA, 22 bp, Homo sapiens
cctggggaatcttgcaggggaa

SEQ ID NO: 7215397 - DNA, 22 bp, Homo sapiens
cctggggaatcttgcaggggaa

SEQ ID NO: 7215398 - DNA, 22 bp, Homo sapiens
cctggggaatcttgcaggggaa

SEQ ID NO: 7215399 - DNA, 22 bp, Homo sapiens
cctggggacctgcctcagccct

SEQ ID NO: 7215400 - DNA, 22 bp, Homo sapiens
cctggggacctgcctcagccct

SEQ ID NO: 7215401 - DNA, 22 bp, Homo sapiens
cctggggacctgcctcagccct

SEQ ID NO: 7215402 - DNA, 22 bp, Homo sapiens
tgtgttcaatccctagtctcag

SEQ ID NO: 7215403 - DNA, 22 bp, Homo sapiens
tgtgttcaccctagcacttaac

SEQ ID NO: 7215404 - DNA, 22 bp, Homo sapiens
tgtgttcagtatgacattcaca

SEQ ID NO: 7215405 - DNA, 23 bp, Homo sapiens
tgtgttcagtcaaggatcagagt

SEQ ID NO: 7215406 - DNA, 22 bp, Homo sapiens
cctgggtgacccgtgagcgtcc

SEQ ID NO: 7215407 - DNA, 22 bp, Homo sapiens
cctgggtgacccgtgagcgtcc

SEQ ID NO: 7215408 - DNA, 22 bp, Homo sapiens
cctgggtgacccgtgagcgtcc

SEQ ID NO: 7215409 - DNA, 22 bp, Homo sapiens
cctgggtgatgtgctgccctcg

SEQ ID NO: 7215410 - DNA, 22 bp, Homo sapiens
cctgggtgatgtgctgccctcg

SEQ ID NO: 7215411 - DNA, 22 bp, Homo sapiens
cctgggtgcccggcccttctct

SEQ ID NO: 7215412 - DNA, 22 bp, Homo sapiens
cctgggtgcccggcccttctct

SEQ ID NO: 7215413 - DNA, 22 bp, Homo sapiens
cctgggtggcagaggttgcagt

SEQ ID NO: 7215414 - DNA, 22 bp, Homo sapiens
cctgggtgacagagtgagacct

SEQ ID NO: 7215415 - DNA, 22 bp, Homo sapiens
cctgggtgacagagtgagacct

SEQ ID NO: 7215416 - DNA, 22 bp, Homo sapiens
cctgggtgaatgatattctaaa

SEQ ID NO: 7215417 - DNA, 22 bp, Homo sapiens
cctgggtgaaatctctcctgca

SEQ ID NO: 7215418 - DNA, 22 bp, Homo sapiens
cctgggtgaatgatattctaaa

SEQ ID NO: 7215419 - DNA, 22 bp, Homo sapiens
cctgggtgaatgatattctaaa

SEQ ID NO: 7215420 - DNA, 22 bp, Homo sapiens
cctgggtgaaatctctcctgca

SEQ ID NO: 7215421 - DNA, 22 bp, Homo sapiens
cctgggtgaaatctctcctgca

SEQ ID NO: 7215422 - DNA, 22 bp, Homo sapiens
cctgggtgaaatagtcctcaag

SEQ ID NO: 7215423 - DNA, 22 bp, Homo sapiens
cctgggtgaaatagtcctcaag

SEQ ID NO: 7215424 - DNA, 19 bp, Homo sapiens
cctgggtctgcagcattca

SEQ ID NO: 7215425 - DNA, 22 bp, Homo sapiens
cctgggtcctggcagcctcctg

SEQ ID NO: 7215426 - DNA, 22 bp, Homo sapiens
cctgggtcccagccaggctttg

SEQ ID NO: 7215427 - DNA, 22 bp, Homo sapiens
cctgggtcccatcccagagtga

SEQ ID NO: 7215428 - DNA, 22 bp, Homo sapiens
cctgggtcttcagtctgctggt

SEQ ID NO: 7215429 - DNA, 22 bp, Homo sapiens
cctgggtcttcagtctgctggt

SEQ ID NO: 7215430 - DNA, 22 bp, Homo sapiens
cctgggtcttggttcatgctct

SEQ ID NO: 7215431 - DNA, 22 bp, Homo sapiens
tgtgggaaatgggagtggaaga

SEQ ID NO: 7215432 - DNA, 22 bp, Homo sapiens
cctgggagctgtggaaaggctg

SEQ ID NO: 7215433 - DNA, 22 bp, Homo sapiens
cctgggagctgtggaaaggctg

SEQ ID NO: 7215434 - DNA, 22 bp, Homo sapiens
cctgggagctgtggaaaggctg

SEQ ID NO: 7215435 - DNA, 22 bp, Homo sapiens
tgtggctgttgaggaccccaag

SEQ ID NO: 7215436 - DNA, 22 bp, Homo sapiens
tgtggctgttgaggaccccaag

SEQ ID NO: 7215437 - DNA, 22 bp, Homo sapiens
tgtgggaaatgggagtggaaga

SEQ ID NO: 7215438 - DNA, 22 bp, Homo sapiens
cctgggagctgtggaaaggctg

SEQ ID NO: 7215439 - DNA, 22 bp, Homo sapiens
cctgggaggcagaggttgcagt

SEQ ID NO: 7215440 - DNA, 22 bp, Homo sapiens
cctgggaggcagaggttgcagt

SEQ ID NO: 7215441 - DNA, 22 bp, Homo sapiens
cctgggaggcagaggttgcagt

SEQ ID NO: 7215442 - DNA, 22 bp, Homo sapiens
cctgggaggcagaggttgcagt

SEQ ID NO: 7215443 - DNA, 19 bp, Homo sapiens
cctgggaggcggaggttgc

SEQ ID NO: 7215444 - DNA, 19 bp, Homo sapiens
cctgggaggcggaggttgc

SEQ ID NO: 7215445 - DNA, 22 bp, Homo sapiens
tgtggctgctcctgggtggtca

SEQ ID NO: 7215446 - DNA, 22 bp, Homo sapiens
tgtggctgctcctgggtggtca

SEQ ID NO: 7215447 - DNA, 22 bp, Homo sapiens
tgtggctgggaagaaggtaact

SEQ ID NO: 7215448 - DNA, 22 bp, Homo sapiens
tgtggctgggctaataggcaaa

SEQ ID NO: 7215449 - DNA, 22 bp, Homo sapiens
tgtggctgggctaataggcaaa

SEQ ID NO: 7215450 - DNA, 22 bp, Homo sapiens
tgtggctgggaagaaggtaact

SEQ ID NO: 7215451 - DNA, 22 bp, Homo sapiens
tgtggctggtctccgagcgtcg

SEQ ID NO: 7215452 - DNA, 22 bp, Homo sapiens
tgtggctgtggatgctttccag

SEQ ID NO: 7215453 - DNA, 22 bp, Homo sapiens
tgtggctgtgtccacctgctgc

SEQ ID NO: 7215454 - DNA, 18 bp, Homo sapiens
tgtggcaggggtgggaga

SEQ ID NO: 7215455 - DNA, 18 bp, Homo sapiens
tgtggcaggggtgggaga

SEQ ID NO: 7215456 - DNA, 21 bp, Homo sapiens
tgtggctgcctctggccctgg

SEQ ID NO: 7215457 - DNA, 22 bp, Homo sapiens
tgtggctgctcaggtgcagacc

SEQ ID NO: 7215458 - DNA, 22 bp, Homo sapiens
tgtggctgctcaggtgcagacc

SEQ ID NO: 7215459 - DNA, 22 bp, Homo sapiens
tgtggctgctcaggtgcagacc

SEQ ID NO: 7215460 - DNA, 22 bp, Homo sapiens
tgtggcagggatactgaggcag

SEQ ID NO: 7215461 - DNA, 22 bp, Homo sapiens
tgtggcagggatactgaggcag

SEQ ID NO: 7215462 - DNA, 22 bp, Homo sapiens
tgtggcagggatactgaggcag

SEQ ID NO: 7215463 - DNA, 18 bp, Homo sapiens
tgtggcaggggtgggaga

SEQ ID NO: 7215464 - DNA, 22 bp, Homo sapiens
tgtggcaggcattctgaggctg

SEQ ID NO: 7215465 - DNA, 22 bp, Homo sapiens
tgtggcaggcattctgaggctg

SEQ ID NO: 7215466 - DNA, 22 bp, Homo sapiens
tgtggcaggcattctgaggctg

SEQ ID NO: 7215467 - DNA, 22 bp, Homo sapiens
tgtggcaggcaagatgtacaga

SEQ ID NO: 7215468 - DNA, 20 bp, Homo sapiens
tgtggcaggatgagggcgga

SEQ ID NO: 7215469 - DNA, 20 bp, Homo sapiens
tgtggcaggatgagggcgga

SEQ ID NO: 7215470 - DNA, 20 bp, Homo sapiens
tgtggcaggatgagggcgga

SEQ ID NO: 7215471 - DNA, 20 bp, Homo sapiens
tgtggcaggatgagggcgga

SEQ ID NO: 7215472 - DNA, 22 bp, Homo sapiens
tgtggcaggaagagcttctgag

SEQ ID NO: 7215473 - DNA, 22 bp, Homo sapiens
tgtggcaggaagagcttctgag

SEQ ID NO: 7215474 - DNA, 22 bp, Homo sapiens
tgtggcaggaagagcttctgag

SEQ ID NO: 7215475 - DNA, 22 bp, Homo sapiens
tgtggcagctggaggtggagaa

SEQ ID NO: 7215476 - DNA, 22 bp, Homo sapiens
tgtggcagctggaggtggagaa

SEQ ID NO: 7215477 - DNA, 22 bp, Homo sapiens
tgtggcagctggaggtggagaa

SEQ ID NO: 7215478 - DNA, 22 bp, Homo sapiens
tgtggcaggaagagcttctgag

SEQ ID NO: 7215479 - DNA, 22 bp, Homo sapiens
tgtggcagctggaggtggagaa

SEQ ID NO: 7215480 - DNA, 22 bp, Homo sapiens
tgtggcagctggaggtggagaa

SEQ ID NO: 7215481 - DNA, 22 bp, Homo sapiens
tgtggcagctggaggtggagaa

SEQ ID NO: 7215482 - DNA, 22 bp, Homo sapiens
tgtgctttcaaagttaagtaaa

SEQ ID NO: 7215483 - DNA, 22 bp, Homo sapiens
tgtgctttcaaagttaagtaaa

SEQ ID NO: 7215484 - DNA, 22 bp, Homo sapiens
tgtgctttcaaagttaagtaaa

SEQ ID NO: 7215485 - DNA, 22 bp, Homo sapiens
tgtgctttggttttacaggatg

SEQ ID NO: 7215486 - DNA, 22 bp, Homo sapiens
tgtgcttttctctgctcctgga

SEQ ID NO: 7215487 - DNA, 20 bp, Homo sapiens
tgtggaaaaacagaagcaga

SEQ ID NO: 7215488 - DNA, 22 bp, Homo sapiens
tgtggaaaaaccacaagtttgg

SEQ ID NO: 7215489 - DNA, 22 bp, Homo sapiens
cctgggaggcggaggttgcagt

SEQ ID NO: 7215490 - DNA, 22 bp, Homo sapiens
cctgggaggctgaggctgcagt

SEQ ID NO: 7215491 - DNA, 22 bp, Homo sapiens
cctgggaggctgaggctgcagt

SEQ ID NO: 7215492 - DNA, 22 bp, Homo sapiens
cctgggaggctgaggctgcagt

SEQ ID NO: 7215493 - DNA, 22 bp, Homo sapiens
cctgggcagcctgctcaaggac

SEQ ID NO: 7215494 - DNA, 22 bp, Homo sapiens
cctgggcatctcatgcacctgc

SEQ ID NO: 7215495 - DNA, 19 bp, Homo sapiens
cctgggaggcggaggttgc

SEQ ID NO: 7215496 - DNA, 22 bp, Homo sapiens
cctgggaggcggaggttgcagg

SEQ ID NO: 7215497 - DNA, 22 bp, Homo sapiens
cctgggaggcggaggttgcagg

SEQ ID NO: 7215498 - DNA, 22 bp, Homo sapiens
cctgggaggcggaggttgcagg

SEQ ID NO: 7215499 - DNA, 22 bp, Homo sapiens
cctgggaggcggaggttgcagt

SEQ ID NO: 7215500 - DNA, 22 bp, Homo sapiens
cctgggaggcggaggttgcagt

SEQ ID NO: 7215501 - DNA, 22 bp, Homo sapiens
cctgggaggcggaggttgcagg

SEQ ID NO: 7215502 - DNA, 22 bp, Homo sapiens
cctgggaggcggaggttgcagt

SEQ ID NO: 7215503 - DNA, 21 bp, Homo sapiens
cctgggccaaattccctggac

SEQ ID NO: 7215504 - DNA, 21 bp, Homo sapiens
cctgggccaaattccctggac

SEQ ID NO: 7215505 - DNA, 21 bp, Homo sapiens
cctgggccaaattccctggac

SEQ ID NO: 7215506 - DNA, 23 bp, Homo sapiens
cctgggcattggctgcagcttct

SEQ ID NO: 7215507 - DNA, 23 bp, Homo sapiens
cctgggcattggctgcagcttct

SEQ ID NO: 7215508 - DNA, 22 bp, Homo sapiens
cctgggcctatcctagaaccaa

SEQ ID NO: 7215509 - DNA, 22 bp, Homo sapiens
cctgggccctcaccgccggtgg

SEQ ID NO: 7215510 - DNA, 22 bp, Homo sapiens
cctgggcctatcctagaaccaa

SEQ ID NO: 7215511 - DNA, 22 bp, Homo sapiens
cctgggcctatcctagaaccaa

SEQ ID NO: 7215512 - DNA, 22 bp, Homo sapiens
cctgggccctcaccgccggtgg

SEQ ID NO: 7215513 - DNA, 22 bp, Homo sapiens
cctgggccaggcttgggaatgc

SEQ ID NO: 7215514 - DNA, 22 bp, Homo sapiens
cctgggccaggcttgggaatgc

SEQ ID NO: 7215515 - DNA, 22 bp, Homo sapiens
cctgggccaggcttgggaatgc

SEQ ID NO: 7215516 - DNA, 21 bp, Homo sapiens
cctgggccaaattccctggac

SEQ ID NO: 7215517 - DNA, 21 bp, Homo sapiens
cctgggccaaattccctggac

SEQ ID NO: 7215518 - DNA, 22 bp, Homo sapiens
tgtggggctccctggcagcctg

SEQ ID NO: 7215519 - DNA, 22 bp, Homo sapiens
tgtggggctccctggcagcctg

SEQ ID NO: 7215520 - DNA, 22 bp, Homo sapiens
tgtggggctgtcaggcaactgg

SEQ ID NO: 7215521 - DNA, 22 bp, Homo sapiens
tgtggggctgtcaggcaactgg

SEQ ID NO: 7215522 - DNA, 22 bp, Homo sapiens
tgtggggctccctggcagcctg

SEQ ID NO: 7215523 - DNA, 22 bp, Homo sapiens
tgtggggctccctggcagcctg

SEQ ID NO: 7215524 - DNA, 22 bp, Homo sapiens
tgtggggcagctagccggcctg

SEQ ID NO: 7215525 - DNA, 22 bp, Homo sapiens
tgtggggccaaagcccagccac

SEQ ID NO: 7215526 - DNA, 22 bp, Homo sapiens
tgtggggcctcgtgctagctgg

SEQ ID NO: 7215527 - DNA, 22 bp, Homo sapiens
cctgggcctcacccagctcttg

SEQ ID NO: 7215528 - DNA, 19 bp, Homo sapiens
tgtggggagtcagggggct

SEQ ID NO: 7215529 - DNA, 22 bp, Homo sapiens
tgtggggcagctagccggcctg

SEQ ID NO: 7215530 - DNA, 22 bp, Homo sapiens
cctgggcctcacccagctcttg

SEQ ID NO: 7215531 - DNA, 22 bp, Homo sapiens
cctgggcctcacccagctcttg

SEQ ID NO: 7215532 - DNA, 22 bp, Homo sapiens
cctgggcctcacccagctcttg

SEQ ID NO: 7215533 - DNA, 22 bp, Homo sapiens
cctgggcctatcctagaaccaa

SEQ ID NO: 7215534 - DNA, 22 bp, Homo sapiens
cctgggcctcacccagctcttg

SEQ ID NO: 7215535 - DNA, 22 bp, Homo sapiens
tgtgtgggcgaagacagccttt

SEQ ID NO: 7215536 - DNA, 22 bp, Homo sapiens
tgtgtgggcgaagacagccttt

SEQ ID NO: 7215537 - DNA, 22 bp, Homo sapiens
tgtgtggggaaggaaggagctg

SEQ ID NO: 7215538 - DNA, 22 bp, Homo sapiens
tgtgtgggtggtaaggaaggcc

SEQ ID NO: 7215539 - DNA, 22 bp, Homo sapiens
tgtgtgggtggtaaggaaggcc

SEQ ID NO: 7215540 - DNA, 21 bp, Homo sapiens
tgtgtgggcatatctgctgca

SEQ ID NO: 7215541 - DNA, 22 bp, Homo sapiens
tgtgtctgtgtatacacggcat

SEQ ID NO: 7215542 - DNA, 23 bp, Homo sapiens
tgtgtctgtttagggaggatgtg

SEQ ID NO: 7215543 - DNA, 23 bp, Homo sapiens
tgtgtctgtttagggaggatgtg

SEQ ID NO: 7215544 - DNA, 22 bp, Homo sapiens
tgtggggcttacaaaggcagat

SEQ ID NO: 7215545 - DNA, 22 bp, Homo sapiens
tgtggggcttacaaaggcagat

SEQ ID NO: 7215546 - DNA, 22 bp, Homo sapiens
tgtggggcttacaaaggcagat

SEQ ID NO: 7215547 - DNA, 22 bp, Homo sapiens
tgtggggctgtggtgttcttct

SEQ ID NO: 7215548 - DNA, 22 bp, Homo sapiens
tgtggggcttacaaaggcagat

SEQ ID NO: 7215549 - DNA, 22 bp, Homo sapiens
tgtggggctgtggtgttcttct

SEQ ID NO: 7215550 - DNA, 22 bp, Homo sapiens
tgtggggctgtcaggcaactgg

SEQ ID NO: 7215551 - DNA, 22 bp, Homo sapiens
tgtggggctgtggtgttcttct

SEQ ID NO: 7215552 - DNA, 22 bp, Homo sapiens
tgtgggggtacacgtacacatg

SEQ ID NO: 7215553 - DNA, 22 bp, Homo sapiens
tgtgggggtacacgtacacatg

SEQ ID NO: 7215554 - DNA, 22 bp, Homo sapiens
tgtgggggtacacgtacacatg

SEQ ID NO: 7215555 - DNA, 22 bp, Homo sapiens
tgtggggtgtggtccaggcatc

SEQ ID NO: 7215556 - DNA, 22 bp, Homo sapiens
tgtgtctgtcctcggttgatgc

SEQ ID NO: 7215557 - DNA, 22 bp, Homo sapiens
tgtgccattgagaggtttcaga

SEQ ID NO: 7215558 - DNA, 23 bp, Homo sapiens
tgtgccattgaggctgaggctca

SEQ ID NO: 7215559 - DNA, 23 bp, Homo sapiens
tgtgccattgaggctgaggctca

SEQ ID NO: 7215560 - DNA, 22 bp, Homo sapiens
tgtgccagttttgtctaagccc

SEQ ID NO: 7215561 - DNA, 22 bp, Homo sapiens
tgtgccatctgatataagagcc

SEQ ID NO: 7215562 - DNA, 22 bp, Homo sapiens
tgtgccagggcctccaaaagcc

SEQ ID NO: 7215563 - DNA, 22 bp, Homo sapiens
tgtgccagtcatccagatgtgt

SEQ ID NO: 7215564 - DNA, 22 bp, Homo sapiens
tgtgccaggccggggcaggaca

SEQ ID NO: 7215565 - DNA, 21 bp, Homo sapiens
tgtgccagggatggggagccc

SEQ ID NO: 7215566 - DNA, 22 bp, Homo sapiens
tgtgcccattacacagaggcat

SEQ ID NO: 7215567 - DNA, 22 bp, Homo sapiens
tgtgcccatctcccagcttgac

SEQ ID NO: 7215568 - DNA, 22 bp, Homo sapiens
tgtgcccagactgcctcagtga

SEQ ID NO: 7215569 - DNA, 20 bp, Homo sapiens
tgtgcccagcagaggctgcc

SEQ ID NO: 7215570 - DNA, 22 bp, Homo sapiens
tgtgcccatccctctggagtgt

SEQ ID NO: 7215571 - DNA, 22 bp, Homo sapiens
tgtgcttctgcagagactattt

SEQ ID NO: 7215572 - DNA, 22 bp, Homo sapiens
tgtgcttctctttctcacttaa

SEQ ID NO: 7215573 - DNA, 22 bp, Homo sapiens
tgtgctgtggaagtttagagaa

SEQ ID NO: 7215574 - DNA, 22 bp, Homo sapiens
tgtgctgtgggactcaggctcc

SEQ ID NO: 7215575 - DNA, 22 bp, Homo sapiens
tgtgcttactttgaattatata

SEQ ID NO: 7215576 - DNA, 22 bp, Homo sapiens
tgtgcttcaggttgtcgccacg

SEQ ID NO: 7215577 - DNA, 22 bp, Homo sapiens
tgtgcttctcacatcactgttg

SEQ ID NO: 7215578 - DNA, 22 bp, Homo sapiens
tgtgcccattacacagaggcat

SEQ ID NO: 7215579 - DNA, 22 bp, Homo sapiens
tgtgctgggaaatggcaggata

SEQ ID NO: 7215580 - DNA, 22 bp, Homo sapiens
tgtgctgggaaatggcaggata

SEQ ID NO: 7215581 - DNA, 22 bp, Homo sapiens
tgtgctgggaaatggcaggata

SEQ ID NO: 7215582 - DNA, 22 bp, Homo sapiens
tgtgctgggagatagagggagg

SEQ ID NO: 7215583 - DNA, 22 bp, Homo sapiens
tgtgctgggagatagagggagg

SEQ ID NO: 7215584 - DNA, 22 bp, Homo sapiens
tgtgctggggtccagctgagcc

SEQ ID NO: 7215585 - DNA, 22 bp, Homo sapiens
tgtgctggggtccagctgagcc

SEQ ID NO: 7215586 - DNA, 22 bp, Homo sapiens
tgtgctggtacatgtgaggatg

SEQ ID NO: 7215587 - DNA, 22 bp, Homo sapiens
tgtgctggtacatgtgaggatg

SEQ ID NO: 7215588 - DNA, 22 bp, Homo sapiens
tgtgccaggccctggggaccaa

SEQ ID NO: 7215589 - DNA, 22 bp, Homo sapiens
tgtgccaggccctggggaccaa

SEQ ID NO: 7215590 - DNA, 22 bp, Homo sapiens
cctgggagctgtggaaaggctg

SEQ ID NO: 7215591 - DNA, 22 bp, Homo sapiens
tgtgccagcctctggctgtgtc

SEQ ID NO: 7215592 - DNA, 22 bp, Homo sapiens
cctgggagccaagcctctgtgt

SEQ ID NO: 7215593 - DNA, 22 bp, Homo sapiens
cctgggagccgactgactgtgc

SEQ ID NO: 7215594 - DNA, 22 bp, Homo sapiens
cctgggagccgactgactgtgc

SEQ ID NO: 7215595 - DNA, 22 bp, Homo sapiens
cctgggagccaagcctctgtgt

SEQ ID NO: 7215596 - DNA, 22 bp, Homo sapiens
cctgggagccaagcctctgtgt

SEQ ID NO: 7215597 - DNA, 21 bp, Homo sapiens
cctgggagatcagctgccttc

SEQ ID NO: 7215598 - DNA, 21 bp, Homo sapiens
cctgggagatcagctgccttc

SEQ ID NO: 7215599 - DNA, 21 bp, Homo sapiens
cctgggagatcagctgccttc

SEQ ID NO: 7215600 - DNA, 22 bp, Homo sapiens
cctgggagagtctgtggtctcc

SEQ ID NO: 7215601 - DNA, 22 bp, Homo sapiens
cctgggagagtctgtggtctcc

SEQ ID NO: 7215602 - DNA, 21 bp, Homo sapiens
cctgggagatcagctgccttc

SEQ ID NO: 7215603 - DNA, 22 bp, Homo sapiens
cctgggagagccatctgtggcc

SEQ ID NO: 7215604 - DNA, 22 bp, Homo sapiens
cctgggagagccatctgtggcc

SEQ ID NO: 7215605 - DNA, 22 bp, Homo sapiens
cctgggagagctgcccgggtga

SEQ ID NO: 7215606 - DNA, 22 bp, Homo sapiens
cctgggagagtctgtggtctcc

SEQ ID NO: 7215607 - DNA, 22 bp, Homo sapiens
cctgggagagtctgtggtctcc

SEQ ID NO: 7215608 - DNA, 21 bp, Homo sapiens
cctgggagaattgggtgtggc

SEQ ID NO: 7215609 - DNA, 22 bp, Homo sapiens
cctgggagagccatctgtggcc

SEQ ID NO: 7215610 - DNA, 22 bp, Homo sapiens
cctgggagagccatctgtggcc

SEQ ID NO: 7215611 - DNA, 22 bp, Homo sapiens
cctgggaagcccatagcagctt

SEQ ID NO: 7215612 - DNA, 20 bp, Homo sapiens
cctgggaaggcagccccagc

SEQ ID NO: 7215613 - DNA, 20 bp, Homo sapiens
cctgggaaggcagccccagc

SEQ ID NO: 7215614 - DNA, 21 bp, Homo sapiens
cctgggagaattgggtgtggc

SEQ ID NO: 7215615 - DNA, 22 bp, Homo sapiens
cctgggaacagtgggttggctc

SEQ ID NO: 7215616 - DNA, 22 bp, Homo sapiens
cctgggaagaccggcagtgggg

SEQ ID NO: 7215617 - DNA, 22 bp, Homo sapiens
cctgggaagaccggcagtgggg

SEQ ID NO: 7215618 - DNA, 22 bp, Homo sapiens
cctgggaagagctgacaggagg

SEQ ID NO: 7215619 - DNA, 22 bp, Homo sapiens
cctgggaagcccatagcagctt

SEQ ID NO: 7215620 - DNA, 22 bp, Homo sapiens
cctgggaagcccatagcagctt

SEQ ID NO: 7215621 - DNA, 22 bp, Homo sapiens
cctgggaagaccggcagtgggg

SEQ ID NO: 7215622 - DNA, 22 bp, Homo sapiens
cctgggaagaccggcagtgggg

SEQ ID NO: 7215623 - DNA, 22 bp, Homo sapiens
cctgggaacagtgggttggctc

SEQ ID NO: 7215624 - DNA, 22 bp, Homo sapiens
cctgggaacagtgggttggctc

SEQ ID NO: 7215625 - DNA, 22 bp, Homo sapiens
cctgggaaagtgaggtcattat

SEQ ID NO: 7215626 - DNA, 22 bp, Homo sapiens
cctgggaaagtgaggtcattat

SEQ ID NO: 7215627 - DNA, 22 bp, Homo sapiens
cctgggaacagcagagtcctgg

SEQ ID NO: 7215628 - DNA, 18 bp, Homo sapiens
cctggcttttctacttgc

SEQ ID NO: 7215629 - DNA, 20 bp, Homo sapiens
cctggctttgcatctgtgat

SEQ ID NO: 7215630 - DNA, 20 bp, Homo sapiens
cctggctttgcatctgtgat

SEQ ID NO: 7215631 - DNA, 22 bp, Homo sapiens
cctggcttttgtttataaattc

SEQ ID NO: 7215632 - DNA, 23 bp, Homo sapiens
cctgggaaaactgctgatcttgc

SEQ ID NO: 7215633 - DNA, 23 bp, Homo sapiens
cctgggaaaactgctgatcttgc

SEQ ID NO: 7215634 - DNA, 20 bp, Homo sapiens
cctggctttgcagcatgaga

SEQ ID NO: 7215635 - DNA, 22 bp, Homo sapiens
cctggcttctgggtctgtgaga

SEQ ID NO: 7215636 - DNA, 22 bp, Homo sapiens
cctggctttagctgccttccct

SEQ ID NO: 7215637 - DNA, 22 bp, Homo sapiens
cctggctttgaccttgctgttt

SEQ ID NO: 7215638 - DNA, 22 bp, Homo sapiens
cctggcttctcaccttgttctg

SEQ ID NO: 7215639 - DNA, 22 bp, Homo sapiens
cctggcttctctgcattgttct

SEQ ID NO: 7215640 - DNA, 22 bp, Homo sapiens
cctggcttctgggtctgtgaga

SEQ ID NO: 7215641 - DNA, 22 bp, Homo sapiens
cctggcttcctggagctcacaa

SEQ ID NO: 7215642 - DNA, 22 bp, Homo sapiens
cctggcttccttcatgacctgg

SEQ ID NO: 7215643 - DNA, 22 bp, Homo sapiens
cctggcttccatatggcacata

SEQ ID NO: 7215644 - DNA, 18 bp, Homo sapiens
cctggcttccatcttggt

SEQ ID NO: 7215645 - DNA, 22 bp, Homo sapiens
cctggcttccatatggcacata

SEQ ID NO: 7215646 - DNA, 22 bp, Homo sapiens
cctggcttcagcattgccctct

SEQ ID NO: 7215647 - DNA, 22 bp, Homo sapiens
cctggcttcagcattgccctct

SEQ ID NO: 7215648 - DNA, 22 bp, Homo sapiens
cctggcttagaggttgcctttc

SEQ ID NO: 7215649 - DNA, 22 bp, Homo sapiens
cctggctgtttatttcggggct

SEQ ID NO: 7215650 - DNA, 22 bp, Homo sapiens
cctggctgtttgagcggggaat

SEQ ID NO: 7215651 - DNA, 22 bp, Homo sapiens
cctggctgtttgagcggggaat

SEQ ID NO: 7215652 - DNA, 22 bp, Homo sapiens
cctggctgtttgagcggggaat

SEQ ID NO: 7215653 - DNA, 22 bp, Homo sapiens
cctggctgtggcggtgctctca

SEQ ID NO: 7215654 - DNA, 22 bp, Homo sapiens
cctggctgtggcggtgctctca

SEQ ID NO: 7215655 - DNA, 22 bp, Homo sapiens
cctggctgtggcggtgctctca

SEQ ID NO: 7215656 - DNA, 22 bp, Homo sapiens
cctggctgtggcggtgctctca

SEQ ID NO: 7215657 - DNA, 22 bp, Homo sapiens
cctggctgtgtgaccttggcaa

SEQ ID NO: 7215658 - DNA, 22 bp, Homo sapiens
cctggctgtgcattgccggccc

SEQ ID NO: 7215659 - DNA, 23 bp, Homo sapiens
cctggctgtggatttgggcctgc

SEQ ID NO: 7215660 - DNA, 23 bp, Homo sapiens
cctggctgtggatttgggcctgc

SEQ ID NO: 7215661 - DNA, 22 bp, Homo sapiens
cctggctgtgcatgtttctatg

SEQ ID NO: 7215662 - DNA, 22 bp, Homo sapiens
cctggctgtgcatgtttctatg

SEQ ID NO: 7215663 - DNA, 22 bp, Homo sapiens
cctggctgtgcattgccggccc

SEQ ID NO: 7215664 - DNA, 22 bp, Homo sapiens
cctggctgtgcattgccggccc

SEQ ID NO: 7215665 - DNA, 22 bp, Homo sapiens
cctggctgtcgttttgtgaaat

SEQ ID NO: 7215666 - DNA, 22 bp, Homo sapiens
cctggctgtcgttttgtgaaat

SEQ ID NO: 7215667 - DNA, 22 bp, Homo sapiens
cctggctgctctgatgagcgcc

SEQ ID NO: 7215668 - DNA, 22 bp, Homo sapiens
cctggctgctctgatgagcgcc

SEQ ID NO: 7215669 - DNA, 22 bp, Homo sapiens
cctggctgccgagtgtgcagcg

SEQ ID NO: 7215670 - DNA, 22 bp, Homo sapiens
cctggctgccgagtgtgcagcg

SEQ ID NO: 7215671 - DNA, 22 bp, Homo sapiens
cctggctgccgagtgtgcagcg

SEQ ID NO: 7215672 - DNA, 22 bp, Homo sapiens
cctggctgccgagtgtgcagcg

SEQ ID NO: 7215673 - DNA, 22 bp, Homo sapiens
cctggctgccgagtgtgcagcg

SEQ ID NO: 7215674 - DNA, 22 bp, Homo sapiens
cctggctgctatagcagcatgt

SEQ ID NO: 7215675 - DNA, 22 bp, Homo sapiens
cctggctgcccatggaccctct

SEQ ID NO: 7215676 - DNA, 20 bp, Homo sapiens
cctggctgcattcaggacgg

SEQ ID NO: 7215677 - DNA, 20 bp, Homo sapiens
cctggctgcattcaggacgg

SEQ ID NO: 7215678 - DNA, 22 bp, Homo sapiens
cctggctgcattttgctggatg

SEQ ID NO: 7215679 - DNA, 22 bp, Homo sapiens
cctggctgcattttgctggatg

SEQ ID NO: 7215680 - DNA, 22 bp, Homo sapiens
cctggctgcattttgctggatg

SEQ ID NO: 7215681 - DNA, 22 bp, Homo sapiens
tgtgaggcctagacagcctggg

SEQ ID NO: 7215682 - DNA, 22 bp, Homo sapiens
tgtgaggattaaatgcatagtg

SEQ ID NO: 7215683 - DNA, 22 bp, Homo sapiens
tgtgaggatgttaaggggatga

SEQ ID NO: 7215684 - DNA, 22 bp, Homo sapiens
tgtgaggatgtaaccagaagtc

SEQ ID NO: 7215685 - DNA, 22 bp, Homo sapiens
tgtgaggataaaaaggaaggag

SEQ ID NO: 7215686 - DNA, 22 bp, Homo sapiens
tgtgaggataaaaaggaaggag

SEQ ID NO: 7215687 - DNA, 22 bp, Homo sapiens
tgtgaggatggagttctacagg

SEQ ID NO: 7215688 - DNA, 22 bp, Homo sapiens
tgtgaggcgaggccagtgagct

SEQ ID NO: 7215689 - DNA, 22 bp, Homo sapiens
tgtgaggcctctgcaggagcag

SEQ ID NO: 7215690 - DNA, 22 bp, Homo sapiens
tgtgagggttttaagggaatga

SEQ ID NO: 7215691 - DNA, 22 bp, Homo sapiens
tgtgagggttttaagggaatga

SEQ ID NO: 7215692 - DNA, 22 bp, Homo sapiens
cctggctgcagtttttgcagaa

SEQ ID NO: 7215693 - DNA, 22 bp, Homo sapiens
tgtgaggctacctgccagggtc

SEQ ID NO: 7215694 - DNA, 22 bp, Homo sapiens
tgtgaggctacctgccagggtc

SEQ ID NO: 7215695 - DNA, 22 bp, Homo sapiens
tgtgagggttttaagggaatga

SEQ ID NO: 7215696 - DNA, 22 bp, Homo sapiens
tgtgagcagctctgtggactca

SEQ ID NO: 7215697 - DNA, 22 bp, Homo sapiens
tgtgagcatatgttttcagctc

SEQ ID NO: 7215698 - DNA, 17 bp, Homo sapiens
tgtgagcatctatagaa

SEQ ID NO: 7215699 - DNA, 22 bp, Homo sapiens
tgtgagcagagcctgacatgag

SEQ ID NO: 7215700 - DNA, 22 bp, Homo sapiens
tgtgagcagagacatgaaaagc

SEQ ID NO: 7215701 - DNA, 20 bp, Homo sapiens
tgtgagcagatgctgagtga

SEQ ID NO: 7215702 - DNA, 22 bp, Homo sapiens
tgtgaggaacaggactagagca

SEQ ID NO: 7215703 - DNA, 22 bp, Homo sapiens
tgtgaggaacaggactagagca

SEQ ID NO: 7215704 - DNA, 22 bp, Homo sapiens
tgtgaggaacaggactagagca

SEQ ID NO: 7215705 - DNA, 22 bp, Homo sapiens
tgtgaggaacccggaatgtggg

SEQ ID NO: 7215706 - DNA, 22 bp, Homo sapiens
tgtgaggacattggaggactca

SEQ ID NO: 7215707 - DNA, 22 bp, Homo sapiens
tgtgaggaacaggactagagca

SEQ ID NO: 7215708 - DNA, 22 bp, Homo sapiens
tgtgaggaacccggaatgtggg

SEQ ID NO: 7215709 - DNA, 22 bp, Homo sapiens
tgtgaggagtaggctgagggtg

SEQ ID NO: 7215710 - DNA, 22 bp, Homo sapiens
tgtgaggagtaggctgagggtg

SEQ ID NO: 7215711 - DNA, 22 bp, Homo sapiens
tgtgaggagtaggctgagggtg

SEQ ID NO: 7215712 - DNA, 22 bp, Homo sapiens
tgtgaggataaaaaggaaggag

SEQ ID NO: 7215713 - DNA, 22 bp, Homo sapiens
tgtgaggataaaaaggaaggag

SEQ ID NO: 7215714 - DNA, 22 bp, Homo sapiens
tgtgaggataaaaaggaaggag

SEQ ID NO: 7215715 - DNA, 22 bp, Homo sapiens
tgtgaggagggtcaaactgagt

SEQ ID NO: 7215716 - DNA, 22 bp, Homo sapiens
tgtgaggaggcggccagaagag

SEQ ID NO: 7215717 - DNA, 20 bp, Homo sapiens
tgtgaggagcatggccgctg

SEQ ID NO: 7215718 - DNA, 22 bp, Homo sapiens
tgtgaggacctcagcagagtct

SEQ ID NO: 7215719 - DNA, 22 bp, Homo sapiens
tgtgaggacctcagcagagtct

SEQ ID NO: 7215720 - DNA, 22 bp, Homo sapiens
tgtgaggacctcagcagagtct

SEQ ID NO: 7215721 - DNA, 22 bp, Homo sapiens
tgtgaggacctcagcagagtct

SEQ ID NO: 7215722 - DNA, 22 bp, Homo sapiens
tgtgaggacctcagcagagtct

SEQ ID NO: 7215723 - DNA, 22 bp, Homo sapiens
tgtgaggacattggaggactca

SEQ ID NO: 7215724 - DNA, 22 bp, Homo sapiens
tgtgaggacattggaggactca

SEQ ID NO: 7215725 - DNA, 22 bp, Homo sapiens
tgtgaggacattggaggactca

SEQ ID NO: 7215726 - DNA, 23 bp, Homo sapiens
tgtgaaggtgggtccaagggctg

SEQ ID NO: 7215727 - DNA, 22 bp, Homo sapiens
tgtgaagggcactgtctggaat

SEQ ID NO: 7215728 - DNA, 22 bp, Homo sapiens
tgtgaaggtaaggaggggcaag

SEQ ID NO: 7215729 - DNA, 22 bp, Homo sapiens
tgtgaaggtaaggaggggcaag

SEQ ID NO: 7215730 - DNA, 22 bp, Homo sapiens
tgtgaaggtaaggaggggcaag

SEQ ID NO: 7215731 - DNA, 22 bp, Homo sapiens
tgtgaaggcagagccagtgaaa

SEQ ID NO: 7215732 - DNA, 22 bp, Homo sapiens
tgtgaaggcagcagctctgtcc

SEQ ID NO: 7215733 - DNA, 22 bp, Homo sapiens
tgtgaaggcagagccagtgaaa

SEQ ID NO: 7215734 - DNA, 22 bp, Homo sapiens
tgtgaaggagcatgcagagggg

SEQ ID NO: 7215735 - DNA, 22 bp, Homo sapiens
tgtgaaggagcatgcagagggg

SEQ ID NO: 7215736 - DNA, 22 bp, Homo sapiens
tgtgaaggagatgaagggagtg

SEQ ID NO: 7215737 - DNA, 22 bp, Homo sapiens
tgtgaaggagatgaagggagtg

SEQ ID NO: 7215738 - DNA, 22 bp, Homo sapiens
tgtgaagctggatcctggagct

SEQ ID NO: 7215739 - DNA, 22 bp, Homo sapiens
tgtgaagcgtgtgcaggggaca

SEQ ID NO: 7215740 - DNA, 22 bp, Homo sapiens
tgtgaagcgtgtgcaggggaca

SEQ ID NO: 7215741 - DNA, 22 bp, Homo sapiens
tgtgaagcccagagaggttcac

SEQ ID NO: 7215742 - DNA, 23 bp, Homo sapiens
tgtgaagccgctcataggggtcc

SEQ ID NO: 7215743 - DNA, 22 bp, Homo sapiens
tgtgaagcatagattctgtaga

SEQ ID NO: 7215744 - DNA, 22 bp, Homo sapiens
tgtgaagcagtcacacgctttc

SEQ ID NO: 7215745 - DNA, 20 bp, Homo sapiens
tgtgaagcaggagggtggtt

SEQ ID NO: 7215746 - DNA, 22 bp, Homo sapiens
tgtgaagatttggcatgcagaa

SEQ ID NO: 7215747 - DNA, 22 bp, Homo sapiens
tgtgaagatttggcatgcagaa

SEQ ID NO: 7215748 - DNA, 22 bp, Homo sapiens
tgtgaagatcagggtcctagag

SEQ ID NO: 7215749 - DNA, 22 bp, Homo sapiens
tgtgaagattaagttactgggc

SEQ ID NO: 7215750 - DNA, 22 bp, Homo sapiens
tgtgaagagtagacatgtggtg

SEQ ID NO: 7215751 - DNA, 22 bp, Homo sapiens
tgtgaagatagctgttacatct

SEQ ID NO: 7215752 - DNA, 22 bp, Homo sapiens
tgtgaagatagctgttacatct

SEQ ID NO: 7215753 - DNA, 22 bp, Homo sapiens
tgtctttggaatatttagctga

SEQ ID NO: 7215754 - DNA, 21 bp, Homo sapiens
tgtctttggcctcattcccag

SEQ ID NO: 7215755 - DNA, 22 bp, Homo sapiens
tgtgaactctggaacaaaacta

SEQ ID NO: 7215756 - DNA, 22 bp, Homo sapiens
tgtgaactctggaacaaaacta

SEQ ID NO: 7215757 - DNA, 18 bp, Homo sapiens
tgtctttggaccactgaa

SEQ ID NO: 7215758 - DNA, 18 bp, Homo sapiens
tgtctttggaccactgaa

SEQ ID NO: 7215759 - DNA, 22 bp, Homo sapiens
tgtgaacttaagattccttatc

SEQ ID NO: 7215760 - DNA, 22 bp, Homo sapiens
tgtgaacttactgtccccacag

SEQ ID NO: 7215761 - DNA, 22 bp, Homo sapiens
tgtgaactttggatggttctga

SEQ ID NO: 7215762 - DNA, 22 bp, Homo sapiens
tgtgaagaattaatgtgaatca

SEQ ID NO: 7215763 - DNA, 22 bp, Homo sapiens
tgtgaagaattaatgtgaatca

SEQ ID NO: 7215764 - DNA, 22 bp, Homo sapiens
tgtgaagaattaatgtgaatca

SEQ ID NO: 7215765 - DNA, 22 bp, Homo sapiens
tgtgaagagagtaataaagtca

SEQ ID NO: 7215766 - DNA, 22 bp, Homo sapiens
tgtctttagttttactgtctgg

SEQ ID NO: 7215767 - DNA, 22 bp, Homo sapiens
tgtctttagttttactgtctgg

SEQ ID NO: 7215768 - DNA, 22 bp, Homo sapiens
tgtctttagttttactgtctgg

SEQ ID NO: 7215769 - DNA, 20 bp, Homo sapiens
tgtctttccatggctggatc

SEQ ID NO: 7215770 - DNA, 22 bp, Homo sapiens
tgtctttctatctctagattta

SEQ ID NO: 7215771 - DNA, 22 bp, Homo sapiens
tgtctttctgacccaaggtagt

SEQ ID NO: 7215772 - DNA, 22 bp, Homo sapiens
tgtctttctgacccaaggtagt

SEQ ID NO: 7215773 - DNA, 22 bp, Homo sapiens
tgtctttctgcaccacctcaca

SEQ ID NO: 7215774 - DNA, 23 bp, Homo sapiens
tgtctttgaatgggctgtagaca

SEQ ID NO: 7215775 - DNA, 22 bp, Homo sapiens
tgtctttgattgataggctatg

SEQ ID NO: 7215776 - DNA, 22 bp, Homo sapiens
tgtctgggttttgggtcatatt

SEQ ID NO: 7215777 - DNA, 22 bp, Homo sapiens
tgtctgggttttgggtcatatt

SEQ ID NO: 7215778 - DNA, 22 bp, Homo sapiens
tgtctgggtcacccctcctggc

SEQ ID NO: 7215779 - DNA, 23 bp, Homo sapiens
tgtctggggcgccagaagagaga

SEQ ID NO: 7215780 - DNA, 21 bp, Homo sapiens
cctggctgcacagttgctggt

SEQ ID NO: 7215781 - DNA, 22 bp, Homo sapiens
cctggctgagggacctcgggta

SEQ ID NO: 7215782 - DNA, 22 bp, Homo sapiens
cctggctgagcctccaggaaga

SEQ ID NO: 7215783 - DNA, 22 bp, Homo sapiens
cctggctgaggggccaaggacc

SEQ ID NO: 7215784 - DNA, 22 bp, Homo sapiens
cctggctgaggggccaaggacc

SEQ ID NO: 7215785 - DNA, 21 bp, Homo sapiens
cctggctgcacagttgctggt

SEQ ID NO: 7215786 - DNA, 21 bp, Homo sapiens
cctggctgcacagttgctggt

SEQ ID NO: 7215787 - DNA, 22 bp, Homo sapiens
cctggctcttctgtgtcagccc

SEQ ID NO: 7215788 - DNA, 22 bp, Homo sapiens
cctggctgaacaaagtccctcc

SEQ ID NO: 7215789 - DNA, 22 bp, Homo sapiens
cctggctgaacaaagtccctcc

SEQ ID NO: 7215790 - DNA, 22 bp, Homo sapiens
cctggctgaacaaagtccctcc

SEQ ID NO: 7215791 - DNA, 22 bp, Homo sapiens
cctggctgaaccaatgaagtgg

SEQ ID NO: 7215792 - DNA, 22 bp, Homo sapiens
cctggctgaaccaatgaagtgg

SEQ ID NO: 7215793 - DNA, 23 bp, Homo sapiens
cctggctgacctgaaggtgtagt

SEQ ID NO: 7215794 - DNA, 23 bp, Homo sapiens
cctggctgacctgaaggtgtagt

SEQ ID NO: 7215795 - DNA, 23 bp, Homo sapiens
cctggctgacctgaaggtgtagt

SEQ ID NO: 7215796 - DNA, 19 bp, Homo sapiens
cctggctctgagcccagcc

SEQ ID NO: 7215797 - DNA, 22 bp, Homo sapiens
cctggctctgaagtccacatca

SEQ ID NO: 7215798 - DNA, 22 bp, Homo sapiens
cctggctctgaagtccacatca

SEQ ID NO: 7215799 - DNA, 19 bp, Homo sapiens
cctggctctgagcccagcc

SEQ ID NO: 7215800 - DNA, 19 bp, Homo sapiens
cctggctctgagcccagcc

SEQ ID NO: 7215801 - DNA, 22 bp, Homo sapiens
cctggctcttcagaggttccta

SEQ ID NO: 7215802 - DNA, 22 bp, Homo sapiens
cctggctcttcgggagtttgtt

SEQ ID NO: 7215803 - DNA, 22 bp, Homo sapiens
cctggctcttcgggagtttgtt

SEQ ID NO: 7215804 - DNA, 22 bp, Homo sapiens
cctggctcttctgtgtcagccc

SEQ ID NO: 7215805 - DNA, 22 bp, Homo sapiens
tgtctggtgggttgacaggcag

SEQ ID NO: 7215806 - DNA, 22 bp, Homo sapiens
tgtctggtgggttgacaggcag

SEQ ID NO: 7215807 - DNA, 22 bp, Homo sapiens
tgtctggtgggttgacaggcag

SEQ ID NO: 7215808 - DNA, 22 bp, Homo sapiens
tgtctggtttgaagtccatgat

SEQ ID NO: 7215809 - DNA, 22 bp, Homo sapiens
tgtctgtaaggtgtttatgtta

SEQ ID NO: 7215810 - DNA, 22 bp, Homo sapiens
tgtctgtcagatattaagtttc

SEQ ID NO: 7215811 - DNA, 22 bp, Homo sapiens
tgtctgtcagcagtgggtcagg

SEQ ID NO: 7215812 - DNA, 17 bp, Homo sapiens
tgtctgtcatcagttcc

SEQ ID NO: 7215813 - DNA, 22 bp, Homo sapiens
tgtctgtccatctgtctgggac

SEQ ID NO: 7215814 - DNA, 22 bp, Homo sapiens
tgtctgtctgcaagccagaaag

SEQ ID NO: 7215815 - DNA, 22 bp, Homo sapiens
tgtctgtctgtacctatttttt

SEQ ID NO: 7215816 - DNA, 22 bp, Homo sapiens
tgtctgtctgtacctatttttt

SEQ ID NO: 7215817 - DNA, 22 bp, Homo sapiens
tgtctgtctttagtgagattgc

SEQ ID NO: 7215818 - DNA, 22 bp, Homo sapiens
tgtctttacttaataaatatac

SEQ ID NO: 7215819 - DNA, 22 bp, Homo sapiens
tgtctttacttaataaatatac

SEQ ID NO: 7215820 - DNA, 22 bp, Homo sapiens
tgtctttacttagaagttcagg

SEQ ID NO: 7215821 - DNA, 22 bp, Homo sapiens
tgtctttagaaagaagcagaca

SEQ ID NO: 7215822 - DNA, 22 bp, Homo sapiens
tgtctttagagtcacaaaacca

SEQ ID NO: 7215823 - DNA, 22 bp, Homo sapiens
tgtctttagccacttgcctctt

SEQ ID NO: 7215824 - DNA, 22 bp, Homo sapiens
tgtctttagccacttgcctctt

SEQ ID NO: 7215825 - DNA, 22 bp, Homo sapiens
tgtctttagcccatatagactt

SEQ ID NO: 7215826 - DNA, 22 bp, Homo sapiens
tgtctttagcccatatagactt

SEQ ID NO: 7215827 - DNA, 21 bp, Homo sapiens
tgtctttaggacctgttaaat

SEQ ID NO: 7215828 - DNA, 22 bp, Homo sapiens
tgtctttagttgcttagatttg

SEQ ID NO: 7215829 - DNA, 22 bp, Homo sapiens
tgtctttagttgcttagatttg

SEQ ID NO: 7215830 - DNA, 22 bp, Homo sapiens
gttattcaatggcttataagga

SEQ ID NO: 7215831 - DNA, 22 bp, Homo sapiens
gttattctacagtcattgaagt

SEQ ID NO: 7215832 - DNA, 22 bp, Homo sapiens
gttattcaacttgtgtctctta

SEQ ID NO: 7215833 - DNA, 22 bp, Homo sapiens
gttattatcttgaggaatctgt

SEQ ID NO: 7215834 - DNA, 22 bp, Homo sapiens
gttattatttctctccttgcta

SEQ ID NO: 7215835 - DNA, 22 bp, Homo sapiens
gttattatttctctccttgcta

SEQ ID NO: 7215836 - DNA, 22 bp, Homo sapiens
gttattaaagtatttgatgtta

SEQ ID NO: 7215837 - DNA, 22 bp, Homo sapiens
gttattagaagtgaaggattgt

SEQ ID NO: 7215838 - DNA, 22 bp, Homo sapiens
gttattagtaagactcgcacat

SEQ ID NO: 7215839 - DNA, 22 bp, Homo sapiens
gttacatggagcaatgatgcat

SEQ ID NO: 7215840 - DNA, 22 bp, Homo sapiens
gttacattaaaaacattcactg

SEQ ID NO: 7215841 - DNA, 22 bp, Homo sapiens
gttacattacttgtgcagttgt

SEQ ID NO: 7215842 - DNA, 22 bp, Homo sapiens
gttacattacttgtgcagttgt

SEQ ID NO: 7215843 - DNA, 22 bp, Homo sapiens
gttacattaggataatttgctg

SEQ ID NO: 7215844 - DNA, 22 bp, Homo sapiens
gttacatttattagaggtctct

SEQ ID NO: 7215845 - DNA, 22 bp, Homo sapiens
gttacatttggtgatttggtgc

SEQ ID NO: 7215846 - DNA, 22 bp, Homo sapiens
gttaccatgagtgggtgggtga

SEQ ID NO: 7215847 - DNA, 22 bp, Homo sapiens
gttattctacagtcattgaagt

SEQ ID NO: 7215848 - DNA, 22 bp, Homo sapiens
gttattctaccactatgtacag

SEQ ID NO: 7215849 - DNA, 22 bp, Homo sapiens
gttattcttttatagcaataca

SEQ ID NO: 7215850 - DNA, 22 bp, Homo sapiens
gttattcttttatagcaataca

SEQ ID NO: 7215851 - DNA, 22 bp, Homo sapiens
gttattgacatgtattaagcac

SEQ ID NO: 7215852 - DNA, 21 bp, Homo sapiens
gttattgacctccaggctggc

SEQ ID NO: 7215853 - DNA, 21 bp, Homo sapiens
gttattgacctccaggctggc

SEQ ID NO: 7215854 - DNA, 22 bp, Homo sapiens
gttattgactctcttgtggctt

SEQ ID NO: 7215855 - DNA, 22 bp, Homo sapiens
gttattgagacatagagttatg

SEQ ID NO: 7215856 - DNA, 22 bp, Homo sapiens
gttattgaggtggagtctcact

SEQ ID NO: 7215857 - DNA, 22 bp, Homo sapiens
gttattgaggtggagtctcact

SEQ ID NO: 7215858 - DNA, 22 bp, Homo sapiens
gttattgaggtggagtctcact

SEQ ID NO: 7215859 - DNA, 22 bp, Homo sapiens
cagcttctaccatcaggaaatt

SEQ ID NO: 7215860 - DNA, 22 bp, Homo sapiens
cagcttctaccatcaggaaatt

SEQ ID NO: 7215861 - DNA, 22 bp, Homo sapiens
cagcttgggagtttggttttat

SEQ ID NO: 7215862 - DNA, 22 bp, Homo sapiens
cagcttggcgaatgtaggtatg

SEQ ID NO: 7215863 - DNA, 22 bp, Homo sapiens
cagcttggcttcacattctgta

SEQ ID NO: 7215864 - DNA, 20 bp, Homo sapiens
cagcttggatgagaggctga

SEQ ID NO: 7215865 - DNA, 20 bp, Homo sapiens
cagcttggatgagaggctga

SEQ ID NO: 7215866 - DNA, 20 bp, Homo sapiens
cagcttggatgagaggctga

SEQ ID NO: 7215867 - DNA, 22 bp, Homo sapiens
cagcttggattttggcacgtgt

SEQ ID NO: 7215868 - DNA, 22 bp, Homo sapiens
cagcttggaggaggatctaaga

SEQ ID NO: 7215869 - DNA, 22 bp, Homo sapiens
cagcttgctaattttgacttca

SEQ ID NO: 7215870 - DNA, 22 bp, Homo sapiens
cagcttctatttatctttgtgt

SEQ ID NO: 7215871 - DNA, 22 bp, Homo sapiens
cagcttctatttatctttgtgt

SEQ ID NO: 7215872 - DNA, 22 bp, Homo sapiens
cagcttctagcatcggctttga

SEQ ID NO: 7215873 - DNA, 22 bp, Homo sapiens
cagcttctcagaaagctgaggt

SEQ ID NO: 7215874 - DNA, 22 bp, Homo sapiens
cagcttctccagatgaccctca

SEQ ID NO: 7215875 - DNA, 22 bp, Homo sapiens
cagcttctccagatgaccctca

SEQ ID NO: 7215876 - DNA, 22 bp, Homo sapiens
cagcttctccagatgaccctca

SEQ ID NO: 7215877 - DNA, 21 bp, Homo sapiens
cagcttctgaaggtgtaggaa

SEQ ID NO: 7215878 - DNA, 22 bp, Homo sapiens
cagcttctgagcaagccagggg

SEQ ID NO: 7215879 - DNA, 22 bp, Homo sapiens
cagcttctgagcaagccagggg

SEQ ID NO: 7215880 - DNA, 22 bp, Homo sapiens
cagcttctgctatcgaacatct

SEQ ID NO: 7215881 - DNA, 22 bp, Homo sapiens
cagcttctcgggagcgcatgtg

SEQ ID NO: 7215882 - DNA, 22 bp, Homo sapiens
cagcttctccattcttctggct

SEQ ID NO: 7215883 - DNA, 22 bp, Homo sapiens
cagcttctccggcctggtgcgg

SEQ ID NO: 7215884 - DNA, 22 bp, Homo sapiens
cagctttaggactcataataaa

SEQ ID NO: 7215885 - DNA, 22 bp, Homo sapiens
cagctttaggactcataataaa

SEQ ID NO: 7215886 - DNA, 22 bp, Homo sapiens
cagctttaggactcataataaa

SEQ ID NO: 7215887 - DNA, 22 bp, Homo sapiens
cagctttaggactcataataaa

SEQ ID NO: 7215888 - DNA, 20 bp, Homo sapiens
cagctttagatctttgatta

SEQ ID NO: 7215889 - DNA, 20 bp, Homo sapiens
cagctttagatctttgatta

SEQ ID NO: 7215890 - DNA, 22 bp, Homo sapiens
cagctttagagaaaacatattt

SEQ ID NO: 7215891 - DNA, 16 bp, Homo sapiens
cagctttatgtcagtg

SEQ ID NO: 7215892 - DNA, 16 bp, Homo sapiens
cagctttatgtcagtg

SEQ ID NO: 7215893 - DNA, 22 bp, Homo sapiens
cagctttattaatgattgtctt

SEQ ID NO: 7215894 - DNA, 17 bp, Homo sapiens
cagctttatgctactgt

SEQ ID NO: 7215895 - DNA, 17 bp, Homo sapiens
cagctttatgctactgt

SEQ ID NO: 7215896 - DNA, 22 bp, Homo sapiens
cagctttagtaacccactgctc

SEQ ID NO: 7215897 - DNA, 22 bp, Homo sapiens
cagcttgtattgaagctatacc

SEQ ID NO: 7215898 - DNA, 22 bp, Homo sapiens
cagcttgttttatttggggacc

SEQ ID NO: 7215899 - DNA, 22 bp, Homo sapiens
cagctttaccaatatttggaaa

SEQ ID NO: 7215900 - DNA, 22 bp, Homo sapiens
cagctttacctttaggagtaac

SEQ ID NO: 7215901 - DNA, 22 bp, Homo sapiens
cagctttagagaaaacatattt

SEQ ID NO: 7215902 - DNA, 22 bp, Homo sapiens
cagctttagagaaaacatattt

SEQ ID NO: 7215903 - DNA, 22 bp, Homo sapiens
cagctttgagagttgcatttta

SEQ ID NO: 7215904 - DNA, 22 bp, Homo sapiens
cagctttgacctaaagtaggaa

SEQ ID NO: 7215905 - DNA, 22 bp, Homo sapiens
cagctttgagcagccagtggca

SEQ ID NO: 7215906 - DNA, 22 bp, Homo sapiens
cagctttgattcactgcctagt

SEQ ID NO: 7215907 - DNA, 22 bp, Homo sapiens
cagctttgattctttctgccat

SEQ ID NO: 7215908 - DNA, 22 bp, Homo sapiens
caggaaaatctgcccacacaag

SEQ ID NO: 7215909 - DNA, 22 bp, Homo sapiens
caggaaaatggaatcacctgta

SEQ ID NO: 7215910 - DNA, 22 bp, Homo sapiens
cagctttctttccataaggttt

SEQ ID NO: 7215911 - DNA, 22 bp, Homo sapiens
cagctttgaaacatggctctag

SEQ ID NO: 7215912 - DNA, 22 bp, Homo sapiens
cagctttctaccttaggcagtg

SEQ ID NO: 7215913 - DNA, 22 bp, Homo sapiens
cagctttatttcacgtgtttgt

SEQ ID NO: 7215914 - DNA, 22 bp, Homo sapiens
cagctttattgaggtataattg

SEQ ID NO: 7215915 - DNA, 22 bp, Homo sapiens
cagctttatttcacgtgtttgt

SEQ ID NO: 7215916 - DNA, 23 bp, Homo sapiens
cagctttcagggctttagggaag

SEQ ID NO: 7215917 - DNA, 22 bp, Homo sapiens
gttcacaagctgggtttctgca

SEQ ID NO: 7215918 - DNA, 22 bp, Homo sapiens
gttcacaatttttactgattgg

SEQ ID NO: 7215919 - DNA, 22 bp, Homo sapiens
gttcacagaaggccagatggta

SEQ ID NO: 7215920 - DNA, 22 bp, Homo sapiens
caggaaagagctgccaggcagg

SEQ ID NO: 7215921 - DNA, 22 bp, Homo sapiens
caggaaagagctgccaggcagg

SEQ ID NO: 7215922 - DNA, 22 bp, Homo sapiens
caggaaagccgagtgccatagg

SEQ ID NO: 7215923 - DNA, 22 bp, Homo sapiens
gttcacaagctgattgtctttc

SEQ ID NO: 7215924 - DNA, 22 bp, Homo sapiens
caggaaacatatgtgcttgagg

SEQ ID NO: 7215925 - DNA, 22 bp, Homo sapiens
caggaaacattcccataacaca

SEQ ID NO: 7215926 - DNA, 22 bp, Homo sapiens
caggaaacattcccataacaca

SEQ ID NO: 7215927 - DNA, 22 bp, Homo sapiens
caggaaacattcttggtaagga

SEQ ID NO: 7215928 - DNA, 22 bp, Homo sapiens
caggaaaatgtcaatggaaagc

SEQ ID NO: 7215929 - DNA, 22 bp, Homo sapiens
caggaaaatgtcaatggaaagc

SEQ ID NO: 7215930 - DNA, 22 bp, Homo sapiens
caggaaacaaagccttgctcat

SEQ ID NO: 7215931 - DNA, 22 bp, Homo sapiens
caggaaacaaagccttgctcat

SEQ ID NO: 7215932 - DNA, 21 bp, Homo sapiens
caggaaagaaaacgtacatat

SEQ ID NO: 7215933 - DNA, 21 bp, Homo sapiens
caggaaagaaaacgtacatat

SEQ ID NO: 7215934 - DNA, 21 bp, Homo sapiens
caggaaagaaaacgtacatat

SEQ ID NO: 7215935 - DNA, 22 bp, Homo sapiens
caggaaagaaatgagaacacca

SEQ ID NO: 7215936 - DNA, 22 bp, Homo sapiens
caggaaagagagctattcactt

SEQ ID NO: 7215937 - DNA, 22 bp, Homo sapiens
caggaaagagctgccaggcagg

SEQ ID NO: 7215938 - DNA, 22 bp, Homo sapiens
caggaaagagctgccaggcagg

SEQ ID NO: 7215939 - DNA, 22 bp, Homo sapiens
gttacaatgttcttcagttctg

SEQ ID NO: 7215940 - DNA, 22 bp, Homo sapiens
gttacacacaatatatcctaaa

SEQ ID NO: 7215941 - DNA, 22 bp, Homo sapiens
gttacacacaatatatcctaaa

SEQ ID NO: 7215942 - DNA, 22 bp, Homo sapiens
gttacacagctaagcttctcct

SEQ ID NO: 7215943 - DNA, 22 bp, Homo sapiens
gttacagtcaggagatattttg

SEQ ID NO: 7215944 - DNA, 22 bp, Homo sapiens
gttacaactccctgaacctcgg

SEQ ID NO: 7215945 - DNA, 22 bp, Homo sapiens
gttacaaatgtaaattctgggg

SEQ ID NO: 7215946 - DNA, 22 bp, Homo sapiens
gttacaaatgtaaattctgggg

SEQ ID NO: 7215947 - DNA, 22 bp, Homo sapiens
gttacaaatgccaaagctgaga

SEQ ID NO: 7215948 - DNA, 22 bp, Homo sapiens
gttacaaatgtaaattctgggg

SEQ ID NO: 7215949 - DNA, 22 bp, Homo sapiens
gttaaataacctcatgtccgtt

SEQ ID NO: 7215950 - DNA, 22 bp, Homo sapiens
gttaaagtgatcttgtcaggtt

SEQ ID NO: 7215951 - DNA, 22 bp, Homo sapiens
gttaaataacctcatgtccgtt

SEQ ID NO: 7215952 - DNA, 22 bp, Homo sapiens
gttaaagtgagctactttaggt

SEQ ID NO: 7215953 - DNA, 22 bp, Homo sapiens
gttaaagtgagctactttaggt

SEQ ID NO: 7215954 - DNA, 22 bp, Homo sapiens
gttaaacagttacatgtgctgg

SEQ ID NO: 7215955 - DNA, 22 bp, Homo sapiens
gttaaactgaaaggctcgttca

SEQ ID NO: 7215956 - DNA, 22 bp, Homo sapiens
gttaaacaataactggcacaca

SEQ ID NO: 7215957 - DNA, 22 bp, Homo sapiens
gttaaacagttacatgtgctgg

SEQ ID NO: 7215958 - DNA, 20 bp, Homo sapiens
gttaaaagagtaatttgagg

SEQ ID NO: 7215959 - DNA, 20 bp, Homo sapiens
gttaaaagagtaatttgagg

SEQ ID NO: 7215960 - DNA, 22 bp, Homo sapiens
gttaaacaagctggacactgaa

SEQ ID NO: 7215961 - DNA, 22 bp, Homo sapiens
gtgttttattggtgcagtcaga

SEQ ID NO: 7215962 - DNA, 22 bp, Homo sapiens
gtgttttattggtgcagtcaga

SEQ ID NO: 7215963 - DNA, 22 bp, Homo sapiens
gtgttttctctccagcaggcag

SEQ ID NO: 7215964 - DNA, 22 bp, Homo sapiens
gtgttttctctccagcaggcag

SEQ ID NO: 7215965 - DNA, 22 bp, Homo sapiens
gtgttttctctccagcaggcag

SEQ ID NO: 7215966 - DNA, 22 bp, Homo sapiens
gtgttttggccattagtgtgat

SEQ ID NO: 7215967 - DNA, 22 bp, Homo sapiens
gtgttttggccattagtgtgat

SEQ ID NO: 7215968 - DNA, 20 bp, Homo sapiens
gttaaaagagtaatttgagg

SEQ ID NO: 7215969 - DNA, 22 bp, Homo sapiens
gtgttttatggagtcataacgt

SEQ ID NO: 7215970 - DNA, 22 bp, Homo sapiens
gtgttttatggagtcataacgt

SEQ ID NO: 7215971 - DNA, 22 bp, Homo sapiens
gtgttttattggtgcagtcaga

SEQ ID NO: 7215972 - DNA, 22 bp, Homo sapiens
gtgttttatcagacaaagtata

SEQ ID NO: 7215973 - DNA, 22 bp, Homo sapiens
gtgttttagtgctgctgagctg

SEQ ID NO: 7215974 - DNA, 22 bp, Homo sapiens
gtgtttgtttgggtagctagac

SEQ ID NO: 7215975 - DNA, 22 bp, Homo sapiens
gtgtttgtttgggtagctagac

SEQ ID NO: 7215976 - DNA, 22 bp, Homo sapiens
gtgttttaagaaagaagctcag

SEQ ID NO: 7215977 - DNA, 22 bp, Homo sapiens
gtgtttgttcgtgactccaaag

SEQ ID NO: 7215978 - DNA, 22 bp, Homo sapiens
gtgtttgttcgtgactccaaag

SEQ ID NO: 7215979 - DNA, 22 bp, Homo sapiens
gtgtttgtttagtgcagagaga

SEQ ID NO: 7215980 - DNA, 22 bp, Homo sapiens
gtgtttgtttagtgcagagaga

SEQ ID NO: 7215981 - DNA, 22 bp, Homo sapiens
gtgtttgtttgggtagctagac

SEQ ID NO: 7215982 - DNA, 22 bp, Homo sapiens
gtgtttgtttgggtagctagac

SEQ ID NO: 7215983 - DNA, 22 bp, Homo sapiens
gtgtgtgtatatatacacacac

SEQ ID NO: 7215984 - DNA, 22 bp, Homo sapiens
gtgtgtgtatctgcctatcaca

SEQ ID NO: 7215985 - DNA, 22 bp, Homo sapiens
gtgtgtgtatctgcctatcaca

SEQ ID NO: 7215986 - DNA, 22 bp, Homo sapiens
gtgtgtgtatatatacacacac

SEQ ID NO: 7215987 - DNA, 22 bp, Homo sapiens
gtgtgtgtatatatacacacac

SEQ ID NO: 7215988 - DNA, 22 bp, Homo sapiens
gtgtgtgtatatatacacacac

SEQ ID NO: 7215989 - DNA, 22 bp, Homo sapiens
gtgtgtgtactctgtatataaa

SEQ ID NO: 7215990 - DNA, 22 bp, Homo sapiens
gtgtgtgtatatatacacacac

SEQ ID NO: 7215991 - DNA, 22 bp, Homo sapiens
gtgtttggtcagacgtccgggg

SEQ ID NO: 7215992 - DNA, 22 bp, Homo sapiens
gtgtttggtcagacgtccgggg

SEQ ID NO: 7215993 - DNA, 22 bp, Homo sapiens
gtgtgtgtatctgcctatcaca

SEQ ID NO: 7215994 - DNA, 22 bp, Homo sapiens
gtgtttgtctcttggcctacct

SEQ ID NO: 7215995 - DNA, 22 bp, Homo sapiens
gtgtttgtctcttggcctacct

SEQ ID NO: 7215996 - DNA, 22 bp, Homo sapiens
gtgtttgtgagctaggtgacat

SEQ ID NO: 7215997 - DNA, 22 bp, Homo sapiens
gtgtttgtgagctaggtgacat

SEQ ID NO: 7215998 - DNA, 22 bp, Homo sapiens
gtgtttgttcatcctctcttct

SEQ ID NO: 7215999 - DNA, 22 bp, Homo sapiens
gtgtttgttcatcctctcttct

SEQ ID NO: 7216000 - DNA, 22 bp, Homo sapiens
gtgtgtgtactctgtatataaa

SEQ ID NO: 7216001 - DNA, 22 bp, Homo sapiens
gtgtgtgtactctgtatataaa

SEQ ID NO: 7216002 - DNA, 22 bp, Homo sapiens
gtgtgtggggccttcgggtcct

SEQ ID NO: 7216003 - DNA, 22 bp, Homo sapiens
gtgtgtggggccttcgggtcct

SEQ ID NO: 7216004 - DNA, 22 bp, Homo sapiens
gtgtgtgtactctgtatataaa

SEQ ID NO: 7216005 - DNA, 22 bp, Homo sapiens
gtgtgtgtactctgtatataaa

SEQ ID NO: 7216006 - DNA, 22 bp, Homo sapiens
gtgtgtgtactctgtatataaa

SEQ ID NO: 7216007 - DNA, 23 bp, Homo sapiens
gtgtgtggaaagtgcatgggcct

SEQ ID NO: 7216008 - DNA, 22 bp, Homo sapiens
gtgtgtggacgtctgagcccag

SEQ ID NO: 7216009 - DNA, 22 bp, Homo sapiens
gtgtgtggcaaactgggcctgc

SEQ ID NO: 7216010 - DNA, 22 bp, Homo sapiens
gtgtgtctttcatttcatgagg

SEQ ID NO: 7216011 - DNA, 22 bp, Homo sapiens
gtgtgtctttcatttcatgagg

SEQ ID NO: 7216012 - DNA, 22 bp, Homo sapiens
gtgtgtgcaagaggtttattga

SEQ ID NO: 7216013 - DNA, 22 bp, Homo sapiens
gtgtgtgcaagaggtttattga

SEQ ID NO: 7216014 - DNA, 22 bp, Homo sapiens
gtgtgtgcaagaggtttattga

SEQ ID NO: 7216015 - DNA, 22 bp, Homo sapiens
gtgtgtgccaactttatgtgca

SEQ ID NO: 7216016 - DNA, 22 bp, Homo sapiens
gtgtgtgccaactttatgtgca

SEQ ID NO: 7216017 - DNA, 22 bp, Homo sapiens
gtgtgtgccaactttatgtgca

SEQ ID NO: 7216018 - DNA, 22 bp, Homo sapiens
gtgtgtgccaactttatgtgca

SEQ ID NO: 7216019 - DNA, 22 bp, Homo sapiens
gtgtgtgccatcaagagctttc

SEQ ID NO: 7216020 - DNA, 20 bp, Homo sapiens
gtgtgtgctccatgcatgct

SEQ ID NO: 7216021 - DNA, 20 bp, Homo sapiens
gtgtgtgctccatgcatgct

SEQ ID NO: 7216022 - DNA, 20 bp, Homo sapiens
gtgtgtgctccatgcatgct

SEQ ID NO: 7216023 - DNA, 22 bp, Homo sapiens
gtgtgtgctccccaggagagct

SEQ ID NO: 7216024 - DNA, 22 bp, Homo sapiens
cagctgtggctgccactgctcc

SEQ ID NO: 7216025 - DNA, 22 bp, Homo sapiens
cagctgtggctgccactgctcc

SEQ ID NO: 7216026 - DNA, 22 bp, Homo sapiens
cagctgtgggcctgacgtggca

SEQ ID NO: 7216027 - DNA, 22 bp, Homo sapiens
cagctgtggggagcttgggcca

SEQ ID NO: 7216028 - DNA, 22 bp, Homo sapiens
cagctgtgtaaacacatgtgta

SEQ ID NO: 7216029 - DNA, 22 bp, Homo sapiens
cagctgtgtaaacacatgtgta

SEQ ID NO: 7216030 - DNA, 22 bp, Homo sapiens
cagctgtgtaaacacatgtgta

SEQ ID NO: 7216031 - DNA, 22 bp, Homo sapiens
cagctgtgtagatgcagggtca

SEQ ID NO: 7216032 - DNA, 22 bp, Homo sapiens
cagctgtgtatgagagcatgct

SEQ ID NO: 7216033 - DNA, 22 bp, Homo sapiens
cagctgtgctgattgctcagta

SEQ ID NO: 7216034 - DNA, 22 bp, Homo sapiens
cagctgtggagatggggtgcat

SEQ ID NO: 7216035 - DNA, 22 bp, Homo sapiens
cagctgtgctgattgctcagta

SEQ ID NO: 7216036 - DNA, 22 bp, Homo sapiens
cagctgtgattcctgctgtcca

SEQ ID NO: 7216037 - DNA, 22 bp, Homo sapiens
cagctgtgatatgcctgcctga

SEQ ID NO: 7216038 - DNA, 22 bp, Homo sapiens
cagcttcagcgtgacaccagtg

SEQ ID NO: 7216039 - DNA, 22 bp, Homo sapiens
cagcttcagcgtgacaccagtg

SEQ ID NO: 7216040 - DNA, 22 bp, Homo sapiens
cagcttcatgacaaacagtttt

SEQ ID NO: 7216041 - DNA, 22 bp, Homo sapiens
cagcttcagggacagcttcttt

SEQ ID NO: 7216042 - DNA, 22 bp, Homo sapiens
cagcttcagggacagcttcttt

SEQ ID NO: 7216043 - DNA, 22 bp, Homo sapiens
cagcttcaactgcacagtcaac

SEQ ID NO: 7216044 - DNA, 22 bp, Homo sapiens
cagcttcaataatggctgatgg

SEQ ID NO: 7216045 - DNA, 20 bp, Homo sapiens
cagcttcaatgtcagcttga

SEQ ID NO: 7216046 - DNA, 20 bp, Homo sapiens
cagcttcaatgtcagcttga

SEQ ID NO: 7216047 - DNA, 22 bp, Homo sapiens
cagctgttgtgctgggcagtta

SEQ ID NO: 7216048 - DNA, 22 bp, Homo sapiens
cagctgttgtgtatcaggcaga

SEQ ID NO: 7216049 - DNA, 22 bp, Homo sapiens
cagctgttgtgtatcaggcaga

SEQ ID NO: 7216050 - DNA, 22 bp, Homo sapiens
cagctgttgtgtatcaggcaga

SEQ ID NO: 7216051 - DNA, 22 bp, Homo sapiens
cagctgttgttatgtctgcagg

SEQ ID NO: 7216052 - DNA, 22 bp, Homo sapiens
cagctgtttcagtagcgttact

SEQ ID NO: 7216053 - DNA, 22 bp, Homo sapiens
cagctgtttgggcatggccaga

SEQ ID NO: 7216054 - DNA, 22 bp, Homo sapiens
cagcttattcagtaagcacata

SEQ ID NO: 7216055 - DNA, 22 bp, Homo sapiens
cagcttcaactgcacagtcaac

SEQ ID NO: 7216056 - DNA, 22 bp, Homo sapiens
cagcttcccttggctgagcaga

SEQ ID NO: 7216057 - DNA, 22 bp, Homo sapiens
cagcttctaaagtgtgaagcca

SEQ ID NO: 7216058 - DNA, 22 bp, Homo sapiens
gtgtgtctcccaagaaggccca

SEQ ID NO: 7216059 - DNA, 22 bp, Homo sapiens
gtgtgtctcccaagaaggccca

SEQ ID NO: 7216060 - DNA, 22 bp, Homo sapiens
gtgtgtctgaagttgagtagac

SEQ ID NO: 7216061 - DNA, 22 bp, Homo sapiens
gtgtgtctgaagttgagtagac

SEQ ID NO: 7216062 - DNA, 22 bp, Homo sapiens
gtgtgtctgaagttgagtagac

SEQ ID NO: 7216063 - DNA, 22 bp, Homo sapiens
gtgtgtctgaagttgagtagac

SEQ ID NO: 7216064 - DNA, 22 bp, Homo sapiens
gtgtgtcttgaccaggatcgga

SEQ ID NO: 7216065 - DNA, 22 bp, Homo sapiens
gtgtgtcttgaccaggatcgga

SEQ ID NO: 7216066 - DNA, 22 bp, Homo sapiens
gtgtgtctttataagaagaggg

SEQ ID NO: 7216067 - DNA, 22 bp, Homo sapiens
gtgtgtctttataagaagaggg

SEQ ID NO: 7216068 - DNA, 22 bp, Homo sapiens
cagcttcccttggctgagcaga

SEQ ID NO: 7216069 - DNA, 22 bp, Homo sapiens
cagcttcccttggctgagcaga

SEQ ID NO: 7216070 - DNA, 22 bp, Homo sapiens
cagcttcccagctcactcataa

SEQ ID NO: 7216071 - DNA, 22 bp, Homo sapiens
cagcttccatctccactgccct

SEQ ID NO: 7216072 - DNA, 22 bp, Homo sapiens
cagcttccatctccactgccct

SEQ ID NO: 7216073 - DNA, 22 bp, Homo sapiens
cagcttccatctccactgccct

SEQ ID NO: 7216074 - DNA, 22 bp, Homo sapiens
cagcttccatctccactgccct

SEQ ID NO: 7216075 - DNA, 22 bp, Homo sapiens
cagcttccacagacttggctcg

SEQ ID NO: 7216076 - DNA, 22 bp, Homo sapiens
cagcttcattgcctgatgtctt

SEQ ID NO: 7216077 - DNA, 22 bp, Homo sapiens
cagcttcatgtccaggtactgt

SEQ ID NO: 7216078 - DNA, 22 bp, Homo sapiens
cagcttcatgacaaacagtttt

SEQ ID NO: 7216079 - DNA, 22 bp, Homo sapiens
cagcttcatgtccaggtactgt

SEQ ID NO: 7216080 - DNA, 22 bp, Homo sapiens
gtttattccagcaatctgctta

SEQ ID NO: 7216081 - DNA, 22 bp, Homo sapiens
gtttattcttcagcaacatctg

SEQ ID NO: 7216082 - DNA, 22 bp, Homo sapiens
gtttattgataaaagctggaca

SEQ ID NO: 7216083 - DNA, 22 bp, Homo sapiens
gtttattgataaaagctggaca

SEQ ID NO: 7216084 - DNA, 22 bp, Homo sapiens
gtttattgataaaagctggaca

SEQ ID NO: 7216085 - DNA, 22 bp, Homo sapiens
gtttattgataaaagctggaca

SEQ ID NO: 7216086 - DNA, 22 bp, Homo sapiens
gtttattgataaaagctggaca

SEQ ID NO: 7216087 - DNA, 22 bp, Homo sapiens
gtttattgataaaagctggaca

SEQ ID NO: 7216088 - DNA, 22 bp, Homo sapiens
gtttattgggtattgtggagcc

SEQ ID NO: 7216089 - DNA, 22 bp, Homo sapiens
gtttattgggtattgtggagcc

SEQ ID NO: 7216090 - DNA, 22 bp, Homo sapiens
gtttattgggtattgtggagcc

SEQ ID NO: 7216091 - DNA, 22 bp, Homo sapiens
gtttattgggtattgtggagcc

SEQ ID NO: 7216092 - DNA, 22 bp, Homo sapiens
gtttattgggtattgtggagcc

SEQ ID NO: 7216093 - DNA, 22 bp, Homo sapiens
gtttattgggtattgtggagcc

SEQ ID NO: 7216094 - DNA, 22 bp, Homo sapiens
gtttcaaaagtcaggctattct

SEQ ID NO: 7216095 - DNA, 22 bp, Homo sapiens
gtttcaaaagtcaggctattct

SEQ ID NO: 7216096 - DNA, 22 bp, Homo sapiens
gtttcaaaagtcaggctattct

SEQ ID NO: 7216097 - DNA, 22 bp, Homo sapiens
gtttcaaaatgatgctgtaact

SEQ ID NO: 7216098 - DNA, 22 bp, Homo sapiens
gtttcaaaatgatgctgtaact

SEQ ID NO: 7216099 - DNA, 22 bp, Homo sapiens
gtttcaaagcacagctcacatt

SEQ ID NO: 7216100 - DNA, 22 bp, Homo sapiens
gtttattattcaacttcatgtt

SEQ ID NO: 7216101 - DNA, 22 bp, Homo sapiens
gtttattattcaacttcatgtt

SEQ ID NO: 7216102 - DNA, 22 bp, Homo sapiens
gtttattattcaacttcatgtt

SEQ ID NO: 7216103 - DNA, 22 bp, Homo sapiens
gtttattattcaacttcatgtt

SEQ ID NO: 7216104 - DNA, 22 bp, Homo sapiens
gtttacattaagtattagcatc

SEQ ID NO: 7216105 - DNA, 22 bp, Homo sapiens
gtttacatgtaatgtgttattg

SEQ ID NO: 7216106 - DNA, 22 bp, Homo sapiens
gtttacatgtaatgtgttattg

SEQ ID NO: 7216107 - DNA, 22 bp, Homo sapiens
gtttcctgaaaagtaagggaca

SEQ ID NO: 7216108 - DNA, 20 bp, Homo sapiens
gtttcctatttacctcctca

SEQ ID NO: 7216109 - DNA, 22 bp, Homo sapiens
gtttcctgaaatagagtactgg

SEQ ID NO: 7216110 - DNA, 20 bp, Homo sapiens
gtttcctatttacctcctca

SEQ ID NO: 7216111 - DNA, 22 bp, Homo sapiens
gtttcctatgtccattgaggga

SEQ ID NO: 7216112 - DNA, 22 bp, Homo sapiens
gtttcctatgtccattgaggga

SEQ ID NO: 7216113 - DNA, 22 bp, Homo sapiens
gtttcctataactcaggcacca

SEQ ID NO: 7216114 - DNA, 22 bp, Homo sapiens
gtttcctatggctgctgcagga

SEQ ID NO: 7216115 - DNA, 22 bp, Homo sapiens
gtttcctatggctgctgcagga

SEQ ID NO: 7216116 - DNA, 22 bp, Homo sapiens
gtttcctataactcaggcacca

SEQ ID NO: 7216117 - DNA, 22 bp, Homo sapiens
gtttcaaagcacagctcacatt

SEQ ID NO: 7216118 - DNA, 22 bp, Homo sapiens
gtttcctaggcttatacagctg

SEQ ID NO: 7216119 - DNA, 22 bp, Homo sapiens
gtttcctgactgtggaattata

SEQ ID NO: 7216120 - DNA, 18 bp, Homo sapiens
gtttcctgaggtgaaggg

SEQ ID NO: 7216121 - DNA, 22 bp, Homo sapiens
gtttcctgatgtgggagatctt

SEQ ID NO: 7216122 - DNA, 22 bp, Homo sapiens
gtttcctgcgtgtgccactcat

SEQ ID NO: 7216123 - DNA, 22 bp, Homo sapiens
gtttcctgcgtgtgccactcat

SEQ ID NO: 7216124 - DNA, 22 bp, Homo sapiens
gtttcctggaaacattaggaga

SEQ ID NO: 7216125 - DNA, 22 bp, Homo sapiens
gtttcctttctattgccttgat

SEQ ID NO: 7216126 - DNA, 22 bp, Homo sapiens
gtttcctttaatagtgatattg

SEQ ID NO: 7216127 - DNA, 22 bp, Homo sapiens
gtttgcctgtgatgtacatttc

SEQ ID NO: 7216128 - DNA, 22 bp, Homo sapiens
gtttcctggaaactgctccact

SEQ ID NO: 7216129 - DNA, 22 bp, Homo sapiens
gtttcctgggccccaacccaga

SEQ ID NO: 7216130 - DNA, 22 bp, Homo sapiens
gtttcctgtggccacagaataa

SEQ ID NO: 7216131 - DNA, 22 bp, Homo sapiens
gtttcctgtggccacagaataa

SEQ ID NO: 7216132 - DNA, 22 bp, Homo sapiens
gtttcctgtgggaactcggctg

SEQ ID NO: 7216133 - DNA, 22 bp, Homo sapiens
gtttcctgtttctcagcagccc

SEQ ID NO: 7216134 - DNA, 22 bp, Homo sapiens
gtttacatgcatgcaagaatga

SEQ ID NO: 7216135 - DNA, 22 bp, Homo sapiens
gtttacatgcagaaaatcaatg

SEQ ID NO: 7216136 - DNA, 22 bp, Homo sapiens
gtttacatgcagaaaatcaatg

SEQ ID NO: 7216137 - DNA, 22 bp, Homo sapiens
gtttacatattttaattggtga

SEQ ID NO: 7216138 - DNA, 22 bp, Homo sapiens
gtttacagagacagaaagtagt

SEQ ID NO: 7216139 - DNA, 22 bp, Homo sapiens
gtttacagtactcacttgcatt

SEQ ID NO: 7216140 - DNA, 22 bp, Homo sapiens
gtttacagtactcacttgcatt

SEQ ID NO: 7216141 - DNA, 21 bp, Homo sapiens
gtttacaaggctttgctcctg

SEQ ID NO: 7216142 - DNA, 22 bp, Homo sapiens
gtttacaacatgccaactgggc

SEQ ID NO: 7216143 - DNA, 21 bp, Homo sapiens
gtttacaaggctttgctcctg

SEQ ID NO: 7216144 - DNA, 23 bp, Homo sapiens
caggaagcagatggggtagaaga

SEQ ID NO: 7216145 - DNA, 22 bp, Homo sapiens
gtttacaacatcttgtccttca

SEQ ID NO: 7216146 - DNA, 22 bp, Homo sapiens
caggaagattgtggaggtggtt

SEQ ID NO: 7216147 - DNA, 22 bp, Homo sapiens
caggaagattgtggaggtggtt

SEQ ID NO: 7216148 - DNA, 22 bp, Homo sapiens
caggaagattgtggaggtggtt

SEQ ID NO: 7216149 - DNA, 22 bp, Homo sapiens
caggaagattgtggaggtggtt

SEQ ID NO: 7216150 - DNA, 22 bp, Homo sapiens
caggaagattgtggaggtggtt

SEQ ID NO: 7216151 - DNA, 22 bp, Homo sapiens
caggaagcacagtgaggagacc

SEQ ID NO: 7216152 - DNA, 22 bp, Homo sapiens
caggaagattagaccaagagct

SEQ ID NO: 7216153 - DNA, 22 bp, Homo sapiens
caggaagattagaccaagagct

SEQ ID NO: 7216154 - DNA, 22 bp, Homo sapiens
caggaagattagaccaagagct

SEQ ID NO: 7216155 - DNA, 22 bp, Homo sapiens
caggaagattagaccaagagct

SEQ ID NO: 7216156 - DNA, 22 bp, Homo sapiens
caggaagattgtggaggtggtt

SEQ ID NO: 7216157 - DNA, 22 bp, Homo sapiens
caggaagaggtggggctaaagt

SEQ ID NO: 7216158 - DNA, 22 bp, Homo sapiens
caggaagaggtggggctaaagt

SEQ ID NO: 7216159 - DNA, 22 bp, Homo sapiens
caggaagattagaccaagagct

SEQ ID NO: 7216160 - DNA, 22 bp, Homo sapiens
caggaacagcaccaggagctag

SEQ ID NO: 7216161 - DNA, 22 bp, Homo sapiens
caggaacagagtggcattgtct

SEQ ID NO: 7216162 - DNA, 22 bp, Homo sapiens
caggaacagctgacctgacaat

SEQ ID NO: 7216163 - DNA, 22 bp, Homo sapiens
caggaacagctgacctgacaat

SEQ ID NO: 7216164 - DNA, 22 bp, Homo sapiens
caggaacagctgacctgacaat

SEQ ID NO: 7216165 - DNA, 22 bp, Homo sapiens
caggaacaggctgatgggcagg

SEQ ID NO: 7216166 - DNA, 22 bp, Homo sapiens
caggaacaggctgatgggcagg

SEQ ID NO: 7216167 - DNA, 22 bp, Homo sapiens
caggaacaggctgatgggcagg

SEQ ID NO: 7216168 - DNA, 22 bp, Homo sapiens
caggaacaggggagtgaacctg

SEQ ID NO: 7216169 - DNA, 22 bp, Homo sapiens
caggaacagggtgtcctggcag

SEQ ID NO: 7216170 - DNA, 19 bp, Homo sapiens
caggaacatggagggaggg

SEQ ID NO: 7216171 - DNA, 19 bp, Homo sapiens
caggaacatggagggaggg

SEQ ID NO: 7216172 - DNA, 22 bp, Homo sapiens
caggaacacaagttcagggatg

SEQ ID NO: 7216173 - DNA, 22 bp, Homo sapiens
caggaacacaatgagtctcaaa

SEQ ID NO: 7216174 - DNA, 22 bp, Homo sapiens
caggaacacctgcagctagtgg

SEQ ID NO: 7216175 - DNA, 22 bp, Homo sapiens
caggaacacctgcagctagtgg

SEQ ID NO: 7216176 - DNA, 22 bp, Homo sapiens
caggaacagagtggcattgtct

SEQ ID NO: 7216177 - DNA, 22 bp, Homo sapiens
caggaacagagtggcattgtct

SEQ ID NO: 7216178 - DNA, 22 bp, Homo sapiens
caggaagagaacatggaggctg

SEQ ID NO: 7216179 - DNA, 22 bp, Homo sapiens
caggaacatttaaccacagggt

SEQ ID NO: 7216180 - DNA, 22 bp, Homo sapiens
caggaacatttaaccacagggt

SEQ ID NO: 7216181 - DNA, 21 bp, Homo sapiens
caggaacattctttacattta

SEQ ID NO: 7216182 - DNA, 21 bp, Homo sapiens
caggaacattctttacattta

SEQ ID NO: 7216183 - DNA, 22 bp, Homo sapiens
caggaacattgtagaattgaaa

SEQ ID NO: 7216184 - DNA, 22 bp, Homo sapiens
caggaacattgtagaattgaaa

SEQ ID NO: 7216185 - DNA, 19 bp, Homo sapiens
caggaacatggagggaggg

SEQ ID NO: 7216186 - DNA, 22 bp, Homo sapiens
caggaacatgtctccaattaga

SEQ ID NO: 7216187 - DNA, 22 bp, Homo sapiens
caggaacatgttggaaagaaat

SEQ ID NO: 7216188 - DNA, 22 bp, Homo sapiens
caggaacatgttggaaagaaat

SEQ ID NO: 7216189 - DNA, 22 bp, Homo sapiens
caggaacatgttggaaagaaat

SEQ ID NO: 7216190 - DNA, 22 bp, Homo sapiens
caggaacatgttggaaagaaat

SEQ ID NO: 7216191 - DNA, 22 bp, Homo sapiens
caggaagaggtatcaccgagca

SEQ ID NO: 7216192 - DNA, 22 bp, Homo sapiens
caggaagaggtatcaccgagca

SEQ ID NO: 7216193 - DNA, 22 bp, Homo sapiens
caggaagaggtatcaccgagca

SEQ ID NO: 7216194 - DNA, 22 bp, Homo sapiens
caggaagaggacaggcttcccc

SEQ ID NO: 7216195 - DNA, 22 bp, Homo sapiens
caggaagaggacaggcttcccc

SEQ ID NO: 7216196 - DNA, 22 bp, Homo sapiens
caggaagaggacaggcttcccc

SEQ ID NO: 7216197 - DNA, 22 bp, Homo sapiens
caggaagaggacaggcttcccc

SEQ ID NO: 7216198 - DNA, 22 bp, Homo sapiens
caggaaaggtgtgtcatgatgg

SEQ ID NO: 7216199 - DNA, 22 bp, Homo sapiens
caggaaaggtgtgtcatgatgg

SEQ ID NO: 7216200 - DNA, 22 bp, Homo sapiens
caggaaagtctgtaaaggaacc

SEQ ID NO: 7216201 - DNA, 22 bp, Homo sapiens
caggaaagtctgtaaaggaacc

SEQ ID NO: 7216202 - DNA, 22 bp, Homo sapiens
caggaaaggtagtcacaatgta

SEQ ID NO: 7216203 - DNA, 22 bp, Homo sapiens
caggaaaggtagtcacaatgta

SEQ ID NO: 7216204 - DNA, 22 bp, Homo sapiens
caggaaaggtgtgtcatgatgg

SEQ ID NO: 7216205 - DNA, 22 bp, Homo sapiens
caggaaagccgagtgccatagg

SEQ ID NO: 7216206 - DNA, 22 bp, Homo sapiens
caggaaagggatgggctgccac

SEQ ID NO: 7216207 - DNA, 22 bp, Homo sapiens
caggaaagggatgggctgccac

SEQ ID NO: 7216208 - DNA, 22 bp, Homo sapiens
caggaaagggatgggctgccac

SEQ ID NO: 7216209 - DNA, 22 bp, Homo sapiens
gttggacagtttgggaagggag

SEQ ID NO: 7216210 - DNA, 22 bp, Homo sapiens
gttggagattaaagagtggggt

SEQ ID NO: 7216211 - DNA, 22 bp, Homo sapiens
gttggaaatgcagagtctcaga

SEQ ID NO: 7216212 - DNA, 22 bp, Homo sapiens
gttggaaatggtttctatccct

SEQ ID NO: 7216213 - DNA, 19 bp, Homo sapiens
gttggcactgaaaatggct

SEQ ID NO: 7216214 - DNA, 22 bp, Homo sapiens
gttggcacttcataatatgaaa

SEQ ID NO: 7216215 - DNA, 22 bp, Homo sapiens
gttggcacttagccccagtcta

SEQ ID NO: 7216216 - DNA, 22 bp, Homo sapiens
gttggcagaaagctttcgatcg

SEQ ID NO: 7216217 - DNA, 22 bp, Homo sapiens
gttggcagagagaagcctagca

SEQ ID NO: 7216218 - DNA, 22 bp, Homo sapiens
gttggccattaattggaggaca

SEQ ID NO: 7216219 - DNA, 22 bp, Homo sapiens
gttggctcattttatagacagc

SEQ ID NO: 7216220 - DNA, 18 bp, Homo sapiens
gttggctgctgtggctgg

SEQ ID NO: 7216221 - DNA, 22 bp, Homo sapiens
gttgggaagcagatggatgagc

SEQ ID NO: 7216222 - DNA, 22 bp, Homo sapiens
caggaaataggcgtttgtcctc

SEQ ID NO: 7216223 - DNA, 22 bp, Homo sapiens
caggaaagtctgtaaaggaacc

SEQ ID NO: 7216224 - DNA, 22 bp, Homo sapiens
caggaaataaaaagtatcttct

SEQ ID NO: 7216225 - DNA, 22 bp, Homo sapiens
caggaaataaatggtaatgcat

SEQ ID NO: 7216226 - DNA, 22 bp, Homo sapiens
caggaaatgggtcgttttataa

SEQ ID NO: 7216227 - DNA, 22 bp, Homo sapiens
caggaaatgggtcgttttataa

SEQ ID NO: 7216228 - DNA, 23 bp, Homo sapiens
caggaaatgttcttgaagcctga

SEQ ID NO: 7216229 - DNA, 22 bp, Homo sapiens
caggaaattcaagagaggctgc

SEQ ID NO: 7216230 - DNA, 22 bp, Homo sapiens
caggaaattcaagagaggctgc

SEQ ID NO: 7216231 - DNA, 22 bp, Homo sapiens
caggaaattcccagaaggactg

SEQ ID NO: 7216232 - DNA, 22 bp, Homo sapiens
caggaaattcttttgtttgtgc

SEQ ID NO: 7216233 - DNA, 22 bp, Homo sapiens
caggaaattctttttaacagaa

SEQ ID NO: 7216234 - DNA, 22 bp, Homo sapiens
caggaaattgcaacagtctgag

SEQ ID NO: 7216235 - DNA, 22 bp, Homo sapiens
caggaaattggctatttgggat

SEQ ID NO: 7216236 - DNA, 22 bp, Homo sapiens
caggaaatttaagagtgtacaa

SEQ ID NO: 7216237 - DNA, 22 bp, Homo sapiens
caggaaatttatgttctactta

SEQ ID NO: 7216238 - DNA, 22 bp, Homo sapiens
caggaaattttgtgatctgttc

SEQ ID NO: 7216239 - DNA, 22 bp, Homo sapiens
caggaaattttgtgatctgttc

SEQ ID NO: 7216240 - DNA, 22 bp, Homo sapiens
caggaacaactcccagcatctc

SEQ ID NO: 7216241 - DNA, 22 bp, Homo sapiens
caggaacaactcccagcatctc

SEQ ID NO: 7216242 - DNA, 22 bp, Homo sapiens
caggaacaactcccagcatctc

SEQ ID NO: 7216243 - DNA, 22 bp, Homo sapiens
caggaacaactcccagcatctc

SEQ ID NO: 7216244 - DNA, 22 bp, Homo sapiens
caggaacaactcccagcatctc

SEQ ID NO: 7216245 - DNA, 22 bp, Homo sapiens
caggaacaaggcctatgggact

SEQ ID NO: 7216246 - DNA, 22 bp, Homo sapiens
caggaacaatacctcttgccag

SEQ ID NO: 7216247 - DNA, 22 bp, Homo sapiens
caggaacaatcttactactatt

SEQ ID NO: 7216248 - DNA, 22 bp, Homo sapiens
caggaacaatcttactactatt

SEQ ID NO: 7216249 - DNA, 22 bp, Homo sapiens
caggaacaatcttactactatt

SEQ ID NO: 7216250 - DNA, 22 bp, Homo sapiens
caggaacaatcttactactatt

SEQ ID NO: 7216251 - DNA, 22 bp, Homo sapiens
caggaacaatgtaagtctcatt

SEQ ID NO: 7216252 - DNA, 22 bp, Homo sapiens
gttcctgaaagatgagtaatta

SEQ ID NO: 7216253 - DNA, 22 bp, Homo sapiens
gttcctgaagggactggtgcag

SEQ ID NO: 7216254 - DNA, 22 bp, Homo sapiens
gttcctgactgtggagtttggt

SEQ ID NO: 7216255 - DNA, 22 bp, Homo sapiens
gttcctgagaaataaagagaga

SEQ ID NO: 7216256 - DNA, 22 bp, Homo sapiens
gttcctgatgctttgaaattca

SEQ ID NO: 7216257 - DNA, 22 bp, Homo sapiens
gttctggagtggtgccaggcct

SEQ ID NO: 7216258 - DNA, 22 bp, Homo sapiens
gttcctcacgtggacagatgat

SEQ ID NO: 7216259 - DNA, 22 bp, Homo sapiens
gttcctcaaaaaggagagcccc

SEQ ID NO: 7216260 - DNA, 22 bp, Homo sapiens
gttcctaagctgtggccctgga

SEQ ID NO: 7216261 - DNA, 22 bp, Homo sapiens
gttcctaagcactgtgcattct

SEQ ID NO: 7216262 - DNA, 22 bp, Homo sapiens
gttcctaaatttgaaggacttt

SEQ ID NO: 7216263 - DNA, 22 bp, Homo sapiens
gttcctaaccagcagagaaaca

SEQ ID NO: 7216264 - DNA, 22 bp, Homo sapiens
gttcctaaccagcagagaaaca

SEQ ID NO: 7216265 - DNA, 22 bp, Homo sapiens
gttcctaaatttgaaggacttt

SEQ ID NO: 7216266 - DNA, 22 bp, Homo sapiens
gttcctaaatctggaggacctc

SEQ ID NO: 7216267 - DNA, 22 bp, Homo sapiens
gttcctaaatctggaggacctc

SEQ ID NO: 7216268 - DNA, 19 bp, Homo sapiens
gttccgggagtaggccggg

SEQ ID NO: 7216269 - DNA, 22 bp, Homo sapiens
gttcacagtgttttctttgcat

SEQ ID NO: 7216270 - DNA, 22 bp, Homo sapiens
gttcacagtctacatagtaaag

SEQ ID NO: 7216271 - DNA, 22 bp, Homo sapiens
gttcccatacagtatcagtgct

SEQ ID NO: 7216272 - DNA, 22 bp, Homo sapiens
gttcttcagattccatttcagt

SEQ ID NO: 7216273 - DNA, 22 bp, Homo sapiens
gttcttcagcattagaagtcat

SEQ ID NO: 7216274 - DNA, 21 bp, Homo sapiens
gttgctcttcaagaaaatccc

SEQ ID NO: 7216275 - DNA, 22 bp, Homo sapiens
gttgctgaaagccctgactggc

SEQ ID NO: 7216276 - DNA, 22 bp, Homo sapiens
gttgctgaaagccctgactggc

SEQ ID NO: 7216277 - DNA, 22 bp, Homo sapiens
gttgctgaaattaatattggag

SEQ ID NO: 7216278 - DNA, 22 bp, Homo sapiens
gttgctgaaattaatattggag

SEQ ID NO: 7216279 - DNA, 22 bp, Homo sapiens
gttgctgaaggcatgccagaga

SEQ ID NO: 7216280 - DNA, 22 bp, Homo sapiens
gttgctgaaggcatgccagaga

SEQ ID NO: 7216281 - DNA, 22 bp, Homo sapiens
gttgctgatggcaagattccag

SEQ ID NO: 7216282 - DNA, 22 bp, Homo sapiens
gttgctgatggcaagattccag

SEQ ID NO: 7216283 - DNA, 22 bp, Homo sapiens
gttgctgatggcaagattccag

SEQ ID NO: 7216284 - DNA, 22 bp, Homo sapiens
gttgctgaaggcatgccagaga

SEQ ID NO: 7216285 - DNA, 22 bp, Homo sapiens
gttgctgatggcaagattccag

SEQ ID NO: 7216286 - DNA, 22 bp, Homo sapiens
gttgctgattaacactttgagt

SEQ ID NO: 7216287 - DNA, 22 bp, Homo sapiens
gttgctgattaacactttgagt

SEQ ID NO: 7216288 - DNA, 22 bp, Homo sapiens
gttgctggaagctatggtccag

SEQ ID NO: 7216289 - DNA, 22 bp, Homo sapiens
gttgctgggagcagggatcctg

SEQ ID NO: 7216290 - DNA, 22 bp, Homo sapiens
gttgcttctcttaagtccagct

SEQ ID NO: 7216291 - DNA, 22 bp, Homo sapiens
gttgcttttctccatcacatgg

SEQ ID NO: 7216292 - DNA, 20 bp, Homo sapiens
gttggaaagttcactctgct

SEQ ID NO: 7216293 - DNA, 20 bp, Homo sapiens
gttggaaagttcactctgct

SEQ ID NO: 7216294 - DNA, 21 bp, Homo sapiens
gttctgttgactgtgggcatc

SEQ ID NO: 7216295 - DNA, 22 bp, Homo sapiens
gttcttaaagattcatcaagca

SEQ ID NO: 7216296 - DNA, 22 bp, Homo sapiens
gttcttaaccttctttggttgt

SEQ ID NO: 7216297 - DNA, 22 bp, Homo sapiens
gttcttcaaagtgacaactaaa

SEQ ID NO: 7216298 - DNA, 22 bp, Homo sapiens
gttcttcacatttcattgagga

SEQ ID NO: 7216299 - DNA, 22 bp, Homo sapiens
gttcttcaccaaggtcagaggc

SEQ ID NO: 7216300 - DNA, 22 bp, Homo sapiens
gttctgggagatcttgagcttc

SEQ ID NO: 7216301 - DNA, 22 bp, Homo sapiens
gttctgggaaggtggacctgtt

SEQ ID NO: 7216302 - DNA, 22 bp, Homo sapiens
gtgtgagagcaaaactgcagga

SEQ ID NO: 7216303 - DNA, 22 bp, Homo sapiens
gtgtgagcatcaaagcctgtca

SEQ ID NO: 7216304 - DNA, 22 bp, Homo sapiens
gtgtgagagactgaagaaagcc

SEQ ID NO: 7216305 - DNA, 22 bp, Homo sapiens
gtgtctttattcctctatgttt

SEQ ID NO: 7216306 - DNA, 22 bp, Homo sapiens
gtgtctttattcctctatgttt

SEQ ID NO: 7216307 - DNA, 22 bp, Homo sapiens
gtgtctttattcctctatgttt

SEQ ID NO: 7216308 - DNA, 17 bp, Homo sapiens
gtgtctttgctgttgtg

SEQ ID NO: 7216309 - DNA, 22 bp, Homo sapiens
gtgtcttttctgtctagcacaa

SEQ ID NO: 7216310 - DNA, 22 bp, Homo sapiens
gtgtcttttgaggctgaccagt

SEQ ID NO: 7216311 - DNA, 22 bp, Homo sapiens
gtgtgaaagtaattgcggtttt

SEQ ID NO: 7216312 - DNA, 22 bp, Homo sapiens
gtgtgaaagttcctaagactat

SEQ ID NO: 7216313 - DNA, 20 bp, Homo sapiens
gtgtgaagccctcaggagga

SEQ ID NO: 7216314 - DNA, 22 bp, Homo sapiens
gtgtctggaacgggtggtactc

SEQ ID NO: 7216315 - DNA, 22 bp, Homo sapiens
gtgtctgctgcaccctcacacc

SEQ ID NO: 7216316 - DNA, 22 bp, Homo sapiens
gtgtctggaacgggtggtactc

SEQ ID NO: 7216317 - DNA, 20 bp, Homo sapiens
gtgtctggagtactagagag

SEQ ID NO: 7216318 - DNA, 20 bp, Homo sapiens
gtgtctggagtactagagag

SEQ ID NO: 7216319 - DNA, 22 bp, Homo sapiens
gtgtctgtgtcattactaatag

SEQ ID NO: 7216320 - DNA, 22 bp, Homo sapiens
gtgtctggcttatgggaactgg

SEQ ID NO: 7216321 - DNA, 22 bp, Homo sapiens
gtgtctgttatacagaggagac

SEQ ID NO: 7216322 - DNA, 19 bp, Homo sapiens
gtgtctgcctttgtgccac

SEQ ID NO: 7216323 - DNA, 19 bp, Homo sapiens
gtgtatgtaagttgtgagg

SEQ ID NO: 7216324 - DNA, 19 bp, Homo sapiens
gtgtatgtaagttgtgagg

SEQ ID NO: 7216325 - DNA, 22 bp, Homo sapiens
gtgtatgttctacttaatatta

SEQ ID NO: 7216326 - DNA, 22 bp, Homo sapiens
gtgtacttctgctgagccatgg

SEQ ID NO: 7216327 - DNA, 22 bp, Homo sapiens
gtgtacatattgagtctgctga

SEQ ID NO: 7216328 - DNA, 22 bp, Homo sapiens
gtgtacatagaattgtgctttg

SEQ ID NO: 7216329 - DNA, 22 bp, Homo sapiens
gtgtagagtgacaaggtgggaa

SEQ ID NO: 7216330 - DNA, 22 bp, Homo sapiens
gtgtagagtgacaaggtgggaa

SEQ ID NO: 7216331 - DNA, 22 bp, Homo sapiens
gtgtagcagaaagaaaattaga

SEQ ID NO: 7216332 - DNA, 19 bp, Homo sapiens
gtgtagctattggtcaaaa

SEQ ID NO: 7216333 - DNA, 22 bp, Homo sapiens
gtgtagcatatagcaagagcat

SEQ ID NO: 7216334 - DNA, 22 bp, Homo sapiens
gtgtataatgctttgaagatta

SEQ ID NO: 7216335 - DNA, 22 bp, Homo sapiens
gtgtatcaaagcacagacttca

SEQ ID NO: 7216336 - DNA, 22 bp, Homo sapiens
gtgtatcaacatgttttttgtg

SEQ ID NO: 7216337 - DNA, 22 bp, Homo sapiens
gtgtatcaagtctgacccccca

SEQ ID NO: 7216338 - DNA, 17 bp, Homo sapiens
gtgtatcaccatggcaa

SEQ ID NO: 7216339 - DNA, 22 bp, Homo sapiens
gtgtatcatatctttggtggca

SEQ ID NO: 7216340 - DNA, 22 bp, Homo sapiens
gtgtatccttattcacacacat

SEQ ID NO: 7216341 - DNA, 22 bp, Homo sapiens
gtgtatctcatgttcttctctg

SEQ ID NO: 7216342 - DNA, 22 bp, Homo sapiens
gtgtatctggcatgtcgagtgt

SEQ ID NO: 7216343 - DNA, 22 bp, Homo sapiens
gtgtatcagtaactgtggacag

SEQ ID NO: 7216344 - DNA, 19 bp, Homo sapiens
gtgtatgtaagttgtgagg

SEQ ID NO: 7216345 - DNA, 22 bp, Homo sapiens
gtggtaagactaacatttctca

SEQ ID NO: 7216346 - DNA, 22 bp, Homo sapiens
gtgggtgtggaactgtgagacc

SEQ ID NO: 7216347 - DNA, 22 bp, Homo sapiens
gtgggtgtggaactgtgagacc

SEQ ID NO: 7216348 - DNA, 22 bp, Homo sapiens
gtgggtgtggaactgtgagacc

SEQ ID NO: 7216349 - DNA, 22 bp, Homo sapiens
gtggtagcatgtctggcttttt

SEQ ID NO: 7216350 - DNA, 22 bp, Homo sapiens
gtgtacagtaagtgaatctagg

SEQ ID NO: 7216351 - DNA, 22 bp, Homo sapiens
gtgtacagtaagtgaatctagg

SEQ ID NO: 7216352 - DNA, 22 bp, Homo sapiens
gtgtacagtgatttgagttcac

SEQ ID NO: 7216353 - DNA, 22 bp, Homo sapiens
gtgggtggattccagcaacgct

SEQ ID NO: 7216354 - DNA, 22 bp, Homo sapiens
gtgggtggattccagcaacgct

SEQ ID NO: 7216355 - DNA, 22 bp, Homo sapiens
gtgggtggattccagcaacgct

SEQ ID NO: 7216356 - DNA, 22 bp, Homo sapiens
gtgggtggattccagcaacgct

SEQ ID NO: 7216357 - DNA, 22 bp, Homo sapiens
gtgggtggggagctctctggag

SEQ ID NO: 7216358 - DNA, 22 bp, Homo sapiens
gtgggtggggagctctctggag

SEQ ID NO: 7216359 - DNA, 22 bp, Homo sapiens
gtgggtggggagctctctggag

SEQ ID NO: 7216360 - DNA, 22 bp, Homo sapiens
gtgggtggggagctctctggag

SEQ ID NO: 7216361 - DNA, 22 bp, Homo sapiens
gtgggtggggagctctctggag

SEQ ID NO: 7216362 - DNA, 22 bp, Homo sapiens
gtgggtgtcctgtgaaggctca

SEQ ID NO: 7216363 - DNA, 22 bp, Homo sapiens
gtgggtgtcctgtgaaggctca

SEQ ID NO: 7216364 - DNA, 22 bp, Homo sapiens
gtgggtgtgagtgacggcgtcc

SEQ ID NO: 7216365 - DNA, 22 bp, Homo sapiens
gtgggtgtgagtgacggcgtcc

SEQ ID NO: 7216366 - DNA, 17 bp, Homo sapiens
cagctgtgagagcctta

SEQ ID NO: 7216367 - DNA, 22 bp, Homo sapiens
cagctgtgagcagccagttgcc

SEQ ID NO: 7216368 - DNA, 22 bp, Homo sapiens
cagctgtgacagccagttgatg

SEQ ID NO: 7216369 - DNA, 17 bp, Homo sapiens
cagctgtgagagcctta

SEQ ID NO: 7216370 - DNA, 22 bp, Homo sapiens
cagctgggtgatcttgggcagg

SEQ ID NO: 7216371 - DNA, 22 bp, Homo sapiens
cagctgtctaagttgagcagga

SEQ ID NO: 7216372 - DNA, 22 bp, Homo sapiens
cagctgtctaagttgagcagga

SEQ ID NO: 7216373 - DNA, 22 bp, Homo sapiens
cagctgtctggggagtgctcgc

SEQ ID NO: 7216374 - DNA, 22 bp, Homo sapiens
cagctgggcctcctgagccctg

SEQ ID NO: 7216375 - DNA, 22 bp, Homo sapiens
cagctgggcctcctgagccctg

SEQ ID NO: 7216376 - DNA, 22 bp, Homo sapiens
cagctgggctaagagtagaggc

SEQ ID NO: 7216377 - DNA, 22 bp, Homo sapiens
cagctgggctaagagtagaggc

SEQ ID NO: 7216378 - DNA, 22 bp, Homo sapiens
cagctggggagagacatggcag

SEQ ID NO: 7216379 - DNA, 22 bp, Homo sapiens
cagctggggagagacatggcag

SEQ ID NO: 7216380 - DNA, 22 bp, Homo sapiens
cagctggggagagacatggcag

SEQ ID NO: 7216381 - DNA, 22 bp, Homo sapiens
cagctggggagagacatggcag

SEQ ID NO: 7216382 - DNA, 22 bp, Homo sapiens
cagctggggagagacatggcag

SEQ ID NO: 7216383 - DNA, 22 bp, Homo sapiens
cagctggggagagacatggcag

SEQ ID NO: 7216384 - DNA, 22 bp, Homo sapiens
cagctggggagagacatggcag

SEQ ID NO: 7216385 - DNA, 22 bp, Homo sapiens
cagctggggcagccacgtgcgg

SEQ ID NO: 7216386 - DNA, 22 bp, Homo sapiens
cagctggggcagccacgtgcgg

SEQ ID NO: 7216387 - DNA, 22 bp, Homo sapiens
cagctggggcagccacgtgcgg

SEQ ID NO: 7216388 - DNA, 22 bp, Homo sapiens
cagctggggcagccacgtgcgg

SEQ ID NO: 7216389 - DNA, 22 bp, Homo sapiens
cagctggggcagccacgtgcgg

SEQ ID NO: 7216390 - DNA, 22 bp, Homo sapiens
cagctgggtgatcttgggcagg

SEQ ID NO: 7216391 - DNA, 22 bp, Homo sapiens
gtgtggaatggagtttttgccc

SEQ ID NO: 7216392 - DNA, 22 bp, Homo sapiens
gtgtggactctctggtgcacag

SEQ ID NO: 7216393 - DNA, 22 bp, Homo sapiens
gtgtggactctctggtgcacag

SEQ ID NO: 7216394 - DNA, 22 bp, Homo sapiens
gtgtggcaaggtgagaagtggg

SEQ ID NO: 7216395 - DNA, 22 bp, Homo sapiens
gtgtggcaaggtgagaagtggg

SEQ ID NO: 7216396 - DNA, 19 bp, Homo sapiens
gtgtggcagagagtgacca

SEQ ID NO: 7216397 - DNA, 19 bp, Homo sapiens
gtgtggcagagagtgacca

SEQ ID NO: 7216398 - DNA, 23 bp, Homo sapiens
gtgtggcagcgctgtggttagct

SEQ ID NO: 7216399 - DNA, 22 bp, Homo sapiens
gtgtggccaattatgggcattc

SEQ ID NO: 7216400 - DNA, 22 bp, Homo sapiens
gtgtggccaattatgggcattc

SEQ ID NO: 7216401 - DNA, 20 bp, Homo sapiens
gtgtggccaggagctgcgct

SEQ ID NO: 7216402 - DNA, 23 bp, Homo sapiens
gtgtggccccagggcctcctcgc

SEQ ID NO: 7216403 - DNA, 22 bp, Homo sapiens
gtgtggccctgcgtcctgagtc

SEQ ID NO: 7216404 - DNA, 22 bp, Homo sapiens
cagctgggagctccattagata

SEQ ID NO: 7216405 - DNA, 22 bp, Homo sapiens
cagctgggagctccattagata

SEQ ID NO: 7216406 - DNA, 22 bp, Homo sapiens
cagctggctggtcagtgcacaa

SEQ ID NO: 7216407 - DNA, 22 bp, Homo sapiens
gtgtggccgccacttggggcag

SEQ ID NO: 7216408 - DNA, 22 bp, Homo sapiens
gtgtggccgccacttggggcag

SEQ ID NO: 7216409 - DNA, 22 bp, Homo sapiens
gtgtggccgtgtatccatggct

SEQ ID NO: 7216410 - DNA, 22 bp, Homo sapiens
gtgtggccgtgtatccatggct

SEQ ID NO: 7216411 - DNA, 22 bp, Homo sapiens
gtgtggcctcaacgggatgcaa

SEQ ID NO: 7216412 - DNA, 22 bp, Homo sapiens
gtgtggcctcaacgggatgcaa

SEQ ID NO: 7216413 - DNA, 22 bp, Homo sapiens
gtgtggccgccacttggggcag

SEQ ID NO: 7216414 - DNA, 22 bp, Homo sapiens
gtgtgcgccgacacagccaggt

SEQ ID NO: 7216415 - DNA, 22 bp, Homo sapiens
gtgtgcctttcacacactggga

SEQ ID NO: 7216416 - DNA, 22 bp, Homo sapiens
gtgtgcgcgctcataggtgtgt

SEQ ID NO: 7216417 - DNA, 22 bp, Homo sapiens
gtgtgcgcgcgcgtcccgggtg

SEQ ID NO: 7216418 - DNA, 22 bp, Homo sapiens
gtgtgcgttcctagtaaacgtg

SEQ ID NO: 7216419 - DNA, 17 bp, Homo sapiens
gtgtgctactatcattt

SEQ ID NO: 7216420 - DNA, 22 bp, Homo sapiens
gtgtgctcaagggcaggaacct

SEQ ID NO: 7216421 - DNA, 18 bp, Homo sapiens
gtgtgctcagagagtgag

SEQ ID NO: 7216422 - DNA, 18 bp, Homo sapiens
gtgtgctcagagagtgag

SEQ ID NO: 7216423 - DNA, 22 bp, Homo sapiens
gtgtgctgagtgactgtcatca

SEQ ID NO: 7216424 - DNA, 22 bp, Homo sapiens
gtgtgctgagtgactgtcatca

SEQ ID NO: 7216425 - DNA, 22 bp, Homo sapiens
gtgtgctgagtgactgtcatca

SEQ ID NO: 7216426 - DNA, 22 bp, Homo sapiens
gtgtgctgcccaactcgcagat

SEQ ID NO: 7216427 - DNA, 22 bp, Homo sapiens
gtgtgctgcccaactcgcagat

SEQ ID NO: 7216428 - DNA, 22 bp, Homo sapiens
gtgtgctgggaccacgctgggt

SEQ ID NO: 7216429 - DNA, 22 bp, Homo sapiens
gtgtgctgttgttcaggtagaa

SEQ ID NO: 7216430 - DNA, 22 bp, Homo sapiens
gtgtggaaacagagagggcaac

SEQ ID NO: 7216431 - DNA, 22 bp, Homo sapiens
gtgtggaaacagagagggcaac

SEQ ID NO: 7216432 - DNA, 22 bp, Homo sapiens
gtgtggaaacagagagggcaac

SEQ ID NO: 7216433 - DNA, 22 bp, Homo sapiens
gtgtggaaacagagagggcaac

SEQ ID NO: 7216434 - DNA, 22 bp, Homo sapiens
gtgtggaaagagtggcctctca

SEQ ID NO: 7216435 - DNA, 22 bp, Homo sapiens
gtgtggaaagagtggcctctca

SEQ ID NO: 7216436 - DNA, 22 bp, Homo sapiens
gtgtggaaccaaataacctaaa

SEQ ID NO: 7216437 - DNA, 22 bp, Homo sapiens
gtgtggaaccaaataacctaaa

SEQ ID NO: 7216438 - DNA, 22 bp, Homo sapiens
gtgtggaagcagatgggtgagc

SEQ ID NO: 7216439 - DNA, 22 bp, Homo sapiens
gtgtggaagcagatgggtgagc

SEQ ID NO: 7216440 - DNA, 22 bp, Homo sapiens
gtgtggaatggagtttttgccc

SEQ ID NO: 7216441 - DNA, 22 bp, Homo sapiens
gtggggatcactggggacaatc

SEQ ID NO: 7216442 - DNA, 22 bp, Homo sapiens
gtggggcagtggcctgggagca

SEQ ID NO: 7216443 - DNA, 22 bp, Homo sapiens
gtggggcagtggcctgggagca

SEQ ID NO: 7216444 - DNA, 22 bp, Homo sapiens
gtggggcagtggcctgggagca

SEQ ID NO: 7216445 - DNA, 22 bp, Homo sapiens
gtggggcagtggcctgggagca

SEQ ID NO: 7216446 - DNA, 22 bp, Homo sapiens
gtggggcagtggcctgggagca

SEQ ID NO: 7216447 - DNA, 22 bp, Homo sapiens
gtggggagggagatgctgaagt

SEQ ID NO: 7216448 - DNA, 22 bp, Homo sapiens
gtggggagggagatgctgaagt

SEQ ID NO: 7216449 - DNA, 22 bp, Homo sapiens
gtggggagtgttctgtgattgg

SEQ ID NO: 7216450 - DNA, 22 bp, Homo sapiens
gtggggagtgttctgtgattgg

SEQ ID NO: 7216451 - DNA, 22 bp, Homo sapiens
gtggggagtgttctgtgattgg

SEQ ID NO: 7216452 - DNA, 22 bp, Homo sapiens
gtggggcatgcacgctgctcct

SEQ ID NO: 7216453 - DNA, 22 bp, Homo sapiens
gtggggcagtggcctgggagca

SEQ ID NO: 7216454 - DNA, 22 bp, Homo sapiens
gtggggcatgcacgctgctcct

SEQ ID NO: 7216455 - DNA, 22 bp, Homo sapiens
gtggggcatgcacgctgctcct

SEQ ID NO: 7216456 - DNA, 22 bp, Homo sapiens
gtggggcatgcacgctgctcct

SEQ ID NO: 7216457 - DNA, 22 bp, Homo sapiens
gtggggcctgtggcttccgtgg

SEQ ID NO: 7216458 - DNA, 22 bp, Homo sapiens
gtggggctcccatctcctggct

SEQ ID NO: 7216459 - DNA, 22 bp, Homo sapiens
gtggggctgagtggagccagaa

SEQ ID NO: 7216460 - DNA, 22 bp, Homo sapiens
gtggggctgagtggagccagaa

SEQ ID NO: 7216461 - DNA, 22 bp, Homo sapiens
gtggggctcccatctcctggct

SEQ ID NO: 7216462 - DNA, 22 bp, Homo sapiens
gtggggctcccatctcctggct

SEQ ID NO: 7216463 - DNA, 22 bp, Homo sapiens
gtggggctcccatctcctggct

SEQ ID NO: 7216464 - DNA, 22 bp, Homo sapiens
gtggggcggcagatgctccctg

SEQ ID NO: 7216465 - DNA, 22 bp, Homo sapiens
gtggggctaaaaactgtgcagt

SEQ ID NO: 7216466 - DNA, 22 bp, Homo sapiens
gtggggctaaaaactgtgcagt

SEQ ID NO: 7216467 - DNA, 22 bp, Homo sapiens
gtggggctaaaaactgtgcagt

SEQ ID NO: 7216468 - DNA, 22 bp, Homo sapiens
gtggggctgcttaggctgcgca

SEQ ID NO: 7216469 - DNA, 22 bp, Homo sapiens
gtggggctgcttaggctgcgca

SEQ ID NO: 7216470 - DNA, 22 bp, Homo sapiens
gtggggctgcttaggctgcgca

SEQ ID NO: 7216471 - DNA, 22 bp, Homo sapiens
gtggggctgcttaggctgcgca

SEQ ID NO: 7216472 - DNA, 22 bp, Homo sapiens
gtggggctgagtggagccagaa

SEQ ID NO: 7216473 - DNA, 22 bp, Homo sapiens
gtggggctgagtggagccagaa

SEQ ID NO: 7216474 - DNA, 22 bp, Homo sapiens
gtggggctgagtggagccagaa

SEQ ID NO: 7216475 - DNA, 22 bp, Homo sapiens
gtggggctggaagatgggtact

SEQ ID NO: 7216476 - DNA, 22 bp, Homo sapiens
cagctgatggttttgctgagac

SEQ ID NO: 7216477 - DNA, 19 bp, Homo sapiens
cagctgcaccgtgaccatc

SEQ ID NO: 7216478 - DNA, 19 bp, Homo sapiens
cagctgcaccgtgaccatc

SEQ ID NO: 7216479 - DNA, 19 bp, Homo sapiens
cagctgcaccgtgaccatc

SEQ ID NO: 7216480 - DNA, 22 bp, Homo sapiens
cagctgcactgaagcaggtttg

SEQ ID NO: 7216481 - DNA, 22 bp, Homo sapiens
cagctgcactgaagcaggtttg

SEQ ID NO: 7216482 - DNA, 22 bp, Homo sapiens
cagctgcagaaagcaagcaggt

SEQ ID NO: 7216483 - DNA, 22 bp, Homo sapiens
cagctgcagaaagcaagcaggt

SEQ ID NO: 7216484 - DNA, 22 bp, Homo sapiens
cagctgcagaaagcaagcaggt

SEQ ID NO: 7216485 - DNA, 22 bp, Homo sapiens
cagctgcagaaagcaagcaggt

SEQ ID NO: 7216486 - DNA, 22 bp, Homo sapiens
cagctgcagaaagcaagcaggt

SEQ ID NO: 7216487 - DNA, 22 bp, Homo sapiens
cagctgcagatcatgtttacag

SEQ ID NO: 7216488 - DNA, 22 bp, Homo sapiens
cagctgcagatcatgtttacag

SEQ ID NO: 7216489 - DNA, 22 bp, Homo sapiens
cagctgcaggaacaaaaatgtg

SEQ ID NO: 7216490 - DNA, 22 bp, Homo sapiens
cagctgcaggagaaacagaggc

SEQ ID NO: 7216491 - DNA, 22 bp, Homo sapiens
cagctgcaggagaaacagaggc

SEQ ID NO: 7216492 - DNA, 22 bp, Homo sapiens
cagctgcaggaacaaaaatgtg

SEQ ID NO: 7216493 - DNA, 22 bp, Homo sapiens
cagctgcaggagctgagcactt

SEQ ID NO: 7216494 - DNA, 22 bp, Homo sapiens
cagctgcaggagctgagcactt

SEQ ID NO: 7216495 - DNA, 22 bp, Homo sapiens
cagctgcctatgacctagcctc

SEQ ID NO: 7216496 - DNA, 22 bp, Homo sapiens
cagctgcctatgacctagcctc

SEQ ID NO: 7216497 - DNA, 22 bp, Homo sapiens
cagctgcctatgacctagcctc

SEQ ID NO: 7216498 - DNA, 22 bp, Homo sapiens
cagctgccacttgctctcggct

SEQ ID NO: 7216499 - DNA, 22 bp, Homo sapiens
cagctgcccctccagggctggg

SEQ ID NO: 7216500 - DNA, 22 bp, Homo sapiens
cagctgcctatgacctagcctc

SEQ ID NO: 7216501 - DNA, 22 bp, Homo sapiens
cagctgcctgcaacacaagctt

SEQ ID NO: 7216502 - DNA, 22 bp, Homo sapiens
cagctgcctgcaacacaagctt

SEQ ID NO: 7216503 - DNA, 22 bp, Homo sapiens
cagctgcctgcaacacaagctt

SEQ ID NO: 7216504 - DNA, 22 bp, Homo sapiens
cagctgcctgcaacacaagctt

SEQ ID NO: 7216505 - DNA, 20 bp, Homo sapiens
cagctgcctggctctgggat

SEQ ID NO: 7216506 - DNA, 20 bp, Homo sapiens
cagctgcctggctctgggat

SEQ ID NO: 7216507 - DNA, 20 bp, Homo sapiens
cagctgcctggctctgggat

SEQ ID NO: 7216508 - DNA, 20 bp, Homo sapiens
cagctgcctggctctgggat

SEQ ID NO: 7216509 - DNA, 22 bp, Homo sapiens
cagctgcctgtattgtcctcat

SEQ ID NO: 7216510 - DNA, 22 bp, Homo sapiens
cagctgcaggagctgagcactt

SEQ ID NO: 7216511 - DNA, 18 bp, Homo sapiens
cagctgcaggctcaggac

SEQ ID NO: 7216512 - DNA, 18 bp, Homo sapiens
cagctgcaggctcaggac

SEQ ID NO: 7216513 - DNA, 22 bp, Homo sapiens
cagctgcaggctgtgcaggaag

SEQ ID NO: 7216514 - DNA, 22 bp, Homo sapiens
cagctgcagtcatcttctagaa

SEQ ID NO: 7216515 - DNA, 22 bp, Homo sapiens
cagctgcagtgggggaccacaa

SEQ ID NO: 7216516 - DNA, 22 bp, Homo sapiens
cagctgcagttcaatgcttgct

SEQ ID NO: 7216517 - DNA, 22 bp, Homo sapiens
cagctgcatgtctgtggtggtc

SEQ ID NO: 7216518 - DNA, 22 bp, Homo sapiens
cagctgcatgtctgtggtggtc

SEQ ID NO: 7216519 - DNA, 22 bp, Homo sapiens
cagctgcatgtctgtggtggtc

SEQ ID NO: 7216520 - DNA, 22 bp, Homo sapiens
cagctgcattaattttagtgaa

SEQ ID NO: 7216521 - DNA, 22 bp, Homo sapiens
cagctgccaagaatcttttcta

SEQ ID NO: 7216522 - DNA, 22 bp, Homo sapiens
cagctgcattaattttagtgaa

SEQ ID NO: 7216523 - DNA, 22 bp, Homo sapiens
cagctgccacttgctctcggct

SEQ ID NO: 7216524 - DNA, 22 bp, Homo sapiens
cagctgccacttgctctcggct

SEQ ID NO: 7216525 - DNA, 22 bp, Homo sapiens
cagctgccacttgctctcggct

SEQ ID NO: 7216526 - DNA, 22 bp, Homo sapiens
cagctgcttactagctgtgtga

SEQ ID NO: 7216527 - DNA, 22 bp, Homo sapiens
cagctgctgttcagttttgttt

SEQ ID NO: 7216528 - DNA, 22 bp, Homo sapiens
cagctgctgttcagttttgttt

SEQ ID NO: 7216529 - DNA, 22 bp, Homo sapiens
cagctgcttactagctgtgtga

SEQ ID NO: 7216530 - DNA, 22 bp, Homo sapiens
cagctgctgttcagttttgttt

SEQ ID NO: 7216531 - DNA, 22 bp, Homo sapiens
cagctgctgttcagttttgttt

SEQ ID NO: 7216532 - DNA, 22 bp, Homo sapiens
cagctgcttactagctgtgtga

SEQ ID NO: 7216533 - DNA, 22 bp, Homo sapiens
cagctgcttctcctccagagct

SEQ ID NO: 7216534 - DNA, 22 bp, Homo sapiens
cagctgcttctcctccagagct

SEQ ID NO: 7216535 - DNA, 22 bp, Homo sapiens
cagctgctttagttttccatcc

SEQ ID NO: 7216536 - DNA, 22 bp, Homo sapiens
cagctggccaatcagggcgccc

SEQ ID NO: 7216537 - DNA, 22 bp, Homo sapiens
cagctgctgttcagttttgttt

SEQ ID NO: 7216538 - DNA, 22 bp, Homo sapiens
cagctgctgttactgcttatta

SEQ ID NO: 7216539 - DNA, 22 bp, Homo sapiens
cagctgctgttcagttttgttt

SEQ ID NO: 7216540 - DNA, 22 bp, Homo sapiens
cagctgctgttcagttttgttt

SEQ ID NO: 7216541 - DNA, 22 bp, Homo sapiens
cagctgctgttcagttttgttt

SEQ ID NO: 7216542 - DNA, 22 bp, Homo sapiens
cagctgctgttcagttttgttt

SEQ ID NO: 7216543 - DNA, 22 bp, Homo sapiens
cagctgctgcctcatccacttt

SEQ ID NO: 7216544 - DNA, 22 bp, Homo sapiens
cagctgctgcctcatccacttt

SEQ ID NO: 7216545 - DNA, 22 bp, Homo sapiens
cagctgctggctccgggctaag

SEQ ID NO: 7216546 - DNA, 22 bp, Homo sapiens
cagctgctgatggcctgacaga

SEQ ID NO: 7216547 - DNA, 22 bp, Homo sapiens
cagctgctgatggcctgacaga

SEQ ID NO: 7216548 - DNA, 22 bp, Homo sapiens
cagctgctgatggcctgacaga

SEQ ID NO: 7216549 - DNA, 22 bp, Homo sapiens
cagctgctgatggcctgacaga

SEQ ID NO: 7216550 - DNA, 22 bp, Homo sapiens
cagctgctgcccttggctgcag

SEQ ID NO: 7216551 - DNA, 22 bp, Homo sapiens
cagctgctgcccttggctgcag

SEQ ID NO: 7216552 - DNA, 22 bp, Homo sapiens
cagctgctctggtggtctctcc

SEQ ID NO: 7216553 - DNA, 22 bp, Homo sapiens
cagctgctcttctggcctgtca

SEQ ID NO: 7216554 - DNA, 22 bp, Homo sapiens
cagctgctgagaagcctccctt

SEQ ID NO: 7216555 - DNA, 22 bp, Homo sapiens
cagctgctgaggaaggggttgg

SEQ ID NO: 7216556 - DNA, 22 bp, Homo sapiens
cagctgcctgtattgtcctcat

SEQ ID NO: 7216557 - DNA, 22 bp, Homo sapiens
cagctgcctgtattgtcctcat

SEQ ID NO: 7216558 - DNA, 22 bp, Homo sapiens
cagctgcctgtctggaggcaat

SEQ ID NO: 7216559 - DNA, 22 bp, Homo sapiens
cagctgcctgtctggaggcaat

SEQ ID NO: 7216560 - DNA, 22 bp, Homo sapiens
cagctgccttctgcgggaagtc

SEQ ID NO: 7216561 - DNA, 19 bp, Homo sapiens
cagctgccttttctttgca

SEQ ID NO: 7216562 - DNA, 22 bp, Homo sapiens
cagctgctctggtggtctctcc

SEQ ID NO: 7216563 - DNA, 22 bp, Homo sapiens
cagctgctctggtggtctctcc

SEQ ID NO: 7216564 - DNA, 22 bp, Homo sapiens
cagctgctctggtggtctctcc

SEQ ID NO: 7216565 - DNA, 22 bp, Homo sapiens
cagctggctccacctctgggct

SEQ ID NO: 7216566 - DNA, 22 bp, Homo sapiens
cagctggctccacctctgggct

SEQ ID NO: 7216567 - DNA, 22 bp, Homo sapiens
cagctggcgactctcctcgatg

SEQ ID NO: 7216568 - DNA, 22 bp, Homo sapiens
cagctggcgcctggggaccaga

SEQ ID NO: 7216569 - DNA, 22 bp, Homo sapiens
cagctggcgcctggggaccaga

SEQ ID NO: 7216570 - DNA, 22 bp, Homo sapiens
cagctggcgggcagagccgcca

SEQ ID NO: 7216571 - DNA, 22 bp, Homo sapiens
cagctggccctttggtagcctt

SEQ ID NO: 7216572 - DNA, 22 bp, Homo sapiens
cagctggccccacagtagaggc

SEQ ID NO: 7216573 - DNA, 22 bp, Homo sapiens
cagctggccccacagtagaggc

SEQ ID NO: 7216574 - DNA, 22 bp, Homo sapiens
cagctggcctgatccctgtggc

SEQ ID NO: 7216575 - DNA, 22 bp, Homo sapiens
cagctggcctgatccctgtggc

SEQ ID NO: 7216576 - DNA, 22 bp, Homo sapiens
cagctggctgcatgatgccaaa

SEQ ID NO: 7216577 - DNA, 22 bp, Homo sapiens
cagctggctgcatgatgccaaa

SEQ ID NO: 7216578 - DNA, 22 bp, Homo sapiens
cagctggctgcatgatgccaaa

SEQ ID NO: 7216579 - DNA, 22 bp, Homo sapiens
cagctggctgcggtgaggggac

SEQ ID NO: 7216580 - DNA, 22 bp, Homo sapiens
cagctggctccacctctgggct

SEQ ID NO: 7216581 - DNA, 22 bp, Homo sapiens
cagctggctgcatgatgccaaa

SEQ ID NO: 7216582 - DNA, 22 bp, Homo sapiens
cagctggctgcatgatgccaaa

SEQ ID NO: 7216583 - DNA, 22 bp, Homo sapiens
gtgggtggatcacctgaggtca

SEQ ID NO: 7216584 - DNA, 22 bp, Homo sapiens
gtgggtggatcacctgaggtca

SEQ ID NO: 7216585 - DNA, 22 bp, Homo sapiens
gtgggtggaggcgtcgagggca

SEQ ID NO: 7216586 - DNA, 22 bp, Homo sapiens
gtgggtggaggcgtcgagggca

SEQ ID NO: 7216587 - DNA, 22 bp, Homo sapiens
gtgggtggatcatgaggtcagg

SEQ ID NO: 7216588 - DNA, 22 bp, Homo sapiens
gtgggtggatcatgaggtcagg

SEQ ID NO: 7216589 - DNA, 22 bp, Homo sapiens
gtgggtggatcatgaggtcagg

SEQ ID NO: 7216590 - DNA, 22 bp, Homo sapiens
gtgggtggatcatgaggtcagg

SEQ ID NO: 7216591 - DNA, 22 bp, Homo sapiens
gtgggtggatcacctgaggtca

SEQ ID NO: 7216592 - DNA, 22 bp, Homo sapiens
gtgggtggatcacctgaggtca

SEQ ID NO: 7216593 - DNA, 22 bp, Homo sapiens
gtgggtggatcacctgaggtca

SEQ ID NO: 7216594 - DNA, 22 bp, Homo sapiens
gtgggtggatcacctgaggtca

SEQ ID NO: 7216595 - DNA, 22 bp, Homo sapiens
gtgggtggatcatgaggtcagg

SEQ ID NO: 7216596 - DNA, 22 bp, Homo sapiens
gtgggtggatggctcacctcca

SEQ ID NO: 7216597 - DNA, 22 bp, Homo sapiens
gtgggtggatcatgaggtcagg

SEQ ID NO: 7216598 - DNA, 22 bp, Homo sapiens
gtgggtggatcatgaggtcagg

SEQ ID NO: 7216599 - DNA, 22 bp, Homo sapiens
gtgggtggatcatgaggtcagg

SEQ ID NO: 7216600 - DNA, 22 bp, Homo sapiens
gtgggtggatcatgaggtcagg

SEQ ID NO: 7216601 - DNA, 22 bp, Homo sapiens
gtggcagaagagtaggatgggc

SEQ ID NO: 7216602 - DNA, 22 bp, Homo sapiens
gtggcagaactatgtgattgct

SEQ ID NO: 7216603 - DNA, 22 bp, Homo sapiens
gtggcagaccttcccttctcct

SEQ ID NO: 7216604 - DNA, 22 bp, Homo sapiens
gtggcagaagagtaggatgggc

SEQ ID NO: 7216605 - DNA, 22 bp, Homo sapiens
gtggcagaagagtaggatgggc

SEQ ID NO: 7216606 - DNA, 22 bp, Homo sapiens
gtggcagaaatattcttgctct

SEQ ID NO: 7216607 - DNA, 22 bp, Homo sapiens
gtggcagaaatgggactttgag

SEQ ID NO: 7216608 - DNA, 22 bp, Homo sapiens
gtggcagaaactggcagaggag

SEQ ID NO: 7216609 - DNA, 22 bp, Homo sapiens
gtggcagaaactggcagaggag

SEQ ID NO: 7216610 - DNA, 22 bp, Homo sapiens
gtggcagagaacaaggagaggt

SEQ ID NO: 7216611 - DNA, 22 bp, Homo sapiens
gtggcagagaacaaggagaggt

SEQ ID NO: 7216612 - DNA, 22 bp, Homo sapiens
gtggcagagaacaaggagaggt

SEQ ID NO: 7216613 - DNA, 22 bp, Homo sapiens
gtggcagagaacaaggagaggt

SEQ ID NO: 7216614 - DNA, 22 bp, Homo sapiens
gtggcagagaacaaggagaggt

SEQ ID NO: 7216615 - DNA, 22 bp, Homo sapiens
gtggcagagcaggagacaggac

SEQ ID NO: 7216616 - DNA, 22 bp, Homo sapiens
gtggcagagcaggagacaggac

SEQ ID NO: 7216617 - DNA, 22 bp, Homo sapiens
gtggcaggtcccattggagcag

SEQ ID NO: 7216618 - DNA, 22 bp, Homo sapiens
gtggcaggtcccattggagcag

SEQ ID NO: 7216619 - DNA, 22 bp, Homo sapiens
gtggcaggtcccattggagcag

SEQ ID NO: 7216620 - DNA, 22 bp, Homo sapiens
gtggcaggtcccattggagcag

SEQ ID NO: 7216621 - DNA, 22 bp, Homo sapiens
gtggcagagccaaggctggagc

SEQ ID NO: 7216622 - DNA, 22 bp, Homo sapiens
gtggcagggtgctcatcatgca

SEQ ID NO: 7216623 - DNA, 22 bp, Homo sapiens
gtggcagggtgctcatcatgca

SEQ ID NO: 7216624 - DNA, 22 bp, Homo sapiens
gtggcaggttataagcatctca

SEQ ID NO: 7216625 - DNA, 22 bp, Homo sapiens
gtggcaggttataagcatctca

SEQ ID NO: 7216626 - DNA, 22 bp, Homo sapiens
gtggcaggtcccattggagcag

SEQ ID NO: 7216627 - DNA, 22 bp, Homo sapiens
gtggcaggtggagcctcctgca

SEQ ID NO: 7216628 - DNA, 22 bp, Homo sapiens
gtggcaggtggagcctcctgca

SEQ ID NO: 7216629 - DNA, 22 bp, Homo sapiens
gtggcaggtggagcctcctgca

SEQ ID NO: 7216630 - DNA, 22 bp, Homo sapiens
gtggcaggttataagcatctca

SEQ ID NO: 7216631 - DNA, 22 bp, Homo sapiens
gtggcaggttccgtagacagca

SEQ ID NO: 7216632 - DNA, 22 bp, Homo sapiens
gtggcaggttccgtagacagca

SEQ ID NO: 7216633 - DNA, 22 bp, Homo sapiens
gtggcaggttccgtagacagca

SEQ ID NO: 7216634 - DNA, 22 bp, Homo sapiens
gtggcaggtggagcctcctgca

SEQ ID NO: 7216635 - DNA, 22 bp, Homo sapiens
gtggcaggttataagcatctca

SEQ ID NO: 7216636 - DNA, 22 bp, Homo sapiens
gtggcaggttataagcatctca

SEQ ID NO: 7216637 - DNA, 22 bp, Homo sapiens
gtggcagaaactggcagaggag

SEQ ID NO: 7216638 - DNA, 22 bp, Homo sapiens
gtggcagaaactggcagaggag

SEQ ID NO: 7216639 - DNA, 22 bp, Homo sapiens
gtggcagaaactggcagaggag

SEQ ID NO: 7216640 - DNA, 22 bp, Homo sapiens
gtggcactgggtgagtgagtga

SEQ ID NO: 7216641 - DNA, 22 bp, Homo sapiens
cagcccaggccgacagttcctc

SEQ ID NO: 7216642 - DNA, 22 bp, Homo sapiens
gtggagccaggggctgtaggta

SEQ ID NO: 7216643 - DNA, 22 bp, Homo sapiens
gtggagccctgccttgctcatg

SEQ ID NO: 7216644 - DNA, 22 bp, Homo sapiens
gtggcactgggtgagtgagtga

SEQ ID NO: 7216645 - DNA, 22 bp, Homo sapiens
cagcccaggactgcaggtgttt

SEQ ID NO: 7216646 - DNA, 22 bp, Homo sapiens
cagcccaggccgacagttcctc

SEQ ID NO: 7216647 - DNA, 22 bp, Homo sapiens
cagcccaggccgacagttcctc

SEQ ID NO: 7216648 - DNA, 22 bp, Homo sapiens
cagcccaggccgacagttcctc

SEQ ID NO: 7216649 - DNA, 22 bp, Homo sapiens
cagcccaggccgacagttcctc

SEQ ID NO: 7216650 - DNA, 22 bp, Homo sapiens
cagcccaggccgacagttcctc

SEQ ID NO: 7216651 - DNA, 22 bp, Homo sapiens
cagcccaggccgacagttcctc

SEQ ID NO: 7216652 - DNA, 22 bp, Homo sapiens
cagcccaggccgacagttcctc

SEQ ID NO: 7216653 - DNA, 22 bp, Homo sapiens
cagcccagccgagggcctggct

SEQ ID NO: 7216654 - DNA, 22 bp, Homo sapiens
cagcccagccttgtctctttat

SEQ ID NO: 7216655 - DNA, 22 bp, Homo sapiens
cagcccagccgagggcctggct

SEQ ID NO: 7216656 - DNA, 22 bp, Homo sapiens
cagcccagcgcaaacaactggc

SEQ ID NO: 7216657 - DNA, 22 bp, Homo sapiens
cagcccagcgcaaacaactggc

SEQ ID NO: 7216658 - DNA, 22 bp, Homo sapiens
cagcccagccgagggcctggct

SEQ ID NO: 7216659 - DNA, 22 bp, Homo sapiens
cagcccagccgagggcctggct

SEQ ID NO: 7216660 - DNA, 22 bp, Homo sapiens
cagcccagccgagggcctggct

SEQ ID NO: 7216661 - DNA, 22 bp, Homo sapiens
cagcccagccgagggcctggct

SEQ ID NO: 7216662 - DNA, 22 bp, Homo sapiens
cagcccagccgagggcctggct

SEQ ID NO: 7216663 - DNA, 22 bp, Homo sapiens
cagcccagccgagggcctggct

SEQ ID NO: 7216664 - DNA, 22 bp, Homo sapiens
cagcccagccgagggcctggct

SEQ ID NO: 7216665 - DNA, 22 bp, Homo sapiens
cagcccagctctgactaaccct

SEQ ID NO: 7216666 - DNA, 22 bp, Homo sapiens
cagcccagctgggatcacactc

SEQ ID NO: 7216667 - DNA, 21 bp, Homo sapiens
cagcccagcttcttccccagt

SEQ ID NO: 7216668 - DNA, 21 bp, Homo sapiens
cagcccagcttcttccccagt

SEQ ID NO: 7216669 - DNA, 21 bp, Homo sapiens
cagcccagcttcttccccagt

SEQ ID NO: 7216670 - DNA, 21 bp, Homo sapiens
cagcccagcttcttccccagt

SEQ ID NO: 7216671 - DNA, 22 bp, Homo sapiens
cagcccaggactgcaggtgttt

SEQ ID NO: 7216672 - DNA, 22 bp, Homo sapiens
cagcccaggactgcaggtgttt

SEQ ID NO: 7216673 - DNA, 22 bp, Homo sapiens
gtggccatttggaaggcaagta

SEQ ID NO: 7216674 - DNA, 22 bp, Homo sapiens
gtggccatttggaaggcaagta

SEQ ID NO: 7216675 - DNA, 22 bp, Homo sapiens
gtggccatgtgcttgcagggta

SEQ ID NO: 7216676 - DNA, 22 bp, Homo sapiens
gtggccatctttggccctgact

SEQ ID NO: 7216677 - DNA, 22 bp, Homo sapiens
gtggccatctttggccctgact

SEQ ID NO: 7216678 - DNA, 22 bp, Homo sapiens
gtggccatgtgcttgcagggta

SEQ ID NO: 7216679 - DNA, 22 bp, Homo sapiens
gtggccataggaggtcagatga

SEQ ID NO: 7216680 - DNA, 22 bp, Homo sapiens
gtggccagtgggaatgggctca

SEQ ID NO: 7216681 - DNA, 22 bp, Homo sapiens
gtggccagtgggaatgggctca

SEQ ID NO: 7216682 - DNA, 22 bp, Homo sapiens
gtggccagtgggaatgggctca

SEQ ID NO: 7216683 - DNA, 22 bp, Homo sapiens
gtggccagtgggaatgggctca

SEQ ID NO: 7216684 - DNA, 22 bp, Homo sapiens
gtggccagtgggaatgggctca

SEQ ID NO: 7216685 - DNA, 19 bp, Homo sapiens
gtggccagggcaggggctg

SEQ ID NO: 7216686 - DNA, 22 bp, Homo sapiens
gtggccagggcccacaggatga

SEQ ID NO: 7216687 - DNA, 22 bp, Homo sapiens
gtggccagggcccacaggatga

SEQ ID NO: 7216688 - DNA, 22 bp, Homo sapiens
gtggccagggcccacaggatga

SEQ ID NO: 7216689 - DNA, 22 bp, Homo sapiens
gtggccaggtcagggacttgtg

SEQ ID NO: 7216690 - DNA, 22 bp, Homo sapiens
gtggccaggtcagggacttgtg

SEQ ID NO: 7216691 - DNA, 22 bp, Homo sapiens
gtggccaggtcagggacttgtg

SEQ ID NO: 7216692 - DNA, 22 bp, Homo sapiens
gtggccagtcccgatgcttgtt

SEQ ID NO: 7216693 - DNA, 22 bp, Homo sapiens
gtggccagtcccgatgcttgtt

SEQ ID NO: 7216694 - DNA, 22 bp, Homo sapiens
gtggcaggttccgtagacagca

SEQ ID NO: 7216695 - DNA, 22 bp, Homo sapiens
gtggcagtcggaagtcaggaga

SEQ ID NO: 7216696 - DNA, 22 bp, Homo sapiens
gtggcagtctcatctgtggctc

SEQ ID NO: 7216697 - DNA, 22 bp, Homo sapiens
gtggccaggcgtccgcgcggct

SEQ ID NO: 7216698 - DNA, 19 bp, Homo sapiens
gtggccagggcaggggctg

SEQ ID NO: 7216699 - DNA, 19 bp, Homo sapiens
gtggccagggcaggggctg

SEQ ID NO: 7216700 - DNA, 22 bp, Homo sapiens
cagctctgctggtggtgccagg

SEQ ID NO: 7216701 - DNA, 22 bp, Homo sapiens
cagctctgctggtggtgccagg

SEQ ID NO: 7216702 - DNA, 22 bp, Homo sapiens
cagctctgctggtggtgccagg

SEQ ID NO: 7216703 - DNA, 22 bp, Homo sapiens
gtggccattttttcctagcaca

SEQ ID NO: 7216704 - DNA, 22 bp, Homo sapiens
gtggccattttttcctagcaca

SEQ ID NO: 7216705 - DNA, 22 bp, Homo sapiens
cagctctgctgggaggatgcag

SEQ ID NO: 7216706 - DNA, 22 bp, Homo sapiens
cagctctgctgggaggatgcag

SEQ ID NO: 7216707 - DNA, 22 bp, Homo sapiens
cagctctgctgggaggatgcag

SEQ ID NO: 7216708 - DNA, 22 bp, Homo sapiens
cagctctgctggtggtgccagg

SEQ ID NO: 7216709 - DNA, 22 bp, Homo sapiens
cagctctgctggtggtgccagg

SEQ ID NO: 7216710 - DNA, 22 bp, Homo sapiens
cagctctgctggtggtgccagg

SEQ ID NO: 7216711 - DNA, 22 bp, Homo sapiens
cagctctgcttccttgtacagg

SEQ ID NO: 7216712 - DNA, 22 bp, Homo sapiens
cagctctgcttccttgtacagg

SEQ ID NO: 7216713 - DNA, 22 bp, Homo sapiens
cagctctgcttccttgtacagg

SEQ ID NO: 7216714 - DNA, 22 bp, Homo sapiens
cagctctggcagagcccaaccc

SEQ ID NO: 7216715 - DNA, 22 bp, Homo sapiens
cagctctggcagagcccaaccc

SEQ ID NO: 7216716 - DNA, 22 bp, Homo sapiens
cagctctggcagagcccaaccc

SEQ ID NO: 7216717 - DNA, 22 bp, Homo sapiens
cagctctggccagatctatcct

SEQ ID NO: 7216718 - DNA, 22 bp, Homo sapiens
cagctctggccagatctatcct

SEQ ID NO: 7216719 - DNA, 22 bp, Homo sapiens
cagctctggccagatctatcct

SEQ ID NO: 7216720 - DNA, 22 bp, Homo sapiens
cagctctggcgtcagggagcga

SEQ ID NO: 7216721 - DNA, 22 bp, Homo sapiens
cagctctggcgtcagggagcga

SEQ ID NO: 7216722 - DNA, 22 bp, Homo sapiens
cagctctggcgtcagggagcga

SEQ ID NO: 7216723 - DNA, 22 bp, Homo sapiens
cagctctggcgtcagggagcga

SEQ ID NO: 7216724 - DNA, 22 bp, Homo sapiens
cagctctggcgtcagggagcga

SEQ ID NO: 7216725 - DNA, 22 bp, Homo sapiens
cagctctggcgtcagggagcga

SEQ ID NO: 7216726 - DNA, 22 bp, Homo sapiens
cagctctggcgtcagggagcga

SEQ ID NO: 7216727 - DNA, 22 bp, Homo sapiens
cagctctggcgtcagggagcga

SEQ ID NO: 7216728 - DNA, 22 bp, Homo sapiens
cagctctggctattgaggacca

SEQ ID NO: 7216729 - DNA, 22 bp, Homo sapiens
cagctctggctattgaggacca

SEQ ID NO: 7216730 - DNA, 22 bp, Homo sapiens
cagctctggctattgaggacca

SEQ ID NO: 7216731 - DNA, 22 bp, Homo sapiens
cagctctggctattgaggacca

SEQ ID NO: 7216732 - DNA, 22 bp, Homo sapiens
cagctctggctattgaggacca

SEQ ID NO: 7216733 - DNA, 22 bp, Homo sapiens
cagctctggctttggggagctt

SEQ ID NO: 7216734 - DNA, 22 bp, Homo sapiens
cagctctggctttggggagctt

SEQ ID NO: 7216735 - DNA, 22 bp, Homo sapiens
cagctctggctttggggagctt

SEQ ID NO: 7216736 - DNA, 22 bp, Homo sapiens
cagctctggctttggggagctt

SEQ ID NO: 7216737 - DNA, 22 bp, Homo sapiens
cagctctggctttggggagctt

SEQ ID NO: 7216738 - DNA, 20 bp, Homo sapiens
cagctctgggaaagaggcca

SEQ ID NO: 7216739 - DNA, 20 bp, Homo sapiens
cagctctgggaaagaggcca

SEQ ID NO: 7216740 - DNA, 20 bp, Homo sapiens
cagctctgggaaagaggcca

SEQ ID NO: 7216741 - DNA, 20 bp, Homo sapiens
cagctctgggaaagaggcca

SEQ ID NO: 7216742 - DNA, 20 bp, Homo sapiens
cagctctgggaaagaggcca

SEQ ID NO: 7216743 - DNA, 22 bp, Homo sapiens
cagctctgggagtcccacccct

SEQ ID NO: 7216744 - DNA, 22 bp, Homo sapiens
cagctctgggagtcccacccct

SEQ ID NO: 7216745 - DNA, 22 bp, Homo sapiens
cagctctgggagtcccacccct

SEQ ID NO: 7216746 - DNA, 22 bp, Homo sapiens
cagctctgggagtcccacccct

SEQ ID NO: 7216747 - DNA, 20 bp, Homo sapiens
cagctctgggcaggtcgagg

SEQ ID NO: 7216748 - DNA, 20 bp, Homo sapiens
cagctctgggcaggtcgagg

SEQ ID NO: 7216749 - DNA, 22 bp, Homo sapiens
cagctctgtctgtagaaacttc

SEQ ID NO: 7216750 - DNA, 22 bp, Homo sapiens
cagctctgtgcaggcctgggga

SEQ ID NO: 7216751 - DNA, 22 bp, Homo sapiens
cagctctgtgcaggcctgggga

SEQ ID NO: 7216752 - DNA, 22 bp, Homo sapiens
cagctctgtgcaggcctgggga

SEQ ID NO: 7216753 - DNA, 22 bp, Homo sapiens
cagctctgtgcaggcctgggga

SEQ ID NO: 7216754 - DNA, 22 bp, Homo sapiens
cagctctgtgcaggcctgggga

SEQ ID NO: 7216755 - DNA, 22 bp, Homo sapiens
cagctctgtgcaggcctgggga

SEQ ID NO: 7216756 - DNA, 22 bp, Homo sapiens
cagctctgtgcaggcctgggga

SEQ ID NO: 7216757 - DNA, 22 bp, Homo sapiens
cagctctgtgggagcgtatgtg

SEQ ID NO: 7216758 - DNA, 22 bp, Homo sapiens
cagctctgtgggagcgtatgtg

SEQ ID NO: 7216759 - DNA, 22 bp, Homo sapiens
cagctctgtgtattttccccac

SEQ ID NO: 7216760 - DNA, 22 bp, Homo sapiens
cagctctgtgtattttccccac

SEQ ID NO: 7216761 - DNA, 22 bp, Homo sapiens
cagctctgttcatagatggtgc

SEQ ID NO: 7216762 - DNA, 22 bp, Homo sapiens
cagctctgttcatagatggtgc

SEQ ID NO: 7216763 - DNA, 22 bp, Homo sapiens
cagctctgttcaaactatccag

SEQ ID NO: 7216764 - DNA, 22 bp, Homo sapiens
cagctctgttcaaactatccag

SEQ ID NO: 7216765 - DNA, 22 bp, Homo sapiens
cagctctgttcatagatggtgc

SEQ ID NO: 7216766 - DNA, 22 bp, Homo sapiens
cagctctgttgccaaagtgggc

SEQ ID NO: 7216767 - DNA, 22 bp, Homo sapiens
cagctctgttgccaaagtgggc

SEQ ID NO: 7216768 - DNA, 22 bp, Homo sapiens
cagctctgttgccaaagtgggc

SEQ ID NO: 7216769 - DNA, 22 bp, Homo sapiens
cagctctgttgccaaagtgggc

SEQ ID NO: 7216770 - DNA, 22 bp, Homo sapiens
cagctctgttgccctggaaacg

SEQ ID NO: 7216771 - DNA, 22 bp, Homo sapiens
cagctctgttgccaaagtgggc

SEQ ID NO: 7216772 - DNA, 22 bp, Homo sapiens
cagctctgttgccctggaaacg

SEQ ID NO: 7216773 - DNA, 22 bp, Homo sapiens
cagctctgttgccctggaaacg

SEQ ID NO: 7216774 - DNA, 22 bp, Homo sapiens
cagctcttaacacagcttgtat

SEQ ID NO: 7216775 - DNA, 22 bp, Homo sapiens
cagctcttaacacagcttgtat

SEQ ID NO: 7216776 - DNA, 22 bp, Homo sapiens
cagctcttaacacagcttgtat

SEQ ID NO: 7216777 - DNA, 22 bp, Homo sapiens
cagctcttaacacagcttgtat

SEQ ID NO: 7216778 - DNA, 22 bp, Homo sapiens
cagctcttagagggagacagac

SEQ ID NO: 7216779 - DNA, 22 bp, Homo sapiens
cagctcttattttctctcctaa

SEQ ID NO: 7216780 - DNA, 22 bp, Homo sapiens
cagctcttattttctctcctaa

SEQ ID NO: 7216781 - DNA, 22 bp, Homo sapiens
cagctcttcagagtgagcaatg

SEQ ID NO: 7216782 - DNA, 22 bp, Homo sapiens
cagctcttcagtgcctgagata

SEQ ID NO: 7216783 - DNA, 22 bp, Homo sapiens
cagctcttcagtgcctgagata

SEQ ID NO: 7216784 - DNA, 22 bp, Homo sapiens
cagctcttccatttccttcagc

SEQ ID NO: 7216785 - DNA, 22 bp, Homo sapiens
cagctcttcctaccctagttgg

SEQ ID NO: 7216786 - DNA, 22 bp, Homo sapiens
cagctcttcctaccctagttgg

SEQ ID NO: 7216787 - DNA, 22 bp, Homo sapiens
cagctgaagaaagagtggttag

SEQ ID NO: 7216788 - DNA, 22 bp, Homo sapiens
cagctgaacatgtagagcatct

SEQ ID NO: 7216789 - DNA, 22 bp, Homo sapiens
cagctgaacctttccctggagc

SEQ ID NO: 7216790 - DNA, 22 bp, Homo sapiens
cagctgaacatgtagagcatct

SEQ ID NO: 7216791 - DNA, 22 bp, Homo sapiens
cagctctttttcacacaacatg

SEQ ID NO: 7216792 - DNA, 22 bp, Homo sapiens
cagctctttgagtattccattt

SEQ ID NO: 7216793 - DNA, 22 bp, Homo sapiens
cagctctttattgccaatattc

SEQ ID NO: 7216794 - DNA, 22 bp, Homo sapiens
cagctcttttttgcagcagctg

SEQ ID NO: 7216795 - DNA, 22 bp, Homo sapiens
cagctgaaagaaggaagtgtca

SEQ ID NO: 7216796 - DNA, 18 bp, Homo sapiens
cagctcttctccagtaac

SEQ ID NO: 7216797 - DNA, 18 bp, Homo sapiens
cagctcttctccagtaac

SEQ ID NO: 7216798 - DNA, 17 bp, Homo sapiens
cagctcttcctccctct

SEQ ID NO: 7216799 - DNA, 18 bp, Homo sapiens
cagctcttctccagtaac

SEQ ID NO: 7216800 - DNA, 22 bp, Homo sapiens
cagctcttggagaaaccagagc

SEQ ID NO: 7216801 - DNA, 22 bp, Homo sapiens
cagctcttggagcctccagtaa

SEQ ID NO: 7216802 - DNA, 22 bp, Homo sapiens
cagctctttactctgcaatgat

SEQ ID NO: 7216803 - DNA, 22 bp, Homo sapiens
cagctctttattgccaatattc

SEQ ID NO: 7216804 - DNA, 22 bp, Homo sapiens
cagctgagctgccagactactg

SEQ ID NO: 7216805 - DNA, 22 bp, Homo sapiens
cagctgagctgccagactactg

SEQ ID NO: 7216806 - DNA, 22 bp, Homo sapiens
cagctgagcatcactagtctgg

SEQ ID NO: 7216807 - DNA, 22 bp, Homo sapiens
cagctgagctcccaggccatca

SEQ ID NO: 7216808 - DNA, 23 bp, Homo sapiens
cagctgaagcagcctgggctgga

SEQ ID NO: 7216809 - DNA, 22 bp, Homo sapiens
cagctgagcatcactagtctgg

SEQ ID NO: 7216810 - DNA, 22 bp, Homo sapiens
cagctgagcatcactagtctgg

SEQ ID NO: 7216811 - DNA, 23 bp, Homo sapiens
cagctgaagcagcctgggctgga

SEQ ID NO: 7216812 - DNA, 22 bp, Homo sapiens
cagctgaagagaggtgctgagt

SEQ ID NO: 7216813 - DNA, 22 bp, Homo sapiens
cagctgaagagaggtgctgagt

SEQ ID NO: 7216814 - DNA, 22 bp, Homo sapiens
cagctgaagaaagagtggttag

SEQ ID NO: 7216815 - DNA, 22 bp, Homo sapiens
cagctgaggtcaaagaagcagg

SEQ ID NO: 7216816 - DNA, 18 bp, Homo sapiens
cagctgaggaccaaactg

SEQ ID NO: 7216817 - DNA, 22 bp, Homo sapiens
cagctgaggaatactagatgta

SEQ ID NO: 7216818 - DNA, 22 bp, Homo sapiens
cagctgagctgccagactactg

SEQ ID NO: 7216819 - DNA, 22 bp, Homo sapiens
cagctgaggaatactagatgta

SEQ ID NO: 7216820 - DNA, 22 bp, Homo sapiens
cagctgaggaatactagatgta

SEQ ID NO: 7216821 - DNA, 22 bp, Homo sapiens
cagctgaggaatactagatgta

SEQ ID NO: 7216822 - DNA, 22 bp, Homo sapiens
cagctgagtttccaagtctgcc

SEQ ID NO: 7216823 - DNA, 22 bp, Homo sapiens
gtggcctgtcagaagccgtggg

SEQ ID NO: 7216824 - DNA, 22 bp, Homo sapiens
gtggcctgtcagaagccgtggg

SEQ ID NO: 7216825 - DNA, 22 bp, Homo sapiens
gtggcctgtcagaagccgtggg

SEQ ID NO: 7216826 - DNA, 20 bp, Homo sapiens
gtggcctgtcctgttgtggg

SEQ ID NO: 7216827 - DNA, 22 bp, Homo sapiens
gtggcctgtgctgtctccccaa

SEQ ID NO: 7216828 - DNA, 22 bp, Homo sapiens
gtggccttaggacacgtttatt

SEQ ID NO: 7216829 - DNA, 22 bp, Homo sapiens
cagctgagttactctgaggtct

SEQ ID NO: 7216830 - DNA, 22 bp, Homo sapiens
cagctgagttactctgaggtct

SEQ ID NO: 7216831 - DNA, 22 bp, Homo sapiens
cagctgagtttccaagtctgcc

SEQ ID NO: 7216832 - DNA, 22 bp, Homo sapiens
gtggcttcttctgccagaagga

SEQ ID NO: 7216833 - DNA, 22 bp, Homo sapiens
gtggcttggaccagtcacagtg

SEQ ID NO: 7216834 - DNA, 22 bp, Homo sapiens
gtgggaagaacttcaagtggct

SEQ ID NO: 7216835 - DNA, 22 bp, Homo sapiens
gtgggaagaacttcaagtggct

SEQ ID NO: 7216836 - DNA, 22 bp, Homo sapiens
gtgggaagaacttcaagtggct

SEQ ID NO: 7216837 - DNA, 22 bp, Homo sapiens
gtgggaagaacttcaagtggct

SEQ ID NO: 7216838 - DNA, 22 bp, Homo sapiens
gtgggaagaacttcaagtggct

SEQ ID NO: 7216839 - DNA, 22 bp, Homo sapiens
gtgggaagaacttcaagtggct

SEQ ID NO: 7216840 - DNA, 22 bp, Homo sapiens
gtgggaagagccaattggggta

SEQ ID NO: 7216841 - DNA, 22 bp, Homo sapiens
gtgggaagagccaattggggta

SEQ ID NO: 7216842 - DNA, 22 bp, Homo sapiens
gtgggaagtctctcggaggaag

SEQ ID NO: 7216843 - DNA, 22 bp, Homo sapiens
gtgggaagtctctcggaggaag

SEQ ID NO: 7216844 - DNA, 22 bp, Homo sapiens
gtgggaagtctctcggaggaag

SEQ ID NO: 7216845 - DNA, 22 bp, Homo sapiens
gtggctcacacctgtaatccca

SEQ ID NO: 7216846 - DNA, 22 bp, Homo sapiens
gtggctcacacctgtaatccca

SEQ ID NO: 7216847 - DNA, 22 bp, Homo sapiens
gtggctcacagcaatgtttcct

SEQ ID NO: 7216848 - DNA, 22 bp, Homo sapiens
gtggctcacagcaatgtttcct

SEQ ID NO: 7216849 - DNA, 22 bp, Homo sapiens
gtggctcacgcctgtaatccca

SEQ ID NO: 7216850 - DNA, 22 bp, Homo sapiens
gtggctcacgcctgtaatccca

SEQ ID NO: 7216851 - DNA, 22 bp, Homo sapiens
gtggctcacgtctgtcatctca

SEQ ID NO: 7216852 - DNA, 22 bp, Homo sapiens
gtggctcacgtctgtcatctca

SEQ ID NO: 7216853 - DNA, 22 bp, Homo sapiens
gtggctcacgtctgtcatctca

SEQ ID NO: 7216854 - DNA, 22 bp, Homo sapiens
gtggcgcagagggtggcagaga

SEQ ID NO: 7216855 - DNA, 22 bp, Homo sapiens
gtggcgcagagggtggcagaga

SEQ ID NO: 7216856 - DNA, 22 bp, Homo sapiens
gtggcgcagagggtggcagaga

SEQ ID NO: 7216857 - DNA, 22 bp, Homo sapiens
gtggccttgctcacatgtccag

SEQ ID NO: 7216858 - DNA, 22 bp, Homo sapiens
gtggccttgctcacatgtccag

SEQ ID NO: 7216859 - DNA, 22 bp, Homo sapiens
gtggccttggcttctaccctga

SEQ ID NO: 7216860 - DNA, 22 bp, Homo sapiens
gtggccttggcttctaccctga

SEQ ID NO: 7216861 - DNA, 22 bp, Homo sapiens
gtggccttgggcactgaccttg

SEQ ID NO: 7216862 - DNA, 22 bp, Homo sapiens
gtggggaggcctaagcaagttg

SEQ ID NO: 7216863 - DNA, 22 bp, Homo sapiens
gtgggcagtggggtcttctgcc

SEQ ID NO: 7216864 - DNA, 22 bp, Homo sapiens
gtggggaggcctaagcaagttg

SEQ ID NO: 7216865 - DNA, 22 bp, Homo sapiens
gtggggagggagatgctgaagt

SEQ ID NO: 7216866 - DNA, 22 bp, Homo sapiens
gtgggcagtggtttgcgcggtc

SEQ ID NO: 7216867 - DNA, 22 bp, Homo sapiens
gtgggcagtggggtcttctgcc

SEQ ID NO: 7216868 - DNA, 22 bp, Homo sapiens
gtgggcagtggggtcttctgcc

SEQ ID NO: 7216869 - DNA, 22 bp, Homo sapiens
gtgggcagtgcctgacggatga

SEQ ID NO: 7216870 - DNA, 22 bp, Homo sapiens
gtgggcaggtaggcaccagcta

SEQ ID NO: 7216871 - DNA, 22 bp, Homo sapiens
gtgggcaggtaggcaccagcta

SEQ ID NO: 7216872 - DNA, 22 bp, Homo sapiens
gtgggcaggtaggcaccagcta

SEQ ID NO: 7216873 - DNA, 22 bp, Homo sapiens
gtgggcagtcatgaaatctaga

SEQ ID NO: 7216874 - DNA, 22 bp, Homo sapiens
gtgggcagtgcctgacggatga

SEQ ID NO: 7216875 - DNA, 22 bp, Homo sapiens
gtgggcagtgcctgacggatga

SEQ ID NO: 7216876 - DNA, 22 bp, Homo sapiens
gtgggcaggccctaggcgattt

SEQ ID NO: 7216877 - DNA, 22 bp, Homo sapiens
gtgggcagggttgctttctccg

SEQ ID NO: 7216878 - DNA, 22 bp, Homo sapiens
gtgggcaggtaggcaccagcta

SEQ ID NO: 7216879 - DNA, 22 bp, Homo sapiens
gtgggcaggtaggcaccagcta

SEQ ID NO: 7216880 - DNA, 22 bp, Homo sapiens
gtgggcaggtaggcaccagcta

SEQ ID NO: 7216881 - DNA, 22 bp, Homo sapiens
gtgggcaggccctaggcgattt

SEQ ID NO: 7216882 - DNA, 22 bp, Homo sapiens
gtgggcaggccctaggcgattt

SEQ ID NO: 7216883 - DNA, 22 bp, Homo sapiens
gtgggcaggccctaggcgattt

SEQ ID NO: 7216884 - DNA, 22 bp, Homo sapiens
gtgggcaggccctaggcgattt

SEQ ID NO: 7216885 - DNA, 22 bp, Homo sapiens
gtgggcaggccctaggcgattt

SEQ ID NO: 7216886 - DNA, 22 bp, Homo sapiens
gtgggcaggccccaaagcaggg

SEQ ID NO: 7216887 - DNA, 22 bp, Homo sapiens
gtgggcaggagtgagcaacagg

SEQ ID NO: 7216888 - DNA, 22 bp, Homo sapiens
gtgggcaggccccaaagcaggg

SEQ ID NO: 7216889 - DNA, 22 bp, Homo sapiens
gtgggcaggccccaaagcaggg

SEQ ID NO: 7216890 - DNA, 22 bp, Homo sapiens
gtgggcaggccccaaagcaggg

SEQ ID NO: 7216891 - DNA, 22 bp, Homo sapiens
gtgggcaggccccaaagcaggg

SEQ ID NO: 7216892 - DNA, 22 bp, Homo sapiens
gtgggcaggagtgagcaacagg

SEQ ID NO: 7216893 - DNA, 22 bp, Homo sapiens
gtgggcaggaggccctgccctg

SEQ ID NO: 7216894 - DNA, 22 bp, Homo sapiens
gtgggcaggaggccctgccctg

SEQ ID NO: 7216895 - DNA, 22 bp, Homo sapiens
gtgggacagtcagaagtgagca

SEQ ID NO: 7216896 - DNA, 22 bp, Homo sapiens
gtgggacagtcagaagtgagca

SEQ ID NO: 7216897 - DNA, 22 bp, Homo sapiens
gtgggacagcggggtgggacag

SEQ ID NO: 7216898 - DNA, 22 bp, Homo sapiens
gtgggacagcggggtgggacag

SEQ ID NO: 7216899 - DNA, 22 bp, Homo sapiens
gtgggacaggtcaaatcttaaa

SEQ ID NO: 7216900 - DNA, 22 bp, Homo sapiens
caggcaagatccagaggctgct

SEQ ID NO: 7216901 - DNA, 22 bp, Homo sapiens
caggcaagatccagaggctgct

SEQ ID NO: 7216902 - DNA, 19 bp, Homo sapiens
caggattgtttaaagcttt

SEQ ID NO: 7216903 - DNA, 22 bp, Homo sapiens
caggcaacgtccttagagatgc

SEQ ID NO: 7216904 - DNA, 22 bp, Homo sapiens
caggcaacgtccttagagatgc

SEQ ID NO: 7216905 - DNA, 22 bp, Homo sapiens
caggcaagatccagaggctgct

SEQ ID NO: 7216906 - DNA, 22 bp, Homo sapiens
caggcaagatccagaggctgct

SEQ ID NO: 7216907 - DNA, 22 bp, Homo sapiens
caggattaaggtgaggggagta

SEQ ID NO: 7216908 - DNA, 22 bp, Homo sapiens
caggatgttgctcccatgtccc

SEQ ID NO: 7216909 - DNA, 22 bp, Homo sapiens
caggattgaatgcttctccctg

SEQ ID NO: 7216910 - DNA, 22 bp, Homo sapiens
caggatggtgtgagtgtgagga

SEQ ID NO: 7216911 - DNA, 22 bp, Homo sapiens
caggatggtggcatgatcagaa

SEQ ID NO: 7216912 - DNA, 22 bp, Homo sapiens
caggatggtggcatgatcagaa

SEQ ID NO: 7216913 - DNA, 22 bp, Homo sapiens
caggatggtggcatgatcagaa

SEQ ID NO: 7216914 - DNA, 22 bp, Homo sapiens
caggatggtgtgagtgtgagga

SEQ ID NO: 7216915 - DNA, 22 bp, Homo sapiens
caggatggtgtgagtgtgagga

SEQ ID NO: 7216916 - DNA, 22 bp, Homo sapiens
caggcaagattagagatgagca

SEQ ID NO: 7216917 - DNA, 22 bp, Homo sapiens
caggcaagcaaggggtcttgaa

SEQ ID NO: 7216918 - DNA, 22 bp, Homo sapiens
caggcaagattagagatgagca

SEQ ID NO: 7216919 - DNA, 22 bp, Homo sapiens
caggcaagattagagatgagca

SEQ ID NO: 7216920 - DNA, 22 bp, Homo sapiens
caggcaagcacggtgaacctgg

SEQ ID NO: 7216921 - DNA, 22 bp, Homo sapiens
caggcaaggaggcactgaggga

SEQ ID NO: 7216922 - DNA, 22 bp, Homo sapiens
caggcaaggaggcactgaggga

SEQ ID NO: 7216923 - DNA, 22 bp, Homo sapiens
caggcaaggaggcactgaggga

SEQ ID NO: 7216924 - DNA, 22 bp, Homo sapiens
caggcaaggaggcactgaggga

SEQ ID NO: 7216925 - DNA, 22 bp, Homo sapiens
caggcaagttcatttccaggca

SEQ ID NO: 7216926 - DNA, 22 bp, Homo sapiens
caggcacaaaaggaccccagca

SEQ ID NO: 7216927 - DNA, 22 bp, Homo sapiens
caggcacaaaaggaccccagca

SEQ ID NO: 7216928 - DNA, 22 bp, Homo sapiens
caggcacaaaaggaccccagca

SEQ ID NO: 7216929 - DNA, 22 bp, Homo sapiens
caggcacaaatttctagataag

SEQ ID NO: 7216930 - DNA, 22 bp, Homo sapiens
caggcacaaatttctagataag

SEQ ID NO: 7216931 - DNA, 22 bp, Homo sapiens
caggcacaaaaggaccccagca

SEQ ID NO: 7216932 - DNA, 22 bp, Homo sapiens
caggcacaaatttctagataag

SEQ ID NO: 7216933 - DNA, 22 bp, Homo sapiens
caggcacaagatcggctagata

SEQ ID NO: 7216934 - DNA, 22 bp, Homo sapiens
caggcacaatgagcgccatctt

SEQ ID NO: 7216935 - DNA, 22 bp, Homo sapiens
caggcacaatgagcgccatctt

SEQ ID NO: 7216936 - DNA, 22 bp, Homo sapiens
caggcacagacgcaaacttctt

SEQ ID NO: 7216937 - DNA, 22 bp, Homo sapiens
caggcacaagaagcaaatgtta

SEQ ID NO: 7216938 - DNA, 22 bp, Homo sapiens
caggcacaagaagcaaatgtta

SEQ ID NO: 7216939 - DNA, 22 bp, Homo sapiens
caggcacaagatcggctagata

SEQ ID NO: 7216940 - DNA, 22 bp, Homo sapiens
caggcacagagagaataccttt

SEQ ID NO: 7216941 - DNA, 22 bp, Homo sapiens
caggcacagagagaataccttt

SEQ ID NO: 7216942 - DNA, 22 bp, Homo sapiens
caggcacagagttattcattta

SEQ ID NO: 7216943 - DNA, 22 bp, Homo sapiens
caggcacagagttattcattta

SEQ ID NO: 7216944 - DNA, 22 bp, Homo sapiens
caggcacagagttattcattta

SEQ ID NO: 7216945 - DNA, 22 bp, Homo sapiens
caggcacagctaagactggcca

SEQ ID NO: 7216946 - DNA, 22 bp, Homo sapiens
caggcacagctaagactggcca

SEQ ID NO: 7216947 - DNA, 22 bp, Homo sapiens
caggcacagctaagactggcca

SEQ ID NO: 7216948 - DNA, 22 bp, Homo sapiens
caggcacagctaagactggcca

SEQ ID NO: 7216949 - DNA, 22 bp, Homo sapiens
caggcacagctgggcaattgcg

SEQ ID NO: 7216950 - DNA, 22 bp, Homo sapiens
caggcacagctgggcaattgcg

SEQ ID NO: 7216951 - DNA, 22 bp, Homo sapiens
caggcacaggggaatgtctttt

SEQ ID NO: 7216952 - DNA, 22 bp, Homo sapiens
caggcacaggggaatgtctttt

SEQ ID NO: 7216953 - DNA, 22 bp, Homo sapiens
caggcacagtggggtcctctct

SEQ ID NO: 7216954 - DNA, 22 bp, Homo sapiens
caggcacagtggggtcctctct

SEQ ID NO: 7216955 - DNA, 22 bp, Homo sapiens
caggcacagtggggtcctctct

SEQ ID NO: 7216956 - DNA, 22 bp, Homo sapiens
caggcacagtggggtcctctct

SEQ ID NO: 7216957 - DNA, 22 bp, Homo sapiens
caggcaccaacttcctggggag

SEQ ID NO: 7216958 - DNA, 19 bp, Homo sapiens
taagacacaaatgcaagcc

SEQ ID NO: 7216959 - DNA, 22 bp, Homo sapiens
taagacacagtccgcactctct

SEQ ID NO: 7216960 - DNA, 22 bp, Homo sapiens
taagacacaaatatcttttaca

SEQ ID NO: 7216961 - DNA, 22 bp, Homo sapiens
taagacaattcttcagtcacaa

SEQ ID NO: 7216962 - DNA, 22 bp, Homo sapiens
caggcacagtggggtcctctct

SEQ ID NO: 7216963 - DNA, 22 bp, Homo sapiens
caggcacagtggggtcctctct

SEQ ID NO: 7216964 - DNA, 22 bp, Homo sapiens
caggcacagtgttgctgttcaa

SEQ ID NO: 7216965 - DNA, 22 bp, Homo sapiens
caggcacagtgttgctgttcaa

SEQ ID NO: 7216966 - DNA, 22 bp, Homo sapiens
caggcacagttccaagcatttt

SEQ ID NO: 7216967 - DNA, 22 bp, Homo sapiens
caggcacagttccaagcatttt

SEQ ID NO: 7216968 - DNA, 22 bp, Homo sapiens
caggcacagttccaagcatttt

SEQ ID NO: 7216969 - DNA, 22 bp, Homo sapiens
caggcacagttccaagcatttt

SEQ ID NO: 7216970 - DNA, 17 bp, Homo sapiens
caggcacatgaagccag

SEQ ID NO: 7216971 - DNA, 17 bp, Homo sapiens
caggcacatgaagccag

SEQ ID NO: 7216972 - DNA, 17 bp, Homo sapiens
caggcacatgaagccag

SEQ ID NO: 7216973 - DNA, 17 bp, Homo sapiens
caggcacatgaagccag

SEQ ID NO: 7216974 - DNA, 17 bp, Homo sapiens
caggcacatgaagccag

SEQ ID NO: 7216975 - DNA, 22 bp, Homo sapiens
caggcacatgggagctcatcat

SEQ ID NO: 7216976 - DNA, 22 bp, Homo sapiens
caggcacatgggagctcatcat

SEQ ID NO: 7216977 - DNA, 22 bp, Homo sapiens
caggcacatgggagctcatcat

SEQ ID NO: 7216978 - DNA, 22 bp, Homo sapiens
caggcacatgggagctcatcat

SEQ ID NO: 7216979 - DNA, 22 bp, Homo sapiens
caggcactagcagaatgaggct

SEQ ID NO: 7216980 - DNA, 22 bp, Homo sapiens
caggcactagcagaatgaggct

SEQ ID NO: 7216981 - DNA, 22 bp, Homo sapiens
caggcactagcagaatgaggct

SEQ ID NO: 7216982 - DNA, 22 bp, Homo sapiens
caggcactagcagaatgaggct

SEQ ID NO: 7216983 - DNA, 22 bp, Homo sapiens
taaggcagccgctcagagaggt

SEQ ID NO: 7216984 - DNA, 22 bp, Homo sapiens
taaggcagccgctcagagaggt

SEQ ID NO: 7216985 - DNA, 22 bp, Homo sapiens
taaggcagccgctcagagaggt

SEQ ID NO: 7216986 - DNA, 22 bp, Homo sapiens
taaggcagccgctcagagaggt

SEQ ID NO: 7216987 - DNA, 22 bp, Homo sapiens
caggcacggtggctcatgcctg

SEQ ID NO: 7216988 - DNA, 22 bp, Homo sapiens
caggcactcagtctggatccct

SEQ ID NO: 7216989 - DNA, 22 bp, Homo sapiens
caggcactagcagaatgaggct

SEQ ID NO: 7216990 - DNA, 22 bp, Homo sapiens
caggcactttgctgggggcgca

SEQ ID NO: 7216991 - DNA, 22 bp, Homo sapiens
caggcagaaattttgtttcatt

SEQ ID NO: 7216992 - DNA, 22 bp, Homo sapiens
taaggcagatgtggaatcaatt

SEQ ID NO: 7216993 - DNA, 22 bp, Homo sapiens
taaggcagatgtggaatcaatt

SEQ ID NO: 7216994 - DNA, 22 bp, Homo sapiens
taaggcagaaatatgagcaggg

SEQ ID NO: 7216995 - DNA, 22 bp, Homo sapiens
taaggcagaaatatgagcaggg

SEQ ID NO: 7216996 - DNA, 22 bp, Homo sapiens
taaggcagatgtggaatcaatt

SEQ ID NO: 7216997 - DNA, 19 bp, Homo sapiens
taaggcagcagtgacaggc

SEQ ID NO: 7216998 - DNA, 22 bp, Homo sapiens
taaggcagccgctcagagaggt

SEQ ID NO: 7216999 - DNA, 22 bp, Homo sapiens
taaggcagaaatatgagcaggg

SEQ ID NO: 7217000 - DNA, 22 bp, Homo sapiens
taaggcacgcggtgaatgccaa

SEQ ID NO: 7217001 - DNA, 22 bp, Homo sapiens
taaggcacccgtgagctgccag

SEQ ID NO: 7217002 - DNA, 22 bp, Homo sapiens
taaggcacctgtccaggctggg

SEQ ID NO: 7217003 - DNA, 22 bp, Homo sapiens
taaggcacgcataagagggggc

SEQ ID NO: 7217004 - DNA, 22 bp, Homo sapiens
taaggcacgcataagagggggc

SEQ ID NO: 7217005 - DNA, 22 bp, Homo sapiens
taagcaaatagctagatcagag

SEQ ID NO: 7217006 - DNA, 22 bp, Homo sapiens
taagcaaatagctagatcagag

SEQ ID NO: 7217007 - DNA, 22 bp, Homo sapiens
taagcaacaaatggtttctgat

SEQ ID NO: 7217008 - DNA, 22 bp, Homo sapiens
taagcaacaaggtgtttaaatt

SEQ ID NO: 7217009 - DNA, 22 bp, Homo sapiens
taaggcacacagttgctgcatg

SEQ ID NO: 7217010 - DNA, 22 bp, Homo sapiens
taaggcacacagttgctgcatg

SEQ ID NO: 7217011 - DNA, 22 bp, Homo sapiens
taaggcacccgtgagctgccag

SEQ ID NO: 7217012 - DNA, 22 bp, Homo sapiens
taagcaaaggattttgatcttt

SEQ ID NO: 7217013 - DNA, 22 bp, Homo sapiens
taagcaaaggattttgatcttt

SEQ ID NO: 7217014 - DNA, 22 bp, Homo sapiens
taagcaaagtttataaggctct

SEQ ID NO: 7217015 - DNA, 22 bp, Homo sapiens
taagcaaataatgcatcaaggg

SEQ ID NO: 7217016 - DNA, 22 bp, Homo sapiens
taagcaaataatgcatcaaggg

SEQ ID NO: 7217017 - DNA, 22 bp, Homo sapiens
taagcaaataatgcatcaaggg

SEQ ID NO: 7217018 - DNA, 22 bp, Homo sapiens
taagcaaataatgcatcaaggg

SEQ ID NO: 7217019 - DNA, 22 bp, Homo sapiens
taagcaaaagtcgagtgtgagc

SEQ ID NO: 7217020 - DNA, 22 bp, Homo sapiens
taagcaaaagtcgagtgtgagc

SEQ ID NO: 7217021 - DNA, 22 bp, Homo sapiens
taagcaaaggattttgatcttt

SEQ ID NO: 7217022 - DNA, 22 bp, Homo sapiens
taagatttttaaaatgtcctca

SEQ ID NO: 7217023 - DNA, 22 bp, Homo sapiens
taagattatttggaggccaaga

SEQ ID NO: 7217024 - DNA, 22 bp, Homo sapiens
taagattatacttaaagagaaa

SEQ ID NO: 7217025 - DNA, 22 bp, Homo sapiens
taagattacagtgagaaataaa

SEQ ID NO: 7217026 - DNA, 22 bp, Homo sapiens
taagatgtcaaagggtcacagt

SEQ ID NO: 7217027 - DNA, 23 bp, Homo sapiens
taagacacccgactccagagatg

SEQ ID NO: 7217028 - DNA, 23 bp, Homo sapiens
taagacacccgactccagagatg

SEQ ID NO: 7217029 - DNA, 22 bp, Homo sapiens
taagacacattggagtagatga

SEQ ID NO: 7217030 - DNA, 22 bp, Homo sapiens
taagacacattggagtagatga

SEQ ID NO: 7217031 - DNA, 22 bp, Homo sapiens
taagacacattggagtagatga

SEQ ID NO: 7217032 - DNA, 22 bp, Homo sapiens
taagacacatgcgtacaagata

SEQ ID NO: 7217033 - DNA, 22 bp, Homo sapiens
taagacacatgcgtacaagata

SEQ ID NO: 7217034 - DNA, 22 bp, Homo sapiens
taagacacatgcgtacaagata

SEQ ID NO: 7217035 - DNA, 22 bp, Homo sapiens
taagacacatgcgtacaagata

SEQ ID NO: 7217036 - DNA, 22 bp, Homo sapiens
taacaatacccattctaattac

SEQ ID NO: 7217037 - DNA, 22 bp, Homo sapiens
taacaatacccattctaattac

SEQ ID NO: 7217038 - DNA, 22 bp, Homo sapiens
taacaatacccattctaattac

SEQ ID NO: 7217039 - DNA, 22 bp, Homo sapiens
taacaatacccattctaattac

SEQ ID NO: 7217040 - DNA, 22 bp, Homo sapiens
taacaatacccattctaattac

SEQ ID NO: 7217041 - DNA, 22 bp, Homo sapiens
taacactgtgtctgccatatcc

SEQ ID NO: 7217042 - DNA, 20 bp, Homo sapiens
taacacttgctttttgactt

SEQ ID NO: 7217043 - DNA, 22 bp, Homo sapiens
taacacttgggggcatccttag

SEQ ID NO: 7217044 - DNA, 22 bp, Homo sapiens
taacactttggattaaaattct

SEQ ID NO: 7217045 - DNA, 22 bp, Homo sapiens
taacactttggattaaaattct

SEQ ID NO: 7217046 - DNA, 22 bp, Homo sapiens
taacagaaaagaactgagtttg

SEQ ID NO: 7217047 - DNA, 22 bp, Homo sapiens
taacagaaaagaactgagtttg

SEQ ID NO: 7217048 - DNA, 22 bp, Homo sapiens
taacagaaaagaactgagtttg

SEQ ID NO: 7217049 - DNA, 22 bp, Homo sapiens
taacagaaacagataagtgtaa

SEQ ID NO: 7217050 - DNA, 22 bp, Homo sapiens
taacagaaacagataagtgtaa

SEQ ID NO: 7217051 - DNA, 22 bp, Homo sapiens
taacagaaacagataagtgtaa

SEQ ID NO: 7217052 - DNA, 22 bp, Homo sapiens
taacagaaacagataagtgtaa

SEQ ID NO: 7217053 - DNA, 22 bp, Homo sapiens
taacagaaacagataagtgtaa

SEQ ID NO: 7217054 - DNA, 22 bp, Homo sapiens
taacagaaaggctcaggtgctc

SEQ ID NO: 7217055 - DNA, 22 bp, Homo sapiens
taacagaaaggctcaggtgctc

SEQ ID NO: 7217056 - DNA, 22 bp, Homo sapiens
taacagaaaggctcaggtgctc

SEQ ID NO: 7217057 - DNA, 22 bp, Homo sapiens
taacagaaaggctcaggtgctc

SEQ ID NO: 7217058 - DNA, 22 bp, Homo sapiens
taacagaaaggggacagaaata

SEQ ID NO: 7217059 - DNA, 22 bp, Homo sapiens
taacagaaaggggacagaaata

SEQ ID NO: 7217060 - DNA, 19 bp, Homo sapiens
taacaaagtctgaagtcag

SEQ ID NO: 7217061 - DNA, 22 bp, Homo sapiens
taacaagagcacctgggaatgg

SEQ ID NO: 7217062 - DNA, 22 bp, Homo sapiens
taacaagatgtcactcctgtcc

SEQ ID NO: 7217063 - DNA, 19 bp, Homo sapiens
taacaagcactctgcattc

SEQ ID NO: 7217064 - DNA, 22 bp, Homo sapiens
taacaaggtggtcttggtattt

SEQ ID NO: 7217065 - DNA, 22 bp, Homo sapiens
taacaagtcattttatcagcag

SEQ ID NO: 7217066 - DNA, 22 bp, Homo sapiens
taacattaggtagacataagcc

SEQ ID NO: 7217067 - DNA, 20 bp, Homo sapiens
taacagaagtagaagtgggt

SEQ ID NO: 7217068 - DNA, 22 bp, Homo sapiens
taacagaagttgttcattgtgg

SEQ ID NO: 7217069 - DNA, 22 bp, Homo sapiens
taacagaagttgttcattgtgg

SEQ ID NO: 7217070 - DNA, 22 bp, Homo sapiens
taacagaagttgttcattgtgg

SEQ ID NO: 7217071 - DNA, 22 bp, Homo sapiens
taacattgtcagttcaactgct

SEQ ID NO: 7217072 - DNA, 22 bp, Homo sapiens
taacattgtcagttcaactgct

SEQ ID NO: 7217073 - DNA, 22 bp, Homo sapiens
taacattgagtccactaaacag

SEQ ID NO: 7217074 - DNA, 22 bp, Homo sapiens
taacatttaaatttttcacata

SEQ ID NO: 7217075 - DNA, 22 bp, Homo sapiens
taacatttaaatttttcacata

SEQ ID NO: 7217076 - DNA, 22 bp, Homo sapiens
taacattgttatgaatcaggtc

SEQ ID NO: 7217077 - DNA, 22 bp, Homo sapiens
taacattgttatgaatcaggtc

SEQ ID NO: 7217078 - DNA, 22 bp, Homo sapiens
taacattccatggatctgcaga

SEQ ID NO: 7217079 - DNA, 22 bp, Homo sapiens
taacattccatggatctgcaga

SEQ ID NO: 7217080 - DNA, 22 bp, Homo sapiens
taacagaaaggggacagaaata

SEQ ID NO: 7217081 - DNA, 22 bp, Homo sapiens
taacagaaaggggacagaaata

SEQ ID NO: 7217082 - DNA, 22 bp, Homo sapiens
taacagaaaggggacagaaata

SEQ ID NO: 7217083 - DNA, 22 bp, Homo sapiens
taacagaaaggggacagaaata

SEQ ID NO: 7217084 - DNA, 22 bp, Homo sapiens
taacagaaatagaaatgagagt

SEQ ID NO: 7217085 - DNA, 22 bp, Homo sapiens
taacagaaatagaaatgagagt

SEQ ID NO: 7217086 - DNA, 22 bp, Homo sapiens
taacagaaatagaaatgagagt

SEQ ID NO: 7217087 - DNA, 22 bp, Homo sapiens
taacagaaatagaaatgagagt

SEQ ID NO: 7217088 - DNA, 22 bp, Homo sapiens
taacagaaatagaaatgagagt

SEQ ID NO: 7217089 - DNA, 22 bp, Homo sapiens
taacagaaatagtaggtgaggg

SEQ ID NO: 7217090 - DNA, 22 bp, Homo sapiens
taacagaaatagtaggtgaggg

SEQ ID NO: 7217091 - DNA, 22 bp, Homo sapiens
taacagaaatagtaggtgaggg

SEQ ID NO: 7217092 - DNA, 22 bp, Homo sapiens
taacagaaatagtaggtgaggg

SEQ ID NO: 7217093 - DNA, 22 bp, Homo sapiens
taacagaaatatttccaggtga

SEQ ID NO: 7217094 - DNA, 22 bp, Homo sapiens
taacagaaatatttccaggtga

SEQ ID NO: 7217095 - DNA, 22 bp, Homo sapiens
taacagaaatatttccaggtga

SEQ ID NO: 7217096 - DNA, 22 bp, Homo sapiens
taacagaaattttagttagggg

SEQ ID NO: 7217097 - DNA, 22 bp, Homo sapiens
taacagaaattttagttagggg

SEQ ID NO: 7217098 - DNA, 22 bp, Homo sapiens
taacagaaattttagttagggg

SEQ ID NO: 7217099 - DNA, 22 bp, Homo sapiens
taacagaaattttagttagggg

SEQ ID NO: 7217100 - DNA, 22 bp, Homo sapiens
taacagaagaaaacatattgga

SEQ ID NO: 7217101 - DNA, 22 bp, Homo sapiens
taacagaagaaaacatattgga

SEQ ID NO: 7217102 - DNA, 22 bp, Homo sapiens
taacagaagaaaacatattgga

SEQ ID NO: 7217103 - DNA, 22 bp, Homo sapiens
taacagaagaaaacatattgga

SEQ ID NO: 7217104 - DNA, 22 bp, Homo sapiens
taacagaagagcaggcagccct

SEQ ID NO: 7217105 - DNA, 22 bp, Homo sapiens
taacagaagatgaaacttcttt

SEQ ID NO: 7217106 - DNA, 22 bp, Homo sapiens
taacagaagagcaggcagccct

SEQ ID NO: 7217107 - DNA, 22 bp, Homo sapiens
taacagaagagcaggcagccct

SEQ ID NO: 7217108 - DNA, 22 bp, Homo sapiens
taacagaagatgaaacttcttt

SEQ ID NO: 7217109 - DNA, 22 bp, Homo sapiens
taacagaagatgaaacttcttt

SEQ ID NO: 7217110 - DNA, 22 bp, Homo sapiens
taacagaagatgaaacttcttt

SEQ ID NO: 7217111 - DNA, 22 bp, Homo sapiens
taacagaagatgaaacttcttt

SEQ ID NO: 7217112 - DNA, 20 bp, Homo sapiens
taacagaagtagaagtgggt

SEQ ID NO: 7217113 - DNA, 20 bp, Homo sapiens
taacagaagtagaagtgggt

SEQ ID NO: 7217114 - DNA, 19 bp, Homo sapiens
taacttgtagatatgaagt

SEQ ID NO: 7217115 - DNA, 22 bp, Homo sapiens
taacttgagctctcagtgctat

SEQ ID NO: 7217116 - DNA, 19 bp, Homo sapiens
taacttgtagatatgaagt

SEQ ID NO: 7217117 - DNA, 22 bp, Homo sapiens
taacttgtgttacattactctt

SEQ ID NO: 7217118 - DNA, 22 bp, Homo sapiens
taacttctttggtttaaagaga

SEQ ID NO: 7217119 - DNA, 16 bp, Homo sapiens
taacatttttaaaagg

SEQ ID NO: 7217120 - DNA, 22 bp, Homo sapiens
taacatttaaatttttcacata

SEQ ID NO: 7217121 - DNA, 22 bp, Homo sapiens
taacatttagaaagtgtccatt

SEQ ID NO: 7217122 - DNA, 22 bp, Homo sapiens
taacatttcggtgacagtggga

SEQ ID NO: 7217123 - DNA, 22 bp, Homo sapiens
taacatttcggtgacagtggga

SEQ ID NO: 7217124 - DNA, 22 bp, Homo sapiens
taacatttgctgtctcctatgt

SEQ ID NO: 7217125 - DNA, 22 bp, Homo sapiens
taacatttgctgtctcctatgt

SEQ ID NO: 7217126 - DNA, 21 bp, Homo sapiens
taacttttgtgcctatcttgt

SEQ ID NO: 7217127 - DNA, 21 bp, Homo sapiens
taacttttgtgcctatcttgt

SEQ ID NO: 7217128 - DNA, 22 bp, Homo sapiens
taacttttctaggtgtgataat

SEQ ID NO: 7217129 - DNA, 22 bp, Homo sapiens
taagaaacatgatacttttcct

SEQ ID NO: 7217130 - DNA, 22 bp, Homo sapiens
taactttagtgtatgaggtaag

SEQ ID NO: 7217131 - DNA, 22 bp, Homo sapiens
taactttaggaataggtaatct

SEQ ID NO: 7217132 - DNA, 22 bp, Homo sapiens
taactttagtgtatgaggtaag

SEQ ID NO: 7217133 - DNA, 22 bp, Homo sapiens
taactttcacatcacactgact

SEQ ID NO: 7217134 - DNA, 22 bp, Homo sapiens
taactttgaagggaattttact

SEQ ID NO: 7217135 - DNA, 22 bp, Homo sapiens
taactttgatcacttgataagg

SEQ ID NO: 7217136 - DNA, 22 bp, Homo sapiens
caggatgaggtagaggcagata

SEQ ID NO: 7217137 - DNA, 22 bp, Homo sapiens
caggatgaggtagaggcagata

SEQ ID NO: 7217138 - DNA, 22 bp, Homo sapiens
caggatgaggtagaggcagata

SEQ ID NO: 7217139 - DNA, 22 bp, Homo sapiens
caggatgagaggcccagggaag

SEQ ID NO: 7217140 - DNA, 22 bp, Homo sapiens
caggatgaccatatgttccagt

SEQ ID NO: 7217141 - DNA, 22 bp, Homo sapiens
caggatgaggtagaggcagata

SEQ ID NO: 7217142 - DNA, 18 bp, Homo sapiens
caggatgagtgatgggga

SEQ ID NO: 7217143 - DNA, 18 bp, Homo sapiens
caggatgagtgatgggga

SEQ ID NO: 7217144 - DNA, 19 bp, Homo sapiens
caggatgatcccatgacac

SEQ ID NO: 7217145 - DNA, 22 bp, Homo sapiens
caggatccccaggtcgccgtcc

SEQ ID NO: 7217146 - DNA, 22 bp, Homo sapiens
caggatccctggcctccgccca

SEQ ID NO: 7217147 - DNA, 22 bp, Homo sapiens
caggatgaagggcaaaggcaag

SEQ ID NO: 7217148 - DNA, 22 bp, Homo sapiens
caggatgaagggcaaaggcaag

SEQ ID NO: 7217149 - DNA, 22 bp, Homo sapiens
caggatggtggcatgatcagaa

SEQ ID NO: 7217150 - DNA, 22 bp, Homo sapiens
caggatggtcttcatttggctc

SEQ ID NO: 7217151 - DNA, 22 bp, Homo sapiens
caggatggtcttcatttggctc

SEQ ID NO: 7217152 - DNA, 22 bp, Homo sapiens
caggatggtctcgatctcctga

SEQ ID NO: 7217153 - DNA, 22 bp, Homo sapiens
caggatggtctcgatctcctga

SEQ ID NO: 7217154 - DNA, 22 bp, Homo sapiens
caggatggagagtgaggggtca

SEQ ID NO: 7217155 - DNA, 22 bp, Homo sapiens
caggatgcttctggggccaggc

SEQ ID NO: 7217156 - DNA, 22 bp, Homo sapiens
caggatgcttctggggccaggc

SEQ ID NO: 7217157 - DNA, 22 bp, Homo sapiens
caggatgctgaaaacacgagga

SEQ ID NO: 7217158 - DNA, 22 bp, Homo sapiens
caggatgctgaaaacacgagga

SEQ ID NO: 7217159 - DNA, 22 bp, Homo sapiens
caggatgctgaaaacacgagga

SEQ ID NO: 7217160 - DNA, 22 bp, Homo sapiens
caggatggtctcgatctcctga

SEQ ID NO: 7217161 - DNA, 20 bp, Homo sapiens
caggatgattggacacgatg

SEQ ID NO: 7217162 - DNA, 22 bp, Homo sapiens
caggatgcactaggaaccaggg

SEQ ID NO: 7217163 - DNA, 22 bp, Homo sapiens
caggatgcagtgggacccaggg

SEQ ID NO: 7217164 - DNA, 22 bp, Homo sapiens
caggatgccttggacacccggt

SEQ ID NO: 7217165 - DNA, 21 bp, Homo sapiens
caggatgatgggaaggtggtg

SEQ ID NO: 7217166 - DNA, 21 bp, Homo sapiens
caggatgatgggaaggtggtg

SEQ ID NO: 7217167 - DNA, 21 bp, Homo sapiens
caggatgatgataattcatgg

SEQ ID NO: 7217168 - DNA, 22 bp, Homo sapiens
tacaggtggatcactagtatag

SEQ ID NO: 7217169 - DNA, 22 bp, Homo sapiens
tacaggtggatcactagtatag

SEQ ID NO: 7217170 - DNA, 22 bp, Homo sapiens
tacaggtgctctacagacagga

SEQ ID NO: 7217171 - DNA, 22 bp, Homo sapiens
tacaggtgctctacagacagga

SEQ ID NO: 7217172 - DNA, 22 bp, Homo sapiens
tacaggtggatcactagtatag

SEQ ID NO: 7217173 - DNA, 22 bp, Homo sapiens
tacaggttacacttttaaaagt

SEQ ID NO: 7217174 - DNA, 22 bp, Homo sapiens
tacaggtggtaaaaatattgtt

SEQ ID NO: 7217175 - DNA, 22 bp, Homo sapiens
tacaggtggtaaaaatattgtt

SEQ ID NO: 7217176 - DNA, 22 bp, Homo sapiens
tacagtaaagctgctatgaatt

SEQ ID NO: 7217177 - DNA, 22 bp, Homo sapiens
tacaggttacacttttaaaagt

SEQ ID NO: 7217178 - DNA, 22 bp, Homo sapiens
tacaggttccaggaattaggac

SEQ ID NO: 7217179 - DNA, 22 bp, Homo sapiens
tacagtaaagctgctatgaatt

SEQ ID NO: 7217180 - DNA, 22 bp, Homo sapiens
tacagtaaagctgctatgaatt

SEQ ID NO: 7217181 - DNA, 22 bp, Homo sapiens
tacagtaaatgtggtagaaact

SEQ ID NO: 7217182 - DNA, 19 bp, Homo sapiens
caggccctggacccatctg

SEQ ID NO: 7217183 - DNA, 22 bp, Homo sapiens
tacagtaaccttatttgtcatt

SEQ ID NO: 7217184 - DNA, 22 bp, Homo sapiens
tacagtaaccttatttgtcatt

SEQ ID NO: 7217185 - DNA, 22 bp, Homo sapiens
tacagtaacatgttgtacaagc

SEQ ID NO: 7217186 - DNA, 22 bp, Homo sapiens
tacagtaaccagtctacttaga

SEQ ID NO: 7217187 - DNA, 22 bp, Homo sapiens
tacagtaaccagtctacttaga

SEQ ID NO: 7217188 - DNA, 22 bp, Homo sapiens
caggccctggcagggctgagtc

SEQ ID NO: 7217189 - DNA, 22 bp, Homo sapiens
caggccctggcagggctgagtc

SEQ ID NO: 7217190 - DNA, 22 bp, Homo sapiens
caggccctggcagggctgagtc

SEQ ID NO: 7217191 - DNA, 22 bp, Homo sapiens
caggccctggcagggctgagtc

SEQ ID NO: 7217192 - DNA, 22 bp, Homo sapiens
caggccctggcagggctgagtc

SEQ ID NO: 7217193 - DNA, 22 bp, Homo sapiens
caggccctgggcaggatcagcc

SEQ ID NO: 7217194 - DNA, 22 bp, Homo sapiens
caggccctgggcaggatcagcc

SEQ ID NO: 7217195 - DNA, 22 bp, Homo sapiens
caggccctgggcaggatcagcc

SEQ ID NO: 7217196 - DNA, 22 bp, Homo sapiens
caggccctgggcaggatcagcc

SEQ ID NO: 7217197 - DNA, 22 bp, Homo sapiens
caggccctgggcaggatcagcc

SEQ ID NO: 7217198 - DNA, 22 bp, Homo sapiens
caggccctgggcaggatcagcc

SEQ ID NO: 7217199 - DNA, 22 bp, Homo sapiens
caggccctgggcaggcacagag

SEQ ID NO: 7217200 - DNA, 22 bp, Homo sapiens
caggccctgggcaggcacagag

SEQ ID NO: 7217201 - DNA, 22 bp, Homo sapiens
caggccctgggcaggcacagag

SEQ ID NO: 7217202 - DNA, 22 bp, Homo sapiens
caggccctttcctgggcatagg

SEQ ID NO: 7217203 - DNA, 22 bp, Homo sapiens
caggccggccggccccagctct

SEQ ID NO: 7217204 - DNA, 22 bp, Homo sapiens
tacagtttgtgtggagctggag

SEQ ID NO: 7217205 - DNA, 22 bp, Homo sapiens
tacagtttgttacattgttagt

SEQ ID NO: 7217206 - DNA, 22 bp, Homo sapiens
tacagtttgttacattgttagt

SEQ ID NO: 7217207 - DNA, 22 bp, Homo sapiens
tacagtttgttacattgttagt

SEQ ID NO: 7217208 - DNA, 18 bp, Homo sapiens
caggccctgtctggcctc

SEQ ID NO: 7217209 - DNA, 18 bp, Homo sapiens
caggccctgtctggcctc

SEQ ID NO: 7217210 - DNA, 18 bp, Homo sapiens
caggccctgtctggcctc

SEQ ID NO: 7217211 - DNA, 22 bp, Homo sapiens
tacatgtggagataactgaagc

SEQ ID NO: 7217212 - DNA, 22 bp, Homo sapiens
tacatgtgctatttgttttgta

SEQ ID NO: 7217213 - DNA, 22 bp, Homo sapiens
tacatgtgctgggttcttggcc

SEQ ID NO: 7217214 - DNA, 22 bp, Homo sapiens
tacatgtggagttttctagtca

SEQ ID NO: 7217215 - DNA, 22 bp, Homo sapiens
tacatgtggccagaaatttgag

SEQ ID NO: 7217216 - DNA, 22 bp, Homo sapiens
tacatcatggcttcatgctgca

SEQ ID NO: 7217217 - DNA, 22 bp, Homo sapiens
tacatcatggcttcatgctgca

SEQ ID NO: 7217218 - DNA, 22 bp, Homo sapiens
tacatgtgatcagaaagtgaaa

SEQ ID NO: 7217219 - DNA, 22 bp, Homo sapiens
tacatgtgcacgtgtgactttg

SEQ ID NO: 7217220 - DNA, 22 bp, Homo sapiens
tacatcatgaaagcatacatca

SEQ ID NO: 7217221 - DNA, 22 bp, Homo sapiens
tacatcatgaaagcatacatca

SEQ ID NO: 7217222 - DNA, 22 bp, Homo sapiens
tacatcataataatacttagaa

SEQ ID NO: 7217223 - DNA, 22 bp, Homo sapiens
tacatcataataatacttagaa

SEQ ID NO: 7217224 - DNA, 22 bp, Homo sapiens
tacatcatgaaagcatacatca

SEQ ID NO: 7217225 - DNA, 22 bp, Homo sapiens
tacatcatgaaagcatacatca

SEQ ID NO: 7217226 - DNA, 22 bp, Homo sapiens
tacatcatgaaagcatacatca

SEQ ID NO: 7217227 - DNA, 22 bp, Homo sapiens
tacatcaaatcaatgttccagt

SEQ ID NO: 7217228 - DNA, 22 bp, Homo sapiens
tacatcaaatcaatgttccagt

SEQ ID NO: 7217229 - DNA, 22 bp, Homo sapiens
tacatcaaggaacacctggtat

SEQ ID NO: 7217230 - DNA, 21 bp, Homo sapiens
tacatcagttttcttggctca

SEQ ID NO: 7217231 - DNA, 22 bp, Homo sapiens
tacatatttgtctttgtactgt

SEQ ID NO: 7217232 - DNA, 20 bp, Homo sapiens
tacatattatatcagctgca

SEQ ID NO: 7217233 - DNA, 22 bp, Homo sapiens
tacatattcaacgttcagtatt

SEQ ID NO: 7217234 - DNA, 22 bp, Homo sapiens
tacatattcaacgttcagtatt

SEQ ID NO: 7217235 - DNA, 22 bp, Homo sapiens
tacatattgtccatagttgctt

SEQ ID NO: 7217236 - DNA, 22 bp, Homo sapiens
tacatatgtaaacatgtataaa

SEQ ID NO: 7217237 - DNA, 22 bp, Homo sapiens
tacatatgtaaacatgtataaa

SEQ ID NO: 7217238 - DNA, 20 bp, Homo sapiens
tacatattatatcagctgca

SEQ ID NO: 7217239 - DNA, 20 bp, Homo sapiens
tacatattatatcagctgca

SEQ ID NO: 7217240 - DNA, 22 bp, Homo sapiens
tacatatgaactttataacttg

SEQ ID NO: 7217241 - DNA, 22 bp, Homo sapiens
tacatatagacagttactctag

SEQ ID NO: 7217242 - DNA, 22 bp, Homo sapiens
tacatatccaggctgagaagat

SEQ ID NO: 7217243 - DNA, 22 bp, Homo sapiens
tacatatgaactttataacttg

SEQ ID NO: 7217244 - DNA, 22 bp, Homo sapiens
tacagtttgttacattgttagt

SEQ ID NO: 7217245 - DNA, 22 bp, Homo sapiens
tacagtttgttacattgttagt

SEQ ID NO: 7217246 - DNA, 22 bp, Homo sapiens
tacagggtattcaagggtagtt

SEQ ID NO: 7217247 - DNA, 22 bp, Homo sapiens
tacaggtaaaattatcagaaac

SEQ ID NO: 7217248 - DNA, 22 bp, Homo sapiens
tacagggtattcaagggtagtt

SEQ ID NO: 7217249 - DNA, 22 bp, Homo sapiens
tacagggtataggtacagatga

SEQ ID NO: 7217250 - DNA, 22 bp, Homo sapiens
tacagggtattcaagggtagtt

SEQ ID NO: 7217251 - DNA, 22 bp, Homo sapiens
tacagcttaaaaaagccaactt

SEQ ID NO: 7217252 - DNA, 22 bp, Homo sapiens
tacagggctgagtgagacatgg

SEQ ID NO: 7217253 - DNA, 22 bp, Homo sapiens
tacaggggtaacagtggggaat

SEQ ID NO: 7217254 - DNA, 22 bp, Homo sapiens
tacaggtaaatgcaaacagctc

SEQ ID NO: 7217255 - DNA, 22 bp, Homo sapiens
tacaggtaagctgtcggcctag

SEQ ID NO: 7217256 - DNA, 22 bp, Homo sapiens
tacaggtagaaatgaagccaga

SEQ ID NO: 7217257 - DNA, 22 bp, Homo sapiens
tacaggtagaaatgaagccaga

SEQ ID NO: 7217258 - DNA, 22 bp, Homo sapiens
tacaggtagaaatgaagccaga

SEQ ID NO: 7217259 - DNA, 20 bp, Homo sapiens
tacaggtagaactccctggc

SEQ ID NO: 7217260 - DNA, 20 bp, Homo sapiens
tacaggtagaactccctggc

SEQ ID NO: 7217261 - DNA, 22 bp, Homo sapiens
tacaggtagaatgggtgtacag

SEQ ID NO: 7217262 - DNA, 22 bp, Homo sapiens
tacaggtagaatgggtgtacag

SEQ ID NO: 7217263 - DNA, 22 bp, Homo sapiens
tacaggtagagtctctagttta

SEQ ID NO: 7217264 - DNA, 22 bp, Homo sapiens
tacaggtagagtctctagttta

SEQ ID NO: 7217265 - DNA, 22 bp, Homo sapiens
tacaggtagagtctctagttta

SEQ ID NO: 7217266 - DNA, 22 bp, Homo sapiens
tacaggtagcaaaacctttcct

SEQ ID NO: 7217267 - DNA, 22 bp, Homo sapiens
tacaggtagggtctatgttaga

SEQ ID NO: 7217268 - DNA, 22 bp, Homo sapiens
tacaggtatgcgccaccttgtc

SEQ ID NO: 7217269 - DNA, 22 bp, Homo sapiens
tacaggtatgcgccaccttgtc

SEQ ID NO: 7217270 - DNA, 22 bp, Homo sapiens
tacagcttaaaaaagccaactt

SEQ ID NO: 7217271 - DNA, 22 bp, Homo sapiens
tacaatagggcttttgtttatg

SEQ ID NO: 7217272 - DNA, 22 bp, Homo sapiens
tacaatagggcttttgtttatg

SEQ ID NO: 7217273 - DNA, 22 bp, Homo sapiens
tacagctgttggtgtttcctct

SEQ ID NO: 7217274 - DNA, 20 bp, Homo sapiens
tacaatacacatgcatatga

SEQ ID NO: 7217275 - DNA, 22 bp, Homo sapiens
tacaagtttatccatcattgtt

SEQ ID NO: 7217276 - DNA, 22 bp, Homo sapiens
tacaagtccgtaaagggcagat

SEQ ID NO: 7217277 - DNA, 22 bp, Homo sapiens
tacaagtccgtaaagggcagat

SEQ ID NO: 7217278 - DNA, 22 bp, Homo sapiens
tacaagtccgtaaagggcagat

SEQ ID NO: 7217279 - DNA, 22 bp, Homo sapiens
tacaagtctcagttttggattc

SEQ ID NO: 7217280 - DNA, 22 bp, Homo sapiens
tacaagtctcagttttggattc

SEQ ID NO: 7217281 - DNA, 22 bp, Homo sapiens
tacaaggcttcagctcagctat

SEQ ID NO: 7217282 - DNA, 23 bp, Homo sapiens
tacaaggtagcattagtttcttc

SEQ ID NO: 7217283 - DNA, 22 bp, Homo sapiens
tacaagtaaattgtagatacca

SEQ ID NO: 7217284 - DNA, 22 bp, Homo sapiens
tacaagtaaattgtagatacca

SEQ ID NO: 7217285 - DNA, 20 bp, Homo sapiens
tacaagtacattatagttat

SEQ ID NO: 7217286 - DNA, 22 bp, Homo sapiens
tacaagtatattctagtgatat

SEQ ID NO: 7217287 - DNA, 22 bp, Homo sapiens
tacaagtatattctagtgatat

SEQ ID NO: 7217288 - DNA, 22 bp, Homo sapiens
tacaagtatgttttaaaatgtt

SEQ ID NO: 7217289 - DNA, 22 bp, Homo sapiens
tacaagtatggaatgattctca

SEQ ID NO: 7217290 - DNA, 22 bp, Homo sapiens
tacaaactccgaagtttgtacc

SEQ ID NO: 7217291 - DNA, 22 bp, Homo sapiens
tacaaactccgaagtttgtacc

SEQ ID NO: 7217292 - DNA, 22 bp, Homo sapiens
tacaaatgaaccaactttgatg

SEQ ID NO: 7217293 - DNA, 22 bp, Homo sapiens
tacaaatgaaccaactttgatg

SEQ ID NO: 7217294 - DNA, 20 bp, Homo sapiens
tacaaacctccacactggtg

SEQ ID NO: 7217295 - DNA, 22 bp, Homo sapiens
tacaaactaacatgtctcatcc

SEQ ID NO: 7217296 - DNA, 22 bp, Homo sapiens
caggcagggagccactgtataa

SEQ ID NO: 7217297 - DNA, 22 bp, Homo sapiens
caggcagggagctggaaaggat

SEQ ID NO: 7217298 - DNA, 22 bp, Homo sapiens
caggcagggagctggaaaggat

SEQ ID NO: 7217299 - DNA, 22 bp, Homo sapiens
tacaaatgagttgtatgaacca

SEQ ID NO: 7217300 - DNA, 22 bp, Homo sapiens
tacaaatgagttgtatgaacca

SEQ ID NO: 7217301 - DNA, 22 bp, Homo sapiens
tacaaatgagttgtatgaacca

SEQ ID NO: 7217302 - DNA, 22 bp, Homo sapiens
tacaaatgaaccaactttgatg

SEQ ID NO: 7217303 - DNA, 22 bp, Homo sapiens
tacaaatgaccatagccactta

SEQ ID NO: 7217304 - DNA, 22 bp, Homo sapiens
tacaaatgcctgacacacagat

SEQ ID NO: 7217305 - DNA, 22 bp, Homo sapiens
tacaaatgcctgacacacagat

SEQ ID NO: 7217306 - DNA, 22 bp, Homo sapiens
tacaaatgcctgacacacagat

SEQ ID NO: 7217307 - DNA, 22 bp, Homo sapiens
tacaaatgcctgacacacagat

SEQ ID NO: 7217308 - DNA, 22 bp, Homo sapiens
tacaaatgcctgacacacagat

SEQ ID NO: 7217309 - DNA, 22 bp, Homo sapiens
tacaaatgggttaaaatatagt

SEQ ID NO: 7217310 - DNA, 22 bp, Homo sapiens
tacaaatggttgaatggatgaa

SEQ ID NO: 7217311 - DNA, 22 bp, Homo sapiens
tacaaatggttgaatggatgaa

SEQ ID NO: 7217312 - DNA, 22 bp, Homo sapiens
tacaaatggttgaatggatgaa

SEQ ID NO: 7217313 - DNA, 22 bp, Homo sapiens
tacaaatgtattttattttggt

SEQ ID NO: 7217314 - DNA, 22 bp, Homo sapiens
tacaaatgtattttattttggt

SEQ ID NO: 7217315 - DNA, 22 bp, Homo sapiens
tacaaatgtattttattttggt

SEQ ID NO: 7217316 - DNA, 22 bp, Homo sapiens
tacaaattaatgggcatgttta

SEQ ID NO: 7217317 - DNA, 20 bp, Homo sapiens
tacaaattttccatgtttcc

SEQ ID NO: 7217318 - DNA, 20 bp, Homo sapiens
tacaaattttccatgtttcc

SEQ ID NO: 7217319 - DNA, 20 bp, Homo sapiens
tacaaattttccatgtttcc

SEQ ID NO: 7217320 - DNA, 19 bp, Homo sapiens
tacaagcttttttggcagg

SEQ ID NO: 7217321 - DNA, 22 bp, Homo sapiens
tacaaggaaaattttatagtaa

SEQ ID NO: 7217322 - DNA, 22 bp, Homo sapiens
caggcagggagccactgtataa

SEQ ID NO: 7217323 - DNA, 22 bp, Homo sapiens
caggcagggagccactgtataa

SEQ ID NO: 7217324 - DNA, 22 bp, Homo sapiens
caggcagggagccactgtataa

SEQ ID NO: 7217325 - DNA, 22 bp, Homo sapiens
caggcagggagccactgtataa

SEQ ID NO: 7217326 - DNA, 22 bp, Homo sapiens
caggcaggctgctttttgttca

SEQ ID NO: 7217327 - DNA, 23 bp, Homo sapiens
caggcaggatgaggactacactc

SEQ ID NO: 7217328 - DNA, 23 bp, Homo sapiens
caggcaggatgaggactacactc

SEQ ID NO: 7217329 - DNA, 23 bp, Homo sapiens
caggcaggatgaggactacactc

SEQ ID NO: 7217330 - DNA, 23 bp, Homo sapiens
caggcaggatgaggactacactc

SEQ ID NO: 7217331 - DNA, 22 bp, Homo sapiens
caggcaggagccagggattcca

SEQ ID NO: 7217332 - DNA, 22 bp, Homo sapiens
caggcaggagccagggattcca

SEQ ID NO: 7217333 - DNA, 22 bp, Homo sapiens
caggcaggagccagggattcca

SEQ ID NO: 7217334 - DNA, 22 bp, Homo sapiens
caggcaggagccagggattcca

SEQ ID NO: 7217335 - DNA, 22 bp, Homo sapiens
caggcaggagccagggattcca

SEQ ID NO: 7217336 - DNA, 23 bp, Homo sapiens
caggcaggatgaggactacactc

SEQ ID NO: 7217337 - DNA, 22 bp, Homo sapiens
caggcaggagaggaggatttct

SEQ ID NO: 7217338 - DNA, 22 bp, Homo sapiens
caggcaggagaggaggatttct

SEQ ID NO: 7217339 - DNA, 22 bp, Homo sapiens
caggcaggagaggaggatttct

SEQ ID NO: 7217340 - DNA, 22 bp, Homo sapiens
caggcaggagacatttggttgg

SEQ ID NO: 7217341 - DNA, 22 bp, Homo sapiens
caggcagctgggtcaccgtccc

SEQ ID NO: 7217342 - DNA, 22 bp, Homo sapiens
caggcagctgctgggttcagcc

SEQ ID NO: 7217343 - DNA, 22 bp, Homo sapiens
caggcagctgctgggttcagcc

SEQ ID NO: 7217344 - DNA, 22 bp, Homo sapiens
caggcagctgctgggttcagcc

SEQ ID NO: 7217345 - DNA, 22 bp, Homo sapiens
caggcagctgctgggttcagcc

SEQ ID NO: 7217346 - DNA, 22 bp, Homo sapiens
caggcagctgcgacaagagagc

SEQ ID NO: 7217347 - DNA, 22 bp, Homo sapiens
caggcagctgcgacaagagagc

SEQ ID NO: 7217348 - DNA, 22 bp, Homo sapiens
caggcagctgcgacaagagagc

SEQ ID NO: 7217349 - DNA, 22 bp, Homo sapiens
caggcagctgcgacaagagagc

SEQ ID NO: 7217350 - DNA, 22 bp, Homo sapiens
caggcagctgactgtcagatat

SEQ ID NO: 7217351 - DNA, 22 bp, Homo sapiens
caggcagctgactgtcagatat

SEQ ID NO: 7217352 - DNA, 22 bp, Homo sapiens
caggcagctgactgtcagatat

SEQ ID NO: 7217353 - DNA, 22 bp, Homo sapiens
caggcagcctgcggtctgcaca

SEQ ID NO: 7217354 - DNA, 22 bp, Homo sapiens
caggcagctctaatggaaagtg

SEQ ID NO: 7217355 - DNA, 22 bp, Homo sapiens
caggcagctctaatggaaagtg

SEQ ID NO: 7217356 - DNA, 22 bp, Homo sapiens
caggcagcctgagggatctggg

SEQ ID NO: 7217357 - DNA, 22 bp, Homo sapiens
caggcagcctgagggatctggg

SEQ ID NO: 7217358 - DNA, 22 bp, Homo sapiens
caggcagcctgagggatctggg

SEQ ID NO: 7217359 - DNA, 22 bp, Homo sapiens
caggcagccctgcaccaagtgt

SEQ ID NO: 7217360 - DNA, 22 bp, Homo sapiens
caggcagccaggggacctgtcc

SEQ ID NO: 7217361 - DNA, 22 bp, Homo sapiens
caggcagcatcagtctgctgta

SEQ ID NO: 7217362 - DNA, 22 bp, Homo sapiens
caggcagcatcagtctgctgta

SEQ ID NO: 7217363 - DNA, 22 bp, Homo sapiens
caggcagcatttactctgatga

SEQ ID NO: 7217364 - DNA, 22 bp, Homo sapiens
caggcagcatttactctgatga

SEQ ID NO: 7217365 - DNA, 22 bp, Homo sapiens
caggcagcagccactctggtat

SEQ ID NO: 7217366 - DNA, 22 bp, Homo sapiens
taatttacttgcaaataacaat

SEQ ID NO: 7217367 - DNA, 22 bp, Homo sapiens
caggcagcagccactctggtat

SEQ ID NO: 7217368 - DNA, 22 bp, Homo sapiens
caggcagcagccactctggtat

SEQ ID NO: 7217369 - DNA, 22 bp, Homo sapiens
caggcagcaggagccctgctcg

SEQ ID NO: 7217370 - DNA, 22 bp, Homo sapiens
caggcagcaggagccctgctcg

SEQ ID NO: 7217371 - DNA, 22 bp, Homo sapiens
caggcagcaggagccctgctcg

SEQ ID NO: 7217372 - DNA, 22 bp, Homo sapiens
caggcagagaggagcatttaat

SEQ ID NO: 7217373 - DNA, 22 bp, Homo sapiens
caggcagagcaactggtccaga

SEQ ID NO: 7217374 - DNA, 22 bp, Homo sapiens
caggcagagcaactggtccaga

SEQ ID NO: 7217375 - DNA, 22 bp, Homo sapiens
caggcagagcaactggtccaga

SEQ ID NO: 7217376 - DNA, 22 bp, Homo sapiens
caggcagagacgtcagtgtagg

SEQ ID NO: 7217377 - DNA, 22 bp, Homo sapiens
caggcagagacgtcagtgtagg

SEQ ID NO: 7217378 - DNA, 22 bp, Homo sapiens
caggcagagacgtcagtgtagg

SEQ ID NO: 7217379 - DNA, 22 bp, Homo sapiens
caggcagactttgagaatgatg

SEQ ID NO: 7217380 - DNA, 17 bp, Homo sapiens
caggcagacatgtaagc

SEQ ID NO: 7217381 - DNA, 17 bp, Homo sapiens
caggcagacatgtaagc

SEQ ID NO: 7217382 - DNA, 22 bp, Homo sapiens
caggcagaagaagtggaaggac

SEQ ID NO: 7217383 - DNA, 22 bp, Homo sapiens
caggcagaaattttgtttcatt

SEQ ID NO: 7217384 - DNA, 22 bp, Homo sapiens
caggcagaagaagtggaaggac

SEQ ID NO: 7217385 - DNA, 22 bp, Homo sapiens
caggcagaagaagtggaaggac

SEQ ID NO: 7217386 - DNA, 22 bp, Homo sapiens
caggcagaagaagtggaaggac

SEQ ID NO: 7217387 - DNA, 22 bp, Homo sapiens
caggcagaagaagtggaaggac

SEQ ID NO: 7217388 - DNA, 22 bp, Homo sapiens
caggcagaaggaagtaccaggc

SEQ ID NO: 7217389 - DNA, 22 bp, Homo sapiens
caggcagaaggaagtaccaggc

SEQ ID NO: 7217390 - DNA, 22 bp, Homo sapiens
caggcagaatgaccgacctcgc

SEQ ID NO: 7217391 - DNA, 17 bp, Homo sapiens
caggcagacatgtaagc

SEQ ID NO: 7217392 - DNA, 22 bp, Homo sapiens
caggcagagcaactggtccaga

SEQ ID NO: 7217393 - DNA, 22 bp, Homo sapiens
caggcagagccaatcgtggggt

SEQ ID NO: 7217394 - DNA, 22 bp, Homo sapiens
caggcagagccaatcgtggggt

SEQ ID NO: 7217395 - DNA, 22 bp, Homo sapiens
taatgttagtatgtaatcttat

SEQ ID NO: 7217396 - DNA, 22 bp, Homo sapiens
taatgttagtatgtaatcttat

SEQ ID NO: 7217397 - DNA, 22 bp, Homo sapiens
taatgttagtatgtaatcttat

SEQ ID NO: 7217398 - DNA, 22 bp, Homo sapiens
taatgttataaattcttggttt

SEQ ID NO: 7217399 - DNA, 22 bp, Homo sapiens
taattgtaaagtagtagtacag

SEQ ID NO: 7217400 - DNA, 22 bp, Homo sapiens
taattgtaaagtagtagtacag

SEQ ID NO: 7217401 - DNA, 22 bp, Homo sapiens
taattgtacgatgttaaatcag

SEQ ID NO: 7217402 - DNA, 22 bp, Homo sapiens
taattgtactccctgtgggaaa

SEQ ID NO: 7217403 - DNA, 22 bp, Homo sapiens
taattgtagctttgtaatcagc

SEQ ID NO: 7217404 - DNA, 22 bp, Homo sapiens
taattgtagctttgtaatcagc

SEQ ID NO: 7217405 - DNA, 22 bp, Homo sapiens
taattgtatggagaaggctgca

SEQ ID NO: 7217406 - DNA, 22 bp, Homo sapiens
taatttaattccatggattcta

SEQ ID NO: 7217407 - DNA, 22 bp, Homo sapiens
taatttaattccatggattcta

SEQ ID NO: 7217408 - DNA, 22 bp, Homo sapiens
taatttaattccatggattcta

SEQ ID NO: 7217409 - DNA, 22 bp, Homo sapiens
taatttaatccaagtgttacat

SEQ ID NO: 7217410 - DNA, 22 bp, Homo sapiens
taatttaatccaagtgttacat

SEQ ID NO: 7217411 - DNA, 22 bp, Homo sapiens
taattgtatggagaaggctgca

SEQ ID NO: 7217412 - DNA, 22 bp, Homo sapiens
taattgtcctcggtccaaatga

SEQ ID NO: 7217413 - DNA, 22 bp, Homo sapiens
taatttaatccaagtgttacat

SEQ ID NO: 7217414 - DNA, 22 bp, Homo sapiens
taatttaatttcatgccagcct

SEQ ID NO: 7217415 - DNA, 22 bp, Homo sapiens
taatttaatttcatgccagcct

SEQ ID NO: 7217416 - DNA, 22 bp, Homo sapiens
taatttacagagatacagtcag

SEQ ID NO: 7217417 - DNA, 22 bp, Homo sapiens
taatttaatttcatgccagcct

SEQ ID NO: 7217418 - DNA, 22 bp, Homo sapiens
taatttacagagatacagtcag

SEQ ID NO: 7217419 - DNA, 22 bp, Homo sapiens
taatttactcagatgttcaatc

SEQ ID NO: 7217420 - DNA, 22 bp, Homo sapiens
taatttacttgcaaataacaat

SEQ ID NO: 7217421 - DNA, 22 bp, Homo sapiens
taatttacagttcgccatgtct

SEQ ID NO: 7217422 - DNA, 22 bp, Homo sapiens
taatttactcagatgttcaatc

SEQ ID NO: 7217423 - DNA, 22 bp, Homo sapiens
caggaaggaaagggtgtggaga

SEQ ID NO: 7217424 - DNA, 22 bp, Homo sapiens
caggaagctgtgaaggagacgg

SEQ ID NO: 7217425 - DNA, 22 bp, Homo sapiens
caggaagctgtgaaggagacgg

SEQ ID NO: 7217426 - DNA, 22 bp, Homo sapiens
caggaaggaaagggtgtggaga

SEQ ID NO: 7217427 - DNA, 22 bp, Homo sapiens
caggaaggaaagggtgtggaga

SEQ ID NO: 7217428 - DNA, 22 bp, Homo sapiens
caggaaggaaagggtgtggaga

SEQ ID NO: 7217429 - DNA, 22 bp, Homo sapiens
caggaagctgagctgcactgca

SEQ ID NO: 7217430 - DNA, 22 bp, Homo sapiens
caggaagctgagctgcactgca

SEQ ID NO: 7217431 - DNA, 22 bp, Homo sapiens
caggaagctgccggtgagcgag

SEQ ID NO: 7217432 - DNA, 22 bp, Homo sapiens
caggaagctgggtttccataca

SEQ ID NO: 7217433 - DNA, 22 bp, Homo sapiens
caggaagctggtcagatcctgt

SEQ ID NO: 7217434 - DNA, 22 bp, Homo sapiens
caggaagggggatccttggaag

SEQ ID NO: 7217435 - DNA, 22 bp, Homo sapiens
caggaagtggggtcatggagta

SEQ ID NO: 7217436 - DNA, 22 bp, Homo sapiens
caggaagtgtgagggtggtgta

SEQ ID NO: 7217437 - DNA, 22 bp, Homo sapiens
caggaatagggcgtgagcatat

SEQ ID NO: 7217438 - DNA, 22 bp, Homo sapiens
caggaatagtggagcaacaaga

SEQ ID NO: 7217439 - DNA, 22 bp, Homo sapiens
caggaatagtggagcaacaaga

SEQ ID NO: 7217440 - DNA, 22 bp, Homo sapiens
caggaatgaaaggtcagggttg

SEQ ID NO: 7217441 - DNA, 22 bp, Homo sapiens
caggaatgaaaggtcagggttg

SEQ ID NO: 7217442 - DNA, 22 bp, Homo sapiens
caggaatgacccaacagtttca

SEQ ID NO: 7217443 - DNA, 22 bp, Homo sapiens
caggaatgactgcagatggggc

SEQ ID NO: 7217444 - DNA, 22 bp, Homo sapiens
caggaatgactgcagatggggc

SEQ ID NO: 7217445 - DNA, 22 bp, Homo sapiens
caggaatgactgcagatggggc

SEQ ID NO: 7217446 - DNA, 22 bp, Homo sapiens
caggaagctcttagcagtcacc

SEQ ID NO: 7217447 - DNA, 22 bp, Homo sapiens
caggaagctgagctgcactgca

SEQ ID NO: 7217448 - DNA, 22 bp, Homo sapiens
caggaagctgagctgcactgca

SEQ ID NO: 7217449 - DNA, 22 bp, Homo sapiens
caggaagccttccttgtctgct

SEQ ID NO: 7217450 - DNA, 22 bp, Homo sapiens
caggaagccacaggacaggtag

SEQ ID NO: 7217451 - DNA, 22 bp, Homo sapiens
caggaagccacaggacaggtag

SEQ ID NO: 7217452 - DNA, 22 bp, Homo sapiens
caggaagcatctggctagctaa

SEQ ID NO: 7217453 - DNA, 22 bp, Homo sapiens
caggaagcatctggctagctaa

SEQ ID NO: 7217454 - DNA, 22 bp, Homo sapiens
caggaagccacaggacaggtag

SEQ ID NO: 7217455 - DNA, 22 bp, Homo sapiens
caggaagcatctggctagctaa

SEQ ID NO: 7217456 - DNA, 22 bp, Homo sapiens
gtttgtaattacctcttttgac

SEQ ID NO: 7217457 - DNA, 22 bp, Homo sapiens
gtttgtaattacctcttttgac

SEQ ID NO: 7217458 - DNA, 22 bp, Homo sapiens
gtttgtaattactgcagcatgg

SEQ ID NO: 7217459 - DNA, 22 bp, Homo sapiens
gtttgtaaccagaacagagagt

SEQ ID NO: 7217460 - DNA, 22 bp, Homo sapiens
gtttggttggctgtctttaaca

SEQ ID NO: 7217461 - DNA, 22 bp, Homo sapiens
gtttgtaagcagtctgcttgtg

SEQ ID NO: 7217462 - DNA, 21 bp, Homo sapiens
gtttgtaaggcactgtgttct

SEQ ID NO: 7217463 - DNA, 21 bp, Homo sapiens
gtttgtaaggcactgtgttct

SEQ ID NO: 7217464 - DNA, 22 bp, Homo sapiens
gtttggtgagcagcttgggtat

SEQ ID NO: 7217465 - DNA, 22 bp, Homo sapiens
gtttggtgagctaagattattt

SEQ ID NO: 7217466 - DNA, 22 bp, Homo sapiens
gtttggtggtagcattggctat

SEQ ID NO: 7217467 - DNA, 22 bp, Homo sapiens
gtttggtgtgagttcataccac

SEQ ID NO: 7217468 - DNA, 22 bp, Homo sapiens
gtttggaatgagtcctgccatt

SEQ ID NO: 7217469 - DNA, 18 bp, Homo sapiens
gtttggacttttctccct

SEQ ID NO: 7217470 - DNA, 18 bp, Homo sapiens
gtttggacttttctccct

SEQ ID NO: 7217471 - DNA, 22 bp, Homo sapiens
gtttggagccccgtgggaagga

SEQ ID NO: 7217472 - DNA, 22 bp, Homo sapiens
gtttggcagagcatggggatga

SEQ ID NO: 7217473 - DNA, 19 bp, Homo sapiens
gtttggcagcaaatcagac

SEQ ID NO: 7217474 - DNA, 22 bp, Homo sapiens
gtttggcactatgatgaggcta

SEQ ID NO: 7217475 - DNA, 22 bp, Homo sapiens
gtttggcacatgaacctatttt

SEQ ID NO: 7217476 - DNA, 22 bp, Homo sapiens
gtttggcaatatttgtggaaca

SEQ ID NO: 7217477 - DNA, 22 bp, Homo sapiens
gtttggcaagaagaggagtaag

SEQ ID NO: 7217478 - DNA, 22 bp, Homo sapiens
gtttggatgtgtagtgagggga

SEQ ID NO: 7217479 - DNA, 19 bp, Homo sapiens
gtttggatcccctgttaga

SEQ ID NO: 7217480 - DNA, 22 bp, Homo sapiens
gtttggcatctcacttaaaccg

SEQ ID NO: 7217481 - DNA, 22 bp, Homo sapiens
gtttggctctgggtgcctgtgc

SEQ ID NO: 7217482 - DNA, 22 bp, Homo sapiens
gtttggggtctgcagagcggcg

SEQ ID NO: 7217483 - DNA, 22 bp, Homo sapiens
gtttggtgacacatagtttgat

SEQ ID NO: 7217484 - DNA, 18 bp, Homo sapiens
gtttggcataactgatgc

SEQ ID NO: 7217485 - DNA, 22 bp, Homo sapiens
gtttggcataggatgtgggtta

SEQ ID NO: 7217486 - DNA, 22 bp, Homo sapiens
gtttggcataggatgtgggtta

SEQ ID NO: 7217487 - DNA, 22 bp, Homo sapiens
gtttggcataaatattttcacc

SEQ ID NO: 7217488 - DNA, 22 bp, Homo sapiens
gtttggcagttttagagtgcaa

SEQ ID NO: 7217489 - DNA, 22 bp, Homo sapiens
gtttggcagttttagagtgcaa

SEQ ID NO: 7217490 - DNA, 22 bp, Homo sapiens
gtttggcagtgttatgtaggtt

SEQ ID NO: 7217491 - DNA, 22 bp, Homo sapiens
gttttccaggtaccttggtatt

SEQ ID NO: 7217492 - DNA, 22 bp, Homo sapiens
gttttccatggaggtctgacct

SEQ ID NO: 7217493 - DNA, 22 bp, Homo sapiens
gttttccatggaggtctgacct

SEQ ID NO: 7217494 - DNA, 18 bp, Homo sapiens
gttttccatttgttcctc

SEQ ID NO: 7217495 - DNA, 18 bp, Homo sapiens
gttttccatttgttcctc

SEQ ID NO: 7217496 - DNA, 22 bp, Homo sapiens
gttttcctactgtatcatcaaa

SEQ ID NO: 7217497 - DNA, 22 bp, Homo sapiens
gttttcctgaaactgatggtgt

SEQ ID NO: 7217498 - DNA, 22 bp, Homo sapiens
gttttccactggattgtttgga

SEQ ID NO: 7217499 - DNA, 22 bp, Homo sapiens
gttttccactggattgtttgga

SEQ ID NO: 7217500 - DNA, 22 bp, Homo sapiens
gttttccaggtaccttggtatt

SEQ ID NO: 7217501 - DNA, 22 bp, Homo sapiens
gttttccaggtaccttggtatt

SEQ ID NO: 7217502 - DNA, 22 bp, Homo sapiens
caggacagtataggctttagga

SEQ ID NO: 7217503 - DNA, 22 bp, Homo sapiens
caggacagtgcaggtccatcct

SEQ ID NO: 7217504 - DNA, 22 bp, Homo sapiens
caggacagtgcaggtccatcct

SEQ ID NO: 7217505 - DNA, 22 bp, Homo sapiens
caggacagtgcaggtccatcct

SEQ ID NO: 7217506 - DNA, 22 bp, Homo sapiens
caggacagtgcaggtccatcct

SEQ ID NO: 7217507 - DNA, 22 bp, Homo sapiens
caggacaggtgttctagatcag

SEQ ID NO: 7217508 - DNA, 22 bp, Homo sapiens
caggacagtataggctttagga

SEQ ID NO: 7217509 - DNA, 22 bp, Homo sapiens
caggacagtataggctttagga

SEQ ID NO: 7217510 - DNA, 22 bp, Homo sapiens
caggacagtataggctttagga

SEQ ID NO: 7217511 - DNA, 22 bp, Homo sapiens
caggacaggtgttctagatcag

SEQ ID NO: 7217512 - DNA, 22 bp, Homo sapiens
caggacagtataggctttagga

SEQ ID NO: 7217513 - DNA, 22 bp, Homo sapiens
caggacaggtgttctagatcag

SEQ ID NO: 7217514 - DNA, 22 bp, Homo sapiens
caggacaggtgttctagatcag

SEQ ID NO: 7217515 - DNA, 22 bp, Homo sapiens
caggacaggccctgtggggtct

SEQ ID NO: 7217516 - DNA, 22 bp, Homo sapiens
caggacaggccctgtggggtct

SEQ ID NO: 7217517 - DNA, 22 bp, Homo sapiens
caggacaggccctgtggggtct

SEQ ID NO: 7217518 - DNA, 22 bp, Homo sapiens
caggacaggtgttctagatcag

SEQ ID NO: 7217519 - DNA, 22 bp, Homo sapiens
caggacaggtgttctagatcag

SEQ ID NO: 7217520 - DNA, 22 bp, Homo sapiens
caggacaggtgttctagatcag

SEQ ID NO: 7217521 - DNA, 22 bp, Homo sapiens
caggacaggccctgtggggtct

SEQ ID NO: 7217522 - DNA, 22 bp, Homo sapiens
caggacaggccctgtggggtct

SEQ ID NO: 7217523 - DNA, 22 bp, Homo sapiens
caggacaggccctgtggggtct

SEQ ID NO: 7217524 - DNA, 22 bp, Homo sapiens
caggacaggccctgtggggtct

SEQ ID NO: 7217525 - DNA, 22 bp, Homo sapiens
caggacaggagtggggtcaaag

SEQ ID NO: 7217526 - DNA, 22 bp, Homo sapiens
caggacaggagtggggtcaaag

SEQ ID NO: 7217527 - DNA, 22 bp, Homo sapiens
caggacaggagtggggtcaaag

SEQ ID NO: 7217528 - DNA, 22 bp, Homo sapiens
caggacaggagtggggtcaaag

SEQ ID NO: 7217529 - DNA, 22 bp, Homo sapiens
caggacaggagtggggtcaaag

SEQ ID NO: 7217530 - DNA, 22 bp, Homo sapiens
caggacagctgggccaccacca

SEQ ID NO: 7217531 - DNA, 22 bp, Homo sapiens
caggacagctgggccaccacca

SEQ ID NO: 7217532 - DNA, 22 bp, Homo sapiens
caggacaggagtggggtcaaag

SEQ ID NO: 7217533 - DNA, 22 bp, Homo sapiens
caggacaggagtggggtcaaag

SEQ ID NO: 7217534 - DNA, 22 bp, Homo sapiens
caggacagctgggccaccacca

SEQ ID NO: 7217535 - DNA, 22 bp, Homo sapiens
caggacagctgggccaccacca

SEQ ID NO: 7217536 - DNA, 22 bp, Homo sapiens
caggacagctgggccaccacca

SEQ ID NO: 7217537 - DNA, 22 bp, Homo sapiens
caggacagctgggccaccacca

SEQ ID NO: 7217538 - DNA, 22 bp, Homo sapiens
caggacagctcaacacctcctc

SEQ ID NO: 7217539 - DNA, 22 bp, Homo sapiens
caggacagctcaacacctcctc

SEQ ID NO: 7217540 - DNA, 22 bp, Homo sapiens
caggacagctcaacacctcctc

SEQ ID NO: 7217541 - DNA, 22 bp, Homo sapiens
caggacagctcaacacctcctc

SEQ ID NO: 7217542 - DNA, 22 bp, Homo sapiens
caggacagctcaacacctcctc

SEQ ID NO: 7217543 - DNA, 22 bp, Homo sapiens
caggacagctcaacacctcctc

SEQ ID NO: 7217544 - DNA, 22 bp, Homo sapiens
caggacacttgttcttctctgc

SEQ ID NO: 7217545 - DNA, 22 bp, Homo sapiens
caggacactacagatgggaggg

SEQ ID NO: 7217546 - DNA, 22 bp, Homo sapiens
caggacactacagatgggaggg

SEQ ID NO: 7217547 - DNA, 22 bp, Homo sapiens
caggaatggttaatctaaagtg

SEQ ID NO: 7217548 - DNA, 22 bp, Homo sapiens
caggaatggttgggactatgtt

SEQ ID NO: 7217549 - DNA, 22 bp, Homo sapiens
caggaatgtagcagcgatggaa

SEQ ID NO: 7217550 - DNA, 22 bp, Homo sapiens
caggaatgtatgatacagtggt

SEQ ID NO: 7217551 - DNA, 22 bp, Homo sapiens
caggaatgggtgacagtcagct

SEQ ID NO: 7217552 - DNA, 22 bp, Homo sapiens
caggaatgccttcttcagccat

SEQ ID NO: 7217553 - DNA, 22 bp, Homo sapiens
caggaatgccttcttcagccat

SEQ ID NO: 7217554 - DNA, 22 bp, Homo sapiens
caggaatggaggcatttatgaa

SEQ ID NO: 7217555 - DNA, 18 bp, Homo sapiens
caggaatggatgggattt

SEQ ID NO: 7217556 - DNA, 22 bp, Homo sapiens
caggaatgccaaccagtgcatg

SEQ ID NO: 7217557 - DNA, 22 bp, Homo sapiens
caggaatgccaaccagtgcatg

SEQ ID NO: 7217558 - DNA, 22 bp, Homo sapiens
caggaatgcattctagaatggc

SEQ ID NO: 7217559 - DNA, 22 bp, Homo sapiens
caggaatgatattcgaggagat

SEQ ID NO: 7217560 - DNA, 22 bp, Homo sapiens
caggaatgatctgctgagtgat

SEQ ID NO: 7217561 - DNA, 22 bp, Homo sapiens
caggaatgatattcgaggagat

SEQ ID NO: 7217562 - DNA, 19 bp, Homo sapiens
caggaatgaggtaatggct

SEQ ID NO: 7217563 - DNA, 22 bp, Homo sapiens
caggaatgaggtcgtaagtgtc

SEQ ID NO: 7217564 - DNA, 22 bp, Homo sapiens
caggaatgaggtcgtaagtgtc

SEQ ID NO: 7217565 - DNA, 22 bp, Homo sapiens
caggaatgagttctggtgctct

SEQ ID NO: 7217566 - DNA, 22 bp, Homo sapiens
caggacactaaaaagccaagct

SEQ ID NO: 7217567 - DNA, 22 bp, Homo sapiens
caggacaatttccacttggtaa

SEQ ID NO: 7217568 - DNA, 22 bp, Homo sapiens
caggacaattttgagccacctg

SEQ ID NO: 7217569 - DNA, 22 bp, Homo sapiens
caggacacagaataaggcagtt

SEQ ID NO: 7217570 - DNA, 22 bp, Homo sapiens
caggacacagaataaggcagtt

SEQ ID NO: 7217571 - DNA, 22 bp, Homo sapiens
caggacacagggtgtggctgat

SEQ ID NO: 7217572 - DNA, 22 bp, Homo sapiens
caggaatgttgcatgtgatctt

SEQ ID NO: 7217573 - DNA, 22 bp, Homo sapiens
caggaatgtttgtgctccttta

SEQ ID NO: 7217574 - DNA, 22 bp, Homo sapiens
caggaatgtgagggttccctgc

SEQ ID NO: 7217575 - DNA, 22 bp, Homo sapiens
caggaatgttgcatgtgatctt

SEQ ID NO: 7217576 - DNA, 22 bp, Homo sapiens
caggaatgtccttgtcatttca

SEQ ID NO: 7217577 - DNA, 22 bp, Homo sapiens
caggaatgtccttgtcatttca

SEQ ID NO: 7217578 - DNA, 22 bp, Homo sapiens
caggaatgtcccatccccttca

SEQ ID NO: 7217579 - DNA, 22 bp, Homo sapiens
caggaatgtccttgtcatttca

SEQ ID NO: 7217580 - DNA, 22 bp, Homo sapiens
caggaatgtgagggttccctgc

SEQ ID NO: 7217581 - DNA, 22 bp, Homo sapiens
caggaattcatagcattgttct

SEQ ID NO: 7217582 - DNA, 22 bp, Homo sapiens
caggacaatctcgtcgggtcct

SEQ ID NO: 7217583 - DNA, 22 bp, Homo sapiens
gttttctcaggatggtgtgtac

SEQ ID NO: 7217584 - DNA, 22 bp, Homo sapiens
gttttctaggatcccctccaag

SEQ ID NO: 7217585 - DNA, 22 bp, Homo sapiens
gttttctcatctcctcaatggt

SEQ ID NO: 7217586 - DNA, 22 bp, Homo sapiens
gttttctcatctcctcaatggt

SEQ ID NO: 7217587 - DNA, 22 bp, Homo sapiens
gttttctcatctcctcaatggt

SEQ ID NO: 7217588 - DNA, 22 bp, Homo sapiens
gttttctaccagggaagagagt

SEQ ID NO: 7217589 - DNA, 22 bp, Homo sapiens
gttttctaggatcccctccaag

SEQ ID NO: 7217590 - DNA, 22 bp, Homo sapiens
gttttctctgagatgcctttct

SEQ ID NO: 7217591 - DNA, 22 bp, Homo sapiens
gttttctctgagatgcctttct

SEQ ID NO: 7217592 - DNA, 22 bp, Homo sapiens
gttttctctgtgtttggatgat

SEQ ID NO: 7217593 - DNA, 22 bp, Homo sapiens
gttttctgattagcaaatctga

SEQ ID NO: 7217594 - DNA, 22 bp, Homo sapiens
gttttctgcctgaaggtgacca

SEQ ID NO: 7217595 - DNA, 22 bp, Homo sapiens
gttttccttctcagccattgcc

SEQ ID NO: 7217596 - DNA, 22 bp, Homo sapiens
gttttccttctcagccattgcc

SEQ ID NO: 7217597 - DNA, 22 bp, Homo sapiens
gttttctaagtaggtagcacca

SEQ ID NO: 7217598 - DNA, 22 bp, Homo sapiens
gttttctaagtaggtagcacca

SEQ ID NO: 7217599 - DNA, 22 bp, Homo sapiens
gttttctaccagggaagagagt

SEQ ID NO: 7217600 - DNA, 22 bp, Homo sapiens
gttttctaccagggaagagagt

SEQ ID NO: 7217601 - DNA, 22 bp, Homo sapiens
gttttcctgaaactgatggtgt

SEQ ID NO: 7217602 - DNA, 22 bp, Homo sapiens
gttttcctgagcccagagatgc

SEQ ID NO: 7217603 - DNA, 22 bp, Homo sapiens
gttttcctgaaactgatggtgt

SEQ ID NO: 7217604 - DNA, 22 bp, Homo sapiens
gttttcctgttgagtagtattc

SEQ ID NO: 7217605 - DNA, 22 bp, Homo sapiens
taaaaagcagctgagattttct

SEQ ID NO: 7217606 - DNA, 19 bp, Homo sapiens
taaaaactgaaggaagcag

SEQ ID NO: 7217607 - DNA, 22 bp, Homo sapiens
taaaaagcagctgagattttct

SEQ ID NO: 7217608 - DNA, 22 bp, Homo sapiens
taaaaagtagtgagaatggcgc

SEQ ID NO: 7217609 - DNA, 22 bp, Homo sapiens
taaaaagtagtgagaatggcgc

SEQ ID NO: 7217610 - DNA, 22 bp, Homo sapiens
gttttctggcagttattcctta

SEQ ID NO: 7217611 - DNA, 22 bp, Homo sapiens
gttttcttcctgcaattggcat

SEQ ID NO: 7217612 - DNA, 22 bp, Homo sapiens
gttttcttcctgcaattggcat

SEQ ID NO: 7217613 - DNA, 22 bp, Homo sapiens
gttttcttcctgcaattggcat

SEQ ID NO: 7217614 - DNA, 22 bp, Homo sapiens
taaaaaacattactctgtcctg

SEQ ID NO: 7217615 - DNA, 22 bp, Homo sapiens
taaaaaacattactctgtcctg

SEQ ID NO: 7217616 - DNA, 22 bp, Homo sapiens
taaaaaacattactctgtcctg

SEQ ID NO: 7217617 - DNA, 22 bp, Homo sapiens
taaaaaacattactctgtcctg

SEQ ID NO: 7217618 - DNA, 19 bp, Homo sapiens
taaaaactgaaggaagcag

SEQ ID NO: 7217619 - DNA, 22 bp, Homo sapiens
taaaatgacttcctccaacatc

SEQ ID NO: 7217620 - DNA, 22 bp, Homo sapiens
taaaatgacttcctccaacatc

SEQ ID NO: 7217621 - DNA, 22 bp, Homo sapiens
taaaatcattctggtgtcagta

SEQ ID NO: 7217622 - DNA, 22 bp, Homo sapiens
taaaatcattctggtgtcagta

SEQ ID NO: 7217623 - DNA, 22 bp, Homo sapiens
taaaatcattctggtgtcagta

SEQ ID NO: 7217624 - DNA, 22 bp, Homo sapiens
taaaatcattctggtgtcagta

SEQ ID NO: 7217625 - DNA, 22 bp, Homo sapiens
taaaatcattctggtgtcagta

SEQ ID NO: 7217626 - DNA, 22 bp, Homo sapiens
taaaatgacttcctccaacatc

SEQ ID NO: 7217627 - DNA, 22 bp, Homo sapiens
taaaatgacttcctccaacatc

SEQ ID NO: 7217628 - DNA, 22 bp, Homo sapiens
taaaatcagccgaccatggtgg

SEQ ID NO: 7217629 - DNA, 22 bp, Homo sapiens
taaaatcagccgaccatggtgg

SEQ ID NO: 7217630 - DNA, 22 bp, Homo sapiens
taaaatcagccgaccatggtgg

SEQ ID NO: 7217631 - DNA, 22 bp, Homo sapiens
taaaatcagccgaccatggtgg

SEQ ID NO: 7217632 - DNA, 22 bp, Homo sapiens
taaaatcaccaaaagcaggtgg

SEQ ID NO: 7217633 - DNA, 22 bp, Homo sapiens
taaaatcaccaaaagcaggtgg

SEQ ID NO: 7217634 - DNA, 22 bp, Homo sapiens
taaaatcaccaaaagcaggtgg

SEQ ID NO: 7217635 - DNA, 22 bp, Homo sapiens
taaaatcaccaaaagcaggtgg

SEQ ID NO: 7217636 - DNA, 22 bp, Homo sapiens
taaaatcatgacagattgacat

SEQ ID NO: 7217637 - DNA, 22 bp, Homo sapiens
taaaaatcttatgaatggcaag

SEQ ID NO: 7217638 - DNA, 22 bp, Homo sapiens
taaaatagcatgtgcagtgaaa

SEQ ID NO: 7217639 - DNA, 22 bp, Homo sapiens
taaaatagcatgtgcagtgaaa

SEQ ID NO: 7217640 - DNA, 22 bp, Homo sapiens
taaaatagccagtgcccctctg

SEQ ID NO: 7217641 - DNA, 22 bp, Homo sapiens
taaaatagcttatgtcttttga

SEQ ID NO: 7217642 - DNA, 22 bp, Homo sapiens
taaaatagcttatgtcttttga

SEQ ID NO: 7217643 - DNA, 22 bp, Homo sapiens
taaaatagcttatgtcttttga

SEQ ID NO: 7217644 - DNA, 18 bp, Homo sapiens
taaaccagatgacagttg

SEQ ID NO: 7217645 - DNA, 18 bp, Homo sapiens
taaaccagatgacagttg

SEQ ID NO: 7217646 - DNA, 22 bp, Homo sapiens
taaaccaagtgtccatattagt

SEQ ID NO: 7217647 - DNA, 22 bp, Homo sapiens
taaaccaggtaaagaagctctc

SEQ ID NO: 7217648 - DNA, 22 bp, Homo sapiens
taaaccattcagactgaaccac

SEQ ID NO: 7217649 - DNA, 19 bp, Homo sapiens
taaaccctggctttttctg

SEQ ID NO: 7217650 - DNA, 22 bp, Homo sapiens
taaaccttatttgaataccaac

SEQ ID NO: 7217651 - DNA, 22 bp, Homo sapiens
taaacatttgttattcttgttt

SEQ ID NO: 7217652 - DNA, 22 bp, Homo sapiens
taaacatttgttattcttgttt

SEQ ID NO: 7217653 - DNA, 22 bp, Homo sapiens
taaaccaagtgtccatattagt

SEQ ID NO: 7217654 - DNA, 22 bp, Homo sapiens
taaaatgatctctcatgttctt

SEQ ID NO: 7217655 - DNA, 22 bp, Homo sapiens
taaaatgatctctcatgttctt

SEQ ID NO: 7217656 - DNA, 22 bp, Homo sapiens
taaacatttgttattcttgttt

SEQ ID NO: 7217657 - DNA, 22 bp, Homo sapiens
taaactctgcattcttttaaaa

SEQ ID NO: 7217658 - DNA, 22 bp, Homo sapiens
taaactctcaacagagaaccac

SEQ ID NO: 7217659 - DNA, 22 bp, Homo sapiens
taaactatctgtgtttgaagtt

SEQ ID NO: 7217660 - DNA, 22 bp, Homo sapiens
taaaccttggtagcatcttgct

SEQ ID NO: 7217661 - DNA, 22 bp, Homo sapiens
taaaccttggtagcatcttgct

SEQ ID NO: 7217662 - DNA, 22 bp, Homo sapiens
taaaccttcatgatggtcatta

SEQ ID NO: 7217663 - DNA, 22 bp, Homo sapiens
taaaccttcatgatggtcatta

SEQ ID NO: 7217664 - DNA, 18 bp, Homo sapiens
taaacctttcttgtggca

SEQ ID NO: 7217665 - DNA, 18 bp, Homo sapiens
taaacctttcttgtggca

SEQ ID NO: 7217666 - DNA, 22 bp, Homo sapiens
caggacagtgcaggtccatcct

SEQ ID NO: 7217667 - DNA, 22 bp, Homo sapiens
caggacagtgcaggtccatcct

SEQ ID NO: 7217668 - DNA, 22 bp, Homo sapiens
taaactcttctgtagaatcaga

SEQ ID NO: 7217669 - DNA, 22 bp, Homo sapiens
taaactgaagctcaactcaaat

SEQ ID NO: 7217670 - DNA, 22 bp, Homo sapiens
caggacagtgcaggtccatcct

SEQ ID NO: 7217671 - DNA, 22 bp, Homo sapiens
caggacagtgcaggtccatcct

SEQ ID NO: 7217672 - DNA, 22 bp, Homo sapiens
caggacagtgcaggtccatcct

SEQ ID NO: 7217673 - DNA, 22 bp, Homo sapiens
caggacagtgcaggtccatcct

SEQ ID NO: 7217674 - DNA, 22 bp, Homo sapiens
caggacagttggcatctgctgc

SEQ ID NO: 7217675 - DNA, 22 bp, Homo sapiens
caggacagtgcaggtccatcct

SEQ ID NO: 7217676 - DNA, 22 bp, Homo sapiens
caggacagttggcatctgctgc

SEQ ID NO: 7217677 - DNA, 22 bp, Homo sapiens
caggacagttggcatctgctgc

SEQ ID NO: 7217678 - DNA, 22 bp, Homo sapiens
caggacagttggcatctgctgc

SEQ ID NO: 7217679 - DNA, 22 bp, Homo sapiens
caggacagttggcatctgctgc

SEQ ID NO: 7217680 - DNA, 22 bp, Homo sapiens
caggacagttggcatctgctgc

SEQ ID NO: 7217681 - DNA, 22 bp, Homo sapiens
caggaccaggcgttctgggctg

SEQ ID NO: 7217682 - DNA, 22 bp, Homo sapiens
caggacatctacccagtgtttc

SEQ ID NO: 7217683 - DNA, 22 bp, Homo sapiens
caggacagtttgctttgccctg

SEQ ID NO: 7217684 - DNA, 22 bp, Homo sapiens
caggacagtttgctttgccctg

SEQ ID NO: 7217685 - DNA, 22 bp, Homo sapiens
caggacagtttgctttgccctg

SEQ ID NO: 7217686 - DNA, 22 bp, Homo sapiens
caggacatcttctgtgttttta

SEQ ID NO: 7217687 - DNA, 22 bp, Homo sapiens
caggaccaggcgttctgggctg

SEQ ID NO: 7217688 - DNA, 22 bp, Homo sapiens
caggacccaacctccctgctct

SEQ ID NO: 7217689 - DNA, 22 bp, Homo sapiens
caggacagtttgctttgccctg

SEQ ID NO: 7217690 - DNA, 22 bp, Homo sapiens
caggacagtttgctttgccctg

SEQ ID NO: 7217691 - DNA, 19 bp, Homo sapiens
caggacagtttgccaagaa

SEQ ID NO: 7217692 - DNA, 19 bp, Homo sapiens
caggacagtttgccaagaa

SEQ ID NO: 7217693 - DNA, 19 bp, Homo sapiens
caggacagtttgccaagaa

SEQ ID NO: 7217694 - DNA, 19 bp, Homo sapiens
caggacagtttgccaagaa

SEQ ID NO: 7217695 - DNA, 22 bp, Homo sapiens
caggacagttggcatctgctgc

SEQ ID NO: 7217696 - DNA, 19 bp, Homo sapiens
caggacagtttgccaagaa

SEQ ID NO: 7217697 - DNA, 22 bp, Homo sapiens
caggacagttggcatctgctgc

SEQ ID NO: 7217698 - DNA, 22 bp, Homo sapiens
caggacagttggcatctgctgc

SEQ ID NO: 7217699 - DNA, 22 bp, Homo sapiens
caggagaaggtttggagtgcag

SEQ ID NO: 7217700 - DNA, 22 bp, Homo sapiens
caggagaaggtttggagtgcag

SEQ ID NO: 7217701 - DNA, 22 bp, Homo sapiens
caggacccatcagccaggcact

SEQ ID NO: 7217702 - DNA, 22 bp, Homo sapiens
caggaccccatattcactgaac

SEQ ID NO: 7217703 - DNA, 22 bp, Homo sapiens
caggaccccatattcactgaac

SEQ ID NO: 7217704 - DNA, 22 bp, Homo sapiens
caggagaagtctctagggggtg

SEQ ID NO: 7217705 - DNA, 22 bp, Homo sapiens
caggagaagtctctagggggtg

SEQ ID NO: 7217706 - DNA, 22 bp, Homo sapiens
caggagaagtctctagggggtg

SEQ ID NO: 7217707 - DNA, 22 bp, Homo sapiens
caggagaagtctctagggggtg

SEQ ID NO: 7217708 - DNA, 22 bp, Homo sapiens
caggagaaggtttggagtgcag

SEQ ID NO: 7217709 - DNA, 22 bp, Homo sapiens
caggagaaggtttggagtgcag

SEQ ID NO: 7217710 - DNA, 22 bp, Homo sapiens
caggagacaagttagcagctga

SEQ ID NO: 7217711 - DNA, 22 bp, Homo sapiens
caggagacaagttagcagctga

SEQ ID NO: 7217712 - DNA, 22 bp, Homo sapiens
caggagaagtctctagggggtg

SEQ ID NO: 7217713 - DNA, 22 bp, Homo sapiens
caggagaagtctctagggggtg

SEQ ID NO: 7217714 - DNA, 22 bp, Homo sapiens
caggagacaagttagcagctga

SEQ ID NO: 7217715 - DNA, 22 bp, Homo sapiens
caggagacaagttagcagctga

SEQ ID NO: 7217716 - DNA, 22 bp, Homo sapiens
caggagactatggcccaaggcc

SEQ ID NO: 7217717 - DNA, 22 bp, Homo sapiens
caggagactcagcatccaggat

SEQ ID NO: 7217718 - DNA, 22 bp, Homo sapiens
caggaggcagtttcagaagtca

SEQ ID NO: 7217719 - DNA, 22 bp, Homo sapiens
caggaggcagtttcagaagtca

SEQ ID NO: 7217720 - DNA, 22 bp, Homo sapiens
caggaggcagcgctctcaggac

SEQ ID NO: 7217721 - DNA, 22 bp, Homo sapiens
caggaggcagcgctctcaggac

SEQ ID NO: 7217722 - DNA, 22 bp, Homo sapiens
caggaggcaggtgcattttgag

SEQ ID NO: 7217723 - DNA, 22 bp, Homo sapiens
caggaggcagcgctctcaggac

SEQ ID NO: 7217724 - DNA, 22 bp, Homo sapiens
caggaggcagaggatgcccagt

SEQ ID NO: 7217725 - DNA, 22 bp, Homo sapiens
caggaggcagaggatgcccagt

SEQ ID NO: 7217726 - DNA, 22 bp, Homo sapiens
caggaggcagaggttgcagcga

SEQ ID NO: 7217727 - DNA, 22 bp, Homo sapiens
caggaggcagaggttgcagtga

SEQ ID NO: 7217728 - DNA, 22 bp, Homo sapiens
caggaggaaatgtgaccctgct

SEQ ID NO: 7217729 - DNA, 22 bp, Homo sapiens
caggaggaaatgtgaccctgct

SEQ ID NO: 7217730 - DNA, 22 bp, Homo sapiens
caggaggattgcttgaggccag

SEQ ID NO: 7217731 - DNA, 22 bp, Homo sapiens
caggaggaacaagaggttctgg

SEQ ID NO: 7217732 - DNA, 22 bp, Homo sapiens
caggaggaagaactctgcaaca

SEQ ID NO: 7217733 - DNA, 22 bp, Homo sapiens
caggaggcagaggatgcccagt

SEQ ID NO: 7217734 - DNA, 22 bp, Homo sapiens
caggaggcagaggatgcccagt

SEQ ID NO: 7217735 - DNA, 20 bp, Homo sapiens
caggaggcaaggtcaaggtc

SEQ ID NO: 7217736 - DNA, 20 bp, Homo sapiens
caggaggcaaggtcaaggtc

SEQ ID NO: 7217737 - DNA, 20 bp, Homo sapiens
caggaggcaaggtcaaggtc

SEQ ID NO: 7217738 - DNA, 22 bp, Homo sapiens
taaatgtactgaggcaacagga

SEQ ID NO: 7217739 - DNA, 22 bp, Homo sapiens
taaatgtactgaggcaacagga

SEQ ID NO: 7217740 - DNA, 22 bp, Homo sapiens
taaatgtactgaggcaacagga

SEQ ID NO: 7217741 - DNA, 22 bp, Homo sapiens
taaatgtagtcaaaggagcctc

SEQ ID NO: 7217742 - DNA, 22 bp, Homo sapiens
taaatgtagtcaaaggagcctc

SEQ ID NO: 7217743 - DNA, 22 bp, Homo sapiens
taaatgtaccttctgccttact

SEQ ID NO: 7217744 - DNA, 22 bp, Homo sapiens
taaatgtaccttctgccttact

SEQ ID NO: 7217745 - DNA, 22 bp, Homo sapiens
taaatgtaccttctgccttact

SEQ ID NO: 7217746 - DNA, 22 bp, Homo sapiens
taaatgtactgaggcaacagga

SEQ ID NO: 7217747 - DNA, 22 bp, Homo sapiens
taaatgtaaatggcgtcttgcg

SEQ ID NO: 7217748 - DNA, 22 bp, Homo sapiens
taaatgtaaatggcgtcttgcg

SEQ ID NO: 7217749 - DNA, 22 bp, Homo sapiens
taaatggtatccttgctgtgct

SEQ ID NO: 7217750 - DNA, 20 bp, Homo sapiens
taaatggtgcatttcttata

SEQ ID NO: 7217751 - DNA, 20 bp, Homo sapiens
taaatggtgcatttcttata

SEQ ID NO: 7217752 - DNA, 20 bp, Homo sapiens
taaatggtgcatttcttata

SEQ ID NO: 7217753 - DNA, 22 bp, Homo sapiens
taaatggttccgtgattcatga

SEQ ID NO: 7217754 - DNA, 22 bp, Homo sapiens
taaatggttccgtgattcatga

SEQ ID NO: 7217755 - DNA, 22 bp, Homo sapiens
taaatggttccgtgattcatga

SEQ ID NO: 7217756 - DNA, 22 bp, Homo sapiens
taaatgtataggcactaaacct

SEQ ID NO: 7217757 - DNA, 22 bp, Homo sapiens
taaatgtcaatgtgatttataa

SEQ ID NO: 7217758 - DNA, 22 bp, Homo sapiens
taaatgtctcccgtgagcctca

SEQ ID NO: 7217759 - DNA, 22 bp, Homo sapiens
taaatgtctcccgtgagcctca

SEQ ID NO: 7217760 - DNA, 22 bp, Homo sapiens
taaatgtctgttaacatgaatg

SEQ ID NO: 7217761 - DNA, 22 bp, Homo sapiens
taaatgtataggcactaaacct

SEQ ID NO: 7217762 - DNA, 22 bp, Homo sapiens
taaatgtataggcactaaacct

SEQ ID NO: 7217763 - DNA, 22 bp, Homo sapiens
taaatgtataggcactaaacct

SEQ ID NO: 7217764 - DNA, 22 bp, Homo sapiens
taaatgtataggcactaaacct

SEQ ID NO: 7217765 - DNA, 22 bp, Homo sapiens
taaatgtagtcaaaggagcctc

SEQ ID NO: 7217766 - DNA, 22 bp, Homo sapiens
taaatgtataggcactaaacct

SEQ ID NO: 7217767 - DNA, 22 bp, Homo sapiens
taaatgtataggcactaaacct

SEQ ID NO: 7217768 - DNA, 22 bp, Homo sapiens
taaatgtgcacaggttagaagg

SEQ ID NO: 7217769 - DNA, 22 bp, Homo sapiens
caggagctggatctccttgcgg

SEQ ID NO: 7217770 - DNA, 22 bp, Homo sapiens
caggagctgggtctggaagcag

SEQ ID NO: 7217771 - DNA, 22 bp, Homo sapiens
caggagctttcttcccaaactt

SEQ ID NO: 7217772 - DNA, 22 bp, Homo sapiens
caggagcttctgcccatggcca

SEQ ID NO: 7217773 - DNA, 22 bp, Homo sapiens
caggagctgggtctggaagcag

SEQ ID NO: 7217774 - DNA, 22 bp, Homo sapiens
caggagctgggtctggaagcag

SEQ ID NO: 7217775 - DNA, 22 bp, Homo sapiens
caggagcttctgcccatggcca

SEQ ID NO: 7217776 - DNA, 22 bp, Homo sapiens
caggaggctttgggatccaagt

SEQ ID NO: 7217777 - DNA, 22 bp, Homo sapiens
caggaggctcctagggctctgt

SEQ ID NO: 7217778 - DNA, 22 bp, Homo sapiens
caggaggcgtcttcagtttgtt

SEQ ID NO: 7217779 - DNA, 23 bp, Homo sapiens
caggagggaatgaagttagacaa

SEQ ID NO: 7217780 - DNA, 20 bp, Homo sapiens
caggagggacatttcagcat

SEQ ID NO: 7217781 - DNA, 22 bp, Homo sapiens
caggagggcccgagactcttcc

SEQ ID NO: 7217782 - DNA, 22 bp, Homo sapiens
caggagggcccgagactcttcc

SEQ ID NO: 7217783 - DNA, 22 bp, Homo sapiens
caggagggcccgagactcttcc

SEQ ID NO: 7217784 - DNA, 22 bp, Homo sapiens
caggagggcccgagactcttcc

SEQ ID NO: 7217785 - DNA, 22 bp, Homo sapiens
caggagggggtggagtttcgcc

SEQ ID NO: 7217786 - DNA, 22 bp, Homo sapiens
caggagggtgtggaaaactggg

SEQ ID NO: 7217787 - DNA, 22 bp, Homo sapiens
caggagggtgtggaaaactggg

SEQ ID NO: 7217788 - DNA, 22 bp, Homo sapiens
caggaggccaactgtgggactt

SEQ ID NO: 7217789 - DNA, 22 bp, Homo sapiens
caggaggccaactgtgggactt

SEQ ID NO: 7217790 - DNA, 22 bp, Homo sapiens
caggaggcatatttaaatccaa

SEQ ID NO: 7217791 - DNA, 22 bp, Homo sapiens
caggaggcccggccacagccca

SEQ ID NO: 7217792 - DNA, 22 bp, Homo sapiens
caggagtggtgtgagggactcc

SEQ ID NO: 7217793 - DNA, 22 bp, Homo sapiens
caggagtggtgtgagggactcc

SEQ ID NO: 7217794 - DNA, 22 bp, Homo sapiens
caggagtgcaggtggtgaggca

SEQ ID NO: 7217795 - DNA, 22 bp, Homo sapiens
caggagtgcaggtggtgaggca

SEQ ID NO: 7217796 - DNA, 22 bp, Homo sapiens
caggagtgcaggtggtgaggca

SEQ ID NO: 7217797 - DNA, 22 bp, Homo sapiens
caggagtgcaggtggtgaggca

SEQ ID NO: 7217798 - DNA, 22 bp, Homo sapiens
caggagtgcaggtggtgaggca

SEQ ID NO: 7217799 - DNA, 22 bp, Homo sapiens
caggagtgcaggtggtgaggca

SEQ ID NO: 7217800 - DNA, 22 bp, Homo sapiens
caggagtgagttggggtctaca

SEQ ID NO: 7217801 - DNA, 22 bp, Homo sapiens
caggagtgagttggggtctaca

SEQ ID NO: 7217802 - DNA, 22 bp, Homo sapiens
caggagtgagttggggtctaca

SEQ ID NO: 7217803 - DNA, 22 bp, Homo sapiens
caggagtgtcgggtcactaggt

SEQ ID NO: 7217804 - DNA, 22 bp, Homo sapiens
caggagtggtgtgagggactcc

SEQ ID NO: 7217805 - DNA, 22 bp, Homo sapiens
caggagtggtgtgagggactcc

SEQ ID NO: 7217806 - DNA, 22 bp, Homo sapiens
caggagtgttgattgctcagga

SEQ ID NO: 7217807 - DNA, 22 bp, Homo sapiens
caggagtgtctccacacagcaa

SEQ ID NO: 7217808 - DNA, 22 bp, Homo sapiens
caggagtgttgattgctcagga

SEQ ID NO: 7217809 - DNA, 22 bp, Homo sapiens
caggagttcaaggttgcagtga

SEQ ID NO: 7217810 - DNA, 22 bp, Homo sapiens
caggagtttctattgttccaaa

SEQ ID NO: 7217811 - DNA, 22 bp, Homo sapiens
caggagttggtaatattgtgga

SEQ ID NO: 7217812 - DNA, 22 bp, Homo sapiens
caggagtttctattgttccaaa

SEQ ID NO: 7217813 - DNA, 22 bp, Homo sapiens
caggagtttctattgttccaaa

SEQ ID NO: 7217814 - DNA, 22 bp, Homo sapiens
caggataacagaaaatagctga

SEQ ID NO: 7217815 - DNA, 22 bp, Homo sapiens
caggatagaaaggccatggagt

SEQ ID NO: 7217816 - DNA, 22 bp, Homo sapiens
taacaaaggttgccaaactaag

SEQ ID NO: 7217817 - DNA, 22 bp, Homo sapiens
taacaaaggttgccaaactaag

SEQ ID NO: 7217818 - DNA, 22 bp, Homo sapiens
taacaaagtaccatagactgga

SEQ ID NO: 7217819 - DNA, 22 bp, Homo sapiens
taacaaagtaccatagattggg

SEQ ID NO: 7217820 - DNA, 22 bp, Homo sapiens
taacaaagtaccatagattggg

SEQ ID NO: 7217821 - DNA, 22 bp, Homo sapiens
taacaaagtaccatagattggg

SEQ ID NO: 7217822 - DNA, 22 bp, Homo sapiens
taacaaagtaccatagattggg

SEQ ID NO: 7217823 - DNA, 22 bp, Homo sapiens
taacaaagtattgtttgtgtat

SEQ ID NO: 7217824 - DNA, 22 bp, Homo sapiens
taacaaagtattgtttgtgtat

SEQ ID NO: 7217825 - DNA, 22 bp, Homo sapiens
taacaaagtattgtttgtgtat

SEQ ID NO: 7217826 - DNA, 19 bp, Homo sapiens
taacaaagtctgaagtcag

SEQ ID NO: 7217827 - DNA, 22 bp, Homo sapiens
caggagctcttaaggatgtgat

SEQ ID NO: 7217828 - DNA, 22 bp, Homo sapiens
caggagctcttaaggatgtgat

SEQ ID NO: 7217829 - DNA, 22 bp, Homo sapiens
caggagctcttaaggatgtgat

SEQ ID NO: 7217830 - DNA, 22 bp, Homo sapiens
caggagctcttaaggatgtgat

SEQ ID NO: 7217831 - DNA, 22 bp, Homo sapiens
caggagctggataggaccacaa

SEQ ID NO: 7217832 - DNA, 22 bp, Homo sapiens
taaagcagtgcaaaagcgtttt

SEQ ID NO: 7217833 - DNA, 22 bp, Homo sapiens
taaagcagtgcaaaagcgtttt

SEQ ID NO: 7217834 - DNA, 22 bp, Homo sapiens
taaagcagtggttctcaaactt

SEQ ID NO: 7217835 - DNA, 22 bp, Homo sapiens
taaagcagtgtggttgtgtccc

SEQ ID NO: 7217836 - DNA, 22 bp, Homo sapiens
taaagcagtgtggttgtgtccc

SEQ ID NO: 7217837 - DNA, 22 bp, Homo sapiens
taaagcagtgtggttgtgtccc

SEQ ID NO: 7217838 - DNA, 22 bp, Homo sapiens
taaagcagtgtggttgtgtccc

SEQ ID NO: 7217839 - DNA, 22 bp, Homo sapiens
taaagcagtgttgggtcggacg

SEQ ID NO: 7217840 - DNA, 22 bp, Homo sapiens
taaagcagtgttgggtcggacg

SEQ ID NO: 7217841 - DNA, 22 bp, Homo sapiens
taaagcataatgaatatctaga

SEQ ID NO: 7217842 - DNA, 22 bp, Homo sapiens
taaagcataatgaatatctaga

SEQ ID NO: 7217843 - DNA, 22 bp, Homo sapiens
taaagcataatgaatatctaga

SEQ ID NO: 7217844 - DNA, 22 bp, Homo sapiens
caggagctactcaggttgggtt

SEQ ID NO: 7217845 - DNA, 22 bp, Homo sapiens
caggagctactcaggttgggtt

SEQ ID NO: 7217846 - DNA, 22 bp, Homo sapiens
caggagctactcaggttgggtt

SEQ ID NO: 7217847 - DNA, 22 bp, Homo sapiens
caggagctcacagtctttgggt

SEQ ID NO: 7217848 - DNA, 22 bp, Homo sapiens
caggagctcactgtctaatggg

SEQ ID NO: 7217849 - DNA, 22 bp, Homo sapiens
caggagctcactgtctaatggg

SEQ ID NO: 7217850 - DNA, 22 bp, Homo sapiens
caggagctcagatgacatctca

SEQ ID NO: 7217851 - DNA, 22 bp, Homo sapiens
caggagatgtaagacttctgtt

SEQ ID NO: 7217852 - DNA, 22 bp, Homo sapiens
caggagatgtaagacttctgtt

SEQ ID NO: 7217853 - DNA, 22 bp, Homo sapiens
caggagatgtacctgtttttga

SEQ ID NO: 7217854 - DNA, 22 bp, Homo sapiens
caggagcaaatccaaaagaatt

SEQ ID NO: 7217855 - DNA, 22 bp, Homo sapiens
caggagcaaggagcagtgggat

SEQ ID NO: 7217856 - DNA, 22 bp, Homo sapiens
caggagcaaggagcagtgggat

SEQ ID NO: 7217857 - DNA, 23 bp, Homo sapiens
caggagatggctgctgtgtcagc

SEQ ID NO: 7217858 - DNA, 23 bp, Homo sapiens
caggagatggctgctgtgtcagc

SEQ ID NO: 7217859 - DNA, 22 bp, Homo sapiens
caggagatgacagggaagaacc

SEQ ID NO: 7217860 - DNA, 22 bp, Homo sapiens
caggagaggctgtacgtttctc

SEQ ID NO: 7217861 - DNA, 22 bp, Homo sapiens
caggagataaaagagatgcttt

SEQ ID NO: 7217862 - DNA, 22 bp, Homo sapiens
caggagataaaagagatgcttt

SEQ ID NO: 7217863 - DNA, 22 bp, Homo sapiens
caggagaggaggctacttctta

SEQ ID NO: 7217864 - DNA, 22 bp, Homo sapiens
caggagaggaggctacttctta

SEQ ID NO: 7217865 - DNA, 22 bp, Homo sapiens
caggagaggctgtacgtttctc

SEQ ID NO: 7217866 - DNA, 22 bp, Homo sapiens
caggagataaaagagatgcttt

SEQ ID NO: 7217867 - DNA, 22 bp, Homo sapiens
caggagataaaagagatgcttt

SEQ ID NO: 7217868 - DNA, 22 bp, Homo sapiens
caggagatcttaggaattctta

SEQ ID NO: 7217869 - DNA, 22 bp, Homo sapiens
caggagatgacagggaagaacc

SEQ ID NO: 7217870 - DNA, 22 bp, Homo sapiens
caggagatgacagggaagaacc

SEQ ID NO: 7217871 - DNA, 22 bp, Homo sapiens
caggagatgacagggaagaacc

SEQ ID NO: 7217872 - DNA, 22 bp, Homo sapiens
caggagatgacagggaagaacc

SEQ ID NO: 7217873 - DNA, 22 bp, Homo sapiens
caggagatgacagggaagaacc

SEQ ID NO: 7217874 - DNA, 22 bp, Homo sapiens
caggagatgacagggaagaacc

SEQ ID NO: 7217875 - DNA, 22 bp, Homo sapiens
caggagagatatgagtccccac

SEQ ID NO: 7217876 - DNA, 22 bp, Homo sapiens
caggagactcagcatccaggat

SEQ ID NO: 7217877 - DNA, 22 bp, Homo sapiens
caggagagatatgagtccccac

SEQ ID NO: 7217878 - DNA, 22 bp, Homo sapiens
caggagagatatgagtccccac

SEQ ID NO: 7217879 - DNA, 22 bp, Homo sapiens
caggagagatatgagtccccac

SEQ ID NO: 7217880 - DNA, 22 bp, Homo sapiens
caggagagatatgagtccccac

SEQ ID NO: 7217881 - DNA, 22 bp, Homo sapiens
caggagagatatgagtccccac

SEQ ID NO: 7217882 - DNA, 19 bp, Homo sapiens
caggagagcatgcactttg

SEQ ID NO: 7217883 - DNA, 19 bp, Homo sapiens
caggagagcatgcactttg

SEQ ID NO: 7217884 - DNA, 22 bp, Homo sapiens
caggagagcccgggtccgggct

SEQ ID NO: 7217885 - DNA, 22 bp, Homo sapiens
caggagagcccgggtccgggct

SEQ ID NO: 7217886 - DNA, 19 bp, Homo sapiens
caggagagcatgcactttg

SEQ ID NO: 7217887 - DNA, 19 bp, Homo sapiens
caggagagcatgcactttg

SEQ ID NO: 7217888 - DNA, 22 bp, Homo sapiens
caggagagcccgggtccgggct

SEQ ID NO: 7217889 - DNA, 15 bp, Homo sapiens
caggagaggaaggtt

SEQ ID NO: 7217890 - DNA, 15 bp, Homo sapiens
caggagaggaaggtt

SEQ ID NO: 7217891 - DNA, 22 bp, Homo sapiens
caggagaggaggctacttctta

SEQ ID NO: 7217892 - DNA, 22 bp, Homo sapiens
taaagtcatctttacatctttg

SEQ ID NO: 7217893 - DNA, 22 bp, Homo sapiens
taaagtcatctttacatctttg

SEQ ID NO: 7217894 - DNA, 22 bp, Homo sapiens
taaagtcatctttacatctttg

SEQ ID NO: 7217895 - DNA, 22 bp, Homo sapiens
taaagtcatctttaaacatgcc

SEQ ID NO: 7217896 - DNA, 22 bp, Homo sapiens
taaagtcatctttacatctttg

SEQ ID NO: 7217897 - DNA, 22 bp, Homo sapiens
taaagtccttgaaccggatgta

SEQ ID NO: 7217898 - DNA, 22 bp, Homo sapiens
taaagtgaaggtcataatgatt

SEQ ID NO: 7217899 - DNA, 22 bp, Homo sapiens
taaagtgaaggtcataatgatt

SEQ ID NO: 7217900 - DNA, 22 bp, Homo sapiens
taaagtgaagttcagaatggct

SEQ ID NO: 7217901 - DNA, 22 bp, Homo sapiens
taaagtcagggagattgaggct

SEQ ID NO: 7217902 - DNA, 22 bp, Homo sapiens
taaagtcagatatctgggttga

SEQ ID NO: 7217903 - DNA, 22 bp, Homo sapiens
taaagtcagatatctgggttga

SEQ ID NO: 7217904 - DNA, 22 bp, Homo sapiens
taaagtcagggagattgaggct

SEQ ID NO: 7217905 - DNA, 22 bp, Homo sapiens
taaagtcataagagtggatccg

SEQ ID NO: 7217906 - DNA, 22 bp, Homo sapiens
taaagtcatctttaaacatgcc

SEQ ID NO: 7217907 - DNA, 23 bp, Homo sapiens
taaagtcacatattagagtgagc

SEQ ID NO: 7217908 - DNA, 22 bp, Homo sapiens
taaagtcacagagcaggtgcaa

SEQ ID NO: 7217909 - DNA, 23 bp, Homo sapiens
taaagtcacatattagagtgagc

SEQ ID NO: 7217910 - DNA, 22 bp, Homo sapiens
taaagtcagagatccttggctt

SEQ ID NO: 7217911 - DNA, 22 bp, Homo sapiens
taaagccatactgaaagccact

SEQ ID NO: 7217912 - DNA, 22 bp, Homo sapiens
taaagccatactgaaagccact

SEQ ID NO: 7217913 - DNA, 22 bp, Homo sapiens
taaagctaaccttagtgaacac

SEQ ID NO: 7217914 - DNA, 22 bp, Homo sapiens
taaagctaaccttagtgaacac

SEQ ID NO: 7217915 - DNA, 22 bp, Homo sapiens
taaagctacacattattaatcc

SEQ ID NO: 7217916 - DNA, 22 bp, Homo sapiens
taaagccacttcattctagtct

SEQ ID NO: 7217917 - DNA, 17 bp, Homo sapiens
taaagccagtcaagtca

SEQ ID NO: 7217918 - DNA, 22 bp, Homo sapiens
taaagccacttcattctagtct

SEQ ID NO: 7217919 - DNA, 22 bp, Homo sapiens
taaagccacgctggaaatcagg

SEQ ID NO: 7217920 - DNA, 22 bp, Homo sapiens
taaagccacgctggaaatcagg

SEQ ID NO: 7217921 - DNA, 22 bp, Homo sapiens
taaagcatgtgttagaagtgca

SEQ ID NO: 7217922 - DNA, 22 bp, Homo sapiens
taaagcatttttgaaattatga

SEQ ID NO: 7217923 - DNA, 22 bp, Homo sapiens
taaagcatttttgaaattatga

SEQ ID NO: 7217924 - DNA, 22 bp, Homo sapiens
taaagcatttttgaaattatga

SEQ ID NO: 7217925 - DNA, 18 bp, Homo sapiens
taaatatatttccccctt

SEQ ID NO: 7217926 - DNA, 18 bp, Homo sapiens
taaatatatttccccctt

SEQ ID NO: 7217927 - DNA, 22 bp, Homo sapiens
taaatagagaatcagcttggag

SEQ ID NO: 7217928 - DNA, 22 bp, Homo sapiens
taaatagaatctaaactgctca

SEQ ID NO: 7217929 - DNA, 22 bp, Homo sapiens
taaatagagaatcagcttggag

SEQ ID NO: 7217930 - DNA, 22 bp, Homo sapiens
taaatagagaatcagcttggag

SEQ ID NO: 7217931 - DNA, 22 bp, Homo sapiens
taaatagggaatagaagaggaa

SEQ ID NO: 7217932 - DNA, 22 bp, Homo sapiens
taaatagggtaagcgtgtttac

SEQ ID NO: 7217933 - DNA, 22 bp, Homo sapiens
taaagtgaagttcagaatggct

SEQ ID NO: 7217934 - DNA, 22 bp, Homo sapiens
taaagtgagtacaaaatgaggg

SEQ ID NO: 7217935 - DNA, 22 bp, Homo sapiens
taaagtgcagactcccggaaac

SEQ ID NO: 7217936 - DNA, 22 bp, Homo sapiens
taaagtgcagactcccggaaac

SEQ ID NO: 7217937 - DNA, 22 bp, Homo sapiens
taaagtgcagattgtgattcag

SEQ ID NO: 7217938 - DNA, 22 bp, Homo sapiens
taaagtgcagattgtgattcag

SEQ ID NO: 7217939 - DNA, 22 bp, Homo sapiens
taaagtgcaggctactcagaag

SEQ ID NO: 7217940 - DNA, 22 bp, Homo sapiens
taaagtgcaggctactcagaag

SEQ ID NO: 7217941 - DNA, 22 bp, Homo sapiens
taaagtgcatgcggggccagat

SEQ ID NO: 7217942 - DNA, 22 bp, Homo sapiens
taaagtgcatgcggggccagat

SEQ ID NO: 7217943 - DNA, 22 bp, Homo sapiens
taaagtgcccagggaaagcggg

SEQ ID NO: 7217944 - DNA, 22 bp, Homo sapiens
taaatatcacctggaattgtta

SEQ ID NO: 7217945 - DNA, 22 bp, Homo sapiens
taaatatgcatgtatccttatc

SEQ ID NO: 7217946 - DNA, 22 bp, Homo sapiens
taaatcaagaatatcagcttgt

SEQ ID NO: 7217947 - DNA, 22 bp, Homo sapiens
taaatcaagaatatcagcttgt

SEQ ID NO: 7217948 - DNA, 22 bp, Homo sapiens
taaatcaagaatatcagcttgt

SEQ ID NO: 7217949 - DNA, 22 bp, Homo sapiens
taaatatgcatgtatccttatc

SEQ ID NO: 7217950 - DNA, 22 bp, Homo sapiens
taaatatgcatgtatccttatc

SEQ ID NO: 7217951 - DNA, 22 bp, Homo sapiens
taaatgcttagattcatagaaa

SEQ ID NO: 7217952 - DNA, 22 bp, Homo sapiens
taaatgctttctatgaaagagg

SEQ ID NO: 7217953 - DNA, 22 bp, Homo sapiens
taaatcacattcgtctgctcct

SEQ ID NO: 7217954 - DNA, 22 bp, Homo sapiens
taaatcacattttctttgtgtt

SEQ ID NO: 7217955 - DNA, 22 bp, Homo sapiens
taaatcacccatctcctaatct

SEQ ID NO: 7217956 - DNA, 22 bp, Homo sapiens
taaatcacaaattttctcattt

SEQ ID NO: 7217957 - DNA, 22 bp, Homo sapiens
taaatcacatcgaaatctgggt

SEQ ID NO: 7217958 - DNA, 22 bp, Homo sapiens
ccagaagcttctacacaggaga

SEQ ID NO: 7217959 - DNA, 22 bp, Homo sapiens
ccagaagcttctacacaggaga

SEQ ID NO: 7217960 - DNA, 22 bp, Homo sapiens
ccagaagcttcaaggagattct

SEQ ID NO: 7217961 - DNA, 22 bp, Homo sapiens
ccagaagcttctacacaggaga

SEQ ID NO: 7217962 - DNA, 22 bp, Homo sapiens
ccagaaggcggagattgcagtg

SEQ ID NO: 7217963 - DNA, 22 bp, Homo sapiens
ccagaaggcggagattgcagtg

SEQ ID NO: 7217964 - DNA, 22 bp, Homo sapiens
ccagaagcagagcctgaggcag

SEQ ID NO: 7217965 - DNA, 22 bp, Homo sapiens
ccagaagccctttgtttgttgt

SEQ ID NO: 7217966 - DNA, 22 bp, Homo sapiens
ccagaagctatgttttagataa

SEQ ID NO: 7217967 - DNA, 22 bp, Homo sapiens
ccagaagctatgttttagataa

SEQ ID NO: 7217968 - DNA, 21 bp, Homo sapiens
ccagaagctgcttgcaggcta

SEQ ID NO: 7217969 - DNA, 21 bp, Homo sapiens
ccagaagctgcttgcaggcta

SEQ ID NO: 7217970 - DNA, 21 bp, Homo sapiens
ccagaagctgcttgcaggcta

SEQ ID NO: 7217971 - DNA, 22 bp, Homo sapiens
ccagaagcttcaaggagattct

SEQ ID NO: 7217972 - DNA, 22 bp, Homo sapiens
ccagaagagatcacagttcttg

SEQ ID NO: 7217973 - DNA, 22 bp, Homo sapiens
ccagaagagatcacagttcttg

SEQ ID NO: 7217974 - DNA, 22 bp, Homo sapiens
ccagaagagatcacagttcttg

SEQ ID NO: 7217975 - DNA, 22 bp, Homo sapiens
ccagaagcaaaacagacagttt

SEQ ID NO: 7217976 - DNA, 22 bp, Homo sapiens
ccagaagcacctccttttgtgc

SEQ ID NO: 7217977 - DNA, 20 bp, Homo sapiens
ccagaagcactcttcatgtt

SEQ ID NO: 7217978 - DNA, 20 bp, Homo sapiens
ccagaagcactcttcatgtt

SEQ ID NO: 7217979 - DNA, 20 bp, Homo sapiens
ccagaaggtttgccactttc

SEQ ID NO: 7217980 - DNA, 20 bp, Homo sapiens
ccagaaggtaggatggaaca

SEQ ID NO: 7217981 - DNA, 20 bp, Homo sapiens
ccagaaggtaggatggaaca

SEQ ID NO: 7217982 - DNA, 22 bp, Homo sapiens
ccagaagtcaggaatgagtctt

SEQ ID NO: 7217983 - DNA, 22 bp, Homo sapiens
ccagaagggctattgcagtgac

SEQ ID NO: 7217984 - DNA, 19 bp, Homo sapiens
ccagaagggcagctatgga

SEQ ID NO: 7217985 - DNA, 19 bp, Homo sapiens
ccagaagggcagctatgga

SEQ ID NO: 7217986 - DNA, 22 bp, Homo sapiens
ccagaagggctattgcagtgac

SEQ ID NO: 7217987 - DNA, 22 bp, Homo sapiens
ccagaagggctattgcagtgac

SEQ ID NO: 7217988 - DNA, 20 bp, Homo sapiens
ccagaaggtaggatggaaca

SEQ ID NO: 7217989 - DNA, 22 bp, Homo sapiens
ccagaagtgtctatcaagatgt

SEQ ID NO: 7217990 - DNA, 22 bp, Homo sapiens
ccagaagtgtctatcaagatgt

SEQ ID NO: 7217991 - DNA, 22 bp, Homo sapiens
ccagaagttcctaagcatcatt

SEQ ID NO: 7217992 - DNA, 22 bp, Homo sapiens
ccagaatcatcatctgaagcct

SEQ ID NO: 7217993 - DNA, 22 bp, Homo sapiens
ccagaatcatcatctgaagcct

SEQ ID NO: 7217994 - DNA, 22 bp, Homo sapiens
ccagaatccaaaacgttttgag

SEQ ID NO: 7217995 - DNA, 22 bp, Homo sapiens
ccagaatccacattccccagag

SEQ ID NO: 7217996 - DNA, 22 bp, Homo sapiens
ccagaatccacattccccagag

SEQ ID NO: 7217997 - DNA, 22 bp, Homo sapiens
ccagaatcccattgtcacttca

SEQ ID NO: 7217998 - DNA, 23 bp, Homo sapiens
ccagaatctactcattggaatga

SEQ ID NO: 7217999 - DNA, 23 bp, Homo sapiens
ccagaatctactcattggaatga

SEQ ID NO: 7218000 - DNA, 22 bp, Homo sapiens
ccagaatctcaatacctttcaa

SEQ ID NO: 7218001 - DNA, 22 bp, Homo sapiens
ccactgccccctgaagaccagg

SEQ ID NO: 7218002 - DNA, 22 bp, Homo sapiens
ccactgcccaccccgacgtcta

SEQ ID NO: 7218003 - DNA, 22 bp, Homo sapiens
ccactgcccaccccgacgtcta

SEQ ID NO: 7218004 - DNA, 22 bp, Homo sapiens
ccactgcccaccccgacgtcta

SEQ ID NO: 7218005 - DNA, 22 bp, Homo sapiens
ccactgccccctgaagaccagg

SEQ ID NO: 7218006 - DNA, 22 bp, Homo sapiens
ccactgccgatgttccatcttg

SEQ ID NO: 7218007 - DNA, 22 bp, Homo sapiens
ccactgccgatgttccatcttg

SEQ ID NO: 7218008 - DNA, 22 bp, Homo sapiens
ccactgccgtgggccttgggga

SEQ ID NO: 7218009 - DNA, 22 bp, Homo sapiens
ccactgccccctgaagaccagg

SEQ ID NO: 7218010 - DNA, 22 bp, Homo sapiens
ccactgccagctttgtcctccc

SEQ ID NO: 7218011 - DNA, 22 bp, Homo sapiens
ccactgccagccgcccggaggc

SEQ ID NO: 7218012 - DNA, 22 bp, Homo sapiens
ccactgccagctttgtcctccc

SEQ ID NO: 7218013 - DNA, 22 bp, Homo sapiens
ccactgccagctttgtcctccc

SEQ ID NO: 7218014 - DNA, 22 bp, Homo sapiens
ccactgccatgggctaggcatg

SEQ ID NO: 7218015 - DNA, 22 bp, Homo sapiens
ccactgccatgggctaggcatg

SEQ ID NO: 7218016 - DNA, 22 bp, Homo sapiens
ccactgccagctttgtcctccc

SEQ ID NO: 7218017 - DNA, 22 bp, Homo sapiens
ccactgccgtgggccttgggga

SEQ ID NO: 7218018 - DNA, 22 bp, Homo sapiens
ccactgcctatttgcagggccc

SEQ ID NO: 7218019 - DNA, 22 bp, Homo sapiens
ccactgcctatttgcagggccc

SEQ ID NO: 7218020 - DNA, 22 bp, Homo sapiens
ccactgcctctccagggccatc

SEQ ID NO: 7218021 - DNA, 22 bp, Homo sapiens
ccactgcctctccagggccatc

SEQ ID NO: 7218022 - DNA, 22 bp, Homo sapiens
ccactgcctgacttagatgaca

SEQ ID NO: 7218023 - DNA, 22 bp, Homo sapiens
ccagaaaagcatctggttcttt

SEQ ID NO: 7218024 - DNA, 22 bp, Homo sapiens
ccagaaaagcatctggttcttt

SEQ ID NO: 7218025 - DNA, 22 bp, Homo sapiens
ccagaaaaggagctgcaggatg

SEQ ID NO: 7218026 - DNA, 22 bp, Homo sapiens
ccactgagtgagcagagcaggg

SEQ ID NO: 7218027 - DNA, 22 bp, Homo sapiens
ccactgagtgagcagagcaggg

SEQ ID NO: 7218028 - DNA, 22 bp, Homo sapiens
ccactgatcctgactttggagc

SEQ ID NO: 7218029 - DNA, 23 bp, Homo sapiens
ccactgatgcattttctctctgt

SEQ ID NO: 7218030 - DNA, 22 bp, Homo sapiens
ccactgcactccagcctgccaa

SEQ ID NO: 7218031 - DNA, 22 bp, Homo sapiens
ccactgcactccagccttggca

SEQ ID NO: 7218032 - DNA, 22 bp, Homo sapiens
ccactgcacttcagcctgggtg

SEQ ID NO: 7218033 - DNA, 22 bp, Homo sapiens
ccactgccagccgcccggaggc

SEQ ID NO: 7218034 - DNA, 22 bp, Homo sapiens
ccactgccagccgcccggaggc

SEQ ID NO: 7218035 - DNA, 22 bp, Homo sapiens
ccactgaggcctgggcccaggg

SEQ ID NO: 7218036 - DNA, 22 bp, Homo sapiens
ccactgaggaacatgggctcca

SEQ ID NO: 7218037 - DNA, 22 bp, Homo sapiens
ccactgagcagtagctgcgtcg

SEQ ID NO: 7218038 - DNA, 22 bp, Homo sapiens
ccactgactccaggagctgagg

SEQ ID NO: 7218039 - DNA, 22 bp, Homo sapiens
ccactgacacagacaaggcctg

SEQ ID NO: 7218040 - DNA, 22 bp, Homo sapiens
ccactgacacagacaaggcctg

SEQ ID NO: 7218041 - DNA, 22 bp, Homo sapiens
ccactgagaagcacagcttgtc

SEQ ID NO: 7218042 - DNA, 23 bp, Homo sapiens
ccactgaagaatccagggagttt

SEQ ID NO: 7218043 - DNA, 22 bp, Homo sapiens
ccactgaaggtcaacatagagc

SEQ ID NO: 7218044 - DNA, 22 bp, Homo sapiens
ccactctgctgtgctccatgat

SEQ ID NO: 7218045 - DNA, 22 bp, Homo sapiens
ccactcttgaatcaagagctca

SEQ ID NO: 7218046 - DNA, 22 bp, Homo sapiens
ccactctgattttggctccact

SEQ ID NO: 7218047 - DNA, 22 bp, Homo sapiens
ccactctgattttggctccact

SEQ ID NO: 7218048 - DNA, 16 bp, Homo sapiens
ccacctgcagctctca

SEQ ID NO: 7218049 - DNA, 23 bp, Homo sapiens
ccacctggactctgggcaggtgc

SEQ ID NO: 7218050 - DNA, 23 bp, Homo sapiens
ccactctcccaccatatctgtat

SEQ ID NO: 7218051 - DNA, 21 bp, Homo sapiens
ccactctgagtgttgaacaga

SEQ ID NO: 7218052 - DNA, 22 bp, Homo sapiens
ccactctgatttcaagggagat

SEQ ID NO: 7218053 - DNA, 22 bp, Homo sapiens
ccacagtccgggctggcaggac

SEQ ID NO: 7218054 - DNA, 22 bp, Homo sapiens
ccacagtaggaacaagttgtcg

SEQ ID NO: 7218055 - DNA, 22 bp, Homo sapiens
ccacagtagaattcatctccct

SEQ ID NO: 7218056 - DNA, 22 bp, Homo sapiens
ccacagtagcatccaaacagta

SEQ ID NO: 7218057 - DNA, 22 bp, Homo sapiens
ccacagtcctggcttctgtctg

SEQ ID NO: 7218058 - DNA, 22 bp, Homo sapiens
ccacagtctatgcaacaaggtc

SEQ ID NO: 7218059 - DNA, 16 bp, Homo sapiens
ccacctgcagctctca

SEQ ID NO: 7218060 - DNA, 16 bp, Homo sapiens
ccacctgcagctctca

SEQ ID NO: 7218061 - DNA, 16 bp, Homo sapiens
ccacctgcagctctca

SEQ ID NO: 7218062 - DNA, 22 bp, Homo sapiens
ccacctgctggttttgctctcc

SEQ ID NO: 7218063 - DNA, 22 bp, Homo sapiens
ccacagtgagttagattgacca

SEQ ID NO: 7218064 - DNA, 18 bp, Homo sapiens
tcctggtggagaagtggt

SEQ ID NO: 7218065 - DNA, 18 bp, Homo sapiens
tcctggtggagaagtggt

SEQ ID NO: 7218066 - DNA, 18 bp, Homo sapiens
tcctggtggagaagtggt

SEQ ID NO: 7218067 - DNA, 20 bp, Homo sapiens
tcctggtggatactgcttaa

SEQ ID NO: 7218068 - DNA, 22 bp, Homo sapiens
tcctggtgcttgtatttgaagt

SEQ ID NO: 7218069 - DNA, 19 bp, Homo sapiens
tcctggtgcttgacactga

SEQ ID NO: 7218070 - DNA, 22 bp, Homo sapiens
tcctggtgcttgtatttgaagt

SEQ ID NO: 7218071 - DNA, 20 bp, Homo sapiens
tcctggtggatactgcttaa

SEQ ID NO: 7218072 - DNA, 20 bp, Homo sapiens
tcctggtggatactgcttaa

SEQ ID NO: 7218073 - DNA, 22 bp, Homo sapiens
tcctggtggatagaagccaagg

SEQ ID NO: 7218074 - DNA, 22 bp, Homo sapiens
tcctggtggatagaagccaagg

SEQ ID NO: 7218075 - DNA, 22 bp, Homo sapiens
ccacagggtcagccactctgca

SEQ ID NO: 7218076 - DNA, 22 bp, Homo sapiens
ccacagggtcagccactctgca

SEQ ID NO: 7218077 - DNA, 22 bp, Homo sapiens
ccacagggtcagccactctgca

SEQ ID NO: 7218078 - DNA, 22 bp, Homo sapiens
ccacagggtcagccactctgca

SEQ ID NO: 7218079 - DNA, 22 bp, Homo sapiens
ccacagggtgtcatcagcttga

SEQ ID NO: 7218080 - DNA, 22 bp, Homo sapiens
ccacagggtgtcatcagcttga

SEQ ID NO: 7218081 - DNA, 22 bp, Homo sapiens
ccacaggtacggattgaggacc

SEQ ID NO: 7218082 - DNA, 16 bp, Homo sapiens
ccacaggtgtcctgca

SEQ ID NO: 7218083 - DNA, 22 bp, Homo sapiens
ccacagtaaagaaacaacttcg

SEQ ID NO: 7218084 - DNA, 22 bp, Homo sapiens
ccacagtaaagaaacaacttcg

SEQ ID NO: 7218085 - DNA, 22 bp, Homo sapiens
ccacagtaaatggattcagacc

SEQ ID NO: 7218086 - DNA, 22 bp, Homo sapiens
ccacagtaactgttttgtaccg

SEQ ID NO: 7218087 - DNA, 16 bp, Homo sapiens
ccacagtaagaaatac

SEQ ID NO: 7218088 - DNA, 22 bp, Homo sapiens
ccacagtaagagatagtttatg

SEQ ID NO: 7218089 - DNA, 22 bp, Homo sapiens
ccacagtaagagatagtttatg

SEQ ID NO: 7218090 - DNA, 22 bp, Homo sapiens
ccacagtacaggaaatcttgtt

SEQ ID NO: 7218091 - DNA, 22 bp, Homo sapiens
tcctggtgaggctagaagtgtc

SEQ ID NO: 7218092 - DNA, 22 bp, Homo sapiens
tcctggtgaggctagaagtgtc

SEQ ID NO: 7218093 - DNA, 23 bp, Homo sapiens
tcctggtgacatgcctgagcatc

SEQ ID NO: 7218094 - DNA, 19 bp, Homo sapiens
tcctggtgaccctgaaatt

SEQ ID NO: 7218095 - DNA, 19 bp, Homo sapiens
tcctggtgaccctgaaatt

SEQ ID NO: 7218096 - DNA, 22 bp, Homo sapiens
tcctggtgaggactccaagata

SEQ ID NO: 7218097 - DNA, 22 bp, Homo sapiens
tcctggtgaggactccaagata

SEQ ID NO: 7218098 - DNA, 22 bp, Homo sapiens
tcctggtgaggctagaagtgtc

SEQ ID NO: 7218099 - DNA, 22 bp, Homo sapiens
tcctggtgatcaaaattcattt

SEQ ID NO: 7218100 - DNA, 22 bp, Homo sapiens
tcctggtgatcaaaattcattt

SEQ ID NO: 7218101 - DNA, 22 bp, Homo sapiens
tcctggtgcctggagctctcca

SEQ ID NO: 7218102 - DNA, 22 bp, Homo sapiens
tcctggtgcctggagctctcca

SEQ ID NO: 7218103 - DNA, 22 bp, Homo sapiens
tcctggtgctgacacccatagc

SEQ ID NO: 7218104 - DNA, 22 bp, Homo sapiens
tcctggtgctgacacccatagc

SEQ ID NO: 7218105 - DNA, 22 bp, Homo sapiens
tcctggtgctgacacccatagc

SEQ ID NO: 7218106 - DNA, 22 bp, Homo sapiens
tcctggtgctgacacccatagc

SEQ ID NO: 7218107 - DNA, 19 bp, Homo sapiens
tcctggtgcttgacactga

SEQ ID NO: 7218108 - DNA, 19 bp, Homo sapiens
tcctggtgcttgacactga

SEQ ID NO: 7218109 - DNA, 23 bp, Homo sapiens
tcctggtgacatgcctgagcatc

SEQ ID NO: 7218110 - DNA, 23 bp, Homo sapiens
tcctggtgacatgcctgagcatc

SEQ ID NO: 7218111 - DNA, 23 bp, Homo sapiens
tcctggtgacatgcctgagcatc

SEQ ID NO: 7218112 - DNA, 22 bp, Homo sapiens
tcctggtctacactgcattggg

SEQ ID NO: 7218113 - DNA, 22 bp, Homo sapiens
tcctggtcttcaggttgcaaaa

SEQ ID NO: 7218114 - DNA, 22 bp, Homo sapiens
tcctggtgaatgactttttatt

SEQ ID NO: 7218115 - DNA, 22 bp, Homo sapiens
tcctggtgaatgactttttatt

SEQ ID NO: 7218116 - DNA, 22 bp, Homo sapiens
tcctggggagggttctggctcc

SEQ ID NO: 7218117 - DNA, 20 bp, Homo sapiens
tcctggtcatgtggctgggc

SEQ ID NO: 7218118 - DNA, 22 bp, Homo sapiens
ccagagcttgacgtgcaacgga

SEQ ID NO: 7218119 - DNA, 18 bp, Homo sapiens
ccagagctggctcctcgc

SEQ ID NO: 7218120 - DNA, 22 bp, Homo sapiens
ccagagcttcggggcggctgta

SEQ ID NO: 7218121 - DNA, 22 bp, Homo sapiens
ccagagcttcggggcggctgta

SEQ ID NO: 7218122 - DNA, 22 bp, Homo sapiens
ccagagctgcatccagcaggtt

SEQ ID NO: 7218123 - DNA, 22 bp, Homo sapiens
ccagagctgcaggtaaaatgct

SEQ ID NO: 7218124 - DNA, 22 bp, Homo sapiens
ccagagctgcatccagcaggtt

SEQ ID NO: 7218125 - DNA, 22 bp, Homo sapiens
ccagagctgcatccagcaggtt

SEQ ID NO: 7218126 - DNA, 22 bp, Homo sapiens
ccagagctgatgggcccagggt

SEQ ID NO: 7218127 - DNA, 22 bp, Homo sapiens
ccagagctgattcctgggactt

SEQ ID NO: 7218128 - DNA, 22 bp, Homo sapiens
ccagagctgatgggcccagggt

SEQ ID NO: 7218129 - DNA, 21 bp, Homo sapiens
ccagagcctgctgagccccct

SEQ ID NO: 7218130 - DNA, 21 bp, Homo sapiens
ccagagcctgctgagccccct

SEQ ID NO: 7218131 - DNA, 22 bp, Homo sapiens
ccagacaggaacacacatctcc

SEQ ID NO: 7218132 - DNA, 22 bp, Homo sapiens
ccagacaggaacacacatctcc

SEQ ID NO: 7218133 - DNA, 22 bp, Homo sapiens
ccagacaggggctgttcctgct

SEQ ID NO: 7218134 - DNA, 22 bp, Homo sapiens
ccagagcctgctgagccccatt

SEQ ID NO: 7218135 - DNA, 22 bp, Homo sapiens
ccagacagcagttaaaggacat

SEQ ID NO: 7218136 - DNA, 22 bp, Homo sapiens
ccagacaggaacacacatctcc

SEQ ID NO: 7218137 - DNA, 22 bp, Homo sapiens
ccagacagcagttaaaggacat

SEQ ID NO: 7218138 - DNA, 22 bp, Homo sapiens
ccagacagcagttaaaggacat

SEQ ID NO: 7218139 - DNA, 20 bp, Homo sapiens
ccagacagcacctgcctggt

SEQ ID NO: 7218140 - DNA, 22 bp, Homo sapiens
ccagacagcagttaaaggacat

SEQ ID NO: 7218141 - DNA, 22 bp, Homo sapiens
ccagaatgttctagagccaccc

SEQ ID NO: 7218142 - DNA, 22 bp, Homo sapiens
ccagaattcagaaagggcataa

SEQ ID NO: 7218143 - DNA, 22 bp, Homo sapiens
ccagaatttgaactcaggcaat

SEQ ID NO: 7218144 - DNA, 20 bp, Homo sapiens
ccagacagcacctgcctggt

SEQ ID NO: 7218145 - DNA, 20 bp, Homo sapiens
ccagacagcacctgcctggt

SEQ ID NO: 7218146 - DNA, 22 bp, Homo sapiens
tctctaaatgattgtgtactcc

SEQ ID NO: 7218147 - DNA, 22 bp, Homo sapiens
tctctaaatctggttcacttgc

SEQ ID NO: 7218148 - DNA, 22 bp, Homo sapiens
tctctaaatgctctcccatccc

SEQ ID NO: 7218149 - DNA, 19 bp, Homo sapiens
tctctaaatggtctttcac

SEQ ID NO: 7218150 - DNA, 22 bp, Homo sapiens
tctctaaatgttgggggaaatg

SEQ ID NO: 7218151 - DNA, 20 bp, Homo sapiens
tctctaacatgaatgctatc

SEQ ID NO: 7218152 - DNA, 22 bp, Homo sapiens
tctctaacagtggctgctgcct

SEQ ID NO: 7218153 - DNA, 22 bp, Homo sapiens
tctctaaatacagatgtcatgg

SEQ ID NO: 7218154 - DNA, 22 bp, Homo sapiens
tctctaaatacagatgtcatgg

SEQ ID NO: 7218155 - DNA, 22 bp, Homo sapiens
tctctaaataacacttattgaa

SEQ ID NO: 7218156 - DNA, 20 bp, Homo sapiens
tctctaaagcacctggacta

SEQ ID NO: 7218157 - DNA, 22 bp, Homo sapiens
tctctaaagcactttaaccaca

SEQ ID NO: 7218158 - DNA, 22 bp, Homo sapiens
tctctaaagcactttaaccaca

SEQ ID NO: 7218159 - DNA, 22 bp, Homo sapiens
tctctaaagcctggaagaggag

SEQ ID NO: 7218160 - DNA, 22 bp, Homo sapiens
tctctaaagtagaaaagacccc

SEQ ID NO: 7218161 - DNA, 22 bp, Homo sapiens
tctcctgggaggacaaggaagg

SEQ ID NO: 7218162 - DNA, 22 bp, Homo sapiens
tctcctgggaggacaaggaagg

SEQ ID NO: 7218163 - DNA, 22 bp, Homo sapiens
tctcccacagtctcccatggct

SEQ ID NO: 7218164 - DNA, 22 bp, Homo sapiens
tctcctgggaggacaaggaagg

SEQ ID NO: 7218165 - DNA, 22 bp, Homo sapiens
tctcccaagtgaccaggaaaga

SEQ ID NO: 7218166 - DNA, 22 bp, Homo sapiens
tctcccaagtgaccaggaaaga

SEQ ID NO: 7218167 - DNA, 22 bp, Homo sapiens
tctcccaagtgaccaggaaaga

SEQ ID NO: 7218168 - DNA, 23 bp, Homo sapiens
tctccagtgtctcttcattgagt

SEQ ID NO: 7218169 - DNA, 23 bp, Homo sapiens
tctccagtgtctcttcattgagt

SEQ ID NO: 7218170 - DNA, 22 bp, Homo sapiens
tctccagtgaatctcctcctgg

SEQ ID NO: 7218171 - DNA, 22 bp, Homo sapiens
tctccagtcccttctctgttag

SEQ ID NO: 7218172 - DNA, 22 bp, Homo sapiens
tctccagtctcaagacattgag

SEQ ID NO: 7218173 - DNA, 22 bp, Homo sapiens
ccagaggaaaaatatctcccta

SEQ ID NO: 7218174 - DNA, 22 bp, Homo sapiens
tctccatctgtcattcttgtcc

SEQ ID NO: 7218175 - DNA, 22 bp, Homo sapiens
tctccatctgtcattcttgtcc

SEQ ID NO: 7218176 - DNA, 19 bp, Homo sapiens
tctccagttgctttcaggg

SEQ ID NO: 7218177 - DNA, 19 bp, Homo sapiens
tctccagttgctttcaggg

SEQ ID NO: 7218178 - DNA, 21 bp, Homo sapiens
tctccagttgacagtgtctcc

SEQ ID NO: 7218179 - DNA, 22 bp, Homo sapiens
tctcccaaggcacagaaagagt

SEQ ID NO: 7218180 - DNA, 21 bp, Homo sapiens
tctcccaaggaggtcctgagg

SEQ ID NO: 7218181 - DNA, 21 bp, Homo sapiens
tctcccaaggaggtcctgagg

SEQ ID NO: 7218182 - DNA, 22 bp, Homo sapiens
tctcccaacatgtggaggtcag

SEQ ID NO: 7218183 - DNA, 22 bp, Homo sapiens
tctcccaacatgtggaggtcag

SEQ ID NO: 7218184 - DNA, 22 bp, Homo sapiens
tctcccaacctctggtgggtgc

SEQ ID NO: 7218185 - DNA, 22 bp, Homo sapiens
tctcccaagcctggcaggggca

SEQ ID NO: 7218186 - DNA, 19 bp, Homo sapiens
ccagaggactgttaatgaa

SEQ ID NO: 7218187 - DNA, 19 bp, Homo sapiens
ccagaggactgttaatgaa

SEQ ID NO: 7218188 - DNA, 22 bp, Homo sapiens
tctctaggtgcagtcactgctc

SEQ ID NO: 7218189 - DNA, 22 bp, Homo sapiens
tctctagtataatatagcaaaa

SEQ ID NO: 7218190 - DNA, 22 bp, Homo sapiens
tctctacctgctccatagccat

SEQ ID NO: 7218191 - DNA, 22 bp, Homo sapiens
tctctacagcacccgcatgcta

SEQ ID NO: 7218192 - DNA, 22 bp, Homo sapiens
tctctacagcacccgcatgcta

SEQ ID NO: 7218193 - DNA, 22 bp, Homo sapiens
tctctacataacctcaatactc

SEQ ID NO: 7218194 - DNA, 22 bp, Homo sapiens
tctctacataacctcaatactc

SEQ ID NO: 7218195 - DNA, 18 bp, Homo sapiens
tctctaccagaagtgacg

SEQ ID NO: 7218196 - DNA, 18 bp, Homo sapiens
tctctaccagaagtgacg

SEQ ID NO: 7218197 - DNA, 22 bp, Homo sapiens
tctctagggtttagcacagata

SEQ ID NO: 7218198 - DNA, 19 bp, Homo sapiens
tctctacactacatttcta

SEQ ID NO: 7218199 - DNA, 19 bp, Homo sapiens
tctctacactacatttcta

SEQ ID NO: 7218200 - DNA, 21 bp, Homo sapiens
tctctacactttcactaggct

SEQ ID NO: 7218201 - DNA, 21 bp, Homo sapiens
tctctacactttcactaggct

SEQ ID NO: 7218202 - DNA, 21 bp, Homo sapiens
tctctacactttcactaggct

SEQ ID NO: 7218203 - DNA, 22 bp, Homo sapiens
tctctacagaatcttattattg

SEQ ID NO: 7218204 - DNA, 22 bp, Homo sapiens
tctctacagacactgttgactt

SEQ ID NO: 7218205 - DNA, 22 bp, Homo sapiens
tctctacagacactgttgactt

SEQ ID NO: 7218206 - DNA, 22 bp, Homo sapiens
tctctacagatcctatatagaa

SEQ ID NO: 7218207 - DNA, 22 bp, Homo sapiens
tctctacagacactgttgactt

SEQ ID NO: 7218208 - DNA, 22 bp, Homo sapiens
tctctacagattccatggggaa

SEQ ID NO: 7218209 - DNA, 22 bp, Homo sapiens
tctctaattcaaccagacactt

SEQ ID NO: 7218210 - DNA, 22 bp, Homo sapiens
tctctaattcaaccagacactt

SEQ ID NO: 7218211 - DNA, 22 bp, Homo sapiens
tctctacaaaaattagcatgca

SEQ ID NO: 7218212 - DNA, 22 bp, Homo sapiens
tctctacaaaaattagcatgca

SEQ ID NO: 7218213 - DNA, 21 bp, Homo sapiens
tctctacaaattatgttaggt

SEQ ID NO: 7218214 - DNA, 22 bp, Homo sapiens
tctctacacaggattcacatga

SEQ ID NO: 7218215 - DNA, 22 bp, Homo sapiens
tctctacacaggattcacatga

SEQ ID NO: 7218216 - DNA, 22 bp, Homo sapiens
tctctacacaggattcacatga

SEQ ID NO: 7218217 - DNA, 22 bp, Homo sapiens
tctctacacaggattcacatga

SEQ ID NO: 7218218 - DNA, 19 bp, Homo sapiens
tctctacactacatttcta

SEQ ID NO: 7218219 - DNA, 22 bp, Homo sapiens
ccagaggacttgggggctgaat

SEQ ID NO: 7218220 - DNA, 22 bp, Homo sapiens
ccagaggacttgggggctgaat

SEQ ID NO: 7218221 - DNA, 22 bp, Homo sapiens
ccagaggacttgggggctgaat

SEQ ID NO: 7218222 - DNA, 22 bp, Homo sapiens
ccagaggacttgggggctgaat

SEQ ID NO: 7218223 - DNA, 22 bp, Homo sapiens
ccagaggacttgggggctgaat

SEQ ID NO: 7218224 - DNA, 22 bp, Homo sapiens
ccagaggagcaggctggctcca

SEQ ID NO: 7218225 - DNA, 22 bp, Homo sapiens
ccagaggagcaggctggctcca

SEQ ID NO: 7218226 - DNA, 22 bp, Homo sapiens
ccagaggagggctctgatgagg

SEQ ID NO: 7218227 - DNA, 22 bp, Homo sapiens
ccagaggagggctctgatgagg

SEQ ID NO: 7218228 - DNA, 22 bp, Homo sapiens
ccagaggagcatggccttgaga

SEQ ID NO: 7218229 - DNA, 22 bp, Homo sapiens
ccagaggagcatggccttgaga

SEQ ID NO: 7218230 - DNA, 22 bp, Homo sapiens
ccagaggaggggggtctttctg

SEQ ID NO: 7218231 - DNA, 22 bp, Homo sapiens
ccagaggagttgaggctttggg

SEQ ID NO: 7218232 - DNA, 22 bp, Homo sapiens
ccagatatcactgccgtgttgt

SEQ ID NO: 7218233 - DNA, 22 bp, Homo sapiens
ccagatatcactgccgtgttgt

SEQ ID NO: 7218234 - DNA, 22 bp, Homo sapiens
ccagatagggatgagagtgcta

SEQ ID NO: 7218235 - DNA, 22 bp, Homo sapiens
ccagataaggctttttaaaagc

SEQ ID NO: 7218236 - DNA, 22 bp, Homo sapiens
ccagatagaaaagaaggcagga

SEQ ID NO: 7218237 - DNA, 22 bp, Homo sapiens
ccagatagcaggtcagaagtgc

SEQ ID NO: 7218238 - DNA, 22 bp, Homo sapiens
ccagagttttatacaacttttt

SEQ ID NO: 7218239 - DNA, 22 bp, Homo sapiens
ccagatattcacttttacatgc

SEQ ID NO: 7218240 - DNA, 17 bp, Homo sapiens
ccagatcccagtcctta

SEQ ID NO: 7218241 - DNA, 22 bp, Homo sapiens
ccagatccctgtttgcctctgg

SEQ ID NO: 7218242 - DNA, 22 bp, Homo sapiens
ccagatccctgtttgcctctgg

SEQ ID NO: 7218243 - DNA, 21 bp, Homo sapiens
ccagatcctgcttcctcaccc

SEQ ID NO: 7218244 - DNA, 21 bp, Homo sapiens
ccagatcctgcttcctcaccc

SEQ ID NO: 7218245 - DNA, 22 bp, Homo sapiens
ccagatgggaagaagcatgact

SEQ ID NO: 7218246 - DNA, 22 bp, Homo sapiens
ccagatgggctttagcaaatga

SEQ ID NO: 7218247 - DNA, 21 bp, Homo sapiens
ccagatgcaaatgcagacatt

SEQ ID NO: 7218248 - DNA, 22 bp, Homo sapiens
ccagatggaaatgatgttctca

SEQ ID NO: 7218249 - DNA, 22 bp, Homo sapiens
ccagatggaaatgatgttctca

SEQ ID NO: 7218250 - DNA, 22 bp, Homo sapiens
ccagatggaaatgatgttctca

SEQ ID NO: 7218251 - DNA, 18 bp, Homo sapiens
ccagatggccagtctgct

SEQ ID NO: 7218252 - DNA, 18 bp, Homo sapiens
ccagatggccagtctgct

SEQ ID NO: 7218253 - DNA, 20 bp, Homo sapiens
tctctctggttggaggagct

SEQ ID NO: 7218254 - DNA, 22 bp, Homo sapiens
ccagatggtttgcatgggaggg

SEQ ID NO: 7218255 - DNA, 22 bp, Homo sapiens
ccagatgggttacttcaagcaa

SEQ ID NO: 7218256 - DNA, 22 bp, Homo sapiens
ccagatggtccagagtctagcc

SEQ ID NO: 7218257 - DNA, 22 bp, Homo sapiens
ccagatggtccagagtctagcc

SEQ ID NO: 7218258 - DNA, 20 bp, Homo sapiens
ccagatggtccctgtgaaaa

SEQ ID NO: 7218259 - DNA, 22 bp, Homo sapiens
tcctggggagggttctggctcc

SEQ ID NO: 7218260 - DNA, 22 bp, Homo sapiens
tcctggggagggttctggctcc

SEQ ID NO: 7218261 - DNA, 22 bp, Homo sapiens
ccacagctgacaatggatagac

SEQ ID NO: 7218262 - DNA, 22 bp, Homo sapiens
ccacagctgaaagcagaggctc

SEQ ID NO: 7218263 - DNA, 22 bp, Homo sapiens
ccacagctgaaagcagaggctc

SEQ ID NO: 7218264 - DNA, 22 bp, Homo sapiens
ccacagctgaaagcagaggctc

SEQ ID NO: 7218265 - DNA, 23 bp, Homo sapiens
ccacagctatagggtagtgcagt

SEQ ID NO: 7218266 - DNA, 23 bp, Homo sapiens
ccacagctatagggtagtgcagt

SEQ ID NO: 7218267 - DNA, 22 bp, Homo sapiens
ccacagctcctcagcctctttc

SEQ ID NO: 7218268 - DNA, 22 bp, Homo sapiens
ccacagctctagctccctccca

SEQ ID NO: 7218269 - DNA, 22 bp, Homo sapiens
ccacagctctagctccctccca

SEQ ID NO: 7218270 - DNA, 17 bp, Homo sapiens
ccacagcctggcacttg

SEQ ID NO: 7218271 - DNA, 22 bp, Homo sapiens
ccacagccattccagggaggct

SEQ ID NO: 7218272 - DNA, 22 bp, Homo sapiens
ccacagccattccagggaggct

SEQ ID NO: 7218273 - DNA, 22 bp, Homo sapiens
ccacagccattccagggaggct

SEQ ID NO: 7218274 - DNA, 22 bp, Homo sapiens
ccacagccattccagggaggct

SEQ ID NO: 7218275 - DNA, 22 bp, Homo sapiens
ccacagccattccagggaggct

SEQ ID NO: 7218276 - DNA, 19 bp, Homo sapiens
ccacagcctgctgtcttcc

SEQ ID NO: 7218277 - DNA, 19 bp, Homo sapiens
ccacagcctgctgtcttcc

SEQ ID NO: 7218278 - DNA, 17 bp, Homo sapiens
ccacagcctggcacttg

SEQ ID NO: 7218279 - DNA, 17 bp, Homo sapiens
ccacagcctggcacttg

SEQ ID NO: 7218280 - DNA, 22 bp, Homo sapiens
ccacagagttgatgcaataaga

SEQ ID NO: 7218281 - DNA, 22 bp, Homo sapiens
ccacagagttacaaaacagtca

SEQ ID NO: 7218282 - DNA, 22 bp, Homo sapiens
ccacagagttgatgcaataaga

SEQ ID NO: 7218283 - DNA, 22 bp, Homo sapiens
ccacagagttgatgcaataaga

SEQ ID NO: 7218284 - DNA, 22 bp, Homo sapiens
ccacagagttacaaaacagtca

SEQ ID NO: 7218285 - DNA, 22 bp, Homo sapiens
ccacagagttacaaaacagtca

SEQ ID NO: 7218286 - DNA, 22 bp, Homo sapiens
ccacagagttacaaaacagtca

SEQ ID NO: 7218287 - DNA, 22 bp, Homo sapiens
ccacagagttacaaaacagtca

SEQ ID NO: 7218288 - DNA, 22 bp, Homo sapiens
ccacagagttacaaaacagtca

SEQ ID NO: 7218289 - DNA, 22 bp, Homo sapiens
ccacagcaccgctgccagtccc

SEQ ID NO: 7218290 - DNA, 22 bp, Homo sapiens
ccacagcaccgctgccagtccc

SEQ ID NO: 7218291 - DNA, 22 bp, Homo sapiens
ccacagcaccgctgccagtccc

SEQ ID NO: 7218292 - DNA, 22 bp, Homo sapiens
ccacagcaccgctgccagtccc

SEQ ID NO: 7218293 - DNA, 22 bp, Homo sapiens
ccacagcacctgcagccagttg

SEQ ID NO: 7218294 - DNA, 18 bp, Homo sapiens
ccacagcagagttcttac

SEQ ID NO: 7218295 - DNA, 18 bp, Homo sapiens
ccacagcagagttcttac

SEQ ID NO: 7218296 - DNA, 18 bp, Homo sapiens
ccacagcagagttcttac

SEQ ID NO: 7218297 - DNA, 22 bp, Homo sapiens
ccacagcaggactggagccgcc

SEQ ID NO: 7218298 - DNA, 22 bp, Homo sapiens
ccacagcatgcaggcctgacac

SEQ ID NO: 7218299 - DNA, 22 bp, Homo sapiens
ccacagcatgcaggcctgacac

SEQ ID NO: 7218300 - DNA, 22 bp, Homo sapiens
ccacagcatgcaggcctgacac

SEQ ID NO: 7218301 - DNA, 22 bp, Homo sapiens
ccacagcatgcaggcctgacac

SEQ ID NO: 7218302 - DNA, 22 bp, Homo sapiens
ccacagagtccgcatttgaggc

SEQ ID NO: 7218303 - DNA, 22 bp, Homo sapiens
ccacagagtccgcatttgaggc

SEQ ID NO: 7218304 - DNA, 22 bp, Homo sapiens
ccacagagtccgcatttgaggc

SEQ ID NO: 7218305 - DNA, 22 bp, Homo sapiens
ccacagagtcttccttctcttc

SEQ ID NO: 7218306 - DNA, 22 bp, Homo sapiens
ccacagagtcttccttctcttc

SEQ ID NO: 7218307 - DNA, 20 bp, Homo sapiens
ccacagaggacagggctgtg

SEQ ID NO: 7218308 - DNA, 20 bp, Homo sapiens
ccacagaggacagggctgtg

SEQ ID NO: 7218309 - DNA, 19 bp, Homo sapiens
tcctgcccaccagccaggg

SEQ ID NO: 7218310 - DNA, 19 bp, Homo sapiens
tcctgcccaccagccaggg

SEQ ID NO: 7218311 - DNA, 19 bp, Homo sapiens
tcctgcccaccagccaggg

SEQ ID NO: 7218312 - DNA, 22 bp, Homo sapiens
ccacagaatgatgacacttcag

SEQ ID NO: 7218313 - DNA, 22 bp, Homo sapiens
ccacagaatgatgacacttcag

SEQ ID NO: 7218314 - DNA, 23 bp, Homo sapiens
ccacagagctgccaattcctgtg

SEQ ID NO: 7218315 - DNA, 22 bp, Homo sapiens
ccacagaggacaactgcctggc

SEQ ID NO: 7218316 - DNA, 22 bp, Homo sapiens
ccacagaggacaactgcctggc

SEQ ID NO: 7218317 - DNA, 22 bp, Homo sapiens
ccacagaggacaactgcctggc

SEQ ID NO: 7218318 - DNA, 22 bp, Homo sapiens
ccacagaggacaactgcctggc

SEQ ID NO: 7218319 - DNA, 22 bp, Homo sapiens
ccacagaggacaactgcctggc

SEQ ID NO: 7218320 - DNA, 20 bp, Homo sapiens
tcctgcagttcctaggaggg

SEQ ID NO: 7218321 - DNA, 20 bp, Homo sapiens
tcctgcagttcctaggaggg

SEQ ID NO: 7218322 - DNA, 20 bp, Homo sapiens
tcctgccacacctcagttgc

SEQ ID NO: 7218323 - DNA, 22 bp, Homo sapiens
tcctgccacctgcacagctccc

SEQ ID NO: 7218324 - DNA, 22 bp, Homo sapiens
tcctgccacctgcacagctccc

SEQ ID NO: 7218325 - DNA, 22 bp, Homo sapiens
tcctgccacctgcacagctccc

SEQ ID NO: 7218326 - DNA, 22 bp, Homo sapiens
tcctgccactgcacatatactt

SEQ ID NO: 7218327 - DNA, 22 bp, Homo sapiens
tcctgccagcccacagactcat

SEQ ID NO: 7218328 - DNA, 22 bp, Homo sapiens
tcctgccagcccacagactcat

SEQ ID NO: 7218329 - DNA, 22 bp, Homo sapiens
tcctgccagctggggctgcttc

SEQ ID NO: 7218330 - DNA, 22 bp, Homo sapiens
tcctgccaggagtgctggccct

SEQ ID NO: 7218331 - DNA, 22 bp, Homo sapiens
tcctgccaggagtgctggccct

SEQ ID NO: 7218332 - DNA, 22 bp, Homo sapiens
tcctgcccacagctgctggaca

SEQ ID NO: 7218333 - DNA, 22 bp, Homo sapiens
tcctgcccacagctgctggaca

SEQ ID NO: 7218334 - DNA, 22 bp, Homo sapiens
tcctgcccacagctgctggaca

SEQ ID NO: 7218335 - DNA, 22 bp, Homo sapiens
ccaagggaaggatgtatatgat

SEQ ID NO: 7218336 - DNA, 17 bp, Homo sapiens
tcctccccgcagttgca

SEQ ID NO: 7218337 - DNA, 20 bp, Homo sapiens
tcctcccccacctttgcagc

SEQ ID NO: 7218338 - DNA, 22 bp, Homo sapiens
tcctccccaaagcccagcctgg

SEQ ID NO: 7218339 - DNA, 22 bp, Homo sapiens
tcctccccaaagcccagcctgg

SEQ ID NO: 7218340 - DNA, 22 bp, Homo sapiens
tcctccccaaagcccagcctgg

SEQ ID NO: 7218341 - DNA, 22 bp, Homo sapiens
tcctccccaaagcccagcctgg

SEQ ID NO: 7218342 - DNA, 22 bp, Homo sapiens
tcctccccaaagcccagcctgg

SEQ ID NO: 7218343 - DNA, 22 bp, Homo sapiens
tcctccccaaagcccagcctgg

SEQ ID NO: 7218344 - DNA, 22 bp, Homo sapiens
tcctcccacataggacaatggg

SEQ ID NO: 7218345 - DNA, 22 bp, Homo sapiens
tcctcccacataggacaatggg

SEQ ID NO: 7218346 - DNA, 22 bp, Homo sapiens
tcctcccaacttttccatctca

SEQ ID NO: 7218347 - DNA, 23 bp, Homo sapiens
tcctcccaaatttcagcctcatt

SEQ ID NO: 7218348 - DNA, 23 bp, Homo sapiens
tcctcccaaatttcagcctcatt

SEQ ID NO: 7218349 - DNA, 22 bp, Homo sapiens
ccaaatcaccagcacgatcatt

SEQ ID NO: 7218350 - DNA, 22 bp, Homo sapiens
ccaaagtgtgggagaagaggta

SEQ ID NO: 7218351 - DNA, 22 bp, Homo sapiens
ccaaataatatttcagaaccat

SEQ ID NO: 7218352 - DNA, 22 bp, Homo sapiens
ccaaataatatttcagaaccat

SEQ ID NO: 7218353 - DNA, 22 bp, Homo sapiens
ccaaatagtctttcattgaatt

SEQ ID NO: 7218354 - DNA, 22 bp, Homo sapiens
ccaaatagtctttcattgaatt

SEQ ID NO: 7218355 - DNA, 22 bp, Homo sapiens
ccacaagtttcagcacccagag

SEQ ID NO: 7218356 - DNA, 22 bp, Homo sapiens
ccacaagtgaagtacacctgcc

SEQ ID NO: 7218357 - DNA, 22 bp, Homo sapiens
ccacaagtgaagtacacctgcc

SEQ ID NO: 7218358 - DNA, 22 bp, Homo sapiens
ccacaaggggactcgttaaatg

SEQ ID NO: 7218359 - DNA, 20 bp, Homo sapiens
ccacaagggaatattgttga

SEQ ID NO: 7218360 - DNA, 22 bp, Homo sapiens
ccacaagtttcagcacccagag

SEQ ID NO: 7218361 - DNA, 22 bp, Homo sapiens
ccacaagtttgttgattgaaac

SEQ ID NO: 7218362 - DNA, 22 bp, Homo sapiens
ccacaatttatgtattctccta

SEQ ID NO: 7218363 - DNA, 22 bp, Homo sapiens
ccacacagggggatgagttatt

SEQ ID NO: 7218364 - DNA, 22 bp, Homo sapiens
ccacacagggggatgagttatt

SEQ ID NO: 7218365 - DNA, 22 bp, Homo sapiens
ccacacagggggatgagttatt

SEQ ID NO: 7218366 - DNA, 22 bp, Homo sapiens
tcctgcagtgtgtctcctgcac

SEQ ID NO: 7218367 - DNA, 22 bp, Homo sapiens
tcctgcagtgtgtctcctgcac

SEQ ID NO: 7218368 - DNA, 22 bp, Homo sapiens
tcctgcagtgtgtctcctgcac

SEQ ID NO: 7218369 - DNA, 22 bp, Homo sapiens
tcctgcagttacatcccagcca

SEQ ID NO: 7218370 - DNA, 22 bp, Homo sapiens
tcctgcagttacatcccagcca

SEQ ID NO: 7218371 - DNA, 22 bp, Homo sapiens
tcctgcagtgtgtctcctgcac

SEQ ID NO: 7218372 - DNA, 22 bp, Homo sapiens
ccaattgtcctaattaattaga

SEQ ID NO: 7218373 - DNA, 22 bp, Homo sapiens
ccaatgtttattttcctgctgc

SEQ ID NO: 7218374 - DNA, 22 bp, Homo sapiens
ccaatgttttatacagaagtac

SEQ ID NO: 7218375 - DNA, 22 bp, Homo sapiens
ccaagggctatttacagaacag

SEQ ID NO: 7218376 - DNA, 22 bp, Homo sapiens
ccaagggctatttacagaacag

SEQ ID NO: 7218377 - DNA, 22 bp, Homo sapiens
ccaatgttaggctctggtttta

SEQ ID NO: 7218378 - DNA, 20 bp, Homo sapiens
ccaatgtttacagattactt

SEQ ID NO: 7218379 - DNA, 22 bp, Homo sapiens
ccaagggcccttctaaaattct

SEQ ID NO: 7218380 - DNA, 22 bp, Homo sapiens
ccaagggcgcctccgttccccc

SEQ ID NO: 7218381 - DNA, 22 bp, Homo sapiens
ccaagggccatcctatcacttg

SEQ ID NO: 7218382 - DNA, 22 bp, Homo sapiens
ccaattttattcttctgcaagt

SEQ ID NO: 7218383 - DNA, 22 bp, Homo sapiens
ccacaaaactgtgtgtcaaaga

SEQ ID NO: 7218384 - DNA, 22 bp, Homo sapiens
ccacaaaactgtgtgtcaaaga

SEQ ID NO: 7218385 - DNA, 22 bp, Homo sapiens
ccacaaaactgtgtgtcaaaga

SEQ ID NO: 7218386 - DNA, 22 bp, Homo sapiens
ccacaaaactgtgtgtcaaaga

SEQ ID NO: 7218387 - DNA, 19 bp, Homo sapiens
ccacaaaattattttagtt

SEQ ID NO: 7218388 - DNA, 19 bp, Homo sapiens
ccacaaaattattttagtt

SEQ ID NO: 7218389 - DNA, 19 bp, Homo sapiens
ccacaaaattattttagtt

SEQ ID NO: 7218390 - DNA, 23 bp, Homo sapiens
ccacaaaccatttgtgaaggagc

SEQ ID NO: 7218391 - DNA, 22 bp, Homo sapiens
ccacaaagaatgggggaagcat

SEQ ID NO: 7218392 - DNA, 22 bp, Homo sapiens
ccacaagactctgtcagcataa

SEQ ID NO: 7218393 - DNA, 22 bp, Homo sapiens
tccctgctgagagtgctctccc

SEQ ID NO: 7218394 - DNA, 22 bp, Homo sapiens
tccctgctcagctcacctggca

SEQ ID NO: 7218395 - DNA, 22 bp, Homo sapiens
tccctgctaattggaatgtata

SEQ ID NO: 7218396 - DNA, 22 bp, Homo sapiens
tccctgctaattggaatgtata

SEQ ID NO: 7218397 - DNA, 20 bp, Homo sapiens
tccctgccttttactgctgg

SEQ ID NO: 7218398 - DNA, 19 bp, Homo sapiens
tccctgcgtttcggcccac

SEQ ID NO: 7218399 - DNA, 22 bp, Homo sapiens
tccctgctgcactcacacctac

SEQ ID NO: 7218400 - DNA, 22 bp, Homo sapiens
tccctgctgcactcacacctac

SEQ ID NO: 7218401 - DNA, 22 bp, Homo sapiens
tccctgctgagagtgctctccc

SEQ ID NO: 7218402 - DNA, 22 bp, Homo sapiens
tccctgctgagagtgctctccc

SEQ ID NO: 7218403 - DNA, 21 bp, Homo sapiens
tccctgctttctggcccagtc

SEQ ID NO: 7218404 - DNA, 22 bp, Homo sapiens
tccctgcttgctctcagccctt

SEQ ID NO: 7218405 - DNA, 22 bp, Homo sapiens
tccctgcttggaatgaccctta

SEQ ID NO: 7218406 - DNA, 22 bp, Homo sapiens
tccctgctgggagatgacctta

SEQ ID NO: 7218407 - DNA, 22 bp, Homo sapiens
tccctgctgggagatgacctta

SEQ ID NO: 7218408 - DNA, 22 bp, Homo sapiens
tccctgctgcactcacacctac

SEQ ID NO: 7218409 - DNA, 22 bp, Homo sapiens
tccctgctgcactcacacctac

SEQ ID NO: 7218410 - DNA, 15 bp, Homo sapiens
tccctgctggtcaaa

SEQ ID NO: 7218411 - DNA, 22 bp, Homo sapiens
tccctgcttgctctcagccctt

SEQ ID NO: 7218412 - DNA, 22 bp, Homo sapiens
tccctgcttgctctcagccctt

SEQ ID NO: 7218413 - DNA, 21 bp, Homo sapiens
tccctgctttctggcccagtc

SEQ ID NO: 7218414 - DNA, 22 bp, Homo sapiens
ccaaaaattagatacacatata

SEQ ID NO: 7218415 - DNA, 19 bp, Homo sapiens
ccaaaagcaattccaagta

SEQ ID NO: 7218416 - DNA, 23 bp, Homo sapiens
ccaaaagcgagtctgttgttccc

SEQ ID NO: 7218417 - DNA, 22 bp, Homo sapiens
ccaaagtattaaatcttagcaa

SEQ ID NO: 7218418 - DNA, 22 bp, Homo sapiens
ccaaagtccacagtttacatta

SEQ ID NO: 7218419 - DNA, 22 bp, Homo sapiens
ccaaagtccatagtttacataa

SEQ ID NO: 7218420 - DNA, 22 bp, Homo sapiens
ccaaagtccatagtttacatta

SEQ ID NO: 7218421 - DNA, 22 bp, Homo sapiens
ccaaagtccatagtttacttta

SEQ ID NO: 7218422 - DNA, 22 bp, Homo sapiens
ccaaagtctggagcagcagagc

SEQ ID NO: 7218423 - DNA, 22 bp, Homo sapiens
ccaaagtctgcattttaacatg

SEQ ID NO: 7218424 - DNA, 22 bp, Homo sapiens
catttgctgaggccttcagagg

SEQ ID NO: 7218425 - DNA, 22 bp, Homo sapiens
catttgctggagatggaccaca

SEQ ID NO: 7218426 - DNA, 22 bp, Homo sapiens
catttgctggggtcttgggagt

SEQ ID NO: 7218427 - DNA, 22 bp, Homo sapiens
catttgattcctttactcttat

SEQ ID NO: 7218428 - DNA, 22 bp, Homo sapiens
catttgcagagggtgacactct

SEQ ID NO: 7218429 - DNA, 22 bp, Homo sapiens
tccctgcctctcagacttcctt

SEQ ID NO: 7218430 - DNA, 22 bp, Homo sapiens
tccctgcctgacagcacccacc

SEQ ID NO: 7218431 - DNA, 22 bp, Homo sapiens
tccctgcctgacagcacccacc

SEQ ID NO: 7218432 - DNA, 22 bp, Homo sapiens
tccctgcctgacagcacccacc

SEQ ID NO: 7218433 - DNA, 22 bp, Homo sapiens
catttggaaagagactagagaa

SEQ ID NO: 7218434 - DNA, 22 bp, Homo sapiens
tccctgcctctcagacttcctt

SEQ ID NO: 7218435 - DNA, 22 bp, Homo sapiens
catttgatgactcaactcataa

SEQ ID NO: 7218436 - DNA, 22 bp, Homo sapiens
catttgattactaaagataatt

SEQ ID NO: 7218437 - DNA, 22 bp, Homo sapiens
catttgatctcctgaataaaca

SEQ ID NO: 7218438 - DNA, 22 bp, Homo sapiens
catttgaattgttctgtgggaa

SEQ ID NO: 7218439 - DNA, 22 bp, Homo sapiens
catttgatcctcacaacaatct

SEQ ID NO: 7218440 - DNA, 22 bp, Homo sapiens
catttgaacctggatgttctta

SEQ ID NO: 7218441 - DNA, 22 bp, Homo sapiens
catttgaactaataactgtgct

SEQ ID NO: 7218442 - DNA, 22 bp, Homo sapiens
catttctcataatattagcact

SEQ ID NO: 7218443 - DNA, 22 bp, Homo sapiens
catttctcataatattagcact

SEQ ID NO: 7218444 - DNA, 22 bp, Homo sapiens
catttgaacctggatgttctta

SEQ ID NO: 7218445 - DNA, 22 bp, Homo sapiens
catttgaagacttagaagagga

SEQ ID NO: 7218446 - DNA, 22 bp, Homo sapiens
catttgaagacttagaagagga

SEQ ID NO: 7218447 - DNA, 20 bp, Homo sapiens
catttgaatctccattctgc

SEQ ID NO: 7218448 - DNA, 22 bp, Homo sapiens
catttgaatgagattgctgtaa

SEQ ID NO: 7218449 - DNA, 22 bp, Homo sapiens
catttagttatactaaaacatt

SEQ ID NO: 7218450 - DNA, 22 bp, Homo sapiens
catttagttatactaaaacatt

SEQ ID NO: 7218451 - DNA, 22 bp, Homo sapiens
catttagttttgcagtagcagg

SEQ ID NO: 7218452 - DNA, 22 bp, Homo sapiens
catttatataaaatgtccagaa

SEQ ID NO: 7218453 - DNA, 22 bp, Homo sapiens
catttatataaaatgtccagaa

SEQ ID NO: 7218454 - DNA, 22 bp, Homo sapiens
catttatataaaatgtccagaa

SEQ ID NO: 7218455 - DNA, 22 bp, Homo sapiens
catttagtacaacttttacagt

SEQ ID NO: 7218456 - DNA, 22 bp, Homo sapiens
catttagtctgatatggatgaa

SEQ ID NO: 7218457 - DNA, 22 bp, Homo sapiens
catttagtctgatatggatgaa

SEQ ID NO: 7218458 - DNA, 22 bp, Homo sapiens
catttagagaagattacaagga

SEQ ID NO: 7218459 - DNA, 22 bp, Homo sapiens
catttagagaagattacaagga

SEQ ID NO: 7218460 - DNA, 19 bp, Homo sapiens
catttagaagtacatatta

SEQ ID NO: 7218461 - DNA, 22 bp, Homo sapiens
catttagaagtcttagaactat

SEQ ID NO: 7218462 - DNA, 19 bp, Homo sapiens
catttagaagtacatatta

SEQ ID NO: 7218463 - DNA, 19 bp, Homo sapiens
catttagaagtacatatta

SEQ ID NO: 7218464 - DNA, 19 bp, Homo sapiens
catttagaagtacatatta

SEQ ID NO: 7218465 - DNA, 22 bp, Homo sapiens
catttacttaaatctttacaag

SEQ ID NO: 7218466 - DNA, 22 bp, Homo sapiens
catttagaaactgtttttaaca

SEQ ID NO: 7218467 - DNA, 22 bp, Homo sapiens
catttacagcagactgatgaaa

SEQ ID NO: 7218468 - DNA, 22 bp, Homo sapiens
catttacacttctaaccacaag

SEQ ID NO: 7218469 - DNA, 22 bp, Homo sapiens
tccaggcagcccttcctgactc

SEQ ID NO: 7218470 - DNA, 22 bp, Homo sapiens
tccaggcacagagttggtcagt

SEQ ID NO: 7218471 - DNA, 22 bp, Homo sapiens
tccaggcacagagttggtcagt

SEQ ID NO: 7218472 - DNA, 22 bp, Homo sapiens
tccaggcacgaggccctgtgca

SEQ ID NO: 7218473 - DNA, 23 bp, Homo sapiens
tccaggcacgcatttcttctagc

SEQ ID NO: 7218474 - DNA, 22 bp, Homo sapiens
tccaggcactatatatactttt

SEQ ID NO: 7218475 - DNA, 20 bp, Homo sapiens
tccaggcagacagctatggg

SEQ ID NO: 7218476 - DNA, 20 bp, Homo sapiens
tccaggcagacagctatggg

SEQ ID NO: 7218477 - DNA, 20 bp, Homo sapiens
tccaggcagacagctatggg

SEQ ID NO: 7218478 - DNA, 22 bp, Homo sapiens
tccaggcagagcaacaaaatat

SEQ ID NO: 7218479 - DNA, 17 bp, Homo sapiens
tccaggcagcaactgag

SEQ ID NO: 7218480 - DNA, 17 bp, Homo sapiens
tccaggcagcaactgag

SEQ ID NO: 7218481 - DNA, 22 bp, Homo sapiens
catttctcactccagcaacttt

SEQ ID NO: 7218482 - DNA, 22 bp, Homo sapiens
tcccagggtcagtggtgaggcc

SEQ ID NO: 7218483 - DNA, 22 bp, Homo sapiens
tcccagggtcagtggtgaggcc

SEQ ID NO: 7218484 - DNA, 22 bp, Homo sapiens
tcccagggtcagtggtgaggcc

SEQ ID NO: 7218485 - DNA, 22 bp, Homo sapiens
tcccagggggatgaacactgcc

SEQ ID NO: 7218486 - DNA, 22 bp, Homo sapiens
tcccagggtatcctgtagtaaa

SEQ ID NO: 7218487 - DNA, 22 bp, Homo sapiens
tcccagggggatgaacactgcc

SEQ ID NO: 7218488 - DNA, 22 bp, Homo sapiens
tcccagggcttttctcatgctt

SEQ ID NO: 7218489 - DNA, 22 bp, Homo sapiens
tcccagggcttttctcatgctt

SEQ ID NO: 7218490 - DNA, 22 bp, Homo sapiens
tcccagggctctagagtgctgg

SEQ ID NO: 7218491 - DNA, 22 bp, Homo sapiens
catttatgttttacttggtcac

SEQ ID NO: 7218492 - DNA, 22 bp, Homo sapiens
catttattagttagttcgatgt

SEQ ID NO: 7218493 - DNA, 22 bp, Homo sapiens
catttattagttagttcgatgt

SEQ ID NO: 7218494 - DNA, 22 bp, Homo sapiens
catttattagttagttcgatgt

SEQ ID NO: 7218495 - DNA, 22 bp, Homo sapiens
catttatataaaatgtccagaa

SEQ ID NO: 7218496 - DNA, 22 bp, Homo sapiens
catttatgaagcactttagagt

SEQ ID NO: 7218497 - DNA, 22 bp, Homo sapiens
catttatgatagtaatatgaaa

SEQ ID NO: 7218498 - DNA, 22 bp, Homo sapiens
catttatgatagtaatatgaaa

SEQ ID NO: 7218499 - DNA, 22 bp, Homo sapiens
tcccagggcagctgtccagaag

SEQ ID NO: 7218500 - DNA, 22 bp, Homo sapiens
tcccagggcagctgtccagaag

SEQ ID NO: 7218501 - DNA, 22 bp, Homo sapiens
tcccagggcagctgtccagaag

SEQ ID NO: 7218502 - DNA, 22 bp, Homo sapiens
tcccagggcactcaccctccct

SEQ ID NO: 7218503 - DNA, 22 bp, Homo sapiens
tcccagggcactcaccctccct

SEQ ID NO: 7218504 - DNA, 22 bp, Homo sapiens
tcccagggccgcaaacgagttt

SEQ ID NO: 7218505 - DNA, 22 bp, Homo sapiens
tcccagggccgcaaacgagttt

SEQ ID NO: 7218506 - DNA, 21 bp, Homo sapiens
tcccagggccaggtgccatca

SEQ ID NO: 7218507 - DNA, 21 bp, Homo sapiens
tcccagggccaggtgccatca

SEQ ID NO: 7218508 - DNA, 22 bp, Homo sapiens
ccaggagcctgggccaggctgg

SEQ ID NO: 7218509 - DNA, 22 bp, Homo sapiens
ccaggagcgcgtgaacaggctg

SEQ ID NO: 7218510 - DNA, 22 bp, Homo sapiens
ccaggagcctgggccaggctgg

SEQ ID NO: 7218511 - DNA, 21 bp, Homo sapiens
ccaggaaggactgagctccct

SEQ ID NO: 7218512 - DNA, 21 bp, Homo sapiens
ccaggaaggactgagctccct

SEQ ID NO: 7218513 - DNA, 22 bp, Homo sapiens
ccaggagcgcgtgaacaggctg

SEQ ID NO: 7218514 - DNA, 22 bp, Homo sapiens
ccaggagcgcgtgaacaggctg

SEQ ID NO: 7218515 - DNA, 22 bp, Homo sapiens
ccaggaggatgattttaagagg

SEQ ID NO: 7218516 - DNA, 22 bp, Homo sapiens
ccaggaggatggttgttaggtg

SEQ ID NO: 7218517 - DNA, 22 bp, Homo sapiens
ccaggaggatggttgttaggtg

SEQ ID NO: 7218518 - DNA, 22 bp, Homo sapiens
ccaggaggcaatatcaagtcca

SEQ ID NO: 7218519 - DNA, 22 bp, Homo sapiens
ccaggaggcagaagttgcagtg

SEQ ID NO: 7218520 - DNA, 22 bp, Homo sapiens
ccaggaggcagaagttgcagtg

SEQ ID NO: 7218521 - DNA, 22 bp, Homo sapiens
ccaggaggcaatatcaagtcca

SEQ ID NO: 7218522 - DNA, 22 bp, Homo sapiens
ccaggaggcagaagttgcagtg

SEQ ID NO: 7218523 - DNA, 22 bp, Homo sapiens
ccaggaggcagaagttgcagtg

SEQ ID NO: 7218524 - DNA, 22 bp, Homo sapiens
ccaggaggcagaagttgcagtg

SEQ ID NO: 7218525 - DNA, 22 bp, Homo sapiens
ccaggaggcagaagttgcagtg

SEQ ID NO: 7218526 - DNA, 22 bp, Homo sapiens
ccaggaagctgtctgatatgaa

SEQ ID NO: 7218527 - DNA, 22 bp, Homo sapiens
ccaggaagctgtgagattccaa

SEQ ID NO: 7218528 - DNA, 22 bp, Homo sapiens
ccaggaaggaagcaggggtttc

SEQ ID NO: 7218529 - DNA, 22 bp, Homo sapiens
ccaggaaggaagcaggggtttc

SEQ ID NO: 7218530 - DNA, 21 bp, Homo sapiens
ccaggaaggactgagctccct

SEQ ID NO: 7218531 - DNA, 21 bp, Homo sapiens
ccaggaaggactgagctccct

SEQ ID NO: 7218532 - DNA, 22 bp, Homo sapiens
ccaggaagcggtgagggctgcc

SEQ ID NO: 7218533 - DNA, 22 bp, Homo sapiens
ccaggaagcggtgagggctgcc

SEQ ID NO: 7218534 - DNA, 22 bp, Homo sapiens
ccaggaagcctttttctttgac

SEQ ID NO: 7218535 - DNA, 22 bp, Homo sapiens
ccaggaagcggtgagggctgcc

SEQ ID NO: 7218536 - DNA, 22 bp, Homo sapiens
ccaggaagcctttttctttgac

SEQ ID NO: 7218537 - DNA, 22 bp, Homo sapiens
ccaggaagctctgctccacggg

SEQ ID NO: 7218538 - DNA, 23 bp, Homo sapiens
ccaggaagaggccatccacagtc

SEQ ID NO: 7218539 - DNA, 23 bp, Homo sapiens
ccaggaagaggccatccacagtc

SEQ ID NO: 7218540 - DNA, 22 bp, Homo sapiens
ccaggaagatttattttggctt

SEQ ID NO: 7218541 - DNA, 22 bp, Homo sapiens
ccaggaagcctcagatgctgag

SEQ ID NO: 7218542 - DNA, 22 bp, Homo sapiens
ccaggaagcctcagatgctgag

SEQ ID NO: 7218543 - DNA, 22 bp, Homo sapiens
ccaggaagcctcagatgctgag

SEQ ID NO: 7218544 - DNA, 22 bp, Homo sapiens
ccaggaagcctcagatgctgag

SEQ ID NO: 7218545 - DNA, 22 bp, Homo sapiens
ccaggaagcctgtgtctctgga

SEQ ID NO: 7218546 - DNA, 22 bp, Homo sapiens
ccaggaagacacatgctcatcc

SEQ ID NO: 7218547 - DNA, 22 bp, Homo sapiens
ccaggaacaaagccccatccac

SEQ ID NO: 7218548 - DNA, 16 bp, Homo sapiens
ccaggaacacacagct

SEQ ID NO: 7218549 - DNA, 22 bp, Homo sapiens
ccaggaactaagaatcctttag

SEQ ID NO: 7218550 - DNA, 23 bp, Homo sapiens
ccaggaaagatccaggaagaggc

SEQ ID NO: 7218551 - DNA, 22 bp, Homo sapiens
ccagcttctccttatgtcctca

SEQ ID NO: 7218552 - DNA, 22 bp, Homo sapiens
ccagcttcatgggcatgcacca

SEQ ID NO: 7218553 - DNA, 22 bp, Homo sapiens
ccagcttcggcaagcagacttt

SEQ ID NO: 7218554 - DNA, 22 bp, Homo sapiens
ccagcttcggcaagcagacttt

SEQ ID NO: 7218555 - DNA, 22 bp, Homo sapiens
ccaggaggcagaggttacagtg

SEQ ID NO: 7218556 - DNA, 22 bp, Homo sapiens
ccaggaggcagaggttgtagtg

SEQ ID NO: 7218557 - DNA, 22 bp, Homo sapiens
ccaggaggcggaaggtacagtg

SEQ ID NO: 7218558 - DNA, 22 bp, Homo sapiens
ccaggaggcggaaggtacagtg

SEQ ID NO: 7218559 - DNA, 22 bp, Homo sapiens
ccaggaggcggaaggtacagtg

SEQ ID NO: 7218560 - DNA, 22 bp, Homo sapiens
ccaggaggcagaggttgtagtg

SEQ ID NO: 7218561 - DNA, 22 bp, Homo sapiens
ccaggaggcggaggttgcagcg

SEQ ID NO: 7218562 - DNA, 22 bp, Homo sapiens
ccaggaggcggaggttgcagcg

SEQ ID NO: 7218563 - DNA, 22 bp, Homo sapiens
ccaggaggcggaggttgcagcg

SEQ ID NO: 7218564 - DNA, 22 bp, Homo sapiens
ccaggaggcggaaggtacagtg

SEQ ID NO: 7218565 - DNA, 22 bp, Homo sapiens
ccaggaggcggaaggtacagtg

SEQ ID NO: 7218566 - DNA, 22 bp, Homo sapiens
tctgtcactattggccagaaca

SEQ ID NO: 7218567 - DNA, 22 bp, Homo sapiens
tctgtcactgagctcaggattc

SEQ ID NO: 7218568 - DNA, 22 bp, Homo sapiens
tctgtcacttaagaattgccta

SEQ ID NO: 7218569 - DNA, 22 bp, Homo sapiens
tctgtcacttattaagatggat

SEQ ID NO: 7218570 - DNA, 23 bp, Homo sapiens
tctgtcactttctgctgtggagt

SEQ ID NO: 7218571 - DNA, 22 bp, Homo sapiens
tctgtcagcccctcagctgtca

SEQ ID NO: 7218572 - DNA, 22 bp, Homo sapiens
tctgtggcacgattgcactgca

SEQ ID NO: 7218573 - DNA, 19 bp, Homo sapiens
tctgtggcacctgggaggg

SEQ ID NO: 7218574 - DNA, 22 bp, Homo sapiens
tctgtggcaaacacagtgacca

SEQ ID NO: 7218575 - DNA, 22 bp, Homo sapiens
tctgtggcaaacacagtgacca

SEQ ID NO: 7218576 - DNA, 22 bp, Homo sapiens
tctgtggcacgattgcactgca

SEQ ID NO: 7218577 - DNA, 22 bp, Homo sapiens
tctgtggcacgattgcactgca

SEQ ID NO: 7218578 - DNA, 18 bp, Homo sapiens
tctgtggcagcagtgcac

SEQ ID NO: 7218579 - DNA, 18 bp, Homo sapiens
tctgtggcagcagtgcac

SEQ ID NO: 7218580 - DNA, 17 bp, Homo sapiens
tctgtcttgactgtcac

SEQ ID NO: 7218581 - DNA, 17 bp, Homo sapiens
tctgtcttgactgtcac

SEQ ID NO: 7218582 - DNA, 22 bp, Homo sapiens
tctgtcttggccagccatctgg

SEQ ID NO: 7218583 - DNA, 21 bp, Homo sapiens
tctgtcttcctcagcctaagg

SEQ ID NO: 7218584 - DNA, 22 bp, Homo sapiens
tctgtcttctgtagctaataat

SEQ ID NO: 7218585 - DNA, 22 bp, Homo sapiens
tctgtcttctgtagctaataat

SEQ ID NO: 7218586 - DNA, 22 bp, Homo sapiens
tctgtcttcttcattgcctata

SEQ ID NO: 7218587 - DNA, 22 bp, Homo sapiens
tctgtcttcttcattgcctata

SEQ ID NO: 7218588 - DNA, 18 bp, Homo sapiens
tctgtctgtgttgtcttt

SEQ ID NO: 7218589 - DNA, 18 bp, Homo sapiens
tctgtctgtgttgtcttt

SEQ ID NO: 7218590 - DNA, 18 bp, Homo sapiens
tctgtctgtgttgtcttt

SEQ ID NO: 7218591 - DNA, 22 bp, Homo sapiens
tctgtcttagcatctttgctca

SEQ ID NO: 7218592 - DNA, 22 bp, Homo sapiens
tctgtcttagcatctttgctca

SEQ ID NO: 7218593 - DNA, 23 bp, Homo sapiens
tctgtctgtgtatgtgcagaaag

SEQ ID NO: 7218594 - DNA, 23 bp, Homo sapiens
tctgtctgtgtatgtgcagaaag

SEQ ID NO: 7218595 - DNA, 22 bp, Homo sapiens
tctgtcttagcatctttgctca

SEQ ID NO: 7218596 - DNA, 22 bp, Homo sapiens
tctgtcttagccatctcaggct

SEQ ID NO: 7218597 - DNA, 22 bp, Homo sapiens
tctgtcttagccatctcaggct

SEQ ID NO: 7218598 - DNA, 22 bp, Homo sapiens
tctgtcttcatcagcatgtgat

SEQ ID NO: 7218599 - DNA, 22 bp, Homo sapiens
tctgtctgggtgcctcgagtac

SEQ ID NO: 7218600 - DNA, 22 bp, Homo sapiens
tctgtctgggtgcctcgagtac

SEQ ID NO: 7218601 - DNA, 21 bp, Homo sapiens
tctgtctggttttagagtggc

SEQ ID NO: 7218602 - DNA, 18 bp, Homo sapiens
tctgtctgtacaagtatc

SEQ ID NO: 7218603 - DNA, 22 bp, Homo sapiens
tctgtctgtccagggcccccgc

SEQ ID NO: 7218604 - DNA, 22 bp, Homo sapiens
ccagctgtgcctaggagcaggg

SEQ ID NO: 7218605 - DNA, 18 bp, Homo sapiens
ccagctgtgcagcatctg

SEQ ID NO: 7218606 - DNA, 22 bp, Homo sapiens
ccagctgtctggttccagagcc

SEQ ID NO: 7218607 - DNA, 22 bp, Homo sapiens
ccagctgtctggttccagagcc

SEQ ID NO: 7218608 - DNA, 22 bp, Homo sapiens
ccagctgtgctgttggcttgtc

SEQ ID NO: 7218609 - DNA, 22 bp, Homo sapiens
ccagctgttggagtttcactgc

SEQ ID NO: 7218610 - DNA, 22 bp, Homo sapiens
ccagctgtttctgatgctaggc

SEQ ID NO: 7218611 - DNA, 22 bp, Homo sapiens
ccagctgtttctgatgctaggc

SEQ ID NO: 7218612 - DNA, 22 bp, Homo sapiens
ccagcttaaaaccatttattta

SEQ ID NO: 7218613 - DNA, 22 bp, Homo sapiens
ccagcttcatgggcatgcacca

SEQ ID NO: 7218614 - DNA, 22 bp, Homo sapiens
ccagcttcatgggcatgcacca

SEQ ID NO: 7218615 - DNA, 22 bp, Homo sapiens
ccagcttcatgggcatgcacca

SEQ ID NO: 7218616 - DNA, 22 bp, Homo sapiens
tctggctttattttcatcatct

SEQ ID NO: 7218617 - DNA, 22 bp, Homo sapiens
tctggcttggctggcatctctg

SEQ ID NO: 7218618 - DNA, 22 bp, Homo sapiens
tctggcttgaacaattaggtaa

SEQ ID NO: 7218619 - DNA, 22 bp, Homo sapiens
tctggcttcgcagctcccagcc

SEQ ID NO: 7218620 - DNA, 22 bp, Homo sapiens
tctggcttcacactgaagtttg

SEQ ID NO: 7218621 - DNA, 22 bp, Homo sapiens
tctggcttcaagtcccagctct

SEQ ID NO: 7218622 - DNA, 22 bp, Homo sapiens
tctggcttcaagtcccagctct

SEQ ID NO: 7218623 - DNA, 22 bp, Homo sapiens
tctggctgttttagatgagctc

SEQ ID NO: 7218624 - DNA, 22 bp, Homo sapiens
tctggctcataggaaggccatt

SEQ ID NO: 7218625 - DNA, 22 bp, Homo sapiens
tctggctcatctctccaggtaa

SEQ ID NO: 7218626 - DNA, 22 bp, Homo sapiens
tctggctcatctctccaggtaa

SEQ ID NO: 7218627 - DNA, 22 bp, Homo sapiens
tctggctcatctctccaggtaa

SEQ ID NO: 7218628 - DNA, 22 bp, Homo sapiens
tctggctgttgttaggttcctg

SEQ ID NO: 7218629 - DNA, 19 bp, Homo sapiens
tctggagctgatgcaggtg

SEQ ID NO: 7218630 - DNA, 19 bp, Homo sapiens
tctggagctgatgcaggtg

SEQ ID NO: 7218631 - DNA, 21 bp, Homo sapiens
tctggagctgcaggctgggca

SEQ ID NO: 7218632 - DNA, 21 bp, Homo sapiens
tctggagctgcaggctgggca

SEQ ID NO: 7218633 - DNA, 21 bp, Homo sapiens
tctggagctgcaggctgggca

SEQ ID NO: 7218634 - DNA, 22 bp, Homo sapiens
tctggagctggagggcaaggca

SEQ ID NO: 7218635 - DNA, 22 bp, Homo sapiens
tctggagctggagggcaaggca

SEQ ID NO: 7218636 - DNA, 22 bp, Homo sapiens
tctggagctggagggcaaggca

SEQ ID NO: 7218637 - DNA, 22 bp, Homo sapiens
tctggagctgggggcttagtat

SEQ ID NO: 7218638 - DNA, 22 bp, Homo sapiens
tctggagctgggggcttagtat

SEQ ID NO: 7218639 - DNA, 22 bp, Homo sapiens
tctggagcttcctcatttacag

SEQ ID NO: 7218640 - DNA, 22 bp, Homo sapiens
tctggagcttgaagctttggtt

SEQ ID NO: 7218641 - DNA, 22 bp, Homo sapiens
tctggagcttgaagctttggtt

SEQ ID NO: 7218642 - DNA, 22 bp, Homo sapiens
tctggagcttgtttcagatggt

SEQ ID NO: 7218643 - DNA, 22 bp, Homo sapiens
tctggagcttgtttcagatggt

SEQ ID NO: 7218644 - DNA, 22 bp, Homo sapiens
tctggaggcaactaacctagtt

SEQ ID NO: 7218645 - DNA, 22 bp, Homo sapiens
tctggaggcaactaacctagtt

SEQ ID NO: 7218646 - DNA, 22 bp, Homo sapiens
tctggaggcaactaacctagtt

SEQ ID NO: 7218647 - DNA, 22 bp, Homo sapiens
tctggaggcaggctgccaggat

SEQ ID NO: 7218648 - DNA, 22 bp, Homo sapiens
tctggaggcaggctgccaggat

SEQ ID NO: 7218649 - DNA, 22 bp, Homo sapiens
tctggaggcaggctgccaggat

SEQ ID NO: 7218650 - DNA, 22 bp, Homo sapiens
tctggctcatacaagcctgcaa

SEQ ID NO: 7218651 - DNA, 22 bp, Homo sapiens
tctggctcataggaaggccatt

SEQ ID NO: 7218652 - DNA, 22 bp, Homo sapiens
tctgccttggaaatttcaacag

SEQ ID NO: 7218653 - DNA, 22 bp, Homo sapiens
tctgccttggcaaccacagctt

SEQ ID NO: 7218654 - DNA, 22 bp, Homo sapiens
tctgccttgccgaattccaggc

SEQ ID NO: 7218655 - DNA, 22 bp, Homo sapiens
tctgccttgccgaattccaggc

SEQ ID NO: 7218656 - DNA, 22 bp, Homo sapiens
tctgccttgccgaattccaggc

SEQ ID NO: 7218657 - DNA, 22 bp, Homo sapiens
tctgcctgaaccactcttggag

SEQ ID NO: 7218658 - DNA, 22 bp, Homo sapiens
tctgcctgaaccactcttggag

SEQ ID NO: 7218659 - DNA, 22 bp, Homo sapiens
tctgcctgaaccactcttggag

SEQ ID NO: 7218660 - DNA, 22 bp, Homo sapiens
tctgcctgagaagtggggtgcc

SEQ ID NO: 7218661 - DNA, 22 bp, Homo sapiens
tctgcctctttcaggcctggca

SEQ ID NO: 7218662 - DNA, 19 bp, Homo sapiens
tctgcctctggtcaggctc

SEQ ID NO: 7218663 - DNA, 19 bp, Homo sapiens
tctgcctctggtcaggctc

SEQ ID NO: 7218664 - DNA, 22 bp, Homo sapiens
tctgcctctttcaggcctggca

SEQ ID NO: 7218665 - DNA, 22 bp, Homo sapiens
tctgcctgaaattcacatgtaa

SEQ ID NO: 7218666 - DNA, 22 bp, Homo sapiens
tctgcctgaaattcacatgtaa

SEQ ID NO: 7218667 - DNA, 22 bp, Homo sapiens
tctgcctgaaccactcttggag

SEQ ID NO: 7218668 - DNA, 22 bp, Homo sapiens
tctgcctgaaattcacatgtaa

SEQ ID NO: 7218669 - DNA, 22 bp, Homo sapiens
tctgcctgaaattcacatgtaa

SEQ ID NO: 7218670 - DNA, 22 bp, Homo sapiens
tctgccttgttgcaggcgctat

SEQ ID NO: 7218671 - DNA, 22 bp, Homo sapiens
tctgccttgttgcaggcgctat

SEQ ID NO: 7218672 - DNA, 22 bp, Homo sapiens
tctgccttgtttgagctttgac

SEQ ID NO: 7218673 - DNA, 22 bp, Homo sapiens
tctgccttgtttgagctttgac

SEQ ID NO: 7218674 - DNA, 22 bp, Homo sapiens
tctgcctttcacacagacggcc

SEQ ID NO: 7218675 - DNA, 22 bp, Homo sapiens
tctgcctttcacacagacggcc

SEQ ID NO: 7218676 - DNA, 22 bp, Homo sapiens
tctgcctttcccaggctactgt

SEQ ID NO: 7218677 - DNA, 22 bp, Homo sapiens
tctgcctttcccaggctactgt

SEQ ID NO: 7218678 - DNA, 22 bp, Homo sapiens
tctgcctttctcaagggcaaaa

SEQ ID NO: 7218679 - DNA, 22 bp, Homo sapiens
tctgcctttctcaagggcaaaa

SEQ ID NO: 7218680 - DNA, 22 bp, Homo sapiens
tctgcctttgctttggctgtca

SEQ ID NO: 7218681 - DNA, 22 bp, Homo sapiens
tctgcctttgctttggctgtca

SEQ ID NO: 7218682 - DNA, 22 bp, Homo sapiens
tctgcctttcccaggctactgt

SEQ ID NO: 7218683 - DNA, 22 bp, Homo sapiens
tctgcctttgtggtcgggagaa

SEQ ID NO: 7218684 - DNA, 22 bp, Homo sapiens
tctgcctttgtggtcgggagaa

SEQ ID NO: 7218685 - DNA, 22 bp, Homo sapiens
tctgccttttactagctggatg

SEQ ID NO: 7218686 - DNA, 22 bp, Homo sapiens
tctgccttttactagctggatg

SEQ ID NO: 7218687 - DNA, 22 bp, Homo sapiens
tctgcctttgctttggctgtca

SEQ ID NO: 7218688 - DNA, 22 bp, Homo sapiens
tctgccttttcactgccactaa

SEQ ID NO: 7218689 - DNA, 22 bp, Homo sapiens
tctgccttttcactgccactaa

SEQ ID NO: 7218690 - DNA, 22 bp, Homo sapiens
tctgcgcgctgctggtaccgaa

SEQ ID NO: 7218691 - DNA, 22 bp, Homo sapiens
tctgcggtccccttctcgccct

SEQ ID NO: 7218692 - DNA, 22 bp, Homo sapiens
tctgcgtgaaactagatggcag

SEQ ID NO: 7218693 - DNA, 22 bp, Homo sapiens
tctgcgtgaatttgcattgtgg

SEQ ID NO: 7218694 - DNA, 22 bp, Homo sapiens
tctgcgtgatgagggtgcagca

SEQ ID NO: 7218695 - DNA, 22 bp, Homo sapiens
tctgcgtggcgtggttctgtgc

SEQ ID NO: 7218696 - DNA, 22 bp, Homo sapiens
tctgcgtgatgagggtgcagca

SEQ ID NO: 7218697 - DNA, 22 bp, Homo sapiens
tctgcgtggctgctgtgagcgt

SEQ ID NO: 7218698 - DNA, 22 bp, Homo sapiens
tctgcgtgggactgaggaggct

SEQ ID NO: 7218699 - DNA, 22 bp, Homo sapiens
tctgcgttattgaaaagcagcc

SEQ ID NO: 7218700 - DNA, 22 bp, Homo sapiens
ccagctggttaaaatagagaaa

SEQ ID NO: 7218701 - DNA, 22 bp, Homo sapiens
ccagctggttaaaatagagaaa

SEQ ID NO: 7218702 - DNA, 22 bp, Homo sapiens
ccagctggtgttccttaggacc

SEQ ID NO: 7218703 - DNA, 21 bp, Homo sapiens
tctggagccctaagctgagaa

SEQ ID NO: 7218704 - DNA, 21 bp, Homo sapiens
tctggagccctaagctgagaa

SEQ ID NO: 7218705 - DNA, 21 bp, Homo sapiens
tctggagccctaagctgagaa

SEQ ID NO: 7218706 - DNA, 22 bp, Homo sapiens
tctggagccttggatgggaaag

SEQ ID NO: 7218707 - DNA, 22 bp, Homo sapiens
tctggagccttggatgggaaag

SEQ ID NO: 7218708 - DNA, 22 bp, Homo sapiens
tctggagcgaggtccctgtctg

SEQ ID NO: 7218709 - DNA, 22 bp, Homo sapiens
ccagctggtgttccttaggacc

SEQ ID NO: 7218710 - DNA, 22 bp, Homo sapiens
ccagctggtctgtgctcatgtt

SEQ ID NO: 7218711 - DNA, 22 bp, Homo sapiens
ccagctggtctgtgctcatgtt

SEQ ID NO: 7218712 - DNA, 22 bp, Homo sapiens
ccagctggtctgtgctcatgtt

SEQ ID NO: 7218713 - DNA, 22 bp, Homo sapiens
ccagctggtctgtgctcatgtt

SEQ ID NO: 7218714 - DNA, 22 bp, Homo sapiens
ccagctggtaagtgatggagcc

SEQ ID NO: 7218715 - DNA, 22 bp, Homo sapiens
ccagctggtaagtgatggagcc

SEQ ID NO: 7218716 - DNA, 22 bp, Homo sapiens
ccagctggtaagtgatggagcc

SEQ ID NO: 7218717 - DNA, 22 bp, Homo sapiens
ccagctggtaagtgatggagcc

SEQ ID NO: 7218718 - DNA, 22 bp, Homo sapiens
ccagctgggtccctgctggggc

SEQ ID NO: 7218719 - DNA, 22 bp, Homo sapiens
ccagctgggtccctgctggggc

SEQ ID NO: 7218720 - DNA, 22 bp, Homo sapiens
ccagctgggtccctgctggggc

SEQ ID NO: 7218721 - DNA, 22 bp, Homo sapiens
ccagctgggtccctgctggggc

SEQ ID NO: 7218722 - DNA, 22 bp, Homo sapiens
tctgcgttgctcacgctgggag

SEQ ID NO: 7218723 - DNA, 22 bp, Homo sapiens
ccagctgcttgggaaaatgtct

SEQ ID NO: 7218724 - DNA, 22 bp, Homo sapiens
ccagctgctttttgtcacatgg

SEQ ID NO: 7218725 - DNA, 22 bp, Homo sapiens
ccagctgctttttgtcacatgg

SEQ ID NO: 7218726 - DNA, 22 bp, Homo sapiens
ccagctgctttttgtcacatgg

SEQ ID NO: 7218727 - DNA, 22 bp, Homo sapiens
ccagctggggaagtggggcata

SEQ ID NO: 7218728 - DNA, 22 bp, Homo sapiens
ccagctggggaagtggggcata

SEQ ID NO: 7218729 - DNA, 22 bp, Homo sapiens
ccagctggggaagtggggcata

SEQ ID NO: 7218730 - DNA, 22 bp, Homo sapiens
tctgagttacacaagcaagggt

SEQ ID NO: 7218731 - DNA, 23 bp, Homo sapiens
tctgagttatgtccttacatttg

SEQ ID NO: 7218732 - DNA, 22 bp, Homo sapiens
tctgagttgaggaaatgcattt

SEQ ID NO: 7218733 - DNA, 22 bp, Homo sapiens
tctgagtttaggaccaggctga

SEQ ID NO: 7218734 - DNA, 22 bp, Homo sapiens
tctgagtcttggggtccctatt

SEQ ID NO: 7218735 - DNA, 20 bp, Homo sapiens
tctgataaaaactactccat

SEQ ID NO: 7218736 - DNA, 22 bp, Homo sapiens
tctgataaataacatttggaaa

SEQ ID NO: 7218737 - DNA, 22 bp, Homo sapiens
tctgataaataacatttggaaa

SEQ ID NO: 7218738 - DNA, 22 bp, Homo sapiens
tctgataaatgccatctttttg

SEQ ID NO: 7218739 - DNA, 22 bp, Homo sapiens
tctgataaatgccatctttttg

SEQ ID NO: 7218740 - DNA, 22 bp, Homo sapiens
tctgataaatgccatctttttg

SEQ ID NO: 7218741 - DNA, 22 bp, Homo sapiens
tctgataaatgccatctttttg

SEQ ID NO: 7218742 - DNA, 22 bp, Homo sapiens
tctgataacaaccatgtctggc

SEQ ID NO: 7218743 - DNA, 22 bp, Homo sapiens
tctgataacaaccatgtctggc

SEQ ID NO: 7218744 - DNA, 22 bp, Homo sapiens
tctgataactctggccccaggc

SEQ ID NO: 7218745 - DNA, 20 bp, Homo sapiens
tctgataactggttgtgatt

SEQ ID NO: 7218746 - DNA, 22 bp, Homo sapiens
tctgataagacagctgatttga

SEQ ID NO: 7218747 - DNA, 22 bp, Homo sapiens
tctgataagacagctgatttga

SEQ ID NO: 7218748 - DNA, 22 bp, Homo sapiens
tctgataagacagctgatttga

SEQ ID NO: 7218749 - DNA, 23 bp, Homo sapiens
tctgataagggagagggaagcag

SEQ ID NO: 7218750 - DNA, 22 bp, Homo sapiens
tctgataagtggtgtatactgt

SEQ ID NO: 7218751 - DNA, 22 bp, Homo sapiens
tctgataagtggtgtatactgt

SEQ ID NO: 7218752 - DNA, 22 bp, Homo sapiens
tctgataagtggtgtatactgt

SEQ ID NO: 7218753 - DNA, 22 bp, Homo sapiens
ccagcctggagggcagtggtgg

SEQ ID NO: 7218754 - DNA, 22 bp, Homo sapiens
ccagcctggagggcagtggtgg

SEQ ID NO: 7218755 - DNA, 22 bp, Homo sapiens
ccagcctggagggcagtggtgg

SEQ ID NO: 7218756 - DNA, 22 bp, Homo sapiens
ccagcctggagggcagtggtgg

SEQ ID NO: 7218757 - DNA, 22 bp, Homo sapiens
ccagcctggagggcagtggtgg

SEQ ID NO: 7218758 - DNA, 22 bp, Homo sapiens
ccagcctggggaggcagcttct

SEQ ID NO: 7218759 - DNA, 22 bp, Homo sapiens
ccagcctggggaggcagcttct

SEQ ID NO: 7218760 - DNA, 22 bp, Homo sapiens
ccagcctggggaggcagcttct

SEQ ID NO: 7218761 - DNA, 22 bp, Homo sapiens
tctgataatggacttctcatct

SEQ ID NO: 7218762 - DNA, 22 bp, Homo sapiens
tctgataatggacttctcatct

SEQ ID NO: 7218763 - DNA, 22 bp, Homo sapiens
tctgataatggacttctcatct

SEQ ID NO: 7218764 - DNA, 22 bp, Homo sapiens
tctgataatgtgcttcgtgacc

SEQ ID NO: 7218765 - DNA, 22 bp, Homo sapiens
tctgataatgtgcttcgtgacc

SEQ ID NO: 7218766 - DNA, 22 bp, Homo sapiens
tctgatagataccatgaggcaa

SEQ ID NO: 7218767 - DNA, 22 bp, Homo sapiens
tctgatagataccatgaggcaa

SEQ ID NO: 7218768 - DNA, 22 bp, Homo sapiens
tctgataggcagaaggcataag

SEQ ID NO: 7218769 - DNA, 22 bp, Homo sapiens
tctgataggtggtagaaggagg

SEQ ID NO: 7218770 - DNA, 22 bp, Homo sapiens
tctgatataaaagtgacattca

SEQ ID NO: 7218771 - DNA, 21 bp, Homo sapiens
ccagcctcagatcagggagct

SEQ ID NO: 7218772 - DNA, 22 bp, Homo sapiens
ccagcctcatcatattcctgct

SEQ ID NO: 7218773 - DNA, 22 bp, Homo sapiens
ccagcctcatcatattcctgct

SEQ ID NO: 7218774 - DNA, 22 bp, Homo sapiens
ccagcctcatcatattcctgct

SEQ ID NO: 7218775 - DNA, 22 bp, Homo sapiens
ccagcctggactgggtcttgtg

SEQ ID NO: 7218776 - DNA, 22 bp, Homo sapiens
ccagccttccagccaatggctg

SEQ ID NO: 7218777 - DNA, 22 bp, Homo sapiens
ccagcctggttcagaattggct

SEQ ID NO: 7218778 - DNA, 22 bp, Homo sapiens
ccagcctggttcagaattggct

SEQ ID NO: 7218779 - DNA, 22 bp, Homo sapiens
ccagccttcacctgctctggtc

SEQ ID NO: 7218780 - DNA, 22 bp, Homo sapiens
ccagcctggggaggcagcttct

SEQ ID NO: 7218781 - DNA, 22 bp, Homo sapiens
ccagcctgggtgttagaagaca

SEQ ID NO: 7218782 - DNA, 22 bp, Homo sapiens
ccagcctggttcagaattggct

SEQ ID NO: 7218783 - DNA, 22 bp, Homo sapiens
ccagccttctgggactctcatc

SEQ ID NO: 7218784 - DNA, 22 bp, Homo sapiens
ccagccttgaatcagttgctgc

SEQ ID NO: 7218785 - DNA, 22 bp, Homo sapiens
ccagccttgcaccgagccagcc

SEQ ID NO: 7218786 - DNA, 22 bp, Homo sapiens
ccagccttgcaccgagccagcc

SEQ ID NO: 7218787 - DNA, 22 bp, Homo sapiens
ccagccttgggggatccaggac

SEQ ID NO: 7218788 - DNA, 19 bp, Homo sapiens
ccagcctttccagtgattg

SEQ ID NO: 7218789 - DNA, 22 bp, Homo sapiens
ccagcctttctattggtttctc

SEQ ID NO: 7218790 - DNA, 22 bp, Homo sapiens
ccagcctttgcatcccccatct

SEQ ID NO: 7218791 - DNA, 22 bp, Homo sapiens
ccagcgactgtgacctcagcta

SEQ ID NO: 7218792 - DNA, 22 bp, Homo sapiens
ccagcgactgtgacctcagcta

SEQ ID NO: 7218793 - DNA, 23 bp, Homo sapiens
ccagcgctcactcagagcatgtt

SEQ ID NO: 7218794 - DNA, 21 bp, Homo sapiens
ccagctccaggaccttggatc

SEQ ID NO: 7218795 - DNA, 21 bp, Homo sapiens
ccagctccaggaccttggatc

SEQ ID NO: 7218796 - DNA, 22 bp, Homo sapiens
ccagctccagcatagccaccat

SEQ ID NO: 7218797 - DNA, 22 bp, Homo sapiens
ccagctccagcatagccaccat

SEQ ID NO: 7218798 - DNA, 22 bp, Homo sapiens
ccagctccagcatagccaccat

SEQ ID NO: 7218799 - DNA, 22 bp, Homo sapiens
ccagctccagcatagccaccat

SEQ ID NO: 7218800 - DNA, 22 bp, Homo sapiens
ccagctccactgtcagatgaga

SEQ ID NO: 7218801 - DNA, 22 bp, Homo sapiens
ccagctccagcatagccaccat

SEQ ID NO: 7218802 - DNA, 22 bp, Homo sapiens
ccagctccagcatagccaccat

SEQ ID NO: 7218803 - DNA, 22 bp, Homo sapiens
ccagctccaagtttgggcatca

SEQ ID NO: 7218804 - DNA, 22 bp, Homo sapiens
ccagctccactgtcagatgaga

SEQ ID NO: 7218805 - DNA, 22 bp, Homo sapiens
ccagctccactgtcagatgaga

SEQ ID NO: 7218806 - DNA, 22 bp, Homo sapiens
ccagctccactgtcagatgaga

SEQ ID NO: 7218807 - DNA, 22 bp, Homo sapiens
ccagctagtaagcacctgcatc

SEQ ID NO: 7218808 - DNA, 22 bp, Homo sapiens
ccagctcagggtcacatggcac

SEQ ID NO: 7218809 - DNA, 23 bp, Homo sapiens
ccagctcatccattacctctctt

SEQ ID NO: 7218810 - DNA, 23 bp, Homo sapiens
ccagctcatccattacctctctt

SEQ ID NO: 7218811 - DNA, 22 bp, Homo sapiens
ccagctcatctcagtgaaatgc

SEQ ID NO: 7218812 - DNA, 22 bp, Homo sapiens
ccagctccaagtttgggcatca

SEQ ID NO: 7218813 - DNA, 22 bp, Homo sapiens
ccagctccaagtttgggcatca

SEQ ID NO: 7218814 - DNA, 22 bp, Homo sapiens
tctgcctcgctaacagcagcca

SEQ ID NO: 7218815 - DNA, 22 bp, Homo sapiens
tctgcctcgctaacagcagcca

SEQ ID NO: 7218816 - DNA, 22 bp, Homo sapiens
tctgcctcgctaacagcagcca

SEQ ID NO: 7218817 - DNA, 22 bp, Homo sapiens
tctgcctcgctaacagcagcca

SEQ ID NO: 7218818 - DNA, 22 bp, Homo sapiens
tctgcctcgctaacagcagcca

SEQ ID NO: 7218819 - DNA, 22 bp, Homo sapiens
tctgcctcgctaacagcagcca

SEQ ID NO: 7218820 - DNA, 22 bp, Homo sapiens
tctgcctcctgcttgtcccgac

SEQ ID NO: 7218821 - DNA, 22 bp, Homo sapiens
tctgccaggcattgtgctgctc

SEQ ID NO: 7218822 - DNA, 22 bp, Homo sapiens
tctgccaggcattgtgctgctc

SEQ ID NO: 7218823 - DNA, 22 bp, Homo sapiens
tctgccaggagccatgagcaag

SEQ ID NO: 7218824 - DNA, 22 bp, Homo sapiens
tctgccaggcattgtgctgctc

SEQ ID NO: 7218825 - DNA, 22 bp, Homo sapiens
tctgccagctctgtgggtctcg

SEQ ID NO: 7218826 - DNA, 21 bp, Homo sapiens
tctgccagctgaagaggtgga

SEQ ID NO: 7218827 - DNA, 21 bp, Homo sapiens
tctgccagctgaagaggtgga

SEQ ID NO: 7218828 - DNA, 22 bp, Homo sapiens
tctgccaggaagaaagcacaat

SEQ ID NO: 7218829 - DNA, 22 bp, Homo sapiens
tctgccagaagttctgagagta

SEQ ID NO: 7218830 - DNA, 22 bp, Homo sapiens
tctgccagacctgactcagtag

SEQ ID NO: 7218831 - DNA, 22 bp, Homo sapiens
tctgccagcaccatgatccttc

SEQ ID NO: 7218832 - DNA, 20 bp, Homo sapiens
tctgccactgcactctgccc

SEQ ID NO: 7218833 - DNA, 22 bp, Homo sapiens
tctgccacttacctccatgtac

SEQ ID NO: 7218834 - DNA, 22 bp, Homo sapiens
tctgccacttgaggtcattggc

SEQ ID NO: 7218835 - DNA, 22 bp, Homo sapiens
tctgccacttttgcttactggg

SEQ ID NO: 7218836 - DNA, 20 bp, Homo sapiens
tctgccactttttctgtcac

SEQ ID NO: 7218837 - DNA, 22 bp, Homo sapiens
tctgccagaagccagggtctgg

SEQ ID NO: 7218838 - DNA, 22 bp, Homo sapiens
ccagctcctgggtcttagtcag

SEQ ID NO: 7218839 - DNA, 22 bp, Homo sapiens
ccagctcctgggtcttagtcag

SEQ ID NO: 7218840 - DNA, 22 bp, Homo sapiens
ccagctcctgagcatggtttcc

SEQ ID NO: 7218841 - DNA, 22 bp, Homo sapiens
ccagctcctgagcatggtttcc

SEQ ID NO: 7218842 - DNA, 22 bp, Homo sapiens
ccagctcctcttgtctctagca

SEQ ID NO: 7218843 - DNA, 22 bp, Homo sapiens
ccagctcctcttgtctctagca

SEQ ID NO: 7218844 - DNA, 22 bp, Homo sapiens
ccagctcctcttgtctctagca

SEQ ID NO: 7218845 - DNA, 22 bp, Homo sapiens
ccagctcctcttgtctctagca

SEQ ID NO: 7218846 - DNA, 22 bp, Homo sapiens
ccagctcctcttgtctctagca

SEQ ID NO: 7218847 - DNA, 22 bp, Homo sapiens
ccagctcctcttgtctctagca

SEQ ID NO: 7218848 - DNA, 22 bp, Homo sapiens
ccagctcctcttgtctctagca

SEQ ID NO: 7218849 - DNA, 22 bp, Homo sapiens
ccagctcctcttcccagtgtca

SEQ ID NO: 7218850 - DNA, 22 bp, Homo sapiens
ccagctcctcttcccagtgtca

SEQ ID NO: 7218851 - DNA, 22 bp, Homo sapiens
ccagctcctcttcccagtgtca

SEQ ID NO: 7218852 - DNA, 22 bp, Homo sapiens
ccagctcctcttcccagtgtca

SEQ ID NO: 7218853 - DNA, 22 bp, Homo sapiens
ccagctccagcatagccaccat

SEQ ID NO: 7218854 - DNA, 21 bp, Homo sapiens
ccagctccaggaccttggatc

SEQ ID NO: 7218855 - DNA, 22 bp, Homo sapiens
ccagctccaggactgggagctg

SEQ ID NO: 7218856 - DNA, 22 bp, Homo sapiens
ccagctccaggactgggagctg

SEQ ID NO: 7218857 - DNA, 22 bp, Homo sapiens
ccagctccaggactgggagctg

SEQ ID NO: 7218858 - DNA, 22 bp, Homo sapiens
ccagctccaggactgggagctg

SEQ ID NO: 7218859 - DNA, 22 bp, Homo sapiens
ccagctcctcttcccagtgtca

SEQ ID NO: 7218860 - DNA, 22 bp, Homo sapiens
ccagctcctcttcccagtgtca

SEQ ID NO: 7218861 - DNA, 22 bp, Homo sapiens
ccagctcctcttcccagtgtca

SEQ ID NO: 7218862 - DNA, 22 bp, Homo sapiens
ccagctcctcttcccagtgtca

SEQ ID NO: 7218863 - DNA, 22 bp, Homo sapiens
ccagctctcaaggctccctggg

SEQ ID NO: 7218864 - DNA, 22 bp, Homo sapiens
ccagctctagccccatgtggct

SEQ ID NO: 7218865 - DNA, 22 bp, Homo sapiens
ccagctctcaaggctccctggg

SEQ ID NO: 7218866 - DNA, 22 bp, Homo sapiens
ccagctctagccccatgtggct

SEQ ID NO: 7218867 - DNA, 22 bp, Homo sapiens
ccagctctagccccatgtggct

SEQ ID NO: 7218868 - DNA, 22 bp, Homo sapiens
ccagctctcagcgggagactca

SEQ ID NO: 7218869 - DNA, 22 bp, Homo sapiens
ccagctctcagcgggagactca

SEQ ID NO: 7218870 - DNA, 22 bp, Homo sapiens
ccagctctcagcgggagactca

SEQ ID NO: 7218871 - DNA, 22 bp, Homo sapiens
tctgccaccaactgtcactaca

SEQ ID NO: 7218872 - DNA, 20 bp, Homo sapiens
tctgccacgtctggtgactg

SEQ ID NO: 7218873 - DNA, 22 bp, Homo sapiens
tctgccactagtggttacctta

SEQ ID NO: 7218874 - DNA, 22 bp, Homo sapiens
ccagctctaaacggctctgtgg

SEQ ID NO: 7218875 - DNA, 22 bp, Homo sapiens
ccagctctagccccatgtggct

SEQ ID NO: 7218876 - DNA, 22 bp, Homo sapiens
ccagctctagccccatgtggct

SEQ ID NO: 7218877 - DNA, 22 bp, Homo sapiens
ccagctctaaacggctctgtgg

SEQ ID NO: 7218878 - DNA, 22 bp, Homo sapiens
ccagctctaaacggctctgtgg

SEQ ID NO: 7218879 - DNA, 22 bp, Homo sapiens
ccagctctaaacggctctgtgg

SEQ ID NO: 7218880 - DNA, 22 bp, Homo sapiens
ccagctccttctgtctgtggag

SEQ ID NO: 7218881 - DNA, 22 bp, Homo sapiens
ccagctcctgggtcttagtcag

SEQ ID NO: 7218882 - DNA, 22 bp, Homo sapiens
ccagctcctgggtcttagtcag

SEQ ID NO: 7218883 - DNA, 22 bp, Homo sapiens
ccagctccttctgtctgtggag

SEQ ID NO: 7218884 - DNA, 22 bp, Homo sapiens
tctgagtcctaaacccccaggg

SEQ ID NO: 7218885 - DNA, 22 bp, Homo sapiens
tctgagtcttggggtccctatt

SEQ ID NO: 7218886 - DNA, 22 bp, Homo sapiens
tctgaggccccagccctgcaca

SEQ ID NO: 7218887 - DNA, 22 bp, Homo sapiens
tctgaggcccctgggcaggatg

SEQ ID NO: 7218888 - DNA, 22 bp, Homo sapiens
tctgaggcatacccaggccccc

SEQ ID NO: 7218889 - DNA, 22 bp, Homo sapiens
tctgaggcatacccaggccccc

SEQ ID NO: 7218890 - DNA, 22 bp, Homo sapiens
tctgaggcccagttcaactctt

SEQ ID NO: 7218891 - DNA, 22 bp, Homo sapiens
tctgaggcataacctgttctgc

SEQ ID NO: 7218892 - DNA, 22 bp, Homo sapiens
tctgaggcagcttgccactcta

SEQ ID NO: 7218893 - DNA, 22 bp, Homo sapiens
tctgaggcataacctgttctgc

SEQ ID NO: 7218894 - DNA, 22 bp, Homo sapiens
tctgaggcatacccaggccccc

SEQ ID NO: 7218895 - DNA, 22 bp, Homo sapiens
tctgaggcatacccaggccccc

SEQ ID NO: 7218896 - DNA, 22 bp, Homo sapiens
tctgaggatagaggcaatagga

SEQ ID NO: 7218897 - DNA, 22 bp, Homo sapiens
tctgaggatagaggcaatagga

SEQ ID NO: 7218898 - DNA, 22 bp, Homo sapiens
tctgaggagtgaccctcttgca

SEQ ID NO: 7218899 - DNA, 23 bp, Homo sapiens
tctgaggatgaaggatagcaagt

SEQ ID NO: 7218900 - DNA, 23 bp, Homo sapiens
tctgaggatgaaggatagcaagt

SEQ ID NO: 7218901 - DNA, 22 bp, Homo sapiens
tctgaggcaaacagaggagtgt

SEQ ID NO: 7218902 - DNA, 22 bp, Homo sapiens
tctgaggcaaacagaggagtgt

SEQ ID NO: 7218903 - DNA, 22 bp, Homo sapiens
tctgaggcagcttgccactcta

SEQ ID NO: 7218904 - DNA, 22 bp, Homo sapiens
ccagccctcactgaggcctctc

SEQ ID NO: 7218905 - DNA, 22 bp, Homo sapiens
ccagccctcactgaggcctctc

SEQ ID NO: 7218906 - DNA, 22 bp, Homo sapiens
ccagccctacagtatcacctgt

SEQ ID NO: 7218907 - DNA, 20 bp, Homo sapiens
tctgagagtctgagtgatga

SEQ ID NO: 7218908 - DNA, 22 bp, Homo sapiens
tctgagagtctttcttcaagtg

SEQ ID NO: 7218909 - DNA, 22 bp, Homo sapiens
tctgagagtctttcttcaagtg

SEQ ID NO: 7218910 - DNA, 22 bp, Homo sapiens
tctgaggacagtgctgtgcctg

SEQ ID NO: 7218911 - DNA, 22 bp, Homo sapiens
tctgaggacctactgaagagtt

SEQ ID NO: 7218912 - DNA, 21 bp, Homo sapiens
ccagcccagctgtgtcccagc

SEQ ID NO: 7218913 - DNA, 21 bp, Homo sapiens
ccagcccagcctccttctctt

SEQ ID NO: 7218914 - DNA, 21 bp, Homo sapiens
ccagcccagctgtgtcccagc

SEQ ID NO: 7218915 - DNA, 19 bp, Homo sapiens
ccagcccatagtccatcac

SEQ ID NO: 7218916 - DNA, 19 bp, Homo sapiens
ccagcccacagtgactttc

SEQ ID NO: 7218917 - DNA, 21 bp, Homo sapiens
ccagcccagcctccttctctt

SEQ ID NO: 7218918 - DNA, 21 bp, Homo sapiens
ccagcccagcctccttctctt

SEQ ID NO: 7218919 - DNA, 21 bp, Homo sapiens
ccagcccagcctccttctctt

SEQ ID NO: 7218920 - DNA, 22 bp, Homo sapiens
ccagccataatacgaacccagc

SEQ ID NO: 7218921 - DNA, 22 bp, Homo sapiens
ccagccataatacgaacccagc

SEQ ID NO: 7218922 - DNA, 22 bp, Homo sapiens
ccagccatgcacaaaccatgag

SEQ ID NO: 7218923 - DNA, 22 bp, Homo sapiens
ccagcccaaacaagccgccttc

SEQ ID NO: 7218924 - DNA, 22 bp, Homo sapiens
ccagcccaaacaagccgccttc

SEQ ID NO: 7218925 - DNA, 22 bp, Homo sapiens
ccagcccaaacaagccgccttc

SEQ ID NO: 7218926 - DNA, 22 bp, Homo sapiens
ccagcccaaacaagccgccttc

SEQ ID NO: 7218927 - DNA, 22 bp, Homo sapiens
ccagcccaaagtcaccccggga

SEQ ID NO: 7218928 - DNA, 22 bp, Homo sapiens
ccagcccatgcccttatagcat

SEQ ID NO: 7218929 - DNA, 22 bp, Homo sapiens
ccagcccatgcccttatagcat

SEQ ID NO: 7218930 - DNA, 22 bp, Homo sapiens
ccagccccgggaacctggccgt

SEQ ID NO: 7218931 - DNA, 22 bp, Homo sapiens
ccagccccgggaacctggccgt

SEQ ID NO: 7218932 - DNA, 22 bp, Homo sapiens
ccagccccgggaacctggccgt

SEQ ID NO: 7218933 - DNA, 22 bp, Homo sapiens
ccagccccgggaacctggccgt

SEQ ID NO: 7218934 - DNA, 19 bp, Homo sapiens
ccagcccatagtccatcac

SEQ ID NO: 7218935 - DNA, 19 bp, Homo sapiens
ccagcccatagtccatcac

SEQ ID NO: 7218936 - DNA, 19 bp, Homo sapiens
ccagcccatagtccatcac

SEQ ID NO: 7218937 - DNA, 22 bp, Homo sapiens
ccagccccgggccttaccgtgc

SEQ ID NO: 7218938 - DNA, 22 bp, Homo sapiens
ccagccccgggaacctggccgt

SEQ ID NO: 7218939 - DNA, 22 bp, Homo sapiens
ccagccccgggaacctggccgt

SEQ ID NO: 7218940 - DNA, 22 bp, Homo sapiens
ccagccccgggccttaccgtgc

SEQ ID NO: 7218941 - DNA, 22 bp, Homo sapiens
ccagcccctatcctcgctccac

SEQ ID NO: 7218942 - DNA, 22 bp, Homo sapiens
ccagcccctatcctcgctccac

SEQ ID NO: 7218943 - DNA, 22 bp, Homo sapiens
ccagcccctatcctcgctccac

SEQ ID NO: 7218944 - DNA, 23 bp, Homo sapiens
tctctcttagctatgcttatggc

SEQ ID NO: 7218945 - DNA, 22 bp, Homo sapiens
tctctctgtgacagctttgctg

SEQ ID NO: 7218946 - DNA, 23 bp, Homo sapiens
tctctcttagctatgcttatggc

SEQ ID NO: 7218947 - DNA, 22 bp, Homo sapiens
tctctctgtgacagctttgctg

SEQ ID NO: 7218948 - DNA, 23 bp, Homo sapiens
tctctcttagctatgcttatggc

SEQ ID NO: 7218949 - DNA, 23 bp, Homo sapiens
tctctcttagctatgcttatggc

SEQ ID NO: 7218950 - DNA, 22 bp, Homo sapiens
tctctcttcaacccttaactag

SEQ ID NO: 7218951 - DNA, 22 bp, Homo sapiens
tctctcttcaacccttaactag

SEQ ID NO: 7218952 - DNA, 22 bp, Homo sapiens
tctctcttcagagataccttgc

SEQ ID NO: 7218953 - DNA, 22 bp, Homo sapiens
tctctcttcagagataccttgc

SEQ ID NO: 7218954 - DNA, 22 bp, Homo sapiens
tctctcttgaagtattagctag

SEQ ID NO: 7218955 - DNA, 22 bp, Homo sapiens
tctctcttgaagtattagctag

SEQ ID NO: 7218956 - DNA, 22 bp, Homo sapiens
tctctcttgaagtattagctag

SEQ ID NO: 7218957 - DNA, 22 bp, Homo sapiens
tctctcttgtcaccccatctgc

SEQ ID NO: 7218958 - DNA, 22 bp, Homo sapiens
tctctcttgtcaccccatctgc

SEQ ID NO: 7218959 - DNA, 22 bp, Homo sapiens
tctctcttctttgttaagaatg

SEQ ID NO: 7218960 - DNA, 22 bp, Homo sapiens
tctctcttctttgttaagaatg

SEQ ID NO: 7218961 - DNA, 22 bp, Homo sapiens
tctctcttctttgttaagaatg

SEQ ID NO: 7218962 - DNA, 22 bp, Homo sapiens
tctctcttgaagtattagctag

SEQ ID NO: 7218963 - DNA, 22 bp, Homo sapiens
tctctcttcatgcttttagaat

SEQ ID NO: 7218964 - DNA, 22 bp, Homo sapiens
tctctcttcatgcttttagaat

SEQ ID NO: 7218965 - DNA, 22 bp, Homo sapiens
tctcttaactggttcagcaatt

SEQ ID NO: 7218966 - DNA, 22 bp, Homo sapiens
tctcttaataagtaaatactga

SEQ ID NO: 7218967 - DNA, 18 bp, Homo sapiens
tctcttgcatcttctgta

SEQ ID NO: 7218968 - DNA, 18 bp, Homo sapiens
tctcttgcatcttctgta

SEQ ID NO: 7218969 - DNA, 22 bp, Homo sapiens
tctcttggacatgtggctctgc

SEQ ID NO: 7218970 - DNA, 22 bp, Homo sapiens
tctcttggaggttcttcctgtt

SEQ ID NO: 7218971 - DNA, 22 bp, Homo sapiens
tctcttggaggttcttcctgtt

SEQ ID NO: 7218972 - DNA, 22 bp, Homo sapiens
tctcttgggaggaaagagagaa

SEQ ID NO: 7218973 - DNA, 22 bp, Homo sapiens
ccagccactgggccactgccag

SEQ ID NO: 7218974 - DNA, 22 bp, Homo sapiens
ccagccactgggccactgccag

SEQ ID NO: 7218975 - DNA, 22 bp, Homo sapiens
ccagccacgaagctcccttcat

SEQ ID NO: 7218976 - DNA, 22 bp, Homo sapiens
ccagccactgggccactgccag

SEQ ID NO: 7218977 - DNA, 22 bp, Homo sapiens
ccagccactgggccactgccag

SEQ ID NO: 7218978 - DNA, 22 bp, Homo sapiens
tctgaaatcctttatcttggct

SEQ ID NO: 7218979 - DNA, 22 bp, Homo sapiens
tctgaaatcctttatcttggct

SEQ ID NO: 7218980 - DNA, 22 bp, Homo sapiens
ccagccagtccagcattggtgt

SEQ ID NO: 7218981 - DNA, 22 bp, Homo sapiens
ccagccagtccagcattggtgt

SEQ ID NO: 7218982 - DNA, 22 bp, Homo sapiens
ccagccagtccagcattggtgt

SEQ ID NO: 7218983 - DNA, 22 bp, Homo sapiens
ccagccagtcccgcatgaccgc

SEQ ID NO: 7218984 - DNA, 22 bp, Homo sapiens
ccagccagtcccgcatgaccgc

SEQ ID NO: 7218985 - DNA, 22 bp, Homo sapiens
ccagccagtcccgcatgaccgc

SEQ ID NO: 7218986 - DNA, 22 bp, Homo sapiens
ccagccagtcccgcatgaccgc

SEQ ID NO: 7218987 - DNA, 22 bp, Homo sapiens
ccagccagtcccgcatgaccgc

SEQ ID NO: 7218988 - DNA, 22 bp, Homo sapiens
ccagccataaacccagatgact

SEQ ID NO: 7218989 - DNA, 22 bp, Homo sapiens
tctgaaatcctttatcttggct

SEQ ID NO: 7218990 - DNA, 22 bp, Homo sapiens
tctgaaatattggtaatacttt

SEQ ID NO: 7218991 - DNA, 22 bp, Homo sapiens
tctgaaatatattttgagtgtt

SEQ ID NO: 7218992 - DNA, 22 bp, Homo sapiens
tctgaaataggcttcttttggt

SEQ ID NO: 7218993 - DNA, 22 bp, Homo sapiens
tctgaaataggagccatgtaga

SEQ ID NO: 7218994 - DNA, 22 bp, Homo sapiens
tctcttggtgatagtctttctt

SEQ ID NO: 7218995 - DNA, 22 bp, Homo sapiens
tctcttggggaaagagaagaat

SEQ ID NO: 7218996 - DNA, 22 bp, Homo sapiens
tctcttggggaaagagaagaat

SEQ ID NO: 7218997 - DNA, 22 bp, Homo sapiens
tctcttggtacacagatgatca

SEQ ID NO: 7218998 - DNA, 22 bp, Homo sapiens
tctcttgtaatttaaaaaatct

SEQ ID NO: 7218999 - DNA, 17 bp, Homo sapiens
tctcttgttcactgctg

SEQ ID NO: 7219000 - DNA, 22 bp, Homo sapiens
tctgaaataggaaagcaaatgg

SEQ ID NO: 7219001 - DNA, 22 bp, Homo sapiens
catgcacacacagttctaatta

SEQ ID NO: 7219002 - DNA, 22 bp, Homo sapiens
catgcacacacagttctaatta

SEQ ID NO: 7219003 - DNA, 22 bp, Homo sapiens
catgcacaagggatgatgaaat

SEQ ID NO: 7219004 - DNA, 22 bp, Homo sapiens
catgcaattttttcttgtcagt

SEQ ID NO: 7219005 - DNA, 22 bp, Homo sapiens
catgcacaaaggtaagatgcgt

SEQ ID NO: 7219006 - DNA, 22 bp, Homo sapiens
catgcacaaaggtaagatgcgt

SEQ ID NO: 7219007 - DNA, 22 bp, Homo sapiens
catgcacaaaggtaagatgcgt

SEQ ID NO: 7219008 - DNA, 22 bp, Homo sapiens
catgcacaacatactcaagagg

SEQ ID NO: 7219009 - DNA, 22 bp, Homo sapiens
catggctgaacactcagtgact

SEQ ID NO: 7219010 - DNA, 22 bp, Homo sapiens
catggctgaggcagaggactga

SEQ ID NO: 7219011 - DNA, 22 bp, Homo sapiens
catggctgaggcagaggactga

SEQ ID NO: 7219012 - DNA, 22 bp, Homo sapiens
catggctgaacactcagtgact

SEQ ID NO: 7219013 - DNA, 23 bp, Homo sapiens
catggctgatttcaagctaccac

SEQ ID NO: 7219014 - DNA, 22 bp, Homo sapiens
catggctgcctgtggacactgc

SEQ ID NO: 7219015 - DNA, 19 bp, Homo sapiens
catggctgctgcttgggag

SEQ ID NO: 7219016 - DNA, 22 bp, Homo sapiens
catggctgcgagaagagtgggt

SEQ ID NO: 7219017 - DNA, 19 bp, Homo sapiens
catggctgctgcttgggag

SEQ ID NO: 7219018 - DNA, 22 bp, Homo sapiens
catggctggccagtgggagtgg

SEQ ID NO: 7219019 - DNA, 22 bp, Homo sapiens
catggctgggagacggctgagg

SEQ ID NO: 7219020 - DNA, 22 bp, Homo sapiens
catggctgggagacggctgagg

SEQ ID NO: 7219021 - DNA, 22 bp, Homo sapiens
catggctggtgcacctctggga

SEQ ID NO: 7219022 - DNA, 22 bp, Homo sapiens
tcattttcacacataaatagca

SEQ ID NO: 7219023 - DNA, 22 bp, Homo sapiens
tcattttcaagtttgaacagga

SEQ ID NO: 7219024 - DNA, 22 bp, Homo sapiens
tcattttcacacataaatagca

SEQ ID NO: 7219025 - DNA, 22 bp, Homo sapiens
tcattttcacacataaatagca

SEQ ID NO: 7219026 - DNA, 22 bp, Homo sapiens
tcattttcacacataaatagca

SEQ ID NO: 7219027 - DNA, 22 bp, Homo sapiens
tcattttcaagtttgaacagga

SEQ ID NO: 7219028 - DNA, 22 bp, Homo sapiens
tcattttcaagtttgaacagga

SEQ ID NO: 7219029 - DNA, 22 bp, Homo sapiens
tcattttcacacataaatagca

SEQ ID NO: 7219030 - DNA, 22 bp, Homo sapiens
tcattttcacacataaatagca

SEQ ID NO: 7219031 - DNA, 22 bp, Homo sapiens
tcattttcccactgaagctgtc

SEQ ID NO: 7219032 - DNA, 22 bp, Homo sapiens
tcattttcccactgaagctgtc

SEQ ID NO: 7219033 - DNA, 22 bp, Homo sapiens
tcattttggggtttgtcatctt

SEQ ID NO: 7219034 - DNA, 18 bp, Homo sapiens
tcattttgtctgcctttg

SEQ ID NO: 7219035 - DNA, 22 bp, Homo sapiens
tcattttgcctgccatttgagt

SEQ ID NO: 7219036 - DNA, 22 bp, Homo sapiens
catgattttgtcttgtgttaat

SEQ ID NO: 7219037 - DNA, 22 bp, Homo sapiens
catgattttgtcttgtgttaat

SEQ ID NO: 7219038 - DNA, 22 bp, Homo sapiens
catgatttactaaaatttgttt

SEQ ID NO: 7219039 - DNA, 22 bp, Homo sapiens
catgcaaaatgtattttattag

SEQ ID NO: 7219040 - DNA, 22 bp, Homo sapiens
catgcaaacacgtaaacattca

SEQ ID NO: 7219041 - DNA, 22 bp, Homo sapiens
catgcaaacacgtaaacattca

SEQ ID NO: 7219042 - DNA, 23 bp, Homo sapiens
catgcaaacactattgcatttgg

SEQ ID NO: 7219043 - DNA, 23 bp, Homo sapiens
catgcaaacactattgcatttgg

SEQ ID NO: 7219044 - DNA, 23 bp, Homo sapiens
catgcaaacactattgcatttgg

SEQ ID NO: 7219045 - DNA, 23 bp, Homo sapiens
catgcaaacactattgcatttgg

SEQ ID NO: 7219046 - DNA, 22 bp, Homo sapiens
catgcaaagcgttttgaccagc

SEQ ID NO: 7219047 - DNA, 22 bp, Homo sapiens
catgcaaagcgttttgaccagc

SEQ ID NO: 7219048 - DNA, 22 bp, Homo sapiens
catgcaaaggtcaagatcagga

SEQ ID NO: 7219049 - DNA, 22 bp, Homo sapiens
catgcaaaggtcaagatcagga

SEQ ID NO: 7219050 - DNA, 22 bp, Homo sapiens
catgcaaaggtcaagatcagga

SEQ ID NO: 7219051 - DNA, 22 bp, Homo sapiens
catgcaaatggtggctaaatgg

SEQ ID NO: 7219052 - DNA, 22 bp, Homo sapiens
catgcaaatgtgctaatctgaa

SEQ ID NO: 7219053 - DNA, 22 bp, Homo sapiens
catgcaaatgtgctaatctgaa

SEQ ID NO: 7219054 - DNA, 20 bp, Homo sapiens
catgcaacagattatttccc

SEQ ID NO: 7219055 - DNA, 22 bp, Homo sapiens
catgcaagacaatctttaaaat

SEQ ID NO: 7219056 - DNA, 22 bp, Homo sapiens
catgcaagacaatctttaaaat

SEQ ID NO: 7219057 - DNA, 22 bp, Homo sapiens
catgtgaattccaaagctaggt

SEQ ID NO: 7219058 - DNA, 22 bp, Homo sapiens
catgtgaattccaaagctaggt

SEQ ID NO: 7219059 - DNA, 22 bp, Homo sapiens
catgtgaattccaaagctaggt

SEQ ID NO: 7219060 - DNA, 22 bp, Homo sapiens
catgtgacaggagcagctctaa

SEQ ID NO: 7219061 - DNA, 23 bp, Homo sapiens
catgtgcaggaactgtgcttttg

SEQ ID NO: 7219062 - DNA, 22 bp, Homo sapiens
catgtgcagggccaggcattgc

SEQ ID NO: 7219063 - DNA, 22 bp, Homo sapiens
catgtgcagtgtaagacatgct

SEQ ID NO: 7219064 - DNA, 22 bp, Homo sapiens
catgtgcagtgtaagacatgct

SEQ ID NO: 7219065 - DNA, 22 bp, Homo sapiens
catgtgcagtgtaagacatgct

SEQ ID NO: 7219066 - DNA, 19 bp, Homo sapiens
catgtgcatgagcacagga

SEQ ID NO: 7219067 - DNA, 19 bp, Homo sapiens
catgtgcatgagcacagga

SEQ ID NO: 7219068 - DNA, 22 bp, Homo sapiens
tccaggcaaaaggaactgcttg

SEQ ID NO: 7219069 - DNA, 22 bp, Homo sapiens
tccaggcaaagccttgtagacg

SEQ ID NO: 7219070 - DNA, 22 bp, Homo sapiens
tccaggcaaagccttgtagacg

SEQ ID NO: 7219071 - DNA, 22 bp, Homo sapiens
tccaggcaaagggactagcagg

SEQ ID NO: 7219072 - DNA, 22 bp, Homo sapiens
tccaggcaaagtgctgggctgc

SEQ ID NO: 7219073 - DNA, 22 bp, Homo sapiens
tccaggcaaggataataaacat

SEQ ID NO: 7219074 - DNA, 22 bp, Homo sapiens
tccaggcaagggaggagcatgg

SEQ ID NO: 7219075 - DNA, 22 bp, Homo sapiens
tccaggcacagagttggtcagt

SEQ ID NO: 7219076 - DNA, 22 bp, Homo sapiens
catgtctgggtatatgcatatg

SEQ ID NO: 7219077 - DNA, 22 bp, Homo sapiens
catgtcttaggaaagcagagga

SEQ ID NO: 7219078 - DNA, 22 bp, Homo sapiens
catgtcttatatcctgtcttca

SEQ ID NO: 7219079 - DNA, 22 bp, Homo sapiens
tccagcccagctcctctcagaa

SEQ ID NO: 7219080 - DNA, 22 bp, Homo sapiens
tccagcccagctcctctcagaa

SEQ ID NO: 7219081 - DNA, 22 bp, Homo sapiens
tccagcccagctcctctcagaa

SEQ ID NO: 7219082 - DNA, 22 bp, Homo sapiens
tccagcccagctcctctcagaa

SEQ ID NO: 7219083 - DNA, 22 bp, Homo sapiens
tccagcccagctcctctcagaa

SEQ ID NO: 7219084 - DNA, 22 bp, Homo sapiens
catgtacatgcctactatcaat

SEQ ID NO: 7219085 - DNA, 22 bp, Homo sapiens
catgtacatgcctactatcaat

SEQ ID NO: 7219086 - DNA, 18 bp, Homo sapiens
tccagcccacattttctg

SEQ ID NO: 7219087 - DNA, 20 bp, Homo sapiens
tccagcccagcagcctgaca

SEQ ID NO: 7219088 - DNA, 20 bp, Homo sapiens
tccagcccagcagcctgaca

SEQ ID NO: 7219089 - DNA, 22 bp, Homo sapiens
tccagccaggatggcccaggga

SEQ ID NO: 7219090 - DNA, 22 bp, Homo sapiens
tccagccacttgcacagttaaa

SEQ ID NO: 7219091 - DNA, 22 bp, Homo sapiens
tccagccacttgcacagttaaa

SEQ ID NO: 7219092 - DNA, 22 bp, Homo sapiens
tccagccaggatggcccaggga

SEQ ID NO: 7219093 - DNA, 22 bp, Homo sapiens
tccagccaggatggcccaggga

SEQ ID NO: 7219094 - DNA, 22 bp, Homo sapiens
tccagccacttgcacagttaaa

SEQ ID NO: 7219095 - DNA, 22 bp, Homo sapiens
catgggagctatctccatcact

SEQ ID NO: 7219096 - DNA, 22 bp, Homo sapiens
catgggaataaagttatttcaa

SEQ ID NO: 7219097 - DNA, 21 bp, Homo sapiens
tccagccagtaaatgctcagc

SEQ ID NO: 7219098 - DNA, 22 bp, Homo sapiens
tccagccatatcttgtagccct

SEQ ID NO: 7219099 - DNA, 22 bp, Homo sapiens
tccagccatatcttgtagccct

SEQ ID NO: 7219100 - DNA, 22 bp, Homo sapiens
tccagccatgactcggacagtg

SEQ ID NO: 7219101 - DNA, 22 bp, Homo sapiens
tccagccatgactcggacagtg

SEQ ID NO: 7219102 - DNA, 22 bp, Homo sapiens
tccagccattcattatgacacc

SEQ ID NO: 7219103 - DNA, 22 bp, Homo sapiens
tccagcccacacctgaagctgg

SEQ ID NO: 7219104 - DNA, 18 bp, Homo sapiens
tccagcccacattttctg

SEQ ID NO: 7219105 - DNA, 22 bp, Homo sapiens
tcatggttcatgagtgtccttt

SEQ ID NO: 7219106 - DNA, 22 bp, Homo sapiens
tcatggggtttggctggatgtc

SEQ ID NO: 7219107 - DNA, 22 bp, Homo sapiens
tcatgtaagagcttttgtgtca

SEQ ID NO: 7219108 - DNA, 22 bp, Homo sapiens
tcatgtaagtatagaaagcagt

SEQ ID NO: 7219109 - DNA, 22 bp, Homo sapiens
tcatggggtgacagaagggagg

SEQ ID NO: 7219110 - DNA, 22 bp, Homo sapiens
tcatggggtagaagcatgttta

SEQ ID NO: 7219111 - DNA, 22 bp, Homo sapiens
tcatggggccacagctgccagc

SEQ ID NO: 7219112 - DNA, 22 bp, Homo sapiens
catgattatgtgttagagtttg

SEQ ID NO: 7219113 - DNA, 22 bp, Homo sapiens
catgattgatccttctaaatgc

SEQ ID NO: 7219114 - DNA, 22 bp, Homo sapiens
catgatttactaaaatttgttt

SEQ ID NO: 7219115 - DNA, 17 bp, Homo sapiens
tcatttgttgtgactag

SEQ ID NO: 7219116 - DNA, 22 bp, Homo sapiens
tcatttgttgctgttacctgag

SEQ ID NO: 7219117 - DNA, 18 bp, Homo sapiens
tcatttgttttgcatgaa

SEQ ID NO: 7219118 - DNA, 18 bp, Homo sapiens
tcatttgttttgcatgaa

SEQ ID NO: 7219119 - DNA, 22 bp, Homo sapiens
tcatttgttctcattctctact

SEQ ID NO: 7219120 - DNA, 22 bp, Homo sapiens
tcatttcaatgatactactaag

SEQ ID NO: 7219121 - DNA, 22 bp, Homo sapiens
tcatttgttctcattctctact

SEQ ID NO: 7219122 - DNA, 22 bp, Homo sapiens
tcatttgttgaactttagtgcg

SEQ ID NO: 7219123 - DNA, 22 bp, Homo sapiens
tcatttcaagttctgacagcta

SEQ ID NO: 7219124 - DNA, 22 bp, Homo sapiens
tcatttcaagttctgacagcta

SEQ ID NO: 7219125 - DNA, 22 bp, Homo sapiens
tcatgtctctatgtgcctatta

SEQ ID NO: 7219126 - DNA, 19 bp, Homo sapiens
tcatgtctctcatctgtga

SEQ ID NO: 7219127 - DNA, 22 bp, Homo sapiens
tcatgtcagtttcttctataaa

SEQ ID NO: 7219128 - DNA, 22 bp, Homo sapiens
tcatgtcagtttcttctataaa

SEQ ID NO: 7219129 - DNA, 22 bp, Homo sapiens
catgagttttttagttcatgca

SEQ ID NO: 7219130 - DNA, 22 bp, Homo sapiens
catgagttcaaaatgcctgcct

SEQ ID NO: 7219131 - DNA, 22 bp, Homo sapiens
catgagtgtcatctcagcagct

SEQ ID NO: 7219132 - DNA, 22 bp, Homo sapiens
catgagaatgaagaagacttaa

SEQ ID NO: 7219133 - DNA, 22 bp, Homo sapiens
catgagtgggcgccaggaagag

SEQ ID NO: 7219134 - DNA, 22 bp, Homo sapiens
catgagaagtggccttcaaaaa

SEQ ID NO: 7219135 - DNA, 22 bp, Homo sapiens
catgagaatgaagaagacttaa

SEQ ID NO: 7219136 - DNA, 22 bp, Homo sapiens
catgagaatgaagaagacttaa

SEQ ID NO: 7219137 - DNA, 22 bp, Homo sapiens
tcagtttataaattgtatttag

SEQ ID NO: 7219138 - DNA, 22 bp, Homo sapiens
tcagtttatggtctagttcatg

SEQ ID NO: 7219139 - DNA, 22 bp, Homo sapiens
catgatctggtcctactgtggg

SEQ ID NO: 7219140 - DNA, 19 bp, Homo sapiens
catgatgagcatcctgcag

SEQ ID NO: 7219141 - DNA, 19 bp, Homo sapiens
catgatgagcatcctgcag

SEQ ID NO: 7219142 - DNA, 22 bp, Homo sapiens
catgatggatgtgcacttcgct

SEQ ID NO: 7219143 - DNA, 22 bp, Homo sapiens
catgatggatgtgcacttcgct

SEQ ID NO: 7219144 - DNA, 22 bp, Homo sapiens
catgatggcgagtttctaggtt

SEQ ID NO: 7219145 - DNA, 22 bp, Homo sapiens
catgatggttcttacaaaggtg

SEQ ID NO: 7219146 - DNA, 22 bp, Homo sapiens
catgatgttatctaaatctggt

SEQ ID NO: 7219147 - DNA, 22 bp, Homo sapiens
catgattatattaatggcttca

SEQ ID NO: 7219148 - DNA, 22 bp, Homo sapiens
catgatataaagtagtagataa

SEQ ID NO: 7219149 - DNA, 22 bp, Homo sapiens
catgatataaagtagtagataa

SEQ ID NO: 7219150 - DNA, 20 bp, Homo sapiens
catgatacttggaagggctt

SEQ ID NO: 7219151 - DNA, 22 bp, Homo sapiens
catgataggtatttaattaaat

SEQ ID NO: 7219152 - DNA, 23 bp, Homo sapiens
catgatatttatcttccctgggt

SEQ ID NO: 7219153 - DNA, 22 bp, Homo sapiens
catgatcaccacttgacagccc

SEQ ID NO: 7219154 - DNA, 22 bp, Homo sapiens
catgatcagaaagagaagctag

SEQ ID NO: 7219155 - DNA, 22 bp, Homo sapiens
catgatacttgaatttggaagg

SEQ ID NO: 7219156 - DNA, 22 bp, Homo sapiens
catgatacttgaatttggaagg

SEQ ID NO: 7219157 - DNA, 22 bp, Homo sapiens
catgatacttgacatttgcgat

SEQ ID NO: 7219158 - DNA, 22 bp, Homo sapiens
catccccagagcagttccacta

SEQ ID NO: 7219159 - DNA, 22 bp, Homo sapiens
catccccaattagcgcccagct

SEQ ID NO: 7219160 - DNA, 22 bp, Homo sapiens
catccccagagcagttccacta

SEQ ID NO: 7219161 - DNA, 22 bp, Homo sapiens
catccatagcctcaataaatag

SEQ ID NO: 7219162 - DNA, 22 bp, Homo sapiens
catccattaactcatttgtttc

SEQ ID NO: 7219163 - DNA, 22 bp, Homo sapiens
catccattcattaattctaaag

SEQ ID NO: 7219164 - DNA, 22 bp, Homo sapiens
tcaggtggcttggagggggacg

SEQ ID NO: 7219165 - DNA, 22 bp, Homo sapiens
tcaggtgggacctgctaggaca

SEQ ID NO: 7219166 - DNA, 22 bp, Homo sapiens
tcaggtggcttcggggagtggc

SEQ ID NO: 7219167 - DNA, 22 bp, Homo sapiens
tcaggtggcttggagggggacg

SEQ ID NO: 7219168 - DNA, 22 bp, Homo sapiens
tcaggtggcttcggggagtggc

SEQ ID NO: 7219169 - DNA, 22 bp, Homo sapiens
tcaggtggcttggagggggacg

SEQ ID NO: 7219170 - DNA, 22 bp, Homo sapiens
tcaggtggcttcggggagtggc

SEQ ID NO: 7219171 - DNA, 22 bp, Homo sapiens
tcaggtggcttcggggagtggc

SEQ ID NO: 7219172 - DNA, 22 bp, Homo sapiens
tcaggtggctggttgctggcta

SEQ ID NO: 7219173 - DNA, 22 bp, Homo sapiens
tcaggtggctggttgctggcta

SEQ ID NO: 7219174 - DNA, 22 bp, Homo sapiens
tcaggtggctggttgctggcta

SEQ ID NO: 7219175 - DNA, 22 bp, Homo sapiens
catctttaacaatttacaatgt

SEQ ID NO: 7219176 - DNA, 22 bp, Homo sapiens
catcttaacaggtctctgaggg

SEQ ID NO: 7219177 - DNA, 22 bp, Homo sapiens
catcttaaccctcagcctccca

SEQ ID NO: 7219178 - DNA, 17 bp, Homo sapiens
catcttaactatggact

SEQ ID NO: 7219179 - DNA, 22 bp, Homo sapiens
catcttaataaatctcctccct

SEQ ID NO: 7219180 - DNA, 21 bp, Homo sapiens
catcttaattgaaagcagaga

SEQ ID NO: 7219181 - DNA, 22 bp, Homo sapiens
tcaggtgggcgttccggtgcgg

SEQ ID NO: 7219182 - DNA, 22 bp, Homo sapiens
tcaggtgggcagtgggttgagc

SEQ ID NO: 7219183 - DNA, 22 bp, Homo sapiens
tcaggtgggcagtgggttgagc

SEQ ID NO: 7219184 - DNA, 22 bp, Homo sapiens
tcaggtgggacctgctaggaca

SEQ ID NO: 7219185 - DNA, 22 bp, Homo sapiens
tcaggtgggagtagaatgctag

SEQ ID NO: 7219186 - DNA, 22 bp, Homo sapiens
tcaggtgggagtagaatgctag

SEQ ID NO: 7219187 - DNA, 22 bp, Homo sapiens
tcaggtgggtctacaattagtt

SEQ ID NO: 7219188 - DNA, 22 bp, Homo sapiens
tcaggtggtcctaagtgccatc

SEQ ID NO: 7219189 - DNA, 22 bp, Homo sapiens
tcaggtggtcctaagtgccatc

SEQ ID NO: 7219190 - DNA, 22 bp, Homo sapiens
tcaggtggtcctaagtgccatc

SEQ ID NO: 7219191 - DNA, 22 bp, Homo sapiens
tcaggtgtaggttgttcagttt

SEQ ID NO: 7219192 - DNA, 22 bp, Homo sapiens
tcaggtgtaggttgttcagttt

SEQ ID NO: 7219193 - DNA, 22 bp, Homo sapiens
catctttgcaccctcaaaacct

SEQ ID NO: 7219194 - DNA, 22 bp, Homo sapiens
catctttcagtttataagtctg

SEQ ID NO: 7219195 - DNA, 22 bp, Homo sapiens
catctttcagtttataagtctg

SEQ ID NO: 7219196 - DNA, 22 bp, Homo sapiens
catctttatttatatagacagg

SEQ ID NO: 7219197 - DNA, 22 bp, Homo sapiens
catctttatttatatagacagg

SEQ ID NO: 7219198 - DNA, 22 bp, Homo sapiens
catctttatttatatagacagg

SEQ ID NO: 7219199 - DNA, 22 bp, Homo sapiens
catctttagggaccattattct

SEQ ID NO: 7219200 - DNA, 22 bp, Homo sapiens
catctttaacagaatggatttg

SEQ ID NO: 7219201 - DNA, 22 bp, Homo sapiens
catctttagttattgaatatag

SEQ ID NO: 7219202 - DNA, 21 bp, Homo sapiens
tcagttctctgcctgtgcttg

SEQ ID NO: 7219203 - DNA, 21 bp, Homo sapiens
tcagttctctgcctgtgcttg

SEQ ID NO: 7219204 - DNA, 22 bp, Homo sapiens
tcagttctggctgctgctgtca

SEQ ID NO: 7219205 - DNA, 22 bp, Homo sapiens
tcagttcttagtaatgcagtct

SEQ ID NO: 7219206 - DNA, 22 bp, Homo sapiens
tcagttgttggaagtagatgta

SEQ ID NO: 7219207 - DNA, 22 bp, Homo sapiens
tcagttgctgtgtaatgttttc

SEQ ID NO: 7219208 - DNA, 22 bp, Homo sapiens
tcagttgccagtattttatata

SEQ ID NO: 7219209 - DNA, 22 bp, Homo sapiens
tcagttgctagaagggggaacc

SEQ ID NO: 7219210 - DNA, 22 bp, Homo sapiens
tcagttgcacctgcatggtact

SEQ ID NO: 7219211 - DNA, 22 bp, Homo sapiens
tcagttgcatgggaagttcaga

SEQ ID NO: 7219212 - DNA, 22 bp, Homo sapiens
tcaggaagtgcctaggctggcc

SEQ ID NO: 7219213 - DNA, 22 bp, Homo sapiens
tcaggaagtctcaattagctac

SEQ ID NO: 7219214 - DNA, 22 bp, Homo sapiens
tcaggaagtgctgaggctgctt

SEQ ID NO: 7219215 - DNA, 22 bp, Homo sapiens
tcaggaagtgctgaggctgctt

SEQ ID NO: 7219216 - DNA, 22 bp, Homo sapiens
tcaggaagtgctgaggctgctt

SEQ ID NO: 7219217 - DNA, 22 bp, Homo sapiens
tcaggaagtgcctaggctggcc

SEQ ID NO: 7219218 - DNA, 22 bp, Homo sapiens
tcaggaagtgcctaggctggcc

SEQ ID NO: 7219219 - DNA, 22 bp, Homo sapiens
tcaggaagttgaggcgtagaga

SEQ ID NO: 7219220 - DNA, 22 bp, Homo sapiens
tcaggaagtggtaaaggatgtt

SEQ ID NO: 7219221 - DNA, 22 bp, Homo sapiens
tcaggaagtggtaaaggatgtt

SEQ ID NO: 7219222 - DNA, 22 bp, Homo sapiens
catagaatgtaataaagagtag

SEQ ID NO: 7219223 - DNA, 22 bp, Homo sapiens
catagaatgtaataaagagtag

SEQ ID NO: 7219224 - DNA, 22 bp, Homo sapiens
catagacaaagatcagaagagt

SEQ ID NO: 7219225 - DNA, 22 bp, Homo sapiens
catagacagatggtaagaagct

SEQ ID NO: 7219226 - DNA, 22 bp, Homo sapiens
catataaatacaacatgtgtta

SEQ ID NO: 7219227 - DNA, 22 bp, Homo sapiens
tcaggaagttgaggcgtagaga

SEQ ID NO: 7219228 - DNA, 19 bp, Homo sapiens
tcaggaagttgatgaggtg

SEQ ID NO: 7219229 - DNA, 22 bp, Homo sapiens
catatacacttccacctctgtg

SEQ ID NO: 7219230 - DNA, 22 bp, Homo sapiens
catataattacctaccagctgg

SEQ ID NO: 7219231 - DNA, 22 bp, Homo sapiens
catataattacctaccagctgg

SEQ ID NO: 7219232 - DNA, 22 bp, Homo sapiens
catataatgtttgaagatgtgg

SEQ ID NO: 7219233 - DNA, 22 bp, Homo sapiens
catataatgtttgaagatgtgg

SEQ ID NO: 7219234 - DNA, 20 bp, Homo sapiens
catatatacctagaagtgga

SEQ ID NO: 7219235 - DNA, 20 bp, Homo sapiens
catatatacctagaagtgga

SEQ ID NO: 7219236 - DNA, 20 bp, Homo sapiens
catatatacctagaagtgga

SEQ ID NO: 7219237 - DNA, 20 bp, Homo sapiens
catatatacctagaagtgga

SEQ ID NO: 7219238 - DNA, 20 bp, Homo sapiens
catatatacctagaagtgga

SEQ ID NO: 7219239 - DNA, 20 bp, Homo sapiens
catatatacctagaagtgga

SEQ ID NO: 7219240 - DNA, 22 bp, Homo sapiens
catatacttttctatagctttc

SEQ ID NO: 7219241 - DNA, 22 bp, Homo sapiens
catatacttttctatagctttc

SEQ ID NO: 7219242 - DNA, 20 bp, Homo sapiens
catatatacctagaagtgga

SEQ ID NO: 7219243 - DNA, 20 bp, Homo sapiens
catatatacctagaagtgga

SEQ ID NO: 7219244 - DNA, 22 bp, Homo sapiens
catatattctggttttcactgg

SEQ ID NO: 7219245 - DNA, 22 bp, Homo sapiens
catatattctggttttcactgg

SEQ ID NO: 7219246 - DNA, 22 bp, Homo sapiens
catatattctggttttcactgg

SEQ ID NO: 7219247 - DNA, 22 bp, Homo sapiens
catatatctacctgcaattgca

SEQ ID NO: 7219248 - DNA, 22 bp, Homo sapiens
catatatgtgcagaccacttga

SEQ ID NO: 7219249 - DNA, 22 bp, Homo sapiens
catatattatggactgcagaat

SEQ ID NO: 7219250 - DNA, 20 bp, Homo sapiens
catatatacctagaagtgga

SEQ ID NO: 7219251 - DNA, 22 bp, Homo sapiens
catatcatttgcttataaatct

SEQ ID NO: 7219252 - DNA, 22 bp, Homo sapiens
catatcatttgcttataaatct

SEQ ID NO: 7219253 - DNA, 22 bp, Homo sapiens
catatcatggcactgagggaat

SEQ ID NO: 7219254 - DNA, 22 bp, Homo sapiens
catatcatttgcttataaatct

SEQ ID NO: 7219255 - DNA, 22 bp, Homo sapiens
catatcataggtcttggataat

SEQ ID NO: 7219256 - DNA, 22 bp, Homo sapiens
catatattctggttttcactgg

SEQ ID NO: 7219257 - DNA, 22 bp, Homo sapiens
catatcttatggttttctaagt

SEQ ID NO: 7219258 - DNA, 22 bp, Homo sapiens
catatctcctccagcacaggcc

SEQ ID NO: 7219259 - DNA, 22 bp, Homo sapiens
catatcccattggccaggacat

SEQ ID NO: 7219260 - DNA, 22 bp, Homo sapiens
catatgaaatatgagttgaaca

SEQ ID NO: 7219261 - DNA, 22 bp, Homo sapiens
catatgaagatgtctttttgta

SEQ ID NO: 7219262 - DNA, 22 bp, Homo sapiens
catatgaagatgtctttttgta

SEQ ID NO: 7219263 - DNA, 22 bp, Homo sapiens
catatgaagttcaacagagatg

SEQ ID NO: 7219264 - DNA, 22 bp, Homo sapiens
catatgaagttcaacagagatg

SEQ ID NO: 7219265 - DNA, 22 bp, Homo sapiens
catatgaagttcaacagagatg

SEQ ID NO: 7219266 - DNA, 23 bp, Homo sapiens
catatgaattttagaggcagttt

SEQ ID NO: 7219267 - DNA, 23 bp, Homo sapiens
catatgaattttagaggcagttt

SEQ ID NO: 7219268 - DNA, 20 bp, Homo sapiens
catatggaaagatattgttc

SEQ ID NO: 7219269 - DNA, 23 bp, Homo sapiens
catatgaaagtagacactttcca

SEQ ID NO: 7219270 - DNA, 23 bp, Homo sapiens
catatgaaagtagacactttcca

SEQ ID NO: 7219271 - DNA, 23 bp, Homo sapiens
catatgaaagtagacactttcca

SEQ ID NO: 7219272 - DNA, 23 bp, Homo sapiens
catatgaaagtagacactttcca

SEQ ID NO: 7219273 - DNA, 22 bp, Homo sapiens
catatgaaatatgagttgaaca

SEQ ID NO: 7219274 - DNA, 22 bp, Homo sapiens
catatgaaatatgagttgaaca

SEQ ID NO: 7219275 - DNA, 22 bp, Homo sapiens
catatgaaatatgagttgaaca

SEQ ID NO: 7219276 - DNA, 21 bp, Homo sapiens
catatgaaagaagtatctgac

SEQ ID NO: 7219277 - DNA, 22 bp, Homo sapiens
catccaggcaccacaaccagct

SEQ ID NO: 7219278 - DNA, 23 bp, Homo sapiens
catccaggagctgagtctgactg

SEQ ID NO: 7219279 - DNA, 22 bp, Homo sapiens
catccagggcagccatggcctg

SEQ ID NO: 7219280 - DNA, 22 bp, Homo sapiens
catccagggcagccatggcctg

SEQ ID NO: 7219281 - DNA, 22 bp, Homo sapiens
catccagctcctgggggccacc

SEQ ID NO: 7219282 - DNA, 22 bp, Homo sapiens
catccagagtccaaggctgggc

SEQ ID NO: 7219283 - DNA, 22 bp, Homo sapiens
catccactagaatgacagagtt

SEQ ID NO: 7219284 - DNA, 22 bp, Homo sapiens
catccagaccgtgccatgctgc

SEQ ID NO: 7219285 - DNA, 22 bp, Homo sapiens
catccactagaatgacagagtt

SEQ ID NO: 7219286 - DNA, 22 bp, Homo sapiens
catccaccgcgtgcacctctac

SEQ ID NO: 7219287 - DNA, 22 bp, Homo sapiens
catcatcttgaatgactgtgat

SEQ ID NO: 7219288 - DNA, 22 bp, Homo sapiens
catcacatcagtgtgaacagtt

SEQ ID NO: 7219289 - DNA, 22 bp, Homo sapiens
catcacatcagtgtgaacagtt

SEQ ID NO: 7219290 - DNA, 22 bp, Homo sapiens
catcacatcagtgtgaacagtt

SEQ ID NO: 7219291 - DNA, 22 bp, Homo sapiens
catcacatctactataagtgat

SEQ ID NO: 7219292 - DNA, 22 bp, Homo sapiens
catcacatctactataagtgat

SEQ ID NO: 7219293 - DNA, 22 bp, Homo sapiens
catcacatgcctatcatgagct

SEQ ID NO: 7219294 - DNA, 22 bp, Homo sapiens
catcacatgcctatcatgagct

SEQ ID NO: 7219295 - DNA, 22 bp, Homo sapiens
catcacatgcctatcatgagct

SEQ ID NO: 7219296 - DNA, 19 bp, Homo sapiens
catcacatggtctgatgaa

SEQ ID NO: 7219297 - DNA, 19 bp, Homo sapiens
catcacatggtctgatgaa

SEQ ID NO: 7219298 - DNA, 22 bp, Homo sapiens
catcacatgtaggcagcatcac

SEQ ID NO: 7219299 - DNA, 22 bp, Homo sapiens
catcacatgtaggcagcatcac

SEQ ID NO: 7219300 - DNA, 22 bp, Homo sapiens
catcatctctggcccttgaagt

SEQ ID NO: 7219301 - DNA, 22 bp, Homo sapiens
catcatctggcttttagaaaaa

SEQ ID NO: 7219302 - DNA, 22 bp, Homo sapiens
catcacaggcattttgagtgtc

SEQ ID NO: 7219303 - DNA, 22 bp, Homo sapiens
catcacagggggctagaagtct

SEQ ID NO: 7219304 - DNA, 22 bp, Homo sapiens
catcacagggggctagaagtct

SEQ ID NO: 7219305 - DNA, 22 bp, Homo sapiens
catcacaggtcctgatgacatt

SEQ ID NO: 7219306 - DNA, 22 bp, Homo sapiens
catcacaggtcctgatgacatt

SEQ ID NO: 7219307 - DNA, 22 bp, Homo sapiens
catcacaggtcctgatgacatt

SEQ ID NO: 7219308 - DNA, 22 bp, Homo sapiens
catcacagtggctgtttattta

SEQ ID NO: 7219309 - DNA, 22 bp, Homo sapiens
catcacagtttgtcagaaatca

SEQ ID NO: 7219310 - DNA, 22 bp, Homo sapiens
catcacagtttgtcagaaatca

SEQ ID NO: 7219311 - DNA, 22 bp, Homo sapiens
catcacagtttgtcagaaatca

SEQ ID NO: 7219312 - DNA, 22 bp, Homo sapiens
catcacatcaaacctactctca

SEQ ID NO: 7219313 - DNA, 22 bp, Homo sapiens
tcagggccaggactaggatgag

SEQ ID NO: 7219314 - DNA, 22 bp, Homo sapiens
tcagggccacgcggaggtgacg

SEQ ID NO: 7219315 - DNA, 22 bp, Homo sapiens
tcagggccaggactaggatgag

SEQ ID NO: 7219316 - DNA, 22 bp, Homo sapiens
tcagggccatcttttgcctcaa

SEQ ID NO: 7219317 - DNA, 22 bp, Homo sapiens
tcagggccatcttttgcctcaa

SEQ ID NO: 7219318 - DNA, 22 bp, Homo sapiens
tcagggccatcttttgcctcaa

SEQ ID NO: 7219319 - DNA, 22 bp, Homo sapiens
tcagggccatcttttgcctcaa

SEQ ID NO: 7219320 - DNA, 19 bp, Homo sapiens
tcagggccatgagcgccac

SEQ ID NO: 7219321 - DNA, 22 bp, Homo sapiens
tcagggcccagagctcaggcaa

SEQ ID NO: 7219322 - DNA, 22 bp, Homo sapiens
tcagggcccagtctgtgcatct

SEQ ID NO: 7219323 - DNA, 22 bp, Homo sapiens
tcagggccctcacttgcatagg

SEQ ID NO: 7219324 - DNA, 22 bp, Homo sapiens
catcacagaaataaacatacct

SEQ ID NO: 7219325 - DNA, 22 bp, Homo sapiens
catcacagaaataaacatacct

SEQ ID NO: 7219326 - DNA, 22 bp, Homo sapiens
catcacagatgttgtgtggagt

SEQ ID NO: 7219327 - DNA, 21 bp, Homo sapiens
catcacaggatgattttttca

SEQ ID NO: 7219328 - DNA, 22 bp, Homo sapiens
catatggacaagaacatttatg

SEQ ID NO: 7219329 - DNA, 22 bp, Homo sapiens
catatgtatttctcataattag

SEQ ID NO: 7219330 - DNA, 22 bp, Homo sapiens
catatgtatttctcataattag

SEQ ID NO: 7219331 - DNA, 22 bp, Homo sapiens
catatgtatttctcataattag

SEQ ID NO: 7219332 - DNA, 22 bp, Homo sapiens
tcagggattgcaaaattcatcc

SEQ ID NO: 7219333 - DNA, 22 bp, Homo sapiens
tcagggattgcaaaattcatcc

SEQ ID NO: 7219334 - DNA, 22 bp, Homo sapiens
tcagggcatggctgcacttggc

SEQ ID NO: 7219335 - DNA, 22 bp, Homo sapiens
tcagggcatggctgcacttggc

SEQ ID NO: 7219336 - DNA, 20 bp, Homo sapiens
tcagggcatgggacagcccc

SEQ ID NO: 7219337 - DNA, 20 bp, Homo sapiens
tcagggcatgggacagcccc

SEQ ID NO: 7219338 - DNA, 20 bp, Homo sapiens
tcagggcatgggacagcccc

SEQ ID NO: 7219339 - DNA, 22 bp, Homo sapiens
tcagggcatgtatgtttcttta

SEQ ID NO: 7219340 - DNA, 22 bp, Homo sapiens
tcagggcatgtatgtttcttta

SEQ ID NO: 7219341 - DNA, 22 bp, Homo sapiens
tcagggcattcaagaggcctgg

SEQ ID NO: 7219342 - DNA, 22 bp, Homo sapiens
tcagggcattcaagaggcctgg

SEQ ID NO: 7219343 - DNA, 22 bp, Homo sapiens
tcagggcattcaagaggcctgg

SEQ ID NO: 7219344 - DNA, 22 bp, Homo sapiens
tcagggccacaacaccagagtc

SEQ ID NO: 7219345 - DNA, 22 bp, Homo sapiens
tcagggccacaacaccagagtc

SEQ ID NO: 7219346 - DNA, 22 bp, Homo sapiens
tcagaaggtttttagcaaagga

SEQ ID NO: 7219347 - DNA, 22 bp, Homo sapiens
tcagaaggtggaggttgcagtg

SEQ ID NO: 7219348 - DNA, 22 bp, Homo sapiens
tcagaaggtactgaagacatgg

SEQ ID NO: 7219349 - DNA, 22 bp, Homo sapiens
tcagaaggtttttagcaaagga

SEQ ID NO: 7219350 - DNA, 22 bp, Homo sapiens
tcagaagtactgtgctacaata

SEQ ID NO: 7219351 - DNA, 22 bp, Homo sapiens
tcagaaggtactgaagacatgg

SEQ ID NO: 7219352 - DNA, 22 bp, Homo sapiens
tcagaaggtacagaagggaggt

SEQ ID NO: 7219353 - DNA, 22 bp, Homo sapiens
tcagaaggtactgaagacatgg

SEQ ID NO: 7219354 - DNA, 22 bp, Homo sapiens
tcagaagggaaacacaagtgac

SEQ ID NO: 7219355 - DNA, 22 bp, Homo sapiens
tcagaaggctttataccagtat

SEQ ID NO: 7219356 - DNA, 20 bp, Homo sapiens
tcagaaggctccagagcaga

SEQ ID NO: 7219357 - DNA, 20 bp, Homo sapiens
tcagaaggctccagagcaga

SEQ ID NO: 7219358 - DNA, 22 bp, Homo sapiens
tcagaagtcacttaggaaaggg

SEQ ID NO: 7219359 - DNA, 22 bp, Homo sapiens
tcagaagtcatgctcagtctgt

SEQ ID NO: 7219360 - DNA, 22 bp, Homo sapiens
tcagaagtcccagaattcacat

SEQ ID NO: 7219361 - DNA, 22 bp, Homo sapiens
tcagaagtctggactgcttctc

SEQ ID NO: 7219362 - DNA, 22 bp, Homo sapiens
cagtttatatgagggtatcaag

SEQ ID NO: 7219363 - DNA, 22 bp, Homo sapiens
cagtttatatgtcagagctgta

SEQ ID NO: 7219364 - DNA, 22 bp, Homo sapiens
cagtttatatgagggtatcaag

SEQ ID NO: 7219365 - DNA, 22 bp, Homo sapiens
cagtttctctcatacatatttg

SEQ ID NO: 7219366 - DNA, 22 bp, Homo sapiens
cagtttctgaggttccaggttt

SEQ ID NO: 7219367 - DNA, 22 bp, Homo sapiens
cagtttctgaggttccaggttt

SEQ ID NO: 7219368 - DNA, 22 bp, Homo sapiens
cagtttctgggcgttcacaggt

SEQ ID NO: 7219369 - DNA, 22 bp, Homo sapiens
cagtttctgggcgttcacaggt

SEQ ID NO: 7219370 - DNA, 22 bp, Homo sapiens
cagtttctgggcgttcacaggt

SEQ ID NO: 7219371 - DNA, 22 bp, Homo sapiens
cagtttctgccaggatgtgtta

SEQ ID NO: 7219372 - DNA, 22 bp, Homo sapiens
cagtttctgccaggatgtgtta

SEQ ID NO: 7219373 - DNA, 22 bp, Homo sapiens
cagtttcttggatgccaatttc

SEQ ID NO: 7219374 - DNA, 22 bp, Homo sapiens
cagtttcttctattttgaacta

SEQ ID NO: 7219375 - DNA, 22 bp, Homo sapiens
cagtttctttccattgttacct

SEQ ID NO: 7219376 - DNA, 22 bp, Homo sapiens
tcagcagtgagaattaatgttg

SEQ ID NO: 7219377 - DNA, 22 bp, Homo sapiens
tcagcagtggctctcatgcagt

SEQ ID NO: 7219378 - DNA, 22 bp, Homo sapiens
tcagcccaggaatgagccttct

SEQ ID NO: 7219379 - DNA, 22 bp, Homo sapiens
tcagcccaggaggttgagacta

SEQ ID NO: 7219380 - DNA, 19 bp, Homo sapiens
tcagcccaggctgggaagc

SEQ ID NO: 7219381 - DNA, 19 bp, Homo sapiens
tcagcccaggctgggaagc

SEQ ID NO: 7219382 - DNA, 22 bp, Homo sapiens
tcagcccagggacagaggcccc

SEQ ID NO: 7219383 - DNA, 22 bp, Homo sapiens
tcagcccagggacagaggcccc

SEQ ID NO: 7219384 - DNA, 20 bp, Homo sapiens
tcagcccagggtgagcatct

SEQ ID NO: 7219385 - DNA, 20 bp, Homo sapiens
tcagcccagggtgagcatct

SEQ ID NO: 7219386 - DNA, 22 bp, Homo sapiens
tcagcccaggtcacgtaatcaa

SEQ ID NO: 7219387 - DNA, 22 bp, Homo sapiens
cagtttcttagtgacacaaatc

SEQ ID NO: 7219388 - DNA, 22 bp, Homo sapiens
cagtttcttagtgacacaaatc

SEQ ID NO: 7219389 - DNA, 22 bp, Homo sapiens
cagtttcttcatcagttaagca

SEQ ID NO: 7219390 - DNA, 22 bp, Homo sapiens
cagtttcttcatcagttaagca

SEQ ID NO: 7219391 - DNA, 22 bp, Homo sapiens
cagtttcttcaattcagacact

SEQ ID NO: 7219392 - DNA, 22 bp, Homo sapiens
cagtttcttcaattcagacact

SEQ ID NO: 7219393 - DNA, 22 bp, Homo sapiens
cagtttcttcaattcagacact

SEQ ID NO: 7219394 - DNA, 22 bp, Homo sapiens
cagtttcttcaattcagacact

SEQ ID NO: 7219395 - DNA, 19 bp, Homo sapiens
tcagcccatcagactcaca

SEQ ID NO: 7219396 - DNA, 22 bp, Homo sapiens
tcagcccatcactcacgtatta

SEQ ID NO: 7219397 - DNA, 22 bp, Homo sapiens
tcagccctacattaggtaagcc

SEQ ID NO: 7219398 - DNA, 22 bp, Homo sapiens
tcagccctagaaagtctaagca

SEQ ID NO: 7219399 - DNA, 21 bp, Homo sapiens
tcagcccaggtgtctttgccc

SEQ ID NO: 7219400 - DNA, 22 bp, Homo sapiens
tcagcccagttaagaacctgtt

SEQ ID NO: 7219401 - DNA, 22 bp, Homo sapiens
tcagcccagttaagaacctgtt

SEQ ID NO: 7219402 - DNA, 22 bp, Homo sapiens
tcagcccagttttatcatctgt

SEQ ID NO: 7219403 - DNA, 22 bp, Homo sapiens
tcagccctagcctcagtccagg

SEQ ID NO: 7219404 - DNA, 22 bp, Homo sapiens
tcagccctagcctcagtccagg

SEQ ID NO: 7219405 - DNA, 22 bp, Homo sapiens
tcagccctgaggacagaggcag

SEQ ID NO: 7219406 - DNA, 22 bp, Homo sapiens
tcagccctgaggacagaggcag

SEQ ID NO: 7219407 - DNA, 22 bp, Homo sapiens
tcagccctgaggacagaggcag

SEQ ID NO: 7219408 - DNA, 20 bp, Homo sapiens
tcagccctgagtccaggctg

SEQ ID NO: 7219409 - DNA, 20 bp, Homo sapiens
tcagccctgagtccaggctg

SEQ ID NO: 7219410 - DNA, 22 bp, Homo sapiens
tcagccctggcactgtctccca

SEQ ID NO: 7219411 - DNA, 22 bp, Homo sapiens
tcagccctggcactgtctccca

SEQ ID NO: 7219412 - DNA, 22 bp, Homo sapiens
tcagccctgggacccagggatg

SEQ ID NO: 7219413 - DNA, 22 bp, Homo sapiens
tcagccctgggcttcctcatgg

SEQ ID NO: 7219414 - DNA, 22 bp, Homo sapiens
tcagccctgggcttcctcatgg

SEQ ID NO: 7219415 - DNA, 22 bp, Homo sapiens
tcagccctgggcttcctcatgg

SEQ ID NO: 7219416 - DNA, 22 bp, Homo sapiens
tcagcccttcctggagctttta

SEQ ID NO: 7219417 - DNA, 22 bp, Homo sapiens
tcagctctggttcatgtggtct

SEQ ID NO: 7219418 - DNA, 22 bp, Homo sapiens
tcagctctggttcatgtggtct

SEQ ID NO: 7219419 - DNA, 20 bp, Homo sapiens
tcagctctgtgcctgggatg

SEQ ID NO: 7219420 - DNA, 20 bp, Homo sapiens
tcagctctgtgcctgggatg

SEQ ID NO: 7219421 - DNA, 22 bp, Homo sapiens
tcagctctgttttgagtggaac

SEQ ID NO: 7219422 - DNA, 22 bp, Homo sapiens
tcagctctgttttgagtggaac

SEQ ID NO: 7219423 - DNA, 22 bp, Homo sapiens
tcagctctgttttgagtggaac

SEQ ID NO: 7219424 - DNA, 22 bp, Homo sapiens
tcagctcttaaccctctggcct

SEQ ID NO: 7219425 - DNA, 20 bp, Homo sapiens
tcagctctgtgcctgggatg

SEQ ID NO: 7219426 - DNA, 22 bp, Homo sapiens
tcagctctgtgtacagttagca

SEQ ID NO: 7219427 - DNA, 22 bp, Homo sapiens
tcagctgcactgttctgaccca

SEQ ID NO: 7219428 - DNA, 22 bp, Homo sapiens
tcagctgagctccagctcatag

SEQ ID NO: 7219429 - DNA, 22 bp, Homo sapiens
tcagctgagctccagctcatag

SEQ ID NO: 7219430 - DNA, 22 bp, Homo sapiens
tcagctgagttctagagcactc

SEQ ID NO: 7219431 - DNA, 22 bp, Homo sapiens
tcagctgaagtggagaagcaga

SEQ ID NO: 7219432 - DNA, 22 bp, Homo sapiens
tcagctcttaaccctctggcct

SEQ ID NO: 7219433 - DNA, 20 bp, Homo sapiens
tcagctcttagaggtcgctt

SEQ ID NO: 7219434 - DNA, 22 bp, Homo sapiens
tcagctcttccccccagccagg

SEQ ID NO: 7219435 - DNA, 20 bp, Homo sapiens
tcagctcttagaggtcgctt

SEQ ID NO: 7219436 - DNA, 20 bp, Homo sapiens
tcagctcttagaggtcgctt

SEQ ID NO: 7219437 - DNA, 22 bp, Homo sapiens
catacatttatacacatctatg

SEQ ID NO: 7219438 - DNA, 22 bp, Homo sapiens
catacatttatacacatctatg

SEQ ID NO: 7219439 - DNA, 22 bp, Homo sapiens
catacatttatacacatctatg

SEQ ID NO: 7219440 - DNA, 22 bp, Homo sapiens
catacattttgcatatttacca

SEQ ID NO: 7219441 - DNA, 22 bp, Homo sapiens
catacattgctcattcagtatc

SEQ ID NO: 7219442 - DNA, 22 bp, Homo sapiens
catacattgctcattcagtatc

SEQ ID NO: 7219443 - DNA, 22 bp, Homo sapiens
catacattgaatttgcacgtgt

SEQ ID NO: 7219444 - DNA, 22 bp, Homo sapiens
catacattacctaacttaatgc

SEQ ID NO: 7219445 - DNA, 22 bp, Homo sapiens
cataatttttttaagtcagaac

SEQ ID NO: 7219446 - DNA, 22 bp, Homo sapiens
cataatttttttaagtcagaac

SEQ ID NO: 7219447 - DNA, 22 bp, Homo sapiens
cataatttttttaagtcagaac

SEQ ID NO: 7219448 - DNA, 22 bp, Homo sapiens
tcagctgcataagtcaccttgc

SEQ ID NO: 7219449 - DNA, 22 bp, Homo sapiens
cataatttttttaagtcagaac

SEQ ID NO: 7219450 - DNA, 22 bp, Homo sapiens
cataatttttttaagtcagaac

SEQ ID NO: 7219451 - DNA, 22 bp, Homo sapiens
cataatttttttaagtcagaac

SEQ ID NO: 7219452 - DNA, 22 bp, Homo sapiens
cataatttttttaagtcagaac

SEQ ID NO: 7219453 - DNA, 22 bp, Homo sapiens
cataatttttttaagtcagaac

SEQ ID NO: 7219454 - DNA, 22 bp, Homo sapiens
catacattacctaacttaatgc

SEQ ID NO: 7219455 - DNA, 22 bp, Homo sapiens
tcagctgcactgttctgaccca

SEQ ID NO: 7219456 - DNA, 22 bp, Homo sapiens
tcagctgcagcaggcaccattt

SEQ ID NO: 7219457 - DNA, 22 bp, Homo sapiens
tcagctgcagcaggcaccattt

SEQ ID NO: 7219458 - DNA, 22 bp, Homo sapiens
tcagctgcagtttcacaagcac

SEQ ID NO: 7219459 - DNA, 22 bp, Homo sapiens
tcagctgcagtttcacaagcac

SEQ ID NO: 7219460 - DNA, 22 bp, Homo sapiens
tcagctgcataacaaagtatga

SEQ ID NO: 7219461 - DNA, 22 bp, Homo sapiens
catactgtcagagcctgaaggg

SEQ ID NO: 7219462 - DNA, 22 bp, Homo sapiens
catactattactaggagcagga

SEQ ID NO: 7219463 - DNA, 22 bp, Homo sapiens
catactgtaagtgcaaaagtgt

SEQ ID NO: 7219464 - DNA, 22 bp, Homo sapiens
catacattttgcatatttacca

SEQ ID NO: 7219465 - DNA, 22 bp, Homo sapiens
catacattttgcatatttacca

SEQ ID NO: 7219466 - DNA, 22 bp, Homo sapiens
catagaaaagagtaggtaatgt

SEQ ID NO: 7219467 - DNA, 22 bp, Homo sapiens
catagaaaagagtaggtaatgt

SEQ ID NO: 7219468 - DNA, 22 bp, Homo sapiens
catagaaaagagtaggtaatgt

SEQ ID NO: 7219469 - DNA, 22 bp, Homo sapiens
tatggctaattctttactgacc

SEQ ID NO: 7219470 - DNA, 22 bp, Homo sapiens
tatggctaattctttactgacc

SEQ ID NO: 7219471 - DNA, 22 bp, Homo sapiens
tatggccatgatggccaattgg

SEQ ID NO: 7219472 - DNA, 22 bp, Homo sapiens
tatggctaattctttactgacc

SEQ ID NO: 7219473 - DNA, 22 bp, Homo sapiens
tatggctactacgaataatgct

SEQ ID NO: 7219474 - DNA, 23 bp, Homo sapiens
tatggcttacagtgctttaggta

SEQ ID NO: 7219475 - DNA, 23 bp, Homo sapiens
tatggcttacagtgctttaggta

SEQ ID NO: 7219476 - DNA, 22 bp, Homo sapiens
tatggcttctcagtcatgaaaa

SEQ ID NO: 7219477 - DNA, 22 bp, Homo sapiens
tatggcttctgctttcttgact

SEQ ID NO: 7219478 - DNA, 22 bp, Homo sapiens
caggtctggtgagagaacagtt

SEQ ID NO: 7219479 - DNA, 22 bp, Homo sapiens
caggtctggtgagagaacagtt

SEQ ID NO: 7219480 - DNA, 22 bp, Homo sapiens
caggtgaagaggataaaaagtt

SEQ ID NO: 7219481 - DNA, 22 bp, Homo sapiens
tatgtacatgttaaagggcaaa

SEQ ID NO: 7219482 - DNA, 22 bp, Homo sapiens
tatgtaccggatgccatacaaa

SEQ ID NO: 7219483 - DNA, 22 bp, Homo sapiens
caggtctttgttgcagcatgga

SEQ ID NO: 7219484 - DNA, 22 bp, Homo sapiens
caggtgaaaaagcaaccatatt

SEQ ID NO: 7219485 - DNA, 22 bp, Homo sapiens
caggtgaaaaagcaaccatatt

SEQ ID NO: 7219486 - DNA, 22 bp, Homo sapiens
caggtgaacccagtctaatcat

SEQ ID NO: 7219487 - DNA, 22 bp, Homo sapiens
caggtgaactcagttttgtatt

SEQ ID NO: 7219488 - DNA, 22 bp, Homo sapiens
caggtgaaaaagcaaccatatt

SEQ ID NO: 7219489 - DNA, 22 bp, Homo sapiens
caggtcttttctactggtggag

SEQ ID NO: 7219490 - DNA, 20 bp, Homo sapiens
caggtcttcatgtggctgtc

SEQ ID NO: 7219491 - DNA, 20 bp, Homo sapiens
caggtcttcatgtggctgtc

SEQ ID NO: 7219492 - DNA, 19 bp, Homo sapiens
caggtcttcttggaggact

SEQ ID NO: 7219493 - DNA, 22 bp, Homo sapiens
caggtctgtttccatcagtgct

SEQ ID NO: 7219494 - DNA, 22 bp, Homo sapiens
caggtctgtttccatcagtgct

SEQ ID NO: 7219495 - DNA, 22 bp, Homo sapiens
caggtctgtttccatcagtgct

SEQ ID NO: 7219496 - DNA, 22 bp, Homo sapiens
caggtctgtttccatcagtgct

SEQ ID NO: 7219497 - DNA, 22 bp, Homo sapiens
caggtctgttttcaaggtcagt

SEQ ID NO: 7219498 - DNA, 22 bp, Homo sapiens
caggtctgtattaacagagggt

SEQ ID NO: 7219499 - DNA, 22 bp, Homo sapiens
caggtctgtattaacagagggt

SEQ ID NO: 7219500 - DNA, 22 bp, Homo sapiens
caggtctgtattaacagagggt

SEQ ID NO: 7219501 - DNA, 22 bp, Homo sapiens
tatctcttgcatgctttttaga

SEQ ID NO: 7219502 - DNA, 17 bp, Homo sapiens
tatctcttcaagtttca

SEQ ID NO: 7219503 - DNA, 22 bp, Homo sapiens
tatctctaggctgccacttaaa

SEQ ID NO: 7219504 - DNA, 22 bp, Homo sapiens
tatctctagcgcacagaagaaa

SEQ ID NO: 7219505 - DNA, 17 bp, Homo sapiens
tatctctgcttcatggt

SEQ ID NO: 7219506 - DNA, 22 bp, Homo sapiens
tatctccatctggagagcaaaa

SEQ ID NO: 7219507 - DNA, 23 bp, Homo sapiens
tatctcagaggaatgtagttact

SEQ ID NO: 7219508 - DNA, 17 bp, Homo sapiens
tatctcatacaattata

SEQ ID NO: 7219509 - DNA, 17 bp, Homo sapiens
tatctcatacaattata

SEQ ID NO: 7219510 - DNA, 22 bp, Homo sapiens
tatctcttgtctgttttgcaaa

SEQ ID NO: 7219511 - DNA, 22 bp, Homo sapiens
tatctctttattgacaataaaa

SEQ ID NO: 7219512 - DNA, 22 bp, Homo sapiens
tatctctttcattttagagtca

SEQ ID NO: 7219513 - DNA, 22 bp, Homo sapiens
tatctgattaatcagtgctttg

SEQ ID NO: 7219514 - DNA, 22 bp, Homo sapiens
tatctgggaaggggagaataga

SEQ ID NO: 7219515 - DNA, 22 bp, Homo sapiens
tatctggttcctttgaggagat

SEQ ID NO: 7219516 - DNA, 22 bp, Homo sapiens
tatgcacacattagcacagggt

SEQ ID NO: 7219517 - DNA, 22 bp, Homo sapiens
tatgcacagaagtttgctgaat

SEQ ID NO: 7219518 - DNA, 22 bp, Homo sapiens
tatggactattgtatgacagag

SEQ ID NO: 7219519 - DNA, 22 bp, Homo sapiens
tatggagattcaaaagcatctt

SEQ ID NO: 7219520 - DNA, 22 bp, Homo sapiens
tatggagattcaaaagcatctt

SEQ ID NO: 7219521 - DNA, 22 bp, Homo sapiens
tatggcaagagaatcaactgaa

SEQ ID NO: 7219522 - DNA, 22 bp, Homo sapiens
tatggcaagatgacatgttctc

SEQ ID NO: 7219523 - DNA, 22 bp, Homo sapiens
tatggcaagatgacatgttctc

SEQ ID NO: 7219524 - DNA, 22 bp, Homo sapiens
tatggcagaggagaggcactag

SEQ ID NO: 7219525 - DNA, 22 bp, Homo sapiens
tatggcagaggagaggcactag

SEQ ID NO: 7219526 - DNA, 22 bp, Homo sapiens
tatggcagaggagaggcactag

SEQ ID NO: 7219527 - DNA, 19 bp, Homo sapiens
tatggcaggccgaggcact

SEQ ID NO: 7219528 - DNA, 22 bp, Homo sapiens
tatggcagttacccttgatgat

SEQ ID NO: 7219529 - DNA, 22 bp, Homo sapiens
tatgtttttaagagaatgcatt

SEQ ID NO: 7219530 - DNA, 22 bp, Homo sapiens
tatgtttttaagagaatgcatt

SEQ ID NO: 7219531 - DNA, 22 bp, Homo sapiens
tatgtttttcaagtgcacacta

SEQ ID NO: 7219532 - DNA, 22 bp, Homo sapiens
tatgttttaggaattaattgtt

SEQ ID NO: 7219533 - DNA, 22 bp, Homo sapiens
tatgttttaggaattaattgtt

SEQ ID NO: 7219534 - DNA, 22 bp, Homo sapiens
tatgtttttaagagaatgcatt

SEQ ID NO: 7219535 - DNA, 22 bp, Homo sapiens
tatgttttaggaattaattgtt

SEQ ID NO: 7219536 - DNA, 22 bp, Homo sapiens
tatgttttaggaattaattgtt

SEQ ID NO: 7219537 - DNA, 22 bp, Homo sapiens
tatgttttaggaattaattgtt

SEQ ID NO: 7219538 - DNA, 22 bp, Homo sapiens
tatgttttaggaattaattgtt

SEQ ID NO: 7219539 - DNA, 22 bp, Homo sapiens
tatgttttaggaattaattgtt

SEQ ID NO: 7219540 - DNA, 22 bp, Homo sapiens
tatgtgtatgtacatacataca

SEQ ID NO: 7219541 - DNA, 22 bp, Homo sapiens
tatgtgtcaaaccattcatctg

SEQ ID NO: 7219542 - DNA, 22 bp, Homo sapiens
tatgtgtccctgctactcaaca

SEQ ID NO: 7219543 - DNA, 22 bp, Homo sapiens
tatgtgtcaaaccattcatctg

SEQ ID NO: 7219544 - DNA, 22 bp, Homo sapiens
tatgtgtccctgctactcaaca

SEQ ID NO: 7219545 - DNA, 22 bp, Homo sapiens
tatgtgtcccttggtgtagcaa

SEQ ID NO: 7219546 - DNA, 22 bp, Homo sapiens
tatgtgtcccttggtgtagcaa

SEQ ID NO: 7219547 - DNA, 22 bp, Homo sapiens
tatgtgtcctaagcaatcatcc

SEQ ID NO: 7219548 - DNA, 22 bp, Homo sapiens
tatgtactaactttcattctag

SEQ ID NO: 7219549 - DNA, 23 bp, Homo sapiens
tatgtgcatatgtgtaagaatac

SEQ ID NO: 7219550 - DNA, 23 bp, Homo sapiens
tatgtgcatatgtgtaagaatac

SEQ ID NO: 7219551 - DNA, 18 bp, Homo sapiens
tatgtgcatatgtgtgta

SEQ ID NO: 7219552 - DNA, 22 bp, Homo sapiens
tatgtgtaatcaaacacatgct

SEQ ID NO: 7219553 - DNA, 22 bp, Homo sapiens
tatgtgtactcgttaaatattt

SEQ ID NO: 7219554 - DNA, 22 bp, Homo sapiens
tattcctcctttctgctcagcc

SEQ ID NO: 7219555 - DNA, 22 bp, Homo sapiens
tattaaatatatctgttagttg

SEQ ID NO: 7219556 - DNA, 22 bp, Homo sapiens
tattaaatatatctgttagttg

SEQ ID NO: 7219557 - DNA, 22 bp, Homo sapiens
tattaaatatatctgttagttg

SEQ ID NO: 7219558 - DNA, 22 bp, Homo sapiens
tatgtttttcagacgtcctaca

SEQ ID NO: 7219559 - DNA, 22 bp, Homo sapiens
tatgtttttcagacgtcctaca

SEQ ID NO: 7219560 - DNA, 22 bp, Homo sapiens
tattaaagagagaatcatcatc

SEQ ID NO: 7219561 - DNA, 22 bp, Homo sapiens
tatgtttttcaagtgcacacta

SEQ ID NO: 7219562 - DNA, 22 bp, Homo sapiens
tatgtttttcaagtgcacacta

SEQ ID NO: 7219563 - DNA, 22 bp, Homo sapiens
tatgtttttcaagtgcacacta

SEQ ID NO: 7219564 - DNA, 22 bp, Homo sapiens
tattaaagagagaatcatcatc

SEQ ID NO: 7219565 - DNA, 22 bp, Homo sapiens
tattaaagggaagttatgcatg

SEQ ID NO: 7219566 - DNA, 22 bp, Homo sapiens
tattaaagggaagttatgcatg

SEQ ID NO: 7219567 - DNA, 20 bp, Homo sapiens
tattgccttaatggagctta

SEQ ID NO: 7219568 - DNA, 22 bp, Homo sapiens
tattgctgactgtcttctgagt

SEQ ID NO: 7219569 - DNA, 22 bp, Homo sapiens
tattgccaaatgtctgctggaa

SEQ ID NO: 7219570 - DNA, 22 bp, Homo sapiens
tattgctgaggattgaggcttg

SEQ ID NO: 7219571 - DNA, 22 bp, Homo sapiens
tattgctggaaaatggtgtgat

SEQ ID NO: 7219572 - DNA, 22 bp, Homo sapiens
tattggaaggcattagtgaata

SEQ ID NO: 7219573 - DNA, 22 bp, Homo sapiens
tattgctttctcagacgtttag

SEQ ID NO: 7219574 - DNA, 22 bp, Homo sapiens
tattgcttttatttctatggac

SEQ ID NO: 7219575 - DNA, 22 bp, Homo sapiens
caggggcaggtgtgagatcatc

SEQ ID NO: 7219576 - DNA, 22 bp, Homo sapiens
caggggcaggtgtgagatcatc

SEQ ID NO: 7219577 - DNA, 22 bp, Homo sapiens
caggggcaggtgtgagatcatc

SEQ ID NO: 7219578 - DNA, 22 bp, Homo sapiens
caggggcaggtgtgagatcatc

SEQ ID NO: 7219579 - DNA, 22 bp, Homo sapiens
caggggccaagggtccagacct

SEQ ID NO: 7219580 - DNA, 22 bp, Homo sapiens
caggggccaagggtccagacct

SEQ ID NO: 7219581 - DNA, 22 bp, Homo sapiens
caggggcagtctgtgtgcgtgg

SEQ ID NO: 7219582 - DNA, 22 bp, Homo sapiens
caggggcagtctgtgtgcgtgg

SEQ ID NO: 7219583 - DNA, 22 bp, Homo sapiens
caggggccaagggtccagacct

SEQ ID NO: 7219584 - DNA, 22 bp, Homo sapiens
caggggccaagggtccagacct

SEQ ID NO: 7219585 - DNA, 22 bp, Homo sapiens
caggggcagtctgtgtgcgtgg

SEQ ID NO: 7219586 - DNA, 22 bp, Homo sapiens
caggggcctggctgtctaggaa

SEQ ID NO: 7219587 - DNA, 22 bp, Homo sapiens
caggggccggctgtccgtgccc

SEQ ID NO: 7219588 - DNA, 22 bp, Homo sapiens
caggggccggctgtccgtgccc

SEQ ID NO: 7219589 - DNA, 22 bp, Homo sapiens
caggggccaggctgtctgctgt

SEQ ID NO: 7219590 - DNA, 22 bp, Homo sapiens
caggggccggctgtccgtgccc

SEQ ID NO: 7219591 - DNA, 22 bp, Homo sapiens
caggggccggctgtccgtgccc

SEQ ID NO: 7219592 - DNA, 22 bp, Homo sapiens
caggggccggctgtccgtgccc

SEQ ID NO: 7219593 - DNA, 22 bp, Homo sapiens
caggggccaagggtccagacct

SEQ ID NO: 7219594 - DNA, 22 bp, Homo sapiens
caggggccaggctgtctgctgt

SEQ ID NO: 7219595 - DNA, 22 bp, Homo sapiens
cagggtggaagctgtagagtgg

SEQ ID NO: 7219596 - DNA, 22 bp, Homo sapiens
cagggtggaagctgtagagtgg

SEQ ID NO: 7219597 - DNA, 22 bp, Homo sapiens
cagggtggaacaggcaatactt

SEQ ID NO: 7219598 - DNA, 22 bp, Homo sapiens
cagggtggaacaggcaatactt

SEQ ID NO: 7219599 - DNA, 22 bp, Homo sapiens
cagggtggaagctgtagagtgg

SEQ ID NO: 7219600 - DNA, 22 bp, Homo sapiens
cagggtggaagctgtagagtgg

SEQ ID NO: 7219601 - DNA, 22 bp, Homo sapiens
cagggtgcttccgtggagctgt

SEQ ID NO: 7219602 - DNA, 22 bp, Homo sapiens
cagggtggaaaagctagttgga

SEQ ID NO: 7219603 - DNA, 22 bp, Homo sapiens
cagggtggaaaagctagttgga

SEQ ID NO: 7219604 - DNA, 22 bp, Homo sapiens
cagggtggaaaagctagttgga

SEQ ID NO: 7219605 - DNA, 22 bp, Homo sapiens
cagggtggaacaggcaatactt

SEQ ID NO: 7219606 - DNA, 22 bp, Homo sapiens
caggggcctggctgtctaggaa

SEQ ID NO: 7219607 - DNA, 22 bp, Homo sapiens
caggggcctggctgtctaggaa

SEQ ID NO: 7219608 - DNA, 22 bp, Homo sapiens
caggggcctggctgtctaggaa

SEQ ID NO: 7219609 - DNA, 22 bp, Homo sapiens
caggggcctggctgtctaggaa

SEQ ID NO: 7219610 - DNA, 22 bp, Homo sapiens
caggggcctggctgtctaggaa

SEQ ID NO: 7219611 - DNA, 22 bp, Homo sapiens
caggggcctggctgtctaggaa

SEQ ID NO: 7219612 - DNA, 22 bp, Homo sapiens
caggggcctggctgtctaggaa

SEQ ID NO: 7219613 - DNA, 22 bp, Homo sapiens
caggggcctgtcctggcttctg

SEQ ID NO: 7219614 - DNA, 22 bp, Homo sapiens
cagggtctgctacacttggcaa

SEQ ID NO: 7219615 - DNA, 22 bp, Homo sapiens
cagggtcttataaggccaattt

SEQ ID NO: 7219616 - DNA, 22 bp, Homo sapiens
cagggtcttggcgccatcaccc

SEQ ID NO: 7219617 - DNA, 22 bp, Homo sapiens
cagggtcttggcgccatcaccc

SEQ ID NO: 7219618 - DNA, 17 bp, Homo sapiens
tacatgtgtatctgatt

SEQ ID NO: 7219619 - DNA, 22 bp, Homo sapiens
tacatgtggtagggagggcagt

SEQ ID NO: 7219620 - DNA, 22 bp, Homo sapiens
tacatgtgggttaaaaacactc

SEQ ID NO: 7219621 - DNA, 22 bp, Homo sapiens
tagttttagtcccattttacag

SEQ ID NO: 7219622 - DNA, 22 bp, Homo sapiens
tacatgtgttctgtttcaagtt

SEQ ID NO: 7219623 - DNA, 22 bp, Homo sapiens
tacatgttatttcactattggt

SEQ ID NO: 7219624 - DNA, 22 bp, Homo sapiens
tacatgttatttcactattggt

SEQ ID NO: 7219625 - DNA, 22 bp, Homo sapiens
tagttttataatgttaacatct

SEQ ID NO: 7219626 - DNA, 22 bp, Homo sapiens
tataagaaacaaggcaaatttt

SEQ ID NO: 7219627 - DNA, 22 bp, Homo sapiens
tagttttagtcccattttacag

SEQ ID NO: 7219628 - DNA, 22 bp, Homo sapiens
tataagaaattgccaacctgtt

SEQ ID NO: 7219629 - DNA, 22 bp, Homo sapiens
tataagaagtgaagaagagtta

SEQ ID NO: 7219630 - DNA, 22 bp, Homo sapiens
tataagaagtgaagaagagtta

SEQ ID NO: 7219631 - DNA, 22 bp, Homo sapiens
tataagaagtgaagaagagtta

SEQ ID NO: 7219632 - DNA, 22 bp, Homo sapiens
tataagatacttggcatagtgc

SEQ ID NO: 7219633 - DNA, 22 bp, Homo sapiens
tataagatacttggcatagtgc

SEQ ID NO: 7219634 - DNA, 22 bp, Homo sapiens
tataagtagttgttgaagactt

SEQ ID NO: 7219635 - DNA, 22 bp, Homo sapiens
tataagtgacagattatccaaa

SEQ ID NO: 7219636 - DNA, 22 bp, Homo sapiens
tataatatgaggcaggagtgat

SEQ ID NO: 7219637 - DNA, 22 bp, Homo sapiens
tataagtgtagtttcaaatgtt

SEQ ID NO: 7219638 - DNA, 22 bp, Homo sapiens
tataatatgaggcaggagtgat

SEQ ID NO: 7219639 - DNA, 22 bp, Homo sapiens
tataatattccttgttgtaggt

SEQ ID NO: 7219640 - DNA, 22 bp, Homo sapiens
tataatccattcattgatttct

SEQ ID NO: 7219641 - DNA, 22 bp, Homo sapiens
tataatattccttgttgtaggt

SEQ ID NO: 7219642 - DNA, 22 bp, Homo sapiens
tataatattccttgttgtaggt

SEQ ID NO: 7219643 - DNA, 22 bp, Homo sapiens
tataatctggttttattaagag

SEQ ID NO: 7219644 - DNA, 22 bp, Homo sapiens
tataatctggttttattaagag

SEQ ID NO: 7219645 - DNA, 22 bp, Homo sapiens
tataattagtaaatggcagatt

SEQ ID NO: 7219646 - DNA, 22 bp, Homo sapiens
tataatctggttttattaagag

SEQ ID NO: 7219647 - DNA, 22 bp, Homo sapiens
tataatctggttttattaagag

SEQ ID NO: 7219648 - DNA, 22 bp, Homo sapiens
tataattagtaaatggcagatt

SEQ ID NO: 7219649 - DNA, 22 bp, Homo sapiens
tatctatgctgcttcagttaag

SEQ ID NO: 7219650 - DNA, 22 bp, Homo sapiens
caggtctggcatcagctgtgtg

SEQ ID NO: 7219651 - DNA, 22 bp, Homo sapiens
caggtctggcatcagctgtgtg

SEQ ID NO: 7219652 - DNA, 22 bp, Homo sapiens
tatctatgtgctctgacctctc

SEQ ID NO: 7219653 - DNA, 22 bp, Homo sapiens
tatctatgtggtgatcttattt

SEQ ID NO: 7219654 - DNA, 22 bp, Homo sapiens
tatctattatgttctatgtgtc

SEQ ID NO: 7219655 - DNA, 22 bp, Homo sapiens
caggtctgcagacagggccatg

SEQ ID NO: 7219656 - DNA, 22 bp, Homo sapiens
caggtctgcagacagggccatg

SEQ ID NO: 7219657 - DNA, 22 bp, Homo sapiens
caggtctggcatcagctgtgtg

SEQ ID NO: 7219658 - DNA, 22 bp, Homo sapiens
caggtctgcaggctggagtcca

SEQ ID NO: 7219659 - DNA, 17 bp, Homo sapiens
caggtctgaggccaggc

SEQ ID NO: 7219660 - DNA, 22 bp, Homo sapiens
caggtctgagtcacatgttcat

SEQ ID NO: 7219661 - DNA, 22 bp, Homo sapiens
caggtctgagtcacatgttcat

SEQ ID NO: 7219662 - DNA, 22 bp, Homo sapiens
caggtccacggcgcccaggggt

SEQ ID NO: 7219663 - DNA, 22 bp, Homo sapiens
caggtccacggcgcccaggggt

SEQ ID NO: 7219664 - DNA, 22 bp, Homo sapiens
caggtccagaaaccaaaggatt

SEQ ID NO: 7219665 - DNA, 22 bp, Homo sapiens
caggtctccagctcagggtcca

SEQ ID NO: 7219666 - DNA, 22 bp, Homo sapiens
caggtctccagctcagggtcca

SEQ ID NO: 7219667 - DNA, 22 bp, Homo sapiens
caggtctcccatcccctctgtt

SEQ ID NO: 7219668 - DNA, 22 bp, Homo sapiens
caggtctcgggttcagcagtga

SEQ ID NO: 7219669 - DNA, 22 bp, Homo sapiens
caggtctgaagagtcacatgcc

SEQ ID NO: 7219670 - DNA, 22 bp, Homo sapiens
caggtctgaagagtcacatgcc

SEQ ID NO: 7219671 - DNA, 17 bp, Homo sapiens
caggtctgaggccaggc

SEQ ID NO: 7219672 - DNA, 22 bp, Homo sapiens
cagggtggaagctgtagagtgg

SEQ ID NO: 7219673 - DNA, 22 bp, Homo sapiens
cagggtggaagctgtagagtgg

SEQ ID NO: 7219674 - DNA, 22 bp, Homo sapiens
cagggtggaatggaatgctggc

SEQ ID NO: 7219675 - DNA, 22 bp, Homo sapiens
cagggtggaatggaatgctggc

SEQ ID NO: 7219676 - DNA, 22 bp, Homo sapiens
cagggtggaatggaatgctggc

SEQ ID NO: 7219677 - DNA, 22 bp, Homo sapiens
cagggtggaatggaatgctggc

SEQ ID NO: 7219678 - DNA, 22 bp, Homo sapiens
cagggtggcacatcacagcatt

SEQ ID NO: 7219679 - DNA, 22 bp, Homo sapiens
cagggtggcacatcacagcatt

SEQ ID NO: 7219680 - DNA, 22 bp, Homo sapiens
cagggtggcacatcacagcatt

SEQ ID NO: 7219681 - DNA, 22 bp, Homo sapiens
cagggtggcacatcacagcatt

SEQ ID NO: 7219682 - DNA, 22 bp, Homo sapiens
tatacagatggaaagatacaca

SEQ ID NO: 7219683 - DNA, 22 bp, Homo sapiens
tatacagatggaaagatacaca

SEQ ID NO: 7219684 - DNA, 22 bp, Homo sapiens
cagggtggcacatcacagcatt

SEQ ID NO: 7219685 - DNA, 22 bp, Homo sapiens
cagggtggcacatcacagcatt

SEQ ID NO: 7219686 - DNA, 22 bp, Homo sapiens
cagggtggcactcagcgcatct

SEQ ID NO: 7219687 - DNA, 22 bp, Homo sapiens
cagggtggcactcagcgcatct

SEQ ID NO: 7219688 - DNA, 22 bp, Homo sapiens
cagggtggcactcagcgcatct

SEQ ID NO: 7219689 - DNA, 22 bp, Homo sapiens
tatacagatttctgggcaatct

SEQ ID NO: 7219690 - DNA, 21 bp, Homo sapiens
tatacagcaaagtctggagca

SEQ ID NO: 7219691 - DNA, 22 bp, Homo sapiens
tatacagctatggcaagacaaa

SEQ ID NO: 7219692 - DNA, 22 bp, Homo sapiens
tatacagctatggcaagacaaa

SEQ ID NO: 7219693 - DNA, 22 bp, Homo sapiens
tatacagattaacagatttaaa

SEQ ID NO: 7219694 - DNA, 22 bp, Homo sapiens
tatacagattaacagatttaaa

SEQ ID NO: 7219695 - DNA, 23 bp, Homo sapiens
tatacagtctccaggcagtcctt

SEQ ID NO: 7219696 - DNA, 22 bp, Homo sapiens
tatacagtcttttgctatattc

SEQ ID NO: 7219697 - DNA, 22 bp, Homo sapiens
tcactcagcattcactgggcct

SEQ ID NO: 7219698 - DNA, 22 bp, Homo sapiens
tcactcagcattcactgggcct

SEQ ID NO: 7219699 - DNA, 22 bp, Homo sapiens
tcactcaatggtatcaggaggt

SEQ ID NO: 7219700 - DNA, 22 bp, Homo sapiens
tcactcaagcatctacagggat

SEQ ID NO: 7219701 - DNA, 22 bp, Homo sapiens
tcactcaatatcccagtggggc

SEQ ID NO: 7219702 - DNA, 22 bp, Homo sapiens
tcactatgcccagaatacagtt

SEQ ID NO: 7219703 - DNA, 22 bp, Homo sapiens
tcacccagcagctgcttctgct

SEQ ID NO: 7219704 - DNA, 22 bp, Homo sapiens
tcactatctcagtaaagcactc

SEQ ID NO: 7219705 - DNA, 22 bp, Homo sapiens
tcacccagacagcttgcactga

SEQ ID NO: 7219706 - DNA, 22 bp, Homo sapiens
tcacccagactgtctgactctt

SEQ ID NO: 7219707 - DNA, 22 bp, Homo sapiens
tcacccagacagcttgcactga

SEQ ID NO: 7219708 - DNA, 22 bp, Homo sapiens
tcacccagactgtctgactctt

SEQ ID NO: 7219709 - DNA, 22 bp, Homo sapiens
tcacccagactgtctgactctt

SEQ ID NO: 7219710 - DNA, 22 bp, Homo sapiens
tcacccagaaaagacagcagat

SEQ ID NO: 7219711 - DNA, 22 bp, Homo sapiens
tcacccagaaaagacagcagat

SEQ ID NO: 7219712 - DNA, 22 bp, Homo sapiens
tcacccagacagcttgcactga

SEQ ID NO: 7219713 - DNA, 22 bp, Homo sapiens
tcacccagacagcttgcactga

SEQ ID NO: 7219714 - DNA, 22 bp, Homo sapiens
tcacccagacttgtgaatgtgt

SEQ ID NO: 7219715 - DNA, 22 bp, Homo sapiens
tcacccagatagtgagcatagt

SEQ ID NO: 7219716 - DNA, 22 bp, Homo sapiens
tcacccagatagtgagcatagt

SEQ ID NO: 7219717 - DNA, 22 bp, Homo sapiens
tcacccagacttgtgaatgtgt

SEQ ID NO: 7219718 - DNA, 22 bp, Homo sapiens
tcacccagatagtgagcatagt

SEQ ID NO: 7219719 - DNA, 22 bp, Homo sapiens
tcacccagattacatcctgtca

SEQ ID NO: 7219720 - DNA, 22 bp, Homo sapiens
tcacccagcagctgcttctgct

SEQ ID NO: 7219721 - DNA, 22 bp, Homo sapiens
tcactcaggttcatgtctttgt

SEQ ID NO: 7219722 - DNA, 22 bp, Homo sapiens
tcactcaggctggagtgcagtg

SEQ ID NO: 7219723 - DNA, 22 bp, Homo sapiens
tcactccatagcttaactcttt

SEQ ID NO: 7219724 - DNA, 18 bp, Homo sapiens
tcactcatagacatctat

SEQ ID NO: 7219725 - DNA, 18 bp, Homo sapiens
tcactcatagacatctat

SEQ ID NO: 7219726 - DNA, 22 bp, Homo sapiens
tcactcatattatctctccaca

SEQ ID NO: 7219727 - DNA, 22 bp, Homo sapiens
tcactcatattatctctccaca

SEQ ID NO: 7219728 - DNA, 22 bp, Homo sapiens
tcagaaagtgaactgttgacat

SEQ ID NO: 7219729 - DNA, 22 bp, Homo sapiens
tcacttctgaaggtagttggca

SEQ ID NO: 7219730 - DNA, 22 bp, Homo sapiens
tcacttcccagacggggtggca

SEQ ID NO: 7219731 - DNA, 22 bp, Homo sapiens
tcacttcccagacggggtggca

SEQ ID NO: 7219732 - DNA, 22 bp, Homo sapiens
tcactcctcattgctgcccatt

SEQ ID NO: 7219733 - DNA, 22 bp, Homo sapiens
tcactccatctttgctactggt

SEQ ID NO: 7219734 - DNA, 19 bp, Homo sapiens
tcagaaggcaggagaggcc

SEQ ID NO: 7219735 - DNA, 19 bp, Homo sapiens
tcagaaggcaggagaggcc

SEQ ID NO: 7219736 - DNA, 22 bp, Homo sapiens
tcagaaggaagttagagtatgg

SEQ ID NO: 7219737 - DNA, 22 bp, Homo sapiens
tcagaaggaagttagagtatgg

SEQ ID NO: 7219738 - DNA, 22 bp, Homo sapiens
tcagaaggaagaagtcatggga

SEQ ID NO: 7219739 - DNA, 22 bp, Homo sapiens
tcagaaatttaggctggacttg

SEQ ID NO: 7219740 - DNA, 22 bp, Homo sapiens
tcagaaatttaggctggacttg

SEQ ID NO: 7219741 - DNA, 22 bp, Homo sapiens
tcagaaattttctcagtagttc

SEQ ID NO: 7219742 - DNA, 22 bp, Homo sapiens
tcagaaattttctcagtagttc

SEQ ID NO: 7219743 - DNA, 22 bp, Homo sapiens
tcagaaattttctcagtagttc

SEQ ID NO: 7219744 - DNA, 23 bp, Homo sapiens
tcagaacaatgccttaggggcat

SEQ ID NO: 7219745 - DNA, 23 bp, Homo sapiens
tcagaacaatgccttaggggcat

SEQ ID NO: 7219746 - DNA, 23 bp, Homo sapiens
tcagaacaatgccttaggggcat

SEQ ID NO: 7219747 - DNA, 21 bp, Homo sapiens
tcagaacaattccatgcctcc

SEQ ID NO: 7219748 - DNA, 21 bp, Homo sapiens
tcagaacaattccatgcctcc

SEQ ID NO: 7219749 - DNA, 22 bp, Homo sapiens
tcagaagctaaatttgatattt

SEQ ID NO: 7219750 - DNA, 22 bp, Homo sapiens
tcagaagctgggtctcagaagc

SEQ ID NO: 7219751 - DNA, 22 bp, Homo sapiens
tcagaaatgatcgttattcatt

SEQ ID NO: 7219752 - DNA, 22 bp, Homo sapiens
tcagaaatgatcgttattcatt

SEQ ID NO: 7219753 - DNA, 22 bp, Homo sapiens
tcagaaatgatcgttattcatt

SEQ ID NO: 7219754 - DNA, 22 bp, Homo sapiens
tcagaaatgtaagctgatgact

SEQ ID NO: 7219755 - DNA, 22 bp, Homo sapiens
tcagaaatgtaagctgatgact

SEQ ID NO: 7219756 - DNA, 22 bp, Homo sapiens
tcagaaatgtaagctgatgact

SEQ ID NO: 7219757 - DNA, 22 bp, Homo sapiens
tcagaaatagtctttaaaatga

SEQ ID NO: 7219758 - DNA, 22 bp, Homo sapiens
tcagaaatagtctttaaaatga

SEQ ID NO: 7219759 - DNA, 22 bp, Homo sapiens
tcagaaatcttgtcaaggcatc

SEQ ID NO: 7219760 - DNA, 22 bp, Homo sapiens
tcagaaatcttgtcaaggcatc

SEQ ID NO: 7219761 - DNA, 22 bp, Homo sapiens
tcagaaatcttgtcaaggcatc

SEQ ID NO: 7219762 - DNA, 22 bp, Homo sapiens
tcagaaatgatcgttattcatt

SEQ ID NO: 7219763 - DNA, 22 bp, Homo sapiens
tcagaaatgatcgttattcatt

SEQ ID NO: 7219764 - DNA, 22 bp, Homo sapiens
tcagaaataatgaatgatgggg

SEQ ID NO: 7219765 - DNA, 22 bp, Homo sapiens
tcagaaataatgaatgatgggg

SEQ ID NO: 7219766 - DNA, 22 bp, Homo sapiens
tcagaaatacaaaacacttact

SEQ ID NO: 7219767 - DNA, 22 bp, Homo sapiens
tcagaaatactatcagcttttg

SEQ ID NO: 7219768 - DNA, 22 bp, Homo sapiens
tcagaaatactatcagcttttg

SEQ ID NO: 7219769 - DNA, 22 bp, Homo sapiens
tcagaaatactatcagcttttg

SEQ ID NO: 7219770 - DNA, 22 bp, Homo sapiens
tcagaaatagctctaagctcct

SEQ ID NO: 7219771 - DNA, 22 bp, Homo sapiens
tcagaaatagctctaagctcct

SEQ ID NO: 7219772 - DNA, 22 bp, Homo sapiens
tcagaaatagtctttaaaatga

SEQ ID NO: 7219773 - DNA, 22 bp, Homo sapiens
tcacccagaaaagacagcagat

SEQ ID NO: 7219774 - DNA, 22 bp, Homo sapiens
tcaccatacataaattacattg

SEQ ID NO: 7219775 - DNA, 22 bp, Homo sapiens
tcaccatacataaattacattg

SEQ ID NO: 7219776 - DNA, 22 bp, Homo sapiens
tcaccataggaacacagtcaga

SEQ ID NO: 7219777 - DNA, 22 bp, Homo sapiens
tcaccataggaacacagtcaga

SEQ ID NO: 7219778 - DNA, 22 bp, Homo sapiens
tcaccatcaggataaaatctca

SEQ ID NO: 7219779 - DNA, 22 bp, Homo sapiens
tcaccatcctcacctagaaatg

SEQ ID NO: 7219780 - DNA, 22 bp, Homo sapiens
tcaccagggagcttgtcctctg

SEQ ID NO: 7219781 - DNA, 22 bp, Homo sapiens
tcaccagggctccagccagcct

SEQ ID NO: 7219782 - DNA, 22 bp, Homo sapiens
tcaccagtctttcttaccattg

SEQ ID NO: 7219783 - DNA, 22 bp, Homo sapiens
tcaccagggctccagccagcct

SEQ ID NO: 7219784 - DNA, 22 bp, Homo sapiens
tcaccaggctggagtgcagtgg

SEQ ID NO: 7219785 - DNA, 22 bp, Homo sapiens
tcaccaggctggaatgcagtgg

SEQ ID NO: 7219786 - DNA, 22 bp, Homo sapiens
tcaccaggctcctgttaagatg

SEQ ID NO: 7219787 - DNA, 22 bp, Homo sapiens
tcacattgaatggaagaataga

SEQ ID NO: 7219788 - DNA, 22 bp, Homo sapiens
tcacattgattacattccatgt

SEQ ID NO: 7219789 - DNA, 22 bp, Homo sapiens
tcacattctttatttgccatcc

SEQ ID NO: 7219790 - DNA, 22 bp, Homo sapiens
tcacattctttatttgccatcc

SEQ ID NO: 7219791 - DNA, 22 bp, Homo sapiens
tcacattgaagaaattttaagt

SEQ ID NO: 7219792 - DNA, 19 bp, Homo sapiens
cagtgctgttcattcagtg

SEQ ID NO: 7219793 - DNA, 22 bp, Homo sapiens
cagtgctgtgtttgctgcctgg

SEQ ID NO: 7219794 - DNA, 22 bp, Homo sapiens
cagtgctgtgtttgctgcctgg

SEQ ID NO: 7219795 - DNA, 22 bp, Homo sapiens
cagtgctgtgctggaagctgtt

SEQ ID NO: 7219796 - DNA, 22 bp, Homo sapiens
cagtgctggtgtaggctgacca

SEQ ID NO: 7219797 - DNA, 23 bp, Homo sapiens
cagtgctggttctgcctgtgggg

SEQ ID NO: 7219798 - DNA, 22 bp, Homo sapiens
cagtgctgcaggcgcctgcggt

SEQ ID NO: 7219799 - DNA, 22 bp, Homo sapiens
cagtgctgagagcctggccagg

SEQ ID NO: 7219800 - DNA, 22 bp, Homo sapiens
cagtgctgcatctccatgccag

SEQ ID NO: 7219801 - DNA, 22 bp, Homo sapiens
cagtgctgccaaagggaccttg

SEQ ID NO: 7219802 - DNA, 21 bp, Homo sapiens
cagtgctgcctaatagggagt

SEQ ID NO: 7219803 - DNA, 19 bp, Homo sapiens
cagtgcccgacgcaggtct

SEQ ID NO: 7219804 - DNA, 19 bp, Homo sapiens
cagtgcccaccctagcaca

SEQ ID NO: 7219805 - DNA, 22 bp, Homo sapiens
cagtgctcctgatgtacccttg

SEQ ID NO: 7219806 - DNA, 22 bp, Homo sapiens
cagtgcccaagatgtgccatgc

SEQ ID NO: 7219807 - DNA, 22 bp, Homo sapiens
cagtgcagaggccagggaggat

SEQ ID NO: 7219808 - DNA, 22 bp, Homo sapiens
cagtgcagaggccagggaggat

SEQ ID NO: 7219809 - DNA, 22 bp, Homo sapiens
cagtgctgggcagaggagagcg

SEQ ID NO: 7219810 - DNA, 22 bp, Homo sapiens
cagtgctggtgtaggctgacca

SEQ ID NO: 7219811 - DNA, 22 bp, Homo sapiens
cagtgctggctgttaggacagt

SEQ ID NO: 7219812 - DNA, 22 bp, Homo sapiens
cagtgctgggcagaggagagcg

SEQ ID NO: 7219813 - DNA, 22 bp, Homo sapiens
cagtgctggctgttaggacagt

SEQ ID NO: 7219814 - DNA, 22 bp, Homo sapiens
cagtgctggaggctggagggaa

SEQ ID NO: 7219815 - DNA, 22 bp, Homo sapiens
cagtgctggaggggtgcttgca

SEQ ID NO: 7219816 - DNA, 22 bp, Homo sapiens
cagtgctggaggggtgcttgca

SEQ ID NO: 7219817 - DNA, 22 bp, Homo sapiens
cagtgaggtagacagctttttc

SEQ ID NO: 7219818 - DNA, 20 bp, Homo sapiens
cagtgaggaggtgctggggg

SEQ ID NO: 7219819 - DNA, 22 bp, Homo sapiens
cagtgagggcccccttccaggt

SEQ ID NO: 7219820 - DNA, 22 bp, Homo sapiens
cagtgagggcccccttccaggt

SEQ ID NO: 7219821 - DNA, 21 bp, Homo sapiens
cagtgaggtccccagcctagg

SEQ ID NO: 7219822 - DNA, 22 bp, Homo sapiens
cagtgaggtggatggatggcct

SEQ ID NO: 7219823 - DNA, 22 bp, Homo sapiens
cagtgaggtgcccagcctgccc

SEQ ID NO: 7219824 - DNA, 22 bp, Homo sapiens
cagtgaggtgcccagcctgccc

SEQ ID NO: 7219825 - DNA, 22 bp, Homo sapiens
cagtgagttgtgctgaggacca

SEQ ID NO: 7219826 - DNA, 22 bp, Homo sapiens
cagtgagtgtgggaagtctctg

SEQ ID NO: 7219827 - DNA, 22 bp, Homo sapiens
cagtgagttgtgctgaggacca

SEQ ID NO: 7219828 - DNA, 22 bp, Homo sapiens
cagtgataggacagctagaact

SEQ ID NO: 7219829 - DNA, 17 bp, Homo sapiens
cagtgatcattacatta

SEQ ID NO: 7219830 - DNA, 22 bp, Homo sapiens
cagtgaggtggatggatggcct

SEQ ID NO: 7219831 - DNA, 22 bp, Homo sapiens
cagtgagtaagtagacagctta

SEQ ID NO: 7219832 - DNA, 22 bp, Homo sapiens
cagtctcaccctggaggcccca

SEQ ID NO: 7219833 - DNA, 22 bp, Homo sapiens
cagtcctttcaatggtgacctt

SEQ ID NO: 7219834 - DNA, 19 bp, Homo sapiens
cagtcctttccgctttctc

SEQ ID NO: 7219835 - DNA, 22 bp, Homo sapiens
cagtcctttctgaaatcctata

SEQ ID NO: 7219836 - DNA, 17 bp, Homo sapiens
cagtcgaggaggacctg

SEQ ID NO: 7219837 - DNA, 20 bp, Homo sapiens
cagtgaggaggtgctggggg

SEQ ID NO: 7219838 - DNA, 22 bp, Homo sapiens
cagtctccgccagctcctcaca

SEQ ID NO: 7219839 - DNA, 22 bp, Homo sapiens
cagtctcctgggggctgttgtt

SEQ ID NO: 7219840 - DNA, 22 bp, Homo sapiens
cagtctccgccagctcctcaca

SEQ ID NO: 7219841 - DNA, 22 bp, Homo sapiens
cagtctcctgggggctgttgtt

SEQ ID NO: 7219842 - DNA, 22 bp, Homo sapiens
cagtctccaaatcagtctgaat

SEQ ID NO: 7219843 - DNA, 22 bp, Homo sapiens
cagtctccgccagctcctcaca

SEQ ID NO: 7219844 - DNA, 22 bp, Homo sapiens
cagtgcagaggccagggaggat

SEQ ID NO: 7219845 - DNA, 22 bp, Homo sapiens
cagtgcagaggccagggaggat

SEQ ID NO: 7219846 - DNA, 17 bp, Homo sapiens
cagtgcagagccctttc

SEQ ID NO: 7219847 - DNA, 17 bp, Homo sapiens
cagtgcagagccctttc

SEQ ID NO: 7219848 - DNA, 22 bp, Homo sapiens
cagtgcagacgtggagggggca

SEQ ID NO: 7219849 - DNA, 22 bp, Homo sapiens
cagtgcagacgtggagggggca

SEQ ID NO: 7219850 - DNA, 22 bp, Homo sapiens
cagtgcagacgtggagggggca

SEQ ID NO: 7219851 - DNA, 22 bp, Homo sapiens
cagtgcacacaatcctctgccg

SEQ ID NO: 7219852 - DNA, 22 bp, Homo sapiens
cagtgcacgggccagtcctgcc

SEQ ID NO: 7219853 - DNA, 22 bp, Homo sapiens
cagtgcagaacacatggaaaat

SEQ ID NO: 7219854 - DNA, 22 bp, Homo sapiens
cagtgcagaacacatggaaaat

SEQ ID NO: 7219855 - DNA, 22 bp, Homo sapiens
cagtgcagaacacatggaaaat

SEQ ID NO: 7219856 - DNA, 22 bp, Homo sapiens
cagtgcaagctgatactgaggt

SEQ ID NO: 7219857 - DNA, 22 bp, Homo sapiens
cagtgcaagctgatactgaggt

SEQ ID NO: 7219858 - DNA, 22 bp, Homo sapiens
cagtgcaattacaagctaattc

SEQ ID NO: 7219859 - DNA, 22 bp, Homo sapiens
cagtgcaaactccctgaggtgg

SEQ ID NO: 7219860 - DNA, 20 bp, Homo sapiens
cagtgcaactgaagaactga

SEQ ID NO: 7219861 - DNA, 20 bp, Homo sapiens
cagtgcaactgaagaactga

SEQ ID NO: 7219862 - DNA, 22 bp, Homo sapiens
cagtgattcaggtctccagttt

SEQ ID NO: 7219863 - DNA, 22 bp, Homo sapiens
cagtgatttcagaatggattat

SEQ ID NO: 7219864 - DNA, 22 bp, Homo sapiens
cagtgattttaaactatggatg

SEQ ID NO: 7219865 - DNA, 22 bp, Homo sapiens
cagtgattttctcagaacttga

SEQ ID NO: 7219866 - DNA, 22 bp, Homo sapiens
cagtgattttggtctgccttag

SEQ ID NO: 7219867 - DNA, 22 bp, Homo sapiens
cagtgattttggtctgccttag

SEQ ID NO: 7219868 - DNA, 22 bp, Homo sapiens
cagtgatggatatggagaagtc

SEQ ID NO: 7219869 - DNA, 22 bp, Homo sapiens
cagtgatgtttctgcatcagag

SEQ ID NO: 7219870 - DNA, 22 bp, Homo sapiens
cagtgattaaaacatgacagcc

SEQ ID NO: 7219871 - DNA, 22 bp, Homo sapiens
cagtgattaagatacccaggct

SEQ ID NO: 7219872 - DNA, 22 bp, Homo sapiens
cagtgattaagatacccaggct

SEQ ID NO: 7219873 - DNA, 19 bp, Homo sapiens
cagtgattaattcatctta

SEQ ID NO: 7219874 - DNA, 19 bp, Homo sapiens
cagtgattaattcatctta

SEQ ID NO: 7219875 - DNA, 22 bp, Homo sapiens
cagtgattattgattgcattca

SEQ ID NO: 7219876 - DNA, 22 bp, Homo sapiens
cagtgattattgattgcattca

SEQ ID NO: 7219877 - DNA, 22 bp, Homo sapiens
cagtgattcacgcccttgggcc

SEQ ID NO: 7219878 - DNA, 22 bp, Homo sapiens
cagtgattcagactcatcattt

SEQ ID NO: 7219879 - DNA, 21 bp, Homo sapiens
tatttagttttacaaatgtgg

SEQ ID NO: 7219880 - DNA, 22 bp, Homo sapiens
tatttagttatctttcataaaa

SEQ ID NO: 7219881 - DNA, 22 bp, Homo sapiens
tatttagtgatagaagcaagga

SEQ ID NO: 7219882 - DNA, 22 bp, Homo sapiens
tatttagtgatagaagcaagga

SEQ ID NO: 7219883 - DNA, 22 bp, Homo sapiens
tatttagtgatagaagcaagga

SEQ ID NO: 7219884 - DNA, 22 bp, Homo sapiens
tatttagttatctttcataaaa

SEQ ID NO: 7219885 - DNA, 22 bp, Homo sapiens
tatttagatgcatttggattgc

SEQ ID NO: 7219886 - DNA, 22 bp, Homo sapiens
tatttagatgcatttggattgc

SEQ ID NO: 7219887 - DNA, 20 bp, Homo sapiens
tatttagattcaagtatgga

SEQ ID NO: 7219888 - DNA, 20 bp, Homo sapiens
tatttagattcaagtatgga

SEQ ID NO: 7219889 - DNA, 22 bp, Homo sapiens
tatttagctggagtcagtgctt

SEQ ID NO: 7219890 - DNA, 22 bp, Homo sapiens
tatttagaacagacaatagaaa

SEQ ID NO: 7219891 - DNA, 22 bp, Homo sapiens
tatttagaacagacaatagaaa

SEQ ID NO: 7219892 - DNA, 22 bp, Homo sapiens
tatttagaatgcgtgtacgtgt

SEQ ID NO: 7219893 - DNA, 22 bp, Homo sapiens
tatttagaacagacaatagaaa

SEQ ID NO: 7219894 - DNA, 22 bp, Homo sapiens
tatttagaacagacaatagaaa

SEQ ID NO: 7219895 - DNA, 22 bp, Homo sapiens
tatttaccctggcagctgtagc

SEQ ID NO: 7219896 - DNA, 22 bp, Homo sapiens
tatttacctagagccctctatc

SEQ ID NO: 7219897 - DNA, 22 bp, Homo sapiens
tatttaccttgtgcaggtcctg

SEQ ID NO: 7219898 - DNA, 22 bp, Homo sapiens
tatttactgtatttgaagttga

SEQ ID NO: 7219899 - DNA, 22 bp, Homo sapiens
tatttacttttaaattgagaac

SEQ ID NO: 7219900 - DNA, 22 bp, Homo sapiens
tatttacttttaaattgagaac

SEQ ID NO: 7219901 - DNA, 22 bp, Homo sapiens
tattggagtatggggctggagt

SEQ ID NO: 7219902 - DNA, 22 bp, Homo sapiens
tattggacagtccagtgagaat

SEQ ID NO: 7219903 - DNA, 22 bp, Homo sapiens
tattggagttggtaagaagtca

SEQ ID NO: 7219904 - DNA, 22 bp, Homo sapiens
tattggagttggtaagaagtca

SEQ ID NO: 7219905 - DNA, 22 bp, Homo sapiens
tattggatgaagaaaggaagga

SEQ ID NO: 7219906 - DNA, 22 bp, Homo sapiens
tattggatgattcacttggcag

SEQ ID NO: 7219907 - DNA, 22 bp, Homo sapiens
tattggattgagacattttaga

SEQ ID NO: 7219908 - DNA, 22 bp, Homo sapiens
tattggaatagttaaggaagat

SEQ ID NO: 7219909 - DNA, 22 bp, Homo sapiens
tattggaatgcactgggagaga

SEQ ID NO: 7219910 - DNA, 22 bp, Homo sapiens
tattggaatttagttagagaat

SEQ ID NO: 7219911 - DNA, 22 bp, Homo sapiens
tattggagaggtcttgggtaga

SEQ ID NO: 7219912 - DNA, 22 bp, Homo sapiens
tattggaggaaaccaagaagaa

SEQ ID NO: 7219913 - DNA, 22 bp, Homo sapiens
tattggaggaaaccaagaagaa

SEQ ID NO: 7219914 - DNA, 20 bp, Homo sapiens
tatttacaacttagagcctc

SEQ ID NO: 7219915 - DNA, 20 bp, Homo sapiens
tatttacaacttagagcctc

SEQ ID NO: 7219916 - DNA, 20 bp, Homo sapiens
tatttacaacttagagcctc

SEQ ID NO: 7219917 - DNA, 20 bp, Homo sapiens
tatttacaacttagagcctc

SEQ ID NO: 7219918 - DNA, 20 bp, Homo sapiens
tatttacaacttagagcctc

SEQ ID NO: 7219919 - DNA, 22 bp, Homo sapiens
tattgggacttaaaggtaaaga

SEQ ID NO: 7219920 - DNA, 22 bp, Homo sapiens
tattgggacttaaaggtaaaga

SEQ ID NO: 7219921 - DNA, 22 bp, Homo sapiens
tattgggcagacatcaggctta

SEQ ID NO: 7219922 - DNA, 22 bp, Homo sapiens
tattgggctggaattgcttcag

SEQ ID NO: 7219923 - DNA, 21 bp, Homo sapiens
tattggccattaaagggaaaa

SEQ ID NO: 7219924 - DNA, 22 bp, Homo sapiens
tattggcttggagcattttcct

SEQ ID NO: 7219925 - DNA, 22 bp, Homo sapiens
tattggcttttccagacctggc

SEQ ID NO: 7219926 - DNA, 23 bp, Homo sapiens
tattggctttttaaaggagtata

SEQ ID NO: 7219927 - DNA, 22 bp, Homo sapiens
tattgggaaaagggcgatggct

SEQ ID NO: 7219928 - DNA, 22 bp, Homo sapiens
tattgggaaaagggcgatggct

SEQ ID NO: 7219929 - DNA, 22 bp, Homo sapiens
cagtccttattcctatattcct

SEQ ID NO: 7219930 - DNA, 22 bp, Homo sapiens
cagtccttagattttactgcca

SEQ ID NO: 7219931 - DNA, 22 bp, Homo sapiens
cagtccttagtctggatggctt

SEQ ID NO: 7219932 - DNA, 22 bp, Homo sapiens
cagtccttcattcctcctttga

SEQ ID NO: 7219933 - DNA, 22 bp, Homo sapiens
cagtccttccttgccccttggg

SEQ ID NO: 7219934 - DNA, 22 bp, Homo sapiens
cagtccttctccattaaggctc

SEQ ID NO: 7219935 - DNA, 22 bp, Homo sapiens
cagtccttgatccaatagtggg

SEQ ID NO: 7219936 - DNA, 22 bp, Homo sapiens
cagtccttgctatgaccctgag

SEQ ID NO: 7219937 - DNA, 22 bp, Homo sapiens
cagtccttgctatgaccctgag

SEQ ID NO: 7219938 - DNA, 22 bp, Homo sapiens
cagtccttgctcaaagtctaca

SEQ ID NO: 7219939 - DNA, 22 bp, Homo sapiens
cagtccttgctctgggatgatg

SEQ ID NO: 7219940 - DNA, 22 bp, Homo sapiens
cagtccttggcaagttctcagt

SEQ ID NO: 7219941 - DNA, 22 bp, Homo sapiens
cagtccttggcaagttctcagt

SEQ ID NO: 7219942 - DNA, 22 bp, Homo sapiens
cagtccttggcttcatccgagt

SEQ ID NO: 7219943 - DNA, 22 bp, Homo sapiens
cagtccttagattttactgcca

SEQ ID NO: 7219944 - DNA, 22 bp, Homo sapiens
cagtccttaaggaaacatttgt

SEQ ID NO: 7219945 - DNA, 22 bp, Homo sapiens
cagtccttaaggaaacatttgt

SEQ ID NO: 7219946 - DNA, 22 bp, Homo sapiens
cagtcctgttcctggagtagtt

SEQ ID NO: 7219947 - DNA, 22 bp, Homo sapiens
cagtcctgtgtcccttggtggg

SEQ ID NO: 7219948 - DNA, 22 bp, Homo sapiens
cagtcctgtgtcccttggtggg

SEQ ID NO: 7219949 - DNA, 22 bp, Homo sapiens
cagtcctgtgttaaacaagagc

SEQ ID NO: 7219950 - DNA, 22 bp, Homo sapiens
cagtcctgtgttaaacaagagc

SEQ ID NO: 7219951 - DNA, 22 bp, Homo sapiens
cagtcctctctgtgtctgcacc

SEQ ID NO: 7219952 - DNA, 22 bp, Homo sapiens
cagtcctgggcaggtcaggcca

SEQ ID NO: 7219953 - DNA, 22 bp, Homo sapiens
cagtcctgggcaggtcaggcca

SEQ ID NO: 7219954 - DNA, 22 bp, Homo sapiens
cagtcctgggcaggtcaggcca

SEQ ID NO: 7219955 - DNA, 22 bp, Homo sapiens
cagtcctggggaccaggctgag

SEQ ID NO: 7219956 - DNA, 22 bp, Homo sapiens
cagtcctggggaccaggctgag

SEQ ID NO: 7219957 - DNA, 22 bp, Homo sapiens
cagtcctggggaccaggctgag

SEQ ID NO: 7219958 - DNA, 22 bp, Homo sapiens
cagtcctggggaccaggctgag

SEQ ID NO: 7219959 - DNA, 22 bp, Homo sapiens
cagtcctgggtgcagcaggaaa

SEQ ID NO: 7219960 - DNA, 22 bp, Homo sapiens
cagtcctgggtgcagcaggaaa

SEQ ID NO: 7219961 - DNA, 22 bp, Homo sapiens
cagtcctgggtgcagcaggaaa

SEQ ID NO: 7219962 - DNA, 20 bp, Homo sapiens
cagtcctgtccctgctgccc

SEQ ID NO: 7219963 - DNA, 22 bp, Homo sapiens
ttcattcatgtattgtctatgg

SEQ ID NO: 7219964 - DNA, 22 bp, Homo sapiens
ttcattcattacgtgccaggca

SEQ ID NO: 7219965 - DNA, 22 bp, Homo sapiens
ttcattcattcatgaatgttaa

SEQ ID NO: 7219966 - DNA, 22 bp, Homo sapiens
ttcattcattcatgaatgttaa

SEQ ID NO: 7219967 - DNA, 22 bp, Homo sapiens
ttcattcttgtctttgtatagt

SEQ ID NO: 7219968 - DNA, 22 bp, Homo sapiens
ttcattcttgtctttgtatagt

SEQ ID NO: 7219969 - DNA, 19 bp, Homo sapiens
ttcattctttctacttacc

SEQ ID NO: 7219970 - DNA, 22 bp, Homo sapiens
ttcattgaaatacagtcttgac

SEQ ID NO: 7219971 - DNA, 22 bp, Homo sapiens
ttcattgaaatgtttctagctg

SEQ ID NO: 7219972 - DNA, 22 bp, Homo sapiens
ttcattgaaattaagcccaact

SEQ ID NO: 7219973 - DNA, 19 bp, Homo sapiens
ttcattctttctacttacc

SEQ ID NO: 7219974 - DNA, 19 bp, Homo sapiens
ttcattctttctacttacc

SEQ ID NO: 7219975 - DNA, 22 bp, Homo sapiens
ttcattgatttaacaaacaagt

SEQ ID NO: 7219976 - DNA, 22 bp, Homo sapiens
ttccagaggcctgggcacactc

SEQ ID NO: 7219977 - DNA, 22 bp, Homo sapiens
ttccagaggcctgggcacactc

SEQ ID NO: 7219978 - DNA, 22 bp, Homo sapiens
ttccagaggctctaggggagaa

SEQ ID NO: 7219979 - DNA, 22 bp, Homo sapiens
ttccagaggctctaggggagaa

SEQ ID NO: 7219980 - DNA, 22 bp, Homo sapiens
ttcattgaaccactttattctt

SEQ ID NO: 7219981 - DNA, 21 bp, Homo sapiens
ttcattgaactatttgtggag

SEQ ID NO: 7219982 - DNA, 22 bp, Homo sapiens
ttcattgaagcacaagtgatct

SEQ ID NO: 7219983 - DNA, 22 bp, Homo sapiens
ttcattgaagcacaagtgatct

SEQ ID NO: 7219984 - DNA, 22 bp, Homo sapiens
ttcattgaaggagggacttgct

SEQ ID NO: 7219985 - DNA, 22 bp, Homo sapiens
ttcattgactggttcgttaagt

SEQ ID NO: 7219986 - DNA, 22 bp, Homo sapiens
ttcattgagctgtacacttagg

SEQ ID NO: 7219987 - DNA, 22 bp, Homo sapiens
ttcattgagctgtacacttagg

SEQ ID NO: 7219988 - DNA, 22 bp, Homo sapiens
ttcattgagctgtacacttagg

SEQ ID NO: 7219989 - DNA, 23 bp, Homo sapiens
ttcattgagctgttcttgaggat

SEQ ID NO: 7219990 - DNA, 22 bp, Homo sapiens
ttcattgagtataggggtatac

SEQ ID NO: 7219991 - DNA, 22 bp, Homo sapiens
ttcattgagtggtttattctaa

SEQ ID NO: 7219992 - DNA, 22 bp, Homo sapiens
ttcattgagttactgcctgggc

SEQ ID NO: 7219993 - DNA, 22 bp, Homo sapiens
ttcattgatagttttatgtatg

SEQ ID NO: 7219994 - DNA, 22 bp, Homo sapiens
ttcattgatagttttatgtatg

SEQ ID NO: 7219995 - DNA, 22 bp, Homo sapiens
ttcattgatgtggtttaatgta

SEQ ID NO: 7219996 - DNA, 22 bp, Homo sapiens
ttcattgattccaggctcttct

SEQ ID NO: 7219997 - DNA, 23 bp, Homo sapiens
ttcattgattgcaaggagattgg

SEQ ID NO: 7219998 - DNA, 22 bp, Homo sapiens
ttcattcaggtgtatttatggg

SEQ ID NO: 7219999 - DNA, 22 bp, Homo sapiens
ttcattcagcacatatttattg

SEQ ID NO: 7220000 - DNA, 20 bp, Homo sapiens
ttcattcacgtagctgttga

SEQ ID NO: 7220001 - DNA, 20 bp, Homo sapiens
ttcattcacgtagctgttga

SEQ ID NO: 7220002 - DNA, 22 bp, Homo sapiens
ttcattcacccaggaaacatct

SEQ ID NO: 7220003 - DNA, 22 bp, Homo sapiens
ttcattcatctctaaaatgcct

SEQ ID NO: 7220004 - DNA, 22 bp, Homo sapiens
ttcattcatctctaaaatgcct

SEQ ID NO: 7220005 - DNA, 22 bp, Homo sapiens
ttcattcatctctaaaatgcct

SEQ ID NO: 7220006 - DNA, 21 bp, Homo sapiens
ttcattcatggcataatatag

SEQ ID NO: 7220007 - DNA, 21 bp, Homo sapiens
ttcattcatggcataatatag

SEQ ID NO: 7220008 - DNA, 22 bp, Homo sapiens
ttcattcagtgagactaggacg

SEQ ID NO: 7220009 - DNA, 22 bp, Homo sapiens
ttcattcatcacatgcagctgg

SEQ ID NO: 7220010 - DNA, 23 bp, Homo sapiens
ttcattcaaaaggaaaagtcatg

SEQ ID NO: 7220011 - DNA, 23 bp, Homo sapiens
ttcattaggagataagggggaca

SEQ ID NO: 7220012 - DNA, 23 bp, Homo sapiens
ttcattcaaaaggaaaagtcatg

SEQ ID NO: 7220013 - DNA, 22 bp, Homo sapiens
ttcattagagattataaaatga

SEQ ID NO: 7220014 - DNA, 22 bp, Homo sapiens
ttcattaattcattcagtgact

SEQ ID NO: 7220015 - DNA, 22 bp, Homo sapiens
ttcaggaataattatcatatga

SEQ ID NO: 7220016 - DNA, 22 bp, Homo sapiens
ttcaggaatcaaccaagtcatt

SEQ ID NO: 7220017 - DNA, 22 bp, Homo sapiens
ttcaggaatcaaccaagtcatt

SEQ ID NO: 7220018 - DNA, 21 bp, Homo sapiens
ttcaggacaggaaaaacaggg

SEQ ID NO: 7220019 - DNA, 19 bp, Homo sapiens
ttcatgtttgtagatggtg

SEQ ID NO: 7220020 - DNA, 22 bp, Homo sapiens
ttcatgtttgtaggactgaggc

SEQ ID NO: 7220021 - DNA, 22 bp, Homo sapiens
ttcatgttttgagccattctga

SEQ ID NO: 7220022 - DNA, 22 bp, Homo sapiens
ttccagaggtagcaatgacttg

SEQ ID NO: 7220023 - DNA, 22 bp, Homo sapiens
ttccagaggcttcagggaagaa

SEQ ID NO: 7220024 - DNA, 22 bp, Homo sapiens
ttccagaggcttgaggaaaatt

SEQ ID NO: 7220025 - DNA, 22 bp, Homo sapiens
ttccagaggcttgaggaaaatt

SEQ ID NO: 7220026 - DNA, 22 bp, Homo sapiens
ttccagaggcttcagggaagaa

SEQ ID NO: 7220027 - DNA, 22 bp, Homo sapiens
ttccagaggcttcagggaagaa

SEQ ID NO: 7220028 - DNA, 22 bp, Homo sapiens
ttccagaggcttcagggaagaa

SEQ ID NO: 7220029 - DNA, 22 bp, Homo sapiens
ttccagagttgggggagtggtt

SEQ ID NO: 7220030 - DNA, 22 bp, Homo sapiens
ttccagagtgactgtgccactt

SEQ ID NO: 7220031 - DNA, 22 bp, Homo sapiens
ttccagatttctacacaagacc

SEQ ID NO: 7220032 - DNA, 22 bp, Homo sapiens
ttccagcagggtacttgtaatt

SEQ ID NO: 7220033 - DNA, 17 bp, Homo sapiens
ttccagcatgttactaa

SEQ ID NO: 7220034 - DNA, 17 bp, Homo sapiens
ttccagcatgttactaa

SEQ ID NO: 7220035 - DNA, 22 bp, Homo sapiens
ttccagctaactcacatccctt

SEQ ID NO: 7220036 - DNA, 22 bp, Homo sapiens
ttccagctaactcacatccctt

SEQ ID NO: 7220037 - DNA, 22 bp, Homo sapiens
ttccagctaactcacatccctt

SEQ ID NO: 7220038 - DNA, 22 bp, Homo sapiens
ttccagctaactcacatccctt

SEQ ID NO: 7220039 - DNA, 22 bp, Homo sapiens
ttccagcttgacttctacttaa

SEQ ID NO: 7220040 - DNA, 22 bp, Homo sapiens
ttccagcttgacttctacttaa

SEQ ID NO: 7220041 - DNA, 22 bp, Homo sapiens
ttccagctcttgaaggtgggat

SEQ ID NO: 7220042 - DNA, 23 bp, Homo sapiens
ttatttggattttagtggaaaga

SEQ ID NO: 7220043 - DNA, 22 bp, Homo sapiens
ttatttggcaatgcttcaccat

SEQ ID NO: 7220044 - DNA, 22 bp, Homo sapiens
ttatttggatttagcttatcaa

SEQ ID NO: 7220045 - DNA, 23 bp, Homo sapiens
ttatttggattttagtggaaaga

SEQ ID NO: 7220046 - DNA, 22 bp, Homo sapiens
ttatttggaaatatggcttctg

SEQ ID NO: 7220047 - DNA, 22 bp, Homo sapiens
ttatttggaaatatggcttctg

SEQ ID NO: 7220048 - DNA, 22 bp, Homo sapiens
ttatttggatttagcttatcaa

SEQ ID NO: 7220049 - DNA, 22 bp, Homo sapiens
ttatttgattagtaaacctgta

SEQ ID NO: 7220050 - DNA, 22 bp, Homo sapiens
ttatttgcccatgtttagcaga

SEQ ID NO: 7220051 - DNA, 22 bp, Homo sapiens
ttatttgtgaatcatttatcta

SEQ ID NO: 7220052 - DNA, 22 bp, Homo sapiens
ttatttgtgaatcatttatcta

SEQ ID NO: 7220053 - DNA, 22 bp, Homo sapiens
ttatttgtgaatcatttatcta

SEQ ID NO: 7220054 - DNA, 22 bp, Homo sapiens
ttatttgtggcatatgagacga

SEQ ID NO: 7220055 - DNA, 22 bp, Homo sapiens
ttatttgtggcatatgagacga

SEQ ID NO: 7220056 - DNA, 22 bp, Homo sapiens
ttatttgtaaggcagggccagt

SEQ ID NO: 7220057 - DNA, 22 bp, Homo sapiens
ttatttgtgaatcatttatcta

SEQ ID NO: 7220058 - DNA, 22 bp, Homo sapiens
ttatttgtgaatcatttatcta

SEQ ID NO: 7220059 - DNA, 22 bp, Homo sapiens
ttatttgtgaatcatttatcta

SEQ ID NO: 7220060 - DNA, 22 bp, Homo sapiens
ttatttgggtttgagtgtggca

SEQ ID NO: 7220061 - DNA, 22 bp, Homo sapiens
ttatttggttattgtaattggg

SEQ ID NO: 7220062 - DNA, 22 bp, Homo sapiens
ttatttggttgctgacttggaa

SEQ ID NO: 7220063 - DNA, 22 bp, Homo sapiens
ttatttcctgacacagctgatt

SEQ ID NO: 7220064 - DNA, 22 bp, Homo sapiens
ttatttcctctctaatagggta

SEQ ID NO: 7220065 - DNA, 22 bp, Homo sapiens
ttatttcctagggaatttgcct

SEQ ID NO: 7220066 - DNA, 22 bp, Homo sapiens
ttatttctactattttgcctga

SEQ ID NO: 7220067 - DNA, 20 bp, Homo sapiens
ttatttctcattctcctact

SEQ ID NO: 7220068 - DNA, 20 bp, Homo sapiens
ttatttctcattctcctact

SEQ ID NO: 7220069 - DNA, 22 bp, Homo sapiens
ttatttcttgtctatgtagcca

SEQ ID NO: 7220070 - DNA, 22 bp, Homo sapiens
ttatttcttgtctatgtagcca

SEQ ID NO: 7220071 - DNA, 22 bp, Homo sapiens
ttatttcttgtctatgtagcca

SEQ ID NO: 7220072 - DNA, 22 bp, Homo sapiens
ttatttcttgtctatgtagcca

SEQ ID NO: 7220073 - DNA, 22 bp, Homo sapiens
ttatttgaaaagaaggttacgt

SEQ ID NO: 7220074 - DNA, 22 bp, Homo sapiens
ttatttgaatctggctagagaa

SEQ ID NO: 7220075 - DNA, 22 bp, Homo sapiens
ttatttgaatgatggcacaatt

SEQ ID NO: 7220076 - DNA, 22 bp, Homo sapiens
ttatttgacttcttgctatgct

SEQ ID NO: 7220077 - DNA, 22 bp, Homo sapiens
ttatttgacttcttgctatgct

SEQ ID NO: 7220078 - DNA, 22 bp, Homo sapiens
ttatttgacttcttgctatgct

SEQ ID NO: 7220079 - DNA, 22 bp, Homo sapiens
ttatttgacttcttgctatgct

SEQ ID NO: 7220080 - DNA, 22 bp, Homo sapiens
ttatttgacttcttgctatgct

SEQ ID NO: 7220081 - DNA, 22 bp, Homo sapiens
ttatttgattagtaaacctgta

SEQ ID NO: 7220082 - DNA, 22 bp, Homo sapiens
ttatttgattagtaaacctgta

SEQ ID NO: 7220083 - DNA, 22 bp, Homo sapiens
ttcaccataatgcaaagtggga

SEQ ID NO: 7220084 - DNA, 18 bp, Homo sapiens
ttcaccagtgtgatgggt

SEQ ID NO: 7220085 - DNA, 22 bp, Homo sapiens
ttcaccactttgcaccaggcct

SEQ ID NO: 7220086 - DNA, 22 bp, Homo sapiens
ttcaccagattttgtatagtca

SEQ ID NO: 7220087 - DNA, 22 bp, Homo sapiens
ttcaccatcattaacttcatgt

SEQ ID NO: 7220088 - DNA, 22 bp, Homo sapiens
ttcaccatcattaacttcatgt

SEQ ID NO: 7220089 - DNA, 19 bp, Homo sapiens
ttcaccatctcaccaaacc

SEQ ID NO: 7220090 - DNA, 19 bp, Homo sapiens
ttcaccatctcaccaaacc

SEQ ID NO: 7220091 - DNA, 19 bp, Homo sapiens
ttcaccatgggactggagc

SEQ ID NO: 7220092 - DNA, 22 bp, Homo sapiens
ttcaccatgggatgacaacagt

SEQ ID NO: 7220093 - DNA, 22 bp, Homo sapiens
ttcaccatgtaaaccatgtggc

SEQ ID NO: 7220094 - DNA, 22 bp, Homo sapiens
ttcaccatgttggccaggctgg

SEQ ID NO: 7220095 - DNA, 19 bp, Homo sapiens
ttcacattttgctctgagg

SEQ ID NO: 7220096 - DNA, 19 bp, Homo sapiens
ttcacatttttgtggcact

SEQ ID NO: 7220097 - DNA, 22 bp, Homo sapiens
ttcacatttgcccttatgtgtg

SEQ ID NO: 7220098 - DNA, 20 bp, Homo sapiens
ttcacatttctgtagtgatt

SEQ ID NO: 7220099 - DNA, 22 bp, Homo sapiens
ttcacatttgaaaggaaagata

SEQ ID NO: 7220100 - DNA, 22 bp, Homo sapiens
ttcacatttgcccttatgtgtg

SEQ ID NO: 7220101 - DNA, 22 bp, Homo sapiens
ttcacatttcataccacagctt

SEQ ID NO: 7220102 - DNA, 22 bp, Homo sapiens
ttcacatttctctgctgtttga

SEQ ID NO: 7220103 - DNA, 22 bp, Homo sapiens
ttcacatttactggtttgtccg

SEQ ID NO: 7220104 - DNA, 22 bp, Homo sapiens
ttcacattgtggttcatgtgaa

SEQ ID NO: 7220105 - DNA, 22 bp, Homo sapiens
ttcacattgtggttcatgtgaa

SEQ ID NO: 7220106 - DNA, 22 bp, Homo sapiens
ttcacattgtggttcatgtgaa

SEQ ID NO: 7220107 - DNA, 22 bp, Homo sapiens
ttcacattgttttaatgtgaat

SEQ ID NO: 7220108 - DNA, 22 bp, Homo sapiens
ttcacattgtgcagattatggt

SEQ ID NO: 7220109 - DNA, 22 bp, Homo sapiens
ttcacattgtgcagattatggt

SEQ ID NO: 7220110 - DNA, 22 bp, Homo sapiens
ttcacattgtgcagattatggt

SEQ ID NO: 7220111 - DNA, 22 bp, Homo sapiens
ttcacattggttcttgatagct

SEQ ID NO: 7220112 - DNA, 22 bp, Homo sapiens
ttcacattggtgatatgtttct

SEQ ID NO: 7220113 - DNA, 22 bp, Homo sapiens
ttatttgtgaatcatttatcta

SEQ ID NO: 7220114 - DNA, 19 bp, Homo sapiens
ttcacattggaagaagtag

SEQ ID NO: 7220115 - DNA, 22 bp, Homo sapiens
ttcacattggtgatatgtttct

SEQ ID NO: 7220116 - DNA, 22 bp, Homo sapiens
ttcagcctgtctgcagacccct

SEQ ID NO: 7220117 - DNA, 22 bp, Homo sapiens
ttcagcccaggagttggaggct

SEQ ID NO: 7220118 - DNA, 22 bp, Homo sapiens
ttcagcatgggtgtgataaatg

SEQ ID NO: 7220119 - DNA, 22 bp, Homo sapiens
ttcagcgatattattcatgagc

SEQ ID NO: 7220120 - DNA, 22 bp, Homo sapiens
ttcagctaaaaatgcccacttg

SEQ ID NO: 7220121 - DNA, 22 bp, Homo sapiens
ttcagctaaaggaaactcagat

SEQ ID NO: 7220122 - DNA, 22 bp, Homo sapiens
ttcagctaaggagtttcactgt

SEQ ID NO: 7220123 - DNA, 22 bp, Homo sapiens
ttcagctaatgggaataagagt

SEQ ID NO: 7220124 - DNA, 20 bp, Homo sapiens
ttcagctaccaggtatcttc

SEQ ID NO: 7220125 - DNA, 22 bp, Homo sapiens
ttcagctacccttggcttaata

SEQ ID NO: 7220126 - DNA, 22 bp, Homo sapiens
ttcagctagcatctcacttggt

SEQ ID NO: 7220127 - DNA, 17 bp, Homo sapiens
ttcagctactcaacaca

SEQ ID NO: 7220128 - DNA, 22 bp, Homo sapiens
ttcagctataacattgagactt

SEQ ID NO: 7220129 - DNA, 22 bp, Homo sapiens
ttcagctatgcgctttgggcaa

SEQ ID NO: 7220130 - DNA, 22 bp, Homo sapiens
ttcagctatggagtcttagtta

SEQ ID NO: 7220131 - DNA, 22 bp, Homo sapiens
ttcagctattatacccactttt

SEQ ID NO: 7220132 - DNA, 21 bp, Homo sapiens
ttcagctattcagaaggggag

SEQ ID NO: 7220133 - DNA, 22 bp, Homo sapiens
ttcagctcagcactgacaagat

SEQ ID NO: 7220134 - DNA, 22 bp, Homo sapiens
ttcagctcagtctgtgcagcag

SEQ ID NO: 7220135 - DNA, 21 bp, Homo sapiens
ttcagctcggtctggcatgat

SEQ ID NO: 7220136 - DNA, 22 bp, Homo sapiens
ttcagctctagtaagcagacac

SEQ ID NO: 7220137 - DNA, 21 bp, Homo sapiens
ttcagctctgcttcagggaat

SEQ ID NO: 7220138 - DNA, 21 bp, Homo sapiens
ttcagcttatgtgtcacttgc

SEQ ID NO: 7220139 - DNA, 22 bp, Homo sapiens
ttcagcttcatttgtctttatg

SEQ ID NO: 7220140 - DNA, 22 bp, Homo sapiens
ttcaggaaggtcctatagcaga

SEQ ID NO: 7220141 - DNA, 22 bp, Homo sapiens
ttcaggaagcctttcttggtct

SEQ ID NO: 7220142 - DNA, 22 bp, Homo sapiens
ttcaggaaatttgtgtcacagg

SEQ ID NO: 7220143 - DNA, 22 bp, Homo sapiens
ttcaggaagtgctgcctggtgt

SEQ ID NO: 7220144 - DNA, 22 bp, Homo sapiens
ttcaggaataattatcatatga

SEQ ID NO: 7220145 - DNA, 22 bp, Homo sapiens
ttcagcttgaatctggctttga

SEQ ID NO: 7220146 - DNA, 21 bp, Homo sapiens
ttcagcttgctgactgcggca

SEQ ID NO: 7220147 - DNA, 22 bp, Homo sapiens
ttcagcttgctgactgcggcag

SEQ ID NO: 7220148 - DNA, 22 bp, Homo sapiens
ttcagcttggagagaattttta

SEQ ID NO: 7220149 - DNA, 22 bp, Homo sapiens
ttcagcttggagagaattttta

SEQ ID NO: 7220150 - DNA, 22 bp, Homo sapiens
ttcagcttggctgtaggtttta

SEQ ID NO: 7220151 - DNA, 23 bp, Homo sapiens
ttcaggaaatgaatacagacaca

SEQ ID NO: 7220152 - DNA, 22 bp, Homo sapiens
ttcagctttgaggttgattttc

SEQ ID NO: 7220153 - DNA, 22 bp, Homo sapiens
ttcaggaaatgtctgcctacca

SEQ ID NO: 7220154 - DNA, 22 bp, Homo sapiens
ttcaggaaatgtctgcctacca

SEQ ID NO: 7220155 - DNA, 19 bp, Homo sapiens
ttcagcagtgtctgctctt

SEQ ID NO: 7220156 - DNA, 17 bp, Homo sapiens
ttcagcagtgtttctcc

SEQ ID NO: 7220157 - DNA, 22 bp, Homo sapiens
ttcagcagttcctattagatgt

SEQ ID NO: 7220158 - DNA, 22 bp, Homo sapiens
ttcagcatagcagcttcaggac

SEQ ID NO: 7220159 - DNA, 22 bp, Homo sapiens
ttcactgtactgactgtcttat

SEQ ID NO: 7220160 - DNA, 21 bp, Homo sapiens
ttcagcagcatgttgtctgtt

SEQ ID NO: 7220161 - DNA, 22 bp, Homo sapiens
ttcactggtcctttataggaac

SEQ ID NO: 7220162 - DNA, 22 bp, Homo sapiens
ttcactgctacatccaggtgcc

SEQ ID NO: 7220163 - DNA, 22 bp, Homo sapiens
ttcactgctgggtgattgggtt

SEQ ID NO: 7220164 - DNA, 22 bp, Homo sapiens
ttcagcagcttttagtacattg

SEQ ID NO: 7220165 - DNA, 22 bp, Homo sapiens
ttcagcagcttttagtacattg

SEQ ID NO: 7220166 - DNA, 21 bp, Homo sapiens
ttcagcagtcctctagagata

SEQ ID NO: 7220167 - DNA, 22 bp, Homo sapiens
ttcacgaccatcagagcttaga

SEQ ID NO: 7220168 - DNA, 18 bp, Homo sapiens
ttcacctgtcctggcagg

SEQ ID NO: 7220169 - DNA, 19 bp, Homo sapiens
ttcactaattgtaagattt

SEQ ID NO: 7220170 - DNA, 19 bp, Homo sapiens
ttcactaattgtaagattt

SEQ ID NO: 7220171 - DNA, 22 bp, Homo sapiens
ttcactatgcttggaaacttct

SEQ ID NO: 7220172 - DNA, 22 bp, Homo sapiens
ttcactatgcttggaaacttct

SEQ ID NO: 7220173 - DNA, 22 bp, Homo sapiens
ttcactcttcggcatctctgta

SEQ ID NO: 7220174 - DNA, 22 bp, Homo sapiens
ttcactgaagtttcttccatgt

SEQ ID NO: 7220175 - DNA, 22 bp, Homo sapiens
ttcactgaattaatttccttct

SEQ ID NO: 7220176 - DNA, 22 bp, Homo sapiens
ttcactgcagcccatgaaggga

SEQ ID NO: 7220177 - DNA, 22 bp, Homo sapiens
ttcaccatgttggccaggctgg

SEQ ID NO: 7220178 - DNA, 22 bp, Homo sapiens
ttcaccattacatacaaagatg

SEQ ID NO: 7220179 - DNA, 22 bp, Homo sapiens
ttcaccattacatacaaagatg

SEQ ID NO: 7220180 - DNA, 22 bp, Homo sapiens
ttcaccattctaagacattggt

SEQ ID NO: 7220181 - DNA, 22 bp, Homo sapiens
ttcaccatttcccactaaacca

SEQ ID NO: 7220182 - DNA, 22 bp, Homo sapiens
ttcacccactagagaactcagg

SEQ ID NO: 7220183 - DNA, 22 bp, Homo sapiens
ttcaccccaaattcccagtgga

SEQ ID NO: 7220184 - DNA, 22 bp, Homo sapiens
ttcaccccaaattcccagtgga

SEQ ID NO: 7220185 - DNA, 22 bp, Homo sapiens
ttacaaagtttaaggtggcact

SEQ ID NO: 7220186 - DNA, 22 bp, Homo sapiens
ttacaacaaaggcacgtgcatg

SEQ ID NO: 7220187 - DNA, 22 bp, Homo sapiens
ttacaaagtttaaggtggcact

SEQ ID NO: 7220188 - DNA, 22 bp, Homo sapiens
ttacaaagttctgagttcaaac

SEQ ID NO: 7220189 - DNA, 22 bp, Homo sapiens
ttacaaagtgttatgataaaca

SEQ ID NO: 7220190 - DNA, 22 bp, Homo sapiens
ttacaaagtgttatgataaaca

SEQ ID NO: 7220191 - DNA, 22 bp, Homo sapiens
ttacaaagtgttatgataaaca

SEQ ID NO: 7220192 - DNA, 22 bp, Homo sapiens
ttacaaagttctgagttcaaac

SEQ ID NO: 7220193 - DNA, 22 bp, Homo sapiens
ttacaaagtgttatgataaaca

SEQ ID NO: 7220194 - DNA, 22 bp, Homo sapiens
ttacaaagtgttatgataaaca

SEQ ID NO: 7220195 - DNA, 22 bp, Homo sapiens
ttacaaagtgctgcaccatttt

SEQ ID NO: 7220196 - DNA, 22 bp, Homo sapiens
ttacaaaggtagttttgtctat

SEQ ID NO: 7220197 - DNA, 22 bp, Homo sapiens
ttacaaaggtagttttgtctat

SEQ ID NO: 7220198 - DNA, 22 bp, Homo sapiens
ttacaaagagtgccagagtgtg

SEQ ID NO: 7220199 - DNA, 21 bp, Homo sapiens
ttacaaagctacagatgttgc

SEQ ID NO: 7220200 - DNA, 22 bp, Homo sapiens
ttaattaactagccaaccacta

SEQ ID NO: 7220201 - DNA, 22 bp, Homo sapiens
ttaattaaattcatgagcattg

SEQ ID NO: 7220202 - DNA, 22 bp, Homo sapiens
ttaattaaattcatgagcattg

SEQ ID NO: 7220203 - DNA, 22 bp, Homo sapiens
ttaatgttttaagttatagaga

SEQ ID NO: 7220204 - DNA, 22 bp, Homo sapiens
ttaatgttttaagttatagaga

SEQ ID NO: 7220205 - DNA, 22 bp, Homo sapiens
ttaattaaattcatgagcattg

SEQ ID NO: 7220206 - DNA, 22 bp, Homo sapiens
ttaattaattagttaagcatgt

SEQ ID NO: 7220207 - DNA, 22 bp, Homo sapiens
ttacaaagaaaattaggcattt

SEQ ID NO: 7220208 - DNA, 22 bp, Homo sapiens
ttaattaattagttaagcatgt

SEQ ID NO: 7220209 - DNA, 20 bp, Homo sapiens
ttacaaagaggcatcgcttt

SEQ ID NO: 7220210 - DNA, 20 bp, Homo sapiens
ttacaaagaggcatcgcttt

SEQ ID NO: 7220211 - DNA, 22 bp, Homo sapiens
ttacaaagagaagttgtagaat

SEQ ID NO: 7220212 - DNA, 22 bp, Homo sapiens
ttacaaagagaagttgtagaat

SEQ ID NO: 7220213 - DNA, 22 bp, Homo sapiens
ttacaactgaagctaatgtgct

SEQ ID NO: 7220214 - DNA, 22 bp, Homo sapiens
ttacaactgaagctaatgtgct

SEQ ID NO: 7220215 - DNA, 22 bp, Homo sapiens
ttacaagacacagtgctgaagg

SEQ ID NO: 7220216 - DNA, 22 bp, Homo sapiens
ttacaagacactgctgacacag

SEQ ID NO: 7220217 - DNA, 17 bp, Homo sapiens
ttacaacgtcatctctg

SEQ ID NO: 7220218 - DNA, 23 bp, Homo sapiens
ttacaactatttgccatgttgtt

SEQ ID NO: 7220219 - DNA, 21 bp, Homo sapiens
ttacaacatttgtgttctatg

SEQ ID NO: 7220220 - DNA, 22 bp, Homo sapiens
ttacaacatatttagcttgatt

SEQ ID NO: 7220221 - DNA, 22 bp, Homo sapiens
ttacaacatatttagcttgatt

SEQ ID NO: 7220222 - DNA, 22 bp, Homo sapiens
ttacaacatatgataggagtct

SEQ ID NO: 7220223 - DNA, 23 bp, Homo sapiens
ttacaacagtgtccatatttgta

SEQ ID NO: 7220224 - DNA, 23 bp, Homo sapiens
ttacaacagtgtccatatttgta

SEQ ID NO: 7220225 - DNA, 22 bp, Homo sapiens
ttacaacagacacatattctaa

SEQ ID NO: 7220226 - DNA, 22 bp, Homo sapiens
ttacaacactacttatccttga

SEQ ID NO: 7220227 - DNA, 22 bp, Homo sapiens
ttacaacagacacatattctaa

SEQ ID NO: 7220228 - DNA, 17 bp, Homo sapiens
ttacaacaattcatgag

SEQ ID NO: 7220229 - DNA, 17 bp, Homo sapiens
ttacaacaattcatgag

SEQ ID NO: 7220230 - DNA, 17 bp, Homo sapiens
ttacaacaattcatgag

SEQ ID NO: 7220231 - DNA, 22 bp, Homo sapiens
ttacaacaaaggcacgtgcatg

SEQ ID NO: 7220232 - DNA, 22 bp, Homo sapiens
ttaataaagtatgaattggaaa

SEQ ID NO: 7220233 - DNA, 22 bp, Homo sapiens
ttaaagcagtttgtatacatgg

SEQ ID NO: 7220234 - DNA, 22 bp, Homo sapiens
ttaaagcagtttgtatacatgg

SEQ ID NO: 7220235 - DNA, 22 bp, Homo sapiens
ttaaagcactaaatgatgaggg

SEQ ID NO: 7220236 - DNA, 22 bp, Homo sapiens
ttaaagcactaaatgatgaggg

SEQ ID NO: 7220237 - DNA, 22 bp, Homo sapiens
ttaaagcacctccttggatgtg

SEQ ID NO: 7220238 - DNA, 22 bp, Homo sapiens
ttaaagcactaaatgatgaggg

SEQ ID NO: 7220239 - DNA, 22 bp, Homo sapiens
ttaaagcaggcatcattcctca

SEQ ID NO: 7220240 - DNA, 22 bp, Homo sapiens
ttaaagcaggcatcattcctca

SEQ ID NO: 7220241 - DNA, 22 bp, Homo sapiens
ttaaagcagtttgtatacatgg

SEQ ID NO: 7220242 - DNA, 22 bp, Homo sapiens
ttaaagcagtttgtatacatgg

SEQ ID NO: 7220243 - DNA, 22 bp, Homo sapiens
ttaaagcagtttgtatacatgg

SEQ ID NO: 7220244 - DNA, 22 bp, Homo sapiens
ttaaagcagtttgtatacatgg

SEQ ID NO: 7220245 - DNA, 22 bp, Homo sapiens
ttaaagagtttattacttgtaa

SEQ ID NO: 7220246 - DNA, 22 bp, Homo sapiens
ttaaagatgcagctttagagaa

SEQ ID NO: 7220247 - DNA, 22 bp, Homo sapiens
ttaaagatgcagctttagagaa

SEQ ID NO: 7220248 - DNA, 22 bp, Homo sapiens
ttaaagcaaaaactaggatgga

SEQ ID NO: 7220249 - DNA, 22 bp, Homo sapiens
ttaaagcaaaaactaggatgga

SEQ ID NO: 7220250 - DNA, 22 bp, Homo sapiens
ttaaagcaaaaactaggatgga

SEQ ID NO: 7220251 - DNA, 22 bp, Homo sapiens
ttaaagcaaccatcaatttgga

SEQ ID NO: 7220252 - DNA, 22 bp, Homo sapiens
ttaaagcaaccatcaatttgga

SEQ ID NO: 7220253 - DNA, 22 bp, Homo sapiens
ttaaagcaaccatcaatttgga

SEQ ID NO: 7220254 - DNA, 22 bp, Homo sapiens
ttaaagcaaccatcaatttgga

SEQ ID NO: 7220255 - DNA, 22 bp, Homo sapiens
ttaaagcaacctcagccctctt

SEQ ID NO: 7220256 - DNA, 22 bp, Homo sapiens
ttaaagcaagtagaagcctgag

SEQ ID NO: 7220257 - DNA, 22 bp, Homo sapiens
ttaaagcacctccttggatgtg

SEQ ID NO: 7220258 - DNA, 22 bp, Homo sapiens
ttaaagaatagtgcccctattg

SEQ ID NO: 7220259 - DNA, 22 bp, Homo sapiens
ttaaagaatagtgcccctattg

SEQ ID NO: 7220260 - DNA, 22 bp, Homo sapiens
ttaaagacatcacagattacac

SEQ ID NO: 7220261 - DNA, 22 bp, Homo sapiens
ttaaactatagcttgatgtgaa

SEQ ID NO: 7220262 - DNA, 22 bp, Homo sapiens
ttaaactgcagactcagtgttc

SEQ ID NO: 7220263 - DNA, 22 bp, Homo sapiens
ttaaactgcttgaattgggttt

SEQ ID NO: 7220264 - DNA, 22 bp, Homo sapiens
ttaaactgggaaagtcttgggg

SEQ ID NO: 7220265 - DNA, 22 bp, Homo sapiens
ttaaactgggtccctgctggca

SEQ ID NO: 7220266 - DNA, 22 bp, Homo sapiens
ttaaactgggttagactgaatt

SEQ ID NO: 7220267 - DNA, 22 bp, Homo sapiens
ttaaagaggcaggttaaataat

SEQ ID NO: 7220268 - DNA, 22 bp, Homo sapiens
ttaaagaggcaggttaaataat

SEQ ID NO: 7220269 - DNA, 22 bp, Homo sapiens
ttaaagaggcaggttaaataat

SEQ ID NO: 7220270 - DNA, 22 bp, Homo sapiens
ttaaagagtaatcataggtcaa

SEQ ID NO: 7220271 - DNA, 22 bp, Homo sapiens
ttaaagagtctactgcacatcc

SEQ ID NO: 7220272 - DNA, 22 bp, Homo sapiens
ttaaagagtctactgcacatcc

SEQ ID NO: 7220273 - DNA, 22 bp, Homo sapiens
ttaataaagtatgaattggaaa

SEQ ID NO: 7220274 - DNA, 22 bp, Homo sapiens
ttaataaagtatgaattggaaa

SEQ ID NO: 7220275 - DNA, 22 bp, Homo sapiens
ttaataaagtatgaattggaaa

SEQ ID NO: 7220276 - DNA, 22 bp, Homo sapiens
ttaataagtagtagttattgtt

SEQ ID NO: 7220277 - DNA, 22 bp, Homo sapiens
ttaataataatgagcccatttt

SEQ ID NO: 7220278 - DNA, 22 bp, Homo sapiens
ttaataataatgagcccatttt

SEQ ID NO: 7220279 - DNA, 22 bp, Homo sapiens
ttaataataatgagcccatttt

SEQ ID NO: 7220280 - DNA, 22 bp, Homo sapiens
ttaatacaagcatatgcacaca

SEQ ID NO: 7220281 - DNA, 22 bp, Homo sapiens
ttaatacagaagcaagacactg

SEQ ID NO: 7220282 - DNA, 22 bp, Homo sapiens
ttaatacagtctccagaagtaa

SEQ ID NO: 7220283 - DNA, 22 bp, Homo sapiens
ttaatacatttcagactgttat

SEQ ID NO: 7220284 - DNA, 22 bp, Homo sapiens
ttaatgtcaacatttctgaaga

SEQ ID NO: 7220285 - DNA, 21 bp, Homo sapiens
ttaatgctatgcagaaaatct

SEQ ID NO: 7220286 - DNA, 22 bp, Homo sapiens
ttacattcttatctcagttatt

SEQ ID NO: 7220287 - DNA, 22 bp, Homo sapiens
ttacattcttatctcagttatt

SEQ ID NO: 7220288 - DNA, 22 bp, Homo sapiens
ttacattcttggaatcttgttt

SEQ ID NO: 7220289 - DNA, 22 bp, Homo sapiens
ttacattcttggaatcttgttt

SEQ ID NO: 7220290 - DNA, 22 bp, Homo sapiens
ttacattcattgaagtgattca

SEQ ID NO: 7220291 - DNA, 22 bp, Homo sapiens
ttacattcccagtgtgcagcat

SEQ ID NO: 7220292 - DNA, 22 bp, Homo sapiens
ttacattcaaggaactcattct

SEQ ID NO: 7220293 - DNA, 22 bp, Homo sapiens
ttacattcaaggaactcattct

SEQ ID NO: 7220294 - DNA, 22 bp, Homo sapiens
ttacattcaatttctagaggta

SEQ ID NO: 7220295 - DNA, 22 bp, Homo sapiens
ttacattcagaaagatttgagt

SEQ ID NO: 7220296 - DNA, 21 bp, Homo sapiens
ttacattcagaggagtggaag

SEQ ID NO: 7220297 - DNA, 22 bp, Homo sapiens
ttacatttcccccttggaggct

SEQ ID NO: 7220298 - DNA, 22 bp, Homo sapiens
ttacatttcccccttggaggct

SEQ ID NO: 7220299 - DNA, 22 bp, Homo sapiens
ttacatttggctatgtcctcta

SEQ ID NO: 7220300 - DNA, 22 bp, Homo sapiens
ttacatttggctatgtcctcta

SEQ ID NO: 7220301 - DNA, 22 bp, Homo sapiens
ttacatttggctatgtcctcta

SEQ ID NO: 7220302 - DNA, 22 bp, Homo sapiens
ttacattttgcacagatgtccc

SEQ ID NO: 7220303 - DNA, 22 bp, Homo sapiens
ttacattaagccaatggattct

SEQ ID NO: 7220304 - DNA, 22 bp, Homo sapiens
ttacattaagccaatggattct

SEQ ID NO: 7220305 - DNA, 22 bp, Homo sapiens
ttacattagacccactttcatg

SEQ ID NO: 7220306 - DNA, 22 bp, Homo sapiens
ttacattagacccactttcatg

SEQ ID NO: 7220307 - DNA, 22 bp, Homo sapiens
ttacatgtggtgtgaagaagag

SEQ ID NO: 7220308 - DNA, 22 bp, Homo sapiens
ttacatgtaatctaaaataatt

SEQ ID NO: 7220309 - DNA, 21 bp, Homo sapiens
ttacatggtttatcatatgga

SEQ ID NO: 7220310 - DNA, 22 bp, Homo sapiens
ttacatggtaaacactctttta

SEQ ID NO: 7220311 - DNA, 22 bp, Homo sapiens
ttacatggttgttggaaatgct

SEQ ID NO: 7220312 - DNA, 21 bp, Homo sapiens
ttacatggtttatcatatgga

SEQ ID NO: 7220313 - DNA, 22 bp, Homo sapiens
ttacatgggcttgtgagtcctt

SEQ ID NO: 7220314 - DNA, 22 bp, Homo sapiens
ttacatggtaaacactctttta

SEQ ID NO: 7220315 - DNA, 22 bp, Homo sapiens
ttacatgggccatttagacatg

SEQ ID NO: 7220316 - DNA, 22 bp, Homo sapiens
ttacatgccattttgaaatcag

SEQ ID NO: 7220317 - DNA, 22 bp, Homo sapiens
ttacatgctctgtgtgtctccg

SEQ ID NO: 7220318 - DNA, 22 bp, Homo sapiens
ttacatgcttagagatgcatgc

SEQ ID NO: 7220319 - DNA, 22 bp, Homo sapiens
ttacatggatgtaaaaaagtta

SEQ ID NO: 7220320 - DNA, 22 bp, Homo sapiens
ttacatgaggttaattaagcat

SEQ ID NO: 7220321 - DNA, 22 bp, Homo sapiens
ttacatgatgatttcataaaca

SEQ ID NO: 7220322 - DNA, 22 bp, Homo sapiens
ttacatgcagagggaagggaga

SEQ ID NO: 7220323 - DNA, 22 bp, Homo sapiens
ttacatgcaggtcagactgcat

SEQ ID NO: 7220324 - DNA, 22 bp, Homo sapiens
ttacatgcaggtcagactgcat

SEQ ID NO: 7220325 - DNA, 17 bp, Homo sapiens
ttacagcagcaatagag

SEQ ID NO: 7220326 - DNA, 22 bp, Homo sapiens
ttacagcagcagggacagacta

SEQ ID NO: 7220327 - DNA, 22 bp, Homo sapiens
ttacagcagtgggaaggagtca

SEQ ID NO: 7220328 - DNA, 22 bp, Homo sapiens
ttacagcatttaatgagatctg

SEQ ID NO: 7220329 - DNA, 23 bp, Homo sapiens
ttacagctaactgctgttattag

SEQ ID NO: 7220330 - DNA, 23 bp, Homo sapiens
ttacagctaactgctgttattag

SEQ ID NO: 7220331 - DNA, 22 bp, Homo sapiens
ttacagctagccaattatttag

SEQ ID NO: 7220332 - DNA, 22 bp, Homo sapiens
ttacagctagccaattatttag

SEQ ID NO: 7220333 - DNA, 19 bp, Homo sapiens
ttacatgacatatgaagga

SEQ ID NO: 7220334 - DNA, 22 bp, Homo sapiens
ttacatgactcaatagaagggc

SEQ ID NO: 7220335 - DNA, 22 bp, Homo sapiens
ttacatgactgcccttgtcagg

SEQ ID NO: 7220336 - DNA, 22 bp, Homo sapiens
ttacagatcatcaaggtataat

SEQ ID NO: 7220337 - DNA, 22 bp, Homo sapiens
ttacagatcatcaaggtataat

SEQ ID NO: 7220338 - DNA, 22 bp, Homo sapiens
ttacagatggatctagcaaaat

SEQ ID NO: 7220339 - DNA, 22 bp, Homo sapiens
ttacagatggatctagcaaaat

SEQ ID NO: 7220340 - DNA, 22 bp, Homo sapiens
ttacagatggggttgcaataaa

SEQ ID NO: 7220341 - DNA, 22 bp, Homo sapiens
ttacagatggggttgcaataaa

SEQ ID NO: 7220342 - DNA, 22 bp, Homo sapiens
ttacagatgtaggaactgaagt

SEQ ID NO: 7220343 - DNA, 19 bp, Homo sapiens
ttacagatgtggaaattga

SEQ ID NO: 7220344 - DNA, 22 bp, Homo sapiens
ttacagatgtttcaggaatact

SEQ ID NO: 7220345 - DNA, 22 bp, Homo sapiens
ttacagattaaaatgctgaggt

SEQ ID NO: 7220346 - DNA, 22 bp, Homo sapiens
ttacagattaaaatgctgaggt

SEQ ID NO: 7220347 - DNA, 22 bp, Homo sapiens
ttacagcaaagtgcgcagacct

SEQ ID NO: 7220348 - DNA, 21 bp, Homo sapiens
ttacagcaatgttagcaggaa

SEQ ID NO: 7220349 - DNA, 22 bp, Homo sapiens
ttacagcacagtgcttttactg

SEQ ID NO: 7220350 - DNA, 18 bp, Homo sapiens
ttacagcagcaacaggaa

SEQ ID NO: 7220351 - DNA, 17 bp, Homo sapiens
ttacagcagcaatagag

SEQ ID NO: 7220352 - DNA, 22 bp, Homo sapiens
ttacaagcagctacatatcaca

SEQ ID NO: 7220353 - DNA, 22 bp, Homo sapiens
ttacaagattaattattggagt

SEQ ID NO: 7220354 - DNA, 22 bp, Homo sapiens
ttacaagatatgtgagaactag

SEQ ID NO: 7220355 - DNA, 22 bp, Homo sapiens
ttacaagatctttgaaggcaag

SEQ ID NO: 7220356 - DNA, 22 bp, Homo sapiens
ttacaagatctttgaaggcaag

SEQ ID NO: 7220357 - DNA, 22 bp, Homo sapiens
ttacaagatctttgaaggcaag

SEQ ID NO: 7220358 - DNA, 22 bp, Homo sapiens
ttacaagatgggaaagggaagt

SEQ ID NO: 7220359 - DNA, 22 bp, Homo sapiens
ttacaagacagtgtggtaaata

SEQ ID NO: 7220360 - DNA, 22 bp, Homo sapiens
ttacaagacagtgtggtaaata

SEQ ID NO: 7220361 - DNA, 22 bp, Homo sapiens
ttacaagacagtgtggtaaata

SEQ ID NO: 7220362 - DNA, 22 bp, Homo sapiens
ttacaagacagtgtggtaaata

SEQ ID NO: 7220363 - DNA, 22 bp, Homo sapiens
ttacaagataacctgatgctgt

SEQ ID NO: 7220364 - DNA, 22 bp, Homo sapiens
ttacaagataacctgatgctgt

SEQ ID NO: 7220365 - DNA, 22 bp, Homo sapiens
ttacaagataacggagaaagca

SEQ ID NO: 7220366 - DNA, 22 bp, Homo sapiens
ttacaagatatgtgagaactag

SEQ ID NO: 7220367 - DNA, 22 bp, Homo sapiens
ttacaagatatgtgagaactag

SEQ ID NO: 7220368 - DNA, 22 bp, Homo sapiens
ttacaaggaggatagcatttcc

SEQ ID NO: 7220369 - DNA, 22 bp, Homo sapiens
ttacaagggtcagtgtgtttgt

SEQ ID NO: 7220370 - DNA, 22 bp, Homo sapiens
ttacaaggtaagttgttaagtc

SEQ ID NO: 7220371 - DNA, 19 bp, Homo sapiens
ttacaagcattgaaagaaa

SEQ ID NO: 7220372 - DNA, 20 bp, Homo sapiens
ttacaagccttgttaaatct

SEQ ID NO: 7220373 - DNA, 22 bp, Homo sapiens
ttacaagctaattgtttcagct

SEQ ID NO: 7220374 - DNA, 20 bp, Homo sapiens
ttacaaggtagaggagggaa

SEQ ID NO: 7220375 - DNA, 22 bp, Homo sapiens
ttacaagtactgaatatgattt

SEQ ID NO: 7220376 - DNA, 22 bp, Homo sapiens
ttacaatgatgggattcagcca

SEQ ID NO: 7220377 - DNA, 22 bp, Homo sapiens
ttacaatgcactcacctttaga

SEQ ID NO: 7220378 - DNA, 22 bp, Homo sapiens
ttacaatgcactcacctttaga

SEQ ID NO: 7220379 - DNA, 22 bp, Homo sapiens
ttacaatgggagcccttggact

SEQ ID NO: 7220380 - DNA, 22 bp, Homo sapiens
ttacaatgggtatacttccatt

SEQ ID NO: 7220381 - DNA, 22 bp, Homo sapiens
ttacaatgggtatacttccatt

SEQ ID NO: 7220382 - DNA, 22 bp, Homo sapiens
ttacaatgggtatacttccatt

SEQ ID NO: 7220383 - DNA, 19 bp, Homo sapiens
ttacaatggtgattaggtt

SEQ ID NO: 7220384 - DNA, 19 bp, Homo sapiens
ttacaatggtgattaggtt

SEQ ID NO: 7220385 - DNA, 22 bp, Homo sapiens
ttacaatgtaaggcatggttct

SEQ ID NO: 7220386 - DNA, 22 bp, Homo sapiens
ttacaattgagtctattgtatg

SEQ ID NO: 7220387 - DNA, 22 bp, Homo sapiens
ttacagatactttgtaggcaag

SEQ ID NO: 7220388 - DNA, 22 bp, Homo sapiens
ttacagatactttgtaggcaag

SEQ ID NO: 7220389 - DNA, 22 bp, Homo sapiens
ttacagaggtatgtatgtctct

SEQ ID NO: 7220390 - DNA, 22 bp, Homo sapiens
ttacagagtggtctggctatgt

SEQ ID NO: 7220391 - DNA, 22 bp, Homo sapiens
ttacagagttcgcacctggtgg

SEQ ID NO: 7220392 - DNA, 22 bp, Homo sapiens
ttacagagataaactgtaagtg

SEQ ID NO: 7220393 - DNA, 22 bp, Homo sapiens
ttacagagataaactgtaagtg

SEQ ID NO: 7220394 - DNA, 22 bp, Homo sapiens
ttacagagcctcattttagaga

SEQ ID NO: 7220395 - DNA, 22 bp, Homo sapiens
ttacagagggcttctctgaact

SEQ ID NO: 7220396 - DNA, 17 bp, Homo sapiens
ttacagaggtaattaag

SEQ ID NO: 7220397 - DNA, 22 bp, Homo sapiens
ttacagagggcttctctgaact

SEQ ID NO: 7220398 - DNA, 22 bp, Homo sapiens
ttacacaaaaataagatatggc

SEQ ID NO: 7220399 - DNA, 22 bp, Homo sapiens
ttacacaaaaataagatatggc

SEQ ID NO: 7220400 - DNA, 22 bp, Homo sapiens
ttacacaaaaataagatatggc

SEQ ID NO: 7220401 - DNA, 22 bp, Homo sapiens
ttacacaaaaataagatatggc

SEQ ID NO: 7220402 - DNA, 22 bp, Homo sapiens
ttacacaaaaataagatatggc

SEQ ID NO: 7220403 - DNA, 22 bp, Homo sapiens
ttacagaaaagggctttaagag

SEQ ID NO: 7220404 - DNA, 22 bp, Homo sapiens
ttacacttttgacaaacctgag

SEQ ID NO: 7220405 - DNA, 22 bp, Homo sapiens
ttacacaaaagcaagtgtgtgt

SEQ ID NO: 7220406 - DNA, 22 bp, Homo sapiens
ttacacaaaagcaagtgtgtgt

SEQ ID NO: 7220407 - DNA, 22 bp, Homo sapiens
ttacacaaacacattccagata

SEQ ID NO: 7220408 - DNA, 22 bp, Homo sapiens
ttacacaaacacattccagata

SEQ ID NO: 7220409 - DNA, 22 bp, Homo sapiens
ttacagaatgtgccatttggtc

SEQ ID NO: 7220410 - DNA, 22 bp, Homo sapiens
ttacagaatctactcgtggtga

SEQ ID NO: 7220411 - DNA, 22 bp, Homo sapiens
ttacagaatctactcgtggtga

SEQ ID NO: 7220412 - DNA, 22 bp, Homo sapiens
ttacagaatgtgccatttggtc

SEQ ID NO: 7220413 - DNA, 22 bp, Homo sapiens
ttacagaatgtgccatttggtc

SEQ ID NO: 7220414 - DNA, 22 bp, Homo sapiens
ttacagaatgttcttccaacag

SEQ ID NO: 7220415 - DNA, 22 bp, Homo sapiens
ttacagaatgttcttccaacag

SEQ ID NO: 7220416 - DNA, 22 bp, Homo sapiens
ttacagaatgttcttccaacag

SEQ ID NO: 7220417 - DNA, 22 bp, Homo sapiens
ttacagaaaatgtgttttaact

SEQ ID NO: 7220418 - DNA, 22 bp, Homo sapiens
ttacagaaaaggggttgtcctt

SEQ ID NO: 7220419 - DNA, 22 bp, Homo sapiens
ttacagaaaatgtgttttaact

SEQ ID NO: 7220420 - DNA, 22 bp, Homo sapiens
ttacagaaaatgtgttttaact

SEQ ID NO: 7220421 - DNA, 22 bp, Homo sapiens
ttacagaatctactcgtggtga

SEQ ID NO: 7220422 - DNA, 22 bp, Homo sapiens
ttacagaaaagggctttaagag

SEQ ID NO: 7220423 - DNA, 22 bp, Homo sapiens
ttacagaaaaggggttgtcctt

SEQ ID NO: 7220424 - DNA, 22 bp, Homo sapiens
ttacagaaaaggggttgtcctt

SEQ ID NO: 7220425 - DNA, 22 bp, Homo sapiens
ttattcatcagtgcattaattt

SEQ ID NO: 7220426 - DNA, 22 bp, Homo sapiens
ttattcatcagtgcattaattt

SEQ ID NO: 7220427 - DNA, 22 bp, Homo sapiens
ttattcatcagtgcattaattt

SEQ ID NO: 7220428 - DNA, 22 bp, Homo sapiens
ttattattgattcgctctcaaa

SEQ ID NO: 7220429 - DNA, 22 bp, Homo sapiens
ttattcagtgcctttgaaagaa

SEQ ID NO: 7220430 - DNA, 22 bp, Homo sapiens
ttattcagtgcatatattaaaa

SEQ ID NO: 7220431 - DNA, 22 bp, Homo sapiens
ttattccattcagttcaacaag

SEQ ID NO: 7220432 - DNA, 22 bp, Homo sapiens
ttattccattcagttcaacaag

SEQ ID NO: 7220433 - DNA, 22 bp, Homo sapiens
ttattccattcagttcaacaag

SEQ ID NO: 7220434 - DNA, 22 bp, Homo sapiens
ttattcctgccttaggtggctg

SEQ ID NO: 7220435 - DNA, 22 bp, Homo sapiens
ttattctcatctccctacttag

SEQ ID NO: 7220436 - DNA, 22 bp, Homo sapiens
ttattctgagagttgaagtaat

SEQ ID NO: 7220437 - DNA, 22 bp, Homo sapiens
ttattctgagagttgaagtaat

SEQ ID NO: 7220438 - DNA, 22 bp, Homo sapiens
ttatttcctaaatctctttgtt

SEQ ID NO: 7220439 - DNA, 22 bp, Homo sapiens
ttatttcctaaatctctttgtt

SEQ ID NO: 7220440 - DNA, 22 bp, Homo sapiens
ttatttccctgagggttgcagg

SEQ ID NO: 7220441 - DNA, 20 bp, Homo sapiens
ttatttccagtccaggtcct

SEQ ID NO: 7220442 - DNA, 22 bp, Homo sapiens
ttatttccagtccagaaattta

SEQ ID NO: 7220443 - DNA, 22 bp, Homo sapiens
ttatttccacaatgtggtaggg

SEQ ID NO: 7220444 - DNA, 22 bp, Homo sapiens
ttatttccaaactggatatacc

SEQ ID NO: 7220445 - DNA, 22 bp, Homo sapiens
ttatttcattgatttctaagac

SEQ ID NO: 7220446 - DNA, 22 bp, Homo sapiens
ttatttcattgatttctaagac

SEQ ID NO: 7220447 - DNA, 22 bp, Homo sapiens
ttatttcattgatttctaagac

SEQ ID NO: 7220448 - DNA, 22 bp, Homo sapiens
ttatttatgttaacagtcgaga

SEQ ID NO: 7220449 - DNA, 22 bp, Homo sapiens
ttatttatgttaacagtcgaga

SEQ ID NO: 7220450 - DNA, 22 bp, Homo sapiens
ttatttatgttaacagtcgaga

SEQ ID NO: 7220451 - DNA, 22 bp, Homo sapiens
ttatttatggccctcacctgat

SEQ ID NO: 7220452 - DNA, 22 bp, Homo sapiens
ttatttatggccctcacctgat

SEQ ID NO: 7220453 - DNA, 22 bp, Homo sapiens
ttatttatggccctcacctgat

SEQ ID NO: 7220454 - DNA, 22 bp, Homo sapiens
ttattcttggatctgagtctct

SEQ ID NO: 7220455 - DNA, 22 bp, Homo sapiens
ttattcttggatctgagtctct

SEQ ID NO: 7220456 - DNA, 22 bp, Homo sapiens
ttattcttggatctgagtctct

SEQ ID NO: 7220457 - DNA, 22 bp, Homo sapiens
ttattctttaaacatatatgtt

SEQ ID NO: 7220458 - DNA, 22 bp, Homo sapiens
ttattctttaaacatatatgtt

SEQ ID NO: 7220459 - DNA, 22 bp, Homo sapiens
ttattcttggatctgagtctct

SEQ ID NO: 7220460 - DNA, 22 bp, Homo sapiens
ttattcttggatctgagtctct

SEQ ID NO: 7220461 - DNA, 22 bp, Homo sapiens
ttattcttggatctgagtctct

SEQ ID NO: 7220462 - DNA, 18 bp, Homo sapiens
ttattcttccaggccacc

SEQ ID NO: 7220463 - DNA, 22 bp, Homo sapiens
ttattcttcttctcttgccagg

SEQ ID NO: 7220464 - DNA, 22 bp, Homo sapiens
ttattctgttgcttttacagta

SEQ ID NO: 7220465 - DNA, 19 bp, Homo sapiens
ttattcttaaagtagctta

SEQ ID NO: 7220466 - DNA, 19 bp, Homo sapiens
ttattcttaaagtagctta

SEQ ID NO: 7220467 - DNA, 22 bp, Homo sapiens
ttattctggaggaagcaaatgg

SEQ ID NO: 7220468 - DNA, 22 bp, Homo sapiens
ttattctgttgcttttacagta

SEQ ID NO: 7220469 - DNA, 22 bp, Homo sapiens
ttatgcaaagaaatagactaat

SEQ ID NO: 7220470 - DNA, 18 bp, Homo sapiens
ttatgcaaaactgttttc

SEQ ID NO: 7220471 - DNA, 22 bp, Homo sapiens
ttattattccccaagtcattat

SEQ ID NO: 7220472 - DNA, 22 bp, Homo sapiens
ttattattccccaagtcattat

SEQ ID NO: 7220473 - DNA, 22 bp, Homo sapiens
ttatgatttagaaagattcact

SEQ ID NO: 7220474 - DNA, 22 bp, Homo sapiens
ttatgatttgccacagattggt

SEQ ID NO: 7220475 - DNA, 22 bp, Homo sapiens
ttatgatttgccacagattggt

SEQ ID NO: 7220476 - DNA, 22 bp, Homo sapiens
ttatgagactgttttacacact

SEQ ID NO: 7220477 - DNA, 22 bp, Homo sapiens
ttatgagctaagttgtggcccc

SEQ ID NO: 7220478 - DNA, 22 bp, Homo sapiens
ttatgatttagaaagattcact

SEQ ID NO: 7220479 - DNA, 22 bp, Homo sapiens
ttatgacatatgagtacaagta

SEQ ID NO: 7220480 - DNA, 19 bp, Homo sapiens
ttatgaatagcttcatcca

SEQ ID NO: 7220481 - DNA, 22 bp, Homo sapiens
ttatgaagttcctgttacagtg

SEQ ID NO: 7220482 - DNA, 22 bp, Homo sapiens
ttatgacaggaaaatcacagaa

SEQ ID NO: 7220483 - DNA, 22 bp, Homo sapiens
ttatgaaagacatttctgttgg

SEQ ID NO: 7220484 - DNA, 22 bp, Homo sapiens
ttatgaaagacatttctgttgg

SEQ ID NO: 7220485 - DNA, 22 bp, Homo sapiens
ttatcttggtgttttagtaatt

SEQ ID NO: 7220486 - DNA, 22 bp, Homo sapiens
ttatcttggcaattctaaggta

SEQ ID NO: 7220487 - DNA, 22 bp, Homo sapiens
ttatcttgggtaactttgtgca

SEQ ID NO: 7220488 - DNA, 22 bp, Homo sapiens
ttatcttggcaattctaaggta

SEQ ID NO: 7220489 - DNA, 22 bp, Homo sapiens
ttatcttggcaattctaaggta

SEQ ID NO: 7220490 - DNA, 22 bp, Homo sapiens
ttatcttgggtaactttgtgca

SEQ ID NO: 7220491 - DNA, 22 bp, Homo sapiens
ttatcttagaggtgattgtatt

SEQ ID NO: 7220492 - DNA, 22 bp, Homo sapiens
ttatcttgagtattgagattct

SEQ ID NO: 7220493 - DNA, 17 bp, Homo sapiens
ttatcttgctgtttcta

SEQ ID NO: 7220494 - DNA, 17 bp, Homo sapiens
ttatcttgctgtttcta

SEQ ID NO: 7220495 - DNA, 22 bp, Homo sapiens
ttatgaaaacaatcagtaggca

SEQ ID NO: 7220496 - DNA, 22 bp, Homo sapiens
ttatgaaagacatttctgttgg

SEQ ID NO: 7220497 - DNA, 22 bp, Homo sapiens
ttatcttggtgttttagtaatt

SEQ ID NO: 7220498 - DNA, 22 bp, Homo sapiens
ttatcttgtagagatattttcg

SEQ ID NO: 7220499 - DNA, 22 bp, Homo sapiens
ttatcttgtagagatattttcg

SEQ ID NO: 7220500 - DNA, 22 bp, Homo sapiens
ttatgaaaacaatcagtaggca

SEQ ID NO: 7220501 - DNA, 22 bp, Homo sapiens
ttatattagttagacttgctgt

SEQ ID NO: 7220502 - DNA, 22 bp, Homo sapiens
ttatctgaaacttttgggacca

SEQ ID NO: 7220503 - DNA, 22 bp, Homo sapiens
ttatctgaaacttttgggacca

SEQ ID NO: 7220504 - DNA, 22 bp, Homo sapiens
ttatctggtatagtggggaaga

SEQ ID NO: 7220505 - DNA, 22 bp, Homo sapiens
ttatctggtatagtggggaaga

SEQ ID NO: 7220506 - DNA, 22 bp, Homo sapiens
ttatatgtatgcttataaacca

SEQ ID NO: 7220507 - DNA, 22 bp, Homo sapiens
ttatatgtttctgtttggaggc

SEQ ID NO: 7220508 - DNA, 22 bp, Homo sapiens
ttatatgtttctgtttggaggc

SEQ ID NO: 7220509 - DNA, 22 bp, Homo sapiens
ttatatgtatgcttataaacca

SEQ ID NO: 7220510 - DNA, 22 bp, Homo sapiens
ttatatgtatgcttataaacca

SEQ ID NO: 7220511 - DNA, 22 bp, Homo sapiens
ttagtgctcacgtgttagaaag

SEQ ID NO: 7220512 - DNA, 22 bp, Homo sapiens
ttatatgattgagcatcttggt

SEQ ID NO: 7220513 - DNA, 22 bp, Homo sapiens
ttatatgattgagcatcttggt

SEQ ID NO: 7220514 - DNA, 22 bp, Homo sapiens
ttatcttagaggtgattgtatt

SEQ ID NO: 7220515 - DNA, 22 bp, Homo sapiens
ttatctgtttaacaaagtatct

SEQ ID NO: 7220516 - DNA, 22 bp, Homo sapiens
ttatctgttgttttagtacaat

SEQ ID NO: 7220517 - DNA, 19 bp, Homo sapiens
ttatctgtgttgcagtggt

SEQ ID NO: 7220518 - DNA, 19 bp, Homo sapiens
ttatctgtgttgcagtggt

SEQ ID NO: 7220519 - DNA, 22 bp, Homo sapiens
ttatctgtgatcctaaatgtct

SEQ ID NO: 7220520 - DNA, 22 bp, Homo sapiens
ttatctgtgatcctaaatgtct

SEQ ID NO: 7220521 - DNA, 22 bp, Homo sapiens
ttatctgtctatcaagactagc

SEQ ID NO: 7220522 - DNA, 20 bp, Homo sapiens
ttatctgtcaatctgtctca

SEQ ID NO: 7220523 - DNA, 20 bp, Homo sapiens
ttatctgtcaatctgtctca

SEQ ID NO: 7220524 - DNA, 22 bp, Homo sapiens
ttatctggtatagtggggaaga

SEQ ID NO: 7220525 - DNA, 20 bp, Homo sapiens
ttatctgtcaatctgtctca

SEQ ID NO: 7220526 - DNA, 22 bp, Homo sapiens
ttagtcacatgcccatctctga

SEQ ID NO: 7220527 - DNA, 22 bp, Homo sapiens
ttagtcacttcttccttcatca

SEQ ID NO: 7220528 - DNA, 20 bp, Homo sapiens
ttagtcagctccttgtgtga

SEQ ID NO: 7220529 - DNA, 22 bp, Homo sapiens
ttagtctctttgcattgccata

SEQ ID NO: 7220530 - DNA, 22 bp, Homo sapiens
ttagtcttcttccttatatgtt

SEQ ID NO: 7220531 - DNA, 22 bp, Homo sapiens
ttagtcttggtgagtcttggtt

SEQ ID NO: 7220532 - DNA, 22 bp, Homo sapiens
ttagtagtaagagtcatatgta

SEQ ID NO: 7220533 - DNA, 22 bp, Homo sapiens
ttagtagtaagagtcatatgta

SEQ ID NO: 7220534 - DNA, 22 bp, Homo sapiens
ttagtagtgatgttatttcaag

SEQ ID NO: 7220535 - DNA, 18 bp, Homo sapiens
ttagtataactgcctgtg

SEQ ID NO: 7220536 - DNA, 22 bp, Homo sapiens
ttagtatctggaaatcacatta

SEQ ID NO: 7220537 - DNA, 22 bp, Homo sapiens
ttagtatctggaaatcacatta

SEQ ID NO: 7220538 - DNA, 22 bp, Homo sapiens
ttagtattaggatcatatttga

SEQ ID NO: 7220539 - DNA, 22 bp, Homo sapiens
ttagtcaaatcattctgtttct

SEQ ID NO: 7220540 - DNA, 22 bp, Homo sapiens
ttagtgattacagatatataaa

SEQ ID NO: 7220541 - DNA, 22 bp, Homo sapiens
ttagtgattactacatagatga

SEQ ID NO: 7220542 - DNA, 22 bp, Homo sapiens
ttagtgattctcttttgaattt

SEQ ID NO: 7220543 - DNA, 22 bp, Homo sapiens
ttagtgatgactagacttttgt

SEQ ID NO: 7220544 - DNA, 22 bp, Homo sapiens
ttagtgatgaagaattactagg

SEQ ID NO: 7220545 - DNA, 22 bp, Homo sapiens
ttagtgaaagtaatacaaagta

SEQ ID NO: 7220546 - DNA, 22 bp, Homo sapiens
ttagtgataggactttaaagcc

SEQ ID NO: 7220547 - DNA, 22 bp, Homo sapiens
ttagaacttaagaatactgtct

SEQ ID NO: 7220548 - DNA, 22 bp, Homo sapiens
ttagaagcactaattactcaca

SEQ ID NO: 7220549 - DNA, 22 bp, Homo sapiens
ttagataatgttattgtaattt

SEQ ID NO: 7220550 - DNA, 22 bp, Homo sapiens
ttagatcattttagctaaatgg

SEQ ID NO: 7220551 - DNA, 22 bp, Homo sapiens
ttagatcattttagctaaatgg

SEQ ID NO: 7220552 - DNA, 22 bp, Homo sapiens
ttagatcattttgaactaattt

SEQ ID NO: 7220553 - DNA, 22 bp, Homo sapiens
ttagatcaatagttctcaactc

SEQ ID NO: 7220554 - DNA, 22 bp, Homo sapiens
ttagatcatagtgtatatactg

SEQ ID NO: 7220555 - DNA, 22 bp, Homo sapiens
ttagatatgtttttgctaatgc

SEQ ID NO: 7220556 - DNA, 22 bp, Homo sapiens
ttagaacttaaacttcagaaag

SEQ ID NO: 7220557 - DNA, 22 bp, Homo sapiens
ttagaactgaagaagattaagg

SEQ ID NO: 7220558 - DNA, 22 bp, Homo sapiens
ttagaaccataatgaatcaatg

SEQ ID NO: 7220559 - DNA, 22 bp, Homo sapiens
ttagaaccataatgaatcaatg

SEQ ID NO: 7220560 - DNA, 22 bp, Homo sapiens
ttagaaccagcatttgtcctgg

SEQ ID NO: 7220561 - DNA, 22 bp, Homo sapiens
ttagaaccagggttacgattct

SEQ ID NO: 7220562 - DNA, 19 bp, Homo sapiens
ttagaacatcctctaggga

SEQ ID NO: 7220563 - DNA, 22 bp, Homo sapiens
ttagaacatctctcttctgcca

SEQ ID NO: 7220564 - DNA, 22 bp, Homo sapiens
ttagaacatttttagaccaata

SEQ ID NO: 7220565 - DNA, 22 bp, Homo sapiens
ttagaaccacctggagagcttt

SEQ ID NO: 7220566 - DNA, 22 bp, Homo sapiens
ttagaaccactgaagactcaca

SEQ ID NO: 7220567 - DNA, 22 bp, Homo sapiens
ttagaacatagcaacagaatta

SEQ ID NO: 7220568 - DNA, 22 bp, Homo sapiens
ttagaacatagcaacagaatta

SEQ ID NO: 7220569 - DNA, 22 bp, Homo sapiens
ttagaacactgagaaagtgatg

SEQ ID NO: 7220570 - DNA, 22 bp, Homo sapiens
ttagaacagtagaagaaagggt

SEQ ID NO: 7220571 - DNA, 22 bp, Homo sapiens
ttagaaatgtcacagatctgat

SEQ ID NO: 7220572 - DNA, 22 bp, Homo sapiens
ttagaaatgtcacagatctgat

SEQ ID NO: 7220573 - DNA, 22 bp, Homo sapiens
ttagaaatgcacccaagaccta

SEQ ID NO: 7220574 - DNA, 22 bp, Homo sapiens
ttagaaatgtcacagatctgat

SEQ ID NO: 7220575 - DNA, 22 bp, Homo sapiens
ttagaaatgtcacagatctgat

SEQ ID NO: 7220576 - DNA, 22 bp, Homo sapiens
ttagaacaaagccaccaggtga

SEQ ID NO: 7220577 - DNA, 21 bp, Homo sapiens
ttagaacaatatttggtatag

SEQ ID NO: 7220578 - DNA, 21 bp, Homo sapiens
ttagaacaatatttggtatag

SEQ ID NO: 7220579 - DNA, 22 bp, Homo sapiens
ttagaacaccattctatattac

SEQ ID NO: 7220580 - DNA, 22 bp, Homo sapiens
ttagaaatcacctctgaagatc

SEQ ID NO: 7220581 - DNA, 22 bp, Homo sapiens
ttagaaatatggtgctgccgcc

SEQ ID NO: 7220582 - DNA, 22 bp, Homo sapiens
ttagaaatctgctgccatgcaa

SEQ ID NO: 7220583 - DNA, 22 bp, Homo sapiens
ttagaaatgatttcacctcttt

SEQ ID NO: 7220584 - DNA, 22 bp, Homo sapiens
ttagaaatgatttcacctcttt

SEQ ID NO: 7220585 - DNA, 22 bp, Homo sapiens
ttagaaaggttttgctctgaaa

SEQ ID NO: 7220586 - DNA, 22 bp, Homo sapiens
ttagaaaggggtgaatcaatgg

SEQ ID NO: 7220587 - DNA, 22 bp, Homo sapiens
ttagaaatacaagtgaggttga

SEQ ID NO: 7220588 - DNA, 22 bp, Homo sapiens
ttacattttgcacagatgtccc

SEQ ID NO: 7220589 - DNA, 22 bp, Homo sapiens
ttacattttgcacagatgtccc

SEQ ID NO: 7220590 - DNA, 22 bp, Homo sapiens
ttacattttggggtaaggataa

SEQ ID NO: 7220591 - DNA, 22 bp, Homo sapiens
ttacattttggggtaaggataa

SEQ ID NO: 7220592 - DNA, 22 bp, Homo sapiens
ttacattttggggtaaggataa

SEQ ID NO: 7220593 - DNA, 22 bp, Homo sapiens
ttagaaaggaatcttcatttca

SEQ ID NO: 7220594 - DNA, 22 bp, Homo sapiens
ttagaaaggagcttatttcttt

SEQ ID NO: 7220595 - DNA, 22 bp, Homo sapiens
ttagaaaggagcttatttcttt

SEQ ID NO: 7220596 - DNA, 22 bp, Homo sapiens
ttagtacagaatcaaaagcaat

SEQ ID NO: 7220597 - DNA, 22 bp, Homo sapiens
ttagtacaagagattaattact

SEQ ID NO: 7220598 - DNA, 22 bp, Homo sapiens
ttagtacaagagattaattact

SEQ ID NO: 7220599 - DNA, 22 bp, Homo sapiens
ttagtacaagagattaattact

SEQ ID NO: 7220600 - DNA, 22 bp, Homo sapiens
ttagtaattagaaagtaattct

SEQ ID NO: 7220601 - DNA, 22 bp, Homo sapiens
ttagtaatgtgttaatatgaat

SEQ ID NO: 7220602 - DNA, 22 bp, Homo sapiens
ttagtaatgtgttaatatgaat

SEQ ID NO: 7220603 - DNA, 22 bp, Homo sapiens
ttagtaagcactcacacattcc

SEQ ID NO: 7220604 - DNA, 22 bp, Homo sapiens
ttagtacatagatgatggttga

SEQ ID NO: 7220605 - DNA, 22 bp, Homo sapiens
ttagtacattgattcattatgt

SEQ ID NO: 7220606 - DNA, 22 bp, Homo sapiens
ttagtacattgattcattatgt

SEQ ID NO: 7220607 - DNA, 22 bp, Homo sapiens
ttagtacattgattcattatgt

SEQ ID NO: 7220608 - DNA, 22 bp, Homo sapiens
ttagtacattgattcattatgt

SEQ ID NO: 7220609 - DNA, 22 bp, Homo sapiens
ttagtagagagtcatgttttta

SEQ ID NO: 7220610 - DNA, 22 bp, Homo sapiens
ttagtagattgtgatcagtact

SEQ ID NO: 7220611 - DNA, 22 bp, Homo sapiens
ttaggtaagtaggatcaaaaaa

SEQ ID NO: 7220612 - DNA, 22 bp, Homo sapiens
ttaggtaaggatggtgacagta

SEQ ID NO: 7220613 - DNA, 19 bp, Homo sapiens
ttaggtattattgctttcc

SEQ ID NO: 7220614 - DNA, 22 bp, Homo sapiens
ttaggtaaggatggtgacagta

SEQ ID NO: 7220615 - DNA, 22 bp, Homo sapiens
ttaggtattcatttacatgttc

SEQ ID NO: 7220616 - DNA, 22 bp, Homo sapiens
ttaggtattttgttatgtcagc

SEQ ID NO: 7220617 - DNA, 22 bp, Homo sapiens
ttaggtgtgacattttgttcct

SEQ ID NO: 7220618 - DNA, 22 bp, Homo sapiens
ttagtaaataaagtctactttc

SEQ ID NO: 7220619 - DNA, 22 bp, Homo sapiens
ttagtaaataaagtctactttc

SEQ ID NO: 7220620 - DNA, 22 bp, Homo sapiens
ttagtaaataaagtctactttc

SEQ ID NO: 7220621 - DNA, 19 bp, Homo sapiens
ttaggggtatgaagtggta

SEQ ID NO: 7220622 - DNA, 22 bp, Homo sapiens
ttagggcttttctgaataggcc

SEQ ID NO: 7220623 - DNA, 22 bp, Homo sapiens
ttagggcaaagtttcaacagtt

SEQ ID NO: 7220624 - DNA, 22 bp, Homo sapiens
ttagggttacaccagcctcctg

SEQ ID NO: 7220625 - DNA, 22 bp, Homo sapiens
ttagggagctcagtcctcagat

SEQ ID NO: 7220626 - DNA, 22 bp, Homo sapiens
ttagggagctcagtcctcagat

SEQ ID NO: 7220627 - DNA, 22 bp, Homo sapiens
ttagggaagtgttattctcagg

SEQ ID NO: 7220628 - DNA, 22 bp, Homo sapiens
ttagggaagtgttattctcagg

SEQ ID NO: 7220629 - DNA, 22 bp, Homo sapiens
ttaggaagcaggcctaaaattt

SEQ ID NO: 7220630 - DNA, 22 bp, Homo sapiens
ttagggaaatatttatatactt

SEQ ID NO: 7220631 - DNA, 22 bp, Homo sapiens
ttagcatttcagtacacatgtt

SEQ ID NO: 7220632 - DNA, 22 bp, Homo sapiens
ttagcatttcagtacacatgtt

SEQ ID NO: 7220633 - DNA, 22 bp, Homo sapiens
ttagcatttcatttcaagagga

SEQ ID NO: 7220634 - DNA, 22 bp, Homo sapiens
ttagcatttcagtacacatgtt

SEQ ID NO: 7220635 - DNA, 22 bp, Homo sapiens
ttagcattgtacatttgtgctt

SEQ ID NO: 7220636 - DNA, 22 bp, Homo sapiens
ttagcatttctggaatcacaag

SEQ ID NO: 7220637 - DNA, 22 bp, Homo sapiens
ttagcattttctgggctgaaat

SEQ ID NO: 7220638 - DNA, 22 bp, Homo sapiens
ttaggaagaaggaggcagtatt

SEQ ID NO: 7220639 - DNA, 22 bp, Homo sapiens
ttaggaagaatatatttagagc

SEQ ID NO: 7220640 - DNA, 22 bp, Homo sapiens
ttaggaagaatatatttagagc

SEQ ID NO: 7220641 - DNA, 22 bp, Homo sapiens
ttaggaagagctttcaatcact

SEQ ID NO: 7220642 - DNA, 22 bp, Homo sapiens
ttaggaagagctttcaatcact

SEQ ID NO: 7220643 - DNA, 22 bp, Homo sapiens
ttaggaagatgctttttctggg

SEQ ID NO: 7220644 - DNA, 22 bp, Homo sapiens
ttaggaagcacacagtaaatat

SEQ ID NO: 7220645 - DNA, 22 bp, Homo sapiens
ttagatgactgaaaagagcaca

SEQ ID NO: 7220646 - DNA, 22 bp, Homo sapiens
ttagatttatatgtgagaatgg

SEQ ID NO: 7220647 - DNA, 22 bp, Homo sapiens
ttagatttatatgtgagaatgg

SEQ ID NO: 7220648 - DNA, 22 bp, Homo sapiens
ttagatttatatgtgagaatgg

SEQ ID NO: 7220649 - DNA, 22 bp, Homo sapiens
ttagatttatatgtgagaatgg

SEQ ID NO: 7220650 - DNA, 22 bp, Homo sapiens
ttagattattgagcatccactg

SEQ ID NO: 7220651 - DNA, 22 bp, Homo sapiens
ttagatttacaagcactgttta

SEQ ID NO: 7220652 - DNA, 22 bp, Homo sapiens
ttagatttacaagcactgttta

SEQ ID NO: 7220653 - DNA, 22 bp, Homo sapiens
ttagcaaacctggactacagat

SEQ ID NO: 7220654 - DNA, 22 bp, Homo sapiens
ttagcaaacccttgctggtgag

SEQ ID NO: 7220655 - DNA, 22 bp, Homo sapiens
ttagcaaacctggactacagat

SEQ ID NO: 7220656 - DNA, 22 bp, Homo sapiens
ttagcaaacatcttcgtgtgag

SEQ ID NO: 7220657 - DNA, 22 bp, Homo sapiens
ttagcaaacccttgctggtgag

SEQ ID NO: 7220658 - DNA, 22 bp, Homo sapiens
ttagcaaacccttgctggtgag

SEQ ID NO: 7220659 - DNA, 22 bp, Homo sapiens
ttagcaaacaaatgaaatggtt

SEQ ID NO: 7220660 - DNA, 22 bp, Homo sapiens
ttagcaaacaaatgaaatggtt

SEQ ID NO: 7220661 - DNA, 17 bp, Homo sapiens
ttagcaaaatagcactt

SEQ ID NO: 7220662 - DNA, 17 bp, Homo sapiens
ttagcaaaatagcactt

SEQ ID NO: 7220663 - DNA, 17 bp, Homo sapiens
ttagcaaaatagcactt

SEQ ID NO: 7220664 - DNA, 17 bp, Homo sapiens
ttagcaaaatagcactt

SEQ ID NO: 7220665 - DNA, 22 bp, Homo sapiens
ttagatttgtagtgagttcaga

SEQ ID NO: 7220666 - DNA, 22 bp, Homo sapiens
ttagattttaagaagggaggta

SEQ ID NO: 7220667 - DNA, 22 bp, Homo sapiens
ttagcaaaaatatctcatatta

SEQ ID NO: 7220668 - DNA, 22 bp, Homo sapiens
ttagcaaaaatatctcatatta

SEQ ID NO: 7220669 - DNA, 22 bp, Homo sapiens
ttagcattctctgtgtgcataa

SEQ ID NO: 7220670 - DNA, 22 bp, Homo sapiens
ttagcattctgcctcctatatc

SEQ ID NO: 7220671 - DNA, 22 bp, Homo sapiens
ttagcattcttctggggggcac

SEQ ID NO: 7220672 - DNA, 22 bp, Homo sapiens
ttagcagttgtgagaccctaga

SEQ ID NO: 7220673 - DNA, 22 bp, Homo sapiens
ttagcatagccattgaaatatg

SEQ ID NO: 7220674 - DNA, 22 bp, Homo sapiens
ttagcatctgctgtaagcttat

SEQ ID NO: 7220675 - DNA, 22 bp, Homo sapiens
ttagcattctcatttgcataaa

SEQ ID NO: 7220676 - DNA, 22 bp, Homo sapiens
ttagcaggaagagttggctgga

SEQ ID NO: 7220677 - DNA, 22 bp, Homo sapiens
ttagcaggtattctctttggtc

SEQ ID NO: 7220678 - DNA, 22 bp, Homo sapiens
ttagcaggtattctctttggtc

SEQ ID NO: 7220679 - DNA, 22 bp, Homo sapiens
ttagcaggaagagttggctgga

SEQ ID NO: 7220680 - DNA, 22 bp, Homo sapiens
ttagcagttcattgattatcgt

SEQ ID NO: 7220681 - DNA, 22 bp, Homo sapiens
ttagcagatttcatgtacattt

SEQ ID NO: 7220682 - DNA, 22 bp, Homo sapiens
ttagcaaactctgttagattct

SEQ ID NO: 7220683 - DNA, 22 bp, Homo sapiens
ttagcactttgattcatgcaga

SEQ ID NO: 7220684 - DNA, 22 bp, Homo sapiens
ttagcagctaagtcatgctgca

SEQ ID NO: 7220685 - DNA, 20 bp, Homo sapiens
tgtttgtgtggggccttggc

SEQ ID NO: 7220686 - DNA, 22 bp, Homo sapiens
tgtttgtggttataataagtat

SEQ ID NO: 7220687 - DNA, 22 bp, Homo sapiens
tgtttgttccctctctttcctg

SEQ ID NO: 7220688 - DNA, 22 bp, Homo sapiens
tgtttgttccctctctttcctg

SEQ ID NO: 7220689 - DNA, 22 bp, Homo sapiens
tgtttgttccctctctttcctg

SEQ ID NO: 7220690 - DNA, 20 bp, Homo sapiens
tgtttgtgccagctttgtca

SEQ ID NO: 7220691 - DNA, 20 bp, Homo sapiens
tgtttgtgccagctttgtca

SEQ ID NO: 7220692 - DNA, 22 bp, Homo sapiens
tgtttgtgctgcctggtgggca

SEQ ID NO: 7220693 - DNA, 22 bp, Homo sapiens
tgtttgtgctgcctggtgggca

SEQ ID NO: 7220694 - DNA, 22 bp, Homo sapiens
tgtttgtgctgcctggtgggca

SEQ ID NO: 7220695 - DNA, 22 bp, Homo sapiens
tgtttgtgctgcctggtgggca

SEQ ID NO: 7220696 - DNA, 22 bp, Homo sapiens
tgtttgcttacttgtatgctgc

SEQ ID NO: 7220697 - DNA, 22 bp, Homo sapiens
tgtttgcttacttgtatgctgc

SEQ ID NO: 7220698 - DNA, 22 bp, Homo sapiens
tgtttgcttacttgtatgctgc

SEQ ID NO: 7220699 - DNA, 22 bp, Homo sapiens
tgtttggaaacactggcagaaa

SEQ ID NO: 7220700 - DNA, 22 bp, Homo sapiens
tgtttggaaacactggcagaaa

SEQ ID NO: 7220701 - DNA, 22 bp, Homo sapiens
tgtttgtagagacagctgatgc

SEQ ID NO: 7220702 - DNA, 22 bp, Homo sapiens
tgtttgtatctctctctgtggc

SEQ ID NO: 7220703 - DNA, 22 bp, Homo sapiens
tgtttgtatggacctgttctat

SEQ ID NO: 7220704 - DNA, 22 bp, Homo sapiens
tgtttgtcatcattgtgagaga

SEQ ID NO: 7220705 - DNA, 22 bp, Homo sapiens
tgtttgtcatcattgtgagaga

SEQ ID NO: 7220706 - DNA, 20 bp, Homo sapiens
tgtttgtgccagctttgtca

SEQ ID NO: 7220707 - DNA, 22 bp, Homo sapiens
tgtttgctctgactatcttgcg

SEQ ID NO: 7220708 - DNA, 22 bp, Homo sapiens
tgtttgctctgactatcttgcg

SEQ ID NO: 7220709 - DNA, 22 bp, Homo sapiens
tgtttgctatatcctacttcat

SEQ ID NO: 7220710 - DNA, 22 bp, Homo sapiens
tgtttgctagggttggtattta

SEQ ID NO: 7220711 - DNA, 22 bp, Homo sapiens
tgtttgctagggttggtattta

SEQ ID NO: 7220712 - DNA, 22 bp, Homo sapiens
tgtttcaactgttaagatatgc

SEQ ID NO: 7220713 - DNA, 22 bp, Homo sapiens
tgtttcaaaggttatacagtca

SEQ ID NO: 7220714 - DNA, 22 bp, Homo sapiens
tgtttcaaaggttatacagtca

SEQ ID NO: 7220715 - DNA, 22 bp, Homo sapiens
tgtttcaaaggttatacagtca

SEQ ID NO: 7220716 - DNA, 18 bp, Homo sapiens
tgtttatttttctcttac

SEQ ID NO: 7220717 - DNA, 18 bp, Homo sapiens
tgtttatttttctcttac

SEQ ID NO: 7220718 - DNA, 18 bp, Homo sapiens
tgtttatttttctcttac

SEQ ID NO: 7220719 - DNA, 18 bp, Homo sapiens
tgtttatttttctcttac

SEQ ID NO: 7220720 - DNA, 18 bp, Homo sapiens
tgtttatttttctcttac

SEQ ID NO: 7220721 - DNA, 18 bp, Homo sapiens
tgtttatttttctcttac

SEQ ID NO: 7220722 - DNA, 22 bp, Homo sapiens
tgtttcaaaacagtgataattt

SEQ ID NO: 7220723 - DNA, 22 bp, Homo sapiens
tgtttcaaaataacaagagggt

SEQ ID NO: 7220724 - DNA, 22 bp, Homo sapiens
tgtttcaaaataacaagagggt

SEQ ID NO: 7220725 - DNA, 22 bp, Homo sapiens
tgttttaagagcgcactttata

SEQ ID NO: 7220726 - DNA, 22 bp, Homo sapiens
tgttttaagagcgcactttata

SEQ ID NO: 7220727 - DNA, 22 bp, Homo sapiens
tgttttaagagcgcactttata

SEQ ID NO: 7220728 - DNA, 22 bp, Homo sapiens
tgttttaagctctagaagggga

SEQ ID NO: 7220729 - DNA, 22 bp, Homo sapiens
tgttttaagctctagaagggga

SEQ ID NO: 7220730 - DNA, 22 bp, Homo sapiens
tgttttaagggtcaactgtcac

SEQ ID NO: 7220731 - DNA, 22 bp, Homo sapiens
tgttttaagggtcaactgtcac

SEQ ID NO: 7220732 - DNA, 23 bp, Homo sapiens
tgtttgtttctatgagagatagc

SEQ ID NO: 7220733 - DNA, 22 bp, Homo sapiens
tgttttaaagccattgcctttc

SEQ ID NO: 7220734 - DNA, 22 bp, Homo sapiens
tgttttaagagcgcactttata

SEQ ID NO: 7220735 - DNA, 22 bp, Homo sapiens
tgttttaagagcgcactttata

SEQ ID NO: 7220736 - DNA, 22 bp, Homo sapiens
tgttttaatctcccattgctct

SEQ ID NO: 7220737 - DNA, 22 bp, Homo sapiens
tgttttaatctcccattgctct

SEQ ID NO: 7220738 - DNA, 22 bp, Homo sapiens
tgttttagctgacacatggagc

SEQ ID NO: 7220739 - DNA, 22 bp, Homo sapiens
tgttttagttctgtcttgcatg

SEQ ID NO: 7220740 - DNA, 22 bp, Homo sapiens
tgttttaagggtcaactgtcac

SEQ ID NO: 7220741 - DNA, 22 bp, Homo sapiens
tgttttaatctcccattgctct

SEQ ID NO: 7220742 - DNA, 22 bp, Homo sapiens
tgttttaagggtcaactgtcac

SEQ ID NO: 7220743 - DNA, 22 bp, Homo sapiens
tgttttaagggtcaactgtcac

SEQ ID NO: 7220744 - DNA, 22 bp, Homo sapiens
tgttttatcaagatggcatgtc

SEQ ID NO: 7220745 - DNA, 22 bp, Homo sapiens
tgttttatcaagatggcatgtc

SEQ ID NO: 7220746 - DNA, 22 bp, Homo sapiens
tgttttatcaagatggcatgtc

SEQ ID NO: 7220747 - DNA, 22 bp, Homo sapiens
tgttttatataagcagagcggt

SEQ ID NO: 7220748 - DNA, 22 bp, Homo sapiens
tgttttatataagcagagcggt

SEQ ID NO: 7220749 - DNA, 22 bp, Homo sapiens
tgttttatgagccatataacct

SEQ ID NO: 7220750 - DNA, 22 bp, Homo sapiens
tgttttatgagccatataacct

SEQ ID NO: 7220751 - DNA, 22 bp, Homo sapiens
tgttttatgagccatataacct

SEQ ID NO: 7220752 - DNA, 22 bp, Homo sapiens
tgttttatgagccatataacct

SEQ ID NO: 7220753 - DNA, 22 bp, Homo sapiens
tgttttatgagccatataacct

SEQ ID NO: 7220754 - DNA, 22 bp, Homo sapiens
tgttttatttctccaagaggga

SEQ ID NO: 7220755 - DNA, 22 bp, Homo sapiens
tgttttatgagccatataacct

SEQ ID NO: 7220756 - DNA, 22 bp, Homo sapiens
tgttttcaagtcaaggccaaat

SEQ ID NO: 7220757 - DNA, 22 bp, Homo sapiens
tgttttcaagtcaaggccaaat

SEQ ID NO: 7220758 - DNA, 22 bp, Homo sapiens
tgtttttccatgtgcagaacaa

SEQ ID NO: 7220759 - DNA, 22 bp, Homo sapiens
tgtttttccatgtgcagaacaa

SEQ ID NO: 7220760 - DNA, 22 bp, Homo sapiens
tgtttttgtctccttgtctgct

SEQ ID NO: 7220761 - DNA, 22 bp, Homo sapiens
tgtttttgtctccttgtctgct

SEQ ID NO: 7220762 - DNA, 22 bp, Homo sapiens
tgtttttgtctccttgtctgct

SEQ ID NO: 7220763 - DNA, 22 bp, Homo sapiens
tgtttttgtctccttgtctgct

SEQ ID NO: 7220764 - DNA, 22 bp, Homo sapiens
ttaaaacagcgtgaatctggca

SEQ ID NO: 7220765 - DNA, 22 bp, Homo sapiens
ttaaaacgtaaatgtccccagc

SEQ ID NO: 7220766 - DNA, 22 bp, Homo sapiens
ttaaaactgcaaatcctactga

SEQ ID NO: 7220767 - DNA, 22 bp, Homo sapiens
ttaaaacagcgtgaatctggca

SEQ ID NO: 7220768 - DNA, 22 bp, Homo sapiens
ttaaaacagcgtgaatctggca

SEQ ID NO: 7220769 - DNA, 22 bp, Homo sapiens
ttaaaactgcaaatcctactga

SEQ ID NO: 7220770 - DNA, 22 bp, Homo sapiens
ttaaaagaatcctgttatcctc

SEQ ID NO: 7220771 - DNA, 22 bp, Homo sapiens
ttaaaagacctgttgaggttag

SEQ ID NO: 7220772 - DNA, 22 bp, Homo sapiens
ttaaaagacctgttgaggttag

SEQ ID NO: 7220773 - DNA, 22 bp, Homo sapiens
ttaaaagacctgttgaggttag

SEQ ID NO: 7220774 - DNA, 22 bp, Homo sapiens
ttaaaagagacttcctttgttt

SEQ ID NO: 7220775 - DNA, 22 bp, Homo sapiens
ttaaaagagcagcccagcatat

SEQ ID NO: 7220776 - DNA, 22 bp, Homo sapiens
ttaaaatgtacaggggaaagtg

SEQ ID NO: 7220777 - DNA, 22 bp, Homo sapiens
ttaaaaaccatcttcctttcct

SEQ ID NO: 7220778 - DNA, 20 bp, Homo sapiens
ttaaaaagagtcacaggaga

SEQ ID NO: 7220779 - DNA, 20 bp, Homo sapiens
ttaaaaagagtcacaggaga

SEQ ID NO: 7220780 - DNA, 22 bp, Homo sapiens
tgtttttgttcaatgctaggtc

SEQ ID NO: 7220781 - DNA, 17 bp, Homo sapiens
tgttttttccctgttct

SEQ ID NO: 7220782 - DNA, 22 bp, Homo sapiens
tgttttttccttatgcaatctg

SEQ ID NO: 7220783 - DNA, 17 bp, Homo sapiens
tgttttttccctgttct

SEQ ID NO: 7220784 - DNA, 22 bp, Homo sapiens
tgtttttttatatacctgaagt

SEQ ID NO: 7220785 - DNA, 22 bp, Homo sapiens
tgtttttttatatacctgaagt

SEQ ID NO: 7220786 - DNA, 22 bp, Homo sapiens
ttaaaaaccatcttcctttcct

SEQ ID NO: 7220787 - DNA, 22 bp, Homo sapiens
tgtttttttatatacctgaagt

SEQ ID NO: 7220788 - DNA, 22 bp, Homo sapiens
ttaaaccatagtttaacataag

SEQ ID NO: 7220789 - DNA, 22 bp, Homo sapiens
ttaaaccatagtttaacataag

SEQ ID NO: 7220790 - DNA, 17 bp, Homo sapiens
ttaaaccataaagaagg

SEQ ID NO: 7220791 - DNA, 22 bp, Homo sapiens
ttaaaccatagtttaacataag

SEQ ID NO: 7220792 - DNA, 22 bp, Homo sapiens
ttaaacatttttgatgatcgat

SEQ ID NO: 7220793 - DNA, 22 bp, Homo sapiens
ttaaacatttatggaggcagca

SEQ ID NO: 7220794 - DNA, 22 bp, Homo sapiens
ttaaaccaccagaagccattat

SEQ ID NO: 7220795 - DNA, 22 bp, Homo sapiens
ttaaaccactgagtggagacta

SEQ ID NO: 7220796 - DNA, 22 bp, Homo sapiens
ttaaaccactttgttgcaagta

SEQ ID NO: 7220797 - DNA, 17 bp, Homo sapiens
ttaaaccataaagaagg

SEQ ID NO: 7220798 - DNA, 22 bp, Homo sapiens
ttaaacagacagtaaatgaaac

SEQ ID NO: 7220799 - DNA, 22 bp, Homo sapiens
ttaaacactgggggttaatgca

SEQ ID NO: 7220800 - DNA, 22 bp, Homo sapiens
ttaaacagaggtagcagactgg

SEQ ID NO: 7220801 - DNA, 22 bp, Homo sapiens
ttaaacatttatggaggcagca

SEQ ID NO: 7220802 - DNA, 22 bp, Homo sapiens
ttaaaattatggcccatttgga

SEQ ID NO: 7220803 - DNA, 22 bp, Homo sapiens
ttaaaattatggcccatttgga

SEQ ID NO: 7220804 - DNA, 22 bp, Homo sapiens
ttaaaatgtacaggggaaagtg

SEQ ID NO: 7220805 - DNA, 23 bp, Homo sapiens
ttaaaatgtggtctctccctagt

SEQ ID NO: 7220806 - DNA, 22 bp, Homo sapiens
ttaaaatttccccaccatgtat

SEQ ID NO: 7220807 - DNA, 22 bp, Homo sapiens
ttaaaatttccccaccatgtat

SEQ ID NO: 7220808 - DNA, 22 bp, Homo sapiens
ttaaacaccacagcagtcccta

SEQ ID NO: 7220809 - DNA, 22 bp, Homo sapiens
ttaaacacctgtctagtgtagc

SEQ ID NO: 7220810 - DNA, 22 bp, Homo sapiens
ttaaacaccaagtgcaaaccac

SEQ ID NO: 7220811 - DNA, 22 bp, Homo sapiens
ttaaacaccaagtgcaaaccac

SEQ ID NO: 7220812 - DNA, 22 bp, Homo sapiens
ttaaacacctgtctagtgtagc

SEQ ID NO: 7220813 - DNA, 22 bp, Homo sapiens
ttaaacacctgtctagtgtagc

SEQ ID NO: 7220814 - DNA, 23 bp, Homo sapiens
ttaaacactagttcgagtagcat

SEQ ID NO: 7220815 - DNA, 23 bp, Homo sapiens
ttaaacactagttcgagtagcat

SEQ ID NO: 7220816 - DNA, 22 bp, Homo sapiens
ttaaacactggagctgggtgtt

SEQ ID NO: 7220817 - DNA, 22 bp, Homo sapiens
ttaaacactggagctgggtgtt

SEQ ID NO: 7220818 - DNA, 22 bp, Homo sapiens
ttaaacacactgagatttatgt

SEQ ID NO: 7220819 - DNA, 22 bp, Homo sapiens
ttaaacacactgagatttatgt

SEQ ID NO: 7220820 - DNA, 22 bp, Homo sapiens
ttaaacacactgagatttatgt

SEQ ID NO: 7220821 - DNA, 22 bp, Homo sapiens
tgttagaaattattagtaatat

SEQ ID NO: 7220822 - DNA, 22 bp, Homo sapiens
tgttagaaattattagtaatat

SEQ ID NO: 7220823 - DNA, 22 bp, Homo sapiens
tgttacttcttatttcttacat

SEQ ID NO: 7220824 - DNA, 22 bp, Homo sapiens
tgttacttcttggtaaaggaga

SEQ ID NO: 7220825 - DNA, 22 bp, Homo sapiens
tgttactgggcatctagtgggt

SEQ ID NO: 7220826 - DNA, 22 bp, Homo sapiens
tgttactgatttgatatacagt

SEQ ID NO: 7220827 - DNA, 22 bp, Homo sapiens
tgttactgagtaatgtatagat

SEQ ID NO: 7220828 - DNA, 18 bp, Homo sapiens
tgttactgagttatgttc

SEQ ID NO: 7220829 - DNA, 22 bp, Homo sapiens
tgttacatttctctttcttgga

SEQ ID NO: 7220830 - DNA, 22 bp, Homo sapiens
tgttaaggagacacatgaaaaa

SEQ ID NO: 7220831 - DNA, 22 bp, Homo sapiens
tgttaaggagacacatgaaaaa

SEQ ID NO: 7220832 - DNA, 22 bp, Homo sapiens
tgttaacttgcaagctgaagaa

SEQ ID NO: 7220833 - DNA, 22 bp, Homo sapiens
tgttaagaagaggcagtactta

SEQ ID NO: 7220834 - DNA, 22 bp, Homo sapiens
tgttaaattgattcacctttct

SEQ ID NO: 7220835 - DNA, 22 bp, Homo sapiens
tgttaaatgttcctttactgga

SEQ ID NO: 7220836 - DNA, 22 bp, Homo sapiens
tgttaaatgttttgctagtgtc

SEQ ID NO: 7220837 - DNA, 22 bp, Homo sapiens
tgttaaatgttcctttactgga

SEQ ID NO: 7220838 - DNA, 22 bp, Homo sapiens
tgttaaatgttcctttactgga

SEQ ID NO: 7220839 - DNA, 22 bp, Homo sapiens
tgttaacatcttggactcgtga

SEQ ID NO: 7220840 - DNA, 22 bp, Homo sapiens
tgttaacatgtgtattgtatga

SEQ ID NO: 7220841 - DNA, 22 bp, Homo sapiens
tgttaaatgagattggaatttg

SEQ ID NO: 7220842 - DNA, 18 bp, Homo sapiens
tgttaaatgaagatttgc

SEQ ID NO: 7220843 - DNA, 18 bp, Homo sapiens
tgttaaatgaagatttgc

SEQ ID NO: 7220844 - DNA, 18 bp, Homo sapiens
tgttaaatgaagatttgc

SEQ ID NO: 7220845 - DNA, 22 bp, Homo sapiens
tgttaaatgagattggaatttg

SEQ ID NO: 7220846 - DNA, 22 bp, Homo sapiens
tgttaaatgtattatgtgttct

SEQ ID NO: 7220847 - DNA, 22 bp, Homo sapiens
tgttaaatgtattatgtgttct

SEQ ID NO: 7220848 - DNA, 22 bp, Homo sapiens
tgttaggactccccagaagctg

SEQ ID NO: 7220849 - DNA, 22 bp, Homo sapiens
tgttagcctgcctgaagagact

SEQ ID NO: 7220850 - DNA, 22 bp, Homo sapiens
tgttagcaaggataattatgat

SEQ ID NO: 7220851 - DNA, 16 bp, Homo sapiens
tgttagctgtgcatta

SEQ ID NO: 7220852 - DNA, 18 bp, Homo sapiens
tgttaggaagggcacaca

SEQ ID NO: 7220853 - DNA, 22 bp, Homo sapiens
tgttaggactccccagaagctg

SEQ ID NO: 7220854 - DNA, 22 bp, Homo sapiens
tgttaggagaaaggaagatatt

SEQ ID NO: 7220855 - DNA, 22 bp, Homo sapiens
tgttaggagcttcctgggctga

SEQ ID NO: 7220856 - DNA, 22 bp, Homo sapiens
tgttagggacacttggagagga

SEQ ID NO: 7220857 - DNA, 22 bp, Homo sapiens
tgttagtattggcaaatttgtt

SEQ ID NO: 7220858 - DNA, 22 bp, Homo sapiens
tgttagaatattgtaatattcg

SEQ ID NO: 7220859 - DNA, 22 bp, Homo sapiens
tgttagaagttaatcactaatt

SEQ ID NO: 7220860 - DNA, 22 bp, Homo sapiens
tgttcttatggctatttctccc

SEQ ID NO: 7220861 - DNA, 22 bp, Homo sapiens
tgttcttagcaggagcatctat

SEQ ID NO: 7220862 - DNA, 22 bp, Homo sapiens
tgttcttagcaggagcatctat

SEQ ID NO: 7220863 - DNA, 22 bp, Homo sapiens
tgttcttacggaacttatcttt

SEQ ID NO: 7220864 - DNA, 22 bp, Homo sapiens
tgttctgttttatggtagggaa

SEQ ID NO: 7220865 - DNA, 22 bp, Homo sapiens
tgttctttgctgttgatgtaga

SEQ ID NO: 7220866 - DNA, 22 bp, Homo sapiens
tgttctttgctgttgatgtaga

SEQ ID NO: 7220867 - DNA, 22 bp, Homo sapiens
tgttctttgccagtgatttaat

SEQ ID NO: 7220868 - DNA, 22 bp, Homo sapiens
tgttctttggcttcacagctct

SEQ ID NO: 7220869 - DNA, 22 bp, Homo sapiens
tgttctttggcttcacagctct

SEQ ID NO: 7220870 - DNA, 22 bp, Homo sapiens
tgttctttggcttcacagctct

SEQ ID NO: 7220871 - DNA, 22 bp, Homo sapiens
tgttcttttctctaaactgata

SEQ ID NO: 7220872 - DNA, 22 bp, Homo sapiens
tgttcttttctctaaactgata

SEQ ID NO: 7220873 - DNA, 22 bp, Homo sapiens
tgttcttttctctaaactgata

SEQ ID NO: 7220874 - DNA, 22 bp, Homo sapiens
tgttcttctagattgcctttta

SEQ ID NO: 7220875 - DNA, 22 bp, Homo sapiens
tgttcttctagattgcctttta

SEQ ID NO: 7220876 - DNA, 22 bp, Homo sapiens
tgttcttgagcctttagaccta

SEQ ID NO: 7220877 - DNA, 22 bp, Homo sapiens
tgttcttgagcctttagaccta

SEQ ID NO: 7220878 - DNA, 22 bp, Homo sapiens
tgttcttgagcctttagaccta

SEQ ID NO: 7220879 - DNA, 22 bp, Homo sapiens
tgttcttgagcctttagaccta

SEQ ID NO: 7220880 - DNA, 22 bp, Homo sapiens
tgttcttgggaatcttacagtt

SEQ ID NO: 7220881 - DNA, 22 bp, Homo sapiens
tgttcttgggaatcttacagtt

SEQ ID NO: 7220882 - DNA, 22 bp, Homo sapiens
tgttcttgggaatcttacagtt

SEQ ID NO: 7220883 - DNA, 22 bp, Homo sapiens
tgttcttgggaatcttacagtt

SEQ ID NO: 7220884 - DNA, 22 bp, Homo sapiens
tgttctttcagttagacacagt

SEQ ID NO: 7220885 - DNA, 22 bp, Homo sapiens
tgttctttcagttagacacagt

SEQ ID NO: 7220886 - DNA, 22 bp, Homo sapiens
tgttctttcagttagacacagt

SEQ ID NO: 7220887 - DNA, 21 bp, Homo sapiens
tgtttactccctgcaagcacg

SEQ ID NO: 7220888 - DNA, 22 bp, Homo sapiens
tgtttactcctgatatattttt

SEQ ID NO: 7220889 - DNA, 22 bp, Homo sapiens
tgtttactgcattctatttgct

SEQ ID NO: 7220890 - DNA, 22 bp, Homo sapiens
tgtttaagctgatgaggtatcg

SEQ ID NO: 7220891 - DNA, 22 bp, Homo sapiens
tgtttaaatagaacatactgca

SEQ ID NO: 7220892 - DNA, 22 bp, Homo sapiens
tgtttaagatccgtcagtcact

SEQ ID NO: 7220893 - DNA, 15 bp, Homo sapiens
tgtttaagccacatt

SEQ ID NO: 7220894 - DNA, 22 bp, Homo sapiens
tgtttaagcctgtggtgtcatc

SEQ ID NO: 7220895 - DNA, 22 bp, Homo sapiens
tgtttaaatagaacatactgca

SEQ ID NO: 7220896 - DNA, 21 bp, Homo sapiens
tgttgttttatggctatgaat

SEQ ID NO: 7220897 - DNA, 22 bp, Homo sapiens
tgtttaaatagaacatactgca

SEQ ID NO: 7220898 - DNA, 22 bp, Homo sapiens
tgtttaaatagaacatactgca

SEQ ID NO: 7220899 - DNA, 22 bp, Homo sapiens
tgttgtcagtattaatttcaca

SEQ ID NO: 7220900 - DNA, 22 bp, Homo sapiens
tgttgtgacctctctgcattca

SEQ ID NO: 7220901 - DNA, 22 bp, Homo sapiens
tgttgtgacctctctgcattca

SEQ ID NO: 7220902 - DNA, 22 bp, Homo sapiens
tgttgttacattcctgtgtccc

SEQ ID NO: 7220903 - DNA, 22 bp, Homo sapiens
tgttgtttctactaataggcca

SEQ ID NO: 7220904 - DNA, 22 bp, Homo sapiens
tgttgtaaaatttgagatgtca

SEQ ID NO: 7220905 - DNA, 22 bp, Homo sapiens
tgttggtaggatttgcttcagc

SEQ ID NO: 7220906 - DNA, 22 bp, Homo sapiens
tgttgggatcgaatggtggaac

SEQ ID NO: 7220907 - DNA, 22 bp, Homo sapiens
tgttggggtcaggagctagcct

SEQ ID NO: 7220908 - DNA, 22 bp, Homo sapiens
tgttgattagtgtttagactta

SEQ ID NO: 7220909 - DNA, 22 bp, Homo sapiens
tgttgggaagctctgccagggg

SEQ ID NO: 7220910 - DNA, 22 bp, Homo sapiens
tgttgggaattgtgagtaatgg

SEQ ID NO: 7220911 - DNA, 22 bp, Homo sapiens
tgttgagtatatacctacaagt

SEQ ID NO: 7220912 - DNA, 22 bp, Homo sapiens
tgttgattagtgtttagactta

SEQ ID NO: 7220913 - DNA, 22 bp, Homo sapiens
tgttgactcaacactgtgggca

SEQ ID NO: 7220914 - DNA, 22 bp, Homo sapiens
tgttgactggtaactttaaaca

SEQ ID NO: 7220915 - DNA, 22 bp, Homo sapiens
tgttgagacacagacacaagcc

SEQ ID NO: 7220916 - DNA, 22 bp, Homo sapiens
tgttcttttctctaaactgata

SEQ ID NO: 7220917 - DNA, 22 bp, Homo sapiens
tgttcttttctctaaactgata

SEQ ID NO: 7220918 - DNA, 18 bp, Homo sapiens
tgttgaaacttcaggtaa

SEQ ID NO: 7220919 - DNA, 23 bp, Homo sapiens
tgttgaagtaactgttacataga

SEQ ID NO: 7220920 - DNA, 20 bp, Homo sapiens
tgttgaattcatggtgactt

SEQ ID NO: 7220921 - DNA, 22 bp, Homo sapiens
tgtttatgcatcgttaatacca

SEQ ID NO: 7220922 - DNA, 21 bp, Homo sapiens
tgtttatggaaaagagacaaa

SEQ ID NO: 7220923 - DNA, 21 bp, Homo sapiens
tgtttatggaaaagagacaaa

SEQ ID NO: 7220924 - DNA, 21 bp, Homo sapiens
tgtttatggaaaagagacaaa

SEQ ID NO: 7220925 - DNA, 22 bp, Homo sapiens
tgtttatcagggtaaagtgtag

SEQ ID NO: 7220926 - DNA, 22 bp, Homo sapiens
tgtttatagggtctgtcacttg

SEQ ID NO: 7220927 - DNA, 22 bp, Homo sapiens
tgtttatagatggccacaatga

SEQ ID NO: 7220928 - DNA, 22 bp, Homo sapiens
tgtttatagggtctgtcacttg

SEQ ID NO: 7220929 - DNA, 22 bp, Homo sapiens
tgtttatagggtctgtcacttg

SEQ ID NO: 7220930 - DNA, 22 bp, Homo sapiens
tgtttatagggtctgtcacttg

SEQ ID NO: 7220931 - DNA, 22 bp, Homo sapiens
tgtttatagggtctgtcacttg

SEQ ID NO: 7220932 - DNA, 22 bp, Homo sapiens
tgtttattacagttcttggaat

SEQ ID NO: 7220933 - DNA, 22 bp, Homo sapiens
tgtttattacagttcttggaat

SEQ ID NO: 7220934 - DNA, 22 bp, Homo sapiens
tgtttattacagttcttggaat

SEQ ID NO: 7220935 - DNA, 22 bp, Homo sapiens
tgtttatgtgtgtgcatatata

SEQ ID NO: 7220936 - DNA, 22 bp, Homo sapiens
tgtttattacagttcttggaat

SEQ ID NO: 7220937 - DNA, 22 bp, Homo sapiens
tgtttattcatggctaatgaaa

SEQ ID NO: 7220938 - DNA, 22 bp, Homo sapiens
tgtttattcatggctaatgaaa

SEQ ID NO: 7220939 - DNA, 22 bp, Homo sapiens
tgtttattcatggctaatgaaa

SEQ ID NO: 7220940 - DNA, 18 bp, Homo sapiens
tgtttattctcctgacag

SEQ ID NO: 7220941 - DNA, 18 bp, Homo sapiens
tgtttattctcctgacag

SEQ ID NO: 7220942 - DNA, 18 bp, Homo sapiens
tgtttattctcctgacag

SEQ ID NO: 7220943 - DNA, 18 bp, Homo sapiens
tgtttattctcctgacag

SEQ ID NO: 7220944 - DNA, 22 bp, Homo sapiens
tgtttattgagtgcctactata

SEQ ID NO: 7220945 - DNA, 22 bp, Homo sapiens
tgtttattgagtgcctactata

SEQ ID NO: 7220946 - DNA, 22 bp, Homo sapiens
tgtttattgagtgcctactata

SEQ ID NO: 7220947 - DNA, 22 bp, Homo sapiens
tgtttattgagtgcctactata

SEQ ID NO: 7220948 - DNA, 22 bp, Homo sapiens
tgtttattgctgcaattgtgcc

SEQ ID NO: 7220949 - DNA, 22 bp, Homo sapiens
tgtttattgctgcaattgtgcc

SEQ ID NO: 7220950 - DNA, 22 bp, Homo sapiens
tgtttattttcaggatggattg

SEQ ID NO: 7220951 - DNA, 22 bp, Homo sapiens
tgtttattttcaggatggattg

SEQ ID NO: 7220952 - DNA, 22 bp, Homo sapiens
tgtttattgctgcaattgtgcc

SEQ ID NO: 7220953 - DNA, 22 bp, Homo sapiens
tgtttattgcagtgctgggctg

SEQ ID NO: 7220954 - DNA, 22 bp, Homo sapiens
tgtttattgctgcaattgtgcc

SEQ ID NO: 7220955 - DNA, 22 bp, Homo sapiens
tgtttattgcagtgctgggctg

SEQ ID NO: 7220956 - DNA, 22 bp, Homo sapiens
tgtttattgcagtgctgggctg

SEQ ID NO: 7220957 - DNA, 22 bp, Homo sapiens
tgtgtggattcatctcaaagag

SEQ ID NO: 7220958 - DNA, 22 bp, Homo sapiens
tgtgtggatgcagcgtgggtct

SEQ ID NO: 7220959 - DNA, 22 bp, Homo sapiens
tgtgtggattcatctcaaagag

SEQ ID NO: 7220960 - DNA, 22 bp, Homo sapiens
tgtgtggattcatctcaaagag

SEQ ID NO: 7220961 - DNA, 22 bp, Homo sapiens
tgtgtggattcatctcaaagag

SEQ ID NO: 7220962 - DNA, 22 bp, Homo sapiens
tgtgtggattcatctcaaagag

SEQ ID NO: 7220963 - DNA, 22 bp, Homo sapiens
tgtgtgctcgatggccctgcag

SEQ ID NO: 7220964 - DNA, 20 bp, Homo sapiens
tgtgtgctaggactacagtg

SEQ ID NO: 7220965 - DNA, 22 bp, Homo sapiens
tgtgtgctctaatgcctagtac

SEQ ID NO: 7220966 - DNA, 22 bp, Homo sapiens
tgtgtggcaagctgtatgctag

SEQ ID NO: 7220967 - DNA, 22 bp, Homo sapiens
tgtgtggcaagctgtatgctag

SEQ ID NO: 7220968 - DNA, 22 bp, Homo sapiens
tgtgtggattcatctcaaagag

SEQ ID NO: 7220969 - DNA, 22 bp, Homo sapiens
tgtgtggcctccatagggtact

SEQ ID NO: 7220970 - DNA, 22 bp, Homo sapiens
tgtgtggcgttgcgtggctagg

SEQ ID NO: 7220971 - DNA, 22 bp, Homo sapiens
tgtgtggcgttgcgtggctagg

SEQ ID NO: 7220972 - DNA, 22 bp, Homo sapiens
tgtgtgggagcacgggctgttg

SEQ ID NO: 7220973 - DNA, 22 bp, Homo sapiens
tgtgtgggagcacgggctgttg

SEQ ID NO: 7220974 - DNA, 22 bp, Homo sapiens
tgtgtgggagcacgggctgttg

SEQ ID NO: 7220975 - DNA, 22 bp, Homo sapiens
tgtgtgggagcacgggctgttg

SEQ ID NO: 7220976 - DNA, 22 bp, Homo sapiens
tgtgtgggagcacgggctgttg

SEQ ID NO: 7220977 - DNA, 22 bp, Homo sapiens
tgtgtgggagcacgggctgttg

SEQ ID NO: 7220978 - DNA, 22 bp, Homo sapiens
tgtgtgggagcacgggctgttg

SEQ ID NO: 7220979 - DNA, 22 bp, Homo sapiens
tgtgtgggagcacgggctgttg

SEQ ID NO: 7220980 - DNA, 21 bp, Homo sapiens
tgtgtgggcatatctgctgca

SEQ ID NO: 7220981 - DNA, 21 bp, Homo sapiens
tgtgtgggcatatctgctgca

SEQ ID NO: 7220982 - DNA, 21 bp, Homo sapiens
tgtgtgggcatatctgctgca

SEQ ID NO: 7220983 - DNA, 21 bp, Homo sapiens
tgtgtgggcatatctgctgca

SEQ ID NO: 7220984 - DNA, 22 bp, Homo sapiens
tgtgtgtgcacatgcatataca

SEQ ID NO: 7220985 - DNA, 22 bp, Homo sapiens
tgtgtgtgcacatgcatataca

SEQ ID NO: 7220986 - DNA, 22 bp, Homo sapiens
tgtgtgtgcacatgcatataca

SEQ ID NO: 7220987 - DNA, 22 bp, Homo sapiens
tgtgtgtgcacatgcatataca

SEQ ID NO: 7220988 - DNA, 22 bp, Homo sapiens
tgtgtgtgactcatactagaac

SEQ ID NO: 7220989 - DNA, 22 bp, Homo sapiens
tgtgtgtgactcatactagaac

SEQ ID NO: 7220990 - DNA, 22 bp, Homo sapiens
tgtgtgtgagtcctggctttcc

SEQ ID NO: 7220991 - DNA, 22 bp, Homo sapiens
tgtgtgtgagtcctggctttcc

SEQ ID NO: 7220992 - DNA, 22 bp, Homo sapiens
tgtgtgtgagtcctggctttcc

SEQ ID NO: 7220993 - DNA, 22 bp, Homo sapiens
tgtgtgtgagtcctggctttcc

SEQ ID NO: 7220994 - DNA, 22 bp, Homo sapiens
tgtgtgtgagtcctggctttcc

SEQ ID NO: 7220995 - DNA, 22 bp, Homo sapiens
tgtgtgtgaaccattgagggct

SEQ ID NO: 7220996 - DNA, 22 bp, Homo sapiens
tgtgtgtgaaccattgagggct

SEQ ID NO: 7220997 - DNA, 22 bp, Homo sapiens
tgtgtgtctttgcctcctctca

SEQ ID NO: 7220998 - DNA, 22 bp, Homo sapiens
tgtgtgtgaaccattgagggct

SEQ ID NO: 7220999 - DNA, 22 bp, Homo sapiens
tgtgtgtgaaccattgagggct

SEQ ID NO: 7221000 - DNA, 22 bp, Homo sapiens
tgtgtgtgaaccattgagggct

SEQ ID NO: 7221001 - DNA, 22 bp, Homo sapiens
tgtgtgtgaaccattgagggct

SEQ ID NO: 7221002 - DNA, 22 bp, Homo sapiens
tgtgtgtgacaacctagttcag

SEQ ID NO: 7221003 - DNA, 22 bp, Homo sapiens
tgtgtgtgacaacctagttcag

SEQ ID NO: 7221004 - DNA, 22 bp, Homo sapiens
tgtgtgtgacaacctagttcag

SEQ ID NO: 7221005 - DNA, 22 bp, Homo sapiens
tgtgtgtgacaacctagttcag

SEQ ID NO: 7221006 - DNA, 22 bp, Homo sapiens
tgtgtgtgacaacctagttcag

SEQ ID NO: 7221007 - DNA, 22 bp, Homo sapiens
tgtgtgtgactcatactagaac

SEQ ID NO: 7221008 - DNA, 22 bp, Homo sapiens
tgtgtgtgactcatactagaac

SEQ ID NO: 7221009 - DNA, 22 bp, Homo sapiens
tgtgtgtgactcatactagaac

SEQ ID NO: 7221010 - DNA, 22 bp, Homo sapiens
tgtgtgccagcctacgaggagc

SEQ ID NO: 7221011 - DNA, 22 bp, Homo sapiens
tgtgtgcattcacatgcatgcc

SEQ ID NO: 7221012 - DNA, 22 bp, Homo sapiens
tgtgtgcattcacatgcatgcc

SEQ ID NO: 7221013 - DNA, 22 bp, Homo sapiens
tgtgtgcattcacatgcatgcc

SEQ ID NO: 7221014 - DNA, 22 bp, Homo sapiens
tgtgtcagaatttttgtggcaa

SEQ ID NO: 7221015 - DNA, 22 bp, Homo sapiens
tgtgtcagaggtagagatggca

SEQ ID NO: 7221016 - DNA, 22 bp, Homo sapiens
tgtgtcagaggtagagatggca

SEQ ID NO: 7221017 - DNA, 22 bp, Homo sapiens
tgtgtgcatgcttggggcagca

SEQ ID NO: 7221018 - DNA, 22 bp, Homo sapiens
tgtgtgcatgttaatgagaaaa

SEQ ID NO: 7221019 - DNA, 22 bp, Homo sapiens
tgtgtgcattagcattctaggg

SEQ ID NO: 7221020 - DNA, 22 bp, Homo sapiens
tgtgtgccagatacaagcactg

SEQ ID NO: 7221021 - DNA, 22 bp, Homo sapiens
tgtgtgccagggcatgcacagg

SEQ ID NO: 7221022 - DNA, 22 bp, Homo sapiens
tgtgtgccagggcatgcacagg

SEQ ID NO: 7221023 - DNA, 22 bp, Homo sapiens
tgtgtgccccagatgagtagct

SEQ ID NO: 7221024 - DNA, 22 bp, Homo sapiens
tgtgtgccccagatgagtagct

SEQ ID NO: 7221025 - DNA, 19 bp, Homo sapiens
tgtgtgccctcaccacata

SEQ ID NO: 7221026 - DNA, 22 bp, Homo sapiens
tgtgtgcctgagccgtgcctgg

SEQ ID NO: 7221027 - DNA, 22 bp, Homo sapiens
tgtgtgcctgagccgtgcctgg

SEQ ID NO: 7221028 - DNA, 22 bp, Homo sapiens
tgtgtgctaatgtatgctctaa

SEQ ID NO: 7221029 - DNA, 22 bp, Homo sapiens
tgtgtgctaatgtatgctctaa

SEQ ID NO: 7221030 - DNA, 22 bp, Homo sapiens
tgtgtgctaatgtatgctctaa

SEQ ID NO: 7221031 - DNA, 22 bp, Homo sapiens
tgtgtagaaagatctccaagat

SEQ ID NO: 7221032 - DNA, 20 bp, Homo sapiens
tgtgtagcaggtgctgtgcc

SEQ ID NO: 7221033 - DNA, 22 bp, Homo sapiens
tgtgtagaggtaagtaacactt

SEQ ID NO: 7221034 - DNA, 22 bp, Homo sapiens
tgtgtagctcatattagtgtta

SEQ ID NO: 7221035 - DNA, 22 bp, Homo sapiens
tgtgtagctttcttctgtgggg

SEQ ID NO: 7221036 - DNA, 22 bp, Homo sapiens
tgtgtattaccattttacagct

SEQ ID NO: 7221037 - DNA, 22 bp, Homo sapiens
tgtgtatttctggaacagacta

SEQ ID NO: 7221038 - DNA, 22 bp, Homo sapiens
tgtgtcaagacatttagtcatt

SEQ ID NO: 7221039 - DNA, 21 bp, Homo sapiens
tgtgtcactaactagaggcta

SEQ ID NO: 7221040 - DNA, 22 bp, Homo sapiens
tgtgtcagaaatcagtgcctcg

SEQ ID NO: 7221041 - DNA, 22 bp, Homo sapiens
tgtgtcagaaatcagtgcctcg

SEQ ID NO: 7221042 - DNA, 22 bp, Homo sapiens
tgtgtcagaaggcaatggggat

SEQ ID NO: 7221043 - DNA, 22 bp, Homo sapiens
tgtgtcagaagtacttttggaa

SEQ ID NO: 7221044 - DNA, 18 bp, Homo sapiens
tgttaaatgaagatttgc

SEQ ID NO: 7221045 - DNA, 22 bp, Homo sapiens
tgttaaactgtattgcataagg

SEQ ID NO: 7221046 - DNA, 22 bp, Homo sapiens
tgttaaacctagtacaggtcct

SEQ ID NO: 7221047 - DNA, 22 bp, Homo sapiens
tgttaaacagctgtcttcttca

SEQ ID NO: 7221048 - DNA, 22 bp, Homo sapiens
tgttaaaccagttttgcatcat

SEQ ID NO: 7221049 - DNA, 22 bp, Homo sapiens
tgttaaacctagtacaggtcct

SEQ ID NO: 7221050 - DNA, 22 bp, Homo sapiens
tgttaaacctagtacaggtcct

SEQ ID NO: 7221051 - DNA, 22 bp, Homo sapiens
tgttaaactcgtaggttaggct

SEQ ID NO: 7221052 - DNA, 22 bp, Homo sapiens
tgttaaaaccacaggtgaggac

SEQ ID NO: 7221053 - DNA, 22 bp, Homo sapiens
tgttaaaaccacaggtgaggac

SEQ ID NO: 7221054 - DNA, 22 bp, Homo sapiens
tgttaaacagatattgcccaca

SEQ ID NO: 7221055 - DNA, 22 bp, Homo sapiens
tgttaaacagctgtcttcttca

SEQ ID NO: 7221056 - DNA, 22 bp, Homo sapiens
tgtgttaattccacaaacattc

SEQ ID NO: 7221057 - DNA, 22 bp, Homo sapiens
tgtgttaagtatttgatacact

SEQ ID NO: 7221058 - DNA, 22 bp, Homo sapiens
tgttaaaaattcagctctagat

SEQ ID NO: 7221059 - DNA, 22 bp, Homo sapiens
tgttaaaaattcagctctagat

SEQ ID NO: 7221060 - DNA, 22 bp, Homo sapiens
tgttaaaaattcagctctagat

SEQ ID NO: 7221061 - DNA, 22 bp, Homo sapiens
tgttaaaaattcagctctagat

SEQ ID NO: 7221062 - DNA, 22 bp, Homo sapiens
tgtgttaagtatttgatacact

SEQ ID NO: 7221063 - DNA, 22 bp, Homo sapiens
tgtgttaaggcactgatatctg

SEQ ID NO: 7221064 - DNA, 22 bp, Homo sapiens
tgtgttaaggtgcatctagtgc

SEQ ID NO: 7221065 - DNA, 22 bp, Homo sapiens
tgtgttaaggtgcatctagtgc

SEQ ID NO: 7221066 - DNA, 22 bp, Homo sapiens
tgtgttaaggtgcatctagtgc

SEQ ID NO: 7221067 - DNA, 22 bp, Homo sapiens
tgtgttaacactgcatgataat

SEQ ID NO: 7221068 - DNA, 22 bp, Homo sapiens
tgtgttaaggcactgatatctg

SEQ ID NO: 7221069 - DNA, 19 bp, Homo sapiens
tgtgtgtttatatatgtat

SEQ ID NO: 7221070 - DNA, 19 bp, Homo sapiens
tgtgtgtttatatatgtat

SEQ ID NO: 7221071 - DNA, 19 bp, Homo sapiens
tgtgtgtttatatatgtat

SEQ ID NO: 7221072 - DNA, 19 bp, Homo sapiens
tgtgtgtttatatatgtat

SEQ ID NO: 7221073 - DNA, 19 bp, Homo sapiens
tgtgtgtttatatatgtat

SEQ ID NO: 7221074 - DNA, 22 bp, Homo sapiens
tgtgtgtgtttctgctcataca

SEQ ID NO: 7221075 - DNA, 22 bp, Homo sapiens
tgtgtgttaacttatttaatgt

SEQ ID NO: 7221076 - DNA, 22 bp, Homo sapiens
tgtgtgttaacttatttaatgt

SEQ ID NO: 7221077 - DNA, 22 bp, Homo sapiens
tgtgtgttagtctcaaagccgt

SEQ ID NO: 7221078 - DNA, 22 bp, Homo sapiens
tgtgtgttagtctcaaagccgt

SEQ ID NO: 7221079 - DNA, 22 bp, Homo sapiens
tgtgtgttatcttagttcatct

SEQ ID NO: 7221080 - DNA, 22 bp, Homo sapiens
tgtgtgttatcttagttcatct

SEQ ID NO: 7221081 - DNA, 22 bp, Homo sapiens
tgtgtgttattttcagccatta

SEQ ID NO: 7221082 - DNA, 22 bp, Homo sapiens
tgtgtgttattttcagccatta

SEQ ID NO: 7221083 - DNA, 22 bp, Homo sapiens
tgtgtgttcagagatagatata

SEQ ID NO: 7221084 - DNA, 22 bp, Homo sapiens
tgtgtgttcagagatagatata

SEQ ID NO: 7221085 - DNA, 22 bp, Homo sapiens
tgtgtgttcagagatagatata

SEQ ID NO: 7221086 - DNA, 22 bp, Homo sapiens
tgtgtgttctcaattattgatg

SEQ ID NO: 7221087 - DNA, 22 bp, Homo sapiens
tgtgtgttctcaattattgatg

SEQ ID NO: 7221088 - DNA, 22 bp, Homo sapiens
tgtgtgttggctggagagggct

SEQ ID NO: 7221089 - DNA, 22 bp, Homo sapiens
tgtgtgttggctggagagggct

SEQ ID NO: 7221090 - DNA, 19 bp, Homo sapiens
tgtgtgtttatatatgtat

SEQ ID NO: 7221091 - DNA, 22 bp, Homo sapiens
tgtgtgtgtttataaatctaaa

SEQ ID NO: 7221092 - DNA, 22 bp, Homo sapiens
tgtgtgtgtttataaatctaaa

SEQ ID NO: 7221093 - DNA, 22 bp, Homo sapiens
tgtgtgtgtttctgctcataca

SEQ ID NO: 7221094 - DNA, 22 bp, Homo sapiens
tgtgtgtgtttctgctcataca

SEQ ID NO: 7221095 - DNA, 22 bp, Homo sapiens
tgtgtgtgtttctgctcataca

SEQ ID NO: 7221096 - DNA, 22 bp, Homo sapiens
tgtgtgtgtttctgctcataca

SEQ ID NO: 7221097 - DNA, 22 bp, Homo sapiens
tgtgtgtgtttacagtttctca

SEQ ID NO: 7221098 - DNA, 22 bp, Homo sapiens
tgtgtgtgtttacagtttctca

SEQ ID NO: 7221099 - DNA, 22 bp, Homo sapiens
tgtgtgtgtttataaatctaaa

SEQ ID NO: 7221100 - DNA, 22 bp, Homo sapiens
tgtgtgtgtttataaatctaaa

SEQ ID NO: 7221101 - DNA, 22 bp, Homo sapiens
tgtgtgtgtttataaatctaaa

SEQ ID NO: 7221102 - DNA, 22 bp, Homo sapiens
tgtgtgtgtttacagtttctca

SEQ ID NO: 7221103 - DNA, 22 bp, Homo sapiens
tgtgtgtgtttacagtttctca

SEQ ID NO: 7221104 - DNA, 22 bp, Homo sapiens
tgtgtgtgtttacagtttctca

SEQ ID NO: 7221105 - DNA, 22 bp, Homo sapiens
tgtgtgtgtttacagtttctca

SEQ ID NO: 7221106 - DNA, 22 bp, Homo sapiens
tgtgtgtgtgcgcgcacgcata

SEQ ID NO: 7221107 - DNA, 22 bp, Homo sapiens
tgtgtgtgttcctcctcagcta

SEQ ID NO: 7221108 - DNA, 22 bp, Homo sapiens
tgtgtgtgttcctcctcagcta

SEQ ID NO: 7221109 - DNA, 22 bp, Homo sapiens
tgtgtgtgttcctcctcagcta

SEQ ID NO: 7221110 - DNA, 22 bp, Homo sapiens
tgtgtgtgttcctcctcagcta

SEQ ID NO: 7221111 - DNA, 22 bp, Homo sapiens
tgtgtgtgtcctcatttgcaga

SEQ ID NO: 7221112 - DNA, 22 bp, Homo sapiens
tgtgtgtgtgcgcgcacgcata

SEQ ID NO: 7221113 - DNA, 22 bp, Homo sapiens
tgtgtgtgtgcgcgcacgcata

SEQ ID NO: 7221114 - DNA, 22 bp, Homo sapiens
tgtgtgtgtgcgcgcacgcata

SEQ ID NO: 7221115 - DNA, 22 bp, Homo sapiens
tgtgtgtgtgcgcgcacgcata

SEQ ID NO: 7221116 - DNA, 23 bp, Homo sapiens
tgtgtgtgtattctacgcaaggt

SEQ ID NO: 7221117 - DNA, 22 bp, Homo sapiens
tgtgtgtgtcctcatttgcaga

SEQ ID NO: 7221118 - DNA, 22 bp, Homo sapiens
tgtgtgtgtcctcatttgcaga

SEQ ID NO: 7221119 - DNA, 22 bp, Homo sapiens
tgtgtgtgtcctcatttgcaga

SEQ ID NO: 7221120 - DNA, 23 bp, Homo sapiens
tgtgtgtgtattctacgcaaggt

SEQ ID NO: 7221121 - DNA, 23 bp, Homo sapiens
tgtgtgtgtattctacgcaaggt

SEQ ID NO: 7221122 - DNA, 23 bp, Homo sapiens
tgtgtgtgtattctacgcaaggt

SEQ ID NO: 7221123 - DNA, 20 bp, Homo sapiens
tgtgtgtgtacttctaaata

SEQ ID NO: 7221124 - DNA, 20 bp, Homo sapiens
tgtgtgtgtacttctaaata

SEQ ID NO: 7221125 - DNA, 20 bp, Homo sapiens
tgtgtgtgtacttctaaata

SEQ ID NO: 7221126 - DNA, 20 bp, Homo sapiens
tgtgtgtgtacttctaaata

SEQ ID NO: 7221127 - DNA, 22 bp, Homo sapiens
tgtgtgtgtaaaagcatttata

SEQ ID NO: 7221128 - DNA, 20 bp, Homo sapiens
tgtgtgtgtacttctaaata

SEQ ID NO: 7221129 - DNA, 20 bp, Homo sapiens
tgtgtgtgtacttctaaata

SEQ ID NO: 7221130 - DNA, 22 bp, Homo sapiens
tgtgtgtggggaggcagcagat

SEQ ID NO: 7221131 - DNA, 22 bp, Homo sapiens
tgtgtgtgtaaaagcatttata

SEQ ID NO: 7221132 - DNA, 22 bp, Homo sapiens
tgtgtgtgtaaaagcatttata

SEQ ID NO: 7221133 - DNA, 22 bp, Homo sapiens
tgtgtgtgtaaaagcatttata

SEQ ID NO: 7221134 - DNA, 22 bp, Homo sapiens
tgtgtgtgtaaaagcatttata

SEQ ID NO: 7221135 - DNA, 22 bp, Homo sapiens
tgtgtgtgggcggaacggcccc

SEQ ID NO: 7221136 - DNA, 22 bp, Homo sapiens
tgtgtgtgggcggaacggcccc

SEQ ID NO: 7221137 - DNA, 22 bp, Homo sapiens
tgtgtgtgggcggaacggcccc

SEQ ID NO: 7221138 - DNA, 22 bp, Homo sapiens
tgtgtgtggggaggcagcagat

SEQ ID NO: 7221139 - DNA, 22 bp, Homo sapiens
tgtgtgtggggaggcagcagat

SEQ ID NO: 7221140 - DNA, 22 bp, Homo sapiens
tgtgtgtggggaggcagcagat

SEQ ID NO: 7221141 - DNA, 22 bp, Homo sapiens
tgtgtgtgcaggagagcaggtg

SEQ ID NO: 7221142 - DNA, 22 bp, Homo sapiens
tgtgtgtgcaggagagcaggtg

SEQ ID NO: 7221143 - DNA, 21 bp, Homo sapiens
tgtgtgtgcaggcacacacac

SEQ ID NO: 7221144 - DNA, 21 bp, Homo sapiens
tgtgtgtgcaggcacacacac

SEQ ID NO: 7221145 - DNA, 21 bp, Homo sapiens
tgtgtgtgcaggcacacacac

SEQ ID NO: 7221146 - DNA, 21 bp, Homo sapiens
tgtgtgtgcaggcacacacac

SEQ ID NO: 7221147 - DNA, 22 bp, Homo sapiens
tgtgtgtgcacgtgcgcgcgag

SEQ ID NO: 7221148 - DNA, 22 bp, Homo sapiens
tgtgtgtgcacgtgcgcgcgag

SEQ ID NO: 7221149 - DNA, 22 bp, Homo sapiens
tgtgtgtgcacgtgcgcgcgag

SEQ ID NO: 7221150 - DNA, 22 bp, Homo sapiens
tgtgtgtgcacgtgcgcgcgag

SEQ ID NO: 7221151 - DNA, 22 bp, Homo sapiens
tgtgtgtgcaggagagcaggtg

SEQ ID NO: 7221152 - DNA, 22 bp, Homo sapiens
tgtgtgtgcaggagagcaggtg

SEQ ID NO: 7221153 - DNA, 22 bp, Homo sapiens
tgtgtgtgcaggagagcaggtg

SEQ ID NO: 7221154 - DNA, 22 bp, Homo sapiens
tgtggggacccatgccatgggc

SEQ ID NO: 7221155 - DNA, 22 bp, Homo sapiens
tgtggggaagagtatgacttgg

SEQ ID NO: 7221156 - DNA, 22 bp, Homo sapiens
tgtgggctttggagtcaggaag

SEQ ID NO: 7221157 - DNA, 22 bp, Homo sapiens
tgtgggctttggagtcaggaag

SEQ ID NO: 7221158 - DNA, 22 bp, Homo sapiens
tgtggggactgagtggaggctt

SEQ ID NO: 7221159 - DNA, 22 bp, Homo sapiens
tgtggggacccatgccatgggc

SEQ ID NO: 7221160 - DNA, 22 bp, Homo sapiens
tgtggggacctggctgccaccc

SEQ ID NO: 7221161 - DNA, 22 bp, Homo sapiens
tgtggggacctggctgccaccc

SEQ ID NO: 7221162 - DNA, 22 bp, Homo sapiens
tgtggggactgagtggaggctt

SEQ ID NO: 7221163 - DNA, 22 bp, Homo sapiens
tgtggggactgagtggaggctt

SEQ ID NO: 7221164 - DNA, 22 bp, Homo sapiens
tgtggggactgagtggaggctt

SEQ ID NO: 7221165 - DNA, 22 bp, Homo sapiens
tgtggggactgagtggaggctt

SEQ ID NO: 7221166 - DNA, 22 bp, Homo sapiens
tgtgtacaagagtgtttactgt

SEQ ID NO: 7221167 - DNA, 22 bp, Homo sapiens
tgtgtacacatgacaggcaccc

SEQ ID NO: 7221168 - DNA, 23 bp, Homo sapiens
tgtgtacatacatatgtacacac

SEQ ID NO: 7221169 - DNA, 23 bp, Homo sapiens
tgtgtacatacatatgtacacac

SEQ ID NO: 7221170 - DNA, 22 bp, Homo sapiens
tgtgtacatatctatcctagat

SEQ ID NO: 7221171 - DNA, 22 bp, Homo sapiens
tgtgtacatctcttctcacatt

SEQ ID NO: 7221172 - DNA, 22 bp, Homo sapiens
tgtgtacatgtatcaactatcg

SEQ ID NO: 7221173 - DNA, 22 bp, Homo sapiens
tgtgtactcaattgagccattt

SEQ ID NO: 7221174 - DNA, 22 bp, Homo sapiens
tgtgggcactaatgacatgcag

SEQ ID NO: 7221175 - DNA, 19 bp, Homo sapiens
tgtgggcaagggatggcag

SEQ ID NO: 7221176 - DNA, 19 bp, Homo sapiens
tgtgggcaagggatggcag

SEQ ID NO: 7221177 - DNA, 22 bp, Homo sapiens
tgtgggcagctggagctgttca

SEQ ID NO: 7221178 - DNA, 22 bp, Homo sapiens
tgtgggcaggagcacaagtcag

SEQ ID NO: 7221179 - DNA, 22 bp, Homo sapiens
tgtgggaggtctggaaggctcc

SEQ ID NO: 7221180 - DNA, 22 bp, Homo sapiens
tgtgggattcatttggatcagc

SEQ ID NO: 7221181 - DNA, 22 bp, Homo sapiens
tgtgggcaaagggtagctgggt

SEQ ID NO: 7221182 - DNA, 22 bp, Homo sapiens
tgtgggcaaagggtagctgggt

SEQ ID NO: 7221183 - DNA, 19 bp, Homo sapiens
tgtgggcaagggatggcag

SEQ ID NO: 7221184 - DNA, 22 bp, Homo sapiens
tgtgggaggaattagaatggga

SEQ ID NO: 7221185 - DNA, 22 bp, Homo sapiens
tgtgggaggaattagaatggga

SEQ ID NO: 7221186 - DNA, 22 bp, Homo sapiens
tgtgggaggaattagaatggga

SEQ ID NO: 7221187 - DNA, 22 bp, Homo sapiens
tgtgggaggattcagaattggg

SEQ ID NO: 7221188 - DNA, 22 bp, Homo sapiens
tgtgggaggattcagaattggg

SEQ ID NO: 7221189 - DNA, 22 bp, Homo sapiens
tgtgggaggtctggaaggctcc

SEQ ID NO: 7221190 - DNA, 22 bp, Homo sapiens
tgtgggaggtctggaaggctcc

SEQ ID NO: 7221191 - DNA, 19 bp, Homo sapiens
tgtgggctgggaaatgtct

SEQ ID NO: 7221192 - DNA, 22 bp, Homo sapiens
tgtgggctgtactgagggcagg

SEQ ID NO: 7221193 - DNA, 22 bp, Homo sapiens
tgtgggctgtactgagggcagg

SEQ ID NO: 7221194 - DNA, 22 bp, Homo sapiens
tgtgggctgtactgagggcagg

SEQ ID NO: 7221195 - DNA, 20 bp, Homo sapiens
tgtgggctttgaaatgtgtg

SEQ ID NO: 7221196 - DNA, 22 bp, Homo sapiens
tgtgggctctaatggcagcaga

SEQ ID NO: 7221197 - DNA, 22 bp, Homo sapiens
tgtgggctctaatggcagcaga

SEQ ID NO: 7221198 - DNA, 22 bp, Homo sapiens
tgtgggcctgggaaggtgacac

SEQ ID NO: 7221199 - DNA, 20 bp, Homo sapiens
tgtgggcctgtgaagcggcg

SEQ ID NO: 7221200 - DNA, 20 bp, Homo sapiens
tgtgggccttcggcgtgctc

SEQ ID NO: 7221201 - DNA, 20 bp, Homo sapiens
tgtgggccttcggcgtgctc

SEQ ID NO: 7221202 - DNA, 20 bp, Homo sapiens
tgtgggccttcggcgtgctc

SEQ ID NO: 7221203 - DNA, 23 bp, Homo sapiens
tgtgggcgcattgtaagggtagc

SEQ ID NO: 7221204 - DNA, 23 bp, Homo sapiens
tgtgggcgcattgtaagggtagc

SEQ ID NO: 7221205 - DNA, 23 bp, Homo sapiens
tgtgggcgcattgtaagggtagc

SEQ ID NO: 7221206 - DNA, 23 bp, Homo sapiens
tgtgggcgcattgtaagggtagc

SEQ ID NO: 7221207 - DNA, 22 bp, Homo sapiens
tgtgggcaggcccgggtctgag

SEQ ID NO: 7221208 - DNA, 22 bp, Homo sapiens
tgtgggccaggaggcctcagtg

SEQ ID NO: 7221209 - DNA, 22 bp, Homo sapiens
tgtgggccaggaggcctcagtg

SEQ ID NO: 7221210 - DNA, 22 bp, Homo sapiens
tgtgggccaggaggcctcagtg

SEQ ID NO: 7221211 - DNA, 20 bp, Homo sapiens
tgtgggcccttggctggcaa

SEQ ID NO: 7221212 - DNA, 20 bp, Homo sapiens
tgtgggcccttggctggcaa

SEQ ID NO: 7221213 - DNA, 22 bp, Homo sapiens
tgtgggcctcagcaggactcca

SEQ ID NO: 7221214 - DNA, 22 bp, Homo sapiens
tgtgggcctcagcaggactcca

SEQ ID NO: 7221215 - DNA, 22 bp, Homo sapiens
tgtgggcctcagcaggactcca

SEQ ID NO: 7221216 - DNA, 22 bp, Homo sapiens
tgtgggcctcagcaggactcca

SEQ ID NO: 7221217 - DNA, 22 bp, Homo sapiens
tgtggctgactcctggtcccca

SEQ ID NO: 7221218 - DNA, 23 bp, Homo sapiens
tgtggctgagaaattgacaactt

SEQ ID NO: 7221219 - DNA, 19 bp, Homo sapiens
tgtggctgagcactcctta

SEQ ID NO: 7221220 - DNA, 19 bp, Homo sapiens
tgtggctgagcactcctta

SEQ ID NO: 7221221 - DNA, 22 bp, Homo sapiens
tgtggctgatcaaagcgctcag

SEQ ID NO: 7221222 - DNA, 22 bp, Homo sapiens
tgtggctgatcaaagcgctcag

SEQ ID NO: 7221223 - DNA, 22 bp, Homo sapiens
tgtggctgcaaaggaaggctgc

SEQ ID NO: 7221224 - DNA, 22 bp, Homo sapiens
tgtggctgcaaaggaaggctgc

SEQ ID NO: 7221225 - DNA, 22 bp, Homo sapiens
tgtggctgcaaaggaaggctgc

SEQ ID NO: 7221226 - DNA, 22 bp, Homo sapiens
tgtggctctcatgcactcccag

SEQ ID NO: 7221227 - DNA, 22 bp, Homo sapiens
tgtggctccactccacattaat

SEQ ID NO: 7221228 - DNA, 22 bp, Homo sapiens
tgtggctcggccagctgctgaa

SEQ ID NO: 7221229 - DNA, 22 bp, Homo sapiens
tgtggctctcctcctgctgccc

SEQ ID NO: 7221230 - DNA, 22 bp, Homo sapiens
tgtggctctgcctggcagtatt

SEQ ID NO: 7221231 - DNA, 21 bp, Homo sapiens
tgtggctgacaccctttggga

SEQ ID NO: 7221232 - DNA, 22 bp, Homo sapiens
tgtggaatgggagtgagaagac

SEQ ID NO: 7221233 - DNA, 22 bp, Homo sapiens
tgtggaatgtcctcagcatcct

SEQ ID NO: 7221234 - DNA, 22 bp, Homo sapiens
tgtggaatttctttcaggtatg

SEQ ID NO: 7221235 - DNA, 22 bp, Homo sapiens
tgtggacaagatgccaattgat

SEQ ID NO: 7221236 - DNA, 22 bp, Homo sapiens
tgtggacaagatgccaattgat

SEQ ID NO: 7221237 - DNA, 22 bp, Homo sapiens
tgtggacaccactgggactgga

SEQ ID NO: 7221238 - DNA, 22 bp, Homo sapiens
tgtggacaccactgggactgga

SEQ ID NO: 7221239 - DNA, 22 bp, Homo sapiens
tgtggacaccactgggactgga

SEQ ID NO: 7221240 - DNA, 22 bp, Homo sapiens
tgtggacaccactgggaggtct

SEQ ID NO: 7221241 - DNA, 22 bp, Homo sapiens
tgtggacaccactgggaggtct

SEQ ID NO: 7221242 - DNA, 22 bp, Homo sapiens
tgtggacaccactgggaggtct

SEQ ID NO: 7221243 - DNA, 22 bp, Homo sapiens
tgtggccttgcagcctggaggt

SEQ ID NO: 7221244 - DNA, 22 bp, Homo sapiens
tgtggaacaaaatgttgggaga

SEQ ID NO: 7221245 - DNA, 22 bp, Homo sapiens
tgtggaacacctagaatgggta

SEQ ID NO: 7221246 - DNA, 23 bp, Homo sapiens
tgtggaacgccataggagcacga

SEQ ID NO: 7221247 - DNA, 22 bp, Homo sapiens
tgtggaactagtattgtcttaa

SEQ ID NO: 7221248 - DNA, 22 bp, Homo sapiens
tgtggaagaaacaagacacttt

SEQ ID NO: 7221249 - DNA, 22 bp, Homo sapiens
tgtggaagaacactggccaggc

SEQ ID NO: 7221250 - DNA, 22 bp, Homo sapiens
tgtggaagaacttcttgcttgg

SEQ ID NO: 7221251 - DNA, 22 bp, Homo sapiens
tgtggaagaacttcttgcttgg

SEQ ID NO: 7221252 - DNA, 22 bp, Homo sapiens
tgtggaagccggtgggaagcag

SEQ ID NO: 7221253 - DNA, 22 bp, Homo sapiens
tgtggaagcctgggccccaggg

SEQ ID NO: 7221254 - DNA, 22 bp, Homo sapiens
tgtggaagggacactggactgg

SEQ ID NO: 7221255 - DNA, 22 bp, Homo sapiens
tgtggaagggacactggactgg

SEQ ID NO: 7221256 - DNA, 22 bp, Homo sapiens
tgtggaagtgccaatgacaaat

SEQ ID NO: 7221257 - DNA, 22 bp, Homo sapiens
tgtggaatattagattaggttg

SEQ ID NO: 7221258 - DNA, 22 bp, Homo sapiens
tgtggaatatttctaaaggcct

SEQ ID NO: 7221259 - DNA, 22 bp, Homo sapiens
tgtgggaagagcagtggcagca

SEQ ID NO: 7221260 - DNA, 22 bp, Homo sapiens
tgtgggaagagcagtggcagca

SEQ ID NO: 7221261 - DNA, 22 bp, Homo sapiens
tgtgggaagagcagtggcagca

SEQ ID NO: 7221262 - DNA, 22 bp, Homo sapiens
tgtgggaagagcagtggcagca

SEQ ID NO: 7221263 - DNA, 22 bp, Homo sapiens
tgtgggaagagcagtggcagca

SEQ ID NO: 7221264 - DNA, 21 bp, Homo sapiens
tgtggctgcctctggccctgg

SEQ ID NO: 7221265 - DNA, 22 bp, Homo sapiens
tgtgggaagatgttgcaggaga

SEQ ID NO: 7221266 - DNA, 22 bp, Homo sapiens
tgtgggaagatgttgcaggaga

SEQ ID NO: 7221267 - DNA, 22 bp, Homo sapiens
tgtgggaagtttggagggaaag

SEQ ID NO: 7221268 - DNA, 22 bp, Homo sapiens
tgtgggaatcagccaggggggc

SEQ ID NO: 7221269 - DNA, 22 bp, Homo sapiens
tgtgggaatcagccaggggggc

SEQ ID NO: 7221270 - DNA, 22 bp, Homo sapiens
tgtggctgcagacactggagcc

SEQ ID NO: 7221271 - DNA, 22 bp, Homo sapiens
tgtggctgcagacactggagcc

SEQ ID NO: 7221272 - DNA, 22 bp, Homo sapiens
tgtggctgcagacactggagcc

SEQ ID NO: 7221273 - DNA, 22 bp, Homo sapiens
tgtggctgcagacactggagcc

SEQ ID NO: 7221274 - DNA, 22 bp, Homo sapiens
tgtggctgcagacactggagcc

SEQ ID NO: 7221275 - DNA, 22 bp, Homo sapiens
tgtggctgcaggcgatggagga

SEQ ID NO: 7221276 - DNA, 22 bp, Homo sapiens
tgtggctgcaggcgatggagga

SEQ ID NO: 7221277 - DNA, 22 bp, Homo sapiens
tgtggctgcaggcgatggagga

SEQ ID NO: 7221278 - DNA, 22 bp, Homo sapiens
tgtggctgcaggcgatggagga

SEQ ID NO: 7221279 - DNA, 22 bp, Homo sapiens
tgtggctgccaccctgaagccg

SEQ ID NO: 7221280 - DNA, 22 bp, Homo sapiens
tgtgggacagggacagcaagag

SEQ ID NO: 7221281 - DNA, 22 bp, Homo sapiens
tgtgggacagggacagtgatat

SEQ ID NO: 7221282 - DNA, 22 bp, Homo sapiens
tgtgggacagggacagcaagag

SEQ ID NO: 7221283 - DNA, 22 bp, Homo sapiens
tgtgggagaaggaagcaagctg

SEQ ID NO: 7221284 - DNA, 22 bp, Homo sapiens
tgtgggagaaggaagcaagctg

SEQ ID NO: 7221285 - DNA, 22 bp, Homo sapiens
tgtgggacagggacagtgatat

SEQ ID NO: 7221286 - DNA, 22 bp, Homo sapiens
tgtgggaatcagccaggggggc

SEQ ID NO: 7221287 - DNA, 22 bp, Homo sapiens
tgtgggaatgacgaggaagagg

SEQ ID NO: 7221288 - DNA, 22 bp, Homo sapiens
tgtgggaatgacgaggaagagg

SEQ ID NO: 7221289 - DNA, 22 bp, Homo sapiens
tgtgggaatgacgaggaagagg

SEQ ID NO: 7221290 - DNA, 22 bp, Homo sapiens
tgtgggaatgctgatgggatct

SEQ ID NO: 7221291 - DNA, 22 bp, Homo sapiens
tgtgggaatgctgatgggatct

SEQ ID NO: 7221292 - DNA, 22 bp, Homo sapiens
tgtgggaatgctgatgggatct

SEQ ID NO: 7221293 - DNA, 23 bp, Homo sapiens
tgtgggaatgttggagaggaaac

SEQ ID NO: 7221294 - DNA, 23 bp, Homo sapiens
tgtgggaatgttggagaggaaac

SEQ ID NO: 7221295 - DNA, 22 bp, Homo sapiens
tgtgggaggaattagaatggga

SEQ ID NO: 7221296 - DNA, 22 bp, Homo sapiens
tgtgggaggaacacagccagaa

SEQ ID NO: 7221297 - DNA, 22 bp, Homo sapiens
tgtgggaggaacacagccagaa

SEQ ID NO: 7221298 - DNA, 22 bp, Homo sapiens
tgtgggaggaacacagccagaa

SEQ ID NO: 7221299 - DNA, 22 bp, Homo sapiens
tgtgggaggaacacagccagaa

SEQ ID NO: 7221300 - DNA, 22 bp, Homo sapiens
tgtgggagaaggaagcaagctg

SEQ ID NO: 7221301 - DNA, 22 bp, Homo sapiens
tgtgggagaaggaagcaagctg

SEQ ID NO: 7221302 - DNA, 22 bp, Homo sapiens
tgtgggaggaacacagccagaa

SEQ ID NO: 7221303 - DNA, 22 bp, Homo sapiens
tgtgggaggaacacagccagaa

SEQ ID NO: 7221304 - DNA, 22 bp, Homo sapiens
tgtgggagaaggaagcaagctg

SEQ ID NO: 7221305 - DNA, 22 bp, Homo sapiens
tgtgggagaaggaagcaagctg

SEQ ID NO: 7221306 - DNA, 22 bp, Homo sapiens
tgtgggagaaggaagcaagctg

SEQ ID NO: 7221307 - DNA, 22 bp, Homo sapiens
tgtgccctcagaagagtacatc

SEQ ID NO: 7221308 - DNA, 22 bp, Homo sapiens
tgtgccctcagaagagtacatc

SEQ ID NO: 7221309 - DNA, 22 bp, Homo sapiens
tgtgccctcagaagagtacatc

SEQ ID NO: 7221310 - DNA, 19 bp, Homo sapiens
tgtgccccctccagcctgc

SEQ ID NO: 7221311 - DNA, 22 bp, Homo sapiens
tgtgccaatctgctgactgtct

SEQ ID NO: 7221312 - DNA, 22 bp, Homo sapiens
tgtgccacatacacagtacatt

SEQ ID NO: 7221313 - DNA, 19 bp, Homo sapiens
tgtgccccctccagcctgc

SEQ ID NO: 7221314 - DNA, 22 bp, Homo sapiens
tgtgccctcctgccaggggctg

SEQ ID NO: 7221315 - DNA, 22 bp, Homo sapiens
tgtgccctgttaaatgcacagt

SEQ ID NO: 7221316 - DNA, 22 bp, Homo sapiens
tgtgccctttcctgctcctcca

SEQ ID NO: 7221317 - DNA, 22 bp, Homo sapiens
tgtgcccttttgacagtgagag

SEQ ID NO: 7221318 - DNA, 22 bp, Homo sapiens
tgtgcctgactaggtgaatcaa

SEQ ID NO: 7221319 - DNA, 22 bp, Homo sapiens
tgtgcctctgcctcatgccctg

SEQ ID NO: 7221320 - DNA, 22 bp, Homo sapiens
tgtgcctgactaggtgaatcaa

SEQ ID NO: 7221321 - DNA, 18 bp, Homo sapiens
tgtgcctctgcaggacgt

SEQ ID NO: 7221322 - DNA, 19 bp, Homo sapiens
tgtgcctcctcgtctccta

SEQ ID NO: 7221323 - DNA, 19 bp, Homo sapiens
tgtgcctctatagcatgtg

SEQ ID NO: 7221324 - DNA, 19 bp, Homo sapiens
tgtgcctctatagcatgtg

SEQ ID NO: 7221325 - DNA, 18 bp, Homo sapiens
tgtgcctctgcaggacgt

SEQ ID NO: 7221326 - DNA, 22 bp, Homo sapiens
tgtgcctcaccctgctcttggc

SEQ ID NO: 7221327 - DNA, 22 bp, Homo sapiens
tgtgcagttttaagtggtctaa

SEQ ID NO: 7221328 - DNA, 17 bp, Homo sapiens
tgtgcatagaataatga

SEQ ID NO: 7221329 - DNA, 22 bp, Homo sapiens
tgtgcatattactacctactcc

SEQ ID NO: 7221330 - DNA, 22 bp, Homo sapiens
tgtgcatcaagagaaaacagtg

SEQ ID NO: 7221331 - DNA, 20 bp, Homo sapiens
tgtgcatgaactgagggatt

SEQ ID NO: 7221332 - DNA, 22 bp, Homo sapiens
tgtgcatgaatcaatgattccg

SEQ ID NO: 7221333 - DNA, 22 bp, Homo sapiens
tgtgcatgacagcatacaaacg

SEQ ID NO: 7221334 - DNA, 22 bp, Homo sapiens
tgtgcatgcacatatatgttgc

SEQ ID NO: 7221335 - DNA, 22 bp, Homo sapiens
tgtgcatgcacatatatgttgc

SEQ ID NO: 7221336 - DNA, 22 bp, Homo sapiens
tgtgcatgcatatgtatttttg

SEQ ID NO: 7221337 - DNA, 22 bp, Homo sapiens
tgtgcatggcatcattgcagcc

SEQ ID NO: 7221338 - DNA, 22 bp, Homo sapiens
tgtgcatgtaccttattctgga

SEQ ID NO: 7221339 - DNA, 22 bp, Homo sapiens
tgtgcatggccagctggatcga

SEQ ID NO: 7221340 - DNA, 22 bp, Homo sapiens
tgtgcatgtaccttattctgga

SEQ ID NO: 7221341 - DNA, 22 bp, Homo sapiens
tgtgcatgtattgatttgtacc

SEQ ID NO: 7221342 - DNA, 22 bp, Homo sapiens
tgtgcatgtctgggcctgtaag

SEQ ID NO: 7221343 - DNA, 22 bp, Homo sapiens
tgtgcatgtctgggcctgtaag

SEQ ID NO: 7221344 - DNA, 22 bp, Homo sapiens
tgtgcatgtctgggcctgtaag

SEQ ID NO: 7221345 - DNA, 22 bp, Homo sapiens
tgtgcatgtgtttcatggatct

SEQ ID NO: 7221346 - DNA, 16 bp, Homo sapiens
tgtgcatgttctgtgt

SEQ ID NO: 7221347 - DNA, 22 bp, Homo sapiens
tgtgcatgttgcttgaactcct

SEQ ID NO: 7221348 - DNA, 22 bp, Homo sapiens
tgtgcattaactccacaagcag

SEQ ID NO: 7221349 - DNA, 20 bp, Homo sapiens
tgtgcattctatgggtttgg

SEQ ID NO: 7221350 - DNA, 21 bp, Homo sapiens
tgtgcattgaactgggcgtgt

SEQ ID NO: 7221351 - DNA, 22 bp, Homo sapiens
tgtgccaagactatattgtgct

SEQ ID NO: 7221352 - DNA, 22 bp, Homo sapiens
tgtgccaagatcaaacttttct

SEQ ID NO: 7221353 - DNA, 23 bp, Homo sapiens
tgtgccaagcttagaaagaacct

SEQ ID NO: 7221354 - DNA, 22 bp, Homo sapiens
tgtgcagctctagagccaagcc

SEQ ID NO: 7221355 - DNA, 22 bp, Homo sapiens
tgtgcagctttctggctttaag

SEQ ID NO: 7221356 - DNA, 20 bp, Homo sapiens
tgtgcaggagagtgaggctg

SEQ ID NO: 7221357 - DNA, 20 bp, Homo sapiens
tgtgcaggagagtgaggctg

SEQ ID NO: 7221358 - DNA, 20 bp, Homo sapiens
tgtgcaggagagtgaggctg

SEQ ID NO: 7221359 - DNA, 22 bp, Homo sapiens
tgtgcagagcccacaggcagct

SEQ ID NO: 7221360 - DNA, 22 bp, Homo sapiens
tgtgcagagtaaggcagctgtt

SEQ ID NO: 7221361 - DNA, 22 bp, Homo sapiens
tgtgcagatagtgatttcagaa

SEQ ID NO: 7221362 - DNA, 20 bp, Homo sapiens
tgtgcaggagagtgaggctg

SEQ ID NO: 7221363 - DNA, 20 bp, Homo sapiens
tgtgcaggagagtgaggctg

SEQ ID NO: 7221364 - DNA, 22 bp, Homo sapiens
tgtgcagggaagggcatgctat

SEQ ID NO: 7221365 - DNA, 22 bp, Homo sapiens
tgtgcaggatgcgggggtacca

SEQ ID NO: 7221366 - DNA, 22 bp, Homo sapiens
tgtgcaggtgcaggaagggggc

SEQ ID NO: 7221367 - DNA, 22 bp, Homo sapiens
tgtgcaggtgcaggaagggggc

SEQ ID NO: 7221368 - DNA, 22 bp, Homo sapiens
tgtgcaggtgcaggaagggggc

SEQ ID NO: 7221369 - DNA, 22 bp, Homo sapiens
tgtgcaggtgcaggaagggggc

SEQ ID NO: 7221370 - DNA, 21 bp, Homo sapiens
tgtgcagtccaatgtgctagc

SEQ ID NO: 7221371 - DNA, 22 bp, Homo sapiens
tgtgcagttcaaacccgtgttg

SEQ ID NO: 7221372 - DNA, 22 bp, Homo sapiens
tgtgcagtttctatgttgtcca

SEQ ID NO: 7221373 - DNA, 22 bp, Homo sapiens
tgtgcacatatactcatattcc

SEQ ID NO: 7221374 - DNA, 22 bp, Homo sapiens
tgtgcacctagggcattttcca

SEQ ID NO: 7221375 - DNA, 22 bp, Homo sapiens
tgtgcacctgagtcgcgcaggg

SEQ ID NO: 7221376 - DNA, 22 bp, Homo sapiens
tgtgcacctgagtcgcgcaggg

SEQ ID NO: 7221377 - DNA, 20 bp, Homo sapiens
tgtgcacctgctagggagca

SEQ ID NO: 7221378 - DNA, 22 bp, Homo sapiens
tgtgcacctcatccaccagacc

SEQ ID NO: 7221379 - DNA, 22 bp, Homo sapiens
tgtgcacctcatccaccagacc

SEQ ID NO: 7221380 - DNA, 22 bp, Homo sapiens
tgtgcacaggaagctattctct

SEQ ID NO: 7221381 - DNA, 22 bp, Homo sapiens
tgtgcacataaaacagtactag

SEQ ID NO: 7221382 - DNA, 22 bp, Homo sapiens
tgtgcaatcatattttaaaatg

SEQ ID NO: 7221383 - DNA, 22 bp, Homo sapiens
tgtgcaatcatattttaaaatg

SEQ ID NO: 7221384 - DNA, 18 bp, Homo sapiens
tgtgcaatattaaccacc

SEQ ID NO: 7221385 - DNA, 18 bp, Homo sapiens
tgtgcaatattaaccacc

SEQ ID NO: 7221386 - DNA, 22 bp, Homo sapiens
tgtgcaatcttgagcaatttat

SEQ ID NO: 7221387 - DNA, 22 bp, Homo sapiens
tgtgcaatttcaatttacacag

SEQ ID NO: 7221388 - DNA, 22 bp, Homo sapiens
tgtgcaaattaagtagattttc

SEQ ID NO: 7221389 - DNA, 22 bp, Homo sapiens
tgtgcaacatgagacagaacag

SEQ ID NO: 7221390 - DNA, 22 bp, Homo sapiens
tgtgcctgatggtcacgtggcc

SEQ ID NO: 7221391 - DNA, 22 bp, Homo sapiens
tgtgcctgatggtcacgtggcc

SEQ ID NO: 7221392 - DNA, 22 bp, Homo sapiens
tgtgcctgatggtcacgtggcc

SEQ ID NO: 7221393 - DNA, 22 bp, Homo sapiens
tgtgcctgctagatggttgtcg

SEQ ID NO: 7221394 - DNA, 22 bp, Homo sapiens
tgtgcctgctagatggttgtcg

SEQ ID NO: 7221395 - DNA, 22 bp, Homo sapiens
tgtgcctggagtccctgaggag

SEQ ID NO: 7221396 - DNA, 22 bp, Homo sapiens
tgtgcctggagtccctgaggag

SEQ ID NO: 7221397 - DNA, 22 bp, Homo sapiens
tgtgcctgagtctcggcccacc

SEQ ID NO: 7221398 - DNA, 22 bp, Homo sapiens
tgtgcctgagttggctgagtac

SEQ ID NO: 7221399 - DNA, 22 bp, Homo sapiens
tgtgcctgagttggctgagtac

SEQ ID NO: 7221400 - DNA, 22 bp, Homo sapiens
tgtgcctgagttggctgagtac

SEQ ID NO: 7221401 - DNA, 22 bp, Homo sapiens
tgtgcctggatctctgtgacaa

SEQ ID NO: 7221402 - DNA, 22 bp, Homo sapiens
tgtgcctggatctctgtgacaa

SEQ ID NO: 7221403 - DNA, 22 bp, Homo sapiens
tgtgcctggatctctgtgacaa

SEQ ID NO: 7221404 - DNA, 22 bp, Homo sapiens
tgtgcctggcattctgggcttc

SEQ ID NO: 7221405 - DNA, 22 bp, Homo sapiens
tgtgcctggcattctgggcttc

SEQ ID NO: 7221406 - DNA, 22 bp, Homo sapiens
tgtgcctggcccagtggtgtca

SEQ ID NO: 7221407 - DNA, 22 bp, Homo sapiens
tgtgcctggcccagtggtgtca

SEQ ID NO: 7221408 - DNA, 22 bp, Homo sapiens
tgtgcctggcccagtggtgtca

SEQ ID NO: 7221409 - DNA, 22 bp, Homo sapiens
tgtgcctggtccctgagtcgag

SEQ ID NO: 7221410 - DNA, 22 bp, Homo sapiens
tgtgcctggtccctgagtcgag

SEQ ID NO: 7221411 - DNA, 22 bp, Homo sapiens
tgtgcctgttggtgtagacata

SEQ ID NO: 7221412 - DNA, 22 bp, Homo sapiens
tgtgcctgttggtgtagacata

SEQ ID NO: 7221413 - DNA, 22 bp, Homo sapiens
tgtgccttatgaattctttctg

SEQ ID NO: 7221414 - DNA, 20 bp, Homo sapiens
tgtgcctggctttgtcctga

SEQ ID NO: 7221415 - DNA, 22 bp, Homo sapiens
tgtgcctgtcaccctcagagag

SEQ ID NO: 7221416 - DNA, 22 bp, Homo sapiens
tgtgcctgtcaccctcagagag

SEQ ID NO: 7221417 - DNA, 22 bp, Homo sapiens
tgtgcctgtcaccctcagagag

SEQ ID NO: 7221418 - DNA, 22 bp, Homo sapiens
tgtgcgcgtgcagcggagtgtt

SEQ ID NO: 7221419 - DNA, 22 bp, Homo sapiens
tgtgcgctccggcgagtcagcg

SEQ ID NO: 7221420 - DNA, 17 bp, Homo sapiens
tgtgcgcttgtgtgagg

SEQ ID NO: 7221421 - DNA, 22 bp, Homo sapiens
tgtgcgggtgcgcatgcagagg

SEQ ID NO: 7221422 - DNA, 22 bp, Homo sapiens
tgtgcgtcctgtgcgcacactg

SEQ ID NO: 7221423 - DNA, 23 bp, Homo sapiens
tgtgcgtgatgctttgttgaagg

SEQ ID NO: 7221424 - DNA, 22 bp, Homo sapiens
tgtgcgtgatggaccgggcctg

SEQ ID NO: 7221425 - DNA, 22 bp, Homo sapiens
tgtgcgtgatggaccgggcctg

SEQ ID NO: 7221426 - DNA, 22 bp, Homo sapiens
tgtgcgtggattcctgtactca

SEQ ID NO: 7221427 - DNA, 22 bp, Homo sapiens
tgtgcgtggattcctgtactca

SEQ ID NO: 7221428 - DNA, 22 bp, Homo sapiens
tgtgcgtgggcacacacatatg

SEQ ID NO: 7221429 - DNA, 22 bp, Homo sapiens
tgtgctctgcccctgactgttt

SEQ ID NO: 7221430 - DNA, 22 bp, Homo sapiens
tgtgctctgcaatcagttcttt

SEQ ID NO: 7221431 - DNA, 17 bp, Homo sapiens
tgtgctctctcactcag

SEQ ID NO: 7221432 - DNA, 22 bp, Homo sapiens
tgtgctctgaagagtgcatgtc

SEQ ID NO: 7221433 - DNA, 22 bp, Homo sapiens
tgtgctccatcatccataatct

SEQ ID NO: 7221434 - DNA, 23 bp, Homo sapiens
tgtgctcccaaatgtaggtctat

SEQ ID NO: 7221435 - DNA, 22 bp, Homo sapiens
tgtgctccatcatccataatct

SEQ ID NO: 7221436 - DNA, 23 bp, Homo sapiens
tgtgctcccaaatgtaggtctat

SEQ ID NO: 7221437 - DNA, 22 bp, Homo sapiens
tgtgctctacctcagtgtcatt

SEQ ID NO: 7221438 - DNA, 22 bp, Homo sapiens
tgtgcgtggttcccggggccat

SEQ ID NO: 7221439 - DNA, 22 bp, Homo sapiens
tgtgcgtggttcccggggccat

SEQ ID NO: 7221440 - DNA, 22 bp, Homo sapiens
tgtgctagaagaggatggacct

SEQ ID NO: 7221441 - DNA, 22 bp, Homo sapiens
tgtgctcactctaaattaagat

SEQ ID NO: 7221442 - DNA, 22 bp, Homo sapiens
tgtgctcatggtccagcatggt

SEQ ID NO: 7221443 - DNA, 22 bp, Homo sapiens
tgtgctcatggtccagcatggt

SEQ ID NO: 7221444 - DNA, 22 bp, Homo sapiens
tgtgctcatggtccagcatggt

SEQ ID NO: 7221445 - DNA, 22 bp, Homo sapiens
tgtgctccaacaatttatattc

SEQ ID NO: 7221446 - DNA, 22 bp, Homo sapiens
tgtgctccacactcccagtcct

SEQ ID NO: 7221447 - DNA, 22 bp, Homo sapiens
tgtgctccacactcccagtcct

SEQ ID NO: 7221448 - DNA, 22 bp, Homo sapiens
tgtgctcttgtctgtgactaac

SEQ ID NO: 7221449 - DNA, 22 bp, Homo sapiens
tgtgctctgtggatctgagcaa

SEQ ID NO: 7221450 - DNA, 22 bp, Homo sapiens
tgtgctcttctgttacttgtag

SEQ ID NO: 7221451 - DNA, 22 bp, Homo sapiens
tgtgctgacaattcacagagaa

SEQ ID NO: 7221452 - DNA, 22 bp, Homo sapiens
tgtgctgccagaaactatggaa

SEQ ID NO: 7221453 - DNA, 22 bp, Homo sapiens
tgtgctgcctctcacagaatta

SEQ ID NO: 7221454 - DNA, 22 bp, Homo sapiens
tgtgctgctctcagtgacagcc

SEQ ID NO: 7221455 - DNA, 22 bp, Homo sapiens
tgtgctgctctcagtgacagcc

SEQ ID NO: 7221456 - DNA, 22 bp, Homo sapiens
tgtggaaaagccccacaggact

SEQ ID NO: 7221457 - DNA, 22 bp, Homo sapiens
tgtggaaagtggtctaagcaca

SEQ ID NO: 7221458 - DNA, 22 bp, Homo sapiens
tgtgctgctctcagtgacagcc

SEQ ID NO: 7221459 - DNA, 22 bp, Homo sapiens
tgtgctgctctcagtgacagcc

SEQ ID NO: 7221460 - DNA, 22 bp, Homo sapiens
tgtgctgctgtgaataagacct

SEQ ID NO: 7221461 - DNA, 23 bp, Homo sapiens
tgtgctggcatctcaggctttgg

SEQ ID NO: 7221462 - DNA, 22 bp, Homo sapiens
tgtgagaattcctgatcacagg

SEQ ID NO: 7221463 - DNA, 22 bp, Homo sapiens
tgtgagaattcctgatcacagg

SEQ ID NO: 7221464 - DNA, 22 bp, Homo sapiens
tgtgagaagggtgaggctttta

SEQ ID NO: 7221465 - DNA, 22 bp, Homo sapiens
tgtgagacaggatttagagcag

SEQ ID NO: 7221466 - DNA, 22 bp, Homo sapiens
tgtgagacgtgttagaacagtg

SEQ ID NO: 7221467 - DNA, 22 bp, Homo sapiens
tgtgagagaagtgtgtgctccc

SEQ ID NO: 7221468 - DNA, 22 bp, Homo sapiens
tgtgagagagtgcatttgcata

SEQ ID NO: 7221469 - DNA, 22 bp, Homo sapiens
tgtgagagcagaagacacatag

SEQ ID NO: 7221470 - DNA, 22 bp, Homo sapiens
tgtgagagctccatcctcatga

SEQ ID NO: 7221471 - DNA, 22 bp, Homo sapiens
tgtgacttagggcaggtgagat

SEQ ID NO: 7221472 - DNA, 22 bp, Homo sapiens
tgtgacttataacatagaattt

SEQ ID NO: 7221473 - DNA, 22 bp, Homo sapiens
tgtgactttgtcaagttgcata

SEQ ID NO: 7221474 - DNA, 22 bp, Homo sapiens
tgtgacttttcacaggctggtc

SEQ ID NO: 7221475 - DNA, 22 bp, Homo sapiens
tgtgagaaaatgattgcacagt

SEQ ID NO: 7221476 - DNA, 22 bp, Homo sapiens
tgtgagaaaatgattgcacagt

SEQ ID NO: 7221477 - DNA, 21 bp, Homo sapiens
tgtgagaagagtactgaggtc

SEQ ID NO: 7221478 - DNA, 22 bp, Homo sapiens
tgtgagaagggcatgcagggag

SEQ ID NO: 7221479 - DNA, 21 bp, Homo sapiens
tgtgactgttgcatttgtcgt

SEQ ID NO: 7221480 - DNA, 19 bp, Homo sapiens
tgtgactggttgtctcgct

SEQ ID NO: 7221481 - DNA, 22 bp, Homo sapiens
tgtgactgtgctgtggagggag

SEQ ID NO: 7221482 - DNA, 22 bp, Homo sapiens
tgtgactgtgctgtggagggag

SEQ ID NO: 7221483 - DNA, 20 bp, Homo sapiens
tgtgacgacatcaaaatatt

SEQ ID NO: 7221484 - DNA, 22 bp, Homo sapiens
tgtgactaggcctgagctcttg

SEQ ID NO: 7221485 - DNA, 23 bp, Homo sapiens
tgtgacccctaggagtggggacc

SEQ ID NO: 7221486 - DNA, 23 bp, Homo sapiens
tgtgacccctaggagtggggacc

SEQ ID NO: 7221487 - DNA, 22 bp, Homo sapiens
tgtgaccctctccgatgggcag

SEQ ID NO: 7221488 - DNA, 22 bp, Homo sapiens
tgtgacctcatcttaactggaa

SEQ ID NO: 7221489 - DNA, 22 bp, Homo sapiens
tgtgacccagactcatcttctt

SEQ ID NO: 7221490 - DNA, 19 bp, Homo sapiens
tgtgaccccagacaagctg

SEQ ID NO: 7221491 - DNA, 22 bp, Homo sapiens
tgtgacccccgtcacggctgct

SEQ ID NO: 7221492 - DNA, 17 bp, Homo sapiens
tgtgacattgggacatt

SEQ ID NO: 7221493 - DNA, 21 bp, Homo sapiens
tgtgaccaggtctactttccc

SEQ ID NO: 7221494 - DNA, 22 bp, Homo sapiens
tgtgactggttgtcccgctttc

SEQ ID NO: 7221495 - DNA, 22 bp, Homo sapiens
tgtgactggttgggaagaggct

SEQ ID NO: 7221496 - DNA, 22 bp, Homo sapiens
tgtgactggcagaggtgtctgg

SEQ ID NO: 7221497 - DNA, 22 bp, Homo sapiens
tgtgactggcagaggtgtctgg

SEQ ID NO: 7221498 - DNA, 22 bp, Homo sapiens
tgtgactgcatttggagctggg

SEQ ID NO: 7221499 - DNA, 22 bp, Homo sapiens
tgtgactgcatttggagctggg

SEQ ID NO: 7221500 - DNA, 22 bp, Homo sapiens
tgtgactgagctgcagagtgtc

SEQ ID NO: 7221501 - DNA, 22 bp, Homo sapiens
tgtgagcactatggctaggctc

SEQ ID NO: 7221502 - DNA, 22 bp, Homo sapiens
tgtgagcaagtgactggtgaga

SEQ ID NO: 7221503 - DNA, 22 bp, Homo sapiens
tgtgagcaagtttatgtgtaca

SEQ ID NO: 7221504 - DNA, 22 bp, Homo sapiens
tgtgagcactatggctaggctc

SEQ ID NO: 7221505 - DNA, 22 bp, Homo sapiens
tgtgagatacctgttcaaatta

SEQ ID NO: 7221506 - DNA, 22 bp, Homo sapiens
tgtgagattttatttgatatgc

SEQ ID NO: 7221507 - DNA, 22 bp, Homo sapiens
tgtgagcaagattcagagattc

SEQ ID NO: 7221508 - DNA, 22 bp, Homo sapiens
tgtgagcaagattcagagattc

SEQ ID NO: 7221509 - DNA, 22 bp, Homo sapiens
tgtgagagttgagatattttgc

SEQ ID NO: 7221510 - DNA, 19 bp, Homo sapiens
tgtgagaggctagctgccc

SEQ ID NO: 7221511 - DNA, 20 bp, Homo sapiens
tgtgagagggtggcttgccc

SEQ ID NO: 7221512 - DNA, 20 bp, Homo sapiens
tgtgagagggtggcttgccc

SEQ ID NO: 7221513 - DNA, 22 bp, Homo sapiens
tgtgagaggagaaatgcattaa

SEQ ID NO: 7221514 - DNA, 22 bp, Homo sapiens
tgtgagttattttcaggagttt

SEQ ID NO: 7221515 - DNA, 22 bp, Homo sapiens
tgtgagttcttagaaagtcagt

SEQ ID NO: 7221516 - DNA, 22 bp, Homo sapiens
tgtgagtgaatgggtctgaagt

SEQ ID NO: 7221517 - DNA, 21 bp, Homo sapiens
tgtgagtccatctgagcagaa

SEQ ID NO: 7221518 - DNA, 22 bp, Homo sapiens
tgtgagtctaggtcagggtgtt

SEQ ID NO: 7221519 - DNA, 22 bp, Homo sapiens
tgtgagcactggctgggaaagt

SEQ ID NO: 7221520 - DNA, 22 bp, Homo sapiens
tgtgagcactggctgggaaagt

SEQ ID NO: 7221521 - DNA, 22 bp, Homo sapiens
tgtgagcactgtgatgctgttc

SEQ ID NO: 7221522 - DNA, 19 bp, Homo sapiens
tgtgatagttgaacctgcc

SEQ ID NO: 7221523 - DNA, 22 bp, Homo sapiens
tgtgatcacatctgggctgaag

SEQ ID NO: 7221524 - DNA, 22 bp, Homo sapiens
tgtgatcattgctaacatccat

SEQ ID NO: 7221525 - DNA, 22 bp, Homo sapiens
tgtgatctgccttggatctgca

SEQ ID NO: 7221526 - DNA, 22 bp, Homo sapiens
tgtgatctctataggattcaat

SEQ ID NO: 7221527 - DNA, 22 bp, Homo sapiens
tgtgatgctggagtgcgaatat

SEQ ID NO: 7221528 - DNA, 22 bp, Homo sapiens
tgtgatcttagacaactcactg

SEQ ID NO: 7221529 - DNA, 22 bp, Homo sapiens
tgtgatgcatagtttttattgc

SEQ ID NO: 7221530 - DNA, 22 bp, Homo sapiens
tgtgatggttcactgggcatga

SEQ ID NO: 7221531 - DNA, 22 bp, Homo sapiens
tgtgatttcatctgaggccagg

SEQ ID NO: 7221532 - DNA, 22 bp, Homo sapiens
tgtgcaaaataataaatcactg

SEQ ID NO: 7221533 - DNA, 22 bp, Homo sapiens
tgtgcaaagtgtacaaattaat

SEQ ID NO: 7221534 - DNA, 22 bp, Homo sapiens
tgtgacatcgctgtgtctgttt

SEQ ID NO: 7221535 - DNA, 22 bp, Homo sapiens
tgtgacagtcgttaggagctca

SEQ ID NO: 7221536 - DNA, 22 bp, Homo sapiens
tgtgacagtcgttaggagctca

SEQ ID NO: 7221537 - DNA, 23 bp, Homo sapiens
tgtgacagggtcattgaaaaggg

SEQ ID NO: 7221538 - DNA, 23 bp, Homo sapiens
tgtgacagggtcattgaaaaggg

SEQ ID NO: 7221539 - DNA, 22 bp, Homo sapiens
tgtgacagaaagtggatgggac

SEQ ID NO: 7221540 - DNA, 22 bp, Homo sapiens
tgtgacagatctctatacatga

SEQ ID NO: 7221541 - DNA, 22 bp, Homo sapiens
tgtgacagatctctatacatga

SEQ ID NO: 7221542 - DNA, 22 bp, Homo sapiens
tgtgacagatctttaaataatg

SEQ ID NO: 7221543 - DNA, 22 bp, Homo sapiens
tgtgacagcacggttcaactgc

SEQ ID NO: 7221544 - DNA, 22 bp, Homo sapiens
tgtgacagccagtaaagtaagc

SEQ ID NO: 7221545 - DNA, 22 bp, Homo sapiens
tgtgaatagattgaagctttgg

SEQ ID NO: 7221546 - DNA, 22 bp, Homo sapiens
tgtgaatagattgaagctttgg

SEQ ID NO: 7221547 - DNA, 22 bp, Homo sapiens
tgtgaataccttgaattcatca

SEQ ID NO: 7221548 - DNA, 22 bp, Homo sapiens
tgtgaatacattggtagaagca

SEQ ID NO: 7221549 - DNA, 22 bp, Homo sapiens
tgtgaaggtttttatgggatat

SEQ ID NO: 7221550 - DNA, 22 bp, Homo sapiens
tgtgaataatgccgcaataaac

SEQ ID NO: 7221551 - DNA, 22 bp, Homo sapiens
tgtgaacatttctggttatttg

SEQ ID NO: 7221552 - DNA, 23 bp, Homo sapiens
tgtgaaggtgggtccaagggctg

SEQ ID NO: 7221553 - DNA, 22 bp, Homo sapiens
tgtgaatagtgccgcaataaac

SEQ ID NO: 7221554 - DNA, 22 bp, Homo sapiens
tgtgaatggacaattaaatcta

SEQ ID NO: 7221555 - DNA, 22 bp, Homo sapiens
tgtgaatggacaattaaatcta

SEQ ID NO: 7221556 - DNA, 22 bp, Homo sapiens
tgtgaatggacaattaaatcta

SEQ ID NO: 7221557 - DNA, 22 bp, Homo sapiens
tgtgaatgtatagtttgtatat

SEQ ID NO: 7221558 - DNA, 22 bp, Homo sapiens
tgtgaatgtatagtttgtatat

SEQ ID NO: 7221559 - DNA, 22 bp, Homo sapiens
tgtgaatgtctaggttttatgt

SEQ ID NO: 7221560 - DNA, 22 bp, Homo sapiens
tgtgaatgtctaggttttatgt

SEQ ID NO: 7221561 - DNA, 23 bp, Homo sapiens
tgtgaattgaggacatcaaaagc

SEQ ID NO: 7221562 - DNA, 22 bp, Homo sapiens
tgtgaaatctgatgaattgacc

SEQ ID NO: 7221563 - DNA, 22 bp, Homo sapiens
tgtgaaatctgatgaattgacc

SEQ ID NO: 7221564 - DNA, 22 bp, Homo sapiens
tgtgaaatctgaactcaaagat

SEQ ID NO: 7221565 - DNA, 22 bp, Homo sapiens
tgtgaaatcacaggctatttag

SEQ ID NO: 7221566 - DNA, 22 bp, Homo sapiens
tgtgaaatcaattagctgcaga

SEQ ID NO: 7221567 - DNA, 22 bp, Homo sapiens
tgtgaaatatttatatactcaa

SEQ ID NO: 7221568 - DNA, 22 bp, Homo sapiens
tgtgaaatattggcaatttcat

SEQ ID NO: 7221569 - DNA, 21 bp, Homo sapiens
tgtgaaatagctatgctacat

SEQ ID NO: 7221570 - DNA, 21 bp, Homo sapiens
tgtgaaatagctatgctacat

SEQ ID NO: 7221571 - DNA, 22 bp, Homo sapiens
tgtgaaacggagtcagggaagg

SEQ ID NO: 7221572 - DNA, 23 bp, Homo sapiens
tgtgaaatttgaggtcagtgctt

SEQ ID NO: 7221573 - DNA, 22 bp, Homo sapiens
tgtgaaattgagaaactttcac

SEQ ID NO: 7221574 - DNA, 22 bp, Homo sapiens
tgtgaaattgaatgcccattgc

SEQ ID NO: 7221575 - DNA, 22 bp, Homo sapiens
tgtgaaattgagaaactttcac

SEQ ID NO: 7221576 - DNA, 22 bp, Homo sapiens
tgtgaaattcttgaaatgcaca

SEQ ID NO: 7221577 - DNA, 22 bp, Homo sapiens
tgtgaaattacttaaaggaaat

SEQ ID NO: 7221578 - DNA, 22 bp, Homo sapiens
tgtgaaattcttgaaatgcaca

SEQ ID NO: 7221579 - DNA, 22 bp, Homo sapiens
tgtgaaattcttgaaatgcaca

SEQ ID NO: 7221580 - DNA, 22 bp, Homo sapiens
tgtgaaattacttaaaggaaat

SEQ ID NO: 7221581 - DNA, 22 bp, Homo sapiens
tgtgaaatgtgtgtataattaa

SEQ ID NO: 7221582 - DNA, 22 bp, Homo sapiens
tgtgaaatgctattgtgacaaa

SEQ ID NO: 7221583 - DNA, 22 bp, Homo sapiens
tgtgaaatgagtatatttgaat

SEQ ID NO: 7221584 - DNA, 22 bp, Homo sapiens
tgtgaaatgaagataattcttg

SEQ ID NO: 7221585 - DNA, 22 bp, Homo sapiens
tgtgaaatctgatgaattgacc

SEQ ID NO: 7221586 - DNA, 22 bp, Homo sapiens
tgtgaaatgctatttccatgag

SEQ ID NO: 7221587 - DNA, 22 bp, Homo sapiens
tgtgaaatgtggatgttaatag

SEQ ID NO: 7221588 - DNA, 22 bp, Homo sapiens
tgtctcttttcaagctaccctt

SEQ ID NO: 7221589 - DNA, 22 bp, Homo sapiens
tgtctctttggcctcccatatg

SEQ ID NO: 7221590 - DNA, 22 bp, Homo sapiens
tgtctctttgggttcctcttgg

SEQ ID NO: 7221591 - DNA, 22 bp, Homo sapiens
tgtctctttggcctcccatatg

SEQ ID NO: 7221592 - DNA, 22 bp, Homo sapiens
tgtctctttgggttcctcttgg

SEQ ID NO: 7221593 - DNA, 22 bp, Homo sapiens
tgtctgaaacttatgatatact

SEQ ID NO: 7221594 - DNA, 22 bp, Homo sapiens
tgtctgaaagaggacgagctgg

SEQ ID NO: 7221595 - DNA, 22 bp, Homo sapiens
tgtctctgctttccttgcaggg

SEQ ID NO: 7221596 - DNA, 22 bp, Homo sapiens
tgtctctgctttccttgcaggg

SEQ ID NO: 7221597 - DNA, 22 bp, Homo sapiens
tgtctctgctttccttgcaggg

SEQ ID NO: 7221598 - DNA, 22 bp, Homo sapiens
tgtctctgctgcaccttctggg

SEQ ID NO: 7221599 - DNA, 22 bp, Homo sapiens
tgtctctgctgcaccttctggg

SEQ ID NO: 7221600 - DNA, 22 bp, Homo sapiens
tgtctctggcccatgagcagag

SEQ ID NO: 7221601 - DNA, 22 bp, Homo sapiens
tgtctctggcccatgagcagag

SEQ ID NO: 7221602 - DNA, 22 bp, Homo sapiens
tgtctctttggcctcccatatg

SEQ ID NO: 7221603 - DNA, 22 bp, Homo sapiens
tgtctctgccagctagcagaat

SEQ ID NO: 7221604 - DNA, 22 bp, Homo sapiens
tgtctctgccagctagcagaat

SEQ ID NO: 7221605 - DNA, 22 bp, Homo sapiens
tgtctctgataagtagttcagt

SEQ ID NO: 7221606 - DNA, 22 bp, Homo sapiens
tgtctctgccagctagcagaat

SEQ ID NO: 7221607 - DNA, 22 bp, Homo sapiens
tgtctctgaggtgagggtcagc

SEQ ID NO: 7221608 - DNA, 22 bp, Homo sapiens
tgtctctgaggtgagggtcagc

SEQ ID NO: 7221609 - DNA, 22 bp, Homo sapiens
tgtctctgagatgactcccacc

SEQ ID NO: 7221610 - DNA, 18 bp, Homo sapiens
tgtctctgaattccagtg

SEQ ID NO: 7221611 - DNA, 22 bp, Homo sapiens
tgtctctgaactgggttttctt

SEQ ID NO: 7221612 - DNA, 22 bp, Homo sapiens
tgtctctgaagccccctccttt

SEQ ID NO: 7221613 - DNA, 22 bp, Homo sapiens
tgtctctgaacagcttactaaa

SEQ ID NO: 7221614 - DNA, 22 bp, Homo sapiens
tgtctctgaaatatgtggctcc

SEQ ID NO: 7221615 - DNA, 22 bp, Homo sapiens
tgtctctctagctcttggtttg

SEQ ID NO: 7221616 - DNA, 22 bp, Homo sapiens
tgtctctctgcccccattgctc

SEQ ID NO: 7221617 - DNA, 19 bp, Homo sapiens
tgtctctgaaagatgagct

SEQ ID NO: 7221618 - DNA, 22 bp, Homo sapiens
tgtctctgaaatatgtggctcc

SEQ ID NO: 7221619 - DNA, 22 bp, Homo sapiens
tgtctgaaggcctgacctacat

SEQ ID NO: 7221620 - DNA, 22 bp, Homo sapiens
tgtctgagcacctgtgctgaac

SEQ ID NO: 7221621 - DNA, 22 bp, Homo sapiens
tgtctgagcgagaaagtagtgt

SEQ ID NO: 7221622 - DNA, 22 bp, Homo sapiens
tgtctgagcgagaaagtagtgt

SEQ ID NO: 7221623 - DNA, 22 bp, Homo sapiens
tgtctgagcacctgtgctgaac

SEQ ID NO: 7221624 - DNA, 22 bp, Homo sapiens
tgtctgagctgcacagaagtaa

SEQ ID NO: 7221625 - DNA, 22 bp, Homo sapiens
tgtctgagctggggcagacaga

SEQ ID NO: 7221626 - DNA, 22 bp, Homo sapiens
tgtctgagctggggcagacaga

SEQ ID NO: 7221627 - DNA, 22 bp, Homo sapiens
tgtctgagctggggcagacaga

SEQ ID NO: 7221628 - DNA, 22 bp, Homo sapiens
tgtctgagctggggcagacaga

SEQ ID NO: 7221629 - DNA, 22 bp, Homo sapiens
tgtctgagctttatgatggaag

SEQ ID NO: 7221630 - DNA, 22 bp, Homo sapiens
tgtctgagctttatgatggaag

SEQ ID NO: 7221631 - DNA, 22 bp, Homo sapiens
tgtctgaggaagtcagcccttt

SEQ ID NO: 7221632 - DNA, 19 bp, Homo sapiens
tgtctgagtatgctgacaa

SEQ ID NO: 7221633 - DNA, 22 bp, Homo sapiens
tgtctgagtcatgcagagatat

SEQ ID NO: 7221634 - DNA, 21 bp, Homo sapiens
tgtctgagtgactgggtctgc

SEQ ID NO: 7221635 - DNA, 22 bp, Homo sapiens
tgtctgagtcatgcagagatat

SEQ ID NO: 7221636 - DNA, 22 bp, Homo sapiens
tgtctgagtgcatatgtgctgg

SEQ ID NO: 7221637 - DNA, 22 bp, Homo sapiens
tgtctgagtgcatatgtgctgg

SEQ ID NO: 7221638 - DNA, 22 bp, Homo sapiens
tgtctgagtggtgcaaggctga

SEQ ID NO: 7221639 - DNA, 21 bp, Homo sapiens
tgtctgcagacttgcttgttg

SEQ ID NO: 7221640 - DNA, 22 bp, Homo sapiens
tgtctgatgatagtgtctctcc

SEQ ID NO: 7221641 - DNA, 22 bp, Homo sapiens
tgtctgcaaagtccagcacagg

SEQ ID NO: 7221642 - DNA, 22 bp, Homo sapiens
tgtctgcaaagtccagcacagg

SEQ ID NO: 7221643 - DNA, 22 bp, Homo sapiens
tgtctgcaccctgtgattgttt

SEQ ID NO: 7221644 - DNA, 22 bp, Homo sapiens
tgtctgatgatagtgtctctcc

SEQ ID NO: 7221645 - DNA, 18 bp, Homo sapiens
tgtctgagttcttccatt

SEQ ID NO: 7221646 - DNA, 23 bp, Homo sapiens
tgtctgagttggaaggccacctc

SEQ ID NO: 7221647 - DNA, 22 bp, Homo sapiens
tgtctgatggggattgctcttc

SEQ ID NO: 7221648 - DNA, 22 bp, Homo sapiens
tgtctgcctgtctctgtgcaaa

SEQ ID NO: 7221649 - DNA, 21 bp, Homo sapiens
tgtctgcctgcttcttcactc

SEQ ID NO: 7221650 - DNA, 21 bp, Homo sapiens
tgtctgcctgcttcttcactc

SEQ ID NO: 7221651 - DNA, 21 bp, Homo sapiens
tgtctgctaagctcagcttcc

SEQ ID NO: 7221652 - DNA, 22 bp, Homo sapiens
tgtctgctacttggttctacca

SEQ ID NO: 7221653 - DNA, 19 bp, Homo sapiens
tgtctgctgatgactctat

SEQ ID NO: 7221654 - DNA, 18 bp, Homo sapiens
tgtctctcctttctgtgt

SEQ ID NO: 7221655 - DNA, 18 bp, Homo sapiens
tgtctctcctttctgtgt

SEQ ID NO: 7221656 - DNA, 21 bp, Homo sapiens
tgtctcctgttggcacatggc

SEQ ID NO: 7221657 - DNA, 22 bp, Homo sapiens
tgtctccttgcttttccctgta

SEQ ID NO: 7221658 - DNA, 22 bp, Homo sapiens
tgtctccttgcttttccctgta

SEQ ID NO: 7221659 - DNA, 22 bp, Homo sapiens
tgtctctcatttagttttgcac

SEQ ID NO: 7221660 - DNA, 22 bp, Homo sapiens
tgtctcctctgtcctgtcagga

SEQ ID NO: 7221661 - DNA, 22 bp, Homo sapiens
tgtctcctctgtcctgtcagga

SEQ ID NO: 7221662 - DNA, 22 bp, Homo sapiens
tgtctcctgagagctggacaga

SEQ ID NO: 7221663 - DNA, 22 bp, Homo sapiens
tgtctcctgagagctggacaga

SEQ ID NO: 7221664 - DNA, 22 bp, Homo sapiens
tgtctcctgagagctggacaga

SEQ ID NO: 7221665 - DNA, 22 bp, Homo sapiens
tgtctcctgcaggggtgtgggc

SEQ ID NO: 7221666 - DNA, 22 bp, Homo sapiens
tgtctcctgcaggggtgtgggc

SEQ ID NO: 7221667 - DNA, 22 bp, Homo sapiens
tgtctcctgcaggggtgtgggc

SEQ ID NO: 7221668 - DNA, 22 bp, Homo sapiens
tgtctcctgagagctggacaga

SEQ ID NO: 7221669 - DNA, 22 bp, Homo sapiens
tgtctcctgggccctggccctg

SEQ ID NO: 7221670 - DNA, 22 bp, Homo sapiens
tgtctcctgggccctggccctg

SEQ ID NO: 7221671 - DNA, 22 bp, Homo sapiens
tgtctcctgggccctggccctg

SEQ ID NO: 7221672 - DNA, 22 bp, Homo sapiens
tgtctcctgggtcccttccacc

SEQ ID NO: 7221673 - DNA, 22 bp, Homo sapiens
tgtctcctgggtcccttccacc

SEQ ID NO: 7221674 - DNA, 22 bp, Homo sapiens
tgtctcctgggtcccttccacc

SEQ ID NO: 7221675 - DNA, 22 bp, Homo sapiens
tgtctcctgggtcccttccacc

SEQ ID NO: 7221676 - DNA, 22 bp, Homo sapiens
tgtctcctgggtcccttccacc

SEQ ID NO: 7221677 - DNA, 21 bp, Homo sapiens
tgtctcctgttggcacatggc

SEQ ID NO: 7221678 - DNA, 21 bp, Homo sapiens
tgtctcctgttggcacatggc

SEQ ID NO: 7221679 - DNA, 21 bp, Homo sapiens
tgtctcctgttggcacatggc

SEQ ID NO: 7221680 - DNA, 19 bp, Homo sapiens
tgtctcctcatgcaagtgt

SEQ ID NO: 7221681 - DNA, 22 bp, Homo sapiens
tgtctcctcaactcatgctcga

SEQ ID NO: 7221682 - DNA, 22 bp, Homo sapiens
tgtctcctcatactgtcatatt

SEQ ID NO: 7221683 - DNA, 22 bp, Homo sapiens
tgtctcctcatactgtcatatt

SEQ ID NO: 7221684 - DNA, 19 bp, Homo sapiens
tgtctcctcatgcaagtgt

SEQ ID NO: 7221685 - DNA, 19 bp, Homo sapiens
tgtctcctccccgccgtct

SEQ ID NO: 7221686 - DNA, 22 bp, Homo sapiens
tgtctcctcggctgtccagcca

SEQ ID NO: 7221687 - DNA, 22 bp, Homo sapiens
tgtctcctcggctgtccagcca

SEQ ID NO: 7221688 - DNA, 22 bp, Homo sapiens
tgtctcctcggctgtccagcca

SEQ ID NO: 7221689 - DNA, 19 bp, Homo sapiens
tgtctcctccccgccgtct

SEQ ID NO: 7221690 - DNA, 22 bp, Homo sapiens
tgtctcctctgtcctgtcagga

SEQ ID NO: 7221691 - DNA, 22 bp, Homo sapiens
tgtctcctcaactcatgctcga

SEQ ID NO: 7221692 - DNA, 22 bp, Homo sapiens
tgtctcctatttcctgctaagg

SEQ ID NO: 7221693 - DNA, 22 bp, Homo sapiens
tgtctcctatttcctgctaagg

SEQ ID NO: 7221694 - DNA, 22 bp, Homo sapiens
tgtctcctcaactcatgctcga

SEQ ID NO: 7221695 - DNA, 22 bp, Homo sapiens
tgtctcctcaactcatgctcga

SEQ ID NO: 7221696 - DNA, 22 bp, Homo sapiens
tgtctcctactgcctgtggatc

SEQ ID NO: 7221697 - DNA, 22 bp, Homo sapiens
tgtctcctactgcctgtggatc

SEQ ID NO: 7221698 - DNA, 22 bp, Homo sapiens
tgtctcctatttcctgctaagg

SEQ ID NO: 7221699 - DNA, 22 bp, Homo sapiens
tgtctcctatttcctgctaagg

SEQ ID NO: 7221700 - DNA, 22 bp, Homo sapiens
tgtctcccaggtgtgcccagtg

SEQ ID NO: 7221701 - DNA, 22 bp, Homo sapiens
tgtctcccaggtgtgcccagtg

SEQ ID NO: 7221702 - DNA, 22 bp, Homo sapiens
tgtctcccaggtgtgcccagtg

SEQ ID NO: 7221703 - DNA, 22 bp, Homo sapiens
tgtctcctaatgtctgtttcct

SEQ ID NO: 7221704 - DNA, 22 bp, Homo sapiens
tgtctcctaatgtctgtttcct

SEQ ID NO: 7221705 - DNA, 23 bp, Homo sapiens
tgtctccatctcattacttgggg

SEQ ID NO: 7221706 - DNA, 23 bp, Homo sapiens
tgtctccatctcattacttgggg

SEQ ID NO: 7221707 - DNA, 22 bp, Homo sapiens
tgtctccatggtgaagcagggt

SEQ ID NO: 7221708 - DNA, 22 bp, Homo sapiens
tgtctccatgtgatagtggcct

SEQ ID NO: 7221709 - DNA, 22 bp, Homo sapiens
tgtctccatgtgatagtggcct

SEQ ID NO: 7221710 - DNA, 22 bp, Homo sapiens
tgtctccattttcaagtagcag

SEQ ID NO: 7221711 - DNA, 22 bp, Homo sapiens
tgtctccattttcaagtagcag

SEQ ID NO: 7221712 - DNA, 22 bp, Homo sapiens
tgtctccaactcactgtatact

SEQ ID NO: 7221713 - DNA, 22 bp, Homo sapiens
tgtctccaactcactgtatact

SEQ ID NO: 7221714 - DNA, 22 bp, Homo sapiens
tgtctccacaggtgtcagctca

SEQ ID NO: 7221715 - DNA, 22 bp, Homo sapiens
tgtctatgtatacatgtgtata

SEQ ID NO: 7221716 - DNA, 22 bp, Homo sapiens
tgtctccaaaacaatctcagat

SEQ ID NO: 7221717 - DNA, 22 bp, Homo sapiens
tgtctagggtctgccccaccag

SEQ ID NO: 7221718 - DNA, 22 bp, Homo sapiens
tgtctagggcgagaatgtgtag

SEQ ID NO: 7221719 - DNA, 22 bp, Homo sapiens
tgtctaggtctaggttggcaat

SEQ ID NO: 7221720 - DNA, 22 bp, Homo sapiens
tgtctaggtctaggttggcaat

SEQ ID NO: 7221721 - DNA, 22 bp, Homo sapiens
tgtctaggttgcggttttatgt

SEQ ID NO: 7221722 - DNA, 22 bp, Homo sapiens
tgtctatgcaatggaaggactg

SEQ ID NO: 7221723 - DNA, 22 bp, Homo sapiens
tgtctccacaggtgtcagctca

SEQ ID NO: 7221724 - DNA, 22 bp, Homo sapiens
tgtctccacaggtgtcagctca

SEQ ID NO: 7221725 - DNA, 22 bp, Homo sapiens
tgtctccacaggtgtcagctca

SEQ ID NO: 7221726 - DNA, 22 bp, Homo sapiens
tgtctccaccatcatcttacca

SEQ ID NO: 7221727 - DNA, 20 bp, Homo sapiens
tgtctccagggctgagtgga

SEQ ID NO: 7221728 - DNA, 22 bp, Homo sapiens
tgtctccaggggcaggccagcc

SEQ ID NO: 7221729 - DNA, 22 bp, Homo sapiens
tgtctccaggggcaggccagcc

SEQ ID NO: 7221730 - DNA, 22 bp, Homo sapiens
tgtctccatagaagagactgca

SEQ ID NO: 7221731 - DNA, 22 bp, Homo sapiens
tgtctccatagagtagcttgat

SEQ ID NO: 7221732 - DNA, 22 bp, Homo sapiens
tgtctccatagagtagcttgat

SEQ ID NO: 7221733 - DNA, 22 bp, Homo sapiens
tgtctaatggcaatttcatgtg

SEQ ID NO: 7221734 - DNA, 22 bp, Homo sapiens
tgtctaagagtgcaatgcatga

SEQ ID NO: 7221735 - DNA, 22 bp, Homo sapiens
tgtctaagggaagatgcaatgt

SEQ ID NO: 7221736 - DNA, 22 bp, Homo sapiens
tgtctacaaacgtgtacacatt

SEQ ID NO: 7221737 - DNA, 22 bp, Homo sapiens
tgtctacacaaatcaaagcttc

SEQ ID NO: 7221738 - DNA, 22 bp, Homo sapiens
tgtctacacaaatcaaagcttc

SEQ ID NO: 7221739 - DNA, 22 bp, Homo sapiens
tgtctacagaatgttaatattt

SEQ ID NO: 7221740 - DNA, 22 bp, Homo sapiens
tgtctacagaatgttaatattt

SEQ ID NO: 7221741 - DNA, 22 bp, Homo sapiens
tgtctaaatgcaatggatttcc

SEQ ID NO: 7221742 - DNA, 22 bp, Homo sapiens
tgtctaaacttgttttatctca

SEQ ID NO: 7221743 - DNA, 22 bp, Homo sapiens
tgtctaaacttgttttatctca

SEQ ID NO: 7221744 - DNA, 19 bp, Homo sapiens
tgtctacataatagattga

SEQ ID NO: 7221745 - DNA, 22 bp, Homo sapiens
tgtctactgctgacactaacag

SEQ ID NO: 7221746 - DNA, 22 bp, Homo sapiens
tgtctagaaatgctgagtctca

SEQ ID NO: 7221747 - DNA, 22 bp, Homo sapiens
tgtctagaaatgctgagtctca

SEQ ID NO: 7221748 - DNA, 22 bp, Homo sapiens
tgtctagacaagaagtattgcc

SEQ ID NO: 7221749 - DNA, 22 bp, Homo sapiens
tgtctagacattagcttcagct

SEQ ID NO: 7221750 - DNA, 21 bp, Homo sapiens
tgtctagacctcatcctacag

SEQ ID NO: 7221751 - DNA, 21 bp, Homo sapiens
tgtctagacctcatcctacag

SEQ ID NO: 7221752 - DNA, 22 bp, Homo sapiens
tgtctagaggccaacaggaaag

SEQ ID NO: 7221753 - DNA, 15 bp, Homo sapiens
tgtctagattgttgt

SEQ ID NO: 7221754 - DNA, 22 bp, Homo sapiens
tgtctagacaagaagtattgcc

SEQ ID NO: 7221755 - DNA, 22 bp, Homo sapiens
tgtctagggagctgctcaggct

SEQ ID NO: 7221756 - DNA, 22 bp, Homo sapiens
tgtctgtgatttaggccagggc

SEQ ID NO: 7221757 - DNA, 22 bp, Homo sapiens
tgtctgtgatttaggccagggc

SEQ ID NO: 7221758 - DNA, 22 bp, Homo sapiens
tgtctgtgacctctttggagcc

SEQ ID NO: 7221759 - DNA, 22 bp, Homo sapiens
tgtctgtgacctcttaggcaag

SEQ ID NO: 7221760 - DNA, 22 bp, Homo sapiens
tgtctgggatgtaattcctgcc

SEQ ID NO: 7221761 - DNA, 22 bp, Homo sapiens
tgtctgggatgtaattcctgcc

SEQ ID NO: 7221762 - DNA, 22 bp, Homo sapiens
tgtctgggagggacagggctac

SEQ ID NO: 7221763 - DNA, 22 bp, Homo sapiens
tgtctgggagggacagggctac

SEQ ID NO: 7221764 - DNA, 22 bp, Homo sapiens
tgtctgggatgttggcagccac

SEQ ID NO: 7221765 - DNA, 22 bp, Homo sapiens
tgtctgggatgttggcagccac

SEQ ID NO: 7221766 - DNA, 22 bp, Homo sapiens
tgtctgggatgttggcagccac

SEQ ID NO: 7221767 - DNA, 22 bp, Homo sapiens
tgtctggggaactgtgcatcca

SEQ ID NO: 7221768 - DNA, 22 bp, Homo sapiens
tgtctgtgacagacctttgcta

SEQ ID NO: 7221769 - DNA, 22 bp, Homo sapiens
tgtctgtgacagacctttgcta

SEQ ID NO: 7221770 - DNA, 22 bp, Homo sapiens
tgtctggatgtctggagcatcg

SEQ ID NO: 7221771 - DNA, 22 bp, Homo sapiens
tgtctggatgtctggagcatcg

SEQ ID NO: 7221772 - DNA, 22 bp, Homo sapiens
tgtctggatgtctggagcatcg

SEQ ID NO: 7221773 - DNA, 20 bp, Homo sapiens
tgtctggatgtttaagcaga

SEQ ID NO: 7221774 - DNA, 23 bp, Homo sapiens
tgtctggattcgactgtggttgg

SEQ ID NO: 7221775 - DNA, 22 bp, Homo sapiens
tgtctggattgctgagccccag

SEQ ID NO: 7221776 - DNA, 22 bp, Homo sapiens
tgtctggcctcaaaagccattt

SEQ ID NO: 7221777 - DNA, 22 bp, Homo sapiens
tgtctgggagactgatcacccg

SEQ ID NO: 7221778 - DNA, 22 bp, Homo sapiens
tgtctgggagggacagggctac

SEQ ID NO: 7221779 - DNA, 22 bp, Homo sapiens
tgtctgggagggacagggctac

SEQ ID NO: 7221780 - DNA, 22 bp, Homo sapiens
tgtctgggagggacagggctac

SEQ ID NO: 7221781 - DNA, 22 bp, Homo sapiens
tgtctgctgatgtcacatagcc

SEQ ID NO: 7221782 - DNA, 22 bp, Homo sapiens
tgtctgctgccctggagcctgg

SEQ ID NO: 7221783 - DNA, 22 bp, Homo sapiens
tgtctgctggttgggagcttaa

SEQ ID NO: 7221784 - DNA, 19 bp, Homo sapiens
tgtctggaagagctgcagg

SEQ ID NO: 7221785 - DNA, 19 bp, Homo sapiens
tgtctggaagagctgcagg

SEQ ID NO: 7221786 - DNA, 22 bp, Homo sapiens
tgtctggaagggctatgtgacc

SEQ ID NO: 7221787 - DNA, 22 bp, Homo sapiens
tgtctggaagtaccagggaagc

SEQ ID NO: 7221788 - DNA, 22 bp, Homo sapiens
tgtctggaagtaccagggaagc

SEQ ID NO: 7221789 - DNA, 22 bp, Homo sapiens
tgtctggaatttctattttgtc

SEQ ID NO: 7221790 - DNA, 22 bp, Homo sapiens
tgtctggacagagattctcaat

SEQ ID NO: 7221791 - DNA, 22 bp, Homo sapiens
tgtctggacagagattctcaat

SEQ ID NO: 7221792 - DNA, 22 bp, Homo sapiens
tgtctggacattgacaatcatg

SEQ ID NO: 7221793 - DNA, 22 bp, Homo sapiens
tgtctggacattgacaatcatg

SEQ ID NO: 7221794 - DNA, 22 bp, Homo sapiens
tgtctggactgctcacagtacc

SEQ ID NO: 7221795 - DNA, 23 bp, Homo sapiens
tgtctggagagggcttgctctcc

SEQ ID NO: 7221796 - DNA, 23 bp, Homo sapiens
tgtctggagcctgagcaggtgct

SEQ ID NO: 7221797 - DNA, 23 bp, Homo sapiens
tgtctggagcctgagcaggtgct

SEQ ID NO: 7221798 - DNA, 22 bp, Homo sapiens
tgtctggagggctggctccctg

SEQ ID NO: 7221799 - DNA, 22 bp, Homo sapiens
tgtctggaggggatgttatggt

SEQ ID NO: 7221800 - DNA, 22 bp, Homo sapiens
tgtctggaggtcaggtcctggg

SEQ ID NO: 7221801 - DNA, 22 bp, Homo sapiens
tgtctggaggtcaggtcctggg

SEQ ID NO: 7221802 - DNA, 23 bp, Homo sapiens
tgtctggagttttgcactgttgc

SEQ ID NO: 7221803 - DNA, 22 bp, Homo sapiens
tgtctggatagagcctaggccc

SEQ ID NO: 7221804 - DNA, 22 bp, Homo sapiens
tgtctggatagagcctaggccc

SEQ ID NO: 7221805 - DNA, 22 bp, Homo sapiens
tgtctggatcagtgggtgcttg

SEQ ID NO: 7221806 - DNA, 22 bp, Homo sapiens
tgtctggatggtggagattgag

SEQ ID NO: 7221807 - DNA, 22 bp, Homo sapiens
tgtctggatggtggagattgag

SEQ ID NO: 7221808 - DNA, 22 bp, Homo sapiens
tgtcttaatttccctttgtcat

SEQ ID NO: 7221809 - DNA, 22 bp, Homo sapiens
tgtcttaatttggatgatgttt

SEQ ID NO: 7221810 - DNA, 19 bp, Homo sapiens
tgtcttaattaactcagag

SEQ ID NO: 7221811 - DNA, 22 bp, Homo sapiens
tgtcttaacataaaaggaaatc

SEQ ID NO: 7221812 - DNA, 22 bp, Homo sapiens
tgtcttaagaaattgcatttgt

SEQ ID NO: 7221813 - DNA, 22 bp, Homo sapiens
tgtctgtgacctctttggagcc

SEQ ID NO: 7221814 - DNA, 20 bp, Homo sapiens
tgtctgtgccacggcactcc

SEQ ID NO: 7221815 - DNA, 22 bp, Homo sapiens
tgtctgtgcccaaggctcccgg

SEQ ID NO: 7221816 - DNA, 22 bp, Homo sapiens
tgtctgtggcaattgtgggtaa

SEQ ID NO: 7221817 - DNA, 22 bp, Homo sapiens
tgtctgtggcaattgtgggtaa

SEQ ID NO: 7221818 - DNA, 22 bp, Homo sapiens
tgtctgtggcaattgtgggtaa

SEQ ID NO: 7221819 - DNA, 22 bp, Homo sapiens
tgtctgtggcaattgtgggtaa

SEQ ID NO: 7221820 - DNA, 22 bp, Homo sapiens
tgtctgtgggcaacgcctccca

SEQ ID NO: 7221821 - DNA, 22 bp, Homo sapiens
tgtctgtgtccaaatttcctct

SEQ ID NO: 7221822 - DNA, 22 bp, Homo sapiens
tgtctgtgtgagcaaatgactt

SEQ ID NO: 7221823 - DNA, 22 bp, Homo sapiens
tgtctgtgtgagcaaatgactt

SEQ ID NO: 7221824 - DNA, 22 bp, Homo sapiens
tgtctgttattggtgtataaga

SEQ ID NO: 7221825 - DNA, 22 bp, Homo sapiens
tgtcttaatttggatgatgttt

SEQ ID NO: 7221826 - DNA, 22 bp, Homo sapiens
tgtcttatgctgcatagactat

SEQ ID NO: 7221827 - DNA, 22 bp, Homo sapiens
tgtcttatgtagatactgagaa

SEQ ID NO: 7221828 - DNA, 20 bp, Homo sapiens
tgtcttattccagtgtttac

SEQ ID NO: 7221829 - DNA, 22 bp, Homo sapiens
tgtcttcacaaagcagaaggga

SEQ ID NO: 7221830 - DNA, 22 bp, Homo sapiens
tgtcttcactcaagtctcttgg

SEQ ID NO: 7221831 - DNA, 22 bp, Homo sapiens
tgtcttcagaattaagagtatg

SEQ ID NO: 7221832 - DNA, 22 bp, Homo sapiens
tgtcttcagcagtcatctgggg

SEQ ID NO: 7221833 - DNA, 22 bp, Homo sapiens
tgtcttcaggagtaaatatcat

SEQ ID NO: 7221834 - DNA, 22 bp, Homo sapiens
tgtcttcaggagtaaatatcat

SEQ ID NO: 7221835 - DNA, 22 bp, Homo sapiens
tgtcttcaggagtaaatatcat

SEQ ID NO: 7221836 - DNA, 22 bp, Homo sapiens
tgtcttcatctccatgcacaga

SEQ ID NO: 7221837 - DNA, 22 bp, Homo sapiens
tgtcttcatctccatgcacaga

SEQ ID NO: 7221838 - DNA, 22 bp, Homo sapiens
tgtcttcattccccatgaagtc

SEQ ID NO: 7221839 - DNA, 22 bp, Homo sapiens
tgtcttccatggttttgacact

SEQ ID NO: 7221840 - DNA, 22 bp, Homo sapiens
tgtcttcctcttggcttgagct

SEQ ID NO: 7221841 - DNA, 23 bp, Homo sapiens
tgtcttcgactcctgcgtgcttc

SEQ ID NO: 7221842 - DNA, 22 bp, Homo sapiens
tgtcttcatctccatgcacaga

SEQ ID NO: 7221843 - DNA, 21 bp, Homo sapiens
tgtcttcatatgagatggtgt

SEQ ID NO: 7221844 - DNA, 21 bp, Homo sapiens
tgtcttcatatgagatggtgt

SEQ ID NO: 7221845 - DNA, 22 bp, Homo sapiens
tgtcttcagtaaaatacactat

SEQ ID NO: 7221846 - DNA, 22 bp, Homo sapiens
tgtcttcagtaaaatacactat

SEQ ID NO: 7221847 - DNA, 22 bp, Homo sapiens
tgtcttcagtaaaatacactat

SEQ ID NO: 7221848 - DNA, 22 bp, Homo sapiens
tgtcttcagtaaaatacactat

SEQ ID NO: 7221849 - DNA, 22 bp, Homo sapiens
tgtcttctgtattcaagtctat

SEQ ID NO: 7221850 - DNA, 22 bp, Homo sapiens
tgtcttctaccttgacagcatt

SEQ ID NO: 7221851 - DNA, 22 bp, Homo sapiens
tgtcttgaggcgcagtgtagat

SEQ ID NO: 7221852 - DNA, 22 bp, Homo sapiens
tgtcttctaccttgacagcatt

SEQ ID NO: 7221853 - DNA, 22 bp, Homo sapiens
tgtcttcgctacaatgaaaagg

SEQ ID NO: 7221854 - DNA, 22 bp, Homo sapiens
tgtcttggccactaggagtgcc

SEQ ID NO: 7221855 - DNA, 22 bp, Homo sapiens
tgtcttggccactaggagtgcc

SEQ ID NO: 7221856 - DNA, 22 bp, Homo sapiens
tgtcttgattagaatgatgggc

SEQ ID NO: 7221857 - DNA, 22 bp, Homo sapiens
tgtctttaaaattaaacacatc

SEQ ID NO: 7221858 - DNA, 22 bp, Homo sapiens
tgtctttaaaattaaacacatc

SEQ ID NO: 7221859 - DNA, 22 bp, Homo sapiens
tgtctttaaaattaaacacatc

SEQ ID NO: 7221860 - DNA, 22 bp, Homo sapiens
tgtcttttataactgacatata

SEQ ID NO: 7221861 - DNA, 22 bp, Homo sapiens
tgtcttttataactgacatata

SEQ ID NO: 7221862 - DNA, 22 bp, Homo sapiens
tgtcttttggagcatctttctt

SEQ ID NO: 7221863 - DNA, 22 bp, Homo sapiens
tgtcttttgccaaagatcagtt

SEQ ID NO: 7221864 - DNA, 22 bp, Homo sapiens
tgtctttaattctacatatctc

SEQ ID NO: 7221865 - DNA, 22 bp, Homo sapiens
tgtctttgtgtacaggatcgcc

SEQ ID NO: 7221866 - DNA, 22 bp, Homo sapiens
tgtctttgttattgtggacagg

SEQ ID NO: 7221867 - DNA, 22 bp, Homo sapiens
tgtctttgttattgtggacagg

SEQ ID NO: 7221868 - DNA, 22 bp, Homo sapiens
tgtcttttacctaatgagctgg

SEQ ID NO: 7221869 - DNA, 22 bp, Homo sapiens
tgtcttttacctaatgagctgg

SEQ ID NO: 7221870 - DNA, 22 bp, Homo sapiens
tgtgaaaagggctttgtacaaa

SEQ ID NO: 7221871 - DNA, 22 bp, Homo sapiens
tgtgaaaagggctttgtacaaa

SEQ ID NO: 7221872 - DNA, 22 bp, Homo sapiens
tgtgaaaagggctttgtacaaa

SEQ ID NO: 7221873 - DNA, 22 bp, Homo sapiens
tgtgaaaagggctttgtacaaa

SEQ ID NO: 7221874 - DNA, 22 bp, Homo sapiens
tgtgaaaagggctttgtacaaa

SEQ ID NO: 7221875 - DNA, 22 bp, Homo sapiens
tgtgaaaagcgtgtgttctagg

SEQ ID NO: 7221876 - DNA, 22 bp, Homo sapiens
tgtgaaaagcgtgtgttctagg

SEQ ID NO: 7221877 - DNA, 22 bp, Homo sapiens
tgtgaaaagcgtgtgttctagg

SEQ ID NO: 7221878 - DNA, 22 bp, Homo sapiens
tgtgaaaagcgtgtgttctagg

SEQ ID NO: 7221879 - DNA, 22 bp, Homo sapiens
tgtgaaaagcaggctactttct

SEQ ID NO: 7221880 - DNA, 22 bp, Homo sapiens
tgtgaaaagcaggctactttct

SEQ ID NO: 7221881 - DNA, 22 bp, Homo sapiens
tgtgaaaagcaggctactttct

SEQ ID NO: 7221882 - DNA, 22 bp, Homo sapiens
tgtcttttggagcatctttctt

SEQ ID NO: 7221883 - DNA, 22 bp, Homo sapiens
tgtcttttggagcatctttctt

SEQ ID NO: 7221884 - DNA, 22 bp, Homo sapiens
tgtctttttactatgttcaatc

SEQ ID NO: 7221885 - DNA, 22 bp, Homo sapiens
tgtcttttggagcatctttctt

SEQ ID NO: 7221886 - DNA, 22 bp, Homo sapiens
tgtcttttggagcatctttctt

SEQ ID NO: 7221887 - DNA, 22 bp, Homo sapiens
tgtctttttactatgttcaatc

SEQ ID NO: 7221888 - DNA, 22 bp, Homo sapiens
tgtctttttactatgttcaatc

SEQ ID NO: 7221889 - DNA, 22 bp, Homo sapiens
tgtgaaaaaagttctagaagga

SEQ ID NO: 7221890 - DNA, 22 bp, Homo sapiens
tgtgaaaaaagttctagaagga

SEQ ID NO: 7221891 - DNA, 22 bp, Homo sapiens
tgtgaaaaaagttctagaagga

SEQ ID NO: 7221892 - DNA, 22 bp, Homo sapiens
tgtgaaaaaagttctagaagga

SEQ ID NO: 7221893 - DNA, 22 bp, Homo sapiens
tggtcctgccccgtgcacagag

SEQ ID NO: 7221894 - DNA, 22 bp, Homo sapiens
tggtcctggagagtgttccata

SEQ ID NO: 7221895 - DNA, 22 bp, Homo sapiens
tggtcctgctacaggggattag

SEQ ID NO: 7221896 - DNA, 22 bp, Homo sapiens
tggtcctggaaggtcctgaggg

SEQ ID NO: 7221897 - DNA, 22 bp, Homo sapiens
tggtcctcaggttctctgtgcg

SEQ ID NO: 7221898 - DNA, 22 bp, Homo sapiens
tggtcctgaggcttgtttccac

SEQ ID NO: 7221899 - DNA, 22 bp, Homo sapiens
tggtcctgatcaccgctgggca

SEQ ID NO: 7221900 - DNA, 22 bp, Homo sapiens
tggtcctgatcaccgctgggca

SEQ ID NO: 7221901 - DNA, 22 bp, Homo sapiens
tggtcctgatcaccgctgggca

SEQ ID NO: 7221902 - DNA, 20 bp, Homo sapiens
tggtccaggacctggtgtcc

SEQ ID NO: 7221903 - DNA, 22 bp, Homo sapiens
tggtccagggtgtagtacagag

SEQ ID NO: 7221904 - DNA, 22 bp, Homo sapiens
tggtccagggtgtagtacagag

SEQ ID NO: 7221905 - DNA, 17 bp, Homo sapiens
tggtccaggtggagcca

SEQ ID NO: 7221906 - DNA, 20 bp, Homo sapiens
tggtcctcacatgccatctt

SEQ ID NO: 7221907 - DNA, 22 bp, Homo sapiens
tggtcctcaccctacccagctg

SEQ ID NO: 7221908 - DNA, 22 bp, Homo sapiens
tggtcctcaccctacccagctg

SEQ ID NO: 7221909 - DNA, 22 bp, Homo sapiens
tggtcatttttatttcagttgc

SEQ ID NO: 7221910 - DNA, 22 bp, Homo sapiens
tggtccagaagatattcaacca

SEQ ID NO: 7221911 - DNA, 22 bp, Homo sapiens
tggtcattgtttgctggctctt

SEQ ID NO: 7221912 - DNA, 19 bp, Homo sapiens
tggtcatttctaatggttc

SEQ ID NO: 7221913 - DNA, 22 bp, Homo sapiens
tggtcatttctgggttctgacc

SEQ ID NO: 7221914 - DNA, 17 bp, Homo sapiens
tggtcattttaatttta

SEQ ID NO: 7221915 - DNA, 22 bp, Homo sapiens
tggtcattttggcatcttgggt

SEQ ID NO: 7221916 - DNA, 22 bp, Homo sapiens
tggtcattttggcatcttgggt

SEQ ID NO: 7221917 - DNA, 21 bp, Homo sapiens
tggtcattgatagtgcaggga

SEQ ID NO: 7221918 - DNA, 22 bp, Homo sapiens
tggtcattgatagtgcagggaa

SEQ ID NO: 7221919 - DNA, 21 bp, Homo sapiens
tggtcattgcggtggaaggag

SEQ ID NO: 7221920 - DNA, 22 bp, Homo sapiens
tggtcattgctattgtttctca

SEQ ID NO: 7221921 - DNA, 22 bp, Homo sapiens
tggtcattggtagtgcagggag

SEQ ID NO: 7221922 - DNA, 22 bp, Homo sapiens
tggtcattgttaaggtcacaca

SEQ ID NO: 7221923 - DNA, 22 bp, Homo sapiens
tggtcataacatgattagtagg

SEQ ID NO: 7221924 - DNA, 22 bp, Homo sapiens
tggtcatgtagtagagacagct

SEQ ID NO: 7221925 - DNA, 22 bp, Homo sapiens
tggtcattaattcttaccttta

SEQ ID NO: 7221926 - DNA, 22 bp, Homo sapiens
tggtcatgtagtagagacagct

SEQ ID NO: 7221927 - DNA, 22 bp, Homo sapiens
tggtcattctgttctacagtag

SEQ ID NO: 7221928 - DNA, 22 bp, Homo sapiens
tggtcagttgcatcagagaagt

SEQ ID NO: 7221929 - DNA, 22 bp, Homo sapiens
tggtcagttgtgactagaacac

SEQ ID NO: 7221930 - DNA, 22 bp, Homo sapiens
tggtcagttgtgactagaacac

SEQ ID NO: 7221931 - DNA, 22 bp, Homo sapiens
tggtcagttgtgactagaacac

SEQ ID NO: 7221932 - DNA, 22 bp, Homo sapiens
tggtcaggtacctctggctgtc

SEQ ID NO: 7221933 - DNA, 23 bp, Homo sapiens
tggtcagtgccttgcatgtggga

SEQ ID NO: 7221934 - DNA, 21 bp, Homo sapiens
tggtcagtatttcagttacat

SEQ ID NO: 7221935 - DNA, 22 bp, Homo sapiens
tggtcagtgtgacattttttaa

SEQ ID NO: 7221936 - DNA, 22 bp, Homo sapiens
tggtcaggggcttctgagctgt

SEQ ID NO: 7221937 - DNA, 22 bp, Homo sapiens
tggtcaggggcttctgagctgt

SEQ ID NO: 7221938 - DNA, 22 bp, Homo sapiens
tggtcaggctgctctgcggcgt

SEQ ID NO: 7221939 - DNA, 22 bp, Homo sapiens
tggtcaggctgctctgcggcgt

SEQ ID NO: 7221940 - DNA, 22 bp, Homo sapiens
tggtcaggattctcagcccttc

SEQ ID NO: 7221941 - DNA, 22 bp, Homo sapiens
tggtcagcgtttgtcagagcag

SEQ ID NO: 7221942 - DNA, 22 bp, Homo sapiens
tggtcagcttcagagtgttcca

SEQ ID NO: 7221943 - DNA, 22 bp, Homo sapiens
tggtcagacaaaggagaatgtt

SEQ ID NO: 7221944 - DNA, 22 bp, Homo sapiens
tggtcagcgtttgtcagagcag

SEQ ID NO: 7221945 - DNA, 22 bp, Homo sapiens
tggtcacagtgtattgatcagg

SEQ ID NO: 7221946 - DNA, 22 bp, Homo sapiens
tggtcacccactgggactgcgg

SEQ ID NO: 7221947 - DNA, 22 bp, Homo sapiens
tggtcacttttgccagtggatg

SEQ ID NO: 7221948 - DNA, 22 bp, Homo sapiens
tggtcctggtcatctgggctgg

SEQ ID NO: 7221949 - DNA, 22 bp, Homo sapiens
tggtcctggtcatctgggctgg

SEQ ID NO: 7221950 - DNA, 22 bp, Homo sapiens
tggtcctggtcatctgggctgg

SEQ ID NO: 7221951 - DNA, 22 bp, Homo sapiens
tggtcctggtagcggtgtgctt

SEQ ID NO: 7221952 - DNA, 22 bp, Homo sapiens
tggtcctggggtgcaggctgac

SEQ ID NO: 7221953 - DNA, 22 bp, Homo sapiens
tggtcctgtagcacttgattag

SEQ ID NO: 7221954 - DNA, 22 bp, Homo sapiens
tggtcctgtagctctctaagtt

SEQ ID NO: 7221955 - DNA, 22 bp, Homo sapiens
tggtcctgtctcaaggagcctt

SEQ ID NO: 7221956 - DNA, 22 bp, Homo sapiens
tggtcctgtgttcttcctgcct

SEQ ID NO: 7221957 - DNA, 22 bp, Homo sapiens
tggtcctgtgttcttcctgcct

SEQ ID NO: 7221958 - DNA, 22 bp, Homo sapiens
tggtctcccagagcagggacgc

SEQ ID NO: 7221959 - DNA, 22 bp, Homo sapiens
tggtctctccatgccctccacc

SEQ ID NO: 7221960 - DNA, 22 bp, Homo sapiens
tggtcgaccagttggaaagtaa

SEQ ID NO: 7221961 - DNA, 23 bp, Homo sapiens
tggtctcacttggtaagatgaag

SEQ ID NO: 7221962 - DNA, 23 bp, Homo sapiens
tggtctcacttggtaagatgaag

SEQ ID NO: 7221963 - DNA, 22 bp, Homo sapiens
tggtccttgtaggcatttgagc

SEQ ID NO: 7221964 - DNA, 22 bp, Homo sapiens
tggtgcaagtctctgaggaggg

SEQ ID NO: 7221965 - DNA, 22 bp, Homo sapiens
tggtgcagagagggatctaggg

SEQ ID NO: 7221966 - DNA, 22 bp, Homo sapiens
tggtgcagagagggatctaggg

SEQ ID NO: 7221967 - DNA, 22 bp, Homo sapiens
tggtgcagatagtggtgtagta

SEQ ID NO: 7221968 - DNA, 22 bp, Homo sapiens
tggtgcagatagtggtgtagta

SEQ ID NO: 7221969 - DNA, 22 bp, Homo sapiens
tggtgaggtcatagagaactgt

SEQ ID NO: 7221970 - DNA, 22 bp, Homo sapiens
tggtgaggtcatagagaactgt

SEQ ID NO: 7221971 - DNA, 22 bp, Homo sapiens
tggtgatcagtcaactgtcttc

SEQ ID NO: 7221972 - DNA, 22 bp, Homo sapiens
tggtgaggtcatagagaactgt

SEQ ID NO: 7221973 - DNA, 22 bp, Homo sapiens
tggtgaggtcatagagaactgt

SEQ ID NO: 7221974 - DNA, 22 bp, Homo sapiens
tggtgaggccaaagccatgaca

SEQ ID NO: 7221975 - DNA, 22 bp, Homo sapiens
tggtgaggccaaagccatgaca

SEQ ID NO: 7221976 - DNA, 22 bp, Homo sapiens
tggtgaggccaaagccatgaca

SEQ ID NO: 7221977 - DNA, 22 bp, Homo sapiens
tggtgaggaagacctgctcctg

SEQ ID NO: 7221978 - DNA, 22 bp, Homo sapiens
tggtgaggaagacctgctcctg

SEQ ID NO: 7221979 - DNA, 18 bp, Homo sapiens
tggtgaagggtggaggag

SEQ ID NO: 7221980 - DNA, 18 bp, Homo sapiens
tggtgaagggtggaggag

SEQ ID NO: 7221981 - DNA, 22 bp, Homo sapiens
tggtgaatagtagcttcagact

SEQ ID NO: 7221982 - DNA, 18 bp, Homo sapiens
tggtgaagggtggaggag

SEQ ID NO: 7221983 - DNA, 18 bp, Homo sapiens
tggtgaagggtggaggag

SEQ ID NO: 7221984 - DNA, 22 bp, Homo sapiens
tggtctctgctgcagcttctca

SEQ ID NO: 7221985 - DNA, 22 bp, Homo sapiens
tggtctctgcaggccaggctca

SEQ ID NO: 7221986 - DNA, 22 bp, Homo sapiens
tggtctctgtaggctaccccat

SEQ ID NO: 7221987 - DNA, 19 bp, Homo sapiens
tggtctctgtctctttgca

SEQ ID NO: 7221988 - DNA, 19 bp, Homo sapiens
tggtctctgtctctttgca

SEQ ID NO: 7221989 - DNA, 22 bp, Homo sapiens
tggtgacagcatggaagaagtg

SEQ ID NO: 7221990 - DNA, 22 bp, Homo sapiens
tggtgacagcatggaagaagtg

SEQ ID NO: 7221991 - DNA, 22 bp, Homo sapiens
tggtgacagcatggaagaagtg

SEQ ID NO: 7221992 - DNA, 22 bp, Homo sapiens
tggtgacagcatggaagaagtg

SEQ ID NO: 7221993 - DNA, 22 bp, Homo sapiens
tggtgcagtccaaagggagcag

SEQ ID NO: 7221994 - DNA, 22 bp, Homo sapiens
tggtgcagttcccagggccggg

SEQ ID NO: 7221995 - DNA, 22 bp, Homo sapiens
tggtgcagttcccagggccggg

SEQ ID NO: 7221996 - DNA, 22 bp, Homo sapiens
tggtgccaagcatgaggactct

SEQ ID NO: 7221997 - DNA, 22 bp, Homo sapiens
tggtgcagttcccagggccggg

SEQ ID NO: 7221998 - DNA, 22 bp, Homo sapiens
tggtgccaagcatgaggactct

SEQ ID NO: 7221999 - DNA, 22 bp, Homo sapiens
tggtgcagtccaaagggagcag

SEQ ID NO: 7222000 - DNA, 22 bp, Homo sapiens
tggtgcagtccaaagggagcag

SEQ ID NO: 7222001 - DNA, 22 bp, Homo sapiens
tggtgcagtccaaagggagcag

SEQ ID NO: 7222002 - DNA, 22 bp, Homo sapiens
tggtgcccttgacagagccagc

SEQ ID NO: 7222003 - DNA, 22 bp, Homo sapiens
tggtgcccttgtgggtgagatg

SEQ ID NO: 7222004 - DNA, 22 bp, Homo sapiens
tggtgccattagccctgctgtt

SEQ ID NO: 7222005 - DNA, 22 bp, Homo sapiens
tggtgccattagccctgctgtt

SEQ ID NO: 7222006 - DNA, 22 bp, Homo sapiens
tggtgccaccctccttcagctg

SEQ ID NO: 7222007 - DNA, 22 bp, Homo sapiens
tggtgccatcatagctcactgc

SEQ ID NO: 7222008 - DNA, 22 bp, Homo sapiens
tggtgccatcatagctcactgc

SEQ ID NO: 7222009 - DNA, 22 bp, Homo sapiens
tggtgcaggagttggcagggac

SEQ ID NO: 7222010 - DNA, 22 bp, Homo sapiens
tggtgcaggccaagctgcgagc

SEQ ID NO: 7222011 - DNA, 22 bp, Homo sapiens
tggtgcaggccaagctgcgagc

SEQ ID NO: 7222012 - DNA, 22 bp, Homo sapiens
tggtgcaggccaagctgcgagc

SEQ ID NO: 7222013 - DNA, 22 bp, Homo sapiens
tggtgcaggtgttgatgcagga

SEQ ID NO: 7222014 - DNA, 22 bp, Homo sapiens
tggtgcaggtgttgatgcagga

SEQ ID NO: 7222015 - DNA, 22 bp, Homo sapiens
tggtgcagatagtggtgtagta

SEQ ID NO: 7222016 - DNA, 22 bp, Homo sapiens
tggtgcaggagttggcagggac

SEQ ID NO: 7222017 - DNA, 22 bp, Homo sapiens
tggtgcaggagttggcagggac

SEQ ID NO: 7222018 - DNA, 22 bp, Homo sapiens
tggtgcagtagaaggccgactt

SEQ ID NO: 7222019 - DNA, 22 bp, Homo sapiens
tggtgcagtagagctgtctggg

SEQ ID NO: 7222020 - DNA, 22 bp, Homo sapiens
tggtgcagtcattggcccaggg

SEQ ID NO: 7222021 - DNA, 22 bp, Homo sapiens
tggtgcagtagagctgtctggg

SEQ ID NO: 7222022 - DNA, 22 bp, Homo sapiens
tggtgcagtagagctgtctggg

SEQ ID NO: 7222023 - DNA, 22 bp, Homo sapiens
tggtgcagtagagctgtctggg

SEQ ID NO: 7222024 - DNA, 21 bp, Homo sapiens
tggtggagtgtgctgagcatg

SEQ ID NO: 7222025 - DNA, 22 bp, Homo sapiens
tggtggagtttctctttcaaac

SEQ ID NO: 7222026 - DNA, 22 bp, Homo sapiens
tggtggcaaaagaggcaaagtg

SEQ ID NO: 7222027 - DNA, 22 bp, Homo sapiens
tggtggcaaaagaggcaaagtg

SEQ ID NO: 7222028 - DNA, 22 bp, Homo sapiens
tggtggcaaatcaggacacttc

SEQ ID NO: 7222029 - DNA, 22 bp, Homo sapiens
tggtggcaaatcaggacacttc

SEQ ID NO: 7222030 - DNA, 22 bp, Homo sapiens
tggtggcaacattgctggagtg

SEQ ID NO: 7222031 - DNA, 22 bp, Homo sapiens
tggtggcaacattgctggagtg

SEQ ID NO: 7222032 - DNA, 22 bp, Homo sapiens
tggtggcaacattgctggagtg

SEQ ID NO: 7222033 - DNA, 22 bp, Homo sapiens
tggtggcaacattgctggagtg

SEQ ID NO: 7222034 - DNA, 22 bp, Homo sapiens
tggtggcaacattgctggagtg

SEQ ID NO: 7222035 - DNA, 21 bp, Homo sapiens
tggtggagtgtgctgagcatg

SEQ ID NO: 7222036 - DNA, 21 bp, Homo sapiens
tggtggagtgtgctgagcatg

SEQ ID NO: 7222037 - DNA, 21 bp, Homo sapiens
tggtggagtgtgctgagcatg

SEQ ID NO: 7222038 - DNA, 21 bp, Homo sapiens
tggtggagtgtgctgagcatg

SEQ ID NO: 7222039 - DNA, 19 bp, Homo sapiens
tggtggaggtgcacctgac

SEQ ID NO: 7222040 - DNA, 19 bp, Homo sapiens
tggtggaggtgcacctgac

SEQ ID NO: 7222041 - DNA, 19 bp, Homo sapiens
tggtggaggtgcacctgac

SEQ ID NO: 7222042 - DNA, 19 bp, Homo sapiens
tggtggaggtgcacctgac

SEQ ID NO: 7222043 - DNA, 22 bp, Homo sapiens
tggtggaggtgcatttcggagc

SEQ ID NO: 7222044 - DNA, 19 bp, Homo sapiens
tggtggaggccccatgttc

SEQ ID NO: 7222045 - DNA, 19 bp, Homo sapiens
tggtggaggccccatgttc

SEQ ID NO: 7222046 - DNA, 22 bp, Homo sapiens
tggtggagggaactatttccag

SEQ ID NO: 7222047 - DNA, 22 bp, Homo sapiens
tggtggagggaactatttccag

SEQ ID NO: 7222048 - DNA, 22 bp, Homo sapiens
tggtggagctgtggccacgacc

SEQ ID NO: 7222049 - DNA, 22 bp, Homo sapiens
tggtggagctgtggccacgacc

SEQ ID NO: 7222050 - DNA, 22 bp, Homo sapiens
tggtggagcctaggctaagtct

SEQ ID NO: 7222051 - DNA, 22 bp, Homo sapiens
tggtggagcctaggctaagtct

SEQ ID NO: 7222052 - DNA, 22 bp, Homo sapiens
tggtggagcctaggctaagtct

SEQ ID NO: 7222053 - DNA, 20 bp, Homo sapiens
tggtggactttggcatggct

SEQ ID NO: 7222054 - DNA, 22 bp, Homo sapiens
tggtggagacctcgctaacccc

SEQ ID NO: 7222055 - DNA, 22 bp, Homo sapiens
tggtggagacctcgctaacccc

SEQ ID NO: 7222056 - DNA, 22 bp, Homo sapiens
tggtggagacctcgctaacccc

SEQ ID NO: 7222057 - DNA, 20 bp, Homo sapiens
tggtggagagaagctatttg

SEQ ID NO: 7222058 - DNA, 22 bp, Homo sapiens
tggtggagagacagtgtattgg

SEQ ID NO: 7222059 - DNA, 20 bp, Homo sapiens
tggtggagagaagctatttg

SEQ ID NO: 7222060 - DNA, 22 bp, Homo sapiens
tggtggagagacagtgtattgg

SEQ ID NO: 7222061 - DNA, 20 bp, Homo sapiens
tggtggactttggcatggct

SEQ ID NO: 7222062 - DNA, 22 bp, Homo sapiens
tggtggacgatgcccagctgga

SEQ ID NO: 7222063 - DNA, 21 bp, Homo sapiens
tggtggaccagtgctgggaga

SEQ ID NO: 7222064 - DNA, 22 bp, Homo sapiens
tggtggacattctggatgtgct

SEQ ID NO: 7222065 - DNA, 22 bp, Homo sapiens
tggtggacatcccagggtgaaa

SEQ ID NO: 7222066 - DNA, 22 bp, Homo sapiens
tggtgctgtggaggggcagaag

SEQ ID NO: 7222067 - DNA, 22 bp, Homo sapiens
tggtggacaccgcagccatgaa

SEQ ID NO: 7222068 - DNA, 22 bp, Homo sapiens
tggtggacaccgcagccatgaa

SEQ ID NO: 7222069 - DNA, 22 bp, Homo sapiens
tggtggacaccgcagccatgaa

SEQ ID NO: 7222070 - DNA, 21 bp, Homo sapiens
tggtgccttcagctgtctttt

SEQ ID NO: 7222071 - DNA, 23 bp, Homo sapiens
tggtggcagaagtagcagatgac

SEQ ID NO: 7222072 - DNA, 23 bp, Homo sapiens
tggtggcagaagtagcagatgac

SEQ ID NO: 7222073 - DNA, 22 bp, Homo sapiens
tggtggcacaagggagagaatc

SEQ ID NO: 7222074 - DNA, 23 bp, Homo sapiens
tggtggcagaagtagcagatgac

SEQ ID NO: 7222075 - DNA, 22 bp, Homo sapiens
tggtggcagagcaagagctgga

SEQ ID NO: 7222076 - DNA, 22 bp, Homo sapiens
tggtggcagagcaagagctgga

SEQ ID NO: 7222077 - DNA, 22 bp, Homo sapiens
tggtggcagagcaagagctgga

SEQ ID NO: 7222078 - DNA, 19 bp, Homo sapiens
tggtggcaatgtcagctaa

SEQ ID NO: 7222079 - DNA, 19 bp, Homo sapiens
tggtggcaatgtcagctaa

SEQ ID NO: 7222080 - DNA, 22 bp, Homo sapiens
tggtggcaatgtcctggagaag

SEQ ID NO: 7222081 - DNA, 22 bp, Homo sapiens
tggtggcaatgtcctggagaag

SEQ ID NO: 7222082 - DNA, 22 bp, Homo sapiens
tggtggcaatgtcctggagaag

SEQ ID NO: 7222083 - DNA, 22 bp, Homo sapiens
tggtggcaatgtcctggagaag

SEQ ID NO: 7222084 - DNA, 22 bp, Homo sapiens
tggtggcaatgtcctggagaag

SEQ ID NO: 7222085 - DNA, 22 bp, Homo sapiens
tggtggcaattcaaagacagca

SEQ ID NO: 7222086 - DNA, 22 bp, Homo sapiens
tggtggcacaagggagagaatc

SEQ ID NO: 7222087 - DNA, 22 bp, Homo sapiens
tggtggcagctgggacagaggt

SEQ ID NO: 7222088 - DNA, 22 bp, Homo sapiens
tggtggcagctgggacagaggt

SEQ ID NO: 7222089 - DNA, 22 bp, Homo sapiens
tggtggcagctgagtgtcaggt

SEQ ID NO: 7222090 - DNA, 22 bp, Homo sapiens
tggtggcagcaggagggcccct

SEQ ID NO: 7222091 - DNA, 22 bp, Homo sapiens
tggtggcagagcaagagctgga

SEQ ID NO: 7222092 - DNA, 22 bp, Homo sapiens
tggtggcagctgagtgtcaggt

SEQ ID NO: 7222093 - DNA, 22 bp, Homo sapiens
tggtggcagctgagtgtcaggt

SEQ ID NO: 7222094 - DNA, 22 bp, Homo sapiens
tggtggcagctgggacagaggt

SEQ ID NO: 7222095 - DNA, 22 bp, Homo sapiens
tggtggcagtctcctggctgtg

SEQ ID NO: 7222096 - DNA, 22 bp, Homo sapiens
tggtggcagtgagaaggagagg

SEQ ID NO: 7222097 - DNA, 22 bp, Homo sapiens
tggtggcatcagtgaagtacac

SEQ ID NO: 7222098 - DNA, 22 bp, Homo sapiens
tggtggcatcagtgaagtacac

SEQ ID NO: 7222099 - DNA, 22 bp, Homo sapiens
tggtggcatcactcagcctccc

SEQ ID NO: 7222100 - DNA, 22 bp, Homo sapiens
tggtggcatgatagtgtgaatg

SEQ ID NO: 7222101 - DNA, 22 bp, Homo sapiens
tggtggccaattcacagggctc

SEQ ID NO: 7222102 - DNA, 22 bp, Homo sapiens
tggtggccaattcacagggctc

SEQ ID NO: 7222103 - DNA, 22 bp, Homo sapiens
tggtggccaattcacagggctc

SEQ ID NO: 7222104 - DNA, 20 bp, Homo sapiens
tggtggccagtgctgcaggc

SEQ ID NO: 7222105 - DNA, 20 bp, Homo sapiens
tggtggccagtgctgcaggc

SEQ ID NO: 7222106 - DNA, 22 bp, Homo sapiens
tggtggccacgtgggcgcgagc

SEQ ID NO: 7222107 - DNA, 16 bp, Homo sapiens
tggtggccatagttat

SEQ ID NO: 7222108 - DNA, 16 bp, Homo sapiens
tggtggccatagttat

SEQ ID NO: 7222109 - DNA, 20 bp, Homo sapiens
tggtggccagtgctgcaggc

SEQ ID NO: 7222110 - DNA, 22 bp, Homo sapiens
tggtgggagtccgctgtgctgc

SEQ ID NO: 7222111 - DNA, 22 bp, Homo sapiens
tggtgggagtccgctgtgctgc

SEQ ID NO: 7222112 - DNA, 22 bp, Homo sapiens
tggtgggagtgagggcatgcca

SEQ ID NO: 7222113 - DNA, 22 bp, Homo sapiens
tggtgggagtgagggcatgcca

SEQ ID NO: 7222114 - DNA, 22 bp, Homo sapiens
tggtgggagtgagggcatgcca

SEQ ID NO: 7222115 - DNA, 22 bp, Homo sapiens
tggtgggcacagtgcccaggct

SEQ ID NO: 7222116 - DNA, 22 bp, Homo sapiens
tggtgggcacagtgcccaggct

SEQ ID NO: 7222117 - DNA, 22 bp, Homo sapiens
tggtggggattccctccctggc

SEQ ID NO: 7222118 - DNA, 16 bp, Homo sapiens
tggtggggaggacagc

SEQ ID NO: 7222119 - DNA, 16 bp, Homo sapiens
tggtggggaggacagc

SEQ ID NO: 7222120 - DNA, 16 bp, Homo sapiens
tggtggggaggacagc

SEQ ID NO: 7222121 - DNA, 16 bp, Homo sapiens
tggtggggaggacagc

SEQ ID NO: 7222122 - DNA, 16 bp, Homo sapiens
tggtggggaggacagc

SEQ ID NO: 7222123 - DNA, 22 bp, Homo sapiens
tggtgggcacagtgcccaggct

SEQ ID NO: 7222124 - DNA, 22 bp, Homo sapiens
tggtgggcacagtgcccaggct

SEQ ID NO: 7222125 - DNA, 22 bp, Homo sapiens
tggtgggcacagtgcccaggct

SEQ ID NO: 7222126 - DNA, 23 bp, Homo sapiens
tggtgggccctgcttgctcactg

SEQ ID NO: 7222127 - DNA, 23 bp, Homo sapiens
tggtgggccctgcttgctcactg

SEQ ID NO: 7222128 - DNA, 22 bp, Homo sapiens
tggtgggctgagtctcatcgga

SEQ ID NO: 7222129 - DNA, 16 bp, Homo sapiens
tggtggggaggacagc

SEQ ID NO: 7222130 - DNA, 22 bp, Homo sapiens
tggtgggctgagtctcatcgga

SEQ ID NO: 7222131 - DNA, 22 bp, Homo sapiens
tggtgggggaggctgtctagca

SEQ ID NO: 7222132 - DNA, 22 bp, Homo sapiens
tggtgggggaggctgtctagca

SEQ ID NO: 7222133 - DNA, 22 bp, Homo sapiens
tggtgggggaggctgtctagca

SEQ ID NO: 7222134 - DNA, 22 bp, Homo sapiens
tggtgggggaggctgtctagca

SEQ ID NO: 7222135 - DNA, 22 bp, Homo sapiens
tggtggggtcatcgtcagatgc

SEQ ID NO: 7222136 - DNA, 22 bp, Homo sapiens
tggtgggggaggctgtctagca

SEQ ID NO: 7222137 - DNA, 22 bp, Homo sapiens
tggtggggtcatcgtcagatgc

SEQ ID NO: 7222138 - DNA, 22 bp, Homo sapiens
tggtggggctttccttctgctt

SEQ ID NO: 7222139 - DNA, 22 bp, Homo sapiens
tggtggggctttccttctgctt

SEQ ID NO: 7222140 - DNA, 22 bp, Homo sapiens
tggtgggggaggctgtctagca

SEQ ID NO: 7222141 - DNA, 22 bp, Homo sapiens
tggtgggggaggctgtctagca

SEQ ID NO: 7222142 - DNA, 22 bp, Homo sapiens
tggtgggggaggctgtctagca

SEQ ID NO: 7222143 - DNA, 22 bp, Homo sapiens
tggtgggggaggctgtctagca

SEQ ID NO: 7222144 - DNA, 22 bp, Homo sapiens
tggtgggggaggctgtctagca

SEQ ID NO: 7222145 - DNA, 22 bp, Homo sapiens
tggtggggccagacttcagctc

SEQ ID NO: 7222146 - DNA, 22 bp, Homo sapiens
tggtggggctttccttctgctt

SEQ ID NO: 7222147 - DNA, 22 bp, Homo sapiens
tggtggggccagacttcagctc

SEQ ID NO: 7222148 - DNA, 22 bp, Homo sapiens
tggtggggctttccttctgctt

SEQ ID NO: 7222149 - DNA, 22 bp, Homo sapiens
tggtggggctttccttctgctt

SEQ ID NO: 7222150 - DNA, 22 bp, Homo sapiens
tggtggggctttccttctgctt

SEQ ID NO: 7222151 - DNA, 22 bp, Homo sapiens
tggtggggccagacttcagctc

SEQ ID NO: 7222152 - DNA, 22 bp, Homo sapiens
tggtggggccagacttcagctc

SEQ ID NO: 7222153 - DNA, 22 bp, Homo sapiens
tggtggggccagacttcagctc

SEQ ID NO: 7222154 - DNA, 22 bp, Homo sapiens
tggtggggccagacttcagctc

SEQ ID NO: 7222155 - DNA, 16 bp, Homo sapiens
tggtggggaggacagc

SEQ ID NO: 7222156 - DNA, 22 bp, Homo sapiens
tggtggggattccctccctggc

SEQ ID NO: 7222157 - DNA, 22 bp, Homo sapiens
tggtggggattccctccctggc

SEQ ID NO: 7222158 - DNA, 22 bp, Homo sapiens
tggtggggattccctccctggc

SEQ ID NO: 7222159 - DNA, 22 bp, Homo sapiens
tggtgggtcggctgggagagct

SEQ ID NO: 7222160 - DNA, 22 bp, Homo sapiens
tggtgggtcggctgggagagct

SEQ ID NO: 7222161 - DNA, 22 bp, Homo sapiens
tggtgggtcggctgggagagct

SEQ ID NO: 7222162 - DNA, 22 bp, Homo sapiens
tggtgggtcggctgggagagct

SEQ ID NO: 7222163 - DNA, 22 bp, Homo sapiens
tggtggtcatagcagaggccgt

SEQ ID NO: 7222164 - DNA, 18 bp, Homo sapiens
tggtggtgacagggtcat

SEQ ID NO: 7222165 - DNA, 22 bp, Homo sapiens
tggtgtcactcaagcccggccg

SEQ ID NO: 7222166 - DNA, 22 bp, Homo sapiens
tggtgtcactcaagcccggccg

SEQ ID NO: 7222167 - DNA, 22 bp, Homo sapiens
tggtgtcatataaggggctctg

SEQ ID NO: 7222168 - DNA, 22 bp, Homo sapiens
tggtgtcatgttggggtttatt

SEQ ID NO: 7222169 - DNA, 22 bp, Homo sapiens
tggtgtcctaagtggaaggaca

SEQ ID NO: 7222170 - DNA, 23 bp, Homo sapiens
tggtggggtcttggagacagcac

SEQ ID NO: 7222171 - DNA, 22 bp, Homo sapiens
tggtgggtcggctgggagagct

SEQ ID NO: 7222172 - DNA, 23 bp, Homo sapiens
tggtggggtcttggagacagcac

SEQ ID NO: 7222173 - DNA, 23 bp, Homo sapiens
tggtggggtcttggagacagcac

SEQ ID NO: 7222174 - DNA, 23 bp, Homo sapiens
tggtggggtcttggagacagcac

SEQ ID NO: 7222175 - DNA, 22 bp, Homo sapiens
tggtggggtcatcgtcagatgc

SEQ ID NO: 7222176 - DNA, 22 bp, Homo sapiens
tggtggggtcatcgtcagatgc

SEQ ID NO: 7222177 - DNA, 22 bp, Homo sapiens
tggtggggtcatcgtcagatgc

SEQ ID NO: 7222178 - DNA, 22 bp, Homo sapiens
tggtggggtcatcgtcagatgc

SEQ ID NO: 7222179 - DNA, 22 bp, Homo sapiens
tggtggggtcatcgtcagatgc

SEQ ID NO: 7222180 - DNA, 22 bp, Homo sapiens
tggtggggtcatcgtcagatgc

SEQ ID NO: 7222181 - DNA, 23 bp, Homo sapiens
tggtggggtcttggagacagcac

SEQ ID NO: 7222182 - DNA, 23 bp, Homo sapiens
tggtggggtcttggagacagcac

SEQ ID NO: 7222183 - DNA, 23 bp, Homo sapiens
tggtggggtcttggagacagcac

SEQ ID NO: 7222184 - DNA, 22 bp, Homo sapiens
tggtgtgggcgtggcaggcaag

SEQ ID NO: 7222185 - DNA, 22 bp, Homo sapiens
tggtgtgggcgtggcaggcaag

SEQ ID NO: 7222186 - DNA, 22 bp, Homo sapiens
tggtgtctcttagtacatagat

SEQ ID NO: 7222187 - DNA, 22 bp, Homo sapiens
tggtgtcttggaagtaggtgct

SEQ ID NO: 7222188 - DNA, 22 bp, Homo sapiens
tggtgtgggcagcagcaggtac

SEQ ID NO: 7222189 - DNA, 22 bp, Homo sapiens
tggtgtgggcagcagcaggtac

SEQ ID NO: 7222190 - DNA, 22 bp, Homo sapiens
tggtgtgtacatttttgcttct

SEQ ID NO: 7222191 - DNA, 22 bp, Homo sapiens
tggtgtgttagagctcagggca

SEQ ID NO: 7222192 - DNA, 22 bp, Homo sapiens
tggtgttgaacctcagcagggg

SEQ ID NO: 7222193 - DNA, 22 bp, Homo sapiens
tggtgttgaacctcagcagggg

SEQ ID NO: 7222194 - DNA, 21 bp, Homo sapiens
tggtgttgacatcaagttata

SEQ ID NO: 7222195 - DNA, 21 bp, Homo sapiens
tggtgttgacatcaagttata

SEQ ID NO: 7222196 - DNA, 22 bp, Homo sapiens
tggtgttgcaaataaagtccaa

SEQ ID NO: 7222197 - DNA, 22 bp, Homo sapiens
tggtgttgcaaataaagtccaa

SEQ ID NO: 7222198 - DNA, 22 bp, Homo sapiens
tggtgttggagatggttgcatt

SEQ ID NO: 7222199 - DNA, 22 bp, Homo sapiens
tggtgttggagatggttgcatt

SEQ ID NO: 7222200 - DNA, 22 bp, Homo sapiens
tggtgttttagcattaaagacc

SEQ ID NO: 7222201 - DNA, 22 bp, Homo sapiens
tggtgttttctttagactttat

SEQ ID NO: 7222202 - DNA, 22 bp, Homo sapiens
tggttaaaatgcagattcagta

SEQ ID NO: 7222203 - DNA, 21 bp, Homo sapiens
tggttaaagttgtgtcatccc

SEQ ID NO: 7222204 - DNA, 22 bp, Homo sapiens
tggttaaaatgcagattcagta

SEQ ID NO: 7222205 - DNA, 22 bp, Homo sapiens
tggtttctgggtttgtctagga

SEQ ID NO: 7222206 - DNA, 22 bp, Homo sapiens
tggtttctgggtttgtctagga

SEQ ID NO: 7222207 - DNA, 22 bp, Homo sapiens
tggtttctgggtttgtctagga

SEQ ID NO: 7222208 - DNA, 22 bp, Homo sapiens
tggtttctgtctgagttcctcc

SEQ ID NO: 7222209 - DNA, 22 bp, Homo sapiens
tggtttctgccctcagagctca

SEQ ID NO: 7222210 - DNA, 22 bp, Homo sapiens
tggtttctgccctcagagctca

SEQ ID NO: 7222211 - DNA, 22 bp, Homo sapiens
tggtttctctgaactctacgac

SEQ ID NO: 7222212 - DNA, 22 bp, Homo sapiens
tggtttctcagactctttgcag

SEQ ID NO: 7222213 - DNA, 22 bp, Homo sapiens
tggtttctcagactctttgcag

SEQ ID NO: 7222214 - DNA, 22 bp, Homo sapiens
tggtttcatgagatgagaattt

SEQ ID NO: 7222215 - DNA, 22 bp, Homo sapiens
tggtttcatgagatgagaattt

SEQ ID NO: 7222216 - DNA, 22 bp, Homo sapiens
tggtttcccattatctgcagga

SEQ ID NO: 7222217 - DNA, 21 bp, Homo sapiens
tggtttctaagctgtcagtct

SEQ ID NO: 7222218 - DNA, 22 bp, Homo sapiens
tggttgtgtcacttagattaga

SEQ ID NO: 7222219 - DNA, 22 bp, Homo sapiens
tggtttaatttccatttccttg

SEQ ID NO: 7222220 - DNA, 22 bp, Homo sapiens
tggtttataacatgtctcatga

SEQ ID NO: 7222221 - DNA, 22 bp, Homo sapiens
tggtttataacatgtctcatga

SEQ ID NO: 7222222 - DNA, 22 bp, Homo sapiens
tggtttatgctgttgcagctct

SEQ ID NO: 7222223 - DNA, 21 bp, Homo sapiens
tggtttatttcactcagcata

SEQ ID NO: 7222224 - DNA, 22 bp, Homo sapiens
tggtttcacggagtgccttgct

SEQ ID NO: 7222225 - DNA, 19 bp, Homo sapiens
tggttgtgcacgggttggt

SEQ ID NO: 7222226 - DNA, 19 bp, Homo sapiens
tggttgtgcacgggttggt

SEQ ID NO: 7222227 - DNA, 17 bp, Homo sapiens
tggttcttttcattccc

SEQ ID NO: 7222228 - DNA, 23 bp, Homo sapiens
tggttctaggcctataattatat

SEQ ID NO: 7222229 - DNA, 22 bp, Homo sapiens
tggttctaaaggactatacaga

SEQ ID NO: 7222230 - DNA, 22 bp, Homo sapiens
tggttccttctgcattttcagc

SEQ ID NO: 7222231 - DNA, 22 bp, Homo sapiens
tggttaaatgctccgatcttgg

SEQ ID NO: 7222232 - DNA, 22 bp, Homo sapiens
tggttaaatgggaagagcaaca

SEQ ID NO: 7222233 - DNA, 22 bp, Homo sapiens
tggttaacttctgagcaggctg

SEQ ID NO: 7222234 - DNA, 22 bp, Homo sapiens
tggttaagtccagaaaggaagc

SEQ ID NO: 7222235 - DNA, 22 bp, Homo sapiens
tggttaagtccagaaaggaagc

SEQ ID NO: 7222236 - DNA, 22 bp, Homo sapiens
tggttaagtccagaaaggaagc

SEQ ID NO: 7222237 - DNA, 22 bp, Homo sapiens
tggttacacaagtgtgtgcagt

SEQ ID NO: 7222238 - DNA, 22 bp, Homo sapiens
tggttcctcagggcagctgtac

SEQ ID NO: 7222239 - DNA, 17 bp, Homo sapiens
tggttttgtttaaaggc

SEQ ID NO: 7222240 - DNA, 22 bp, Homo sapiens
tggttttcaacaagggcagcga

SEQ ID NO: 7222241 - DNA, 22 bp, Homo sapiens
tggttttctggtggtggcagtg

SEQ ID NO: 7222242 - DNA, 22 bp, Homo sapiens
tggttttatttatgttgagtca

SEQ ID NO: 7222243 - DNA, 22 bp, Homo sapiens
tggttttagggaatcaatctat

SEQ ID NO: 7222244 - DNA, 22 bp, Homo sapiens
tggttttagatgcctttactgc

SEQ ID NO: 7222245 - DNA, 22 bp, Homo sapiens
tggttttagagtatattcaggg

SEQ ID NO: 7222246 - DNA, 22 bp, Homo sapiens
tggttttaaaagatgtttgaga

SEQ ID NO: 7222247 - DNA, 22 bp, Homo sapiens
tggttttaaaaacatgctgcat

SEQ ID NO: 7222248 - DNA, 22 bp, Homo sapiens
tggtttgtttgttcatgtaaaa

SEQ ID NO: 7222249 - DNA, 22 bp, Homo sapiens
tggttttaaaaacatgctgcat

SEQ ID NO: 7222250 - DNA, 22 bp, Homo sapiens
tggttttaaaaacatgctgcat

SEQ ID NO: 7222251 - DNA, 22 bp, Homo sapiens
tggtttgtatatgtttgtgaga

SEQ ID NO: 7222252 - DNA, 18 bp, Homo sapiens
tggtttgtcatgagaatt

SEQ ID NO: 7222253 - DNA, 22 bp, Homo sapiens
tggtttgtctaaatgagtaata

SEQ ID NO: 7222254 - DNA, 22 bp, Homo sapiens
tggtttctttccactctccacc

SEQ ID NO: 7222255 - DNA, 22 bp, Homo sapiens
tggtttctttccactctccacc

SEQ ID NO: 7222256 - DNA, 22 bp, Homo sapiens
tgtaaaaccaaatcaatctagt

SEQ ID NO: 7222257 - DNA, 22 bp, Homo sapiens
tgtaaaagacatttctaagcaa

SEQ ID NO: 7222258 - DNA, 22 bp, Homo sapiens
tgtaaaaagcccagccgctgag

SEQ ID NO: 7222259 - DNA, 22 bp, Homo sapiens
tgtaaaataccattccttgtca

SEQ ID NO: 7222260 - DNA, 23 bp, Homo sapiens
tgtaaaatggggtagtgttacca

SEQ ID NO: 7222261 - DNA, 23 bp, Homo sapiens
tgtaaaatggggtagtgttacca

SEQ ID NO: 7222262 - DNA, 23 bp, Homo sapiens
tgtaaaatggggtagtgttacca

SEQ ID NO: 7222263 - DNA, 23 bp, Homo sapiens
tgtaaaatggggtagtgttacca

SEQ ID NO: 7222264 - DNA, 22 bp, Homo sapiens
tgtaaaagacatttctaagcaa

SEQ ID NO: 7222265 - DNA, 22 bp, Homo sapiens
tgtaaaaggaaatcaaagcact

SEQ ID NO: 7222266 - DNA, 23 bp, Homo sapiens
tgtaaaagcatttgtcagcctgg

SEQ ID NO: 7222267 - DNA, 22 bp, Homo sapiens
tgtaaaaggaaatcaaagcact

SEQ ID NO: 7222268 - DNA, 22 bp, Homo sapiens
tgtaaaaggttgttctttcgtt

SEQ ID NO: 7222269 - DNA, 22 bp, Homo sapiens
tgtaaaataattctccatgttt

SEQ ID NO: 7222270 - DNA, 22 bp, Homo sapiens
tgtaaaataattctccatgttt

SEQ ID NO: 7222271 - DNA, 22 bp, Homo sapiens
tgtaaagtatctgtgagctctc

SEQ ID NO: 7222272 - DNA, 22 bp, Homo sapiens
tgtaaagtatctgtgagctctc

SEQ ID NO: 7222273 - DNA, 22 bp, Homo sapiens
tgtaaagtccaagatcaaagag

SEQ ID NO: 7222274 - DNA, 22 bp, Homo sapiens
tgtaaagctttgagtgtttatc

SEQ ID NO: 7222275 - DNA, 22 bp, Homo sapiens
tgtaaagggtgttaaattactc

SEQ ID NO: 7222276 - DNA, 22 bp, Homo sapiens
tgtaaaggtaggtgcaaaatga

SEQ ID NO: 7222277 - DNA, 22 bp, Homo sapiens
tgtaaaggtaggtgcaaaatga

SEQ ID NO: 7222278 - DNA, 23 bp, Homo sapiens
tgtaaagatgatgctctagacac

SEQ ID NO: 7222279 - DNA, 23 bp, Homo sapiens
tgtaaagatgatgctctagacac

SEQ ID NO: 7222280 - DNA, 22 bp, Homo sapiens
tgtaaagcaactgatctgctcc

SEQ ID NO: 7222281 - DNA, 22 bp, Homo sapiens
tgtaaagcatttcctaaatcca

SEQ ID NO: 7222282 - DNA, 22 bp, Homo sapiens
tgtaaagatccttagcaacatc

SEQ ID NO: 7222283 - DNA, 22 bp, Homo sapiens
tgtaaacagccccatggagagc

SEQ ID NO: 7222284 - DNA, 22 bp, Homo sapiens
tgtaaagagaaggcttataaag

SEQ ID NO: 7222285 - DNA, 22 bp, Homo sapiens
tgtaaagagaaggcttataaag

SEQ ID NO: 7222286 - DNA, 18 bp, Homo sapiens
tgtaaacactttcattct

SEQ ID NO: 7222287 - DNA, 18 bp, Homo sapiens
tgtaaacactttcattct

SEQ ID NO: 7222288 - DNA, 22 bp, Homo sapiens
tgtaaacaaatgcattcttgct

SEQ ID NO: 7222289 - DNA, 23 bp, Homo sapiens
tgtaaaatggggtagtgttacca

SEQ ID NO: 7222290 - DNA, 22 bp, Homo sapiens
tgtaaataatgcatgtaaatca

SEQ ID NO: 7222291 - DNA, 22 bp, Homo sapiens
tgtaaataatgcatgtaaatca

SEQ ID NO: 7222292 - DNA, 22 bp, Homo sapiens
tgtaaagtgaggataagaacag

SEQ ID NO: 7222293 - DNA, 22 bp, Homo sapiens
tgtaaataatgcatgtaaatca

SEQ ID NO: 7222294 - DNA, 22 bp, Homo sapiens
tgtaaataatgcatgtaaatca

SEQ ID NO: 7222295 - DNA, 22 bp, Homo sapiens
tgtaaataatgcatgtaaatca

SEQ ID NO: 7222296 - DNA, 22 bp, Homo sapiens
tgtaaatggtcagataaaccta

SEQ ID NO: 7222297 - DNA, 22 bp, Homo sapiens
tgtaaatgtgaatttccttttc

SEQ ID NO: 7222298 - DNA, 22 bp, Homo sapiens
tgtaaattctatacacttaaaa

SEQ ID NO: 7222299 - DNA, 22 bp, Homo sapiens
tgtaaatgaagtatgctttact

SEQ ID NO: 7222300 - DNA, 22 bp, Homo sapiens
tgtaaatcactgaactaaatga

SEQ ID NO: 7222301 - DNA, 22 bp, Homo sapiens
tgtaaatcactgaactaaatga

SEQ ID NO: 7222302 - DNA, 22 bp, Homo sapiens
tgtaaatcactgaactaaatga

SEQ ID NO: 7222303 - DNA, 22 bp, Homo sapiens
tgtaaatagttagcttgcctct

SEQ ID NO: 7222304 - DNA, 20 bp, Homo sapiens
tgtaaataggcattgtagtt

SEQ ID NO: 7222305 - DNA, 22 bp, Homo sapiens
tgtaagatattcagcttattga

SEQ ID NO: 7222306 - DNA, 22 bp, Homo sapiens
tgtaagatatgagtacatgtaa

SEQ ID NO: 7222307 - DNA, 22 bp, Homo sapiens
tgtaagaacatgtgtgggcaca

SEQ ID NO: 7222308 - DNA, 20 bp, Homo sapiens
tgtaagaagtaggagggtta

SEQ ID NO: 7222309 - DNA, 22 bp, Homo sapiens
tgtaagaataatgatttctaag

SEQ ID NO: 7222310 - DNA, 22 bp, Homo sapiens
tgtaactggacaagatattcat

SEQ ID NO: 7222311 - DNA, 23 bp, Homo sapiens
tgtaacttcttaaattcttcact

SEQ ID NO: 7222312 - DNA, 23 bp, Homo sapiens
tgtaacttcttaaattcttcact

SEQ ID NO: 7222313 - DNA, 22 bp, Homo sapiens
tgtaagaaaacctgtacaaaga

SEQ ID NO: 7222314 - DNA, 22 bp, Homo sapiens
tgtaaggtgctcatgtatttct

SEQ ID NO: 7222315 - DNA, 22 bp, Homo sapiens
tgtaagtagtaatggaaggaca

SEQ ID NO: 7222316 - DNA, 22 bp, Homo sapiens
tgtaattttacgtgacacagtt

SEQ ID NO: 7222317 - DNA, 22 bp, Homo sapiens
tgtaattttctcaagtttctac

SEQ ID NO: 7222318 - DNA, 22 bp, Homo sapiens
tgtacaaagagtatagctttga

SEQ ID NO: 7222319 - DNA, 22 bp, Homo sapiens
tgtacaaagagtatagctttga

SEQ ID NO: 7222320 - DNA, 22 bp, Homo sapiens
tgtacaaagttaaacctatata

SEQ ID NO: 7222321 - DNA, 22 bp, Homo sapiens
tgtacaaagttaaacctatata

SEQ ID NO: 7222322 - DNA, 22 bp, Homo sapiens
tgtacaaagccagaactcccaa

SEQ ID NO: 7222323 - DNA, 22 bp, Homo sapiens
tgtaacagtagttactattctt

SEQ ID NO: 7222324 - DNA, 22 bp, Homo sapiens
tgtaacatatagcatgttcttg

SEQ ID NO: 7222325 - DNA, 22 bp, Homo sapiens
tgtaacatatagcatgttcttg

SEQ ID NO: 7222326 - DNA, 22 bp, Homo sapiens
tgtaacatggttcttactctca

SEQ ID NO: 7222327 - DNA, 22 bp, Homo sapiens
tgtaacctgactgctttgctct

SEQ ID NO: 7222328 - DNA, 23 bp, Homo sapiens
tgtaacaatttcatatacatgca

SEQ ID NO: 7222329 - DNA, 23 bp, Homo sapiens
tgtaacaatttcatatacatgca

SEQ ID NO: 7222330 - DNA, 23 bp, Homo sapiens
tgtaacaatttcatatacatgca

SEQ ID NO: 7222331 - DNA, 23 bp, Homo sapiens
tgtaacaatttcatatacatgca

SEQ ID NO: 7222332 - DNA, 23 bp, Homo sapiens
tgtaacaatttcatatacatgca

SEQ ID NO: 7222333 - DNA, 23 bp, Homo sapiens
tgtaacaatttcatatacatgca

SEQ ID NO: 7222334 - DNA, 22 bp, Homo sapiens
tgtaacaatttcttactattgt

SEQ ID NO: 7222335 - DNA, 22 bp, Homo sapiens
tgtaacaatttcttactattgt

SEQ ID NO: 7222336 - DNA, 22 bp, Homo sapiens
tgtaacaatttcttactattgt

SEQ ID NO: 7222337 - DNA, 22 bp, Homo sapiens
tgtaacaatttcttactattgt

SEQ ID NO: 7222338 - DNA, 23 bp, Homo sapiens
tgtaaattttgtagtcacatttt

SEQ ID NO: 7222339 - DNA, 23 bp, Homo sapiens
tgtaaattttgtagtcacatttt

SEQ ID NO: 7222340 - DNA, 21 bp, Homo sapiens
tgtaacaaaatactgcagatt

SEQ ID NO: 7222341 - DNA, 22 bp, Homo sapiens
tgtaaattgtcacctaaatgct

SEQ ID NO: 7222342 - DNA, 23 bp, Homo sapiens
tgtaaattttgtagtcacatttt

SEQ ID NO: 7222343 - DNA, 23 bp, Homo sapiens
tgtaaattttgtagtcacatttt

SEQ ID NO: 7222344 - DNA, 22 bp, Homo sapiens
tgtaaattctatacacttaaaa

SEQ ID NO: 7222345 - DNA, 22 bp, Homo sapiens
tgtaaattgaaggaaatttgtg

SEQ ID NO: 7222346 - DNA, 22 bp, Homo sapiens
tgtaaattgaaggaaatttgtg

SEQ ID NO: 7222347 - DNA, 22 bp, Homo sapiens
tgtaacaatgaatatagtgact

SEQ ID NO: 7222348 - DNA, 21 bp, Homo sapiens
tgtaacaagttccctaggtga

SEQ ID NO: 7222349 - DNA, 22 bp, Homo sapiens
tgtaacaatgaatatagtgact

SEQ ID NO: 7222350 - DNA, 22 bp, Homo sapiens
tgtaacaatgaatatagtgact

SEQ ID NO: 7222351 - DNA, 21 bp, Homo sapiens
tgtaacaaaatactgcagatt

SEQ ID NO: 7222352 - DNA, 22 bp, Homo sapiens
tgtaacaaatacccttgaagtt

SEQ ID NO: 7222353 - DNA, 17 bp, Homo sapiens
tgtaacaactcctatta

SEQ ID NO: 7222354 - DNA, 17 bp, Homo sapiens
tgtaacaactcctatta

SEQ ID NO: 7222355 - DNA, 22 bp, Homo sapiens
tgtaacaagtaatccatgggag

SEQ ID NO: 7222356 - DNA, 22 bp, Homo sapiens
tgtacaatctgatgatgtatgg

SEQ ID NO: 7222357 - DNA, 22 bp, Homo sapiens
tgtacaatgccagggaacacca

SEQ ID NO: 7222358 - DNA, 22 bp, Homo sapiens
tgtacaatgccagggaacacca

SEQ ID NO: 7222359 - DNA, 22 bp, Homo sapiens
tgtacaatgccagggaacacca

SEQ ID NO: 7222360 - DNA, 22 bp, Homo sapiens
tgtacaagttgcctgctatctc

SEQ ID NO: 7222361 - DNA, 22 bp, Homo sapiens
tgtacaaggccatctacatgct

SEQ ID NO: 7222362 - DNA, 22 bp, Homo sapiens
tgtacaagtgaaagatgtgggc

SEQ ID NO: 7222363 - DNA, 22 bp, Homo sapiens
tgtacaagaataattttatata

SEQ ID NO: 7222364 - DNA, 22 bp, Homo sapiens
tgtacaagcaaatagaccttca

SEQ ID NO: 7222365 - DNA, 22 bp, Homo sapiens
tgtacaaattcattgaactgta

SEQ ID NO: 7222366 - DNA, 22 bp, Homo sapiens
tgtacaaattcattgaactgta

SEQ ID NO: 7222367 - DNA, 22 bp, Homo sapiens
tgtacacaattcttaacataca

SEQ ID NO: 7222368 - DNA, 22 bp, Homo sapiens
tgtacacaatgtgcaggtttgt

SEQ ID NO: 7222369 - DNA, 22 bp, Homo sapiens
tgtacacaattcttaacataca

SEQ ID NO: 7222370 - DNA, 22 bp, Homo sapiens
tgtacacaattcttaacataca

SEQ ID NO: 7222371 - DNA, 22 bp, Homo sapiens
tgtacacaattcttaacataca

SEQ ID NO: 7222372 - DNA, 22 bp, Homo sapiens
tgtacacaattcttaacataca

SEQ ID NO: 7222373 - DNA, 22 bp, Homo sapiens
tgtacacacacgtgtgtatcta

SEQ ID NO: 7222374 - DNA, 20 bp, Homo sapiens
tgtacacagtactttacaat

SEQ ID NO: 7222375 - DNA, 20 bp, Homo sapiens
tgtacacagtactttacaat

SEQ ID NO: 7222376 - DNA, 20 bp, Homo sapiens
tgtacacagtactttacaat

SEQ ID NO: 7222377 - DNA, 22 bp, Homo sapiens
tgtacacataccactgagtgaa

SEQ ID NO: 7222378 - DNA, 22 bp, Homo sapiens
tgtacaatgccgagactaactc

SEQ ID NO: 7222379 - DNA, 22 bp, Homo sapiens
tgtacacaacctacagtctgct

SEQ ID NO: 7222380 - DNA, 22 bp, Homo sapiens
tgtacacaacctacagtctgct

SEQ ID NO: 7222381 - DNA, 22 bp, Homo sapiens
tgtacacaacgtgcaggtttgt

SEQ ID NO: 7222382 - DNA, 22 bp, Homo sapiens
tgtacagataaagactgtaaat

SEQ ID NO: 7222383 - DNA, 22 bp, Homo sapiens
tgtacagattgatcatggagag

SEQ ID NO: 7222384 - DNA, 22 bp, Homo sapiens
tgtacagatatcaggagtgagg

SEQ ID NO: 7222385 - DNA, 22 bp, Homo sapiens
tgtacagattgatcatggagag

SEQ ID NO: 7222386 - DNA, 22 bp, Homo sapiens
tgtacagtctgcagcttgctgt

SEQ ID NO: 7222387 - DNA, 22 bp, Homo sapiens
tgtacagtgccatgcagtttgc

SEQ ID NO: 7222388 - DNA, 22 bp, Homo sapiens
tgtaccaggccctgtggacatg

SEQ ID NO: 7222389 - DNA, 22 bp, Homo sapiens
tgtaccatatagatggtacctt

SEQ ID NO: 7222390 - DNA, 22 bp, Homo sapiens
tgtaccgcaaatgctgctgcct

SEQ ID NO: 7222391 - DNA, 22 bp, Homo sapiens
tgtacactgcaggatgcattgc

SEQ ID NO: 7222392 - DNA, 22 bp, Homo sapiens
tgtacagaaattcctactacat

SEQ ID NO: 7222393 - DNA, 22 bp, Homo sapiens
tgtacagaaattcctactacat

SEQ ID NO: 7222394 - DNA, 22 bp, Homo sapiens
tgtacagaaggcactaaggtca

SEQ ID NO: 7222395 - DNA, 22 bp, Homo sapiens
tgtacagaggtgtacatatgat

SEQ ID NO: 7222396 - DNA, 22 bp, Homo sapiens
tgtacagaggtgtacatatgat

SEQ ID NO: 7222397 - DNA, 22 bp, Homo sapiens
tgtacacatggtgtacactccc

SEQ ID NO: 7222398 - DNA, 22 bp, Homo sapiens
tgtacacattaagctctttaga

SEQ ID NO: 7222399 - DNA, 22 bp, Homo sapiens
tgtacacatatcatttgtggga

SEQ ID NO: 7222400 - DNA, 22 bp, Homo sapiens
tgtacacatgcccacttgaagc

SEQ ID NO: 7222401 - DNA, 22 bp, Homo sapiens
tgtacacatgcccacttgaagc

SEQ ID NO: 7222402 - DNA, 22 bp, Homo sapiens
tgtacacatgcccacttgaagc

SEQ ID NO: 7222403 - DNA, 22 bp, Homo sapiens
tgtacacatggtgtacactccc

SEQ ID NO: 7222404 - DNA, 22 bp, Homo sapiens
tgtacacatggtgtacactccc

SEQ ID NO: 7222405 - DNA, 22 bp, Homo sapiens
tgtacacatttttatgttaaca

SEQ ID NO: 7222406 - DNA, 22 bp, Homo sapiens
tgtacacattaagctctttaga

SEQ ID NO: 7222407 - DNA, 22 bp, Homo sapiens
tgtacacatttattctctctca

SEQ ID NO: 7222408 - DNA, 22 bp, Homo sapiens
tgtacacatttattctctctca

SEQ ID NO: 7222409 - DNA, 22 bp, Homo sapiens
tgtacacatttttatgttaaca

SEQ ID NO: 7222410 - DNA, 22 bp, Homo sapiens
tgtacacatttttatgttaaca

SEQ ID NO: 7222411 - DNA, 22 bp, Homo sapiens
tgtagatgagtcagggtgcatg

SEQ ID NO: 7222412 - DNA, 22 bp, Homo sapiens
tgtagatgagtcagggtgcacc

SEQ ID NO: 7222413 - DNA, 18 bp, Homo sapiens
tgtagagccaggtttgcc

SEQ ID NO: 7222414 - DNA, 22 bp, Homo sapiens
tgtagcacatgcattagagtgt

SEQ ID NO: 7222415 - DNA, 22 bp, Homo sapiens
tgtagcaccaacctgccttttt

SEQ ID NO: 7222416 - DNA, 22 bp, Homo sapiens
tgtagcaccagtcaccagccca

SEQ ID NO: 7222417 - DNA, 22 bp, Homo sapiens
tgtagcacctagcagaaactct

SEQ ID NO: 7222418 - DNA, 22 bp, Homo sapiens
tgtagcacctagcagaaactct

SEQ ID NO: 7222419 - DNA, 22 bp, Homo sapiens
tgtagcaccatctcctccttcc

SEQ ID NO: 7222420 - DNA, 22 bp, Homo sapiens
tgtagcacgttagtgttagagc

SEQ ID NO: 7222421 - DNA, 22 bp, Homo sapiens
tgtagcactatgcactacacat

SEQ ID NO: 7222422 - DNA, 22 bp, Homo sapiens
tgtagcactatttggtcattga

SEQ ID NO: 7222423 - DNA, 22 bp, Homo sapiens
tgtagcactcatcaactatgtt

SEQ ID NO: 7222424 - DNA, 22 bp, Homo sapiens
tgtagcactgggttagaaatca

SEQ ID NO: 7222425 - DNA, 22 bp, Homo sapiens
tgtagcactgggttagaaatca

SEQ ID NO: 7222426 - DNA, 22 bp, Homo sapiens
tgtagcaagagcaatccattgt

SEQ ID NO: 7222427 - DNA, 22 bp, Homo sapiens
tgtagcacaaaaaggatcttgg

SEQ ID NO: 7222428 - DNA, 22 bp, Homo sapiens
tgtagcacaaacacagtccagg

SEQ ID NO: 7222429 - DNA, 22 bp, Homo sapiens
tgtagcacaagatagatacttc

SEQ ID NO: 7222430 - DNA, 22 bp, Homo sapiens
tgtagcacaagatagatacttc

SEQ ID NO: 7222431 - DNA, 22 bp, Homo sapiens
tgtagcacaagatagatacttc

SEQ ID NO: 7222432 - DNA, 22 bp, Homo sapiens
tgtagcacactcaggggtagca

SEQ ID NO: 7222433 - DNA, 22 bp, Homo sapiens
tgtagcacactcataatctttc

SEQ ID NO: 7222434 - DNA, 22 bp, Homo sapiens
tgtagcacagagctttgacact

SEQ ID NO: 7222435 - DNA, 22 bp, Homo sapiens
tgtagcacagagctttgacact

SEQ ID NO: 7222436 - DNA, 22 bp, Homo sapiens
tgtagcacagctgctctctact

SEQ ID NO: 7222437 - DNA, 22 bp, Homo sapiens
tgtagcacagggttgggggaga

SEQ ID NO: 7222438 - DNA, 22 bp, Homo sapiens
tgtagcagtttttcattatcca

SEQ ID NO: 7222439 - DNA, 22 bp, Homo sapiens
tgtagcagtttttcattatcca

SEQ ID NO: 7222440 - DNA, 22 bp, Homo sapiens
tgtagcatgtaaattggttatt

SEQ ID NO: 7222441 - DNA, 22 bp, Homo sapiens
tgtagcattttatgtaataagt

SEQ ID NO: 7222442 - DNA, 22 bp, Homo sapiens
tgtagccaagattggagatcgt

SEQ ID NO: 7222443 - DNA, 22 bp, Homo sapiens
tgtagccaccaggctggatctg

SEQ ID NO: 7222444 - DNA, 22 bp, Homo sapiens
tgtagcctattaggagaggagc

SEQ ID NO: 7222445 - DNA, 22 bp, Homo sapiens
tgtagcctttatgtgagaagga

SEQ ID NO: 7222446 - DNA, 22 bp, Homo sapiens
tgtagctctccagccagcaagg

SEQ ID NO: 7222447 - DNA, 18 bp, Homo sapiens
tgtagctggaggccaggc

SEQ ID NO: 7222448 - DNA, 17 bp, Homo sapiens
tgtagcttctccttctc

SEQ ID NO: 7222449 - DNA, 22 bp, Homo sapiens
tgtaggaaaaacaatgatctgc

SEQ ID NO: 7222450 - DNA, 17 bp, Homo sapiens
tgtagcttctccttctc

SEQ ID NO: 7222451 - DNA, 22 bp, Homo sapiens
tgtataaaccatggacagcttt

SEQ ID NO: 7222452 - DNA, 20 bp, Homo sapiens
tgtaggaaggaccctgtctg

SEQ ID NO: 7222453 - DNA, 22 bp, Homo sapiens
tgtaggaagatataaaatatct

SEQ ID NO: 7222454 - DNA, 22 bp, Homo sapiens
tgtaggaactcacagatattct

SEQ ID NO: 7222455 - DNA, 22 bp, Homo sapiens
tgtaggaaaaacaatgatctgc

SEQ ID NO: 7222456 - DNA, 22 bp, Homo sapiens
tgtaggaaagttgtgagtctgg

SEQ ID NO: 7222457 - DNA, 18 bp, Homo sapiens
tgtagagccaggtttgcc

SEQ ID NO: 7222458 - DNA, 22 bp, Homo sapiens
tgtagacagtgggatctctggg

SEQ ID NO: 7222459 - DNA, 22 bp, Homo sapiens
tgtagacatgaccattaacatt

SEQ ID NO: 7222460 - DNA, 22 bp, Homo sapiens
tgtagacatgaccattaacatt

SEQ ID NO: 7222461 - DNA, 22 bp, Homo sapiens
tgtagacaggatctagttaaaa

SEQ ID NO: 7222462 - DNA, 22 bp, Homo sapiens
tgtagaagttcttcaggagaat

SEQ ID NO: 7222463 - DNA, 22 bp, Homo sapiens
tgtagaacctgtttattataga

SEQ ID NO: 7222464 - DNA, 22 bp, Homo sapiens
tgtagaagctagcctggagcca

SEQ ID NO: 7222465 - DNA, 22 bp, Homo sapiens
tgtagaagttcttcaggagaat

SEQ ID NO: 7222466 - DNA, 22 bp, Homo sapiens
tgtagaagttcttcaggagaat

SEQ ID NO: 7222467 - DNA, 22 bp, Homo sapiens
tgtagaaagctcttctgaaatc

SEQ ID NO: 7222468 - DNA, 22 bp, Homo sapiens
tgtagaaagctcttctgaaatc

SEQ ID NO: 7222469 - DNA, 22 bp, Homo sapiens
tgtagaaattagtaagatcaac

SEQ ID NO: 7222470 - DNA, 22 bp, Homo sapiens
tgtagaaattagtaagatcaac

SEQ ID NO: 7222471 - DNA, 22 bp, Homo sapiens
tgtagaaactacacatgcaaca

SEQ ID NO: 7222472 - DNA, 22 bp, Homo sapiens
tgtagaaactacacatgcaaca

SEQ ID NO: 7222473 - DNA, 22 bp, Homo sapiens
tgtacttgcttattagaaatct

SEQ ID NO: 7222474 - DNA, 18 bp, Homo sapiens
tgtagaaaagataggaat

SEQ ID NO: 7222475 - DNA, 18 bp, Homo sapiens
tgtagaaaagataggaat

SEQ ID NO: 7222476 - DNA, 19 bp, Homo sapiens
tgtacgtgtgggtgtttaa

SEQ ID NO: 7222477 - DNA, 22 bp, Homo sapiens
tgtacgcatgtgcatgcacacg

SEQ ID NO: 7222478 - DNA, 22 bp, Homo sapiens
tgtactcagctcagatctcagg

SEQ ID NO: 7222479 - DNA, 22 bp, Homo sapiens
tgtactgtatcattgcaacttt

SEQ ID NO: 7222480 - DNA, 22 bp, Homo sapiens
tgtacttattttatgtcagcac

SEQ ID NO: 7222481 - DNA, 22 bp, Homo sapiens
tgtacttcaaaccctttggttt

SEQ ID NO: 7222482 - DNA, 22 bp, Homo sapiens
tgtacttccccaatgacagcac

SEQ ID NO: 7222483 - DNA, 22 bp, Homo sapiens
tgtacttgcttattagaaatct

SEQ ID NO: 7222484 - DNA, 22 bp, Homo sapiens
tgtatgaatctcatttgtttaa

SEQ ID NO: 7222485 - DNA, 22 bp, Homo sapiens
tgtatgaatctcatttgtttaa

SEQ ID NO: 7222486 - DNA, 22 bp, Homo sapiens
tgtatgcaaatttattagcaca

SEQ ID NO: 7222487 - DNA, 22 bp, Homo sapiens
tgtatgcaataataactatgtg

SEQ ID NO: 7222488 - DNA, 23 bp, Homo sapiens
tgtatgaatatgccacagtttaa

SEQ ID NO: 7222489 - DNA, 22 bp, Homo sapiens
tgtatcaatcatgtaatttggt

SEQ ID NO: 7222490 - DNA, 22 bp, Homo sapiens
tgtatcaatcatgtaatttggt

SEQ ID NO: 7222491 - DNA, 22 bp, Homo sapiens
tgtatctgtaatcccagatcaa

SEQ ID NO: 7222492 - DNA, 22 bp, Homo sapiens
tgtatctgtttagcacccagcc

SEQ ID NO: 7222493 - DNA, 22 bp, Homo sapiens
tgtatcttagtgtgaaaatatt

SEQ ID NO: 7222494 - DNA, 22 bp, Homo sapiens
tgtatcttcagtttgtctttcc

SEQ ID NO: 7222495 - DNA, 22 bp, Homo sapiens
tgtatctttctgtacttttatg

SEQ ID NO: 7222496 - DNA, 22 bp, Homo sapiens
tgtatgaaaaggaatagattga

SEQ ID NO: 7222497 - DNA, 22 bp, Homo sapiens
tgtatgaacctttaatatagtg

SEQ ID NO: 7222498 - DNA, 22 bp, Homo sapiens
tgtatcaagatcagcagctgtt

SEQ ID NO: 7222499 - DNA, 22 bp, Homo sapiens
tgtatcaagggtttatgtaagc

SEQ ID NO: 7222500 - DNA, 22 bp, Homo sapiens
tgtatcaagggtttatgtaagc

SEQ ID NO: 7222501 - DNA, 22 bp, Homo sapiens
tgtatcaaaccaaattaattct

SEQ ID NO: 7222502 - DNA, 22 bp, Homo sapiens
tgtatcaaaccaaattaattct

SEQ ID NO: 7222503 - DNA, 22 bp, Homo sapiens
tgtatcaaaccaaattaattct

SEQ ID NO: 7222504 - DNA, 22 bp, Homo sapiens
tgtatcaaaccaaattaattct

SEQ ID NO: 7222505 - DNA, 22 bp, Homo sapiens
tgtatattgttctgtctcttca

SEQ ID NO: 7222506 - DNA, 20 bp, Homo sapiens
tgtatattttctggtgtaaa

SEQ ID NO: 7222507 - DNA, 22 bp, Homo sapiens
tgtatattgcctgagtctttcc

SEQ ID NO: 7222508 - DNA, 22 bp, Homo sapiens
tgtatattgcctgagtctttcc

SEQ ID NO: 7222509 - DNA, 22 bp, Homo sapiens
tgtatatacatacacacatgaa

SEQ ID NO: 7222510 - DNA, 22 bp, Homo sapiens
tgtatatatttctttcattcta

SEQ ID NO: 7222511 - DNA, 22 bp, Homo sapiens
tgtatatgagtctgagtgtaca

SEQ ID NO: 7222512 - DNA, 22 bp, Homo sapiens
tgtatatgtcctggcatgtcat

SEQ ID NO: 7222513 - DNA, 22 bp, Homo sapiens
tgtatatgtcctggcatgtcat

SEQ ID NO: 7222514 - DNA, 22 bp, Homo sapiens
tgtatatgtgatgtacatgtac

SEQ ID NO: 7222515 - DNA, 22 bp, Homo sapiens
tgtatatgtttgtatgtacaca

SEQ ID NO: 7222516 - DNA, 22 bp, Homo sapiens
tgtatattcactgagcaagggg

SEQ ID NO: 7222517 - DNA, 22 bp, Homo sapiens
tgtatattctgcctaaaagctt

SEQ ID NO: 7222518 - DNA, 22 bp, Homo sapiens
tgtatattctgcctaaaagctt

SEQ ID NO: 7222519 - DNA, 22 bp, Homo sapiens
tgtatagagttggaagatgact

SEQ ID NO: 7222520 - DNA, 22 bp, Homo sapiens
tgtatacatttggtgcatattt

SEQ ID NO: 7222521 - DNA, 22 bp, Homo sapiens
tgtatataagcatttacttgtt

SEQ ID NO: 7222522 - DNA, 22 bp, Homo sapiens
tgtatatacatacacacatgaa

SEQ ID NO: 7222523 - DNA, 22 bp, Homo sapiens
tgtatacaggcataagagatac

SEQ ID NO: 7222524 - DNA, 22 bp, Homo sapiens
tgtatacatacatatgtgtgtg

SEQ ID NO: 7222525 - DNA, 22 bp, Homo sapiens
tgtatacatgtgttcatgcatg

SEQ ID NO: 7222526 - DNA, 22 bp, Homo sapiens
tgtatacaagtcgtgtaaactt

SEQ ID NO: 7222527 - DNA, 22 bp, Homo sapiens
tgtatacaaattggaatcagat

SEQ ID NO: 7222528 - DNA, 22 bp, Homo sapiens
tgtataagtgtgtagagtaaga

SEQ ID NO: 7222529 - DNA, 22 bp, Homo sapiens
tgtataagcctagtgaaatttc

SEQ ID NO: 7222530 - DNA, 22 bp, Homo sapiens
tgtataagcctagtgaaatttc

SEQ ID NO: 7222531 - DNA, 22 bp, Homo sapiens
tgtataaacttaagcaggaacc

SEQ ID NO: 7222532 - DNA, 22 bp, Homo sapiens
tgtataaacttaagcaggaacc

SEQ ID NO: 7222533 - DNA, 22 bp, Homo sapiens
tgtataaacttaagcaggaacc

SEQ ID NO: 7222534 - DNA, 22 bp, Homo sapiens
tgtataaacttaagcaggaacc

SEQ ID NO: 7222535 - DNA, 22 bp, Homo sapiens
tgtataaacttaagcaggaacc

SEQ ID NO: 7222536 - DNA, 22 bp, Homo sapiens
tgtataaatttaaattcctgct

SEQ ID NO: 7222537 - DNA, 22 bp, Homo sapiens
tgtatacactatgctatatggt

SEQ ID NO: 7222538 - DNA, 22 bp, Homo sapiens
tgtatacactatgctatatggt

SEQ ID NO: 7222539 - DNA, 22 bp, Homo sapiens
tgtatacaggattactcatagc

SEQ ID NO: 7222540 - DNA, 23 bp, Homo sapiens
tgtatacaccctgtgcatctggg

SEQ ID NO: 7222541 - DNA, 23 bp, Homo sapiens
tgtatacaccctgtgcatctggg

SEQ ID NO: 7222542 - DNA, 22 bp, Homo sapiens
tgtatacaattcacacttccca

SEQ ID NO: 7222543 - DNA, 22 bp, Homo sapiens
tgtattgttataatttgtatgt

SEQ ID NO: 7222544 - DNA, 20 bp, Homo sapiens
tgtattgttattgggacaga

SEQ ID NO: 7222545 - DNA, 22 bp, Homo sapiens
tgtatttaagctttacctaaaa

SEQ ID NO: 7222546 - DNA, 20 bp, Homo sapiens
tgtatttaatgaaggctttt

SEQ ID NO: 7222547 - DNA, 22 bp, Homo sapiens
tgtatttaagctttacctaaaa

SEQ ID NO: 7222548 - DNA, 22 bp, Homo sapiens
tgtatttaagctttacctaaaa

SEQ ID NO: 7222549 - DNA, 22 bp, Homo sapiens
tgtatttaattgtatcatcaca

SEQ ID NO: 7222550 - DNA, 22 bp, Homo sapiens
tgtatttagtccagtctctcat

SEQ ID NO: 7222551 - DNA, 22 bp, Homo sapiens
tgtatttagtccagtctctcat

SEQ ID NO: 7222552 - DNA, 22 bp, Homo sapiens
tgtatttatattagaatggttg

SEQ ID NO: 7222553 - DNA, 22 bp, Homo sapiens
tgtatttatattagaatggttg

SEQ ID NO: 7222554 - DNA, 20 bp, Homo sapiens
tgtatttaatgaaggctttt

SEQ ID NO: 7222555 - DNA, 20 bp, Homo sapiens
tgtatttaatgaaggctttt

SEQ ID NO: 7222556 - DNA, 22 bp, Homo sapiens
tgtatttaattgtatcatcaca

SEQ ID NO: 7222557 - DNA, 22 bp, Homo sapiens
tgtatttaattgtatcatcaca

SEQ ID NO: 7222558 - DNA, 22 bp, Homo sapiens
tgtatttaattgtatcatcaca

SEQ ID NO: 7222559 - DNA, 22 bp, Homo sapiens
tgtatttaattgtatcatcaca

SEQ ID NO: 7222560 - DNA, 20 bp, Homo sapiens
tgtattcttctccttcctcc

SEQ ID NO: 7222561 - DNA, 22 bp, Homo sapiens
tgtatgtaaagtttgtaataga

SEQ ID NO: 7222562 - DNA, 22 bp, Homo sapiens
tgtatgtatacacatagatacg

SEQ ID NO: 7222563 - DNA, 22 bp, Homo sapiens
tgtattctctcaatatttcata

SEQ ID NO: 7222564 - DNA, 22 bp, Homo sapiens
tgtatgctttccttctttctgg

SEQ ID NO: 7222565 - DNA, 22 bp, Homo sapiens
tgtatgctttggttgtttctct

SEQ ID NO: 7222566 - DNA, 22 bp, Homo sapiens
tgtatggcttggaaatagttta

SEQ ID NO: 7222567 - DNA, 22 bp, Homo sapiens
tgtatgcacatggataagtatg

SEQ ID NO: 7222568 - DNA, 21 bp, Homo sapiens
tgtatgcacgcacatgcacac

SEQ ID NO: 7222569 - DNA, 22 bp, Homo sapiens
tgtatgcttgagtgtgtatact

SEQ ID NO: 7222570 - DNA, 22 bp, Homo sapiens
tgtatgcttgagtgtgtatact

SEQ ID NO: 7222571 - DNA, 22 bp, Homo sapiens
tgtatgctttccaaaaatgctg

SEQ ID NO: 7222572 - DNA, 22 bp, Homo sapiens
tgtatttcctggtttagatcaa

SEQ ID NO: 7222573 - DNA, 22 bp, Homo sapiens
tgtatttgagttatgaaagaga

SEQ ID NO: 7222574 - DNA, 22 bp, Homo sapiens
tgtatttgggtcacaagatggg

SEQ ID NO: 7222575 - DNA, 17 bp, Homo sapiens
tgtatttgtaccacagc

SEQ ID NO: 7222576 - DNA, 22 bp, Homo sapiens
tgtatttgttgttaaatggaga

SEQ ID NO: 7222577 - DNA, 22 bp, Homo sapiens
tgtatttattcaggatgtaact

SEQ ID NO: 7222578 - DNA, 22 bp, Homo sapiens
tgtatttattcaggatgtaact

SEQ ID NO: 7222579 - DNA, 22 bp, Homo sapiens
tgtatttattcaggatgtaact

SEQ ID NO: 7222580 - DNA, 17 bp, Homo sapiens
tgtatttatcatgtcag

SEQ ID NO: 7222581 - DNA, 17 bp, Homo sapiens
tgtatttatcatgtcag

SEQ ID NO: 7222582 - DNA, 17 bp, Homo sapiens
tgtatttatcatgtcag

SEQ ID NO: 7222583 - DNA, 17 bp, Homo sapiens
tgtatttatcatgtcag

SEQ ID NO: 7222584 - DNA, 17 bp, Homo sapiens
tgtatttatcatgtcag

SEQ ID NO: 7222585 - DNA, 22 bp, Homo sapiens
tgtatttattcaggatgtaact

SEQ ID NO: 7222586 - DNA, 22 bp, Homo sapiens
tgtatttattcaggatgtaact

SEQ ID NO: 7222587 - DNA, 22 bp, Homo sapiens
tgtatttattcaggatgtaact

SEQ ID NO: 7222588 - DNA, 22 bp, Homo sapiens
tgtatttattcttctggtgttt

SEQ ID NO: 7222589 - DNA, 22 bp, Homo sapiens
tgtatttattcttctggtgttt

SEQ ID NO: 7222590 - DNA, 22 bp, Homo sapiens
tgtattttctgaggagcattag

SEQ ID NO: 7222591 - DNA, 22 bp, Homo sapiens
tgtattttctgaggagcattag

SEQ ID NO: 7222592 - DNA, 22 bp, Homo sapiens
tgtattttctgaagataatcaa

SEQ ID NO: 7222593 - DNA, 22 bp, Homo sapiens
tgtattttctgaagataatcaa

SEQ ID NO: 7222594 - DNA, 22 bp, Homo sapiens
tgtattttcagagtggcatttc

SEQ ID NO: 7222595 - DNA, 22 bp, Homo sapiens
tgtattttcagagtggcatttc

SEQ ID NO: 7222596 - DNA, 22 bp, Homo sapiens
tgtattttctgaggagcattag

SEQ ID NO: 7222597 - DNA, 22 bp, Homo sapiens
tgtattttcttctggaagctta

SEQ ID NO: 7222598 - DNA, 22 bp, Homo sapiens
tgtattttgagtccaatctcct

SEQ ID NO: 7222599 - DNA, 22 bp, Homo sapiens
tgtcacctggaaatcactctaa

SEQ ID NO: 7222600 - DNA, 22 bp, Homo sapiens
tgtcaccatgccagcttctgcc

SEQ ID NO: 7222601 - DNA, 22 bp, Homo sapiens
tgtcaccagctgctcctcagga

SEQ ID NO: 7222602 - DNA, 22 bp, Homo sapiens
tgtcacattgaatatgatttat

SEQ ID NO: 7222603 - DNA, 22 bp, Homo sapiens
tgtcacattatatgtgaggata

SEQ ID NO: 7222604 - DNA, 22 bp, Homo sapiens
tgtcacatgtttaatgtggact

SEQ ID NO: 7222605 - DNA, 22 bp, Homo sapiens
tgtcacatgacacaaatatcta

SEQ ID NO: 7222606 - DNA, 22 bp, Homo sapiens
tgtcacatgaaacttgctcatc

SEQ ID NO: 7222607 - DNA, 22 bp, Homo sapiens
tgtcacatatataatgttcaat

SEQ ID NO: 7222608 - DNA, 22 bp, Homo sapiens
tgtcacatatataatgttcaat

SEQ ID NO: 7222609 - DNA, 22 bp, Homo sapiens
tgtcacagtttgtactttatag

SEQ ID NO: 7222610 - DNA, 22 bp, Homo sapiens
tgtcacagtgcacagctaagaa

SEQ ID NO: 7222611 - DNA, 22 bp, Homo sapiens
tgtcacagtttgtactttatag

SEQ ID NO: 7222612 - DNA, 22 bp, Homo sapiens
tgtcacagtgcacagctaagaa

SEQ ID NO: 7222613 - DNA, 22 bp, Homo sapiens
tgtcacagggataccatggggc

SEQ ID NO: 7222614 - DNA, 22 bp, Homo sapiens
tgtcacagtctcgtgagcatct

SEQ ID NO: 7222615 - DNA, 22 bp, Homo sapiens
tgtcacagtctcgtgagcatct

SEQ ID NO: 7222616 - DNA, 22 bp, Homo sapiens
tgtcacagagcgtgcaacagaa

SEQ ID NO: 7222617 - DNA, 21 bp, Homo sapiens
tgtcacagattctcagcttgc

SEQ ID NO: 7222618 - DNA, 22 bp, Homo sapiens
tgtatttttagacctttagacc

SEQ ID NO: 7222619 - DNA, 22 bp, Homo sapiens
tgtatttttagacctttagacc

SEQ ID NO: 7222620 - DNA, 22 bp, Homo sapiens
tgtatttttagacctttagacc

SEQ ID NO: 7222621 - DNA, 22 bp, Homo sapiens
tgtcaaaaataagagagattgt

SEQ ID NO: 7222622 - DNA, 22 bp, Homo sapiens
tgtcaaaatgactttactacag

SEQ ID NO: 7222623 - DNA, 22 bp, Homo sapiens
tgtcaaacaccaacatttctcc

SEQ ID NO: 7222624 - DNA, 22 bp, Homo sapiens
tgtcaaagcctgaatcacatag

SEQ ID NO: 7222625 - DNA, 22 bp, Homo sapiens
tgtcacagagcaactatttctt

SEQ ID NO: 7222626 - DNA, 22 bp, Homo sapiens
tgtcacagagcaactatttctt

SEQ ID NO: 7222627 - DNA, 22 bp, Homo sapiens
tgtcacagagcgtgcaacagaa

SEQ ID NO: 7222628 - DNA, 22 bp, Homo sapiens
tgtcacacctcgtttagcattc

SEQ ID NO: 7222629 - DNA, 22 bp, Homo sapiens
tgtcacactgaccacatctgta

SEQ ID NO: 7222630 - DNA, 22 bp, Homo sapiens
tgtcacagagcaactatttctt

SEQ ID NO: 7222631 - DNA, 22 bp, Homo sapiens
tgtcacaacagaggaactgaat

SEQ ID NO: 7222632 - DNA, 22 bp, Homo sapiens
tgtcacaacagaggaactgaat

SEQ ID NO: 7222633 - DNA, 22 bp, Homo sapiens
tgtcacaaggccatgaaaagaa

SEQ ID NO: 7222634 - DNA, 22 bp, Homo sapiens
tgtcacaaggccatgaaaagaa

SEQ ID NO: 7222635 - DNA, 22 bp, Homo sapiens
tgtcacaagtaactggcaatgc

SEQ ID NO: 7222636 - DNA, 22 bp, Homo sapiens
tgtcacaatatcccaatctgcc

SEQ ID NO: 7222637 - DNA, 22 bp, Homo sapiens
tgtcacaatatcccaatctgcc

SEQ ID NO: 7222638 - DNA, 22 bp, Homo sapiens
tgtcacaatatcccaatctgcc

SEQ ID NO: 7222639 - DNA, 22 bp, Homo sapiens
tgtcacaatttatttctcttga

SEQ ID NO: 7222640 - DNA, 22 bp, Homo sapiens
tgtcaatgggaatttgttttag

SEQ ID NO: 7222641 - DNA, 22 bp, Homo sapiens
tgtcaaatagtagaaagatggc

SEQ ID NO: 7222642 - DNA, 22 bp, Homo sapiens
tgtcaatgaagatatgaataat

SEQ ID NO: 7222643 - DNA, 22 bp, Homo sapiens
tgtcaaagcctgaatcacatag

SEQ ID NO: 7222644 - DNA, 22 bp, Homo sapiens
tgtcaaagcctgaatcacatag

SEQ ID NO: 7222645 - DNA, 22 bp, Homo sapiens
tgtcaaagcctgaatcacatag

SEQ ID NO: 7222646 - DNA, 22 bp, Homo sapiens
tgtcaaagggtaagctggataa

SEQ ID NO: 7222647 - DNA, 22 bp, Homo sapiens
tgtcaaagtatcagtctctggc

SEQ ID NO: 7222648 - DNA, 22 bp, Homo sapiens
tgtcaaagtatcagtctctggc

SEQ ID NO: 7222649 - DNA, 22 bp, Homo sapiens
tgtcaatgaaaatgtataaggt

SEQ ID NO: 7222650 - DNA, 22 bp, Homo sapiens
tgtcaattatgtgacacatctt

SEQ ID NO: 7222651 - DNA, 22 bp, Homo sapiens
tgtcacaaacatacattataga

SEQ ID NO: 7222652 - DNA, 22 bp, Homo sapiens
tgtcctggtgctccaggtggct

SEQ ID NO: 7222653 - DNA, 21 bp, Homo sapiens
tgtcctggtcactgctctccc

SEQ ID NO: 7222654 - DNA, 21 bp, Homo sapiens
tgtcctggtcactgctctccc

SEQ ID NO: 7222655 - DNA, 22 bp, Homo sapiens
tgtcctgggtcaaccaggtcga

SEQ ID NO: 7222656 - DNA, 22 bp, Homo sapiens
tgtcctgggtccctgctagaag

SEQ ID NO: 7222657 - DNA, 22 bp, Homo sapiens
tgtcctgggtggatgcttcatt

SEQ ID NO: 7222658 - DNA, 22 bp, Homo sapiens
tgtcctgggtggatgcttcatt

SEQ ID NO: 7222659 - DNA, 22 bp, Homo sapiens
tgtcctggtgctccaggtggct

SEQ ID NO: 7222660 - DNA, 22 bp, Homo sapiens
tgtcctggtgcttcttgggatt

SEQ ID NO: 7222661 - DNA, 22 bp, Homo sapiens
tgtcctggtgcttcttgggatt

SEQ ID NO: 7222662 - DNA, 22 bp, Homo sapiens
tgtcctgtaggaggcagaacaa

SEQ ID NO: 7222663 - DNA, 19 bp, Homo sapiens
tgtcctgtcctgctctgac

SEQ ID NO: 7222664 - DNA, 22 bp, Homo sapiens
tgtcctgtgacctggcaccaca

SEQ ID NO: 7222665 - DNA, 22 bp, Homo sapiens
tgtcctgtgattccagctcttc

SEQ ID NO: 7222666 - DNA, 22 bp, Homo sapiens
tgtcctgtgcactgtagcatgt

SEQ ID NO: 7222667 - DNA, 22 bp, Homo sapiens
tgtcctgtgccaccttcctgag

SEQ ID NO: 7222668 - DNA, 22 bp, Homo sapiens
tgtccttgatgaatatgaaatt

SEQ ID NO: 7222669 - DNA, 22 bp, Homo sapiens
tgtccttggccagtttctggtg

SEQ ID NO: 7222670 - DNA, 22 bp, Homo sapiens
tgtccttatctccaaacaatca

SEQ ID NO: 7222671 - DNA, 22 bp, Homo sapiens
tgtccttcttgtcttgcccaaa

SEQ ID NO: 7222672 - DNA, 22 bp, Homo sapiens
tgtccttgatgaatatgaaatt

SEQ ID NO: 7222673 - DNA, 22 bp, Homo sapiens
tgtccttataagaaaaggaaat

SEQ ID NO: 7222674 - DNA, 22 bp, Homo sapiens
tgtccttataagaaaaggaaat

SEQ ID NO: 7222675 - DNA, 22 bp, Homo sapiens
tgtccttatattgtggaagggg

SEQ ID NO: 7222676 - DNA, 22 bp, Homo sapiens
tgtccttagaagaagtgaaaga

SEQ ID NO: 7222677 - DNA, 22 bp, Homo sapiens
tgtccttagggatataaaatat

SEQ ID NO: 7222678 - DNA, 21 bp, Homo sapiens
tgtccttaatgcaatgtcctt

SEQ ID NO: 7222679 - DNA, 22 bp, Homo sapiens
tgtcctgttctggcgtgagtgg

SEQ ID NO: 7222680 - DNA, 22 bp, Homo sapiens
tgtcctgtgtctaggggtcttc

SEQ ID NO: 7222681 - DNA, 22 bp, Homo sapiens
tgtcctgttatatgttgggtag

SEQ ID NO: 7222682 - DNA, 22 bp, Homo sapiens
tgtccttgttcctaatgtaaaa

SEQ ID NO: 7222683 - DNA, 22 bp, Homo sapiens
tgtccttgtgacattctggctt

SEQ ID NO: 7222684 - DNA, 22 bp, Homo sapiens
tgtccttgttcctaatgtaaaa

SEQ ID NO: 7222685 - DNA, 22 bp, Homo sapiens
tgtccttttccccaaattcact

SEQ ID NO: 7222686 - DNA, 22 bp, Homo sapiens
tgtccttttctttagtgcagct

SEQ ID NO: 7222687 - DNA, 22 bp, Homo sapiens
tgtcctggccaaggccttgctt

SEQ ID NO: 7222688 - DNA, 22 bp, Homo sapiens
tgtcctggcctccagaaagtcg

SEQ ID NO: 7222689 - DNA, 22 bp, Homo sapiens
tgtcctcagatatgtctactct

SEQ ID NO: 7222690 - DNA, 22 bp, Homo sapiens
tgtcctcaggacctggcacagt

SEQ ID NO: 7222691 - DNA, 22 bp, Homo sapiens
tgtcctcaggacctggcacagt

SEQ ID NO: 7222692 - DNA, 22 bp, Homo sapiens
tgtcctcacatggtggggagag

SEQ ID NO: 7222693 - DNA, 22 bp, Homo sapiens
tgtcctcagatatgtctactct

SEQ ID NO: 7222694 - DNA, 22 bp, Homo sapiens
tgtcctcaaggagcttcagtct

SEQ ID NO: 7222695 - DNA, 22 bp, Homo sapiens
tgtcctatttctctgtgcatga

SEQ ID NO: 7222696 - DNA, 22 bp, Homo sapiens
tgtcctcacacgtagggagtaa

SEQ ID NO: 7222697 - DNA, 19 bp, Homo sapiens
tgtcctcacagagcataac

SEQ ID NO: 7222698 - DNA, 22 bp, Homo sapiens
tgtcctcacaggaatgaacttt

SEQ ID NO: 7222699 - DNA, 22 bp, Homo sapiens
tgtcctcacaggaatgaacttt

SEQ ID NO: 7222700 - DNA, 22 bp, Homo sapiens
tgtcctgggaatgggatgcagt

SEQ ID NO: 7222701 - DNA, 22 bp, Homo sapiens
tgtcctgggaatgggatgcagt

SEQ ID NO: 7222702 - DNA, 22 bp, Homo sapiens
tgtcctgggaactcacagtcca

SEQ ID NO: 7222703 - DNA, 22 bp, Homo sapiens
tgtcctgggaaatcccttaggc

SEQ ID NO: 7222704 - DNA, 22 bp, Homo sapiens
tgtcctgggaactcacagtcca

SEQ ID NO: 7222705 - DNA, 22 bp, Homo sapiens
tgtcctgggaactcacagtcca

SEQ ID NO: 7222706 - DNA, 22 bp, Homo sapiens
tgtcctgggaggcggggtccag

SEQ ID NO: 7222707 - DNA, 22 bp, Homo sapiens
tgtcctgggccggcgactggtc

SEQ ID NO: 7222708 - DNA, 22 bp, Homo sapiens
tgtcctggggacaagaggccct

SEQ ID NO: 7222709 - DNA, 22 bp, Homo sapiens
tgtcctggggcgacttggggcc

SEQ ID NO: 7222710 - DNA, 22 bp, Homo sapiens
tgtcctgggtcaaatcctggtc

SEQ ID NO: 7222711 - DNA, 22 bp, Homo sapiens
tgtcctgggtcaaccaggtcga

SEQ ID NO: 7222712 - DNA, 22 bp, Homo sapiens
tgtccccattctaagaggtggc

SEQ ID NO: 7222713 - DNA, 22 bp, Homo sapiens
tgtccccattctaagaggtggc

SEQ ID NO: 7222714 - DNA, 22 bp, Homo sapiens
tgtccccaggtcctctgccgtc

SEQ ID NO: 7222715 - DNA, 20 bp, Homo sapiens
tgtcccctagatcccagctc

SEQ ID NO: 7222716 - DNA, 20 bp, Homo sapiens
tgtcccctagatcccagctc

SEQ ID NO: 7222717 - DNA, 20 bp, Homo sapiens
tgtcccctagatcccagctc

SEQ ID NO: 7222718 - DNA, 22 bp, Homo sapiens
tgtccctcattgacgctgtgcc

SEQ ID NO: 7222719 - DNA, 22 bp, Homo sapiens
tgtccccagagcctgttcctgc

SEQ ID NO: 7222720 - DNA, 22 bp, Homo sapiens
tgtcccatggataccaggctat

SEQ ID NO: 7222721 - DNA, 22 bp, Homo sapiens
tgtcccatggcttttctggtgg

SEQ ID NO: 7222722 - DNA, 22 bp, Homo sapiens
tgtccccaaggttcagcccaca

SEQ ID NO: 7222723 - DNA, 22 bp, Homo sapiens
tgtccctgctgtacttagagca

SEQ ID NO: 7222724 - DNA, 22 bp, Homo sapiens
tgtccctggactccaggagcca

SEQ ID NO: 7222725 - DNA, 22 bp, Homo sapiens
tgtccctggtggaggctggcag

SEQ ID NO: 7222726 - DNA, 19 bp, Homo sapiens
tgtccctggtcaccagact

SEQ ID NO: 7222727 - DNA, 20 bp, Homo sapiens
tgtcctaatagacaagcaga

SEQ ID NO: 7222728 - DNA, 19 bp, Homo sapiens
tgtccgtggccttctggat

SEQ ID NO: 7222729 - DNA, 22 bp, Homo sapiens
tgtccctggtggaggctggcag

SEQ ID NO: 7222730 - DNA, 18 bp, Homo sapiens
tgtccctgcaaataacat

SEQ ID NO: 7222731 - DNA, 22 bp, Homo sapiens
tgtccctgatccactggacccc

SEQ ID NO: 7222732 - DNA, 22 bp, Homo sapiens
tgtccctctgaggcttccctgg

SEQ ID NO: 7222733 - DNA, 22 bp, Homo sapiens
tgtccctgatccactggacccc

SEQ ID NO: 7222734 - DNA, 22 bp, Homo sapiens
tgtcccagcagctgggttctct

SEQ ID NO: 7222735 - DNA, 22 bp, Homo sapiens
tgtccaggctcccttggtgctg

SEQ ID NO: 7222736 - DNA, 22 bp, Homo sapiens
tgtccagggatggggtcaggga

SEQ ID NO: 7222737 - DNA, 22 bp, Homo sapiens
tgtcccaggctgaagtacagtg

SEQ ID NO: 7222738 - DNA, 22 bp, Homo sapiens
tgtcccaggtcctagatgacca

SEQ ID NO: 7222739 - DNA, 22 bp, Homo sapiens
tgtcccagtcaaggctgtcatc

SEQ ID NO: 7222740 - DNA, 22 bp, Homo sapiens
tgtcccagttcccagggttgct

SEQ ID NO: 7222741 - DNA, 22 bp, Homo sapiens
tgtcccagttgggtattgaatt

SEQ ID NO: 7222742 - DNA, 22 bp, Homo sapiens
tgtcccagtttatctgggactg

SEQ ID NO: 7222743 - DNA, 22 bp, Homo sapiens
tgtcccagttttgcaggttaga

SEQ ID NO: 7222744 - DNA, 22 bp, Homo sapiens
tgtcaggtttctccaacttata

SEQ ID NO: 7222745 - DNA, 22 bp, Homo sapiens
tgtcaggttggttttcagagaa

SEQ ID NO: 7222746 - DNA, 22 bp, Homo sapiens
tgtcaggtttcagttaatggtt

SEQ ID NO: 7222747 - DNA, 22 bp, Homo sapiens
tgtcaggttcagtgattttact

SEQ ID NO: 7222748 - DNA, 22 bp, Homo sapiens
tgtcaggttctttaattctgca

SEQ ID NO: 7222749 - DNA, 22 bp, Homo sapiens
tgtcaggtctacaaaaatgctg

SEQ ID NO: 7222750 - DNA, 22 bp, Homo sapiens
tgtcaggtctctgtgatggtaa

SEQ ID NO: 7222751 - DNA, 15 bp, Homo sapiens
tgtcaggtgaatggt

SEQ ID NO: 7222752 - DNA, 22 bp, Homo sapiens
tgtcaggtgacacactaggagc

SEQ ID NO: 7222753 - DNA, 22 bp, Homo sapiens
tgtcaggtgacagtttttacca

SEQ ID NO: 7222754 - DNA, 22 bp, Homo sapiens
tgtcaggtgcagcttggatgca

SEQ ID NO: 7222755 - DNA, 22 bp, Homo sapiens
tgtcaggttcaaatcttggtcc

SEQ ID NO: 7222756 - DNA, 22 bp, Homo sapiens
tgtcaggtagagataatggggg

SEQ ID NO: 7222757 - DNA, 22 bp, Homo sapiens
tgtcaggtagtaggtagaaact

SEQ ID NO: 7222758 - DNA, 22 bp, Homo sapiens
tgtcaggtatgcaacagaatgc

SEQ ID NO: 7222759 - DNA, 22 bp, Homo sapiens
tgtcaggtcagacttggttttt

SEQ ID NO: 7222760 - DNA, 22 bp, Homo sapiens
tgtcaggtcagtatttgatgcc

SEQ ID NO: 7222761 - DNA, 22 bp, Homo sapiens
tgtcaggtcattgccatggaaa

SEQ ID NO: 7222762 - DNA, 22 bp, Homo sapiens
tgtcaggtctaaaatgggtctc

SEQ ID NO: 7222763 - DNA, 22 bp, Homo sapiens
tgtcagggcatgcggtccagcc

SEQ ID NO: 7222764 - DNA, 22 bp, Homo sapiens
tgtcagggctggacacagctgc

SEQ ID NO: 7222765 - DNA, 19 bp, Homo sapiens
tgtcaggggtgtgctgtgc

SEQ ID NO: 7222766 - DNA, 23 bp, Homo sapiens
tgtcaggtaaggaaggattcact

SEQ ID NO: 7222767 - DNA, 22 bp, Homo sapiens
tgtcactttgccttctggactt

SEQ ID NO: 7222768 - DNA, 22 bp, Homo sapiens
tgtcacttcagttttgaaacaa

SEQ ID NO: 7222769 - DNA, 22 bp, Homo sapiens
tgtcacttggagaagctgatcc

SEQ ID NO: 7222770 - DNA, 22 bp, Homo sapiens
tgtcacttggagaagctgatcc

SEQ ID NO: 7222771 - DNA, 21 bp, Homo sapiens
tgtcactttaagctagctcta

SEQ ID NO: 7222772 - DNA, 22 bp, Homo sapiens
tgtcactttttataggtgttga

SEQ ID NO: 7222773 - DNA, 22 bp, Homo sapiens
tgtcaggagggtccagagaaaa

SEQ ID NO: 7222774 - DNA, 19 bp, Homo sapiens
tgtcaccttctgtcagttt

SEQ ID NO: 7222775 - DNA, 22 bp, Homo sapiens
tgtcaccatgcgaggctaattt

SEQ ID NO: 7222776 - DNA, 22 bp, Homo sapiens
tgtcactgttacatgaactctt

SEQ ID NO: 7222777 - DNA, 22 bp, Homo sapiens
tgtcacttcaggaatgcaggga

SEQ ID NO: 7222778 - DNA, 22 bp, Homo sapiens
tgtcagtggtagacccagaggt

SEQ ID NO: 7222779 - DNA, 22 bp, Homo sapiens
tgtcagtggtcatagtagaaaa

SEQ ID NO: 7222780 - DNA, 22 bp, Homo sapiens
tgtcagtgctatagtgggaata

SEQ ID NO: 7222781 - DNA, 22 bp, Homo sapiens
tgtcagtgtatacatacagtat

SEQ ID NO: 7222782 - DNA, 22 bp, Homo sapiens
tgtcagtgtctatgaagaattt

SEQ ID NO: 7222783 - DNA, 20 bp, Homo sapiens
tgtcagtgcctgaggcacag

SEQ ID NO: 7222784 - DNA, 22 bp, Homo sapiens
tgtcagtgatttgtagggaatt

SEQ ID NO: 7222785 - DNA, 22 bp, Homo sapiens
tgtcatagtgtggtagcagtgg

SEQ ID NO: 7222786 - DNA, 22 bp, Homo sapiens
tgtcatagtgtggtagcagtgg

SEQ ID NO: 7222787 - DNA, 22 bp, Homo sapiens
tgtcataatgctgctagaaatt

SEQ ID NO: 7222788 - DNA, 22 bp, Homo sapiens
tgtcatagtgtggtagcagtgg

SEQ ID NO: 7222789 - DNA, 22 bp, Homo sapiens
tgtcatatagaatgttctatga

SEQ ID NO: 7222790 - DNA, 22 bp, Homo sapiens
tgtcatatagaatgttctatga

SEQ ID NO: 7222791 - DNA, 22 bp, Homo sapiens
tgtcataacttagtgacaaatc

SEQ ID NO: 7222792 - DNA, 18 bp, Homo sapiens
tgtcataatatatcacct

SEQ ID NO: 7222793 - DNA, 22 bp, Homo sapiens
tgtcagtttcctgtgccctgct

SEQ ID NO: 7222794 - DNA, 18 bp, Homo sapiens
tgtcagtttccctttctt

SEQ ID NO: 7222795 - DNA, 22 bp, Homo sapiens
tgtcagtttagttgaagaaaga

SEQ ID NO: 7222796 - DNA, 22 bp, Homo sapiens
tgtcagttcagtgattacaaaa

SEQ ID NO: 7222797 - DNA, 22 bp, Homo sapiens
tgtcagttcaattatagtaatt

SEQ ID NO: 7222798 - DNA, 22 bp, Homo sapiens
tgtcagttcaattatagtaatt

SEQ ID NO: 7222799 - DNA, 22 bp, Homo sapiens
tgtcagttaaatgaggtacaag

SEQ ID NO: 7222800 - DNA, 22 bp, Homo sapiens
tgtcatgagttatttcatagga

SEQ ID NO: 7222801 - DNA, 22 bp, Homo sapiens
tgtcatgatgtgcacaccacag

SEQ ID NO: 7222802 - DNA, 22 bp, Homo sapiens
tgtcatgcaggtttgttataga

SEQ ID NO: 7222803 - DNA, 22 bp, Homo sapiens
tgtcatcttaaatcattcccac

SEQ ID NO: 7222804 - DNA, 22 bp, Homo sapiens
tgtcatcttgtccagccaggca

SEQ ID NO: 7222805 - DNA, 22 bp, Homo sapiens
tgtcatcttaaatcattcccac

SEQ ID NO: 7222806 - DNA, 22 bp, Homo sapiens
tgtcatctgcgggtggcactgc

SEQ ID NO: 7222807 - DNA, 23 bp, Homo sapiens
tgtcatctccagactcccagtgc

SEQ ID NO: 7222808 - DNA, 22 bp, Homo sapiens
tgtcatcatttgagagaagaaa

SEQ ID NO: 7222809 - DNA, 22 bp, Homo sapiens
tgtcatcatttgagagaagaaa

SEQ ID NO: 7222810 - DNA, 21 bp, Homo sapiens
tgtcatatttcaatacagttt

SEQ ID NO: 7222811 - DNA, 22 bp, Homo sapiens
tgtcatcagcatataagacagt

SEQ ID NO: 7222812 - DNA, 22 bp, Homo sapiens
tgtcatcagggtgcaagagtta

SEQ ID NO: 7222813 - DNA, 22 bp, Homo sapiens
tgtcatatgctgtcatagccat

SEQ ID NO: 7222814 - DNA, 22 bp, Homo sapiens
tgtcatatgttgatgaaagaga

SEQ ID NO: 7222815 - DNA, 20 bp, Homo sapiens
tgtcatttatttatcaaatg

SEQ ID NO: 7222816 - DNA, 20 bp, Homo sapiens
tgtcatttatttatcaaatg

SEQ ID NO: 7222817 - DNA, 22 bp, Homo sapiens
tgtcatttattctcttattcta

SEQ ID NO: 7222818 - DNA, 22 bp, Homo sapiens
tgtcatttatgcttcttcagtg

SEQ ID NO: 7222819 - DNA, 22 bp, Homo sapiens
tgtcatttatcttatagtaatc

SEQ ID NO: 7222820 - DNA, 22 bp, Homo sapiens
tgtcatttagtcctctgtgtgt

SEQ ID NO: 7222821 - DNA, 22 bp, Homo sapiens
tgtcatttaatagatatgatgg

SEQ ID NO: 7222822 - DNA, 22 bp, Homo sapiens
tgtcatttactccataccctca

SEQ ID NO: 7222823 - DNA, 22 bp, Homo sapiens
tgtcatttactccataccctca

SEQ ID NO: 7222824 - DNA, 22 bp, Homo sapiens
tgtcatttaatagatatgatgg

SEQ ID NO: 7222825 - DNA, 22 bp, Homo sapiens
tgtcatttaatagatatgatgg

SEQ ID NO: 7222826 - DNA, 22 bp, Homo sapiens
tgtcatttaaagctttccagat

SEQ ID NO: 7222827 - DNA, 22 bp, Homo sapiens
tgtcattcatttaagtatgttt

SEQ ID NO: 7222828 - DNA, 22 bp, Homo sapiens
tgtcattggtgatctgatgcct

SEQ ID NO: 7222829 - DNA, 22 bp, Homo sapiens
tgtcattcatttaagtatgttt

SEQ ID NO: 7222830 - DNA, 22 bp, Homo sapiens
tgtcattggtacaaattgattg

SEQ ID NO: 7222831 - DNA, 22 bp, Homo sapiens
tgtcattttcatcctaaggagc

SEQ ID NO: 7222832 - DNA, 22 bp, Homo sapiens
tgtcattttcatcctaaggagc

SEQ ID NO: 7222833 - DNA, 22 bp, Homo sapiens
tgtcattttcatcctaaggagc

SEQ ID NO: 7222834 - DNA, 22 bp, Homo sapiens
tgtcattttctaatctgttgtc

SEQ ID NO: 7222835 - DNA, 22 bp, Homo sapiens
tgtcattttagtgcatcactca

SEQ ID NO: 7222836 - DNA, 22 bp, Homo sapiens
tgtcattttatgtatgtggtct

SEQ ID NO: 7222837 - DNA, 22 bp, Homo sapiens
tgtcattttatgtatgtggtct

SEQ ID NO: 7222838 - DNA, 22 bp, Homo sapiens
tgtcattttcagcttatgcttc

SEQ ID NO: 7222839 - DNA, 22 bp, Homo sapiens
tgtcattttcagcttatgcttc

SEQ ID NO: 7222840 - DNA, 22 bp, Homo sapiens
tgtcattttaatcacctttcca

SEQ ID NO: 7222841 - DNA, 22 bp, Homo sapiens
tgtcattttaatcacctttcca

SEQ ID NO: 7222842 - DNA, 22 bp, Homo sapiens
tgtcatttggtgccaggaaaga

SEQ ID NO: 7222843 - DNA, 22 bp, Homo sapiens
tgtcatttgtttaggcaataat

SEQ ID NO: 7222844 - DNA, 22 bp, Homo sapiens
tgtcatttgtttaggcaataat

SEQ ID NO: 7222845 - DNA, 22 bp, Homo sapiens
tgtcatttggactttggtatta

SEQ ID NO: 7222846 - DNA, 22 bp, Homo sapiens
tgtcatttggactttggtatta

SEQ ID NO: 7222847 - DNA, 22 bp, Homo sapiens
tgtcatttggactttggtatta

SEQ ID NO: 7222848 - DNA, 22 bp, Homo sapiens
tgtcatttcacaatatcactca

SEQ ID NO: 7222849 - DNA, 22 bp, Homo sapiens
tgtcatttattttgctgtctgt

SEQ ID NO: 7222850 - DNA, 22 bp, Homo sapiens
tgtcatttcctgaatgctgagt

SEQ ID NO: 7222851 - DNA, 22 bp, Homo sapiens
tgtcatttcacaatatcactca

SEQ ID NO: 7222852 - DNA, 22 bp, Homo sapiens
tgtcatttcacaatatcactca

SEQ ID NO: 7222853 - DNA, 22 bp, Homo sapiens
tgtccagcacagccaggcttac

SEQ ID NO: 7222854 - DNA, 22 bp, Homo sapiens
tgtccagcggcctggctgctga

SEQ ID NO: 7222855 - DNA, 22 bp, Homo sapiens
tgtccagctcgagacactatct

SEQ ID NO: 7222856 - DNA, 22 bp, Homo sapiens
tgtccacatatgttgtttctga

SEQ ID NO: 7222857 - DNA, 22 bp, Homo sapiens
tgtccacatcactcacttgtca

SEQ ID NO: 7222858 - DNA, 22 bp, Homo sapiens
tgtccacatcactcacttgtca

SEQ ID NO: 7222859 - DNA, 22 bp, Homo sapiens
tgtcattttgtctcactgctat

SEQ ID NO: 7222860 - DNA, 22 bp, Homo sapiens
tgtcattttctggttagttaat

SEQ ID NO: 7222861 - DNA, 22 bp, Homo sapiens
tgtcattttctggttagttaat

SEQ ID NO: 7222862 - DNA, 22 bp, Homo sapiens
tggggtgtgagaagtagaggga

SEQ ID NO: 7222863 - DNA, 22 bp, Homo sapiens
tggggtgtgctcagagcagggg

SEQ ID NO: 7222864 - DNA, 17 bp, Homo sapiens
tggggtgttgaagggtt

SEQ ID NO: 7222865 - DNA, 22 bp, Homo sapiens
tggggtggtgggaaccaagtag

SEQ ID NO: 7222866 - DNA, 22 bp, Homo sapiens
tggggtggtgggaaccaagtag

SEQ ID NO: 7222867 - DNA, 22 bp, Homo sapiens
tggggtggtgggaaccaagtag

SEQ ID NO: 7222868 - DNA, 22 bp, Homo sapiens
tggggtggtgggaaccaagtag

SEQ ID NO: 7222869 - DNA, 22 bp, Homo sapiens
tggggtggggttactcattctg

SEQ ID NO: 7222870 - DNA, 22 bp, Homo sapiens
tggggtggtaatacaccgttct

SEQ ID NO: 7222871 - DNA, 22 bp, Homo sapiens
tggggtggtaatacaccgttct

SEQ ID NO: 7222872 - DNA, 22 bp, Homo sapiens
tggggtggtaatacaccgttct

SEQ ID NO: 7222873 - DNA, 22 bp, Homo sapiens
tggggtggggttactcattctg

SEQ ID NO: 7222874 - DNA, 22 bp, Homo sapiens
tggggtggggttactcattctg

SEQ ID NO: 7222875 - DNA, 22 bp, Homo sapiens
tggggtggggttactcattctg

SEQ ID NO: 7222876 - DNA, 22 bp, Homo sapiens
tggggtggggttactcattctg

SEQ ID NO: 7222877 - DNA, 22 bp, Homo sapiens
tggggtgggcatgcgctgtcct

SEQ ID NO: 7222878 - DNA, 22 bp, Homo sapiens
tggggtggggttactcattctg

SEQ ID NO: 7222879 - DNA, 22 bp, Homo sapiens
tggggtggggttactcattctg

SEQ ID NO: 7222880 - DNA, 22 bp, Homo sapiens
tggggtgggcatgcgctgtcct

SEQ ID NO: 7222881 - DNA, 22 bp, Homo sapiens
tggggtgggcatgcgctgtcct

SEQ ID NO: 7222882 - DNA, 22 bp, Homo sapiens
tggggtgggcatgcgctgtcct

SEQ ID NO: 7222883 - DNA, 22 bp, Homo sapiens
tggggtgggcatgcgctgtcct

SEQ ID NO: 7222884 - DNA, 22 bp, Homo sapiens
tggggtgggcatgcgctgtcct

SEQ ID NO: 7222885 - DNA, 22 bp, Homo sapiens
tggggtgggcatgcgctgtcct

SEQ ID NO: 7222886 - DNA, 22 bp, Homo sapiens
tggggtgggcatgcgctgtcct

SEQ ID NO: 7222887 - DNA, 22 bp, Homo sapiens
tggggtggatagaaagtgatgt

SEQ ID NO: 7222888 - DNA, 22 bp, Homo sapiens
tggggtggatagaaagtgatgt

SEQ ID NO: 7222889 - DNA, 22 bp, Homo sapiens
tggggtggatagaaagtgatgt

SEQ ID NO: 7222890 - DNA, 22 bp, Homo sapiens
tggggtggatagaaagtgatgt

SEQ ID NO: 7222891 - DNA, 22 bp, Homo sapiens
tggggtggaacccttctgctgg

SEQ ID NO: 7222892 - DNA, 22 bp, Homo sapiens
tggggtggatagaaagtgatgt

SEQ ID NO: 7222893 - DNA, 22 bp, Homo sapiens
tggggtggatagaaagtgatgt

SEQ ID NO: 7222894 - DNA, 22 bp, Homo sapiens
tggggtggaacccttctgctgg

SEQ ID NO: 7222895 - DNA, 22 bp, Homo sapiens
tggggtggaacccttctgctgg

SEQ ID NO: 7222896 - DNA, 22 bp, Homo sapiens
tggggtggaacccttctgctgg

SEQ ID NO: 7222897 - DNA, 22 bp, Homo sapiens
tggggtggaacccttctgctgg

SEQ ID NO: 7222898 - DNA, 22 bp, Homo sapiens
tggggtgccgacagggagggca

SEQ ID NO: 7222899 - DNA, 22 bp, Homo sapiens
tggggtgagattcagatattca

SEQ ID NO: 7222900 - DNA, 22 bp, Homo sapiens
tggggtgccgacagggagggca

SEQ ID NO: 7222901 - DNA, 22 bp, Homo sapiens
tggggtgacagtgcagtggtca

SEQ ID NO: 7222902 - DNA, 22 bp, Homo sapiens
tggggtgccgacagggagggca

SEQ ID NO: 7222903 - DNA, 22 bp, Homo sapiens
tggggtgccgacagggagggca

SEQ ID NO: 7222904 - DNA, 22 bp, Homo sapiens
tggggtgctttcttgcctgtac

SEQ ID NO: 7222905 - DNA, 22 bp, Homo sapiens
tggggtggaacccttctgctgg

SEQ ID NO: 7222906 - DNA, 22 bp, Homo sapiens
tggggtggaacccttctgctgg

SEQ ID NO: 7222907 - DNA, 18 bp, Homo sapiens
tggggggcttgtctgaag

SEQ ID NO: 7222908 - DNA, 22 bp, Homo sapiens
tggggggcatgaacctccacgg

SEQ ID NO: 7222909 - DNA, 22 bp, Homo sapiens
tggggggcatgaacctccacgg

SEQ ID NO: 7222910 - DNA, 22 bp, Homo sapiens
tggggggatacttgctactggc

SEQ ID NO: 7222911 - DNA, 22 bp, Homo sapiens
tggggggcacttcagcacaatg

SEQ ID NO: 7222912 - DNA, 22 bp, Homo sapiens
tgggggctgtgcacaggctcac

SEQ ID NO: 7222913 - DNA, 22 bp, Homo sapiens
tgggggctgtgcacaggctcac

SEQ ID NO: 7222914 - DNA, 22 bp, Homo sapiens
tggggggatacttgctactggc

SEQ ID NO: 7222915 - DNA, 22 bp, Homo sapiens
tgggggtcctcctctgcttaag

SEQ ID NO: 7222916 - DNA, 22 bp, Homo sapiens
tgggggtgaaagtctggacagt

SEQ ID NO: 7222917 - DNA, 22 bp, Homo sapiens
tgggggtgaaagtctggacagt

SEQ ID NO: 7222918 - DNA, 22 bp, Homo sapiens
tgggggtgaaagtctggacagt

SEQ ID NO: 7222919 - DNA, 22 bp, Homo sapiens
tgggggtgaaagtctggacagt

SEQ ID NO: 7222920 - DNA, 22 bp, Homo sapiens
tgggggtgactatctcgggaat

SEQ ID NO: 7222921 - DNA, 22 bp, Homo sapiens
tgggggtgaaagtctggacagt

SEQ ID NO: 7222922 - DNA, 22 bp, Homo sapiens
tgggggtgactatctcgggaat

SEQ ID NO: 7222923 - DNA, 21 bp, Homo sapiens
tgggggtgaggcctaggaatc

SEQ ID NO: 7222924 - DNA, 23 bp, Homo sapiens
tgggggtgcacgggccacatctt

SEQ ID NO: 7222925 - DNA, 23 bp, Homo sapiens
tgggggtgcacgggccacatctt

SEQ ID NO: 7222926 - DNA, 23 bp, Homo sapiens
tgggggtgcacgggccacatctt

SEQ ID NO: 7222927 - DNA, 23 bp, Homo sapiens
tgggggtgcacgggccacatctt

SEQ ID NO: 7222928 - DNA, 22 bp, Homo sapiens
tgggggtgccctatgaggaagc

SEQ ID NO: 7222929 - DNA, 22 bp, Homo sapiens
tgggggtgccctatgaggaagc

SEQ ID NO: 7222930 - DNA, 22 bp, Homo sapiens
tgggggtgccctatgaggaagc

SEQ ID NO: 7222931 - DNA, 22 bp, Homo sapiens
tgggggtgctgagaagacagga

SEQ ID NO: 7222932 - DNA, 22 bp, Homo sapiens
tgggggtgctgagaagacagga

SEQ ID NO: 7222933 - DNA, 22 bp, Homo sapiens
tgggggtgctgagaagacagga

SEQ ID NO: 7222934 - DNA, 22 bp, Homo sapiens
tggggtctggagttgcccatga

SEQ ID NO: 7222935 - DNA, 22 bp, Homo sapiens
tggggtctgagtatctgcattt

SEQ ID NO: 7222936 - DNA, 22 bp, Homo sapiens
tggggtctgagtatctgcattt

SEQ ID NO: 7222937 - DNA, 18 bp, Homo sapiens
tggggtctctcaggtaag

SEQ ID NO: 7222938 - DNA, 20 bp, Homo sapiens
tggggtctagttggcctggg

SEQ ID NO: 7222939 - DNA, 20 bp, Homo sapiens
tggggtctagttggcctggg

SEQ ID NO: 7222940 - DNA, 22 bp, Homo sapiens
tgggggtgctgagaagacagga

SEQ ID NO: 7222941 - DNA, 22 bp, Homo sapiens
tgggggtggttcttgcctccag

SEQ ID NO: 7222942 - DNA, 22 bp, Homo sapiens
tgggggtggttcttgcctccag

SEQ ID NO: 7222943 - DNA, 22 bp, Homo sapiens
tgggggtggttcttgcctccag

SEQ ID NO: 7222944 - DNA, 22 bp, Homo sapiens
tgggggtggttcttgcctccag

SEQ ID NO: 7222945 - DNA, 22 bp, Homo sapiens
tgggtccagtgtcctggctatg

SEQ ID NO: 7222946 - DNA, 22 bp, Homo sapiens
tgggtccagtgtcctggctatg

SEQ ID NO: 7222947 - DNA, 22 bp, Homo sapiens
tgggtcccaggaaggaccagca

SEQ ID NO: 7222948 - DNA, 22 bp, Homo sapiens
tgggtccctcatgagaggcatt

SEQ ID NO: 7222949 - DNA, 20 bp, Homo sapiens
tgggtcctgcacattctcca

SEQ ID NO: 7222950 - DNA, 22 bp, Homo sapiens
tgggtcctgtctccttgttctg

SEQ ID NO: 7222951 - DNA, 22 bp, Homo sapiens
tgggtccttcaaagctgggtct

SEQ ID NO: 7222952 - DNA, 22 bp, Homo sapiens
tgggtccttgctgattgctgag

SEQ ID NO: 7222953 - DNA, 23 bp, Homo sapiens
tgggtctctagtacaggcaggca

SEQ ID NO: 7222954 - DNA, 23 bp, Homo sapiens
tgggtctctagtacaggcaggca

SEQ ID NO: 7222955 - DNA, 20 bp, Homo sapiens
tgggtctgcttggcttcagt

SEQ ID NO: 7222956 - DNA, 20 bp, Homo sapiens
tgggtctgcttggcttcagt

SEQ ID NO: 7222957 - DNA, 22 bp, Homo sapiens
tgggtctgtagggctgtccaat

SEQ ID NO: 7222958 - DNA, 22 bp, Homo sapiens
tgggtctgtagggctgtccaat

SEQ ID NO: 7222959 - DNA, 22 bp, Homo sapiens
tgggtccacttctgcactgtgg

SEQ ID NO: 7222960 - DNA, 22 bp, Homo sapiens
tgggtccacggaagacttaggg

SEQ ID NO: 7222961 - DNA, 22 bp, Homo sapiens
tgggtccacttctgcactgtgg

SEQ ID NO: 7222962 - DNA, 22 bp, Homo sapiens
tgggtaggggacgtggaagaaa

SEQ ID NO: 7222963 - DNA, 22 bp, Homo sapiens
tgggtaggggacgtggaagaaa

SEQ ID NO: 7222964 - DNA, 22 bp, Homo sapiens
tgggtagggcctgcgcctgtgc

SEQ ID NO: 7222965 - DNA, 22 bp, Homo sapiens
tgggtaggggacgtggaagaaa

SEQ ID NO: 7222966 - DNA, 22 bp, Homo sapiens
tgggtaggggacgtggaagaaa

SEQ ID NO: 7222967 - DNA, 22 bp, Homo sapiens
tgggtagggagctggaatccta

SEQ ID NO: 7222968 - DNA, 22 bp, Homo sapiens
tgggtagggcctgcgcctgtgc

SEQ ID NO: 7222969 - DNA, 22 bp, Homo sapiens
tgggtaggccaggaagcagtgt

SEQ ID NO: 7222970 - DNA, 22 bp, Homo sapiens
tgggtagggacttagctggctg

SEQ ID NO: 7222971 - DNA, 22 bp, Homo sapiens
tgggtagggacttagctggctg

SEQ ID NO: 7222972 - DNA, 22 bp, Homo sapiens
tgggtagggacttagctggctg

SEQ ID NO: 7222973 - DNA, 22 bp, Homo sapiens
tgggtaggccaggaagcagtgt

SEQ ID NO: 7222974 - DNA, 22 bp, Homo sapiens
tgggtaggccaggaagcagtgt

SEQ ID NO: 7222975 - DNA, 22 bp, Homo sapiens
tgggtaggccaggaagcagtgt

SEQ ID NO: 7222976 - DNA, 22 bp, Homo sapiens
tgggtaggaccagaaatgcact

SEQ ID NO: 7222977 - DNA, 22 bp, Homo sapiens
tgggtaggaccagaaatgcact

SEQ ID NO: 7222978 - DNA, 23 bp, Homo sapiens
tggggttgaattgtagctgtgcc

SEQ ID NO: 7222979 - DNA, 22 bp, Homo sapiens
tggggttctttgtttcctgcct

SEQ ID NO: 7222980 - DNA, 22 bp, Homo sapiens
tggggttacctacaagtctgag

SEQ ID NO: 7222981 - DNA, 22 bp, Homo sapiens
tggggttgcctcccgccctgga

SEQ ID NO: 7222982 - DNA, 22 bp, Homo sapiens
tgggtaaactgggtctggagag

SEQ ID NO: 7222983 - DNA, 22 bp, Homo sapiens
tgggtaagaattgggggctctg

SEQ ID NO: 7222984 - DNA, 22 bp, Homo sapiens
tgggtaaatatcctttgtgaaa

SEQ ID NO: 7222985 - DNA, 22 bp, Homo sapiens
tgggtaagtgcataaaaagtaa

SEQ ID NO: 7222986 - DNA, 22 bp, Homo sapiens
tgggtaagtggaggacaaagta

SEQ ID NO: 7222987 - DNA, 22 bp, Homo sapiens
tgggtacctgtgtacatttgca

SEQ ID NO: 7222988 - DNA, 22 bp, Homo sapiens
tgggtactcctattagttcagt

SEQ ID NO: 7222989 - DNA, 22 bp, Homo sapiens
tgggtagcagggctgagctgtg

SEQ ID NO: 7222990 - DNA, 22 bp, Homo sapiens
tgggtaggaatcgagtgtatgg

SEQ ID NO: 7222991 - DNA, 22 bp, Homo sapiens
tgggtagaggaattgggctacc

SEQ ID NO: 7222992 - DNA, 22 bp, Homo sapiens
tgggtagagcaggctggggctt

SEQ ID NO: 7222993 - DNA, 22 bp, Homo sapiens
tgggtactcctattagttcagt

SEQ ID NO: 7222994 - DNA, 22 bp, Homo sapiens
tgggtactcctattagttcagt

SEQ ID NO: 7222995 - DNA, 22 bp, Homo sapiens
tgggtagaaacaaggctggact

SEQ ID NO: 7222996 - DNA, 22 bp, Homo sapiens
tgggtagaaacaaggctggact

SEQ ID NO: 7222997 - DNA, 21 bp, Homo sapiens
tgggtgcaagctgcggatgct

SEQ ID NO: 7222998 - DNA, 21 bp, Homo sapiens
tgggtgcaagctgcggatgct

SEQ ID NO: 7222999 - DNA, 22 bp, Homo sapiens
tgggtgcaggatgagtgctggc

SEQ ID NO: 7223000 - DNA, 22 bp, Homo sapiens
tgggtgcatgtgagcacgtgca

SEQ ID NO: 7223001 - DNA, 23 bp, Homo sapiens
tgggtgctaatctgctctgtgga

SEQ ID NO: 7223002 - DNA, 22 bp, Homo sapiens
tgggtgctctgcgaccgtaggg

SEQ ID NO: 7223003 - DNA, 21 bp, Homo sapiens
tgggtggaagcgggaggccgc

SEQ ID NO: 7223004 - DNA, 21 bp, Homo sapiens
tgggtggaagcgggaggccgc

SEQ ID NO: 7223005 - DNA, 21 bp, Homo sapiens
tgggtggaagcgggaggccgc

SEQ ID NO: 7223006 - DNA, 21 bp, Homo sapiens
tgggtggaagcgggaggccgc

SEQ ID NO: 7223007 - DNA, 21 bp, Homo sapiens
tgggtggaagcgggaggccgc

SEQ ID NO: 7223008 - DNA, 17 bp, Homo sapiens
tgggtgctgggatgagg

SEQ ID NO: 7223009 - DNA, 17 bp, Homo sapiens
tgggtgctgggatgagg

SEQ ID NO: 7223010 - DNA, 22 bp, Homo sapiens
tgggtgctctgcttccctgcac

SEQ ID NO: 7223011 - DNA, 22 bp, Homo sapiens
tgggtgctgctttagggggtca

SEQ ID NO: 7223012 - DNA, 22 bp, Homo sapiens
tgggtgagcggctgcacacccg

SEQ ID NO: 7223013 - DNA, 22 bp, Homo sapiens
tgggtgaggagaggctgtctaa

SEQ ID NO: 7223014 - DNA, 22 bp, Homo sapiens
tgggtgagccacaggagttgtc

SEQ ID NO: 7223015 - DNA, 22 bp, Homo sapiens
tgggtgaggatgatgaggcagc

SEQ ID NO: 7223016 - DNA, 22 bp, Homo sapiens
tgggtgaggatgatgaggcagc

SEQ ID NO: 7223017 - DNA, 22 bp, Homo sapiens
tgggtgagtggagggcattcta

SEQ ID NO: 7223018 - DNA, 22 bp, Homo sapiens
tgggtgtgcccagatggtgtcc

SEQ ID NO: 7223019 - DNA, 22 bp, Homo sapiens
tgggtgtgcccagatggtgtcc

SEQ ID NO: 7223020 - DNA, 22 bp, Homo sapiens
tgggtgtgcccagatggtgtcc

SEQ ID NO: 7223021 - DNA, 22 bp, Homo sapiens
tgggtgtgcccagatggtgtcc

SEQ ID NO: 7223022 - DNA, 22 bp, Homo sapiens
tgggtgtgcccagatggtgtcc

SEQ ID NO: 7223023 - DNA, 22 bp, Homo sapiens
tgggtgtgtccatattttgact

SEQ ID NO: 7223024 - DNA, 22 bp, Homo sapiens
tgggttaaaagttgaatgaatt

SEQ ID NO: 7223025 - DNA, 22 bp, Homo sapiens
tgggttaaaatgataccttgca

SEQ ID NO: 7223026 - DNA, 22 bp, Homo sapiens
tgggttaacagtttataccaga

SEQ ID NO: 7223027 - DNA, 22 bp, Homo sapiens
tgggttaagcctcattcatagc

SEQ ID NO: 7223028 - DNA, 22 bp, Homo sapiens
tgggttaatagaatcattaact

SEQ ID NO: 7223029 - DNA, 19 bp, Homo sapiens
tgggtgtgaccatctctgc

SEQ ID NO: 7223030 - DNA, 19 bp, Homo sapiens
tgggtgtgaccatctctgc

SEQ ID NO: 7223031 - DNA, 22 bp, Homo sapiens
tgggtgtgagcccgggagccgc

SEQ ID NO: 7223032 - DNA, 22 bp, Homo sapiens
tgggtgtgagcccgggagccgc

SEQ ID NO: 7223033 - DNA, 22 bp, Homo sapiens
tgggtgtgagcccgggagccgc

SEQ ID NO: 7223034 - DNA, 22 bp, Homo sapiens
tgggtgtgcccagatggtgtcc

SEQ ID NO: 7223035 - DNA, 22 bp, Homo sapiens
tgggtgtgccatattccatttc

SEQ ID NO: 7223036 - DNA, 22 bp, Homo sapiens
tgggtggtccaggctcagcaga

SEQ ID NO: 7223037 - DNA, 22 bp, Homo sapiens
tgggtggtggcagtaatgagaa

SEQ ID NO: 7223038 - DNA, 22 bp, Homo sapiens
tgggtggtttatgagtgggttt

SEQ ID NO: 7223039 - DNA, 22 bp, Homo sapiens
tgggtggtttatgagtgggttt

SEQ ID NO: 7223040 - DNA, 22 bp, Homo sapiens
tgggtgtgaagtctgttggcct

SEQ ID NO: 7223041 - DNA, 22 bp, Homo sapiens
tgggtgtgaagtctgttggcct

SEQ ID NO: 7223042 - DNA, 22 bp, Homo sapiens
tgggtgtcaatgtcacacgatt

SEQ ID NO: 7223043 - DNA, 22 bp, Homo sapiens
tgggtgtgaagtctgttggcct

SEQ ID NO: 7223044 - DNA, 19 bp, Homo sapiens
tgggtgtgaccatctctgc

SEQ ID NO: 7223045 - DNA, 16 bp, Homo sapiens
tgggtgggaggagcgg

SEQ ID NO: 7223046 - DNA, 16 bp, Homo sapiens
tgggtgggaggagcgg

SEQ ID NO: 7223047 - DNA, 16 bp, Homo sapiens
tgggtgggaggagcgg

SEQ ID NO: 7223048 - DNA, 22 bp, Homo sapiens
tgggtgggagcgccctgtctgg

SEQ ID NO: 7223049 - DNA, 22 bp, Homo sapiens
tgggtgggagcgccctgtctgg

SEQ ID NO: 7223050 - DNA, 22 bp, Homo sapiens
tgggtgggagcgccctgtctgg

SEQ ID NO: 7223051 - DNA, 22 bp, Homo sapiens
tgggtgggagcgccctgtctgg

SEQ ID NO: 7223052 - DNA, 22 bp, Homo sapiens
tgggtgggagcgccctgtctgg

SEQ ID NO: 7223053 - DNA, 22 bp, Homo sapiens
tgggtgggagcgccctgtctgg

SEQ ID NO: 7223054 - DNA, 21 bp, Homo sapiens
tgggtgggcagagtctcttca

SEQ ID NO: 7223055 - DNA, 21 bp, Homo sapiens
tgggtgggcagagtctcttca

SEQ ID NO: 7223056 - DNA, 21 bp, Homo sapiens
tgggtgggcagagtctcttca

SEQ ID NO: 7223057 - DNA, 21 bp, Homo sapiens
tgggtgggcagagtctcttca

SEQ ID NO: 7223058 - DNA, 17 bp, Homo sapiens
tgggtggtagggagagg

SEQ ID NO: 7223059 - DNA, 17 bp, Homo sapiens
tgggtggtagggagagg

SEQ ID NO: 7223060 - DNA, 21 bp, Homo sapiens
tgggtgggcagagtctcttca

SEQ ID NO: 7223061 - DNA, 21 bp, Homo sapiens
tgggtgggcagagtctcttca

SEQ ID NO: 7223062 - DNA, 16 bp, Homo sapiens
tgggtgggaggagcgg

SEQ ID NO: 7223063 - DNA, 21 bp, Homo sapiens
tgggtgggcagagtctcttca

SEQ ID NO: 7223064 - DNA, 16 bp, Homo sapiens
tggtagtcacttagag

SEQ ID NO: 7223065 - DNA, 23 bp, Homo sapiens
tggtataaaaacagtacctacct

SEQ ID NO: 7223066 - DNA, 22 bp, Homo sapiens
tggtagggacactatgcagaaa

SEQ ID NO: 7223067 - DNA, 22 bp, Homo sapiens
tggtataaaaatttgtgaatgt

SEQ ID NO: 7223068 - DNA, 22 bp, Homo sapiens
tggtataaaactttttattgaa

SEQ ID NO: 7223069 - DNA, 22 bp, Homo sapiens
tggtataaaagagtaaactatg

SEQ ID NO: 7223070 - DNA, 22 bp, Homo sapiens
tggtataaaagagtaaactatg

SEQ ID NO: 7223071 - DNA, 22 bp, Homo sapiens
tggtataaacagttactggaga

SEQ ID NO: 7223072 - DNA, 22 bp, Homo sapiens
tggtataagctgtgtcagagcc

SEQ ID NO: 7223073 - DNA, 22 bp, Homo sapiens
tggtataagtaatcataattgc

SEQ ID NO: 7223074 - DNA, 22 bp, Homo sapiens
tggtataatacagtaagtgttg

SEQ ID NO: 7223075 - DNA, 22 bp, Homo sapiens
tggtatatgcatggaggtatca

SEQ ID NO: 7223076 - DNA, 22 bp, Homo sapiens
tggtatattaactagtttcttc

SEQ ID NO: 7223077 - DNA, 20 bp, Homo sapiens
tggtatcaattactagattg

SEQ ID NO: 7223078 - DNA, 22 bp, Homo sapiens
tggtatcatgacctcagcagag

SEQ ID NO: 7223079 - DNA, 22 bp, Homo sapiens
tggtatgaccgtggtgcaagca

SEQ ID NO: 7223080 - DNA, 22 bp, Homo sapiens
tggtatgaccgtggtgcaagca

SEQ ID NO: 7223081 - DNA, 22 bp, Homo sapiens
tggtatttaagacttcactcct

SEQ ID NO: 7223082 - DNA, 22 bp, Homo sapiens
tggtattacttctagacacaag

SEQ ID NO: 7223083 - DNA, 22 bp, Homo sapiens
tggtattacttctagacacaag

SEQ ID NO: 7223084 - DNA, 22 bp, Homo sapiens
tggtatttcagcttttgtatct

SEQ ID NO: 7223085 - DNA, 22 bp, Homo sapiens
tggtatttccaggcttatggta

SEQ ID NO: 7223086 - DNA, 22 bp, Homo sapiens
tggtatttcctcattctgcttt

SEQ ID NO: 7223087 - DNA, 22 bp, Homo sapiens
tggtatttgtcattcgagttct

SEQ ID NO: 7223088 - DNA, 22 bp, Homo sapiens
tggtcaaaagaaagctcagaac

SEQ ID NO: 7223089 - DNA, 22 bp, Homo sapiens
tggtcaaaccagttatctgtaa

SEQ ID NO: 7223090 - DNA, 22 bp, Homo sapiens
tggtcaaaccagttatctgtaa

SEQ ID NO: 7223091 - DNA, 22 bp, Homo sapiens
tggtcaacaggcagggatgaaa

SEQ ID NO: 7223092 - DNA, 22 bp, Homo sapiens
tggtaaggtcttcactcagatt

SEQ ID NO: 7223093 - DNA, 22 bp, Homo sapiens
tggtaaggattgtagaaacgaa

SEQ ID NO: 7223094 - DNA, 22 bp, Homo sapiens
tggtaaattatttttatatccc

SEQ ID NO: 7223095 - DNA, 22 bp, Homo sapiens
tggtaaccacaaccctccttgt

SEQ ID NO: 7223096 - DNA, 22 bp, Homo sapiens
tggtaagaacccatcagagaag

SEQ ID NO: 7223097 - DNA, 22 bp, Homo sapiens
tggtaaagtggcttcacagtgt

SEQ ID NO: 7223098 - DNA, 22 bp, Homo sapiens
tggtaaagttgattggtgctct

SEQ ID NO: 7223099 - DNA, 22 bp, Homo sapiens
tggtaaaaactgcaattacttt

SEQ ID NO: 7223100 - DNA, 22 bp, Homo sapiens
tggtaaagaaatgtcagggcag

SEQ ID NO: 7223101 - DNA, 22 bp, Homo sapiens
tgggttctttcacttctcagtt

SEQ ID NO: 7223102 - DNA, 22 bp, Homo sapiens
tgggttctttcacttctcagtt

SEQ ID NO: 7223103 - DNA, 22 bp, Homo sapiens
tgggttggaagcaggaggcacc

SEQ ID NO: 7223104 - DNA, 19 bp, Homo sapiens
tgggttggaagggaatgaa

SEQ ID NO: 7223105 - DNA, 19 bp, Homo sapiens
tgggttggaagggaatgaa

SEQ ID NO: 7223106 - DNA, 19 bp, Homo sapiens
tgggttggaagggaatgaa

SEQ ID NO: 7223107 - DNA, 22 bp, Homo sapiens
tgggttcagatcccagctctgt

SEQ ID NO: 7223108 - DNA, 22 bp, Homo sapiens
tgggttcagatcccagctctgt

SEQ ID NO: 7223109 - DNA, 22 bp, Homo sapiens
tgggttggtcagcataagatgg

SEQ ID NO: 7223110 - DNA, 22 bp, Homo sapiens
tgggttttccacatatgccatg

SEQ ID NO: 7223111 - DNA, 22 bp, Homo sapiens
tgggttttccatctatttactc

SEQ ID NO: 7223112 - DNA, 22 bp, Homo sapiens
tgggttttgtgaccatagatta

SEQ ID NO: 7223113 - DNA, 22 bp, Homo sapiens
tgggggagcgacagacataatt

SEQ ID NO: 7223114 - DNA, 22 bp, Homo sapiens
tgggggagccttcacagtagct

SEQ ID NO: 7223115 - DNA, 22 bp, Homo sapiens
tgggggagccttcacagtagct

SEQ ID NO: 7223116 - DNA, 22 bp, Homo sapiens
tgggggagctcagtccagccca

SEQ ID NO: 7223117 - DNA, 22 bp, Homo sapiens
tgggggagctcagtccagccca

SEQ ID NO: 7223118 - DNA, 22 bp, Homo sapiens
tgggggagcgacagacataatt

SEQ ID NO: 7223119 - DNA, 22 bp, Homo sapiens
tgggggagccttcacagtagct

SEQ ID NO: 7223120 - DNA, 22 bp, Homo sapiens
tgggggagattgtgcatctcta

SEQ ID NO: 7223121 - DNA, 22 bp, Homo sapiens
tgggggagattgtgcatctcta

SEQ ID NO: 7223122 - DNA, 22 bp, Homo sapiens
tgggggagattgtgcatctcta

SEQ ID NO: 7223123 - DNA, 22 bp, Homo sapiens
tgggggagccttcacagtagct

SEQ ID NO: 7223124 - DNA, 22 bp, Homo sapiens
tgggggagtatagtctggcctc

SEQ ID NO: 7223125 - DNA, 22 bp, Homo sapiens
tgggggagctcagtccagccca

SEQ ID NO: 7223126 - DNA, 22 bp, Homo sapiens
tgggggagctcagtccagccca

SEQ ID NO: 7223127 - DNA, 22 bp, Homo sapiens
tgggggagtatagtctggcctc

SEQ ID NO: 7223128 - DNA, 22 bp, Homo sapiens
tgggggattgttttaatgaata

SEQ ID NO: 7223129 - DNA, 22 bp, Homo sapiens
tgggggcatggaccagcctggc

SEQ ID NO: 7223130 - DNA, 17 bp, Homo sapiens
tgggggcgccagggtct

SEQ ID NO: 7223131 - DNA, 22 bp, Homo sapiens
tgggggctccaggctccaggga

SEQ ID NO: 7223132 - DNA, 22 bp, Homo sapiens
tgggggctccaggctccaggga

SEQ ID NO: 7223133 - DNA, 22 bp, Homo sapiens
tgggggctagaacccagggatt

SEQ ID NO: 7223134 - DNA, 22 bp, Homo sapiens
tgggggctccaggctccaggga

SEQ ID NO: 7223135 - DNA, 22 bp, Homo sapiens
tgggggctgagtaagatgagat

SEQ ID NO: 7223136 - DNA, 22 bp, Homo sapiens
tgggggctgagtaagatgagat

SEQ ID NO: 7223137 - DNA, 22 bp, Homo sapiens
tgggggctgagtaagatgagat

SEQ ID NO: 7223138 - DNA, 22 bp, Homo sapiens
tgggggctgtgcacaggctcac

SEQ ID NO: 7223139 - DNA, 22 bp, Homo sapiens
tgggggcagccaggctgtcaag

SEQ ID NO: 7223140 - DNA, 22 bp, Homo sapiens
tgggggcacttcgaggtcgcct

SEQ ID NO: 7223141 - DNA, 22 bp, Homo sapiens
tgggggcatggaccagcctggc

SEQ ID NO: 7223142 - DNA, 22 bp, Homo sapiens
tgggggcatggaccagcctggc

SEQ ID NO: 7223143 - DNA, 22 bp, Homo sapiens
tgggggcatggaccagcctggc

SEQ ID NO: 7223144 - DNA, 22 bp, Homo sapiens
tgggggcagccaggctgtcaag

SEQ ID NO: 7223145 - DNA, 22 bp, Homo sapiens
tgggggcatggaccagcctggc

SEQ ID NO: 7223146 - DNA, 22 bp, Homo sapiens
tgggggcatggaccagcctggc

SEQ ID NO: 7223147 - DNA, 22 bp, Homo sapiens
tgggggagagtgcaagcatgaa

SEQ ID NO: 7223148 - DNA, 22 bp, Homo sapiens
tgggggagagtgcaagcatgaa

SEQ ID NO: 7223149 - DNA, 22 bp, Homo sapiens
tggggctgtccttagtctgaga

SEQ ID NO: 7223150 - DNA, 22 bp, Homo sapiens
tggggctgtccttagtctgaga

SEQ ID NO: 7223151 - DNA, 22 bp, Homo sapiens
tgggggagagaggcattctttc

SEQ ID NO: 7223152 - DNA, 22 bp, Homo sapiens
tgggggagagtgcaagcatgaa

SEQ ID NO: 7223153 - DNA, 22 bp, Homo sapiens
tgggggagagtgcaagcatgaa

SEQ ID NO: 7223154 - DNA, 22 bp, Homo sapiens
tgggggagagtgcaagcatgaa

SEQ ID NO: 7223155 - DNA, 22 bp, Homo sapiens
tgggggagagtttagatgattt

SEQ ID NO: 7223156 - DNA, 22 bp, Homo sapiens
tgggggagagtttagatgattt

SEQ ID NO: 7223157 - DNA, 22 bp, Homo sapiens
tgggggagagtttagatgattt

SEQ ID NO: 7223158 - DNA, 22 bp, Homo sapiens
tgggggagatagagtctgatgg

SEQ ID NO: 7223159 - DNA, 22 bp, Homo sapiens
tgggggagattagagcttctta

SEQ ID NO: 7223160 - DNA, 22 bp, Homo sapiens
tgggggagattagagcttctta

SEQ ID NO: 7223161 - DNA, 22 bp, Homo sapiens
tgggggagattagagcttctta

SEQ ID NO: 7223162 - DNA, 22 bp, Homo sapiens
tgggggagattgtgcatctcta

SEQ ID NO: 7223163 - DNA, 22 bp, Homo sapiens
tgggggagattagagcttctta

SEQ ID NO: 7223164 - DNA, 22 bp, Homo sapiens
tgggggagattagagcttctta

SEQ ID NO: 7223165 - DNA, 22 bp, Homo sapiens
tgggggagattagagcttctta

SEQ ID NO: 7223166 - DNA, 22 bp, Homo sapiens
tgggggagattagagcttctta

SEQ ID NO: 7223167 - DNA, 22 bp, Homo sapiens
tgggggagattgtgcatctcta

SEQ ID NO: 7223168 - DNA, 22 bp, Homo sapiens
tggggctggcacagtctctatt

SEQ ID NO: 7223169 - DNA, 22 bp, Homo sapiens
tggggctggctattgtctccct

SEQ ID NO: 7223170 - DNA, 22 bp, Homo sapiens
tggggctggctattgtctccct

SEQ ID NO: 7223171 - DNA, 22 bp, Homo sapiens
tggggctggctattgtctccct

SEQ ID NO: 7223172 - DNA, 22 bp, Homo sapiens
tggggctggctattgtctccct

SEQ ID NO: 7223173 - DNA, 22 bp, Homo sapiens
tggggctggcacagtctctatt

SEQ ID NO: 7223174 - DNA, 22 bp, Homo sapiens
tggggctggggatcttgagcct

SEQ ID NO: 7223175 - DNA, 22 bp, Homo sapiens
tggggctggggatcttgagcct

SEQ ID NO: 7223176 - DNA, 22 bp, Homo sapiens
tggggctggctattgtctccct

SEQ ID NO: 7223177 - DNA, 22 bp, Homo sapiens
tggggctggctattgtctccct

SEQ ID NO: 7223178 - DNA, 22 bp, Homo sapiens
tggggctgtcccggtttggcga

SEQ ID NO: 7223179 - DNA, 22 bp, Homo sapiens
tggggctgtccttagtctgaga

SEQ ID NO: 7223180 - DNA, 22 bp, Homo sapiens
tggggctgtccttagtctgaga

SEQ ID NO: 7223181 - DNA, 22 bp, Homo sapiens
tggggctgtccttagtctgaga

SEQ ID NO: 7223182 - DNA, 22 bp, Homo sapiens
tggggctgtccttagtctgaga

SEQ ID NO: 7223183 - DNA, 22 bp, Homo sapiens
tggggctgtccttagtctgaga

SEQ ID NO: 7223184 - DNA, 22 bp, Homo sapiens
tggggctgtcccggtttggcga

SEQ ID NO: 7223185 - DNA, 22 bp, Homo sapiens
tggggctgtcccggtttggcga

SEQ ID NO: 7223186 - DNA, 22 bp, Homo sapiens
tggggctgtcccggtttggcga

SEQ ID NO: 7223187 - DNA, 22 bp, Homo sapiens
tggggctggggatcttgagcct

SEQ ID NO: 7223188 - DNA, 22 bp, Homo sapiens
tggggctggggatcttgagcct

SEQ ID NO: 7223189 - DNA, 22 bp, Homo sapiens
tggggctagaatcctgcaggaa

SEQ ID NO: 7223190 - DNA, 22 bp, Homo sapiens
tggggctaaacacgcctggcct

SEQ ID NO: 7223191 - DNA, 22 bp, Homo sapiens
tggggctaaacacgcctggcct

SEQ ID NO: 7223192 - DNA, 22 bp, Homo sapiens
tggggccttggcctcattagat

SEQ ID NO: 7223193 - DNA, 22 bp, Homo sapiens
tggggccttggcctcattagat

SEQ ID NO: 7223194 - DNA, 22 bp, Homo sapiens
tggggcgcccccactccacaga

SEQ ID NO: 7223195 - DNA, 22 bp, Homo sapiens
tggggcgcgaggtcctggctcc

SEQ ID NO: 7223196 - DNA, 20 bp, Homo sapiens
tggggcctgtttctgtggtt

SEQ ID NO: 7223197 - DNA, 22 bp, Homo sapiens
tggggcctgcacaggctgaatg

SEQ ID NO: 7223198 - DNA, 22 bp, Homo sapiens
tggggcctgaggtggagctgca

SEQ ID NO: 7223199 - DNA, 22 bp, Homo sapiens
tggggcctgaggtggagctgca

SEQ ID NO: 7223200 - DNA, 20 bp, Homo sapiens
tggggcctgtttctgtggtt

SEQ ID NO: 7223201 - DNA, 20 bp, Homo sapiens
tggggcctgtttctgtggtt

SEQ ID NO: 7223202 - DNA, 22 bp, Homo sapiens
tggggcctgtgacgggtccaga

SEQ ID NO: 7223203 - DNA, 22 bp, Homo sapiens
tggggcctggtcagagctgcac

SEQ ID NO: 7223204 - DNA, 22 bp, Homo sapiens
tggggcctggtcagagctgcac

SEQ ID NO: 7223205 - DNA, 22 bp, Homo sapiens
tggggcctggtcagagctgcac

SEQ ID NO: 7223206 - DNA, 22 bp, Homo sapiens
tggggctcctcctggcaggagg

SEQ ID NO: 7223207 - DNA, 22 bp, Homo sapiens
tggggctcatgcctgctggaac

SEQ ID NO: 7223208 - DNA, 22 bp, Homo sapiens
tggggctcacctaggctggaag

SEQ ID NO: 7223209 - DNA, 22 bp, Homo sapiens
tggggctcacctaggctggaag

SEQ ID NO: 7223210 - DNA, 22 bp, Homo sapiens
tggggctcatgcctgctggaac

SEQ ID NO: 7223211 - DNA, 22 bp, Homo sapiens
tggggctctccacagtgtctca

SEQ ID NO: 7223212 - DNA, 23 bp, Homo sapiens
tggggctctggcaggcctgaggt

SEQ ID NO: 7223213 - DNA, 23 bp, Homo sapiens
tggggctctggcaggcctgaggt

SEQ ID NO: 7223214 - DNA, 22 bp, Homo sapiens
tggggctcctcctggcaggagg

SEQ ID NO: 7223215 - DNA, 22 bp, Homo sapiens
tggggctctccacagtgtctca

SEQ ID NO: 7223216 - DNA, 22 bp, Homo sapiens
tggggctctccacagtgtctca

SEQ ID NO: 7223217 - DNA, 23 bp, Homo sapiens
tggggctgatggagacggaccag

SEQ ID NO: 7223218 - DNA, 23 bp, Homo sapiens
tggggctgatggagacggaccag

SEQ ID NO: 7223219 - DNA, 22 bp, Homo sapiens
tggggctggcacagtctctatt

SEQ ID NO: 7223220 - DNA, 22 bp, Homo sapiens
tggggctgaggagcctcactct

SEQ ID NO: 7223221 - DNA, 22 bp, Homo sapiens
tggggctgaggagcctcactct

SEQ ID NO: 7223222 - DNA, 23 bp, Homo sapiens
tggggctctggcaggcctgaggt

SEQ ID NO: 7223223 - DNA, 22 bp, Homo sapiens
tggggctgaggagcctcactct

SEQ ID NO: 7223224 - DNA, 22 bp, Homo sapiens
tggggctgaggagcctcactct

SEQ ID NO: 7223225 - DNA, 22 bp, Homo sapiens
tggggcagagtaggattttggc

SEQ ID NO: 7223226 - DNA, 22 bp, Homo sapiens
tggggcagagtaggattttggc

SEQ ID NO: 7223227 - DNA, 22 bp, Homo sapiens
tggggcagagtaggattttggc

SEQ ID NO: 7223228 - DNA, 22 bp, Homo sapiens
tggggcagagtaggattttggc

SEQ ID NO: 7223229 - DNA, 22 bp, Homo sapiens
tggggcagagtaggattttggc

SEQ ID NO: 7223230 - DNA, 22 bp, Homo sapiens
tggggcacttatgatgtgccac

SEQ ID NO: 7223231 - DNA, 22 bp, Homo sapiens
tggggcaccttgtatctctaag

SEQ ID NO: 7223232 - DNA, 20 bp, Homo sapiens
tggggcacatgcagattggt

SEQ ID NO: 7223233 - DNA, 22 bp, Homo sapiens
tggggcaagaagtgccctgaag

SEQ ID NO: 7223234 - DNA, 22 bp, Homo sapiens
tggggcaagaagtgccctgaag

SEQ ID NO: 7223235 - DNA, 22 bp, Homo sapiens
tggggcacagctgagaaagcac

SEQ ID NO: 7223236 - DNA, 22 bp, Homo sapiens
tggggcagcagacctttcttgg

SEQ ID NO: 7223237 - DNA, 22 bp, Homo sapiens
tggggcagcagacctttcttgg

SEQ ID NO: 7223238 - DNA, 22 bp, Homo sapiens
tggggccacactgatctcccag

SEQ ID NO: 7223239 - DNA, 22 bp, Homo sapiens
tggggccacagcctcctagctt

SEQ ID NO: 7223240 - DNA, 22 bp, Homo sapiens
tggggccacagcctcctagctt

SEQ ID NO: 7223241 - DNA, 22 bp, Homo sapiens
tggggccacagcctcctagctt

SEQ ID NO: 7223242 - DNA, 22 bp, Homo sapiens
tggggccacagcctcctagctt

SEQ ID NO: 7223243 - DNA, 22 bp, Homo sapiens
tggggccagagatggggcgcag

SEQ ID NO: 7223244 - DNA, 22 bp, Homo sapiens
tggggccagagatggggcgcag

SEQ ID NO: 7223245 - DNA, 22 bp, Homo sapiens
tggggccagagatggggcgcag

SEQ ID NO: 7223246 - DNA, 22 bp, Homo sapiens
tggggccagagctgcagggagc

SEQ ID NO: 7223247 - DNA, 22 bp, Homo sapiens
tggggccagagctgcagggagc

SEQ ID NO: 7223248 - DNA, 22 bp, Homo sapiens
tggggccagagctgcagggagc

SEQ ID NO: 7223249 - DNA, 22 bp, Homo sapiens
tggggccagagctgcagggagc

SEQ ID NO: 7223250 - DNA, 22 bp, Homo sapiens
tggggccagagctgcagggagc

SEQ ID NO: 7223251 - DNA, 22 bp, Homo sapiens
tggggccagagctgcagggagc

SEQ ID NO: 7223252 - DNA, 22 bp, Homo sapiens
tggggccagcggggaggactca

SEQ ID NO: 7223253 - DNA, 22 bp, Homo sapiens
tggggccagcggggaggactca

SEQ ID NO: 7223254 - DNA, 22 bp, Homo sapiens
tggggccagagctgcagggagc

SEQ ID NO: 7223255 - DNA, 22 bp, Homo sapiens
tggggccagcggggaggactca

SEQ ID NO: 7223256 - DNA, 22 bp, Homo sapiens
tggggccagcggggaggactca

SEQ ID NO: 7223257 - DNA, 22 bp, Homo sapiens
tggggccagcggggaggactca

SEQ ID NO: 7223258 - DNA, 22 bp, Homo sapiens
tggggccagggaggaccagaca

SEQ ID NO: 7223259 - DNA, 22 bp, Homo sapiens
tggggccagggaggaccagaca

SEQ ID NO: 7223260 - DNA, 22 bp, Homo sapiens
tggggccagggaggaccagaca

SEQ ID NO: 7223261 - DNA, 22 bp, Homo sapiens
tggggccagggaggaccagaca

SEQ ID NO: 7223262 - DNA, 22 bp, Homo sapiens
tggggccaggtggctgcaggtc

SEQ ID NO: 7223263 - DNA, 22 bp, Homo sapiens
tggggccaggtggctgcaggtc

SEQ ID NO: 7223264 - DNA, 22 bp, Homo sapiens
tggggccaggtggctgcaggtc

SEQ ID NO: 7223265 - DNA, 22 bp, Homo sapiens
tggggccaggtggctgcaggtc

SEQ ID NO: 7223266 - DNA, 22 bp, Homo sapiens
tggggccaggtggctgcaggtc

SEQ ID NO: 7223267 - DNA, 22 bp, Homo sapiens
tggggccatctcacccactgtt

SEQ ID NO: 7223268 - DNA, 22 bp, Homo sapiens
tggggccatctcacccactgtt

SEQ ID NO: 7223269 - DNA, 22 bp, Homo sapiens
tggggcctgaaaggttctcgcc

SEQ ID NO: 7223270 - DNA, 22 bp, Homo sapiens
tggggcctgaggtggagctgca

SEQ ID NO: 7223271 - DNA, 22 bp, Homo sapiens
tggggaggacgggcgccttcct

SEQ ID NO: 7223272 - DNA, 22 bp, Homo sapiens
tggggaggatatgtgagttatt

SEQ ID NO: 7223273 - DNA, 22 bp, Homo sapiens
tggggaggatatgtgagttatt

SEQ ID NO: 7223274 - DNA, 22 bp, Homo sapiens
tggggaggatatgtgagttatt

SEQ ID NO: 7223275 - DNA, 22 bp, Homo sapiens
tggggaggatatgtgagttatt

SEQ ID NO: 7223276 - DNA, 22 bp, Homo sapiens
tggggaggacgggcgccttcct

SEQ ID NO: 7223277 - DNA, 22 bp, Homo sapiens
tggggaggacgggcgccttcct

SEQ ID NO: 7223278 - DNA, 22 bp, Homo sapiens
tggggaggacgggcgccttcct

SEQ ID NO: 7223279 - DNA, 22 bp, Homo sapiens
tggggaggacgggcgccttcct

SEQ ID NO: 7223280 - DNA, 22 bp, Homo sapiens
tggggaggacgggcgccttcct

SEQ ID NO: 7223281 - DNA, 23 bp, Homo sapiens
tggggagggaagtcatttctgta

SEQ ID NO: 7223282 - DNA, 23 bp, Homo sapiens
tggggagggaagtcatttctgta

SEQ ID NO: 7223283 - DNA, 22 bp, Homo sapiens
tggggaggatatgtgagttatt

SEQ ID NO: 7223284 - DNA, 22 bp, Homo sapiens
tggggaggatatgtgagttatt

SEQ ID NO: 7223285 - DNA, 22 bp, Homo sapiens
tggggaggatatgtgagttatt

SEQ ID NO: 7223286 - DNA, 22 bp, Homo sapiens
tggggaggatatgtgagttatt

SEQ ID NO: 7223287 - DNA, 23 bp, Homo sapiens
tggggagggaagtcatttctgta

SEQ ID NO: 7223288 - DNA, 21 bp, Homo sapiens
tggggaggggacctgattatg

SEQ ID NO: 7223289 - DNA, 21 bp, Homo sapiens
tggggaggggacctgattatg

SEQ ID NO: 7223290 - DNA, 23 bp, Homo sapiens
tggggagggaagtcatttctgta

SEQ ID NO: 7223291 - DNA, 23 bp, Homo sapiens
tggggagggaagtcatttctgta

SEQ ID NO: 7223292 - DNA, 23 bp, Homo sapiens
tggggagggaagtcatttctgta

SEQ ID NO: 7223293 - DNA, 23 bp, Homo sapiens
tggggagggaagtcatttctgta

SEQ ID NO: 7223294 - DNA, 22 bp, Homo sapiens
tggggaggaagtcagatttcag

SEQ ID NO: 7223295 - DNA, 22 bp, Homo sapiens
tggggaggaagtcagatttcag

SEQ ID NO: 7223296 - DNA, 22 bp, Homo sapiens
tggggaggaagtcagatttcag

SEQ ID NO: 7223297 - DNA, 22 bp, Homo sapiens
tggggaggaagtcagatttcag

SEQ ID NO: 7223298 - DNA, 22 bp, Homo sapiens
tggggaggaagtcagatttcag

SEQ ID NO: 7223299 - DNA, 22 bp, Homo sapiens
tggggaggaagtcagatttcag

SEQ ID NO: 7223300 - DNA, 22 bp, Homo sapiens
tggggacattcatgcaggttgt

SEQ ID NO: 7223301 - DNA, 22 bp, Homo sapiens
tggggacgtactgagaggtccg

SEQ ID NO: 7223302 - DNA, 22 bp, Homo sapiens
tggggacgtactgagaggtccg

SEQ ID NO: 7223303 - DNA, 22 bp, Homo sapiens
tggggactgacagccaggcctc

SEQ ID NO: 7223304 - DNA, 22 bp, Homo sapiens
tggggactgacagccaggcctc

SEQ ID NO: 7223305 - DNA, 22 bp, Homo sapiens
tggggactgacagccaggcctc

SEQ ID NO: 7223306 - DNA, 22 bp, Homo sapiens
tggggacagggctcagcaattt

SEQ ID NO: 7223307 - DNA, 22 bp, Homo sapiens
tggggacatagccagtctggct

SEQ ID NO: 7223308 - DNA, 22 bp, Homo sapiens
tggggacagggctcagcaattt

SEQ ID NO: 7223309 - DNA, 22 bp, Homo sapiens
tggggacatagccagtctggct

SEQ ID NO: 7223310 - DNA, 22 bp, Homo sapiens
tggggacattcatgcaggttgt

SEQ ID NO: 7223311 - DNA, 22 bp, Homo sapiens
tggggaggttcgggaatcttgt

SEQ ID NO: 7223312 - DNA, 22 bp, Homo sapiens
tggggaggttcgggaatcttgt

SEQ ID NO: 7223313 - DNA, 22 bp, Homo sapiens
tggggaggttcgggaatcttgt

SEQ ID NO: 7223314 - DNA, 22 bp, Homo sapiens
tggggaggtaacaatttcaggc

SEQ ID NO: 7223315 - DNA, 22 bp, Homo sapiens
tggggaggtaacaatttcaggc

SEQ ID NO: 7223316 - DNA, 22 bp, Homo sapiens
tggggagtcgctgcagagcgat

SEQ ID NO: 7223317 - DNA, 22 bp, Homo sapiens
tggggaggttcgggaatcttgt

SEQ ID NO: 7223318 - DNA, 22 bp, Homo sapiens
tggggaggttcgggaatcttgt

SEQ ID NO: 7223319 - DNA, 22 bp, Homo sapiens
tggggaggttcgggaatcttgt

SEQ ID NO: 7223320 - DNA, 22 bp, Homo sapiens
tggggaggttcgggaatcttgt

SEQ ID NO: 7223321 - DNA, 22 bp, Homo sapiens
tggggaggttcgggaatcttgt

SEQ ID NO: 7223322 - DNA, 22 bp, Homo sapiens
tggggaggtaacaatttcaggc

SEQ ID NO: 7223323 - DNA, 22 bp, Homo sapiens
tggggaggtaacaatttcaggc

SEQ ID NO: 7223324 - DNA, 22 bp, Homo sapiens
tggggaggtaacaatttcaggc

SEQ ID NO: 7223325 - DNA, 22 bp, Homo sapiens
tggggaggtaacaatttcaggc

SEQ ID NO: 7223326 - DNA, 22 bp, Homo sapiens
tggggaggtaacaatttcaggc

SEQ ID NO: 7223327 - DNA, 22 bp, Homo sapiens
tggggaggtaacaatttcaggc

SEQ ID NO: 7223328 - DNA, 22 bp, Homo sapiens
tggggaggtaacaatttcaggc

SEQ ID NO: 7223329 - DNA, 21 bp, Homo sapiens
tggggaggggacctgattatg

SEQ ID NO: 7223330 - DNA, 21 bp, Homo sapiens
tggggaggggacctgattatg

SEQ ID NO: 7223331 - DNA, 21 bp, Homo sapiens
tggggaggggacctgattatg

SEQ ID NO: 7223332 - DNA, 21 bp, Homo sapiens
tggggaggggacctgattatg

SEQ ID NO: 7223333 - DNA, 22 bp, Homo sapiens
tggggaggtaacaatttcaggc

SEQ ID NO: 7223334 - DNA, 21 bp, Homo sapiens
tggggaggggacctgattatg

SEQ ID NO: 7223335 - DNA, 21 bp, Homo sapiens
tggggaggggacctgattatg

SEQ ID NO: 7223336 - DNA, 22 bp, Homo sapiens
tggggagtgatgcctcggataa

SEQ ID NO: 7223337 - DNA, 22 bp, Homo sapiens
tggggagtgatgcctcggataa

SEQ ID NO: 7223338 - DNA, 20 bp, Homo sapiens
tggggagttgagcacgagca

SEQ ID NO: 7223339 - DNA, 20 bp, Homo sapiens
tggggagttgagcacgagca

SEQ ID NO: 7223340 - DNA, 22 bp, Homo sapiens
tggggatgaaacccaggcatct

SEQ ID NO: 7223341 - DNA, 22 bp, Homo sapiens
tggggatggatgaatctttgct

SEQ ID NO: 7223342 - DNA, 22 bp, Homo sapiens
tggggatggatgaatctttgct

SEQ ID NO: 7223343 - DNA, 19 bp, Homo sapiens
tggggatgctgatgaccaa

SEQ ID NO: 7223344 - DNA, 22 bp, Homo sapiens
tggggatggatgaatctttgct

SEQ ID NO: 7223345 - DNA, 22 bp, Homo sapiens
tggggatggatgaatctttgct

SEQ ID NO: 7223346 - DNA, 22 bp, Homo sapiens
tggggatgaaacccaggcatct

SEQ ID NO: 7223347 - DNA, 22 bp, Homo sapiens
tggggatgaaacccaggcatct

SEQ ID NO: 7223348 - DNA, 22 bp, Homo sapiens
tggggatgaaacccaggcatct

SEQ ID NO: 7223349 - DNA, 19 bp, Homo sapiens
tggggatgctgatgaccaa

SEQ ID NO: 7223350 - DNA, 19 bp, Homo sapiens
tggggatgctgatgaccaa

SEQ ID NO: 7223351 - DNA, 22 bp, Homo sapiens
tggggatgtagaaatgaacaac

SEQ ID NO: 7223352 - DNA, 22 bp, Homo sapiens
tggggatgtagaaatgaacaac

SEQ ID NO: 7223353 - DNA, 22 bp, Homo sapiens
tggggatgtagaaatgaacaac

SEQ ID NO: 7223354 - DNA, 22 bp, Homo sapiens
tggggatgtaaatgaggtgata

SEQ ID NO: 7223355 - DNA, 22 bp, Homo sapiens
tggggatgtcatataagaggaa

SEQ ID NO: 7223356 - DNA, 22 bp, Homo sapiens
tggggatgtcatataagaggaa

SEQ ID NO: 7223357 - DNA, 22 bp, Homo sapiens
tggggatgtcatataagaggaa

SEQ ID NO: 7223358 - DNA, 22 bp, Homo sapiens
tggggatgtcatataagaggaa

SEQ ID NO: 7223359 - DNA, 22 bp, Homo sapiens
tggggatgtcatataagaggaa

SEQ ID NO: 7223360 - DNA, 22 bp, Homo sapiens
tggggatgtcatataagaggaa

SEQ ID NO: 7223361 - DNA, 22 bp, Homo sapiens
tggggcaaagtaggtatttagt

SEQ ID NO: 7223362 - DNA, 22 bp, Homo sapiens
tggggcaaagtaggtatttagt

SEQ ID NO: 7223363 - DNA, 22 bp, Homo sapiens
tggggcaagaagtgccctgaag

SEQ ID NO: 7223364 - DNA, 22 bp, Homo sapiens
tggggatgtaaatgaggtgata

SEQ ID NO: 7223365 - DNA, 22 bp, Homo sapiens
tggggatgtaaatgaggtgata

SEQ ID NO: 7223366 - DNA, 22 bp, Homo sapiens
tggggatgtaaatgaggtgata

SEQ ID NO: 7223367 - DNA, 17 bp, Homo sapiens
tggggatggttcatgag

SEQ ID NO: 7223368 - DNA, 16 bp, Homo sapiens
tggggatggggaagag

SEQ ID NO: 7223369 - DNA, 17 bp, Homo sapiens
tggggatggttcatgag

SEQ ID NO: 7223370 - DNA, 16 bp, Homo sapiens
tggggatggggaagag

SEQ ID NO: 7223371 - DNA, 16 bp, Homo sapiens
tggggatggggaagag

SEQ ID NO: 7223372 - DNA, 22 bp, Homo sapiens
tgggcttaggtcggaggcggcc

SEQ ID NO: 7223373 - DNA, 22 bp, Homo sapiens
tgggcttaggtcggaggcggcc

SEQ ID NO: 7223374 - DNA, 18 bp, Homo sapiens
tgggcttgaaagcaaggt

SEQ ID NO: 7223375 - DNA, 22 bp, Homo sapiens
tgggcttggtttctaggtaggt

SEQ ID NO: 7223376 - DNA, 22 bp, Homo sapiens
tgggcttggtttctaggtaggt

SEQ ID NO: 7223377 - DNA, 22 bp, Homo sapiens
tggggaaaatgcagaagattac

SEQ ID NO: 7223378 - DNA, 22 bp, Homo sapiens
tggggaaaatgcttgtagtcag

SEQ ID NO: 7223379 - DNA, 22 bp, Homo sapiens
tgggctgtccagcacctgggct

SEQ ID NO: 7223380 - DNA, 22 bp, Homo sapiens
tgggctgtggagaggagctgga

SEQ ID NO: 7223381 - DNA, 22 bp, Homo sapiens
tgggctggtgagggatcattta

SEQ ID NO: 7223382 - DNA, 22 bp, Homo sapiens
tgggctggtgagggatcattta

SEQ ID NO: 7223383 - DNA, 22 bp, Homo sapiens
tgggctggtgagggatcattta

SEQ ID NO: 7223384 - DNA, 22 bp, Homo sapiens
tgggctggtgagggatcattta

SEQ ID NO: 7223385 - DNA, 22 bp, Homo sapiens
tgggctggctgaacttcaacct

SEQ ID NO: 7223386 - DNA, 22 bp, Homo sapiens
tgggctggctgaggcattcact

SEQ ID NO: 7223387 - DNA, 22 bp, Homo sapiens
tgggctggctgaggcattcact

SEQ ID NO: 7223388 - DNA, 22 bp, Homo sapiens
tgggctggctgaggcattcact

SEQ ID NO: 7223389 - DNA, 22 bp, Homo sapiens
tgggctggctgaggcattcact

SEQ ID NO: 7223390 - DNA, 22 bp, Homo sapiens
tgggctggctgaggcattcact

SEQ ID NO: 7223391 - DNA, 22 bp, Homo sapiens
tgggctggcgtggagagtttag

SEQ ID NO: 7223392 - DNA, 22 bp, Homo sapiens
tgggctggctgaacttcaacct

SEQ ID NO: 7223393 - DNA, 22 bp, Homo sapiens
tgggctggctgaacttcaacct

SEQ ID NO: 7223394 - DNA, 22 bp, Homo sapiens
tgggctggctgaacttcaacct

SEQ ID NO: 7223395 - DNA, 22 bp, Homo sapiens
tgggctggctgaacttcaacct

SEQ ID NO: 7223396 - DNA, 18 bp, Homo sapiens
tgggctgcctggcctctg

SEQ ID NO: 7223397 - DNA, 22 bp, Homo sapiens
tgggctggcgtggagagtttag

SEQ ID NO: 7223398 - DNA, 22 bp, Homo sapiens
tgggctggcgtggagagtttag

SEQ ID NO: 7223399 - DNA, 22 bp, Homo sapiens
tgggctggcgtggagagtttag

SEQ ID NO: 7223400 - DNA, 22 bp, Homo sapiens
tgggctggcgtggagagtttag

SEQ ID NO: 7223401 - DNA, 22 bp, Homo sapiens
tggggacacagagccaaactat

SEQ ID NO: 7223402 - DNA, 22 bp, Homo sapiens
tggggacaggagacttacagct

SEQ ID NO: 7223403 - DNA, 22 bp, Homo sapiens
tggggaaggcggagcttgcagc

SEQ ID NO: 7223404 - DNA, 22 bp, Homo sapiens
tggggaagggcaccctggagac

SEQ ID NO: 7223405 - DNA, 22 bp, Homo sapiens
tggggaagggcaccctggagac

SEQ ID NO: 7223406 - DNA, 22 bp, Homo sapiens
tggggaagggcaccctggagac

SEQ ID NO: 7223407 - DNA, 22 bp, Homo sapiens
tggggaagggcaccctggagac

SEQ ID NO: 7223408 - DNA, 22 bp, Homo sapiens
tggggaagggcaccctggagac

SEQ ID NO: 7223409 - DNA, 17 bp, Homo sapiens
tggggaagctcagattt

SEQ ID NO: 7223410 - DNA, 17 bp, Homo sapiens
tggggaagctcagattt

SEQ ID NO: 7223411 - DNA, 17 bp, Homo sapiens
tggggaagctcagattt

SEQ ID NO: 7223412 - DNA, 16 bp, Homo sapiens
tggggaagctcgtgag

SEQ ID NO: 7223413 - DNA, 16 bp, Homo sapiens
tggggaagctcgtgag

SEQ ID NO: 7223414 - DNA, 16 bp, Homo sapiens
tggggaagctcgtgag

SEQ ID NO: 7223415 - DNA, 22 bp, Homo sapiens
tggggaaggatcaccacaatct

SEQ ID NO: 7223416 - DNA, 22 bp, Homo sapiens
tggggaaggatcaccacaatct

SEQ ID NO: 7223417 - DNA, 22 bp, Homo sapiens
tggggaaggcggagcttgcagc

SEQ ID NO: 7223418 - DNA, 22 bp, Homo sapiens
tggggaaggatcaccacaatct

SEQ ID NO: 7223419 - DNA, 22 bp, Homo sapiens
tggggaaggcggagcttgcagc

SEQ ID NO: 7223420 - DNA, 22 bp, Homo sapiens
tggggaaggcggagcttgcagc

SEQ ID NO: 7223421 - DNA, 22 bp, Homo sapiens
tggggaaggcggagcttgcagc

SEQ ID NO: 7223422 - DNA, 22 bp, Homo sapiens
tggggaagggcaccctggagac

SEQ ID NO: 7223423 - DNA, 17 bp, Homo sapiens
tggggaagctcagattt

SEQ ID NO: 7223424 - DNA, 22 bp, Homo sapiens
tggggaagcactttgaacttaa

SEQ ID NO: 7223425 - DNA, 22 bp, Homo sapiens
tggggaagcactttgaacttaa

SEQ ID NO: 7223426 - DNA, 22 bp, Homo sapiens
tggggaagacagcagacactgt

SEQ ID NO: 7223427 - DNA, 22 bp, Homo sapiens
tggggaagacagcagacactgt

SEQ ID NO: 7223428 - DNA, 22 bp, Homo sapiens
tggggaagacagcagacactgt

SEQ ID NO: 7223429 - DNA, 22 bp, Homo sapiens
tggggaagcactttgaacttaa

SEQ ID NO: 7223430 - DNA, 22 bp, Homo sapiens
tggggaagcactttgaacttaa

SEQ ID NO: 7223431 - DNA, 22 bp, Homo sapiens
tggggaagaataatgtatgtac

SEQ ID NO: 7223432 - DNA, 22 bp, Homo sapiens
tggggaagaataatgtatgtac

SEQ ID NO: 7223433 - DNA, 22 bp, Homo sapiens
tggggaagaataatgtatgtac

SEQ ID NO: 7223434 - DNA, 22 bp, Homo sapiens
tggggaagacagcagacactgt

SEQ ID NO: 7223435 - DNA, 22 bp, Homo sapiens
tggggaagacagcagacactgt

SEQ ID NO: 7223436 - DNA, 22 bp, Homo sapiens
tggggaaactatttccttgtcc

SEQ ID NO: 7223437 - DNA, 22 bp, Homo sapiens
tggggaaactatttccttgtcc

SEQ ID NO: 7223438 - DNA, 22 bp, Homo sapiens
tggggaaagacattcatacagt

SEQ ID NO: 7223439 - DNA, 22 bp, Homo sapiens
tggggaaagatagttttctcta

SEQ ID NO: 7223440 - DNA, 22 bp, Homo sapiens
tggggaaagatagttttctcta

SEQ ID NO: 7223441 - DNA, 22 bp, Homo sapiens
tggggaaagatagttttctcta

SEQ ID NO: 7223442 - DNA, 20 bp, Homo sapiens
tggggaaagccatcgatgag

SEQ ID NO: 7223443 - DNA, 22 bp, Homo sapiens
tgggagtgaggcagagtctatc

SEQ ID NO: 7223444 - DNA, 22 bp, Homo sapiens
tgggagtccaaggtttttatag

SEQ ID NO: 7223445 - DNA, 22 bp, Homo sapiens
tgggagtagatgaggagtgggc

SEQ ID NO: 7223446 - DNA, 22 bp, Homo sapiens
tgggaggcttccagaccttgct

SEQ ID NO: 7223447 - DNA, 20 bp, Homo sapiens
tgggagtacaatcatgagca

SEQ ID NO: 7223448 - DNA, 22 bp, Homo sapiens
tgggaggtctcttgcggcctag

SEQ ID NO: 7223449 - DNA, 22 bp, Homo sapiens
tgggaggtctcttgcggcctag

SEQ ID NO: 7223450 - DNA, 22 bp, Homo sapiens
tgggaggccgaggcaggtggat

SEQ ID NO: 7223451 - DNA, 22 bp, Homo sapiens
tgggaggcttccagaccttgct

SEQ ID NO: 7223452 - DNA, 22 bp, Homo sapiens
tgggaggcttccagaccttgct

SEQ ID NO: 7223453 - DNA, 22 bp, Homo sapiens
tgggaggccaaggcaggcggat

SEQ ID NO: 7223454 - DNA, 22 bp, Homo sapiens
tgggaggccaaggcaggcggat

SEQ ID NO: 7223455 - DNA, 22 bp, Homo sapiens
tgggaggccaaggcaggcggat

SEQ ID NO: 7223456 - DNA, 22 bp, Homo sapiens
tgggaggcaggtaggtgatgat

SEQ ID NO: 7223457 - DNA, 22 bp, Homo sapiens
tgggaggcaggtaggtgatgat

SEQ ID NO: 7223458 - DNA, 22 bp, Homo sapiens
tgggaggccaaggcaggcggat

SEQ ID NO: 7223459 - DNA, 22 bp, Homo sapiens
tgggaggccgaggcaggtggat

SEQ ID NO: 7223460 - DNA, 22 bp, Homo sapiens
tgggaggccgaggcaggtggat

SEQ ID NO: 7223461 - DNA, 22 bp, Homo sapiens
tgggaggcccaggcctggcagg

SEQ ID NO: 7223462 - DNA, 22 bp, Homo sapiens
tgggaggccgaggcaggtggat

SEQ ID NO: 7223463 - DNA, 22 bp, Homo sapiens
tgggaggcccaggcctggcagg

SEQ ID NO: 7223464 - DNA, 22 bp, Homo sapiens
tgggaggcccaggcctggcagg

SEQ ID NO: 7223465 - DNA, 18 bp, Homo sapiens
tgggagtgggagtggata

SEQ ID NO: 7223466 - DNA, 18 bp, Homo sapiens
tgggagtgggagtggata

SEQ ID NO: 7223467 - DNA, 18 bp, Homo sapiens
tgggagtgggagtggata

SEQ ID NO: 7223468 - DNA, 22 bp, Homo sapiens
tgggatagattgatggatagag

SEQ ID NO: 7223469 - DNA, 22 bp, Homo sapiens
tgggatagtagctgagagacaa

SEQ ID NO: 7223470 - DNA, 22 bp, Homo sapiens
tgggagtgaggcagagtctatc

SEQ ID NO: 7223471 - DNA, 22 bp, Homo sapiens
tgggagtgatacagtatggaat

SEQ ID NO: 7223472 - DNA, 22 bp, Homo sapiens
tgggagtgcacctgggacacga

SEQ ID NO: 7223473 - DNA, 22 bp, Homo sapiens
tgggagtgcacctgggacacga

SEQ ID NO: 7223474 - DNA, 22 bp, Homo sapiens
tgggatgagaagtgcgagggtt

SEQ ID NO: 7223475 - DNA, 22 bp, Homo sapiens
tgggatcttttgagatactgtg

SEQ ID NO: 7223476 - DNA, 22 bp, Homo sapiens
tgggatgaatacaatgggatca

SEQ ID NO: 7223477 - DNA, 22 bp, Homo sapiens
tgggatctgcagtttaacaaaa

SEQ ID NO: 7223478 - DNA, 22 bp, Homo sapiens
tgggatgagctatatagaaagt

SEQ ID NO: 7223479 - DNA, 22 bp, Homo sapiens
tgggatattttgagctttcctc

SEQ ID NO: 7223480 - DNA, 20 bp, Homo sapiens
tgggatcgaatcaagtctgt

SEQ ID NO: 7223481 - DNA, 22 bp, Homo sapiens
tgggatatacctatcctagaag

SEQ ID NO: 7223482 - DNA, 22 bp, Homo sapiens
tgggatagtagctgagagacaa

SEQ ID NO: 7223483 - DNA, 18 bp, Homo sapiens
tgggatggagagtaactg

SEQ ID NO: 7223484 - DNA, 22 bp, Homo sapiens
tgggatgccctgaccctctgga

SEQ ID NO: 7223485 - DNA, 19 bp, Homo sapiens
tgggatgatgcagaaggta

SEQ ID NO: 7223486 - DNA, 22 bp, Homo sapiens
tgggatgctcagggcctggagc

SEQ ID NO: 7223487 - DNA, 18 bp, Homo sapiens
tgggatggagagtaactg

SEQ ID NO: 7223488 - DNA, 18 bp, Homo sapiens
tgggatggagagtaactg

SEQ ID NO: 7223489 - DNA, 18 bp, Homo sapiens
tgggatggagagtaactg

SEQ ID NO: 7223490 - DNA, 22 bp, Homo sapiens
tgggatggagcctgagtatagt

SEQ ID NO: 7223491 - DNA, 22 bp, Homo sapiens
tgggatggagcctgagtatagt

SEQ ID NO: 7223492 - DNA, 19 bp, Homo sapiens
tgggatgatgcagaaggta

SEQ ID NO: 7223493 - DNA, 22 bp, Homo sapiens
tgggatgagttgttaggactga

SEQ ID NO: 7223494 - DNA, 22 bp, Homo sapiens
tgggatgagggtgagccacatg

SEQ ID NO: 7223495 - DNA, 23 bp, Homo sapiens
tgggatggattcaccagtgtgct

SEQ ID NO: 7223496 - DNA, 22 bp, Homo sapiens
tgggatggcatcctgggccttg

SEQ ID NO: 7223497 - DNA, 22 bp, Homo sapiens
tgggatggcatcctgggccttg

SEQ ID NO: 7223498 - DNA, 23 bp, Homo sapiens
tgggatggattcaccagtgtgct

SEQ ID NO: 7223499 - DNA, 23 bp, Homo sapiens
tgggatggattcaccagtgtgct

SEQ ID NO: 7223500 - DNA, 23 bp, Homo sapiens
tgggatggattcaccagtgtgct

SEQ ID NO: 7223501 - DNA, 23 bp, Homo sapiens
tgggatggattcaccagtgtgct

SEQ ID NO: 7223502 - DNA, 23 bp, Homo sapiens
tgggatggattcaccagtgtgct

SEQ ID NO: 7223503 - DNA, 22 bp, Homo sapiens
tgggatggagcctgagtatagt

SEQ ID NO: 7223504 - DNA, 23 bp, Homo sapiens
tgggatggattcaccagtgtgct

SEQ ID NO: 7223505 - DNA, 22 bp, Homo sapiens
tgggcagaggacagggaagatc

SEQ ID NO: 7223506 - DNA, 22 bp, Homo sapiens
tgggcagaggcagcagaaacct

SEQ ID NO: 7223507 - DNA, 22 bp, Homo sapiens
tgggcagaggacagggaagatc

SEQ ID NO: 7223508 - DNA, 22 bp, Homo sapiens
tgggcagaggacagggaagatc

SEQ ID NO: 7223509 - DNA, 22 bp, Homo sapiens
tgggcagaggacagggaagatc

SEQ ID NO: 7223510 - DNA, 22 bp, Homo sapiens
tgggcagaggacagggaagatc

SEQ ID NO: 7223511 - DNA, 22 bp, Homo sapiens
tgggcagagagtagaggcaacg

SEQ ID NO: 7223512 - DNA, 22 bp, Homo sapiens
tgggcagagagtagaggcaacg

SEQ ID NO: 7223513 - DNA, 22 bp, Homo sapiens
tgggcagagatctggatcaaac

SEQ ID NO: 7223514 - DNA, 22 bp, Homo sapiens
tgggcagagatctggatcaaac

SEQ ID NO: 7223515 - DNA, 22 bp, Homo sapiens
tgggcagagatctggatcaaac

SEQ ID NO: 7223516 - DNA, 22 bp, Homo sapiens
tgggcagagatctggatcaaac

SEQ ID NO: 7223517 - DNA, 22 bp, Homo sapiens
tgggcagagatctggatcaaac

SEQ ID NO: 7223518 - DNA, 22 bp, Homo sapiens
tgggcagaggacagggaagatc

SEQ ID NO: 7223519 - DNA, 22 bp, Homo sapiens
tgggcagagtcatacaggagac

SEQ ID NO: 7223520 - DNA, 22 bp, Homo sapiens
tgggcagagtcatacaggagac

SEQ ID NO: 7223521 - DNA, 22 bp, Homo sapiens
tgggcagagtagctcagaagaa

SEQ ID NO: 7223522 - DNA, 22 bp, Homo sapiens
tgggcagaggctctgaagtcca

SEQ ID NO: 7223523 - DNA, 22 bp, Homo sapiens
tgggcagagtcatacaggagac

SEQ ID NO: 7223524 - DNA, 22 bp, Homo sapiens
tgggcagagtcatacaggagac

SEQ ID NO: 7223525 - DNA, 22 bp, Homo sapiens
tgggcagagtcatacaggagac

SEQ ID NO: 7223526 - DNA, 22 bp, Homo sapiens
tgggcagagtcatacaggagac

SEQ ID NO: 7223527 - DNA, 22 bp, Homo sapiens
tgggcagagtcatacaggagac

SEQ ID NO: 7223528 - DNA, 22 bp, Homo sapiens
tgggcagagtcatacaggagac

SEQ ID NO: 7223529 - DNA, 22 bp, Homo sapiens
tgggcagagtcgtggggaatag

SEQ ID NO: 7223530 - DNA, 22 bp, Homo sapiens
tgggcagagtcgtggggaatag

SEQ ID NO: 7223531 - DNA, 22 bp, Homo sapiens
tgggcactcctggggacagctg

SEQ ID NO: 7223532 - DNA, 22 bp, Homo sapiens
tgggcactcaggctgaggccgt

SEQ ID NO: 7223533 - DNA, 22 bp, Homo sapiens
tgggcactcagagttttcaaga

SEQ ID NO: 7223534 - DNA, 22 bp, Homo sapiens
tgggcacctgaggcctggcagg

SEQ ID NO: 7223535 - DNA, 22 bp, Homo sapiens
tgggcactatggctctgtgcac

SEQ ID NO: 7223536 - DNA, 22 bp, Homo sapiens
tgggcagactgagccctgtccc

SEQ ID NO: 7223537 - DNA, 22 bp, Homo sapiens
tgggcagagagtagaggcaacg

SEQ ID NO: 7223538 - DNA, 22 bp, Homo sapiens
tgggcagagagtagaggcaacg

SEQ ID NO: 7223539 - DNA, 21 bp, Homo sapiens
tgggcaccaaaacctaggagt

SEQ ID NO: 7223540 - DNA, 22 bp, Homo sapiens
tgggcacctagcaacccttctc

SEQ ID NO: 7223541 - DNA, 22 bp, Homo sapiens
tgggcacctgaggcctggcagg

SEQ ID NO: 7223542 - DNA, 21 bp, Homo sapiens
tgggcaccaaaacctaggagt

SEQ ID NO: 7223543 - DNA, 20 bp, Homo sapiens
tgggcaccagatgggatgcc

SEQ ID NO: 7223544 - DNA, 22 bp, Homo sapiens
tgggcacagtgagttgccttta

SEQ ID NO: 7223545 - DNA, 22 bp, Homo sapiens
tgggcacagtgagttgccttta

SEQ ID NO: 7223546 - DNA, 22 bp, Homo sapiens
tgggcacatagttttatggtca

SEQ ID NO: 7223547 - DNA, 22 bp, Homo sapiens
tgggcacaggggaatggatgaa

SEQ ID NO: 7223548 - DNA, 22 bp, Homo sapiens
tgggcacaggggaatggatgaa

SEQ ID NO: 7223549 - DNA, 22 bp, Homo sapiens
tgggcacaggggtaggaatgag

SEQ ID NO: 7223550 - DNA, 22 bp, Homo sapiens
tgggcacaggggtaggaatgag

SEQ ID NO: 7223551 - DNA, 21 bp, Homo sapiens
tgggatgggtctgggaccagc

SEQ ID NO: 7223552 - DNA, 21 bp, Homo sapiens
tgggatgggtctgggaccagc

SEQ ID NO: 7223553 - DNA, 22 bp, Homo sapiens
tgggatgggatctcgctgtgtc

SEQ ID NO: 7223554 - DNA, 22 bp, Homo sapiens
tgggatgggatctcgctgtgtc

SEQ ID NO: 7223555 - DNA, 21 bp, Homo sapiens
tgggatgggtctgggaccagc

SEQ ID NO: 7223556 - DNA, 22 bp, Homo sapiens
tgggatgtggccatggttctct

SEQ ID NO: 7223557 - DNA, 22 bp, Homo sapiens
tgggatgtggccatggttctct

SEQ ID NO: 7223558 - DNA, 22 bp, Homo sapiens
tgggatggcctttgaaagccag

SEQ ID NO: 7223559 - DNA, 22 bp, Homo sapiens
tgggatggcctttgaaagccag

SEQ ID NO: 7223560 - DNA, 22 bp, Homo sapiens
tgggatggcatcctgggccttg

SEQ ID NO: 7223561 - DNA, 22 bp, Homo sapiens
tgggatgggatctcgctgtgtc

SEQ ID NO: 7223562 - DNA, 22 bp, Homo sapiens
tgggatggcctttgaaagccag

SEQ ID NO: 7223563 - DNA, 22 bp, Homo sapiens
tgggatgggatctcgctgtgtc

SEQ ID NO: 7223564 - DNA, 22 bp, Homo sapiens
tgggatgtgtgctgcttagtcc

SEQ ID NO: 7223565 - DNA, 22 bp, Homo sapiens
tgggattcaccatgggcttcag

SEQ ID NO: 7223566 - DNA, 22 bp, Homo sapiens
tgggcaaactgtcaaccatgtc

SEQ ID NO: 7223567 - DNA, 22 bp, Homo sapiens
tgggcaaagtcacatacatgat

SEQ ID NO: 7223568 - DNA, 22 bp, Homo sapiens
tgggcaaatgtcactttctttt

SEQ ID NO: 7223569 - DNA, 22 bp, Homo sapiens
tgggcaagcaggagggcctcag

SEQ ID NO: 7223570 - DNA, 22 bp, Homo sapiens
tgggcaagctctgggtggacac

SEQ ID NO: 7223571 - DNA, 22 bp, Homo sapiens
tgggcaagctctgggtggacac

SEQ ID NO: 7223572 - DNA, 22 bp, Homo sapiens
tgggcaaggctggagcctgcag

SEQ ID NO: 7223573 - DNA, 22 bp, Homo sapiens
tgggcaagtatcggactctgag

SEQ ID NO: 7223574 - DNA, 22 bp, Homo sapiens
tgggcaagtatcggactctgag

SEQ ID NO: 7223575 - DNA, 22 bp, Homo sapiens
tgggcaagtcacttctgtcttt

SEQ ID NO: 7223576 - DNA, 21 bp, Homo sapiens
tgggcaagtttgggggtcctc

SEQ ID NO: 7223577 - DNA, 21 bp, Homo sapiens
tgggcaagtttgggggtcctc

SEQ ID NO: 7223578 - DNA, 22 bp, Homo sapiens
tgggcaatatgactcagtattt

SEQ ID NO: 7223579 - DNA, 22 bp, Homo sapiens
tgggcaatttatttggtcatca

SEQ ID NO: 7223580 - DNA, 22 bp, Homo sapiens
tgggcaatttatttggtcatca

SEQ ID NO: 7223581 - DNA, 22 bp, Homo sapiens
tgggcaattttctttcctcatt

SEQ ID NO: 7223582 - DNA, 22 bp, Homo sapiens
tgggcacaaacatctgcctgtt

SEQ ID NO: 7223583 - DNA, 22 bp, Homo sapiens
tgggcacaaacatctgcctgtt

SEQ ID NO: 7223584 - DNA, 18 bp, Homo sapiens
tgggcacaatgaacagca

SEQ ID NO: 7223585 - DNA, 22 bp, Homo sapiens
tgggcacagaatagatggccca

SEQ ID NO: 7223586 - DNA, 22 bp, Homo sapiens
tgggcacagaatagatggccca

SEQ ID NO: 7223587 - DNA, 22 bp, Homo sapiens
tgggcacagaatagatggccca

SEQ ID NO: 7223588 - DNA, 22 bp, Homo sapiens
tgggcacagagtcccatctgcc

SEQ ID NO: 7223589 - DNA, 22 bp, Homo sapiens
tgggcacagagtcccatctgcc

SEQ ID NO: 7223590 - DNA, 22 bp, Homo sapiens
tgggcagggatctcttttgcaa

SEQ ID NO: 7223591 - DNA, 22 bp, Homo sapiens
tgggcagggatctcttttgcaa

SEQ ID NO: 7223592 - DNA, 22 bp, Homo sapiens
tgggcagggatctcttttgcaa

SEQ ID NO: 7223593 - DNA, 22 bp, Homo sapiens
tgggcagggatctcttttgcaa

SEQ ID NO: 7223594 - DNA, 22 bp, Homo sapiens
tgggcaggggccctgcttccgt

SEQ ID NO: 7223595 - DNA, 22 bp, Homo sapiens
tgggcaggggccctgcttccgt

SEQ ID NO: 7223596 - DNA, 22 bp, Homo sapiens
tgggcaggggccctgcttccgt

SEQ ID NO: 7223597 - DNA, 22 bp, Homo sapiens
tgggcagggatctcttttgcaa

SEQ ID NO: 7223598 - DNA, 22 bp, Homo sapiens
tgggcagggagctggaaccaca

SEQ ID NO: 7223599 - DNA, 22 bp, Homo sapiens
tgggcagggagctggaaccaca

SEQ ID NO: 7223600 - DNA, 22 bp, Homo sapiens
tgggcagggagctggaaccaca

SEQ ID NO: 7223601 - DNA, 22 bp, Homo sapiens
tgggcagggagctggaaccaca

SEQ ID NO: 7223602 - DNA, 22 bp, Homo sapiens
tgggcagggagctggaaccaca

SEQ ID NO: 7223603 - DNA, 22 bp, Homo sapiens
tgggcagggagctggaaccaca

SEQ ID NO: 7223604 - DNA, 22 bp, Homo sapiens
tgggcagggagctggaaccaca

SEQ ID NO: 7223605 - DNA, 22 bp, Homo sapiens
tgggcagggagctggaaccaca

SEQ ID NO: 7223606 - DNA, 22 bp, Homo sapiens
tgggcaggagagaagctaaaga

SEQ ID NO: 7223607 - DNA, 22 bp, Homo sapiens
tgggcaggagagaagctaaaga

SEQ ID NO: 7223608 - DNA, 22 bp, Homo sapiens
tgggcaggagagaagctaaaga

SEQ ID NO: 7223609 - DNA, 22 bp, Homo sapiens
tgggcaggagagaagctaaaga

SEQ ID NO: 7223610 - DNA, 22 bp, Homo sapiens
tgggcagggagctggaaccaca

SEQ ID NO: 7223611 - DNA, 22 bp, Homo sapiens
tgggcagggagctggaaccaca

SEQ ID NO: 7223612 - DNA, 22 bp, Homo sapiens
tgggcagggagctggaaccaca

SEQ ID NO: 7223613 - DNA, 22 bp, Homo sapiens
tgggcagggagctggaaccaca

SEQ ID NO: 7223614 - DNA, 23 bp, Homo sapiens
tgggcagcttctgcatgcccacc

SEQ ID NO: 7223615 - DNA, 22 bp, Homo sapiens
tgggcagcttccacttagttag

SEQ ID NO: 7223616 - DNA, 19 bp, Homo sapiens
tgggcagctccctctgtcc

SEQ ID NO: 7223617 - DNA, 19 bp, Homo sapiens
tgggcagctccctctgtcc

SEQ ID NO: 7223618 - DNA, 19 bp, Homo sapiens
tgggcagctccctctgtcc

SEQ ID NO: 7223619 - DNA, 19 bp, Homo sapiens
tgggcagctccctctgtcc

SEQ ID NO: 7223620 - DNA, 22 bp, Homo sapiens
tgggcagccatcccagcctctc

SEQ ID NO: 7223621 - DNA, 22 bp, Homo sapiens
tgggcagcatcctccacagtca

SEQ ID NO: 7223622 - DNA, 22 bp, Homo sapiens
tgggcagccatcccagcctctc

SEQ ID NO: 7223623 - DNA, 22 bp, Homo sapiens
tgggcagccatcccagcctctc

SEQ ID NO: 7223624 - DNA, 22 bp, Homo sapiens
tgggcagccatcccagcctctc

SEQ ID NO: 7223625 - DNA, 22 bp, Homo sapiens
tgggcagcatcctccacagtca

SEQ ID NO: 7223626 - DNA, 22 bp, Homo sapiens
tgggcagcatcctccacagtca

SEQ ID NO: 7223627 - DNA, 22 bp, Homo sapiens
tgggcagcagcaaagccagact

SEQ ID NO: 7223628 - DNA, 22 bp, Homo sapiens
tgggcagcagcaaagccagact

SEQ ID NO: 7223629 - DNA, 22 bp, Homo sapiens
tgggcagcagcaaagccagact

SEQ ID NO: 7223630 - DNA, 20 bp, Homo sapiens
tgggcagcactgctggctgg

SEQ ID NO: 7223631 - DNA, 20 bp, Homo sapiens
tgggcagcactgctggctgg

SEQ ID NO: 7223632 - DNA, 22 bp, Homo sapiens
tgggcagcagaaccaggccgac

SEQ ID NO: 7223633 - DNA, 22 bp, Homo sapiens
tgggcagcagaaccaggccgac

SEQ ID NO: 7223634 - DNA, 22 bp, Homo sapiens
tgggcagcagaaccaggccgac

SEQ ID NO: 7223635 - DNA, 22 bp, Homo sapiens
tgggcagcagaaccaggccgac

SEQ ID NO: 7223636 - DNA, 22 bp, Homo sapiens
tgggcagattaatgcagtggct

SEQ ID NO: 7223637 - DNA, 22 bp, Homo sapiens
tgggcagattaatgcagtggct

SEQ ID NO: 7223638 - DNA, 22 bp, Homo sapiens
tgggcagattaatgcagtggct

SEQ ID NO: 7223639 - DNA, 22 bp, Homo sapiens
tgggcagattaatgcagtggct

SEQ ID NO: 7223640 - DNA, 22 bp, Homo sapiens
tgggcagattaatgcagtggct

SEQ ID NO: 7223641 - DNA, 22 bp, Homo sapiens
tgggcagcaaagactgtgtgct

SEQ ID NO: 7223642 - DNA, 22 bp, Homo sapiens
tgggcagcaaagactgtgtgct

SEQ ID NO: 7223643 - DNA, 22 bp, Homo sapiens
tgggcagcaaagactgtgtgct

SEQ ID NO: 7223644 - DNA, 22 bp, Homo sapiens
tgggcagcaaagactgtgtgct

SEQ ID NO: 7223645 - DNA, 20 bp, Homo sapiens
tgggcagcactgctggctgg

SEQ ID NO: 7223646 - DNA, 20 bp, Homo sapiens
tgggcagcactgctggctgg

SEQ ID NO: 7223647 - DNA, 22 bp, Homo sapiens
tgggcagcaaagactgtgtgct

SEQ ID NO: 7223648 - DNA, 20 bp, Homo sapiens
tgggcagcactgctggctgg

SEQ ID NO: 7223649 - DNA, 20 bp, Homo sapiens
tgggcagcactgctggctgg

SEQ ID NO: 7223650 - DNA, 22 bp, Homo sapiens
tgggcagatgtggctctccttg

SEQ ID NO: 7223651 - DNA, 22 bp, Homo sapiens
tgggcagattaatgcagtggct

SEQ ID NO: 7223652 - DNA, 22 bp, Homo sapiens
tgggcagattaatgcagtggct

SEQ ID NO: 7223653 - DNA, 22 bp, Homo sapiens
tgggcagattaatgcagtggct

SEQ ID NO: 7223654 - DNA, 21 bp, Homo sapiens
tgggcagatggcagtgtggct

SEQ ID NO: 7223655 - DNA, 22 bp, Homo sapiens
tgggcagatgtcctctgaagtg

SEQ ID NO: 7223656 - DNA, 22 bp, Homo sapiens
tgggcagatctttggtggctag

SEQ ID NO: 7223657 - DNA, 15 bp, Homo sapiens
tgggcagatcacttg

SEQ ID NO: 7223658 - DNA, 22 bp, Homo sapiens
tgggcagagtcgtggggaatag

SEQ ID NO: 7223659 - DNA, 22 bp, Homo sapiens
tgggcagagtcgtggggaatag

SEQ ID NO: 7223660 - DNA, 22 bp, Homo sapiens
tgggcagagttgtgatgaactg

SEQ ID NO: 7223661 - DNA, 22 bp, Homo sapiens
tgggcagagttgtgatgaactg

SEQ ID NO: 7223662 - DNA, 22 bp, Homo sapiens
tgggcagatctttggtggctag

SEQ ID NO: 7223663 - DNA, 22 bp, Homo sapiens
tgggcagatctttggtggctag

SEQ ID NO: 7223664 - DNA, 22 bp, Homo sapiens
tgggcagatctttggtggctag

SEQ ID NO: 7223665 - DNA, 22 bp, Homo sapiens
tgggcagatctttggtggctag

SEQ ID NO: 7223666 - DNA, 16 bp, Homo sapiens
tgggcagatgagaaga

SEQ ID NO: 7223667 - DNA, 21 bp, Homo sapiens
tgggcagatggcagtgtggct

SEQ ID NO: 7223668 - DNA, 21 bp, Homo sapiens
tgggcagatggcagtgtggct

SEQ ID NO: 7223669 - DNA, 22 bp, Homo sapiens
tgggccagctccctgcccctgg

SEQ ID NO: 7223670 - DNA, 22 bp, Homo sapiens
tgggccagctgaagtgccgccc

SEQ ID NO: 7223671 - DNA, 22 bp, Homo sapiens
tgggccagctgaagtgccgccc

SEQ ID NO: 7223672 - DNA, 22 bp, Homo sapiens
tgggccagctgaagtgccgccc

SEQ ID NO: 7223673 - DNA, 22 bp, Homo sapiens
tgggccagctgaagtgccgccc

SEQ ID NO: 7223674 - DNA, 22 bp, Homo sapiens
tgggccagctgaagtgccgccc

SEQ ID NO: 7223675 - DNA, 22 bp, Homo sapiens
tgggccaggatttcaagaccct

SEQ ID NO: 7223676 - DNA, 22 bp, Homo sapiens
tgggccaggatttcaagaccct

SEQ ID NO: 7223677 - DNA, 22 bp, Homo sapiens
tgggccaggcatgtgatcagca

SEQ ID NO: 7223678 - DNA, 22 bp, Homo sapiens
tgggccagcactgggtgctcat

SEQ ID NO: 7223679 - DNA, 22 bp, Homo sapiens
tgggccagcactgggtgctcat

SEQ ID NO: 7223680 - DNA, 22 bp, Homo sapiens
tgggccagcactgggtgctcat

SEQ ID NO: 7223681 - DNA, 22 bp, Homo sapiens
tgggccagcactgggtgctcat

SEQ ID NO: 7223682 - DNA, 22 bp, Homo sapiens
tgggccagctccctgcccctgg

SEQ ID NO: 7223683 - DNA, 22 bp, Homo sapiens
tgggccacacacagaagaatca

SEQ ID NO: 7223684 - DNA, 22 bp, Homo sapiens
tgggccacaagccatgggacca

SEQ ID NO: 7223685 - DNA, 22 bp, Homo sapiens
tgggccacacacagaagaatca

SEQ ID NO: 7223686 - DNA, 22 bp, Homo sapiens
tgggccacagagtgagaaatgt

SEQ ID NO: 7223687 - DNA, 22 bp, Homo sapiens
tgggccacaagccatgggacca

SEQ ID NO: 7223688 - DNA, 22 bp, Homo sapiens
tgggccacagctcacacatcca

SEQ ID NO: 7223689 - DNA, 22 bp, Homo sapiens
tgggccacagctcacacatcca

SEQ ID NO: 7223690 - DNA, 22 bp, Homo sapiens
tgggccacagttcaccaatccc

SEQ ID NO: 7223691 - DNA, 22 bp, Homo sapiens
tgggccacattccaaaccagct

SEQ ID NO: 7223692 - DNA, 22 bp, Homo sapiens
tgggccacattccaaaccagct

SEQ ID NO: 7223693 - DNA, 22 bp, Homo sapiens
tgggccacctgctctgtttcta

SEQ ID NO: 7223694 - DNA, 22 bp, Homo sapiens
tgggccacctgcttttttgcat

SEQ ID NO: 7223695 - DNA, 22 bp, Homo sapiens
tgggccacgggggtggagagct

SEQ ID NO: 7223696 - DNA, 22 bp, Homo sapiens
tgggccacgggggtggagagct

SEQ ID NO: 7223697 - DNA, 22 bp, Homo sapiens
tgggccacgtcatctcccacaa

SEQ ID NO: 7223698 - DNA, 22 bp, Homo sapiens
tgggccacgtcatctcccacaa

SEQ ID NO: 7223699 - DNA, 22 bp, Homo sapiens
tgggccagcaattgctgctcag

SEQ ID NO: 7223700 - DNA, 22 bp, Homo sapiens
tgggccagcaattgctgctcag

SEQ ID NO: 7223701 - DNA, 22 bp, Homo sapiens
tgggccagcaattgctgctcag

SEQ ID NO: 7223702 - DNA, 22 bp, Homo sapiens
tgggccagcactgggtgctcat

SEQ ID NO: 7223703 - DNA, 22 bp, Homo sapiens
tgggccagcactgggtgctcat

SEQ ID NO: 7223704 - DNA, 22 bp, Homo sapiens
tgggccagcactgggtgctcat

SEQ ID NO: 7223705 - DNA, 19 bp, Homo sapiens
tgggcaggttcagtaatgg

SEQ ID NO: 7223706 - DNA, 19 bp, Homo sapiens
tgggcaggttcagtaatgg

SEQ ID NO: 7223707 - DNA, 22 bp, Homo sapiens
tgggcaggttgttatttgacat

SEQ ID NO: 7223708 - DNA, 19 bp, Homo sapiens
tgggcaggttcagtaatgg

SEQ ID NO: 7223709 - DNA, 19 bp, Homo sapiens
tgggcaggttcagtaatgg

SEQ ID NO: 7223710 - DNA, 19 bp, Homo sapiens
tgggcaggttcagtaatgg

SEQ ID NO: 7223711 - DNA, 22 bp, Homo sapiens
tgggcaggtgctattttccatg

SEQ ID NO: 7223712 - DNA, 19 bp, Homo sapiens
tgggcaggttcagtaatgg

SEQ ID NO: 7223713 - DNA, 22 bp, Homo sapiens
tgggcaggtgctattttccatg

SEQ ID NO: 7223714 - DNA, 22 bp, Homo sapiens
tgggcagggtctctgttatcag

SEQ ID NO: 7223715 - DNA, 22 bp, Homo sapiens
tgggcaggggccctgcttccgt

SEQ ID NO: 7223716 - DNA, 22 bp, Homo sapiens
tgggcaggggccctgcttccgt

SEQ ID NO: 7223717 - DNA, 22 bp, Homo sapiens
tgggcaggggccctgcttccgt

SEQ ID NO: 7223718 - DNA, 22 bp, Homo sapiens
tgggcaggggccctgcttccgt

SEQ ID NO: 7223719 - DNA, 22 bp, Homo sapiens
tgggcaggggccctgcttccgt

SEQ ID NO: 7223720 - DNA, 22 bp, Homo sapiens
tgggcaggggccctgcttccgt

SEQ ID NO: 7223721 - DNA, 22 bp, Homo sapiens
tgggcaggtgctattttccatg

SEQ ID NO: 7223722 - DNA, 22 bp, Homo sapiens
tgggcagggtctctgttatcag

SEQ ID NO: 7223723 - DNA, 22 bp, Homo sapiens
tgggcagggtctctgttatcag

SEQ ID NO: 7223724 - DNA, 19 bp, Homo sapiens
tgggcagtgccagggctta

SEQ ID NO: 7223725 - DNA, 22 bp, Homo sapiens
tgggcagtgagaaaggtcaggt

SEQ ID NO: 7223726 - DNA, 19 bp, Homo sapiens
tgggcagtgccagggctta

SEQ ID NO: 7223727 - DNA, 22 bp, Homo sapiens
tgggcagtggctgggcctctct

SEQ ID NO: 7223728 - DNA, 22 bp, Homo sapiens
tgggcagtgggcctaggtgtga

SEQ ID NO: 7223729 - DNA, 22 bp, Homo sapiens
tgggcaggttgttatttgacat

SEQ ID NO: 7223730 - DNA, 22 bp, Homo sapiens
tgggcaggttgttatttgacat

SEQ ID NO: 7223731 - DNA, 22 bp, Homo sapiens
tgggcagtcatcagcacaccgg

SEQ ID NO: 7223732 - DNA, 22 bp, Homo sapiens
tgggcagttgctcctcagaccc

SEQ ID NO: 7223733 - DNA, 22 bp, Homo sapiens
tgggcatcatggacagcagagg

SEQ ID NO: 7223734 - DNA, 23 bp, Homo sapiens
tgggcatctcctctgtgccaggc

SEQ ID NO: 7223735 - DNA, 22 bp, Homo sapiens
tgggcatcccgcgtctggctgc

SEQ ID NO: 7223736 - DNA, 23 bp, Homo sapiens
tgggcatctcctctgtgccaggc

SEQ ID NO: 7223737 - DNA, 22 bp, Homo sapiens
tgggcatgaagaaggaagtggg

SEQ ID NO: 7223738 - DNA, 22 bp, Homo sapiens
tgggcatgaagaaggaagtggg

SEQ ID NO: 7223739 - DNA, 22 bp, Homo sapiens
tgggcatgagtggacagagaag

SEQ ID NO: 7223740 - DNA, 22 bp, Homo sapiens
tgggcatggactgtggagccgc

SEQ ID NO: 7223741 - DNA, 22 bp, Homo sapiens
tgggcatggactgtggagccgc

SEQ ID NO: 7223742 - DNA, 22 bp, Homo sapiens
tgggccaacaggaggtctagga

SEQ ID NO: 7223743 - DNA, 22 bp, Homo sapiens
tgggctgaaatgctgtggacta

SEQ ID NO: 7223744 - DNA, 22 bp, Homo sapiens
tgggctgagcactgaggaagga

SEQ ID NO: 7223745 - DNA, 20 bp, Homo sapiens
tgggctgaggatcaggtgcc

SEQ ID NO: 7223746 - DNA, 22 bp, Homo sapiens
tgggctgagcagtgaagctcat

SEQ ID NO: 7223747 - DNA, 22 bp, Homo sapiens
tgggctgagcagtgaagctcat

SEQ ID NO: 7223748 - DNA, 22 bp, Homo sapiens
tgggctgagcactgaggaagga

SEQ ID NO: 7223749 - DNA, 22 bp, Homo sapiens
tgggctgagcactgaggaagga

SEQ ID NO: 7223750 - DNA, 22 bp, Homo sapiens
tgggctgagtgtggaactagtt

SEQ ID NO: 7223751 - DNA, 22 bp, Homo sapiens
tgggctgagtggcagccagagt

SEQ ID NO: 7223752 - DNA, 22 bp, Homo sapiens
tgggctgagtggcagccagagt

SEQ ID NO: 7223753 - DNA, 20 bp, Homo sapiens
tgggctgaggatcaggtgcc

SEQ ID NO: 7223754 - DNA, 20 bp, Homo sapiens
tgggctgaggatcaggtgcc

SEQ ID NO: 7223755 - DNA, 22 bp, Homo sapiens
tgggctgaggggccttgatgac

SEQ ID NO: 7223756 - DNA, 21 bp, Homo sapiens
tgggctctttaacccaggcac

SEQ ID NO: 7223757 - DNA, 22 bp, Homo sapiens
tgggctgaaatgctgtggacta

SEQ ID NO: 7223758 - DNA, 21 bp, Homo sapiens
tgggctctttaacccaggcac

SEQ ID NO: 7223759 - DNA, 22 bp, Homo sapiens
tgggctctgtgccaggttggtg

SEQ ID NO: 7223760 - DNA, 22 bp, Homo sapiens
tgggctctgtgccaggttggtg

SEQ ID NO: 7223761 - DNA, 22 bp, Homo sapiens
tgggctgagtgtggaactagtt

SEQ ID NO: 7223762 - DNA, 22 bp, Homo sapiens
tgggctgcaccctcagcctctg

SEQ ID NO: 7223763 - DNA, 22 bp, Homo sapiens
tgggctgcacctttgtaaatct

SEQ ID NO: 7223764 - DNA, 22 bp, Homo sapiens
tgggctgcactccattttctgc

SEQ ID NO: 7223765 - DNA, 22 bp, Homo sapiens
tgggctgcactgctctttatcg

SEQ ID NO: 7223766 - DNA, 22 bp, Homo sapiens
tgggctgcagagcccggccttc

SEQ ID NO: 7223767 - DNA, 22 bp, Homo sapiens
tgggctgcaggggttgagagct

SEQ ID NO: 7223768 - DNA, 22 bp, Homo sapiens
tgggctgccagctctccagatg

SEQ ID NO: 7223769 - DNA, 22 bp, Homo sapiens
tgggctgcccaaggtggccatg

SEQ ID NO: 7223770 - DNA, 22 bp, Homo sapiens
tgggctgccagctctccagatg

SEQ ID NO: 7223771 - DNA, 22 bp, Homo sapiens
tgggctgcccaaggtggccatg

SEQ ID NO: 7223772 - DNA, 22 bp, Homo sapiens
tgggctgcccaaggtggccatg

SEQ ID NO: 7223773 - DNA, 22 bp, Homo sapiens
tgggctgccctgatggtcctca

SEQ ID NO: 7223774 - DNA, 22 bp, Homo sapiens
tgggctgccctgatggtcctca

SEQ ID NO: 7223775 - DNA, 22 bp, Homo sapiens
tgggctgccggcaggctctgcc

SEQ ID NO: 7223776 - DNA, 22 bp, Homo sapiens
tgggctgccggcaggctctgcc

SEQ ID NO: 7223777 - DNA, 22 bp, Homo sapiens
tgggctgccggcaggctctgcc

SEQ ID NO: 7223778 - DNA, 22 bp, Homo sapiens
tgggctctggacaaacccttgc

SEQ ID NO: 7223779 - DNA, 22 bp, Homo sapiens
tgggctctggaattgagtggcc

SEQ ID NO: 7223780 - DNA, 22 bp, Homo sapiens
tgggctctggaattgagtggcc

SEQ ID NO: 7223781 - DNA, 22 bp, Homo sapiens
tgggctctgggtggcctgagca

SEQ ID NO: 7223782 - DNA, 22 bp, Homo sapiens
tgggctctggtttcctggctgg

SEQ ID NO: 7223783 - DNA, 22 bp, Homo sapiens
tgggctctgggtggcctgagca

SEQ ID NO: 7223784 - DNA, 22 bp, Homo sapiens
tgggctctggagggcctaggat

SEQ ID NO: 7223785 - DNA, 22 bp, Homo sapiens
tgggctctggggaaactgtgat

SEQ ID NO: 7223786 - DNA, 22 bp, Homo sapiens
tgggctctggggaaactgtgat

SEQ ID NO: 7223787 - DNA, 22 bp, Homo sapiens
tgggctctgcatcagtgcccat

SEQ ID NO: 7223788 - DNA, 22 bp, Homo sapiens
tgggctctgaagtcagtctgct

SEQ ID NO: 7223789 - DNA, 22 bp, Homo sapiens
tgggctctgctgcgtaccagtt

SEQ ID NO: 7223790 - DNA, 22 bp, Homo sapiens
tgggctctgctgcgtaccagtt

SEQ ID NO: 7223791 - DNA, 22 bp, Homo sapiens
tgggctctgcatcagtgcccat

SEQ ID NO: 7223792 - DNA, 22 bp, Homo sapiens
tgggctctgctgcgtaccagtt

SEQ ID NO: 7223793 - DNA, 22 bp, Homo sapiens
tgggctctgctgcgtaccagtt

SEQ ID NO: 7223794 - DNA, 22 bp, Homo sapiens
tgggctctcaaagtgcggcttg

SEQ ID NO: 7223795 - DNA, 22 bp, Homo sapiens
tgggctcagtgggagaaagggc

SEQ ID NO: 7223796 - DNA, 22 bp, Homo sapiens
tgggctctattcagagtttttc

SEQ ID NO: 7223797 - DNA, 22 bp, Homo sapiens
tgggctcagtctgcttggtcct

SEQ ID NO: 7223798 - DNA, 19 bp, Homo sapiens
tgggctctcaagagcggaa

SEQ ID NO: 7223799 - DNA, 22 bp, Homo sapiens
tgggctctcagtcagactggca

SEQ ID NO: 7223800 - DNA, 22 bp, Homo sapiens
tgggctctcctggaggacaaca

SEQ ID NO: 7223801 - DNA, 22 bp, Homo sapiens
tgggctctcctggaggacaaca

SEQ ID NO: 7223802 - DNA, 22 bp, Homo sapiens
tgggctctctttacctcataac

SEQ ID NO: 7223803 - DNA, 22 bp, Homo sapiens
tgggctctgaagtcagtctgct

SEQ ID NO: 7223804 - DNA, 22 bp, Homo sapiens
tgggctctctggcaggaaggct

SEQ ID NO: 7223805 - DNA, 22 bp, Homo sapiens
tgggctctctggcaggaaggct

SEQ ID NO: 7223806 - DNA, 22 bp, Homo sapiens
tgggctctctcacctggaggct

SEQ ID NO: 7223807 - DNA, 22 bp, Homo sapiens
tgggctctcctggaggacaaca

SEQ ID NO: 7223808 - DNA, 22 bp, Homo sapiens
tgggctctcgtccctgcagaag

SEQ ID NO: 7223809 - DNA, 22 bp, Homo sapiens
tgggctctcgtccctgcagaag

SEQ ID NO: 7223810 - DNA, 22 bp, Homo sapiens
tgggctctcgtccctgcagaag

SEQ ID NO: 7223811 - DNA, 22 bp, Homo sapiens
tgggcctgggttcctcctgggc

SEQ ID NO: 7223812 - DNA, 22 bp, Homo sapiens
tgggcctgggttcctcctgggc

SEQ ID NO: 7223813 - DNA, 22 bp, Homo sapiens
tgggcctgggtctttgctgcca

SEQ ID NO: 7223814 - DNA, 22 bp, Homo sapiens
tgggcctgggttcctcctgggc

SEQ ID NO: 7223815 - DNA, 21 bp, Homo sapiens
tgggcctgtccctcttggagg

SEQ ID NO: 7223816 - DNA, 22 bp, Homo sapiens
tgggcctgtgatgctgggctat

SEQ ID NO: 7223817 - DNA, 22 bp, Homo sapiens
tgggcctgtgatgctgggctat

SEQ ID NO: 7223818 - DNA, 22 bp, Homo sapiens
tgggcctgtgatgctgggctat

SEQ ID NO: 7223819 - DNA, 22 bp, Homo sapiens
tgggcctgtgatgctgggctat

SEQ ID NO: 7223820 - DNA, 20 bp, Homo sapiens
tgggcctgtggcagaagtct

SEQ ID NO: 7223821 - DNA, 20 bp, Homo sapiens
tgggcctgtggcagaagtct

SEQ ID NO: 7223822 - DNA, 22 bp, Homo sapiens
tgggcctgtggcttggctctag

SEQ ID NO: 7223823 - DNA, 22 bp, Homo sapiens
tgggcctgtggcttggctctag

SEQ ID NO: 7223824 - DNA, 22 bp, Homo sapiens
tgggcctgtggcttggctctag

SEQ ID NO: 7223825 - DNA, 22 bp, Homo sapiens
tgggcctgtggcttggctctag

SEQ ID NO: 7223826 - DNA, 22 bp, Homo sapiens
tgggcgacagagcaagactccg

SEQ ID NO: 7223827 - DNA, 22 bp, Homo sapiens
tgggcgaggagaatgctgtgaa

SEQ ID NO: 7223828 - DNA, 22 bp, Homo sapiens
tgggcgaggagaatgctgtgaa

SEQ ID NO: 7223829 - DNA, 23 bp, Homo sapiens
tgggcgaggcaggagtggagcac

SEQ ID NO: 7223830 - DNA, 22 bp, Homo sapiens
tgggccttctcaatgcactgga

SEQ ID NO: 7223831 - DNA, 22 bp, Homo sapiens
tgggccttgtcccctcagctgt

SEQ ID NO: 7223832 - DNA, 22 bp, Homo sapiens
tgggcgacagagcaagactccg

SEQ ID NO: 7223833 - DNA, 22 bp, Homo sapiens
tgggcctgtttcccttcagggc

SEQ ID NO: 7223834 - DNA, 22 bp, Homo sapiens
tgggcctgttggggttgagtta

SEQ ID NO: 7223835 - DNA, 22 bp, Homo sapiens
tgggcctgtttcccttcagggc

SEQ ID NO: 7223836 - DNA, 22 bp, Homo sapiens
tgggcctgttgcctgagtccat

SEQ ID NO: 7223837 - DNA, 22 bp, Homo sapiens
tgggcctgtggggatcttgaag

SEQ ID NO: 7223838 - DNA, 22 bp, Homo sapiens
tgggcctgtggggatcttgaag

SEQ ID NO: 7223839 - DNA, 22 bp, Homo sapiens
tgggcctgttgcctgagtccat

SEQ ID NO: 7223840 - DNA, 22 bp, Homo sapiens
tgggcctgttggggttgagtta

SEQ ID NO: 7223841 - DNA, 22 bp, Homo sapiens
tgggctcaaactggaggttgtt

SEQ ID NO: 7223842 - DNA, 22 bp, Homo sapiens
tgggctcaaactggaggttgtt

SEQ ID NO: 7223843 - DNA, 22 bp, Homo sapiens
tgggctagcagggaagagagac

SEQ ID NO: 7223844 - DNA, 22 bp, Homo sapiens
tgggctagcagggaagagagac

SEQ ID NO: 7223845 - DNA, 22 bp, Homo sapiens
tgggctagatttggtgacccag

SEQ ID NO: 7223846 - DNA, 22 bp, Homo sapiens
tgggctagatatttttgggctg

SEQ ID NO: 7223847 - DNA, 22 bp, Homo sapiens
tgggctcaatctgcttctgttt

SEQ ID NO: 7223848 - DNA, 18 bp, Homo sapiens
tgggctcaaaggatcctc

SEQ ID NO: 7223849 - DNA, 18 bp, Homo sapiens
tgggctcaaaggatcctc

SEQ ID NO: 7223850 - DNA, 22 bp, Homo sapiens
tgggctcaagtgatgctcctgt

SEQ ID NO: 7223851 - DNA, 23 bp, Homo sapiens
tgggcgaggcaggagtggagcac

SEQ ID NO: 7223852 - DNA, 23 bp, Homo sapiens
tgggcgaggcaggagtggagcac

SEQ ID NO: 7223853 - DNA, 22 bp, Homo sapiens
tgggcgaggcccagggctgcgt

SEQ ID NO: 7223854 - DNA, 22 bp, Homo sapiens
tgggcgaggcccagggctgcgt

SEQ ID NO: 7223855 - DNA, 22 bp, Homo sapiens
tgggcgaggcccagggctgcgt

SEQ ID NO: 7223856 - DNA, 21 bp, Homo sapiens
tgggcgcttgacctctgcact

SEQ ID NO: 7223857 - DNA, 22 bp, Homo sapiens
tgggcggactcgggcatggaat

SEQ ID NO: 7223858 - DNA, 22 bp, Homo sapiens
tgggcggactcgggcatggaat

SEQ ID NO: 7223859 - DNA, 22 bp, Homo sapiens
tgggcgggcaggagcgcacctg

SEQ ID NO: 7223860 - DNA, 23 bp, Homo sapiens
tgggcggggcttttcactctgcc

SEQ ID NO: 7223861 - DNA, 22 bp, Homo sapiens
tgggcgggcaggagcgcacctg

SEQ ID NO: 7223862 - DNA, 23 bp, Homo sapiens
tgggcggggcttttcactctgcc

SEQ ID NO: 7223863 - DNA, 23 bp, Homo sapiens
tgggcggggcttttcactctgcc

SEQ ID NO: 7223864 - DNA, 23 bp, Homo sapiens
tgggcggggcttttcactctgcc

SEQ ID NO: 7223865 - DNA, 22 bp, Homo sapiens
tgggcggtgtgcaggctctgct

SEQ ID NO: 7223866 - DNA, 22 bp, Homo sapiens
tgggctactctgggagcctaac

SEQ ID NO: 7223867 - DNA, 22 bp, Homo sapiens
tgggctcagggtcgaggacttt

SEQ ID NO: 7223868 - DNA, 22 bp, Homo sapiens
tgggctcagggtcgaggacttt

SEQ ID NO: 7223869 - DNA, 22 bp, Homo sapiens
tgggctcagtctgcacctgcgg

SEQ ID NO: 7223870 - DNA, 22 bp, Homo sapiens
tgggctcagtctgcacctgcgg

SEQ ID NO: 7223871 - DNA, 22 bp, Homo sapiens
tgggctcagggtcgaggacttt

SEQ ID NO: 7223872 - DNA, 22 bp, Homo sapiens
tgggctcagggaagcttggcct

SEQ ID NO: 7223873 - DNA, 22 bp, Homo sapiens
tgggctcagggaagcttggcct

SEQ ID NO: 7223874 - DNA, 22 bp, Homo sapiens
tgggctcaggaccccagaggcc

SEQ ID NO: 7223875 - DNA, 22 bp, Homo sapiens
tgggctcaggaccccagaggcc

SEQ ID NO: 7223876 - DNA, 22 bp, Homo sapiens
tgggctcaggaccccagaggcc

SEQ ID NO: 7223877 - DNA, 23 bp, Homo sapiens
tgggctcagcttccagtggggag

SEQ ID NO: 7223878 - DNA, 22 bp, Homo sapiens
tgggctcagctcccaagggaag

SEQ ID NO: 7223879 - DNA, 22 bp, Homo sapiens
tgggctcagctcccaagggaag

SEQ ID NO: 7223880 - DNA, 22 bp, Homo sapiens
tgggctcagctcccaagggaag

SEQ ID NO: 7223881 - DNA, 22 bp, Homo sapiens
tgggctcagctcccaagggaag

SEQ ID NO: 7223882 - DNA, 22 bp, Homo sapiens
tgggctcagccttcatgtggcc

SEQ ID NO: 7223883 - DNA, 22 bp, Homo sapiens
tgggctcagccttcatgtggcc

SEQ ID NO: 7223884 - DNA, 22 bp, Homo sapiens
tgggctcagcctcagtctgtgg

SEQ ID NO: 7223885 - DNA, 21 bp, Homo sapiens
tgggctcagccccagccctgc

SEQ ID NO: 7223886 - DNA, 22 bp, Homo sapiens
tgggctcactggggcagggacc

SEQ ID NO: 7223887 - DNA, 22 bp, Homo sapiens
tgggctcactggggcagggacc

SEQ ID NO: 7223888 - DNA, 22 bp, Homo sapiens
tgggctcactggggcagggacc

SEQ ID NO: 7223889 - DNA, 22 bp, Homo sapiens
tgggccagtccagccccaggga

SEQ ID NO: 7223890 - DNA, 22 bp, Homo sapiens
tgggccagtccagccccaggga

SEQ ID NO: 7223891 - DNA, 22 bp, Homo sapiens
tgggccagtcctgcctaaggtg

SEQ ID NO: 7223892 - DNA, 22 bp, Homo sapiens
tgggccagtccagccccaggga

SEQ ID NO: 7223893 - DNA, 22 bp, Homo sapiens
tgggccagtccagccccaggga

SEQ ID NO: 7223894 - DNA, 22 bp, Homo sapiens
tgggccagtccagccccaggga

SEQ ID NO: 7223895 - DNA, 22 bp, Homo sapiens
tgggccagtagctactcgcaag

SEQ ID NO: 7223896 - DNA, 22 bp, Homo sapiens
tgggccagtagctactcgcaag

SEQ ID NO: 7223897 - DNA, 17 bp, Homo sapiens
tgggccagtagaaggga

SEQ ID NO: 7223898 - DNA, 22 bp, Homo sapiens
tgggccagtagctactcgcaag

SEQ ID NO: 7223899 - DNA, 17 bp, Homo sapiens
tgggccagtagaaggga

SEQ ID NO: 7223900 - DNA, 21 bp, Homo sapiens
tgggccagtagaaaggaaggc

SEQ ID NO: 7223901 - DNA, 21 bp, Homo sapiens
tgggccagtagaaaggaaggc

SEQ ID NO: 7223902 - DNA, 17 bp, Homo sapiens
tgggccagtagaaggga

SEQ ID NO: 7223903 - DNA, 17 bp, Homo sapiens
tgggccagtagaaggga

SEQ ID NO: 7223904 - DNA, 17 bp, Homo sapiens
tgggccagtagaaggga

SEQ ID NO: 7223905 - DNA, 21 bp, Homo sapiens
tgggccagtagaaaggaaggc

SEQ ID NO: 7223906 - DNA, 22 bp, Homo sapiens
tgggccaggtgcagtgctttag

SEQ ID NO: 7223907 - DNA, 21 bp, Homo sapiens
tgggccagtagaaaggaaggc

SEQ ID NO: 7223908 - DNA, 21 bp, Homo sapiens
tgggccagtagaaaggaaggc

SEQ ID NO: 7223909 - DNA, 22 bp, Homo sapiens
tgggccaggtctgtgtcagctg

SEQ ID NO: 7223910 - DNA, 22 bp, Homo sapiens
tgggccaggtgcagtgctttag

SEQ ID NO: 7223911 - DNA, 23 bp, Homo sapiens
tgggccagggagtccggtttctt

SEQ ID NO: 7223912 - DNA, 23 bp, Homo sapiens
tgggccagggagtccggtttctt

SEQ ID NO: 7223913 - DNA, 22 bp, Homo sapiens
tgggccagggcacccagtccag

SEQ ID NO: 7223914 - DNA, 22 bp, Homo sapiens
tgggccaggcatgtgatcagca

SEQ ID NO: 7223915 - DNA, 22 bp, Homo sapiens
tgggccaggcatgtgatcagca

SEQ ID NO: 7223916 - DNA, 22 bp, Homo sapiens
tgggccaggggcctcttctgat

SEQ ID NO: 7223917 - DNA, 22 bp, Homo sapiens
tgggccaggggcctcttctgat

SEQ ID NO: 7223918 - DNA, 22 bp, Homo sapiens
tgggccaggggcctcttctgat

SEQ ID NO: 7223919 - DNA, 22 bp, Homo sapiens
tgggccaggggcctcttctgat

SEQ ID NO: 7223920 - DNA, 22 bp, Homo sapiens
tgggccaggtctgtgtcagctg

SEQ ID NO: 7223921 - DNA, 22 bp, Homo sapiens
tgggccaggtctgtgtcagctg

SEQ ID NO: 7223922 - DNA, 22 bp, Homo sapiens
tgggcctcatcttcaatgagtc

SEQ ID NO: 7223923 - DNA, 22 bp, Homo sapiens
tgggcctcagtttccttaggat

SEQ ID NO: 7223924 - DNA, 22 bp, Homo sapiens
tgggcctcatgcccagccaccc

SEQ ID NO: 7223925 - DNA, 22 bp, Homo sapiens
tgggcctcctgccctggcctag

SEQ ID NO: 7223926 - DNA, 22 bp, Homo sapiens
tgggcctcctggaagaatgtgg

SEQ ID NO: 7223927 - DNA, 22 bp, Homo sapiens
tgggcctcctttccattcagag

SEQ ID NO: 7223928 - DNA, 22 bp, Homo sapiens
tgggcctcccatgtcttaggga

SEQ ID NO: 7223929 - DNA, 22 bp, Homo sapiens
tgggccagtttctcattgaaat

SEQ ID NO: 7223930 - DNA, 22 bp, Homo sapiens
tgggccagttggtgactacaaa

SEQ ID NO: 7223931 - DNA, 22 bp, Homo sapiens
tgggccagttggaatggatact

SEQ ID NO: 7223932 - DNA, 22 bp, Homo sapiens
tgggccagttctttactcgtcc

SEQ ID NO: 7223933 - DNA, 22 bp, Homo sapiens
tgggccagtcctgcctaaggtg

SEQ ID NO: 7223934 - DNA, 22 bp, Homo sapiens
tgggccagtcctgcctaaggtg

SEQ ID NO: 7223935 - DNA, 22 bp, Homo sapiens
tgggccagtcctgcctaaggtg

SEQ ID NO: 7223936 - DNA, 22 bp, Homo sapiens
tgggccagtccagccccaggga

SEQ ID NO: 7223937 - DNA, 22 bp, Homo sapiens
tgggccagtcctgcctaaggtg

SEQ ID NO: 7223938 - DNA, 22 bp, Homo sapiens
tgggccagttatttcacctctg

SEQ ID NO: 7223939 - DNA, 22 bp, Homo sapiens
tgggccagttatttcacctctg

SEQ ID NO: 7223940 - DNA, 23 bp, Homo sapiens
tgggccagttctgttgaaagcca

SEQ ID NO: 7223941 - DNA, 23 bp, Homo sapiens
tgggccagttctgttgaaagcca

SEQ ID NO: 7223942 - DNA, 22 bp, Homo sapiens
tgggccagttctttactcgtcc

SEQ ID NO: 7223943 - DNA, 22 bp, Homo sapiens
tgggcctcctttccattcagag

SEQ ID NO: 7223944 - DNA, 22 bp, Homo sapiens
tgggcctcggggaagcccgtgt

SEQ ID NO: 7223945 - DNA, 22 bp, Homo sapiens
tgggcctctgccacgctccccc

SEQ ID NO: 7223946 - DNA, 22 bp, Homo sapiens
tgggcctctgggttagtcccta

SEQ ID NO: 7223947 - DNA, 20 bp, Homo sapiens
tgggcctctggtgcctctgg

SEQ ID NO: 7223948 - DNA, 22 bp, Homo sapiens
tgggcctctgtttcctcatctg

SEQ ID NO: 7223949 - DNA, 22 bp, Homo sapiens
tgggcctgaaggagctgcgccc

SEQ ID NO: 7223950 - DNA, 22 bp, Homo sapiens
tgggcctgaaggagctgcgccc

SEQ ID NO: 7223951 - DNA, 22 bp, Homo sapiens
tgggcctgaaggagctgcgccc

SEQ ID NO: 7223952 - DNA, 22 bp, Homo sapiens
tgggcctgaaggagctgcgccc

SEQ ID NO: 7223953 - DNA, 22 bp, Homo sapiens
tgggcctgactcacctgcctcc

SEQ ID NO: 7223954 - DNA, 22 bp, Homo sapiens
tgggcctgacacttactaggga

SEQ ID NO: 7223955 - DNA, 22 bp, Homo sapiens
tgggcctgacacttactaggga

SEQ ID NO: 7223956 - DNA, 22 bp, Homo sapiens
tgggcctgacacttactaggga

SEQ ID NO: 7223957 - DNA, 22 bp, Homo sapiens
tgggcctgaaggagctgcgccc

SEQ ID NO: 7223958 - DNA, 22 bp, Homo sapiens
tgggcctgactcacctgcctcc

SEQ ID NO: 7223959 - DNA, 20 bp, Homo sapiens
tgggcctgagcctgtgggct

SEQ ID NO: 7223960 - DNA, 20 bp, Homo sapiens
tgggcctgagcctgtgggct

SEQ ID NO: 7223961 - DNA, 22 bp, Homo sapiens
tgggcctgagctcaccaggggc

SEQ ID NO: 7223962 - DNA, 22 bp, Homo sapiens
tgggcctgagctcaccaggggc

SEQ ID NO: 7223963 - DNA, 22 bp, Homo sapiens
tgggcctgagctcaccaggggc

SEQ ID NO: 7223964 - DNA, 20 bp, Homo sapiens
tgggcctgagcctgtgggct

SEQ ID NO: 7223965 - DNA, 22 bp, Homo sapiens
tgggcctgagctcaccaggggc

SEQ ID NO: 7223966 - DNA, 22 bp, Homo sapiens
tgggcctgagctcaccaggggc

SEQ ID NO: 7223967 - DNA, 22 bp, Homo sapiens
tgggcctgagctcaccaggggc

SEQ ID NO: 7223968 - DNA, 22 bp, Homo sapiens
tgggcctgagctcaccaggggc

SEQ ID NO: 7223969 - DNA, 22 bp, Homo sapiens
tgggcctgagtttgggaactgg

SEQ ID NO: 7223970 - DNA, 22 bp, Homo sapiens
tgggcctgagtttgggaactgg

SEQ ID NO: 7223971 - DNA, 22 bp, Homo sapiens
tgggcctgagtttgggaactgg

SEQ ID NO: 7223972 - DNA, 21 bp, Homo sapiens
tgggcctgattcccagggtca

SEQ ID NO: 7223973 - DNA, 21 bp, Homo sapiens
tgggcctgattcccagggtca

SEQ ID NO: 7223974 - DNA, 21 bp, Homo sapiens
tgggcctgattcccagggtca

SEQ ID NO: 7223975 - DNA, 21 bp, Homo sapiens
tgggcctgattcccagggtca

SEQ ID NO: 7223976 - DNA, 22 bp, Homo sapiens
tgggcctgggctggacagcctg

SEQ ID NO: 7223977 - DNA, 22 bp, Homo sapiens
tgggcctggggcagcccaaatc

SEQ ID NO: 7223978 - DNA, 22 bp, Homo sapiens
tgggcctggggcagcccaaatc

SEQ ID NO: 7223979 - DNA, 22 bp, Homo sapiens
tgggcctgggtctttgctgcca

SEQ ID NO: 7223980 - DNA, 22 bp, Homo sapiens
tgggcctgggtctttgctgcca

SEQ ID NO: 7223981 - DNA, 22 bp, Homo sapiens
tgggcctgggctcctgtcctct

SEQ ID NO: 7223982 - DNA, 22 bp, Homo sapiens
tgggcctgggctggacagcctg

SEQ ID NO: 7223983 - DNA, 22 bp, Homo sapiens
tgggcctgggctggacagcctg

SEQ ID NO: 7223984 - DNA, 22 bp, Homo sapiens
tgggcctgggctggacagcctg

SEQ ID NO: 7223985 - DNA, 22 bp, Homo sapiens
tgggcctgggctggacagcctg

SEQ ID NO: 7223986 - DNA, 23 bp, Homo sapiens
tgggcctggaaagccttagagag

SEQ ID NO: 7223987 - DNA, 23 bp, Homo sapiens
tgggcctggaaagccttagagag

SEQ ID NO: 7223988 - DNA, 23 bp, Homo sapiens
tgggcctggaaagccttagagag

SEQ ID NO: 7223989 - DNA, 22 bp, Homo sapiens
tgggcctgggctcctgtcctct

SEQ ID NO: 7223990 - DNA, 23 bp, Homo sapiens
tgggcctggaaagccttagagag

SEQ ID NO: 7223991 - DNA, 22 bp, Homo sapiens
tgggcctggacaaggccactag

SEQ ID NO: 7223992 - DNA, 22 bp, Homo sapiens
tgggcctggacaaggccactag

SEQ ID NO: 7223993 - DNA, 22 bp, Homo sapiens
tgggcctgggagggcagacgct

SEQ ID NO: 7223994 - DNA, 22 bp, Homo sapiens
tgggcctgggctcctgtcctct

SEQ ID NO: 7223995 - DNA, 22 bp, Homo sapiens
tgggcctgccccaggcttcagc

SEQ ID NO: 7223996 - DNA, 19 bp, Homo sapiens
tgggcctgcatctgggtct

SEQ ID NO: 7223997 - DNA, 19 bp, Homo sapiens
tgggcctgcatctgggtct

SEQ ID NO: 7223998 - DNA, 19 bp, Homo sapiens
tgggcctgcatctgggtct

SEQ ID NO: 7223999 - DNA, 22 bp, Homo sapiens
tgggcctgccccaggcttcagc

SEQ ID NO: 7224000 - DNA, 22 bp, Homo sapiens
tgggcctgccccaggcttcagc

SEQ ID NO: 7224001 - DNA, 18 bp, Homo sapiens
tgggcctgcatcctagtc

SEQ ID NO: 7224002 - DNA, 22 bp, Homo sapiens
tgggcctgattcttgaatcctg

SEQ ID NO: 7224003 - DNA, 22 bp, Homo sapiens
tgggcctgatttatcatcttca

SEQ ID NO: 7224004 - DNA, 18 bp, Homo sapiens
tgggcctgcatcctagtc

SEQ ID NO: 7224005 - DNA, 21 bp, Homo sapiens
tgggcctgattcccagggtca

SEQ ID NO: 7224006 - DNA, 22 bp, Homo sapiens
tgggcctgattcttgaatcctg

SEQ ID NO: 7224007 - DNA, 21 bp, Homo sapiens
tgggcctgattcccagggtca

SEQ ID NO: 7224008 - DNA, 22 bp, Homo sapiens
tggctcattctttagaatatac

SEQ ID NO: 7224009 - DNA, 21 bp, Homo sapiens
tggctcagttgctgggcacag

SEQ ID NO: 7224010 - DNA, 21 bp, Homo sapiens
tggctcagttgctgggcacag

SEQ ID NO: 7224011 - DNA, 22 bp, Homo sapiens
tggctcatggaattagctatta

SEQ ID NO: 7224012 - DNA, 22 bp, Homo sapiens
tggctcattctactctccctgg

SEQ ID NO: 7224013 - DNA, 22 bp, Homo sapiens
tggctccaaatcaactgctgtt

SEQ ID NO: 7224014 - DNA, 22 bp, Homo sapiens
tggctccaaatcaactgctgtt

SEQ ID NO: 7224015 - DNA, 22 bp, Homo sapiens
tggctccacaggccagggtgtg

SEQ ID NO: 7224016 - DNA, 22 bp, Homo sapiens
tggctccaccgccgcggagctc

SEQ ID NO: 7224017 - DNA, 22 bp, Homo sapiens
tggctccaccgccgcggagctc

SEQ ID NO: 7224018 - DNA, 22 bp, Homo sapiens
tggctcagtggcagccgcagct

SEQ ID NO: 7224019 - DNA, 22 bp, Homo sapiens
tggctcagtggcagccgcagct

SEQ ID NO: 7224020 - DNA, 22 bp, Homo sapiens
tggctcagttaggtcagaaaca

SEQ ID NO: 7224021 - DNA, 22 bp, Homo sapiens
tggctcagttaggtcagaaaca

SEQ ID NO: 7224022 - DNA, 22 bp, Homo sapiens
tggctcagttaggtcagaaaca

SEQ ID NO: 7224023 - DNA, 22 bp, Homo sapiens
tggctcagttaggtcagaaaca

SEQ ID NO: 7224024 - DNA, 22 bp, Homo sapiens
tggctcagttccatcatctgga

SEQ ID NO: 7224025 - DNA, 22 bp, Homo sapiens
tggctcagttccatcatctgga

SEQ ID NO: 7224026 - DNA, 22 bp, Homo sapiens
tggctcagttccatcatctgga

SEQ ID NO: 7224027 - DNA, 22 bp, Homo sapiens
tggctcagttccatcatctgga

SEQ ID NO: 7224028 - DNA, 21 bp, Homo sapiens
tggctcagttgctgggcacag

SEQ ID NO: 7224029 - DNA, 21 bp, Homo sapiens
tggctcagttgctgggcacag

SEQ ID NO: 7224030 - DNA, 22 bp, Homo sapiens
tggctcagttccatcatctgga

SEQ ID NO: 7224031 - DNA, 21 bp, Homo sapiens
tggctcagttgctgggcacag

SEQ ID NO: 7224032 - DNA, 22 bp, Homo sapiens
tggctccaccgccgcggagctc

SEQ ID NO: 7224033 - DNA, 22 bp, Homo sapiens
tggctccactctccaggagttt

SEQ ID NO: 7224034 - DNA, 22 bp, Homo sapiens
tggctccactctccaggagttt

SEQ ID NO: 7224035 - DNA, 22 bp, Homo sapiens
tggctccagatctgtctcctgt

SEQ ID NO: 7224036 - DNA, 22 bp, Homo sapiens
tggctccagatttcctgctgca

SEQ ID NO: 7224037 - DNA, 22 bp, Homo sapiens
tggctccagatttcctgctgca

SEQ ID NO: 7224038 - DNA, 22 bp, Homo sapiens
tggctccagatttcctgctgca

SEQ ID NO: 7224039 - DNA, 22 bp, Homo sapiens
tggctccagccctgagcaagct

SEQ ID NO: 7224040 - DNA, 22 bp, Homo sapiens
tggctccagccctgagcaagct

SEQ ID NO: 7224041 - DNA, 22 bp, Homo sapiens
tggctccagccctgagcaagct

SEQ ID NO: 7224042 - DNA, 22 bp, Homo sapiens
tggctccagcgtccacgtcctg

SEQ ID NO: 7224043 - DNA, 22 bp, Homo sapiens
tggctccagcgtccacgtcctg

SEQ ID NO: 7224044 - DNA, 23 bp, Homo sapiens
tggctccaggagaagccagaagc

SEQ ID NO: 7224045 - DNA, 23 bp, Homo sapiens
tggctccaggagaagccagaagc

SEQ ID NO: 7224046 - DNA, 23 bp, Homo sapiens
tggctccaggagaagccagaagc

SEQ ID NO: 7224047 - DNA, 23 bp, Homo sapiens
tggctccaggagaagccagaagc

SEQ ID NO: 7224048 - DNA, 23 bp, Homo sapiens
tggctccaggagaagccagaagc

SEQ ID NO: 7224049 - DNA, 18 bp, Homo sapiens
tggctcctgcctcctgca

SEQ ID NO: 7224050 - DNA, 18 bp, Homo sapiens
tggctcctgcctcctgca

SEQ ID NO: 7224051 - DNA, 22 bp, Homo sapiens
tggctcctgcagaccatctgga

SEQ ID NO: 7224052 - DNA, 22 bp, Homo sapiens
tggctcctgcatttgtgctaac

SEQ ID NO: 7224053 - DNA, 18 bp, Homo sapiens
tggctcctgcctcctgca

SEQ ID NO: 7224054 - DNA, 18 bp, Homo sapiens
tggctcctgcctcctgca

SEQ ID NO: 7224055 - DNA, 19 bp, Homo sapiens
tggctcctgcctgccttct

SEQ ID NO: 7224056 - DNA, 19 bp, Homo sapiens
tggctcctgcctgccttct

SEQ ID NO: 7224057 - DNA, 19 bp, Homo sapiens
tggctcctgcctgccttct

SEQ ID NO: 7224058 - DNA, 22 bp, Homo sapiens
tggctcctccctgtgtgtgcgt

SEQ ID NO: 7224059 - DNA, 20 bp, Homo sapiens
tggctcctcttggctgtggc

SEQ ID NO: 7224060 - DNA, 20 bp, Homo sapiens
tggctcctcttggctgtggc

SEQ ID NO: 7224061 - DNA, 22 bp, Homo sapiens
tggctcctgcagaccatctgga

SEQ ID NO: 7224062 - DNA, 22 bp, Homo sapiens
tggctccaggggacacgcagta

SEQ ID NO: 7224063 - DNA, 22 bp, Homo sapiens
tggctccaggggacacgcagta

SEQ ID NO: 7224064 - DNA, 22 bp, Homo sapiens
tggctccatcatccatgcaaga

SEQ ID NO: 7224065 - DNA, 22 bp, Homo sapiens
tggctccatcatccatgcaaga

SEQ ID NO: 7224066 - DNA, 22 bp, Homo sapiens
tggctccatgatagttcttaca

SEQ ID NO: 7224067 - DNA, 22 bp, Homo sapiens
tggctccattctttatgagttg

SEQ ID NO: 7224068 - DNA, 22 bp, Homo sapiens
tggctcccaaggagctcctgcc

SEQ ID NO: 7224069 - DNA, 22 bp, Homo sapiens
tggctcccaaggagctcctgcc

SEQ ID NO: 7224070 - DNA, 22 bp, Homo sapiens
tggctcccaaggagctcctgcc

SEQ ID NO: 7224071 - DNA, 22 bp, Homo sapiens
tggctcccaaggagctcctgcc

SEQ ID NO: 7224072 - DNA, 22 bp, Homo sapiens
tggctcccacaaactcactact

SEQ ID NO: 7224073 - DNA, 22 bp, Homo sapiens
tggctcccacaaactcactact

SEQ ID NO: 7224074 - DNA, 22 bp, Homo sapiens
tggctcccgcttgcacctaaga

SEQ ID NO: 7224075 - DNA, 22 bp, Homo sapiens
tggctcccgcttgcacctaaga

SEQ ID NO: 7224076 - DNA, 22 bp, Homo sapiens
tggctccgttgtacaggctgga

SEQ ID NO: 7224077 - DNA, 22 bp, Homo sapiens
tggctcctaatcggcttctttc

SEQ ID NO: 7224078 - DNA, 22 bp, Homo sapiens
tggctcctaggatggtgcctgg

SEQ ID NO: 7224079 - DNA, 22 bp, Homo sapiens
tggctcctaggatggtgcctgg

SEQ ID NO: 7224080 - DNA, 22 bp, Homo sapiens
tggctcctaggatggtgcctgg

SEQ ID NO: 7224081 - DNA, 22 bp, Homo sapiens
tggctcctatcaaggagtgggt

SEQ ID NO: 7224082 - DNA, 22 bp, Homo sapiens
tggctcagtgaagagataactt

SEQ ID NO: 7224083 - DNA, 22 bp, Homo sapiens
tggctcagtctgggttgactga

SEQ ID NO: 7224084 - DNA, 22 bp, Homo sapiens
tggctcagtgaagagataactt

SEQ ID NO: 7224085 - DNA, 22 bp, Homo sapiens
tggctcagtgaagagataactt

SEQ ID NO: 7224086 - DNA, 22 bp, Homo sapiens
tggctcagtgaagagataactt

SEQ ID NO: 7224087 - DNA, 22 bp, Homo sapiens
tggctcagtgaagagataactt

SEQ ID NO: 7224088 - DNA, 22 bp, Homo sapiens
tggctcagtgaagagataactt

SEQ ID NO: 7224089 - DNA, 22 bp, Homo sapiens
tggctcagtcatggatgagtaa

SEQ ID NO: 7224090 - DNA, 22 bp, Homo sapiens
tggctcagtcatggatgagtaa

SEQ ID NO: 7224091 - DNA, 22 bp, Homo sapiens
tggctcagtcatggatgagtaa

SEQ ID NO: 7224092 - DNA, 22 bp, Homo sapiens
tggctcagtcatggatgagtaa

SEQ ID NO: 7224093 - DNA, 22 bp, Homo sapiens
tggctcagtcatggatgagtaa

SEQ ID NO: 7224094 - DNA, 22 bp, Homo sapiens
tggctcagtctgggttgactga

SEQ ID NO: 7224095 - DNA, 22 bp, Homo sapiens
tggctcagtctgggttgactga

SEQ ID NO: 7224096 - DNA, 22 bp, Homo sapiens
tggctcagtgacattcctccca

SEQ ID NO: 7224097 - DNA, 22 bp, Homo sapiens
tggctcagtgacattcctccca

SEQ ID NO: 7224098 - DNA, 22 bp, Homo sapiens
tggctcagtgacattcctccca

SEQ ID NO: 7224099 - DNA, 22 bp, Homo sapiens
tggctcagtgcattcacagtaa

SEQ ID NO: 7224100 - DNA, 22 bp, Homo sapiens
tggctcagtgcattcacagtaa

SEQ ID NO: 7224101 - DNA, 22 bp, Homo sapiens
tggctcagtgcattcacagtaa

SEQ ID NO: 7224102 - DNA, 22 bp, Homo sapiens
tggctcagtgcattcacagtaa

SEQ ID NO: 7224103 - DNA, 22 bp, Homo sapiens
tggctcagtggcagccgcagct

SEQ ID NO: 7224104 - DNA, 22 bp, Homo sapiens
tggctcagtggcagccgcagct

SEQ ID NO: 7224105 - DNA, 22 bp, Homo sapiens
tggctcagtggcagccgcagct

SEQ ID NO: 7224106 - DNA, 22 bp, Homo sapiens
tggctcaggggtctggctctgt

SEQ ID NO: 7224107 - DNA, 22 bp, Homo sapiens
tggctcaggggtctggctctgt

SEQ ID NO: 7224108 - DNA, 22 bp, Homo sapiens
tggctcaggggtctggctctgt

SEQ ID NO: 7224109 - DNA, 22 bp, Homo sapiens
tggctcaggggtctggctctgt

SEQ ID NO: 7224110 - DNA, 22 bp, Homo sapiens
tggctcagggtccccaaatggt

SEQ ID NO: 7224111 - DNA, 22 bp, Homo sapiens
tggctcagggtccccaaatggt

SEQ ID NO: 7224112 - DNA, 22 bp, Homo sapiens
tggctcagggtccccaaatggt

SEQ ID NO: 7224113 - DNA, 23 bp, Homo sapiens
tggctcagggtctcttatgaagt

SEQ ID NO: 7224114 - DNA, 23 bp, Homo sapiens
tggctcagggtctcttatgaagt

SEQ ID NO: 7224115 - DNA, 23 bp, Homo sapiens
tggctcagggtctcttatgaagt

SEQ ID NO: 7224116 - DNA, 23 bp, Homo sapiens
tggctcagggtctcttatgaagt

SEQ ID NO: 7224117 - DNA, 23 bp, Homo sapiens
tggctcagggtctcttatgaagt

SEQ ID NO: 7224118 - DNA, 22 bp, Homo sapiens
tggctcaggtgtgagctgaaga

SEQ ID NO: 7224119 - DNA, 22 bp, Homo sapiens
tggctcaggtgtgagctgaaga

SEQ ID NO: 7224120 - DNA, 22 bp, Homo sapiens
tggctcaggtgtgagctgaaga

SEQ ID NO: 7224121 - DNA, 22 bp, Homo sapiens
tggctcaggtgtgagctgaaga

SEQ ID NO: 7224122 - DNA, 22 bp, Homo sapiens
tggctcaggtgtgagctgaaga

SEQ ID NO: 7224123 - DNA, 22 bp, Homo sapiens
tggctcaggtgtgagctgaaga

SEQ ID NO: 7224124 - DNA, 22 bp, Homo sapiens
tggctcagtaatcgagtctcct

SEQ ID NO: 7224125 - DNA, 22 bp, Homo sapiens
tggctcagtaatcgagtctcct

SEQ ID NO: 7224126 - DNA, 22 bp, Homo sapiens
tggctcagtaatcgagtctcct

SEQ ID NO: 7224127 - DNA, 22 bp, Homo sapiens
tggctcagtaatcgagtctcct

SEQ ID NO: 7224128 - DNA, 22 bp, Homo sapiens
tggctcagtagcagtgtggtca

SEQ ID NO: 7224129 - DNA, 22 bp, Homo sapiens
tggctcagtagcagtgtggtca

SEQ ID NO: 7224130 - DNA, 22 bp, Homo sapiens
tggctcagtagcagtgtggtca

SEQ ID NO: 7224131 - DNA, 22 bp, Homo sapiens
tggctcagtagcagtgtggtca

SEQ ID NO: 7224132 - DNA, 22 bp, Homo sapiens
tggctcagtagcagtgtggtca

SEQ ID NO: 7224133 - DNA, 22 bp, Homo sapiens
tggctcagtagcagtgtggtca

SEQ ID NO: 7224134 - DNA, 22 bp, Homo sapiens
tggctcagatttttgtaggctt

SEQ ID NO: 7224135 - DNA, 22 bp, Homo sapiens
tggctcagcaagacattgacct

SEQ ID NO: 7224136 - DNA, 22 bp, Homo sapiens
tggctcagcaagacattgacct

SEQ ID NO: 7224137 - DNA, 22 bp, Homo sapiens
tggctcagcaagacattgacct

SEQ ID NO: 7224138 - DNA, 22 bp, Homo sapiens
tggctcagcaagacattgacct

SEQ ID NO: 7224139 - DNA, 22 bp, Homo sapiens
tggctcagcaagacattgacct

SEQ ID NO: 7224140 - DNA, 22 bp, Homo sapiens
tggctcagcaagacattgacct

SEQ ID NO: 7224141 - DNA, 22 bp, Homo sapiens
tggctcagcaggttagaaacta

SEQ ID NO: 7224142 - DNA, 22 bp, Homo sapiens
tggctcagcaggttagaaacta

SEQ ID NO: 7224143 - DNA, 22 bp, Homo sapiens
tggctcagcaggttagaaacta

SEQ ID NO: 7224144 - DNA, 22 bp, Homo sapiens
tggctcagcattcactggtctt

SEQ ID NO: 7224145 - DNA, 22 bp, Homo sapiens
tggctcagcattcactggtctt

SEQ ID NO: 7224146 - DNA, 22 bp, Homo sapiens
tggctcagcattcactggtctt

SEQ ID NO: 7224147 - DNA, 22 bp, Homo sapiens
tggctcagcattcactggtctt

SEQ ID NO: 7224148 - DNA, 22 bp, Homo sapiens
tggctcagccagccctaggaac

SEQ ID NO: 7224149 - DNA, 22 bp, Homo sapiens
tggctcagccagccctaggaac

SEQ ID NO: 7224150 - DNA, 22 bp, Homo sapiens
tggctcagccagccctaggaac

SEQ ID NO: 7224151 - DNA, 22 bp, Homo sapiens
tggctcagccagccctaggaac

SEQ ID NO: 7224152 - DNA, 22 bp, Homo sapiens
tggctcagccagccctaggaac

SEQ ID NO: 7224153 - DNA, 22 bp, Homo sapiens
tggctcagccagccctaggaac

SEQ ID NO: 7224154 - DNA, 22 bp, Homo sapiens
tggctcagcttacttttgaggg

SEQ ID NO: 7224155 - DNA, 22 bp, Homo sapiens
tggctcagcttacttttgaggg

SEQ ID NO: 7224156 - DNA, 22 bp, Homo sapiens
tggctcagcttacttttgaggg

SEQ ID NO: 7224157 - DNA, 22 bp, Homo sapiens
tggctcagcttacttttgaggg

SEQ ID NO: 7224158 - DNA, 22 bp, Homo sapiens
tggctcagcttacttttgaggg

SEQ ID NO: 7224159 - DNA, 22 bp, Homo sapiens
tggctcagctttccccatctgg

SEQ ID NO: 7224160 - DNA, 22 bp, Homo sapiens
tggctcagctttccccatctgg

SEQ ID NO: 7224161 - DNA, 22 bp, Homo sapiens
tggctcagctttccccatctgg

SEQ ID NO: 7224162 - DNA, 22 bp, Homo sapiens
tggctcagctttccccatctgg

SEQ ID NO: 7224163 - DNA, 22 bp, Homo sapiens
tggctcaggagggatctttgct

SEQ ID NO: 7224164 - DNA, 22 bp, Homo sapiens
tggctcaggagggatctttgct

SEQ ID NO: 7224165 - DNA, 22 bp, Homo sapiens
tggctcaggagggatctttgct

SEQ ID NO: 7224166 - DNA, 22 bp, Homo sapiens
tggctcaggagggatctttgct

SEQ ID NO: 7224167 - DNA, 22 bp, Homo sapiens
tggctcaggagggatctttgct

SEQ ID NO: 7224168 - DNA, 22 bp, Homo sapiens
tggctcaggataattttcccaa

SEQ ID NO: 7224169 - DNA, 22 bp, Homo sapiens
tggctcaggataattttcccaa

SEQ ID NO: 7224170 - DNA, 22 bp, Homo sapiens
tggctcaggataattttcccaa

SEQ ID NO: 7224171 - DNA, 22 bp, Homo sapiens
tggctcaggatctaagcagaat

SEQ ID NO: 7224172 - DNA, 22 bp, Homo sapiens
tggctcaggatctaagcagaat

SEQ ID NO: 7224173 - DNA, 22 bp, Homo sapiens
tggctcaggatctaagcagaat

SEQ ID NO: 7224174 - DNA, 22 bp, Homo sapiens
tggctcaggatctaagcagaat

SEQ ID NO: 7224175 - DNA, 22 bp, Homo sapiens
tggctcaggatctaagcagaat

SEQ ID NO: 7224176 - DNA, 22 bp, Homo sapiens
tggctcaggatctaagcagaat

SEQ ID NO: 7224177 - DNA, 22 bp, Homo sapiens
tggctcaggatctaagcagaat

SEQ ID NO: 7224178 - DNA, 22 bp, Homo sapiens
tggctcaggatctaagcagaat

SEQ ID NO: 7224179 - DNA, 22 bp, Homo sapiens
tggctcaggccacttcttttat

SEQ ID NO: 7224180 - DNA, 22 bp, Homo sapiens
tggctcaggccacttcttttat

SEQ ID NO: 7224181 - DNA, 22 bp, Homo sapiens
tggctcaggccacttcttttat

SEQ ID NO: 7224182 - DNA, 22 bp, Homo sapiens
tggctcaggcctacgacgcctt

SEQ ID NO: 7224183 - DNA, 22 bp, Homo sapiens
tggctcaggcctacgacgcctt

SEQ ID NO: 7224184 - DNA, 22 bp, Homo sapiens
tggctcaggcctacgacgcctt

SEQ ID NO: 7224185 - DNA, 22 bp, Homo sapiens
tggctcaggcctacgacgcctt

SEQ ID NO: 7224186 - DNA, 22 bp, Homo sapiens
tggctcaggcctacgacgcctt

SEQ ID NO: 7224187 - DNA, 22 bp, Homo sapiens
tggctcaggcttgaaaatagat

SEQ ID NO: 7224188 - DNA, 22 bp, Homo sapiens
tggctcaggcttgaaaatagat

SEQ ID NO: 7224189 - DNA, 22 bp, Homo sapiens
tggctcaggcttgaaaatagat

SEQ ID NO: 7224190 - DNA, 22 bp, Homo sapiens
tggctcaggcttgaaaatagat

SEQ ID NO: 7224191 - DNA, 22 bp, Homo sapiens
tggccttgaaccaggtctccac

SEQ ID NO: 7224192 - DNA, 22 bp, Homo sapiens
tggccttgaaccaggtctccac

SEQ ID NO: 7224193 - DNA, 22 bp, Homo sapiens
tggccttgaactcatcacgtgg

SEQ ID NO: 7224194 - DNA, 22 bp, Homo sapiens
tggcctgtcttgttgtgctaga

SEQ ID NO: 7224195 - DNA, 22 bp, Homo sapiens
tggcctgtggatcccagctctg

SEQ ID NO: 7224196 - DNA, 18 bp, Homo sapiens
tggccttgaatcatatca

SEQ ID NO: 7224197 - DNA, 22 bp, Homo sapiens
tggccttgagaatgtccctagg

SEQ ID NO: 7224198 - DNA, 22 bp, Homo sapiens
tggccttgagaatgtccctagg

SEQ ID NO: 7224199 - DNA, 22 bp, Homo sapiens
tggccttgagagatcaaaaggt

SEQ ID NO: 7224200 - DNA, 21 bp, Homo sapiens
tggccttgagagtctccttgc

SEQ ID NO: 7224201 - DNA, 22 bp, Homo sapiens
tggccttgagatgcagcagcca

SEQ ID NO: 7224202 - DNA, 22 bp, Homo sapiens
tggccttgagatgcagcagcca

SEQ ID NO: 7224203 - DNA, 22 bp, Homo sapiens
tggccttgagatgcagcagcca

SEQ ID NO: 7224204 - DNA, 22 bp, Homo sapiens
tggccttgagatgcagcagcca

SEQ ID NO: 7224205 - DNA, 22 bp, Homo sapiens
tggccttgagatgcagcagcca

SEQ ID NO: 7224206 - DNA, 22 bp, Homo sapiens
tggccttgagtggtctccgccc

SEQ ID NO: 7224207 - DNA, 22 bp, Homo sapiens
tggccttgagtggtctccgccc

SEQ ID NO: 7224208 - DNA, 22 bp, Homo sapiens
tggccttgataactggggagag

SEQ ID NO: 7224209 - DNA, 22 bp, Homo sapiens
tggccttgattatgccagtaga

SEQ ID NO: 7224210 - DNA, 22 bp, Homo sapiens
tggccttgccacatttgtcagc

SEQ ID NO: 7224211 - DNA, 22 bp, Homo sapiens
tggccttgccacatttgtcagc

SEQ ID NO: 7224212 - DNA, 22 bp, Homo sapiens
tggccttgcccagcgcctaggt

SEQ ID NO: 7224213 - DNA, 22 bp, Homo sapiens
tggccttggacagagcgctcct

SEQ ID NO: 7224214 - DNA, 22 bp, Homo sapiens
tggccttggacagagcgctcct

SEQ ID NO: 7224215 - DNA, 22 bp, Homo sapiens
tggccttggagaggcacggccc

SEQ ID NO: 7224216 - DNA, 22 bp, Homo sapiens
tggccttggagaggcacggccc

SEQ ID NO: 7224217 - DNA, 22 bp, Homo sapiens
tggccttggcagtgagaagagt

SEQ ID NO: 7224218 - DNA, 22 bp, Homo sapiens
tggccttggcagtgagaagagt

SEQ ID NO: 7224219 - DNA, 22 bp, Homo sapiens
tggcgaggtttcagagagcggc

SEQ ID NO: 7224220 - DNA, 22 bp, Homo sapiens
tggcgcagtttctctgctgcct

SEQ ID NO: 7224221 - DNA, 22 bp, Homo sapiens
tggcgaggccaggccagggcct

SEQ ID NO: 7224222 - DNA, 22 bp, Homo sapiens
tggccttgttctctctcccatc

SEQ ID NO: 7224223 - DNA, 22 bp, Homo sapiens
tggccttgttctctctcccatc

SEQ ID NO: 7224224 - DNA, 22 bp, Homo sapiens
tggccttgttctctctcccatc

SEQ ID NO: 7224225 - DNA, 22 bp, Homo sapiens
tggcctttgttgatagctatgc

SEQ ID NO: 7224226 - DNA, 22 bp, Homo sapiens
tggccttttctttcacaggcaa

SEQ ID NO: 7224227 - DNA, 22 bp, Homo sapiens
tggccttggccgtgctggggtc

SEQ ID NO: 7224228 - DNA, 22 bp, Homo sapiens
tggccttggccttttctgctcc

SEQ ID NO: 7224229 - DNA, 22 bp, Homo sapiens
tggccttggccttttctgctcc

SEQ ID NO: 7224230 - DNA, 22 bp, Homo sapiens
tggccttggctgagagatttaa

SEQ ID NO: 7224231 - DNA, 22 bp, Homo sapiens
tggccttgggcaggtggcctgc

SEQ ID NO: 7224232 - DNA, 22 bp, Homo sapiens
tggccttgggcaggtggcctgc

SEQ ID NO: 7224233 - DNA, 20 bp, Homo sapiens
tggccttggggagctcacac

SEQ ID NO: 7224234 - DNA, 20 bp, Homo sapiens
tggccttggggagctcacac

SEQ ID NO: 7224235 - DNA, 20 bp, Homo sapiens
tggccttggggagctcacac

SEQ ID NO: 7224236 - DNA, 22 bp, Homo sapiens
tggccttgggtccttagcatca

SEQ ID NO: 7224237 - DNA, 22 bp, Homo sapiens
tggccttgggtccttagcatca

SEQ ID NO: 7224238 - DNA, 22 bp, Homo sapiens
tggccttggtcacaatgcaaac

SEQ ID NO: 7224239 - DNA, 22 bp, Homo sapiens
tggccttggtcctctttgcaat

SEQ ID NO: 7224240 - DNA, 22 bp, Homo sapiens
tggccttggtcctctttgcaat

SEQ ID NO: 7224241 - DNA, 22 bp, Homo sapiens
tggccttgtctctcagaaccgc

SEQ ID NO: 7224242 - DNA, 22 bp, Homo sapiens
tggccttgtctctcagaaccgc

SEQ ID NO: 7224243 - DNA, 15 bp, Homo sapiens
tggccttgtggttgt

SEQ ID NO: 7224244 - DNA, 22 bp, Homo sapiens
tggccttgtgtttaagcaagaa

SEQ ID NO: 7224245 - DNA, 22 bp, Homo sapiens
tggccttgtgttttagagaaag

SEQ ID NO: 7224246 - DNA, 22 bp, Homo sapiens
tggcctggctcacagtgagatt

SEQ ID NO: 7224247 - DNA, 22 bp, Homo sapiens
tggcctggctcacagtgagatt

SEQ ID NO: 7224248 - DNA, 22 bp, Homo sapiens
tggcctggctcacagtgagatt

SEQ ID NO: 7224249 - DNA, 22 bp, Homo sapiens
tggcctggccctgaggccctgt

SEQ ID NO: 7224250 - DNA, 22 bp, Homo sapiens
tggcctgggtcacaccagggtc

SEQ ID NO: 7224251 - DNA, 22 bp, Homo sapiens
tggcctgggtgctgctgacatc

SEQ ID NO: 7224252 - DNA, 22 bp, Homo sapiens
tggcctgggtgctgctgacatc

SEQ ID NO: 7224253 - DNA, 22 bp, Homo sapiens
tggcctgggtgctgctgacatc

SEQ ID NO: 7224254 - DNA, 22 bp, Homo sapiens
tggcctgggtgctgctgacatc

SEQ ID NO: 7224255 - DNA, 22 bp, Homo sapiens
tggcctggtccttgtcaaggca

SEQ ID NO: 7224256 - DNA, 22 bp, Homo sapiens
tggcctggtccttgtcaaggca

SEQ ID NO: 7224257 - DNA, 22 bp, Homo sapiens
tggcctggtccttgtcaaggca

SEQ ID NO: 7224258 - DNA, 22 bp, Homo sapiens
tggcctggtccttgtcaaggca

SEQ ID NO: 7224259 - DNA, 22 bp, Homo sapiens
tggcctggtccttgtcaaggca

SEQ ID NO: 7224260 - DNA, 22 bp, Homo sapiens
tggcctggtaccacatagattt

SEQ ID NO: 7224261 - DNA, 22 bp, Homo sapiens
tggcctggtaccacatagattt

SEQ ID NO: 7224262 - DNA, 22 bp, Homo sapiens
tggcctggttgttgctgccgtt

SEQ ID NO: 7224263 - DNA, 22 bp, Homo sapiens
tggcctggttgttgctgccgtt

SEQ ID NO: 7224264 - DNA, 22 bp, Homo sapiens
tggcctggttgttgctgccgtt

SEQ ID NO: 7224265 - DNA, 22 bp, Homo sapiens
tggcctgtcactgcccagggct

SEQ ID NO: 7224266 - DNA, 22 bp, Homo sapiens
tggcctggtgtctgcgaggcct

SEQ ID NO: 7224267 - DNA, 22 bp, Homo sapiens
tggcctggttatattgctatca

SEQ ID NO: 7224268 - DNA, 22 bp, Homo sapiens
tggcctggttgttgctgccgtt

SEQ ID NO: 7224269 - DNA, 22 bp, Homo sapiens
tggcctggtgctcaggcagtag

SEQ ID NO: 7224270 - DNA, 22 bp, Homo sapiens
tggcctggtgctcaggcagtag

SEQ ID NO: 7224271 - DNA, 22 bp, Homo sapiens
tggcctggtgtctgcgaggcct

SEQ ID NO: 7224272 - DNA, 22 bp, Homo sapiens
tggcctggtgtctgcgaggcct

SEQ ID NO: 7224273 - DNA, 22 bp, Homo sapiens
tggcctggtgctcaggcagtag

SEQ ID NO: 7224274 - DNA, 22 bp, Homo sapiens
tggcctggtgtctgcgaggcct

SEQ ID NO: 7224275 - DNA, 22 bp, Homo sapiens
tggcctggtgtctgcgaggcct

SEQ ID NO: 7224276 - DNA, 22 bp, Homo sapiens
tggctcagagttcatcttttag

SEQ ID NO: 7224277 - DNA, 22 bp, Homo sapiens
tggctcagagttcatcttttag

SEQ ID NO: 7224278 - DNA, 22 bp, Homo sapiens
tggctcagagttcatcttttag

SEQ ID NO: 7224279 - DNA, 22 bp, Homo sapiens
tggctcagaggggaagtggttt

SEQ ID NO: 7224280 - DNA, 22 bp, Homo sapiens
tggctcagaggggaagtggttt

SEQ ID NO: 7224281 - DNA, 22 bp, Homo sapiens
tggctcagaggggaagtggttt

SEQ ID NO: 7224282 - DNA, 22 bp, Homo sapiens
tggctcagataattcaaggggc

SEQ ID NO: 7224283 - DNA, 22 bp, Homo sapiens
tggctcagataattcaaggggc

SEQ ID NO: 7224284 - DNA, 22 bp, Homo sapiens
tggctcagataattcaaggggc

SEQ ID NO: 7224285 - DNA, 22 bp, Homo sapiens
tggctcagataattcaaggggc

SEQ ID NO: 7224286 - DNA, 22 bp, Homo sapiens
tggctcagataattcaaggggc

SEQ ID NO: 7224287 - DNA, 22 bp, Homo sapiens
tggctcagatgctcttccagtg

SEQ ID NO: 7224288 - DNA, 22 bp, Homo sapiens
tggctcagatgctcttccagtg

SEQ ID NO: 7224289 - DNA, 22 bp, Homo sapiens
tggctcagatgctcttccagtg

SEQ ID NO: 7224290 - DNA, 22 bp, Homo sapiens
tggctcagatgctcttccagtg

SEQ ID NO: 7224291 - DNA, 22 bp, Homo sapiens
tggctcagatgctcttccagtg

SEQ ID NO: 7224292 - DNA, 18 bp, Homo sapiens
tggctcagatggctttaa

SEQ ID NO: 7224293 - DNA, 18 bp, Homo sapiens
tggctcagatggctttaa

SEQ ID NO: 7224294 - DNA, 18 bp, Homo sapiens
tggctcagatggctttaa

SEQ ID NO: 7224295 - DNA, 18 bp, Homo sapiens
tggctcagatggctttaa

SEQ ID NO: 7224296 - DNA, 22 bp, Homo sapiens
tggctcagatttttgtaggctt

SEQ ID NO: 7224297 - DNA, 22 bp, Homo sapiens
tggctcagatttttgtaggctt

SEQ ID NO: 7224298 - DNA, 22 bp, Homo sapiens
tggctcagatttttgtaggctt

SEQ ID NO: 7224299 - DNA, 22 bp, Homo sapiens
tggctcagatttttgtaggctt

SEQ ID NO: 7224300 - DNA, 22 bp, Homo sapiens
tggctcagatttttgtaggctt

SEQ ID NO: 7224301 - DNA, 22 bp, Homo sapiens
tggctcagaggggaagtggttt

SEQ ID NO: 7224302 - DNA, 22 bp, Homo sapiens
tggctcagaggggaagtggttt

SEQ ID NO: 7224303 - DNA, 22 bp, Homo sapiens
tggctcagagccttgagagctg

SEQ ID NO: 7224304 - DNA, 22 bp, Homo sapiens
tggctcagagccttgagagctg

SEQ ID NO: 7224305 - DNA, 22 bp, Homo sapiens
tggctcagagagggagtgtgga

SEQ ID NO: 7224306 - DNA, 22 bp, Homo sapiens
tggctcagagcagggactctgg

SEQ ID NO: 7224307 - DNA, 22 bp, Homo sapiens
tggctcagagcagggactctgg

SEQ ID NO: 7224308 - DNA, 22 bp, Homo sapiens
tggctcagagcagggactctgg

SEQ ID NO: 7224309 - DNA, 22 bp, Homo sapiens
tggctcagagcagggactctgg

SEQ ID NO: 7224310 - DNA, 22 bp, Homo sapiens
tggctcagagcagggactctgg

SEQ ID NO: 7224311 - DNA, 22 bp, Homo sapiens
tggctcagagccttgagagctg

SEQ ID NO: 7224312 - DNA, 22 bp, Homo sapiens
tggctcagagccttgagagctg

SEQ ID NO: 7224313 - DNA, 22 bp, Homo sapiens
tggctcagaaggctgccttcac

SEQ ID NO: 7224314 - DNA, 22 bp, Homo sapiens
tggctcagaagaaaaggtaaac

SEQ ID NO: 7224315 - DNA, 22 bp, Homo sapiens
tggctcagaagaaaaggtaaac

SEQ ID NO: 7224316 - DNA, 22 bp, Homo sapiens
tggctcagaaggctgccttcac

SEQ ID NO: 7224317 - DNA, 22 bp, Homo sapiens
tggctcagaaggctgccttcac

SEQ ID NO: 7224318 - DNA, 22 bp, Homo sapiens
tggctcagaaggctgccttcac

SEQ ID NO: 7224319 - DNA, 22 bp, Homo sapiens
tggctcagaaggctgccttcac

SEQ ID NO: 7224320 - DNA, 22 bp, Homo sapiens
tggctcagagagggagtgtgga

SEQ ID NO: 7224321 - DNA, 22 bp, Homo sapiens
tggctcagagagggagtgtgga

SEQ ID NO: 7224322 - DNA, 22 bp, Homo sapiens
tggctcagagagggagtgtgga

SEQ ID NO: 7224323 - DNA, 22 bp, Homo sapiens
tggctcagagagggagtgtgga

SEQ ID NO: 7224324 - DNA, 19 bp, Homo sapiens
tggctataattccagagct

SEQ ID NO: 7224325 - DNA, 22 bp, Homo sapiens
tggctatactctcagttaatac

SEQ ID NO: 7224326 - DNA, 22 bp, Homo sapiens
tggctcaagtaacaaaaatata

SEQ ID NO: 7224327 - DNA, 22 bp, Homo sapiens
tggctcacaatctcccatgaag

SEQ ID NO: 7224328 - DNA, 22 bp, Homo sapiens
tggctcaccttcagaatatacc

SEQ ID NO: 7224329 - DNA, 22 bp, Homo sapiens
tggctcactgtagccttgacct

SEQ ID NO: 7224330 - DNA, 22 bp, Homo sapiens
tggctcacttccgtggagaggt

SEQ ID NO: 7224331 - DNA, 22 bp, Homo sapiens
tggctcagaactacttctagtt

SEQ ID NO: 7224332 - DNA, 22 bp, Homo sapiens
tggctcagaactacttctagtt

SEQ ID NO: 7224333 - DNA, 22 bp, Homo sapiens
tggctcagaactacttctagtt

SEQ ID NO: 7224334 - DNA, 22 bp, Homo sapiens
tggctcagaactacttctagtt

SEQ ID NO: 7224335 - DNA, 22 bp, Homo sapiens
tggctcagaactacttctagtt

SEQ ID NO: 7224336 - DNA, 22 bp, Homo sapiens
tggctcagaactacttctagtt

SEQ ID NO: 7224337 - DNA, 22 bp, Homo sapiens
tggctcagaagaaaaggtaaac

SEQ ID NO: 7224338 - DNA, 22 bp, Homo sapiens
tggctcagaagaaaaggtaaac

SEQ ID NO: 7224339 - DNA, 22 bp, Homo sapiens
tggctcagaactacttctagtt

SEQ ID NO: 7224340 - DNA, 22 bp, Homo sapiens
tggctcagaagaaaaggtaaac

SEQ ID NO: 7224341 - DNA, 22 bp, Homo sapiens
tggctcagaagaaaaggtaaac

SEQ ID NO: 7224342 - DNA, 22 bp, Homo sapiens
tggctcagaagaaaaggtaaac

SEQ ID NO: 7224343 - DNA, 20 bp, Homo sapiens
tggcggggatgagggagtta

SEQ ID NO: 7224344 - DNA, 20 bp, Homo sapiens
tggcggggatgagggagtta

SEQ ID NO: 7224345 - DNA, 22 bp, Homo sapiens
tggctaacaaggtgaaaccccg

SEQ ID NO: 7224346 - DNA, 22 bp, Homo sapiens
tggctaacaaggtgaaaccccg

SEQ ID NO: 7224347 - DNA, 19 bp, Homo sapiens
tggctataattccagagct

SEQ ID NO: 7224348 - DNA, 22 bp, Homo sapiens
tggcggctcaggaggggcagtt

SEQ ID NO: 7224349 - DNA, 22 bp, Homo sapiens
tggcggagttccagctgggatc

SEQ ID NO: 7224350 - DNA, 17 bp, Homo sapiens
tggcgctcccagggtgc

SEQ ID NO: 7224351 - DNA, 22 bp, Homo sapiens
tggcggctcaggaggggcagtt

SEQ ID NO: 7224352 - DNA, 22 bp, Homo sapiens
tggcggctcaggaggggcagtt

SEQ ID NO: 7224353 - DNA, 21 bp, Homo sapiens
tggcggggacttgtggctgcc

SEQ ID NO: 7224354 - DNA, 21 bp, Homo sapiens
tggcggggacttgtggctgcc

SEQ ID NO: 7224355 - DNA, 20 bp, Homo sapiens
tggcggggatgagggagtta

SEQ ID NO: 7224356 - DNA, 22 bp, Homo sapiens
tggcgcgctcgctctcgctgag

SEQ ID NO: 7224357 - DNA, 17 bp, Homo sapiens
tggcgctcccagggtgc

SEQ ID NO: 7224358 - DNA, 22 bp, Homo sapiens
tggcggaatgtgagattacctg

SEQ ID NO: 7224359 - DNA, 22 bp, Homo sapiens
tggcggagttccagctgggatc

SEQ ID NO: 7224360 - DNA, 22 bp, Homo sapiens
tggctgagtgttccaaggagca

SEQ ID NO: 7224361 - DNA, 22 bp, Homo sapiens
tggctgagtgttccaaggagca

SEQ ID NO: 7224362 - DNA, 21 bp, Homo sapiens
tggctgagtggatgcatgaat

SEQ ID NO: 7224363 - DNA, 21 bp, Homo sapiens
tggctgagtggatgcatgaat

SEQ ID NO: 7224364 - DNA, 22 bp, Homo sapiens
tggctgagtgatatttgcaaag

SEQ ID NO: 7224365 - DNA, 22 bp, Homo sapiens
tggctgagtgaacatgtccatt

SEQ ID NO: 7224366 - DNA, 22 bp, Homo sapiens
tggctgagttctccaggagtag

SEQ ID NO: 7224367 - DNA, 22 bp, Homo sapiens
tggctgagttctccaggagtag

SEQ ID NO: 7224368 - DNA, 22 bp, Homo sapiens
tggctgagttctccaggagtag

SEQ ID NO: 7224369 - DNA, 22 bp, Homo sapiens
tggctgagttctccaggagtag

SEQ ID NO: 7224370 - DNA, 22 bp, Homo sapiens
tggctgagttcctggcacacgg

SEQ ID NO: 7224371 - DNA, 22 bp, Homo sapiens
tggctgagttacgaacagagca

SEQ ID NO: 7224372 - DNA, 22 bp, Homo sapiens
tggctgagttacgaacagagca

SEQ ID NO: 7224373 - DNA, 22 bp, Homo sapiens
tggctgcagatcaagggcaggc

SEQ ID NO: 7224374 - DNA, 22 bp, Homo sapiens
tggctgcagatctgtgggacac

SEQ ID NO: 7224375 - DNA, 22 bp, Homo sapiens
tggctgcagatcaagggcaggc

SEQ ID NO: 7224376 - DNA, 22 bp, Homo sapiens
tggctgcagacacctatggcag

SEQ ID NO: 7224377 - DNA, 22 bp, Homo sapiens
tggctgcagatcaagggcaggc

SEQ ID NO: 7224378 - DNA, 22 bp, Homo sapiens
tggctgcagatcaagggcaggc

SEQ ID NO: 7224379 - DNA, 22 bp, Homo sapiens
tggctgcagacacctatggcag

SEQ ID NO: 7224380 - DNA, 22 bp, Homo sapiens
tggctgcagaacctcctcagga

SEQ ID NO: 7224381 - DNA, 21 bp, Homo sapiens
tggctgcactgtggctttcat

SEQ ID NO: 7224382 - DNA, 22 bp, Homo sapiens
tggctgcacttacctctcctgc

SEQ ID NO: 7224383 - DNA, 20 bp, Homo sapiens
tggctgcacaccaggacagg

SEQ ID NO: 7224384 - DNA, 22 bp, Homo sapiens
tggctgagtttcatgcatcatg

SEQ ID NO: 7224385 - DNA, 21 bp, Homo sapiens
tggctgcaagcagctgcctcc

SEQ ID NO: 7224386 - DNA, 20 bp, Homo sapiens
tggctgcacaccaggacagg

SEQ ID NO: 7224387 - DNA, 22 bp, Homo sapiens
tggctgctgagaaggcagctgt

SEQ ID NO: 7224388 - DNA, 22 bp, Homo sapiens
tggctgctgagaaggcagctgt

SEQ ID NO: 7224389 - DNA, 22 bp, Homo sapiens
tggctgctcaagggaggaggct

SEQ ID NO: 7224390 - DNA, 22 bp, Homo sapiens
tggctgctctcttccccagggt

SEQ ID NO: 7224391 - DNA, 22 bp, Homo sapiens
tggctgctctcttccccagggt

SEQ ID NO: 7224392 - DNA, 22 bp, Homo sapiens
tggctgctgagaaggcagctgt

SEQ ID NO: 7224393 - DNA, 22 bp, Homo sapiens
tggctgctgagaaggcagctgt

SEQ ID NO: 7224394 - DNA, 22 bp, Homo sapiens
tggctgccagctcctcgccttg

SEQ ID NO: 7224395 - DNA, 22 bp, Homo sapiens
tggctgccatgacgcctgggga

SEQ ID NO: 7224396 - DNA, 22 bp, Homo sapiens
tggctgccatgacgcctgggga

SEQ ID NO: 7224397 - DNA, 22 bp, Homo sapiens
tggctgcagttcacaggagcaa

SEQ ID NO: 7224398 - DNA, 22 bp, Homo sapiens
tggctgcagttcacaggagcaa

SEQ ID NO: 7224399 - DNA, 22 bp, Homo sapiens
tggctgcagtgcttgagatgtc

SEQ ID NO: 7224400 - DNA, 22 bp, Homo sapiens
tggctgcagtgcttgagatgtc

SEQ ID NO: 7224401 - DNA, 22 bp, Homo sapiens
tggctgcagtgcttgagatgtc

SEQ ID NO: 7224402 - DNA, 22 bp, Homo sapiens
tggctgcagttgggccctcaga

SEQ ID NO: 7224403 - DNA, 22 bp, Homo sapiens
tggctgccaagcaggtcagaga

SEQ ID NO: 7224404 - DNA, 22 bp, Homo sapiens
tggctgccaagcaggtcagaga

SEQ ID NO: 7224405 - DNA, 22 bp, Homo sapiens
tggctgctgagaaggcagctgt

SEQ ID NO: 7224406 - DNA, 22 bp, Homo sapiens
tggctgctgcagacagacagga

SEQ ID NO: 7224407 - DNA, 22 bp, Homo sapiens
tggctgctgctcactcagcctc

SEQ ID NO: 7224408 - DNA, 22 bp, Homo sapiens
tggctgctgcttggtcttcttc

SEQ ID NO: 7224409 - DNA, 22 bp, Homo sapiens
tggctgctgctcactcagcctc

SEQ ID NO: 7224410 - DNA, 22 bp, Homo sapiens
tggctgctgctcactcagcctc

SEQ ID NO: 7224411 - DNA, 21 bp, Homo sapiens
tggctgctggccctctctcca

SEQ ID NO: 7224412 - DNA, 22 bp, Homo sapiens
tggctgctgtgggtagagggat

SEQ ID NO: 7224413 - DNA, 22 bp, Homo sapiens
tggctgctgcttggtcttcttc

SEQ ID NO: 7224414 - DNA, 18 bp, Homo sapiens
tggctgctggagtagggt

SEQ ID NO: 7224415 - DNA, 18 bp, Homo sapiens
tggctgcttccaggtaca

SEQ ID NO: 7224416 - DNA, 18 bp, Homo sapiens
tggctgcttccaggtaca

SEQ ID NO: 7224417 - DNA, 22 bp, Homo sapiens
tggctgctgtgggtagagggat

SEQ ID NO: 7224418 - DNA, 18 bp, Homo sapiens
tggctgctggagtagggt

SEQ ID NO: 7224419 - DNA, 22 bp, Homo sapiens
tggctgcttaaaattgctgcaa

SEQ ID NO: 7224420 - DNA, 18 bp, Homo sapiens
tggctgcttccaggtaca

SEQ ID NO: 7224421 - DNA, 22 bp, Homo sapiens
tggctggaaacaggagattcag

SEQ ID NO: 7224422 - DNA, 22 bp, Homo sapiens
tggctggaatggagctgagcct

SEQ ID NO: 7224423 - DNA, 22 bp, Homo sapiens
tggctggaatggagctgagcct

SEQ ID NO: 7224424 - DNA, 22 bp, Homo sapiens
tggctgacaatgtagcagtaac

SEQ ID NO: 7224425 - DNA, 22 bp, Homo sapiens
tggctgacaaataggtgcagtt

SEQ ID NO: 7224426 - DNA, 22 bp, Homo sapiens
tggctgacaatgtagcagtaac

SEQ ID NO: 7224427 - DNA, 22 bp, Homo sapiens
tggctgaataatattctgttgt

SEQ ID NO: 7224428 - DNA, 22 bp, Homo sapiens
tggctgaataatattctgttgt

SEQ ID NO: 7224429 - DNA, 22 bp, Homo sapiens
tggctgaatctgcagcaggaag

SEQ ID NO: 7224430 - DNA, 22 bp, Homo sapiens
tggctgaactaatgtgctgttt

SEQ ID NO: 7224431 - DNA, 22 bp, Homo sapiens
tggctgaaggaagattcttcta

SEQ ID NO: 7224432 - DNA, 22 bp, Homo sapiens
tggctgaataaaatatggtgtt

SEQ ID NO: 7224433 - DNA, 22 bp, Homo sapiens
tggctgagaaaaaagagctata

SEQ ID NO: 7224434 - DNA, 22 bp, Homo sapiens
tggctgagaaaaaagagctata

SEQ ID NO: 7224435 - DNA, 22 bp, Homo sapiens
tggctgagaaaatggttttagg

SEQ ID NO: 7224436 - DNA, 22 bp, Homo sapiens
tggctgagaagttctggtggga

SEQ ID NO: 7224437 - DNA, 22 bp, Homo sapiens
tggctgagaagttctggtggga

SEQ ID NO: 7224438 - DNA, 22 bp, Homo sapiens
tggctgagaagttctggtggga

SEQ ID NO: 7224439 - DNA, 21 bp, Homo sapiens
tggctgagccaggtgtgtgga

SEQ ID NO: 7224440 - DNA, 21 bp, Homo sapiens
tggctgagccaggtgtgtgga

SEQ ID NO: 7224441 - DNA, 22 bp, Homo sapiens
tggctgagcctttggggctttc

SEQ ID NO: 7224442 - DNA, 22 bp, Homo sapiens
tggctgagcctttggggctttc

SEQ ID NO: 7224443 - DNA, 23 bp, Homo sapiens
tggctgagcccactatcttggcc

SEQ ID NO: 7224444 - DNA, 22 bp, Homo sapiens
tggctgagcctttggggctttc

SEQ ID NO: 7224445 - DNA, 23 bp, Homo sapiens
tggctgagcccactatcttggcc

SEQ ID NO: 7224446 - DNA, 23 bp, Homo sapiens
tggctgagcccactatcttggcc

SEQ ID NO: 7224447 - DNA, 23 bp, Homo sapiens
tggctgagcccactatcttggcc

SEQ ID NO: 7224448 - DNA, 22 bp, Homo sapiens
tggctgagaagttctggtggga

SEQ ID NO: 7224449 - DNA, 22 bp, Homo sapiens
tggctgagagtcatcctgtgtg

SEQ ID NO: 7224450 - DNA, 22 bp, Homo sapiens
tggctgagagtcatcctgtgtg

SEQ ID NO: 7224451 - DNA, 22 bp, Homo sapiens
tggctgagagtcatcctgtgtg

SEQ ID NO: 7224452 - DNA, 23 bp, Homo sapiens
tggctgagatcctactgtttgct

SEQ ID NO: 7224453 - DNA, 22 bp, Homo sapiens
tggctgagccacttgttcagat

SEQ ID NO: 7224454 - DNA, 22 bp, Homo sapiens
tggctgagccacttgttcagat

SEQ ID NO: 7224455 - DNA, 22 bp, Homo sapiens
tggctgagccacttgttcagat

SEQ ID NO: 7224456 - DNA, 22 bp, Homo sapiens
tggctgaggagagggcggaagt

SEQ ID NO: 7224457 - DNA, 22 bp, Homo sapiens
tggctgaggagagggcggaagt

SEQ ID NO: 7224458 - DNA, 19 bp, Homo sapiens
tggctgagctggactgagg

SEQ ID NO: 7224459 - DNA, 22 bp, Homo sapiens
tggctgaggagggtcttctggt

SEQ ID NO: 7224460 - DNA, 22 bp, Homo sapiens
tggctgaggagggtcttctggt

SEQ ID NO: 7224461 - DNA, 22 bp, Homo sapiens
tggctgaggcacagctgccgcc

SEQ ID NO: 7224462 - DNA, 22 bp, Homo sapiens
tggctgaggcacagctgccgcc

SEQ ID NO: 7224463 - DNA, 19 bp, Homo sapiens
tggctgagctggactgagg

SEQ ID NO: 7224464 - DNA, 19 bp, Homo sapiens
tggctgagctggactgagg

SEQ ID NO: 7224465 - DNA, 19 bp, Homo sapiens
tggctgagctggactgagg

SEQ ID NO: 7224466 - DNA, 22 bp, Homo sapiens
tggctgagctgcagcgtggctt

SEQ ID NO: 7224467 - DNA, 22 bp, Homo sapiens
tggctgagctgcagcgtggctt

SEQ ID NO: 7224468 - DNA, 22 bp, Homo sapiens
tggctgagctccctgtgtgttg

SEQ ID NO: 7224469 - DNA, 22 bp, Homo sapiens
tggctgagctccctgtgtgttg

SEQ ID NO: 7224470 - DNA, 22 bp, Homo sapiens
tggctgagctgcagcgtggctt

SEQ ID NO: 7224471 - DNA, 22 bp, Homo sapiens
tggctgagctgcagcgtggctt

SEQ ID NO: 7224472 - DNA, 22 bp, Homo sapiens
tggctgaggctggagtgcagtg

SEQ ID NO: 7224473 - DNA, 22 bp, Homo sapiens
tggctgaggctggagtgcagtg

SEQ ID NO: 7224474 - DNA, 22 bp, Homo sapiens
tggctgaggctggagtgcagtg

SEQ ID NO: 7224475 - DNA, 22 bp, Homo sapiens
tggctgaggctggagtgcagtg

SEQ ID NO: 7224476 - DNA, 22 bp, Homo sapiens
tggctgaggcttttcttaaaga

SEQ ID NO: 7224477 - DNA, 22 bp, Homo sapiens
tggctgaggctggagtgcagtg

SEQ ID NO: 7224478 - DNA, 22 bp, Homo sapiens
tggctgagggcactatgaagcc

SEQ ID NO: 7224479 - DNA, 22 bp, Homo sapiens
tggctgagggcactatgaagcc

SEQ ID NO: 7224480 - DNA, 22 bp, Homo sapiens
tggctgagtgaacatgtccatt

SEQ ID NO: 7224481 - DNA, 22 bp, Homo sapiens
tggctgagtaagttgtgatatg

SEQ ID NO: 7224482 - DNA, 22 bp, Homo sapiens
tggctgaggttatgctggttgt

SEQ ID NO: 7224483 - DNA, 22 bp, Homo sapiens
tggctgaggttatgctggttgt

SEQ ID NO: 7224484 - DNA, 19 bp, Homo sapiens
tggctctgtttctctggag

SEQ ID NO: 7224485 - DNA, 19 bp, Homo sapiens
tggctctgtttctctggag

SEQ ID NO: 7224486 - DNA, 19 bp, Homo sapiens
tggctctgtttctctggag

SEQ ID NO: 7224487 - DNA, 19 bp, Homo sapiens
tggctctgtttctctggag

SEQ ID NO: 7224488 - DNA, 22 bp, Homo sapiens
tggctctgttgtaaagaaattt

SEQ ID NO: 7224489 - DNA, 22 bp, Homo sapiens
tggctctgttgtgctgagccag

SEQ ID NO: 7224490 - DNA, 22 bp, Homo sapiens
tggctctgttgtgctgagccag

SEQ ID NO: 7224491 - DNA, 22 bp, Homo sapiens
tggctctgtttgttaactagac

SEQ ID NO: 7224492 - DNA, 22 bp, Homo sapiens
tggctctgtttgttaactagac

SEQ ID NO: 7224493 - DNA, 22 bp, Homo sapiens
tggctctgtttgttaactagac

SEQ ID NO: 7224494 - DNA, 22 bp, Homo sapiens
tggctctgttttatgagtacca

SEQ ID NO: 7224495 - DNA, 22 bp, Homo sapiens
tggctctgttttatgagtacca

SEQ ID NO: 7224496 - DNA, 22 bp, Homo sapiens
tggctcttaaggtccctgtgct

SEQ ID NO: 7224497 - DNA, 23 bp, Homo sapiens
tggctctgtgtcacatacaggat

SEQ ID NO: 7224498 - DNA, 23 bp, Homo sapiens
tggctctgtgtcacatacaggat

SEQ ID NO: 7224499 - DNA, 22 bp, Homo sapiens
tggctctgtgtctcccagcagc

SEQ ID NO: 7224500 - DNA, 22 bp, Homo sapiens
tggctctgtgtctcccagcagc

SEQ ID NO: 7224501 - DNA, 22 bp, Homo sapiens
tggctctgtgtctcccagcagc

SEQ ID NO: 7224502 - DNA, 22 bp, Homo sapiens
tggctctgtgtctcccagcagc

SEQ ID NO: 7224503 - DNA, 21 bp, Homo sapiens
tggctctgttcaatatatgga

SEQ ID NO: 7224504 - DNA, 22 bp, Homo sapiens
tggctctgttcgccatcaggag

SEQ ID NO: 7224505 - DNA, 22 bp, Homo sapiens
tggctctgttcgccatcaggag

SEQ ID NO: 7224506 - DNA, 22 bp, Homo sapiens
tggctctgttcgccatcaggag

SEQ ID NO: 7224507 - DNA, 22 bp, Homo sapiens
tggctctgttcgccatcaggag

SEQ ID NO: 7224508 - DNA, 22 bp, Homo sapiens
tggctctgttcgccatcaggag

SEQ ID NO: 7224509 - DNA, 22 bp, Homo sapiens
tggctctgttgaggtatggatt

SEQ ID NO: 7224510 - DNA, 22 bp, Homo sapiens
tggctctgttgaggtatggatt

SEQ ID NO: 7224511 - DNA, 22 bp, Homo sapiens
tggctctgttgctcgcagtttt

SEQ ID NO: 7224512 - DNA, 22 bp, Homo sapiens
tggctctgttgctcgcagtttt

SEQ ID NO: 7224513 - DNA, 22 bp, Homo sapiens
tggctctgttgtaaagaaattt

SEQ ID NO: 7224514 - DNA, 22 bp, Homo sapiens
tggctctgttgtgctgagccag

SEQ ID NO: 7224515 - DNA, 22 bp, Homo sapiens
tggctctgggcaccgtgtccac

SEQ ID NO: 7224516 - DNA, 22 bp, Homo sapiens
tggctctgggaatgggaagatg

SEQ ID NO: 7224517 - DNA, 22 bp, Homo sapiens
tggctctgggaatgggaagatg

SEQ ID NO: 7224518 - DNA, 22 bp, Homo sapiens
tggctctgggcaccgtgtccac

SEQ ID NO: 7224519 - DNA, 22 bp, Homo sapiens
tggctctgggcaccgtgtccac

SEQ ID NO: 7224520 - DNA, 22 bp, Homo sapiens
tggctctggcgtgaagcccaga

SEQ ID NO: 7224521 - DNA, 22 bp, Homo sapiens
tggctctggcgtgaagcccaga

SEQ ID NO: 7224522 - DNA, 22 bp, Homo sapiens
tggctctgggaatctgttgctt

SEQ ID NO: 7224523 - DNA, 22 bp, Homo sapiens
tggctctgggaatctgttgctt

SEQ ID NO: 7224524 - DNA, 22 bp, Homo sapiens
tggctctgggaatctgttgctt

SEQ ID NO: 7224525 - DNA, 22 bp, Homo sapiens
tggctctggagctggcggctga

SEQ ID NO: 7224526 - DNA, 22 bp, Homo sapiens
tggctctggattaatctaggaa

SEQ ID NO: 7224527 - DNA, 22 bp, Homo sapiens
tggctctggagctggcggctga

SEQ ID NO: 7224528 - DNA, 22 bp, Homo sapiens
tggctctggccaccgggagggc

SEQ ID NO: 7224529 - DNA, 22 bp, Homo sapiens
tggctctggattaatctaggaa

SEQ ID NO: 7224530 - DNA, 22 bp, Homo sapiens
tggctctggccaccgggagggc

SEQ ID NO: 7224531 - DNA, 22 bp, Homo sapiens
tggctctggccaccgggagggc

SEQ ID NO: 7224532 - DNA, 23 bp, Homo sapiens
tggctctgtggatccctcaggag

SEQ ID NO: 7224533 - DNA, 23 bp, Homo sapiens
tggctctgtggatccctcaggag

SEQ ID NO: 7224534 - DNA, 23 bp, Homo sapiens
tggctctgtggatccctcaggag

SEQ ID NO: 7224535 - DNA, 23 bp, Homo sapiens
tggctctgtggatccctcaggag

SEQ ID NO: 7224536 - DNA, 23 bp, Homo sapiens
tggctctgtggatccctcaggag

SEQ ID NO: 7224537 - DNA, 23 bp, Homo sapiens
tggctctgtgtcacatacaggat

SEQ ID NO: 7224538 - DNA, 22 bp, Homo sapiens
tggctctgtggtcttagcatgc

SEQ ID NO: 7224539 - DNA, 22 bp, Homo sapiens
tggctctgtggatgttctgacc

SEQ ID NO: 7224540 - DNA, 22 bp, Homo sapiens
tggctctgtggatgttctgacc

SEQ ID NO: 7224541 - DNA, 22 bp, Homo sapiens
tggctctggggacagtaagtcc

SEQ ID NO: 7224542 - DNA, 19 bp, Homo sapiens
tggctctgtcgaaggcaca

SEQ ID NO: 7224543 - DNA, 22 bp, Homo sapiens
tggctctgtcgccgtttggaat

SEQ ID NO: 7224544 - DNA, 22 bp, Homo sapiens
tggctctgtcgccgtttggaat

SEQ ID NO: 7224545 - DNA, 22 bp, Homo sapiens
tggctctgtgaacagacgactg

SEQ ID NO: 7224546 - DNA, 22 bp, Homo sapiens
tggctctgtgaacagacgactg

SEQ ID NO: 7224547 - DNA, 22 bp, Homo sapiens
tggctctgtgaacagacgactg

SEQ ID NO: 7224548 - DNA, 22 bp, Homo sapiens
tggctctgtgcttctagtatct

SEQ ID NO: 7224549 - DNA, 22 bp, Homo sapiens
tggctctgtgcttctagtatct

SEQ ID NO: 7224550 - DNA, 22 bp, Homo sapiens
tggctctgtgcttctagtatct

SEQ ID NO: 7224551 - DNA, 22 bp, Homo sapiens
tggctctgagacacaggctctc

SEQ ID NO: 7224552 - DNA, 22 bp, Homo sapiens
tggctctgagacacaggctctc

SEQ ID NO: 7224553 - DNA, 21 bp, Homo sapiens
tggctcgatttatagcatttc

SEQ ID NO: 7224554 - DNA, 23 bp, Homo sapiens
tggctctagaaggccattttcct

SEQ ID NO: 7224555 - DNA, 22 bp, Homo sapiens
tggctcctttccagcctggttt

SEQ ID NO: 7224556 - DNA, 22 bp, Homo sapiens
tggctcctttccagcctggttt

SEQ ID NO: 7224557 - DNA, 22 bp, Homo sapiens
tggctccttccgcagcatgcct

SEQ ID NO: 7224558 - DNA, 22 bp, Homo sapiens
tggctccttccgcagcatgcct

SEQ ID NO: 7224559 - DNA, 22 bp, Homo sapiens
tggctccttccgcagcatgcct

SEQ ID NO: 7224560 - DNA, 22 bp, Homo sapiens
tggctccttcattctcctgcca

SEQ ID NO: 7224561 - DNA, 22 bp, Homo sapiens
tggctccttcattctcctgcca

SEQ ID NO: 7224562 - DNA, 20 bp, Homo sapiens
tggctcctggctcctccctc

SEQ ID NO: 7224563 - DNA, 20 bp, Homo sapiens
tggctcctggctcctccctc

SEQ ID NO: 7224564 - DNA, 20 bp, Homo sapiens
tggctcctggctcctccctc

SEQ ID NO: 7224565 - DNA, 22 bp, Homo sapiens
tggctccttcattctcctgcca

SEQ ID NO: 7224566 - DNA, 22 bp, Homo sapiens
tggctccttcattctcctgcca

SEQ ID NO: 7224567 - DNA, 22 bp, Homo sapiens
tggctctgagacacaggctctc

SEQ ID NO: 7224568 - DNA, 22 bp, Homo sapiens
tggctctgagacacaggctctc

SEQ ID NO: 7224569 - DNA, 23 bp, Homo sapiens
tggctctgagaggttcagatgct

SEQ ID NO: 7224570 - DNA, 23 bp, Homo sapiens
tggctctgagaggttcagatgct

SEQ ID NO: 7224571 - DNA, 23 bp, Homo sapiens
tggctctgagaggttcagatgct

SEQ ID NO: 7224572 - DNA, 23 bp, Homo sapiens
tggctctgagaggttcagatgct

SEQ ID NO: 7224573 - DNA, 21 bp, Homo sapiens
tggctctgagcctcatggctg

SEQ ID NO: 7224574 - DNA, 21 bp, Homo sapiens
tggctctgagcctcatggctg

SEQ ID NO: 7224575 - DNA, 22 bp, Homo sapiens
tggctctgagctgcaaagctgc

SEQ ID NO: 7224576 - DNA, 23 bp, Homo sapiens
tggctctgagcttcctggtggcc

SEQ ID NO: 7224577 - DNA, 23 bp, Homo sapiens
tggctctgagcttcctggtggcc

SEQ ID NO: 7224578 - DNA, 22 bp, Homo sapiens
tggctctgagctgcaaagctgc

SEQ ID NO: 7224579 - DNA, 23 bp, Homo sapiens
tggctctgagcttcctggtggcc

SEQ ID NO: 7224580 - DNA, 23 bp, Homo sapiens
tggctctgagcttcctggtggcc

SEQ ID NO: 7224581 - DNA, 17 bp, Homo sapiens
tggctctgaggctgaat

SEQ ID NO: 7224582 - DNA, 17 bp, Homo sapiens
tggctctgaggctgaat

SEQ ID NO: 7224583 - DNA, 17 bp, Homo sapiens
tggctctgaggctgaat

SEQ ID NO: 7224584 - DNA, 17 bp, Homo sapiens
tggctctgaggctgaat

SEQ ID NO: 7224585 - DNA, 17 bp, Homo sapiens
tggctctgaggctgaat

SEQ ID NO: 7224586 - DNA, 17 bp, Homo sapiens
tggctctgaggctgaat

SEQ ID NO: 7224587 - DNA, 17 bp, Homo sapiens
tggctctgaggctgaat

SEQ ID NO: 7224588 - DNA, 22 bp, Homo sapiens
tggctctgagtctgcccttggc

SEQ ID NO: 7224589 - DNA, 22 bp, Homo sapiens
tggctctgagtctgcccttggc

SEQ ID NO: 7224590 - DNA, 22 bp, Homo sapiens
tggctctggagctggcggctga

SEQ ID NO: 7224591 - DNA, 22 bp, Homo sapiens
tggctctggagctcctgggccc

SEQ ID NO: 7224592 - DNA, 22 bp, Homo sapiens
tggctctggagctcctgggccc

SEQ ID NO: 7224593 - DNA, 18 bp, Homo sapiens
tggctctggacttgctcc

SEQ ID NO: 7224594 - DNA, 22 bp, Homo sapiens
tggctctggagctcctgggccc

SEQ ID NO: 7224595 - DNA, 22 bp, Homo sapiens
tggctctggagctcctgggccc

SEQ ID NO: 7224596 - DNA, 22 bp, Homo sapiens
tggctctgctgaacctagtgca

SEQ ID NO: 7224597 - DNA, 22 bp, Homo sapiens
tggctctgctgaacctagtgca

SEQ ID NO: 7224598 - DNA, 22 bp, Homo sapiens
tggctctgctgaacctagtgca

SEQ ID NO: 7224599 - DNA, 22 bp, Homo sapiens
tggctctgctgaacctagtgca

SEQ ID NO: 7224600 - DNA, 22 bp, Homo sapiens
tggctctgccccatacccctgc

SEQ ID NO: 7224601 - DNA, 22 bp, Homo sapiens
tggctctgcgtctgttcgtggg

SEQ ID NO: 7224602 - DNA, 22 bp, Homo sapiens
tggctctgcgtctgttcgtggg

SEQ ID NO: 7224603 - DNA, 22 bp, Homo sapiens
tggctctgcgtctgttcgtggg

SEQ ID NO: 7224604 - DNA, 21 bp, Homo sapiens
tggctctgctcagagcagtcc

SEQ ID NO: 7224605 - DNA, 21 bp, Homo sapiens
tggctctgctcagagcagtcc

SEQ ID NO: 7224606 - DNA, 21 bp, Homo sapiens
tggctctgctcagagcagtcc

SEQ ID NO: 7224607 - DNA, 21 bp, Homo sapiens
tggctctgctcagagcagtcc

SEQ ID NO: 7224608 - DNA, 21 bp, Homo sapiens
tggctctgctcagagcagtcc

SEQ ID NO: 7224609 - DNA, 21 bp, Homo sapiens
tggctctgctcagagcagtcc

SEQ ID NO: 7224610 - DNA, 21 bp, Homo sapiens
tggctctgctcagagcagtcc

SEQ ID NO: 7224611 - DNA, 22 bp, Homo sapiens
tggctctgctgaacctagtgca

SEQ ID NO: 7224612 - DNA, 22 bp, Homo sapiens
tggctctgatcagatgtccagt

SEQ ID NO: 7224613 - DNA, 22 bp, Homo sapiens
tggctctgatcagatgtccagt

SEQ ID NO: 7224614 - DNA, 22 bp, Homo sapiens
tggctctgatcagatgtccagt

SEQ ID NO: 7224615 - DNA, 22 bp, Homo sapiens
tggctctgatgggaggtattgg

SEQ ID NO: 7224616 - DNA, 22 bp, Homo sapiens
tggctctgcacctcagtgtacc

SEQ ID NO: 7224617 - DNA, 22 bp, Homo sapiens
tggctctgcacctcagtgtacc

SEQ ID NO: 7224618 - DNA, 22 bp, Homo sapiens
tggctctgcacctcagtgtacc

SEQ ID NO: 7224619 - DNA, 22 bp, Homo sapiens
tggctctgcacctcagtgtacc

SEQ ID NO: 7224620 - DNA, 22 bp, Homo sapiens
tggctctgcagcagtgtgcgtg

SEQ ID NO: 7224621 - DNA, 22 bp, Homo sapiens
tggctctgcagcagtgtgcgtg

SEQ ID NO: 7224622 - DNA, 18 bp, Homo sapiens
tggctctgcagccagatg

SEQ ID NO: 7224623 - DNA, 22 bp, Homo sapiens
tggctctgcagcagtgtgcgtg

SEQ ID NO: 7224624 - DNA, 18 bp, Homo sapiens
tggctctgcagccagatg

SEQ ID NO: 7224625 - DNA, 18 bp, Homo sapiens
tggctctgcagccagatg

SEQ ID NO: 7224626 - DNA, 18 bp, Homo sapiens
tggctctgcagccagatg

SEQ ID NO: 7224627 - DNA, 22 bp, Homo sapiens
tggctctgccacctttccctaa

SEQ ID NO: 7224628 - DNA, 22 bp, Homo sapiens
tggctctgccacctttccctaa

SEQ ID NO: 7224629 - DNA, 22 bp, Homo sapiens
tggctctgccactaacttggta

SEQ ID NO: 7224630 - DNA, 18 bp, Homo sapiens
tggctctgccactcaccg

SEQ ID NO: 7224631 - DNA, 18 bp, Homo sapiens
tggctctgccactcaccg

SEQ ID NO: 7224632 - DNA, 18 bp, Homo sapiens
tggctctgccactcaccg

SEQ ID NO: 7224633 - DNA, 18 bp, Homo sapiens
tggctctgccactcaccg

SEQ ID NO: 7224634 - DNA, 18 bp, Homo sapiens
tggctctgccactcaccg

SEQ ID NO: 7224635 - DNA, 22 bp, Homo sapiens
tggctctgccccatacccctgc

SEQ ID NO: 7224636 - DNA, 22 bp, Homo sapiens
tgggaagggagtttcttggagt

SEQ ID NO: 7224637 - DNA, 22 bp, Homo sapiens
tgggaagggagtttcttggagt

SEQ ID NO: 7224638 - DNA, 22 bp, Homo sapiens
tgggaagggagtttcttggagt

SEQ ID NO: 7224639 - DNA, 22 bp, Homo sapiens
tgggaagggagtttcttggagt

SEQ ID NO: 7224640 - DNA, 22 bp, Homo sapiens
tgggaagggagtttcttggagt

SEQ ID NO: 7224641 - DNA, 22 bp, Homo sapiens
tgggaagggccgatggagcctc

SEQ ID NO: 7224642 - DNA, 22 bp, Homo sapiens
tgggaagggccgatggagcctc

SEQ ID NO: 7224643 - DNA, 22 bp, Homo sapiens
tgggaagggccgatggagcctc

SEQ ID NO: 7224644 - DNA, 22 bp, Homo sapiens
tgggaagggccgatggagcctc

SEQ ID NO: 7224645 - DNA, 22 bp, Homo sapiens
tgggaagggccgatggagcctc

SEQ ID NO: 7224646 - DNA, 22 bp, Homo sapiens
tgggaagggccgatggagcctc

SEQ ID NO: 7224647 - DNA, 22 bp, Homo sapiens
tgggaagggagagtgtcctgga

SEQ ID NO: 7224648 - DNA, 22 bp, Homo sapiens
tgggaagggagagtgtcctgga

SEQ ID NO: 7224649 - DNA, 22 bp, Homo sapiens
tgggaaggcgtggaagtagaag

SEQ ID NO: 7224650 - DNA, 22 bp, Homo sapiens
tgggaagggagagtgtcctgga

SEQ ID NO: 7224651 - DNA, 22 bp, Homo sapiens
tgggaagggagagtgtcctgga

SEQ ID NO: 7224652 - DNA, 22 bp, Homo sapiens
tgggaagcacgctcagcagaaa

SEQ ID NO: 7224653 - DNA, 22 bp, Homo sapiens
tgggaagctactcatgcaggca

SEQ ID NO: 7224654 - DNA, 22 bp, Homo sapiens
tgggaagcctagcagacagctg

SEQ ID NO: 7224655 - DNA, 22 bp, Homo sapiens
tgggaaggcgtggaagtagaag

SEQ ID NO: 7224656 - DNA, 22 bp, Homo sapiens
tgggaaggcgtggaagtagaag

SEQ ID NO: 7224657 - DNA, 22 bp, Homo sapiens
tgggaaggcgtggaagtagaag

SEQ ID NO: 7224658 - DNA, 22 bp, Homo sapiens
tgggaagatggagtgacaggca

SEQ ID NO: 7224659 - DNA, 22 bp, Homo sapiens
tgggaagcacgctcagcagaaa

SEQ ID NO: 7224660 - DNA, 22 bp, Homo sapiens
tgggaagcattaatgatagggg

SEQ ID NO: 7224661 - DNA, 22 bp, Homo sapiens
tgggaagatgataattcacagt

SEQ ID NO: 7224662 - DNA, 22 bp, Homo sapiens
tgggaagatggagtgacaggca

SEQ ID NO: 7224663 - DNA, 22 bp, Homo sapiens
tgggaagatggagtgacaggca

SEQ ID NO: 7224664 - DNA, 22 bp, Homo sapiens
tgggaagatggagtgacaggca

SEQ ID NO: 7224665 - DNA, 22 bp, Homo sapiens
tgggaagaggcgggaggctgtt

SEQ ID NO: 7224666 - DNA, 22 bp, Homo sapiens
tgggaagaggcgggaggctgtt

SEQ ID NO: 7224667 - DNA, 22 bp, Homo sapiens
tgggaagaggggtataaagaag

SEQ ID NO: 7224668 - DNA, 22 bp, Homo sapiens
tgggaagaggggtataaagaag

SEQ ID NO: 7224669 - DNA, 22 bp, Homo sapiens
tgggaagaggggtataaagaag

SEQ ID NO: 7224670 - DNA, 22 bp, Homo sapiens
tgggaagagttagagacagctg

SEQ ID NO: 7224671 - DNA, 22 bp, Homo sapiens
tgggaagagttagagacagctg

SEQ ID NO: 7224672 - DNA, 22 bp, Homo sapiens
tgggaagagttagagacagctg

SEQ ID NO: 7224673 - DNA, 22 bp, Homo sapiens
tgggaagagttagagacagctg

SEQ ID NO: 7224674 - DNA, 22 bp, Homo sapiens
tgggaagatatgagtgaccaac

SEQ ID NO: 7224675 - DNA, 22 bp, Homo sapiens
tgggaagatatgagtgaccaac

SEQ ID NO: 7224676 - DNA, 22 bp, Homo sapiens
tgggaagatatgagtgaccaac

SEQ ID NO: 7224677 - DNA, 23 bp, Homo sapiens
tgggaagatatgtatgttcaagg

SEQ ID NO: 7224678 - DNA, 22 bp, Homo sapiens
tgggaaggggagctggaaagga

SEQ ID NO: 7224679 - DNA, 22 bp, Homo sapiens
tgggaaggggagctggaaagga

SEQ ID NO: 7224680 - DNA, 22 bp, Homo sapiens
tgggaaggggagctggaaagga

SEQ ID NO: 7224681 - DNA, 22 bp, Homo sapiens
tgggaaggggagctggaaagga

SEQ ID NO: 7224682 - DNA, 22 bp, Homo sapiens
tgggaaggggagctggaaagga

SEQ ID NO: 7224683 - DNA, 22 bp, Homo sapiens
tgggaaggggagctggaaagga

SEQ ID NO: 7224684 - DNA, 22 bp, Homo sapiens
tgggaaggggagctggaaagga

SEQ ID NO: 7224685 - DNA, 22 bp, Homo sapiens
tgggaaggggagctggaaagga

SEQ ID NO: 7224686 - DNA, 22 bp, Homo sapiens
tgggaaggggagctggaaagga

SEQ ID NO: 7224687 - DNA, 22 bp, Homo sapiens
tgggaagggccgatggagcctc

SEQ ID NO: 7224688 - DNA, 22 bp, Homo sapiens
tgggaagggcctgcccttcctc

SEQ ID NO: 7224689 - DNA, 22 bp, Homo sapiens
tgggaagggcctgcccttcctc

SEQ ID NO: 7224690 - DNA, 22 bp, Homo sapiens
tgggaagggcctgcccttcctc

SEQ ID NO: 7224691 - DNA, 22 bp, Homo sapiens
tgggaagggtcaacagctggaa

SEQ ID NO: 7224692 - DNA, 22 bp, Homo sapiens
tgggaagggtcaacagctggaa

SEQ ID NO: 7224693 - DNA, 22 bp, Homo sapiens
tgggaagggtcaacagctggaa

SEQ ID NO: 7224694 - DNA, 22 bp, Homo sapiens
tgggaagggtcaacagctggaa

SEQ ID NO: 7224695 - DNA, 22 bp, Homo sapiens
tgggaaggggagctggaaagga

SEQ ID NO: 7224696 - DNA, 22 bp, Homo sapiens
tgggaagggtcaacagctggaa

SEQ ID NO: 7224697 - DNA, 22 bp, Homo sapiens
tgggaagggtcaacagctggaa

SEQ ID NO: 7224698 - DNA, 22 bp, Homo sapiens
tgggaagggtcaacagctggaa

SEQ ID NO: 7224699 - DNA, 22 bp, Homo sapiens
tgggaaggggagctggaaagga

SEQ ID NO: 7224700 - DNA, 22 bp, Homo sapiens
tgggaaggggagctggaaagga

SEQ ID NO: 7224701 - DNA, 22 bp, Homo sapiens
tgggaagggtcaacagctggaa

SEQ ID NO: 7224702 - DNA, 22 bp, Homo sapiens
tgggaagggtcagtttcttcat

SEQ ID NO: 7224703 - DNA, 22 bp, Homo sapiens
tgggaagggtcagtttcttcat

SEQ ID NO: 7224704 - DNA, 22 bp, Homo sapiens
tgggaagggtcaacagctggaa

SEQ ID NO: 7224705 - DNA, 22 bp, Homo sapiens
tgggaagggtcaacagctggaa

SEQ ID NO: 7224706 - DNA, 22 bp, Homo sapiens
tgggaaggtacacgggaaagag

SEQ ID NO: 7224707 - DNA, 22 bp, Homo sapiens
tgggaaggtacacgggaaagag

SEQ ID NO: 7224708 - DNA, 22 bp, Homo sapiens
tgggaaggtacacgggaaagag

SEQ ID NO: 7224709 - DNA, 22 bp, Homo sapiens
tgggaagggtctgaatctgaga

SEQ ID NO: 7224710 - DNA, 22 bp, Homo sapiens
tgggaagggtctgaatctgaga

SEQ ID NO: 7224711 - DNA, 22 bp, Homo sapiens
tgggaagggtctgaatctgaga

SEQ ID NO: 7224712 - DNA, 22 bp, Homo sapiens
tgggaagggtctgaatctgaga

SEQ ID NO: 7224713 - DNA, 22 bp, Homo sapiens
tgggaagggtctgaatctgaga

SEQ ID NO: 7224714 - DNA, 22 bp, Homo sapiens
tgggaaggtacacgggaaagag

SEQ ID NO: 7224715 - DNA, 22 bp, Homo sapiens
tgggaaggtacacgggaaagag

SEQ ID NO: 7224716 - DNA, 22 bp, Homo sapiens
tgggaaggtacacgggaaagag

SEQ ID NO: 7224717 - DNA, 22 bp, Homo sapiens
tgggaaggtacacgggaaagag

SEQ ID NO: 7224718 - DNA, 22 bp, Homo sapiens
tgggaaggtacacgggaaagag

SEQ ID NO: 7224719 - DNA, 22 bp, Homo sapiens
tgggaaggtgattttccaaaag

SEQ ID NO: 7224720 - DNA, 22 bp, Homo sapiens
tgggaaggtgattttccaaaag

SEQ ID NO: 7224721 - DNA, 22 bp, Homo sapiens
tgggaaggtgattttccaaaag

SEQ ID NO: 7224722 - DNA, 22 bp, Homo sapiens
tgggaaggtgtagaaagaacaa

SEQ ID NO: 7224723 - DNA, 22 bp, Homo sapiens
tgggaaggtgtagaaagaacaa

SEQ ID NO: 7224724 - DNA, 22 bp, Homo sapiens
tgggaaggtgtagaaagaacaa

SEQ ID NO: 7224725 - DNA, 22 bp, Homo sapiens
tgggaaggtgtagaaagaacaa

SEQ ID NO: 7224726 - DNA, 22 bp, Homo sapiens
tgggacaggttggagagaagca

SEQ ID NO: 7224727 - DNA, 22 bp, Homo sapiens
tgggacaggttggagagaagca

SEQ ID NO: 7224728 - DNA, 22 bp, Homo sapiens
tgggacaggttggagagaagca

SEQ ID NO: 7224729 - DNA, 22 bp, Homo sapiens
tgggacaggttggagagaagca

SEQ ID NO: 7224730 - DNA, 22 bp, Homo sapiens
tgggacaggttggagagaagca

SEQ ID NO: 7224731 - DNA, 22 bp, Homo sapiens
tgggacaggttggagagaagca

SEQ ID NO: 7224732 - DNA, 22 bp, Homo sapiens
tgggacaggttggagagaagca

SEQ ID NO: 7224733 - DNA, 22 bp, Homo sapiens
tgggacaggttggagagaagca

SEQ ID NO: 7224734 - DNA, 22 bp, Homo sapiens
tgggacagtgaccccagaggtc

SEQ ID NO: 7224735 - DNA, 22 bp, Homo sapiens
tgggacagtgaccccagaggtc

SEQ ID NO: 7224736 - DNA, 22 bp, Homo sapiens
tgggacagtgaccccagaggtc

SEQ ID NO: 7224737 - DNA, 22 bp, Homo sapiens
tgggacacacaaggtcagctct

SEQ ID NO: 7224738 - DNA, 22 bp, Homo sapiens
tgggacacaaaccagaccagga

SEQ ID NO: 7224739 - DNA, 22 bp, Homo sapiens
tgggacacacaaggtcagctct

SEQ ID NO: 7224740 - DNA, 22 bp, Homo sapiens
tgggacacacaaggtcagctct

SEQ ID NO: 7224741 - DNA, 22 bp, Homo sapiens
tgggacacagaaaaggcaggtt

SEQ ID NO: 7224742 - DNA, 22 bp, Homo sapiens
tgggacacagaaaaggcaggtt

SEQ ID NO: 7224743 - DNA, 22 bp, Homo sapiens
tgggacacagaaaaggcaggtt

SEQ ID NO: 7224744 - DNA, 23 bp, Homo sapiens
tgggacacagggtcatggttatt

SEQ ID NO: 7224745 - DNA, 23 bp, Homo sapiens
tgggacacagggtcatggttatt

SEQ ID NO: 7224746 - DNA, 22 bp, Homo sapiens
tgggacacagtgtgtgaagtgc

SEQ ID NO: 7224747 - DNA, 22 bp, Homo sapiens
tgggacacattagtcaccttac

SEQ ID NO: 7224748 - DNA, 22 bp, Homo sapiens
tgggacacattagtcaccttac

SEQ ID NO: 7224749 - DNA, 22 bp, Homo sapiens
tgggacacccaggagggagtgg

SEQ ID NO: 7224750 - DNA, 22 bp, Homo sapiens
tgggacacccaggagggagtgg

SEQ ID NO: 7224751 - DNA, 22 bp, Homo sapiens
tgggacacagtgtgtgaagtgc

SEQ ID NO: 7224752 - DNA, 22 bp, Homo sapiens
tgggacacccaggagggagtgg

SEQ ID NO: 7224753 - DNA, 22 bp, Homo sapiens
tgggacacccaggagggagtgg

SEQ ID NO: 7224754 - DNA, 22 bp, Homo sapiens
tgggacaccctcacgcctgcac

SEQ ID NO: 7224755 - DNA, 23 bp, Homo sapiens
tgggaattgcagggggttctgcc

SEQ ID NO: 7224756 - DNA, 22 bp, Homo sapiens
tgggaattgaggtgattgtgag

SEQ ID NO: 7224757 - DNA, 22 bp, Homo sapiens
tgggacacaaaccagaccagga

SEQ ID NO: 7224758 - DNA, 22 bp, Homo sapiens
tgggacacaaaccagaccagga

SEQ ID NO: 7224759 - DNA, 22 bp, Homo sapiens
tgggaatgtggcaaggcataga

SEQ ID NO: 7224760 - DNA, 22 bp, Homo sapiens
tgggaatgctgatttcaggaac

SEQ ID NO: 7224761 - DNA, 22 bp, Homo sapiens
tgggaatgctgatttcaggaac

SEQ ID NO: 7224762 - DNA, 22 bp, Homo sapiens
tgggaatggatgctaagtgcta

SEQ ID NO: 7224763 - DNA, 22 bp, Homo sapiens
tgggaatgggcctagaaggctg

SEQ ID NO: 7224764 - DNA, 22 bp, Homo sapiens
tgggaatgggcctagaaggctg

SEQ ID NO: 7224765 - DNA, 22 bp, Homo sapiens
tgggaatgggcctagaaggctg

SEQ ID NO: 7224766 - DNA, 22 bp, Homo sapiens
tgggaaggttagcagtttgtca

SEQ ID NO: 7224767 - DNA, 22 bp, Homo sapiens
tgggaaggttagcagtttgtca

SEQ ID NO: 7224768 - DNA, 22 bp, Homo sapiens
tgggaaggttagcagtttgtca

SEQ ID NO: 7224769 - DNA, 22 bp, Homo sapiens
tgggaagtaggacagtgcagtt

SEQ ID NO: 7224770 - DNA, 22 bp, Homo sapiens
tgggaatacaattctgagagaa

SEQ ID NO: 7224771 - DNA, 22 bp, Homo sapiens
tgggaatagaacaagatagaga

SEQ ID NO: 7224772 - DNA, 23 bp, Homo sapiens
tgggaatgacatctagagcagag

SEQ ID NO: 7224773 - DNA, 23 bp, Homo sapiens
tgggaatgacatctagagcagag

SEQ ID NO: 7224774 - DNA, 23 bp, Homo sapiens
tgggaatgacatctagagcagag

SEQ ID NO: 7224775 - DNA, 22 bp, Homo sapiens
tgggacagttgtcctccactct

SEQ ID NO: 7224776 - DNA, 22 bp, Homo sapiens
tgggacagttgtcctccactct

SEQ ID NO: 7224777 - DNA, 22 bp, Homo sapiens
tgggacagttgtcctccactct

SEQ ID NO: 7224778 - DNA, 22 bp, Homo sapiens
tgggacagttgtcctccactct

SEQ ID NO: 7224779 - DNA, 22 bp, Homo sapiens
tgggacagtgtgccttgctcct

SEQ ID NO: 7224780 - DNA, 22 bp, Homo sapiens
tgggacagtgtgccttgctcct

SEQ ID NO: 7224781 - DNA, 21 bp, Homo sapiens
tgggacagtgatggctcctcc

SEQ ID NO: 7224782 - DNA, 21 bp, Homo sapiens
tgggacagtgatggctcctcc

SEQ ID NO: 7224783 - DNA, 22 bp, Homo sapiens
tgggacagtgaccccagaggtc

SEQ ID NO: 7224784 - DNA, 22 bp, Homo sapiens
tgggacagtgaccccagaggtc

SEQ ID NO: 7224785 - DNA, 22 bp, Homo sapiens
tgggacagtgaccccagaggtc

SEQ ID NO: 7224786 - DNA, 22 bp, Homo sapiens
tgggacagtgaccccagaggtc

SEQ ID NO: 7224787 - DNA, 21 bp, Homo sapiens
tgggacagtgatggctcctcc

SEQ ID NO: 7224788 - DNA, 21 bp, Homo sapiens
tgggacagtgatggctcctcc

SEQ ID NO: 7224789 - DNA, 21 bp, Homo sapiens
tgggacagtgatggctcctcc

SEQ ID NO: 7224790 - DNA, 21 bp, Homo sapiens
tgggacagtgatggctcctcc

SEQ ID NO: 7224791 - DNA, 22 bp, Homo sapiens
tgggacagtgtgccttgctcct

SEQ ID NO: 7224792 - DNA, 22 bp, Homo sapiens
tgggactcactcttttggccag

SEQ ID NO: 7224793 - DNA, 22 bp, Homo sapiens
tgggactcactcttttggccag

SEQ ID NO: 7224794 - DNA, 22 bp, Homo sapiens
tgggactgagaatatgatgggg

SEQ ID NO: 7224795 - DNA, 22 bp, Homo sapiens
tgggactgagaatatgatgggg

SEQ ID NO: 7224796 - DNA, 22 bp, Homo sapiens
tgggactgctcttgctggggtc

SEQ ID NO: 7224797 - DNA, 22 bp, Homo sapiens
tgggactgctcttgctggggtc

SEQ ID NO: 7224798 - DNA, 22 bp, Homo sapiens
tgggactgctcttgctggggtc

SEQ ID NO: 7224799 - DNA, 22 bp, Homo sapiens
tgggactgctcttgctggggtc

SEQ ID NO: 7224800 - DNA, 22 bp, Homo sapiens
tgggactgtgacctccagggta

SEQ ID NO: 7224801 - DNA, 22 bp, Homo sapiens
tgggactgtgacctccagggta

SEQ ID NO: 7224802 - DNA, 22 bp, Homo sapiens
tgggactgtgacctccagggta

SEQ ID NO: 7224803 - DNA, 22 bp, Homo sapiens
tgggactgtggtcaaggacaaa

SEQ ID NO: 7224804 - DNA, 22 bp, Homo sapiens
tgggactcactcttttggccag

SEQ ID NO: 7224805 - DNA, 22 bp, Homo sapiens
tgggacctgttacattgagtta

SEQ ID NO: 7224806 - DNA, 23 bp, Homo sapiens
tgggacctgtttgcccacagatg

SEQ ID NO: 7224807 - DNA, 22 bp, Homo sapiens
tgggacctgccctggccccatc

SEQ ID NO: 7224808 - DNA, 22 bp, Homo sapiens
tgggacctgctcctggaatgag

SEQ ID NO: 7224809 - DNA, 22 bp, Homo sapiens
tgggacctgctcttggaatgag

SEQ ID NO: 7224810 - DNA, 16 bp, Homo sapiens
tgggacctgtggccaa

SEQ ID NO: 7224811 - DNA, 22 bp, Homo sapiens
tgggaccacactttgaacaaca

SEQ ID NO: 7224812 - DNA, 22 bp, Homo sapiens
tgggaccagataaagggaggtc

SEQ ID NO: 7224813 - DNA, 21 bp, Homo sapiens
tgggacctagctttgcacagg

SEQ ID NO: 7224814 - DNA, 21 bp, Homo sapiens
tgggacctatttcaactggat

SEQ ID NO: 7224815 - DNA, 22 bp, Homo sapiens
tgggacctctcttgagagagca

SEQ ID NO: 7224816 - DNA, 22 bp, Homo sapiens
tgggacctctcttgagagagca

SEQ ID NO: 7224817 - DNA, 22 bp, Homo sapiens
tgggacctgaagcaggttggca

SEQ ID NO: 7224818 - DNA, 22 bp, Homo sapiens
tgggagcagccaacatggcctt

SEQ ID NO: 7224819 - DNA, 22 bp, Homo sapiens
tgggagcagccaacatggcctt

SEQ ID NO: 7224820 - DNA, 22 bp, Homo sapiens
tgggagcagcctcagcttcggg

SEQ ID NO: 7224821 - DNA, 22 bp, Homo sapiens
tgggagcagccaacatggcctt

SEQ ID NO: 7224822 - DNA, 22 bp, Homo sapiens
tgggagcagccaacatggcctt

SEQ ID NO: 7224823 - DNA, 22 bp, Homo sapiens
tgggagcactctttgggaagca

SEQ ID NO: 7224824 - DNA, 22 bp, Homo sapiens
tgggagcagcagggagatgcgg

SEQ ID NO: 7224825 - DNA, 22 bp, Homo sapiens
tgggagcagcagggagatgcgg

SEQ ID NO: 7224826 - DNA, 22 bp, Homo sapiens
tgggagcagcagggagatgcgg

SEQ ID NO: 7224827 - DNA, 22 bp, Homo sapiens
tgggagcagcagggagatgcgg

SEQ ID NO: 7224828 - DNA, 22 bp, Homo sapiens
tgggagcagcagggagatgcgg

SEQ ID NO: 7224829 - DNA, 22 bp, Homo sapiens
tgggagcagctgggaacacagc

SEQ ID NO: 7224830 - DNA, 22 bp, Homo sapiens
tgggagcagctgggaacacagc

SEQ ID NO: 7224831 - DNA, 22 bp, Homo sapiens
tgggagcagctgggaacacagc

SEQ ID NO: 7224832 - DNA, 22 bp, Homo sapiens
tgggagcagctttgcgagggag

SEQ ID NO: 7224833 - DNA, 22 bp, Homo sapiens
tgggagcagctttgcgagggag

SEQ ID NO: 7224834 - DNA, 22 bp, Homo sapiens
tgggagcagctttgcgagggag

SEQ ID NO: 7224835 - DNA, 22 bp, Homo sapiens
tgggagcagctttgcgagggag

SEQ ID NO: 7224836 - DNA, 22 bp, Homo sapiens
tgggagcagctttgcgagggag

SEQ ID NO: 7224837 - DNA, 22 bp, Homo sapiens
tgggagcaggaagcaggaagta

SEQ ID NO: 7224838 - DNA, 22 bp, Homo sapiens
tgggagcaggaagcaggaagta

SEQ ID NO: 7224839 - DNA, 22 bp, Homo sapiens
tgggagcaggaagcaggaagta

SEQ ID NO: 7224840 - DNA, 22 bp, Homo sapiens
tgggagctcctggagggcagga

SEQ ID NO: 7224841 - DNA, 22 bp, Homo sapiens
tgggagctcctggagggcagga

SEQ ID NO: 7224842 - DNA, 22 bp, Homo sapiens
tgggagcaccttgagggcagaa

SEQ ID NO: 7224843 - DNA, 22 bp, Homo sapiens
tgggagcaccttgagggcagaa

SEQ ID NO: 7224844 - DNA, 22 bp, Homo sapiens
tgggagcaccttgagggcagaa

SEQ ID NO: 7224845 - DNA, 22 bp, Homo sapiens
tgggagcaccttgagggcagaa

SEQ ID NO: 7224846 - DNA, 22 bp, Homo sapiens
tgggagcaccctgaggagcttc

SEQ ID NO: 7224847 - DNA, 22 bp, Homo sapiens
tgggagcaccttgagggcagaa

SEQ ID NO: 7224848 - DNA, 22 bp, Homo sapiens
tgggagcaccttgagggcagaa

SEQ ID NO: 7224849 - DNA, 22 bp, Homo sapiens
tgggagcaccttgagggcagaa

SEQ ID NO: 7224850 - DNA, 22 bp, Homo sapiens
tgggagcaccttgagggcagaa

SEQ ID NO: 7224851 - DNA, 22 bp, Homo sapiens
tgggagcactctttgggaagca

SEQ ID NO: 7224852 - DNA, 22 bp, Homo sapiens
tgggagcactctttgggaagca

SEQ ID NO: 7224853 - DNA, 22 bp, Homo sapiens
tgggagcactctttgggaagca

SEQ ID NO: 7224854 - DNA, 22 bp, Homo sapiens
tgggagcactctttgggaagca

SEQ ID NO: 7224855 - DNA, 22 bp, Homo sapiens
tgggagcactctttgggaagca

SEQ ID NO: 7224856 - DNA, 22 bp, Homo sapiens
tgggagcaccctgaggagcttc

SEQ ID NO: 7224857 - DNA, 22 bp, Homo sapiens
tgggagcaccctgaggagcttc

SEQ ID NO: 7224858 - DNA, 22 bp, Homo sapiens
tgggagcaccctgaggagcttc

SEQ ID NO: 7224859 - DNA, 22 bp, Homo sapiens
tgggagcaagctggtgctggag

SEQ ID NO: 7224860 - DNA, 22 bp, Homo sapiens
tgggagcaagctggtgctggag

SEQ ID NO: 7224861 - DNA, 22 bp, Homo sapiens
tgggagcaccctgaggagcttc

SEQ ID NO: 7224862 - DNA, 22 bp, Homo sapiens
tgggagcaagctggtgctggag

SEQ ID NO: 7224863 - DNA, 22 bp, Homo sapiens
tgggagcaagctggtgctggag

SEQ ID NO: 7224864 - DNA, 22 bp, Homo sapiens
tgggagcaagctggtgctggag

SEQ ID NO: 7224865 - DNA, 22 bp, Homo sapiens
tgggagcaagctggtgctggag

SEQ ID NO: 7224866 - DNA, 22 bp, Homo sapiens
tgggagcaagctggtgctggag

SEQ ID NO: 7224867 - DNA, 22 bp, Homo sapiens
tgggaggatctcttgaggccag

SEQ ID NO: 7224868 - DNA, 22 bp, Homo sapiens
tgggaggatctcttgaggccag

SEQ ID NO: 7224869 - DNA, 22 bp, Homo sapiens
tgggaggatcgcttgagcccag

SEQ ID NO: 7224870 - DNA, 22 bp, Homo sapiens
tgggaggatcgcttgagcccag

SEQ ID NO: 7224871 - DNA, 22 bp, Homo sapiens
tgggaggagccctctgggaagg

SEQ ID NO: 7224872 - DNA, 22 bp, Homo sapiens
tgggaggagccctctgggaagg

SEQ ID NO: 7224873 - DNA, 22 bp, Homo sapiens
tgggaggagccctctgggaagg

SEQ ID NO: 7224874 - DNA, 22 bp, Homo sapiens
tgggaggatcgcttgagcccag

SEQ ID NO: 7224875 - DNA, 22 bp, Homo sapiens
tgggaggcaggtaggtgatgat

SEQ ID NO: 7224876 - DNA, 22 bp, Homo sapiens
tgggaggcagaagttgactgga

SEQ ID NO: 7224877 - DNA, 22 bp, Homo sapiens
tgggaggcaggtaggtgatgat

SEQ ID NO: 7224878 - DNA, 22 bp, Homo sapiens
tgggaggcagaagttgactgga

SEQ ID NO: 7224879 - DNA, 22 bp, Homo sapiens
tgggaggatctcttgaggccag

SEQ ID NO: 7224880 - DNA, 22 bp, Homo sapiens
tgggaggatctcttgaggccag

SEQ ID NO: 7224881 - DNA, 22 bp, Homo sapiens
tgggaggcagaagttgactgga

SEQ ID NO: 7224882 - DNA, 22 bp, Homo sapiens
tgggaggacttgtgggcttcat

SEQ ID NO: 7224883 - DNA, 22 bp, Homo sapiens
tgggaggacttgtgggcttcat

SEQ ID NO: 7224884 - DNA, 22 bp, Homo sapiens
tgggaggacttgtgggcttcat

SEQ ID NO: 7224885 - DNA, 22 bp, Homo sapiens
tgggaggaagtgctaatgggag

SEQ ID NO: 7224886 - DNA, 22 bp, Homo sapiens
tgggaggaatgtcactgagcca

SEQ ID NO: 7224887 - DNA, 22 bp, Homo sapiens
tgggaggaatgtcactgagcca

SEQ ID NO: 7224888 - DNA, 20 bp, Homo sapiens
tgggagctggtgaggtctca

SEQ ID NO: 7224889 - DNA, 22 bp, Homo sapiens
tgggaggaagtgctaatgggag

SEQ ID NO: 7224890 - DNA, 22 bp, Homo sapiens
tgggaggaagtgctaatgggag

SEQ ID NO: 7224891 - DNA, 22 bp, Homo sapiens
tgggagctggggttggacgtct

SEQ ID NO: 7224892 - DNA, 22 bp, Homo sapiens
tgggagctggggttggacgtct

SEQ ID NO: 7224893 - DNA, 22 bp, Homo sapiens
tgggagctctgagcctgctatg

SEQ ID NO: 7224894 - DNA, 22 bp, Homo sapiens
tgggagctctgagcctgctgtg

SEQ ID NO: 7224895 - DNA, 22 bp, Homo sapiens
tgggagctctgagcctgctgtg

SEQ ID NO: 7224896 - DNA, 22 bp, Homo sapiens
tgggagctgagctaaaccccag

SEQ ID NO: 7224897 - DNA, 22 bp, Homo sapiens
tgggagatggttctgagacttt

SEQ ID NO: 7224898 - DNA, 22 bp, Homo sapiens
tgggagatttctgtcctcaatg

SEQ ID NO: 7224899 - DNA, 22 bp, Homo sapiens
tgggagcaaatgactgggagat

SEQ ID NO: 7224900 - DNA, 22 bp, Homo sapiens
tgggagcaaatgactgggagat

SEQ ID NO: 7224901 - DNA, 22 bp, Homo sapiens
tgggagcaaatgactgggagat

SEQ ID NO: 7224902 - DNA, 22 bp, Homo sapiens
tgggagcaaatgactgggagat

SEQ ID NO: 7224903 - DNA, 22 bp, Homo sapiens
tgggagcaagctacttagggaa

SEQ ID NO: 7224904 - DNA, 22 bp, Homo sapiens
tgggagcaagctacttagggaa

SEQ ID NO: 7224905 - DNA, 22 bp, Homo sapiens
tgggagcaagctacttagggaa

SEQ ID NO: 7224906 - DNA, 22 bp, Homo sapiens
tgggagagtctaaaaccgaggt

SEQ ID NO: 7224907 - DNA, 22 bp, Homo sapiens
tgggagagtctaaaaccgaggt

SEQ ID NO: 7224908 - DNA, 22 bp, Homo sapiens
tgggagagtctaaaaccgaggt

SEQ ID NO: 7224909 - DNA, 22 bp, Homo sapiens
tgggagagtgctcaatgtgcaa

SEQ ID NO: 7224910 - DNA, 22 bp, Homo sapiens
tgggagagtgctcaatgtgcaa

SEQ ID NO: 7224911 - DNA, 22 bp, Homo sapiens
tgggagagtgctcaatgtgcaa

SEQ ID NO: 7224912 - DNA, 22 bp, Homo sapiens
tgggagagtttgtttagagtga

SEQ ID NO: 7224913 - DNA, 22 bp, Homo sapiens
tgggagagtttgtttagagtga

SEQ ID NO: 7224914 - DNA, 22 bp, Homo sapiens
tgggagagtttgtttagagtga

SEQ ID NO: 7224915 - DNA, 22 bp, Homo sapiens
tgggagagtttgtttagagtga

SEQ ID NO: 7224916 - DNA, 22 bp, Homo sapiens
tgggagagtttgtttagagtga

SEQ ID NO: 7224917 - DNA, 22 bp, Homo sapiens
tgggagataaagcatctgttct

SEQ ID NO: 7224918 - DNA, 23 bp, Homo sapiens
tgggagataagcagaagcctggt

SEQ ID NO: 7224919 - DNA, 21 bp, Homo sapiens
tgggagagggctcagctaccc

SEQ ID NO: 7224920 - DNA, 22 bp, Homo sapiens
tgggagaggctgccatcttgca

SEQ ID NO: 7224921 - DNA, 22 bp, Homo sapiens
tgggagaggctgccatcttgca

SEQ ID NO: 7224922 - DNA, 21 bp, Homo sapiens
tgggagagggctcagctaccc

SEQ ID NO: 7224923 - DNA, 21 bp, Homo sapiens
tgggagagggctcagctaccc

SEQ ID NO: 7224924 - DNA, 21 bp, Homo sapiens
tgggagagggctcagctaccc

SEQ ID NO: 7224925 - DNA, 21 bp, Homo sapiens
tgggagagggctcagctaccc

SEQ ID NO: 7224926 - DNA, 21 bp, Homo sapiens
tgggagagggctcagctaccc

SEQ ID NO: 7224927 - DNA, 21 bp, Homo sapiens
tgggagagggctcagctaccc

SEQ ID NO: 7224928 - DNA, 22 bp, Homo sapiens
tgggagagtaaccaattccttc

SEQ ID NO: 7224929 - DNA, 22 bp, Homo sapiens
tgggagagtaaccaattccttc

SEQ ID NO: 7224930 - DNA, 22 bp, Homo sapiens
tgggagagtaaccaattccttc

SEQ ID NO: 7224931 - DNA, 22 bp, Homo sapiens
tgggagagtctaaaaccgaggt

SEQ ID NO: 7224932 - DNA, 22 bp, Homo sapiens
tgggagagtctaaaaccgaggt

SEQ ID NO: 7224933 - DNA, 22 bp, Homo sapiens
tgggagagcttcatgccttcag

SEQ ID NO: 7224934 - DNA, 19 bp, Homo sapiens
tgggagaggcaacagagta

SEQ ID NO: 7224935 - DNA, 19 bp, Homo sapiens
tgggagaggcaacagagta

SEQ ID NO: 7224936 - DNA, 19 bp, Homo sapiens
tgggagaggcaacagagta

SEQ ID NO: 7224937 - DNA, 19 bp, Homo sapiens
tgggagaggcaacagagta

SEQ ID NO: 7224938 - DNA, 19 bp, Homo sapiens
tgggagaggcaacagagta

SEQ ID NO: 7224939 - DNA, 19 bp, Homo sapiens
tgggagaggcaacagagta

SEQ ID NO: 7224940 - DNA, 19 bp, Homo sapiens
tgggagaggcaacagagta

SEQ ID NO: 7224941 - DNA, 22 bp, Homo sapiens
tgggagaggctgccatcttgca

SEQ ID NO: 7224942 - DNA, 22 bp, Homo sapiens
tgggagaggctgccatcttgca

SEQ ID NO: 7224943 - DNA, 22 bp, Homo sapiens
tgggagaggctgccatcttgca

SEQ ID NO: 7224944 - DNA, 22 bp, Homo sapiens
tgggactgtggtcaaggacaaa

SEQ ID NO: 7224945 - DNA, 22 bp, Homo sapiens
tgggactgtggtcaaggacaaa

SEQ ID NO: 7224946 - DNA, 22 bp, Homo sapiens
tgggagaaactgtctctcccac

SEQ ID NO: 7224947 - DNA, 22 bp, Homo sapiens
tgggagaaactgtctctcccac

SEQ ID NO: 7224948 - DNA, 22 bp, Homo sapiens
tgggagaaagaaccctgagtga

SEQ ID NO: 7224949 - DNA, 22 bp, Homo sapiens
tgggagaaagaaccctgagtga

SEQ ID NO: 7224950 - DNA, 22 bp, Homo sapiens
tgggagaacactgctctggatg

SEQ ID NO: 7224951 - DNA, 22 bp, Homo sapiens
tgggagaacactgctctggatg

SEQ ID NO: 7224952 - DNA, 22 bp, Homo sapiens
tgggagaacccagggtcaggct

SEQ ID NO: 7224953 - DNA, 22 bp, Homo sapiens
tgggagaacccagggtcaggct

SEQ ID NO: 7224954 - DNA, 22 bp, Homo sapiens
tgggagaacccagggtcaggct

SEQ ID NO: 7224955 - DNA, 22 bp, Homo sapiens
tgggagaacccagggtcaggct

SEQ ID NO: 7224956 - DNA, 22 bp, Homo sapiens
tgggagaacccagggtcaggct

SEQ ID NO: 7224957 - DNA, 22 bp, Homo sapiens
tgggagaacccagggtcaggct

SEQ ID NO: 7224958 - DNA, 20 bp, Homo sapiens
tgggagaagaacactggaac

SEQ ID NO: 7224959 - DNA, 20 bp, Homo sapiens
tgggagaagaacactggaac

SEQ ID NO: 7224960 - DNA, 22 bp, Homo sapiens
tgggagaagacgtactttagac

SEQ ID NO: 7224961 - DNA, 22 bp, Homo sapiens
tgggagaagacgtactttagac

SEQ ID NO: 7224962 - DNA, 22 bp, Homo sapiens
tgggagaagagaaattactgcc

SEQ ID NO: 7224963 - DNA, 22 bp, Homo sapiens
tgggagaagcagcagccaagtg

SEQ ID NO: 7224964 - DNA, 22 bp, Homo sapiens
tgggagaagcagcagccaagtg

SEQ ID NO: 7224965 - DNA, 22 bp, Homo sapiens
tgggagaagcagcagccaagtg

SEQ ID NO: 7224966 - DNA, 22 bp, Homo sapiens
tgggagaagcagcagccaagtg

SEQ ID NO: 7224967 - DNA, 22 bp, Homo sapiens
tgggagaagcagcagccaagtg

SEQ ID NO: 7224968 - DNA, 22 bp, Homo sapiens
tgggagaagcagtgggacagta

SEQ ID NO: 7224969 - DNA, 22 bp, Homo sapiens
tgggagaagcagtgggacagta

SEQ ID NO: 7224970 - DNA, 22 bp, Homo sapiens
tgggagagaataatcaataggt

SEQ ID NO: 7224971 - DNA, 22 bp, Homo sapiens
tgggagagcttcatgccttcag

SEQ ID NO: 7224972 - DNA, 22 bp, Homo sapiens
tgggagagcttcatgccttcag

SEQ ID NO: 7224973 - DNA, 21 bp, Homo sapiens
tgggagacacagccttgagct

SEQ ID NO: 7224974 - DNA, 21 bp, Homo sapiens
tgggagaccgccttcctggga

SEQ ID NO: 7224975 - DNA, 22 bp, Homo sapiens
tgggagacactggtgggagctt

SEQ ID NO: 7224976 - DNA, 22 bp, Homo sapiens
tgggagaatcttgctctgctac

SEQ ID NO: 7224977 - DNA, 22 bp, Homo sapiens
tgggagaatatatttaaaactt

SEQ ID NO: 7224978 - DNA, 22 bp, Homo sapiens
tgggagaagcatggggtgcaga

SEQ ID NO: 7224979 - DNA, 22 bp, Homo sapiens
tgggagaagcatggggtgcaga

SEQ ID NO: 7224980 - DNA, 22 bp, Homo sapiens
tgggagaagcagtgggacagta

SEQ ID NO: 7224981 - DNA, 22 bp, Homo sapiens
tgggagaagcagtgggacagta

SEQ ID NO: 7224982 - DNA, 22 bp, Homo sapiens
tgggagaagcagtgggacagta

SEQ ID NO: 7224983 - DNA, 22 bp, Homo sapiens
tgggagaagcatggggtgcaga

SEQ ID NO: 7224984 - DNA, 22 bp, Homo sapiens
tgggagaagcatggggtgcaga

SEQ ID NO: 7224985 - DNA, 22 bp, Homo sapiens
tgggaagaagcagagaactgga

SEQ ID NO: 7224986 - DNA, 22 bp, Homo sapiens
tgggaagaagcagagaactgga

SEQ ID NO: 7224987 - DNA, 22 bp, Homo sapiens
tgggaactggggcattgtttct

SEQ ID NO: 7224988 - DNA, 22 bp, Homo sapiens
tgggaagaagcagagaactgga

SEQ ID NO: 7224989 - DNA, 22 bp, Homo sapiens
tgggaagaagcagagaactgga

SEQ ID NO: 7224990 - DNA, 22 bp, Homo sapiens
tgggaagaagcagagaactgga

SEQ ID NO: 7224991 - DNA, 22 bp, Homo sapiens
tgggaacattttgagctgagag

SEQ ID NO: 7224992 - DNA, 22 bp, Homo sapiens
tgggaacattttgagctgagag

SEQ ID NO: 7224993 - DNA, 22 bp, Homo sapiens
tgggaacagtagctgctgagct

SEQ ID NO: 7224994 - DNA, 22 bp, Homo sapiens
tgggaacagtagctgctgagct

SEQ ID NO: 7224995 - DNA, 22 bp, Homo sapiens
tgggaacagtagctgctgagct

SEQ ID NO: 7224996 - DNA, 22 bp, Homo sapiens
tgggaacattttgagctgagag

SEQ ID NO: 7224997 - DNA, 22 bp, Homo sapiens
tgggaagactcctcaggaggcg

SEQ ID NO: 7224998 - DNA, 22 bp, Homo sapiens
tgggaagactcctcaggaggcg

SEQ ID NO: 7224999 - DNA, 22 bp, Homo sapiens
tgggaagactcctcaggaggcg

SEQ ID NO: 7225000 - DNA, 22 bp, Homo sapiens
tgggaagactcctcaggaggcg

SEQ ID NO: 7225001 - DNA, 22 bp, Homo sapiens
tgggaagactcctcaggaggcg

SEQ ID NO: 7225002 - DNA, 22 bp, Homo sapiens
tgggaagactcctcaggaggcg

SEQ ID NO: 7225003 - DNA, 22 bp, Homo sapiens
tgggaagactcctcaggaggcg

SEQ ID NO: 7225004 - DNA, 22 bp, Homo sapiens
tgggaagactcctcaggaggcg

SEQ ID NO: 7225005 - DNA, 22 bp, Homo sapiens
tgggaagaggatgaggcatatg

SEQ ID NO: 7225006 - DNA, 22 bp, Homo sapiens
tgggaagaggcgggaggctgtt

SEQ ID NO: 7225007 - DNA, 22 bp, Homo sapiens
tgggaagaggcgggaggctgtt

SEQ ID NO: 7225008 - DNA, 22 bp, Homo sapiens
tgggaagaggcgggaggctgtt

SEQ ID NO: 7225009 - DNA, 22 bp, Homo sapiens
tgggaagaggcgggaggctgtt

SEQ ID NO: 7225010 - DNA, 22 bp, Homo sapiens
tgggaacacctgctgcccagtg

SEQ ID NO: 7225011 - DNA, 22 bp, Homo sapiens
tgggaacaacatgcactgccac

SEQ ID NO: 7225012 - DNA, 22 bp, Homo sapiens
tgggaaattgtatttctatttc

SEQ ID NO: 7225013 - DNA, 22 bp, Homo sapiens
tgggaaattgtatttctatttc

SEQ ID NO: 7225014 - DNA, 22 bp, Homo sapiens
tgggaaattgtatttctatttc

SEQ ID NO: 7225015 - DNA, 22 bp, Homo sapiens
tgggaaatgtgtttctggacca

SEQ ID NO: 7225016 - DNA, 22 bp, Homo sapiens
tgggaaatcagtatagtatcag

SEQ ID NO: 7225017 - DNA, 22 bp, Homo sapiens
tgggaaagtgttgaggtgtctt

SEQ ID NO: 7225018 - DNA, 22 bp, Homo sapiens
tgggaaagtgttgaggtgtctt

SEQ ID NO: 7225019 - DNA, 22 bp, Homo sapiens
tgggaaagtgtagcctgcaggc

SEQ ID NO: 7225020 - DNA, 22 bp, Homo sapiens
tgggaaagtctttatttctctt

SEQ ID NO: 7225021 - DNA, 22 bp, Homo sapiens
tgggaaagtctttatttctctt

SEQ ID NO: 7225022 - DNA, 22 bp, Homo sapiens
tgggaaagtgtagcctgcaggc

SEQ ID NO: 7225023 - DNA, 22 bp, Homo sapiens
tgggaaagtgtagcctgcaggc

SEQ ID NO: 7225024 - DNA, 22 bp, Homo sapiens
tgggaaagtgttgaggtgtctt

SEQ ID NO: 7225025 - DNA, 22 bp, Homo sapiens
tgggaaagtgttgaggtgtctt

SEQ ID NO: 7225026 - DNA, 22 bp, Homo sapiens
tgggaaagtgttgaggtgtctt

SEQ ID NO: 7225027 - DNA, 18 bp, Homo sapiens
tgggaaagtttatagaat

SEQ ID NO: 7225028 - DNA, 18 bp, Homo sapiens
tgggaaagtttatagaat

SEQ ID NO: 7225029 - DNA, 22 bp, Homo sapiens
tggctttgacttaccagaagtg

SEQ ID NO: 7225030 - DNA, 22 bp, Homo sapiens
tggctttgatggacagaggtca

SEQ ID NO: 7225031 - DNA, 22 bp, Homo sapiens
tggctttgatggacagaggtca

SEQ ID NO: 7225032 - DNA, 22 bp, Homo sapiens
tgggaaagactcaggacaggag

SEQ ID NO: 7225033 - DNA, 22 bp, Homo sapiens
tgggaaagactcaggacaggag

SEQ ID NO: 7225034 - DNA, 22 bp, Homo sapiens
tgggaaagactcaggacaggag

SEQ ID NO: 7225035 - DNA, 22 bp, Homo sapiens
tgggaaagactcaggacaggag

SEQ ID NO: 7225036 - DNA, 22 bp, Homo sapiens
tgggaaagactcaggacaggag

SEQ ID NO: 7225037 - DNA, 22 bp, Homo sapiens
tgggaaagactcaggacaggag

SEQ ID NO: 7225038 - DNA, 22 bp, Homo sapiens
tgggaaagccagcagtgtcacc

SEQ ID NO: 7225039 - DNA, 22 bp, Homo sapiens
tgggaaagccagcagtgtcacc

SEQ ID NO: 7225040 - DNA, 22 bp, Homo sapiens
tgggaaagccagcagtgtcacc

SEQ ID NO: 7225041 - DNA, 22 bp, Homo sapiens
tgggaaagctgcagaaattctc

SEQ ID NO: 7225042 - DNA, 22 bp, Homo sapiens
tgggaaagctgcagaaattctc

SEQ ID NO: 7225043 - DNA, 19 bp, Homo sapiens
tgggaaagtaacatacaaa

SEQ ID NO: 7225044 - DNA, 19 bp, Homo sapiens
tgggaaagtaacatacaaa

SEQ ID NO: 7225045 - DNA, 19 bp, Homo sapiens
tgggaaagtaacatacaaa

SEQ ID NO: 7225046 - DNA, 22 bp, Homo sapiens
tgggaaagtaattgtcatcctt

SEQ ID NO: 7225047 - DNA, 22 bp, Homo sapiens
tgggaaagtaattgtcatcctt

SEQ ID NO: 7225048 - DNA, 22 bp, Homo sapiens
tgggaaagtaattgtcatcctt

SEQ ID NO: 7225049 - DNA, 20 bp, Homo sapiens
tgggaaagtctaagtgcctc

SEQ ID NO: 7225050 - DNA, 20 bp, Homo sapiens
tgggaaagtctaagtgcctc

SEQ ID NO: 7225051 - DNA, 20 bp, Homo sapiens
tgggaaagtctaagtgcctc

SEQ ID NO: 7225052 - DNA, 20 bp, Homo sapiens
tgggaaagtctaagtgcctc

SEQ ID NO: 7225053 - DNA, 20 bp, Homo sapiens
tgggaaagtctaagtgcctc

SEQ ID NO: 7225054 - DNA, 22 bp, Homo sapiens
tggctttcccccagcccagttg

SEQ ID NO: 7225055 - DNA, 22 bp, Homo sapiens
tggctttatacttaagcacaat

SEQ ID NO: 7225056 - DNA, 22 bp, Homo sapiens
tggcttcttgacttcttggctg

SEQ ID NO: 7225057 - DNA, 18 bp, Homo sapiens
tggcttcttgagctaaca

SEQ ID NO: 7225058 - DNA, 22 bp, Homo sapiens
tggcttcttgatcttggacttg

SEQ ID NO: 7225059 - DNA, 22 bp, Homo sapiens
tggcttcttgggatgggtcatt

SEQ ID NO: 7225060 - DNA, 22 bp, Homo sapiens
tggcttctgagcattgaaacgt

SEQ ID NO: 7225061 - DNA, 22 bp, Homo sapiens
tggcttctgagtctcctgacat

SEQ ID NO: 7225062 - DNA, 22 bp, Homo sapiens
tggcttctctgtgtgagggaga

SEQ ID NO: 7225063 - DNA, 22 bp, Homo sapiens
tggcttctctgttttagtattt

SEQ ID NO: 7225064 - DNA, 20 bp, Homo sapiens
tggcttctcttcactcctgt

SEQ ID NO: 7225065 - DNA, 22 bp, Homo sapiens
tggcttctctggcatccccatc

SEQ ID NO: 7225066 - DNA, 22 bp, Homo sapiens
tggcttctctggcatccccatc

SEQ ID NO: 7225067 - DNA, 22 bp, Homo sapiens
tggcttctccctctgcctgatt

SEQ ID NO: 7225068 - DNA, 22 bp, Homo sapiens
tggcttctccctctgcctgatt

SEQ ID NO: 7225069 - DNA, 22 bp, Homo sapiens
tggcttctccctctgcctgatt

SEQ ID NO: 7225070 - DNA, 22 bp, Homo sapiens
tggcttctcgcctgtcatcccg

SEQ ID NO: 7225071 - DNA, 22 bp, Homo sapiens
tggcttctccctccccatctag

SEQ ID NO: 7225072 - DNA, 23 bp, Homo sapiens
tggcttctgccccattctctcca

SEQ ID NO: 7225073 - DNA, 22 bp, Homo sapiens
tggcttctgctcccagaatgat

SEQ ID NO: 7225074 - DNA, 22 bp, Homo sapiens
tggcttctgctttcagtggagg

SEQ ID NO: 7225075 - DNA, 22 bp, Homo sapiens
tggcttctgctttcagtggagg

SEQ ID NO: 7225076 - DNA, 22 bp, Homo sapiens
tggcttctggccaggcacagga

SEQ ID NO: 7225077 - DNA, 22 bp, Homo sapiens
tggcttctggctggtgagaaat

SEQ ID NO: 7225078 - DNA, 22 bp, Homo sapiens
tggcttctggctggtgagaaat

SEQ ID NO: 7225079 - DNA, 22 bp, Homo sapiens
tggcttctgggacttgtgagca

SEQ ID NO: 7225080 - DNA, 22 bp, Homo sapiens
tggcttctggtttatccttata

SEQ ID NO: 7225081 - DNA, 22 bp, Homo sapiens
tggcttctgtccctgctacatt

SEQ ID NO: 7225082 - DNA, 19 bp, Homo sapiens
tggcttctgttttcatgtt

SEQ ID NO: 7225083 - DNA, 22 bp, Homo sapiens
tggcttcctgtttcccagaaag

SEQ ID NO: 7225084 - DNA, 18 bp, Homo sapiens
tggcttcctgcgggctgc

SEQ ID NO: 7225085 - DNA, 22 bp, Homo sapiens
tggcttcctggacagatgcggt

SEQ ID NO: 7225086 - DNA, 22 bp, Homo sapiens
tggcttcctgtttcccagaaag

SEQ ID NO: 7225087 - DNA, 22 bp, Homo sapiens
tggcttctagagcccatccttc

SEQ ID NO: 7225088 - DNA, 22 bp, Homo sapiens
tggcttctagtttgaggaaaaa

SEQ ID NO: 7225089 - DNA, 22 bp, Homo sapiens
tggcttctattgctgtggcatt

SEQ ID NO: 7225090 - DNA, 22 bp, Homo sapiens
tggcttctattgctgtggcatt

SEQ ID NO: 7225091 - DNA, 22 bp, Homo sapiens
tggcttctcagaatactctgga

SEQ ID NO: 7225092 - DNA, 22 bp, Homo sapiens
tggcttctcagaatactctgga

SEQ ID NO: 7225093 - DNA, 22 bp, Homo sapiens
tggcttctcagtttcataatga

SEQ ID NO: 7225094 - DNA, 22 bp, Homo sapiens
tggcttctccagaaatcttggt

SEQ ID NO: 7225095 - DNA, 22 bp, Homo sapiens
tggcttccgccgcgggcctcgg

SEQ ID NO: 7225096 - DNA, 22 bp, Homo sapiens
tggcttcctaaactgatttcca

SEQ ID NO: 7225097 - DNA, 22 bp, Homo sapiens
tggcttcagagacagaatctat

SEQ ID NO: 7225098 - DNA, 22 bp, Homo sapiens
tggcttcacctcagcatgaagg

SEQ ID NO: 7225099 - DNA, 17 bp, Homo sapiens
tggcttcagatgtacat

SEQ ID NO: 7225100 - DNA, 23 bp, Homo sapiens
tggctggcagaaactgaagcatg

SEQ ID NO: 7225101 - DNA, 22 bp, Homo sapiens
tggctggcaaggctggagtcag

SEQ ID NO: 7225102 - DNA, 22 bp, Homo sapiens
tggctggcaaggctggagtcag

SEQ ID NO: 7225103 - DNA, 22 bp, Homo sapiens
tggctggattattggctagtac

SEQ ID NO: 7225104 - DNA, 22 bp, Homo sapiens
tggctggatgtgagatcaagag

SEQ ID NO: 7225105 - DNA, 22 bp, Homo sapiens
tggctggagtctggtgctagcc

SEQ ID NO: 7225106 - DNA, 22 bp, Homo sapiens
tggctggagtctggtgctagcc

SEQ ID NO: 7225107 - DNA, 22 bp, Homo sapiens
tggctggagtgggagaagttta

SEQ ID NO: 7225108 - DNA, 22 bp, Homo sapiens
tggctggatatcagaggaagtg

SEQ ID NO: 7225109 - DNA, 22 bp, Homo sapiens
tggctggatatcaggcaagggg

SEQ ID NO: 7225110 - DNA, 22 bp, Homo sapiens
tggctggatatcaggcaagggg

SEQ ID NO: 7225111 - DNA, 22 bp, Homo sapiens
tggctggacagtgggcagtgga

SEQ ID NO: 7225112 - DNA, 22 bp, Homo sapiens
tggctggagaacttggggatct

SEQ ID NO: 7225113 - DNA, 22 bp, Homo sapiens
tggctggagagggtcccatgag

SEQ ID NO: 7225114 - DNA, 19 bp, Homo sapiens
tggctggagatctgctact

SEQ ID NO: 7225115 - DNA, 19 bp, Homo sapiens
tggctggagatctgctact

SEQ ID NO: 7225116 - DNA, 22 bp, Homo sapiens
tggctggagcattccttgtctt

SEQ ID NO: 7225117 - DNA, 22 bp, Homo sapiens
tggctggagcccctcaagagca

SEQ ID NO: 7225118 - DNA, 22 bp, Homo sapiens
tggctggaggaaggaactgagg

SEQ ID NO: 7225119 - DNA, 22 bp, Homo sapiens
tggctggagggttagtgagata

SEQ ID NO: 7225120 - DNA, 22 bp, Homo sapiens
tggctggagggttagtgagata

SEQ ID NO: 7225121 - DNA, 22 bp, Homo sapiens
tggctggagtataggagtagga

SEQ ID NO: 7225122 - DNA, 22 bp, Homo sapiens
tggctggagtataggagtagga

SEQ ID NO: 7225123 - DNA, 22 bp, Homo sapiens
tggctggcgccgggctagccac

SEQ ID NO: 7225124 - DNA, 22 bp, Homo sapiens
tggctggccctgggagtgcaga

SEQ ID NO: 7225125 - DNA, 22 bp, Homo sapiens
tggctggcagttatctttggat

SEQ ID NO: 7225126 - DNA, 22 bp, Homo sapiens
tggctggcatagccattgctcc

SEQ ID NO: 7225127 - DNA, 22 bp, Homo sapiens
tggctggcatagccattgctcc

SEQ ID NO: 7225128 - DNA, 18 bp, Homo sapiens
tggctggcagtgggcagc

SEQ ID NO: 7225129 - DNA, 22 bp, Homo sapiens
tggctggcagtaggctagtggc

SEQ ID NO: 7225130 - DNA, 22 bp, Homo sapiens
tggctggctagtgggcaggatt

SEQ ID NO: 7225131 - DNA, 22 bp, Homo sapiens
tggctggctagaatggaaatgt

SEQ ID NO: 7225132 - DNA, 22 bp, Homo sapiens
tggctggcgttggggccagtga

SEQ ID NO: 7225133 - DNA, 22 bp, Homo sapiens
tggctgggagctggaactgggc

SEQ ID NO: 7225134 - DNA, 22 bp, Homo sapiens
tggctgggagctggaactgggc

SEQ ID NO: 7225135 - DNA, 22 bp, Homo sapiens
tggctgggagctggaactgggc

SEQ ID NO: 7225136 - DNA, 22 bp, Homo sapiens
tggctgggagctggaactgggc

SEQ ID NO: 7225137 - DNA, 22 bp, Homo sapiens
tggctgggcccccacctgcctc

SEQ ID NO: 7225138 - DNA, 22 bp, Homo sapiens
tggctgggcccccacctgcctc

SEQ ID NO: 7225139 - DNA, 22 bp, Homo sapiens
tggctgggcccccacctgcctc

SEQ ID NO: 7225140 - DNA, 22 bp, Homo sapiens
tggctgggcccccacctgcctc

SEQ ID NO: 7225141 - DNA, 22 bp, Homo sapiens
tggctgggcccccacctgcctc

SEQ ID NO: 7225142 - DNA, 22 bp, Homo sapiens
tggctgggccgggccttgtgcc

SEQ ID NO: 7225143 - DNA, 22 bp, Homo sapiens
tggctgggccgggccttgtgcc

SEQ ID NO: 7225144 - DNA, 22 bp, Homo sapiens
tggctgggccgggccttgtgcc

SEQ ID NO: 7225145 - DNA, 22 bp, Homo sapiens
tggctgggccgggccttgtgcc

SEQ ID NO: 7225146 - DNA, 22 bp, Homo sapiens
tggctgggccgggccttgtgcc

SEQ ID NO: 7225147 - DNA, 22 bp, Homo sapiens
tggctgtgttaccacttcatgt

SEQ ID NO: 7225148 - DNA, 23 bp, Homo sapiens
tggcttaacctcttcctatgtct

SEQ ID NO: 7225149 - DNA, 22 bp, Homo sapiens
tggctgttggagctggaagatg

SEQ ID NO: 7225150 - DNA, 22 bp, Homo sapiens
tggcttaaccttgtgagtgtta

SEQ ID NO: 7225151 - DNA, 22 bp, Homo sapiens
tggcttaagacgaaaagaaggg

SEQ ID NO: 7225152 - DNA, 22 bp, Homo sapiens
tggcttaagatttatgctttta

SEQ ID NO: 7225153 - DNA, 22 bp, Homo sapiens
tggcttaagatttatgctttta

SEQ ID NO: 7225154 - DNA, 22 bp, Homo sapiens
tggcttaagcgcaactctgtct

SEQ ID NO: 7225155 - DNA, 22 bp, Homo sapiens
tggcttaatatttcatatttaa

SEQ ID NO: 7225156 - DNA, 22 bp, Homo sapiens
tggctgtgtgccaggctgtctg

SEQ ID NO: 7225157 - DNA, 22 bp, Homo sapiens
tggctgtgtgccaggctgtctg

SEQ ID NO: 7225158 - DNA, 22 bp, Homo sapiens
tggcttaatttctctgtgcctc

SEQ ID NO: 7225159 - DNA, 22 bp, Homo sapiens
tggcttcaaaatctagtggtct

SEQ ID NO: 7225160 - DNA, 22 bp, Homo sapiens
tggcttatcacattgtccatgg

SEQ ID NO: 7225161 - DNA, 22 bp, Homo sapiens
tggcttcacaatttcataacta

SEQ ID NO: 7225162 - DNA, 22 bp, Homo sapiens
tggctgtgggatatgtgactga

SEQ ID NO: 7225163 - DNA, 22 bp, Homo sapiens
tggctgtgggatatgtgactga

SEQ ID NO: 7225164 - DNA, 22 bp, Homo sapiens
tggctgtgggatgagagcctca

SEQ ID NO: 7225165 - DNA, 22 bp, Homo sapiens
tggctgtgggatgagagcctca

SEQ ID NO: 7225166 - DNA, 20 bp, Homo sapiens
tggctgtgggcatctgtttc

SEQ ID NO: 7225167 - DNA, 20 bp, Homo sapiens
tggctgtgggcatctgtttc

SEQ ID NO: 7225168 - DNA, 19 bp, Homo sapiens
tggctgtggggaaatgctt

SEQ ID NO: 7225169 - DNA, 19 bp, Homo sapiens
tggctgtggggaaatgctt

SEQ ID NO: 7225170 - DNA, 22 bp, Homo sapiens
tggctgtgggtggaaggaaacc

SEQ ID NO: 7225171 - DNA, 22 bp, Homo sapiens
tggctgtggtttatcccagttc

SEQ ID NO: 7225172 - DNA, 22 bp, Homo sapiens
tggctgtgtcatcatagctgtg

SEQ ID NO: 7225173 - DNA, 22 bp, Homo sapiens
tggctgtgtcatcatagctgtg

SEQ ID NO: 7225174 - DNA, 22 bp, Homo sapiens
tggctgtggactcagatggctc

SEQ ID NO: 7225175 - DNA, 22 bp, Homo sapiens
tggctgtggactcagatggctc

SEQ ID NO: 7225176 - DNA, 22 bp, Homo sapiens
tggctgtggactcagatggctc

SEQ ID NO: 7225177 - DNA, 22 bp, Homo sapiens
tggctgtggactcagatggctc

SEQ ID NO: 7225178 - DNA, 22 bp, Homo sapiens
tggctgtgcctctttccaggcc

SEQ ID NO: 7225179 - DNA, 22 bp, Homo sapiens
tggctgtgcctctttccaggcc

SEQ ID NO: 7225180 - DNA, 22 bp, Homo sapiens
tggctgtgcctctttccaggcc

SEQ ID NO: 7225181 - DNA, 22 bp, Homo sapiens
tggctgtgcggcctcgggcaga

SEQ ID NO: 7225182 - DNA, 22 bp, Homo sapiens
tggctgtgcggcctcgggcaga

SEQ ID NO: 7225183 - DNA, 22 bp, Homo sapiens
tggctgtcagtcgcctgcattc

SEQ ID NO: 7225184 - DNA, 22 bp, Homo sapiens
tggctgtcatgcccttcttacc

SEQ ID NO: 7225185 - DNA, 22 bp, Homo sapiens
tggctgtgatttgcacgagatg

SEQ ID NO: 7225186 - DNA, 22 bp, Homo sapiens
tggctgtgatttgcacgagatg

SEQ ID NO: 7225187 - DNA, 22 bp, Homo sapiens
tggctgggtgctatccagtact

SEQ ID NO: 7225188 - DNA, 22 bp, Homo sapiens
tggctggtcacatggtaggtct

SEQ ID NO: 7225189 - DNA, 22 bp, Homo sapiens
tggctggtcacatggtaggtct

SEQ ID NO: 7225190 - DNA, 22 bp, Homo sapiens
tggctgggtgctatccagtact

SEQ ID NO: 7225191 - DNA, 22 bp, Homo sapiens
tggctgggtgctatccagtact

SEQ ID NO: 7225192 - DNA, 22 bp, Homo sapiens
tggctgggtgctatccagtact

SEQ ID NO: 7225193 - DNA, 21 bp, Homo sapiens
tggctggtggcagggcttctc

SEQ ID NO: 7225194 - DNA, 21 bp, Homo sapiens
tggctggtggcagggcttctc

SEQ ID NO: 7225195 - DNA, 22 bp, Homo sapiens
tggctgtacattggaattatct

SEQ ID NO: 7225196 - DNA, 22 bp, Homo sapiens
tggctgtcagctgcctggtgcg

SEQ ID NO: 7225197 - DNA, 19 bp, Homo sapiens
tggctgggtgccaatggcc

SEQ ID NO: 7225198 - DNA, 19 bp, Homo sapiens
tggctgggtgccaatggcc

SEQ ID NO: 7225199 - DNA, 19 bp, Homo sapiens
tggctgggtgccaatggcc

SEQ ID NO: 7225200 - DNA, 19 bp, Homo sapiens
tggctgggtgccaatggcc

SEQ ID NO: 7225201 - DNA, 19 bp, Homo sapiens
tggctgggtgccaatggcc

SEQ ID NO: 7225202 - DNA, 19 bp, Homo sapiens
tggctgggtgccaatggcc

SEQ ID NO: 7225203 - DNA, 19 bp, Homo sapiens
tggctgggtgccaatggcc

SEQ ID NO: 7225204 - DNA, 22 bp, Homo sapiens
tggctgggggtgctatagctgc

SEQ ID NO: 7225205 - DNA, 22 bp, Homo sapiens
tggctgggggtgctatagctgc

SEQ ID NO: 7225206 - DNA, 22 bp, Homo sapiens
tggctgggggtgctatagctgc

SEQ ID NO: 7225207 - DNA, 22 bp, Homo sapiens
tggctgggggtgctatagctgc

SEQ ID NO: 7225208 - DNA, 22 bp, Homo sapiens
tggctggggagccccgactccc

SEQ ID NO: 7225209 - DNA, 22 bp, Homo sapiens
tggctggggagccccgactccc

SEQ ID NO: 7225210 - DNA, 22 bp, Homo sapiens
tggctggggagccccgactccc

SEQ ID NO: 7225211 - DNA, 22 bp, Homo sapiens
tggctggggagccccgactccc

SEQ ID NO: 7225212 - DNA, 22 bp, Homo sapiens
tggctgggccgggccttgtgcc

SEQ ID NO: 7225213 - DNA, 22 bp, Homo sapiens
tggctgggccgggccttgtgcc

SEQ ID NO: 7225214 - DNA, 19 bp, Homo sapiens
tggctgggcgtgcctccgt

SEQ ID NO: 7225215 - DNA, 19 bp, Homo sapiens
tggctgggcgtgcctccgt

SEQ ID NO: 7225216 - DNA, 19 bp, Homo sapiens
tggctgggcgtgcctccgt

SEQ ID NO: 7225217 - DNA, 19 bp, Homo sapiens
tggctgggcgtgcctccgt

SEQ ID NO: 7225218 - DNA, 22 bp, Homo sapiens
tggctggggcctgaatcctgca

SEQ ID NO: 7225219 - DNA, 22 bp, Homo sapiens
tggctggggcctgaatcctgca

SEQ ID NO: 7225220 - DNA, 22 bp, Homo sapiens
tggctggggcctgaatcctgca

SEQ ID NO: 7225221 - DNA, 22 bp, Homo sapiens
tggctggggccacagttttcct

SEQ ID NO: 7225222 - DNA, 22 bp, Homo sapiens
tggctggggccacagttttcct

SEQ ID NO: 7225223 - DNA, 22 bp, Homo sapiens
tggctggggccacagttttcct

SEQ ID NO: 7225224 - DNA, 22 bp, Homo sapiens
tggctggggccacagttttcct

SEQ ID NO: 7225225 - DNA, 22 bp, Homo sapiens
tggcagtgccccttgaccagtg

SEQ ID NO: 7225226 - DNA, 23 bp, Homo sapiens
tggcagtgcccagggagatgatc

SEQ ID NO: 7225227 - DNA, 23 bp, Homo sapiens
tggcagtgcccagggagatgatc

SEQ ID NO: 7225228 - DNA, 22 bp, Homo sapiens
tggcagtgatgcggcaggacat

SEQ ID NO: 7225229 - DNA, 22 bp, Homo sapiens
tggcagtgatgcggcaggacat

SEQ ID NO: 7225230 - DNA, 22 bp, Homo sapiens
tggcagtgatgcggcaggacat

SEQ ID NO: 7225231 - DNA, 22 bp, Homo sapiens
tggcagtgatgcggcaggacat

SEQ ID NO: 7225232 - DNA, 22 bp, Homo sapiens
tggcagtgatgcggcaggacat

SEQ ID NO: 7225233 - DNA, 18 bp, Homo sapiens
tggcagtgaggtaggcat

SEQ ID NO: 7225234 - DNA, 18 bp, Homo sapiens
tggcagtgaggtaggcat

SEQ ID NO: 7225235 - DNA, 22 bp, Homo sapiens
tggcagtcttgtaggcatctcc

SEQ ID NO: 7225236 - DNA, 22 bp, Homo sapiens
tggcagtgaaccaaggctccaa

SEQ ID NO: 7225237 - DNA, 22 bp, Homo sapiens
tggcagtctgcctcttcaccat

SEQ ID NO: 7225238 - DNA, 22 bp, Homo sapiens
tggcagtctgggttggcagtta

SEQ ID NO: 7225239 - DNA, 22 bp, Homo sapiens
tggcagtctgggttggcagtta

SEQ ID NO: 7225240 - DNA, 22 bp, Homo sapiens
tggcagtcggacttctatctca

SEQ ID NO: 7225241 - DNA, 22 bp, Homo sapiens
tggcagtcccctgtgcctggaa

SEQ ID NO: 7225242 - DNA, 22 bp, Homo sapiens
tggcagtccagaccctggactc

SEQ ID NO: 7225243 - DNA, 22 bp, Homo sapiens
tggcagtcccctgtgcctggaa

SEQ ID NO: 7225244 - DNA, 22 bp, Homo sapiens
tggcaggttggcctttggttca

SEQ ID NO: 7225245 - DNA, 21 bp, Homo sapiens
tggcaggttcaaaggcctatc

SEQ ID NO: 7225246 - DNA, 21 bp, Homo sapiens
tggcaggttcaaaggcctatc

SEQ ID NO: 7225247 - DNA, 22 bp, Homo sapiens
tggcaggttggcctttggttca

SEQ ID NO: 7225248 - DNA, 22 bp, Homo sapiens
tggcaggtttcctcctcatagt

SEQ ID NO: 7225249 - DNA, 22 bp, Homo sapiens
tggcaggtttcgttaaaaatgg

SEQ ID NO: 7225250 - DNA, 16 bp, Homo sapiens
tggcaggtttttatct

SEQ ID NO: 7225251 - DNA, 22 bp, Homo sapiens
tggcagtagatccagtctctct

SEQ ID NO: 7225252 - DNA, 22 bp, Homo sapiens
tggcagtcattatcgctgagtc

SEQ ID NO: 7225253 - DNA, 22 bp, Homo sapiens
tggcagtccagaccctggactc

SEQ ID NO: 7225254 - DNA, 22 bp, Homo sapiens
tggcagggtgccagttgcgagt

SEQ ID NO: 7225255 - DNA, 22 bp, Homo sapiens
tggcagggtgccagttgcgagt

SEQ ID NO: 7225256 - DNA, 22 bp, Homo sapiens
tggcagggtgccagttgcgagt

SEQ ID NO: 7225257 - DNA, 22 bp, Homo sapiens
tggcagggtgccagttgcgagt

SEQ ID NO: 7225258 - DNA, 22 bp, Homo sapiens
tggcagggtgccagttgcgagt

SEQ ID NO: 7225259 - DNA, 22 bp, Homo sapiens
tggcagggtgccagttgcgagt

SEQ ID NO: 7225260 - DNA, 22 bp, Homo sapiens
tggcagggtggcaacttttggt

SEQ ID NO: 7225261 - DNA, 22 bp, Homo sapiens
tggcagggtggcaacttttggt

SEQ ID NO: 7225262 - DNA, 22 bp, Homo sapiens
tggcagggtgccagttgcgagt

SEQ ID NO: 7225263 - DNA, 22 bp, Homo sapiens
tggcagggtggcaacttttggt

SEQ ID NO: 7225264 - DNA, 22 bp, Homo sapiens
tggcagggtggcaacttttggt

SEQ ID NO: 7225265 - DNA, 22 bp, Homo sapiens
tggcagggtggcaacttttggt

SEQ ID NO: 7225266 - DNA, 22 bp, Homo sapiens
tggcaggtcatgagtggccacc

SEQ ID NO: 7225267 - DNA, 22 bp, Homo sapiens
tggcaggtcatgagtggccacc

SEQ ID NO: 7225268 - DNA, 22 bp, Homo sapiens
tggcagggtgccagttgcgagt

SEQ ID NO: 7225269 - DNA, 22 bp, Homo sapiens
tggcagggtacaccttaacacc

SEQ ID NO: 7225270 - DNA, 22 bp, Homo sapiens
tggcagggtacaccttaacacc

SEQ ID NO: 7225271 - DNA, 22 bp, Homo sapiens
tggcagggtcttgctgtgttgc

SEQ ID NO: 7225272 - DNA, 22 bp, Homo sapiens
tggcagggtcttgctgtgttgc

SEQ ID NO: 7225273 - DNA, 22 bp, Homo sapiens
tggcagggtcttgctgtgttgc

SEQ ID NO: 7225274 - DNA, 22 bp, Homo sapiens
tggcagggtcttgctgtgttgc

SEQ ID NO: 7225275 - DNA, 22 bp, Homo sapiens
tggcagggtcttgctgtgttgc

SEQ ID NO: 7225276 - DNA, 22 bp, Homo sapiens
tggcagggtcttgctgtgttgc

SEQ ID NO: 7225277 - DNA, 18 bp, Homo sapiens
tggcaggtccagctgtgg

SEQ ID NO: 7225278 - DNA, 18 bp, Homo sapiens
tggcaggtccagctgtgg

SEQ ID NO: 7225279 - DNA, 22 bp, Homo sapiens
tggcaggtgaagttgttaggga

SEQ ID NO: 7225280 - DNA, 22 bp, Homo sapiens
tggcaggtccactcacagatct

SEQ ID NO: 7225281 - DNA, 22 bp, Homo sapiens
tggcaggtccactcacagatct

SEQ ID NO: 7225282 - DNA, 18 bp, Homo sapiens
tggcaggtccagctgtgg

SEQ ID NO: 7225283 - DNA, 22 bp, Homo sapiens
tggcaggtgaagttgttaggga

SEQ ID NO: 7225284 - DNA, 22 bp, Homo sapiens
tggcaggtgcacttttggtttc

SEQ ID NO: 7225285 - DNA, 22 bp, Homo sapiens
tggcaggtgccatgggctcaga

SEQ ID NO: 7225286 - DNA, 22 bp, Homo sapiens
tggcaggtgcacttttggtttc

SEQ ID NO: 7225287 - DNA, 22 bp, Homo sapiens
tggcaggtgcctgtaatctcag

SEQ ID NO: 7225288 - DNA, 22 bp, Homo sapiens
tggcaggtggagacagcagagc

SEQ ID NO: 7225289 - DNA, 22 bp, Homo sapiens
tggcaggtggcacagcctggga

SEQ ID NO: 7225290 - DNA, 22 bp, Homo sapiens
tggcaggtggcacagcctggga

SEQ ID NO: 7225291 - DNA, 20 bp, Homo sapiens
tggcaggtggcctcagttcc

SEQ ID NO: 7225292 - DNA, 20 bp, Homo sapiens
tggcaggtggcctcagttcc

SEQ ID NO: 7225293 - DNA, 20 bp, Homo sapiens
tggcaggtggcctcagttcc

SEQ ID NO: 7225294 - DNA, 22 bp, Homo sapiens
tggcaggtggctctggcattct

SEQ ID NO: 7225295 - DNA, 23 bp, Homo sapiens
tggcaggtggttagatgttttgt

SEQ ID NO: 7225296 - DNA, 23 bp, Homo sapiens
tggcaggtggttagatgttttgt

SEQ ID NO: 7225297 - DNA, 22 bp, Homo sapiens
tggcaggttaacttacaactgt

SEQ ID NO: 7225298 - DNA, 22 bp, Homo sapiens
tggcaggttatgcgggccacat

SEQ ID NO: 7225299 - DNA, 22 bp, Homo sapiens
tggcatgataggaggtgcagaa

SEQ ID NO: 7225300 - DNA, 17 bp, Homo sapiens
tggcatgagggtgtggg

SEQ ID NO: 7225301 - DNA, 19 bp, Homo sapiens
tggcatgatgatggatggg

SEQ ID NO: 7225302 - DNA, 22 bp, Homo sapiens
tggcatgataggaggtgcagaa

SEQ ID NO: 7225303 - DNA, 22 bp, Homo sapiens
tggcatgcaagaggaggctccc

SEQ ID NO: 7225304 - DNA, 22 bp, Homo sapiens
tggcatggactagtgctgaggt

SEQ ID NO: 7225305 - DNA, 22 bp, Homo sapiens
tggcatggactagtgctgaggt

SEQ ID NO: 7225306 - DNA, 22 bp, Homo sapiens
tggcatgccttgtcagacagtg

SEQ ID NO: 7225307 - DNA, 22 bp, Homo sapiens
tggcatgcggcaacacgtcggt

SEQ ID NO: 7225308 - DNA, 22 bp, Homo sapiens
tggcatgctatgggcaaaaggg

SEQ ID NO: 7225309 - DNA, 18 bp, Homo sapiens
tggcatgctttgatacat

SEQ ID NO: 7225310 - DNA, 22 bp, Homo sapiens
tggcatgcacagccctgttcgg

SEQ ID NO: 7225311 - DNA, 22 bp, Homo sapiens
tggcatgcaagaggaggctccc

SEQ ID NO: 7225312 - DNA, 21 bp, Homo sapiens
tggcatgcagtgttcctgtgc

SEQ ID NO: 7225313 - DNA, 22 bp, Homo sapiens
tggcatgcatctgttgtcctag

SEQ ID NO: 7225314 - DNA, 22 bp, Homo sapiens
tggcatgcattgtgggtaatta

SEQ ID NO: 7225315 - DNA, 22 bp, Homo sapiens
tggcatgccttgtcagacagtg

SEQ ID NO: 7225316 - DNA, 22 bp, Homo sapiens
tggcatctttgtcccagaagct

SEQ ID NO: 7225317 - DNA, 17 bp, Homo sapiens
tggcatcttttgctcat

SEQ ID NO: 7225318 - DNA, 22 bp, Homo sapiens
tggcatctcaaacaggcagatt

SEQ ID NO: 7225319 - DNA, 22 bp, Homo sapiens
tggcatctccgacagtcttgat

SEQ ID NO: 7225320 - DNA, 20 bp, Homo sapiens
tggcatctctcaattgtagg

SEQ ID NO: 7225321 - DNA, 19 bp, Homo sapiens
tggcatctgggccctccag

SEQ ID NO: 7225322 - DNA, 22 bp, Homo sapiens
tggcatctgtgttgcggttgtc

SEQ ID NO: 7225323 - DNA, 23 bp, Homo sapiens
tggcatcttggcatcttgctgct

SEQ ID NO: 7225324 - DNA, 22 bp, Homo sapiens
tggcatggggcagaacattaca

SEQ ID NO: 7225325 - DNA, 22 bp, Homo sapiens
tggcatgggtggagagagcaca

SEQ ID NO: 7225326 - DNA, 22 bp, Homo sapiens
tggcatgggccagggagagctg

SEQ ID NO: 7225327 - DNA, 22 bp, Homo sapiens
tggcatgggccagggagagctg

SEQ ID NO: 7225328 - DNA, 22 bp, Homo sapiens
tggcatgggcaaaccagggaaa

SEQ ID NO: 7225329 - DNA, 22 bp, Homo sapiens
tggcatggcgtggcatcgtgtg

SEQ ID NO: 7225330 - DNA, 22 bp, Homo sapiens
tggcatggctactggaatggcg

SEQ ID NO: 7225331 - DNA, 22 bp, Homo sapiens
tggcatggcgtggcatcgtgtg

SEQ ID NO: 7225332 - DNA, 22 bp, Homo sapiens
tggcatggcgtggcatcgtgtg

SEQ ID NO: 7225333 - DNA, 22 bp, Homo sapiens
tggcatggactagtgctgaggt

SEQ ID NO: 7225334 - DNA, 21 bp, Homo sapiens
tggcatggaggtagcagtgtg

SEQ ID NO: 7225335 - DNA, 21 bp, Homo sapiens
tggcatggaggtagcagtgtg

SEQ ID NO: 7225336 - DNA, 22 bp, Homo sapiens
tggcatggcaaccctgcaggga

SEQ ID NO: 7225337 - DNA, 22 bp, Homo sapiens
tggcatggagtggatggcccca

SEQ ID NO: 7225338 - DNA, 22 bp, Homo sapiens
tggcatggcaaccctgcaggga

SEQ ID NO: 7225339 - DNA, 22 bp, Homo sapiens
tggcatggccagtgctgggagt

SEQ ID NO: 7225340 - DNA, 22 bp, Homo sapiens
tggcatggccagtgctgggagt

SEQ ID NO: 7225341 - DNA, 22 bp, Homo sapiens
tggcagtggctcagagtgcaga

SEQ ID NO: 7225342 - DNA, 22 bp, Homo sapiens
tggcagtggctcagagtgcaga

SEQ ID NO: 7225343 - DNA, 22 bp, Homo sapiens
tggcagtggctcagagtgcaga

SEQ ID NO: 7225344 - DNA, 19 bp, Homo sapiens
tggcagtgtggggtatgaa

SEQ ID NO: 7225345 - DNA, 22 bp, Homo sapiens
tggcagtgtttctaaggggctc

SEQ ID NO: 7225346 - DNA, 22 bp, Homo sapiens
tggcagtgtttctaaggggctc

SEQ ID NO: 7225347 - DNA, 22 bp, Homo sapiens
tggcagtgccccttgaccagtg

SEQ ID NO: 7225348 - DNA, 22 bp, Homo sapiens
tggcagtggataggggagcggt

SEQ ID NO: 7225349 - DNA, 18 bp, Homo sapiens
tggcataaaatcagagtc

SEQ ID NO: 7225350 - DNA, 23 bp, Homo sapiens
tggcatagtgaggggcacagaga

SEQ ID NO: 7225351 - DNA, 22 bp, Homo sapiens
tggcagtttacagagttctgaa

SEQ ID NO: 7225352 - DNA, 22 bp, Homo sapiens
tggcagtttcatgtgattcaac

SEQ ID NO: 7225353 - DNA, 22 bp, Homo sapiens
tggcagttattaatcaagtctt

SEQ ID NO: 7225354 - DNA, 22 bp, Homo sapiens
tggcagttcaggctgcaatcat

SEQ ID NO: 7225355 - DNA, 22 bp, Homo sapiens
tggcagttctaattgaccattt

SEQ ID NO: 7225356 - DNA, 22 bp, Homo sapiens
tggcagttggggatgaagtgag

SEQ ID NO: 7225357 - DNA, 22 bp, Homo sapiens
tggcagttgtgaggttcatatt

SEQ ID NO: 7225358 - DNA, 21 bp, Homo sapiens
tggcatacagtggttttcccc

SEQ ID NO: 7225359 - DNA, 23 bp, Homo sapiens
tggcatagtgaggggcacagaga

SEQ ID NO: 7225360 - DNA, 22 bp, Homo sapiens
tggcatataaagatgtgttcaa

SEQ ID NO: 7225361 - DNA, 22 bp, Homo sapiens
tggcatatgattcttggcatcc

SEQ ID NO: 7225362 - DNA, 22 bp, Homo sapiens
tggcatcacctccacgatcatc

SEQ ID NO: 7225363 - DNA, 22 bp, Homo sapiens
tggcatcacctccacgatcatc

SEQ ID NO: 7225364 - DNA, 22 bp, Homo sapiens
tggcatatgattcttggcatcc

SEQ ID NO: 7225365 - DNA, 22 bp, Homo sapiens
tggcatcattttcagctggcca

SEQ ID NO: 7225366 - DNA, 22 bp, Homo sapiens
tggcatccagataccctgaggg

SEQ ID NO: 7225367 - DNA, 22 bp, Homo sapiens
tggcatccagccatgtgatttt

SEQ ID NO: 7225368 - DNA, 22 bp, Homo sapiens
tggcatcctctcttctgagtgc

SEQ ID NO: 7225369 - DNA, 22 bp, Homo sapiens
tggccagaaggtttaaaagagg

SEQ ID NO: 7225370 - DNA, 22 bp, Homo sapiens
tggccagaactcagacatgtgg

SEQ ID NO: 7225371 - DNA, 22 bp, Homo sapiens
tggccagaactcagacatgtgg

SEQ ID NO: 7225372 - DNA, 22 bp, Homo sapiens
tggccagaactcagacatgtgg

SEQ ID NO: 7225373 - DNA, 22 bp, Homo sapiens
tggccagaacctgcagtaggcc

SEQ ID NO: 7225374 - DNA, 22 bp, Homo sapiens
tggccagaacctgcagtaggcc

SEQ ID NO: 7225375 - DNA, 22 bp, Homo sapiens
tggccagaactcagacatgtgg

SEQ ID NO: 7225376 - DNA, 22 bp, Homo sapiens
tggccagacagagaggctttgt

SEQ ID NO: 7225377 - DNA, 22 bp, Homo sapiens
tggccagacctgactgtcaggg

SEQ ID NO: 7225378 - DNA, 17 bp, Homo sapiens
tggccagagcaggcccc

SEQ ID NO: 7225379 - DNA, 22 bp, Homo sapiens
tggccagagtccagtgagcctt

SEQ ID NO: 7225380 - DNA, 19 bp, Homo sapiens
tggccacctctgctgttct

SEQ ID NO: 7225381 - DNA, 20 bp, Homo sapiens
tggccacctgcgtcccagcc

SEQ ID NO: 7225382 - DNA, 22 bp, Homo sapiens
tggccaccttatggctattgga

SEQ ID NO: 7225383 - DNA, 22 bp, Homo sapiens
tggccactcctccctgcaggct

SEQ ID NO: 7225384 - DNA, 22 bp, Homo sapiens
tggccacccctttctctgcact

SEQ ID NO: 7225385 - DNA, 22 bp, Homo sapiens
tggccacccctttctctgcact

SEQ ID NO: 7225386 - DNA, 22 bp, Homo sapiens
tggccacccctttctctgcact

SEQ ID NO: 7225387 - DNA, 22 bp, Homo sapiens
tggccacccctttctctgcact

SEQ ID NO: 7225388 - DNA, 22 bp, Homo sapiens
tggccacccccaatgtcagtag

SEQ ID NO: 7225389 - DNA, 22 bp, Homo sapiens
tggccaccaccaatacttgcct

SEQ ID NO: 7225390 - DNA, 22 bp, Homo sapiens
tggccacatgcgtctgtgaggc

SEQ ID NO: 7225391 - DNA, 22 bp, Homo sapiens
tggccaccaccaatacttgcct

SEQ ID NO: 7225392 - DNA, 22 bp, Homo sapiens
tggccacatgcgtctgtgaggc

SEQ ID NO: 7225393 - DNA, 22 bp, Homo sapiens
tggccacagtgtccagcagcag

SEQ ID NO: 7225394 - DNA, 22 bp, Homo sapiens
tggccacagtgtccagcagcag

SEQ ID NO: 7225395 - DNA, 22 bp, Homo sapiens
tggccacagtgtccagcagcag

SEQ ID NO: 7225396 - DNA, 22 bp, Homo sapiens
tggccacagtgtccagcagcag

SEQ ID NO: 7225397 - DNA, 22 bp, Homo sapiens
tggccacagtgtccagcagcag

SEQ ID NO: 7225398 - DNA, 22 bp, Homo sapiens
tggccacatatgtgggacagct

SEQ ID NO: 7225399 - DNA, 22 bp, Homo sapiens
tggccacagtgtccagcagcag

SEQ ID NO: 7225400 - DNA, 22 bp, Homo sapiens
tggccacagtgtccagcagcag

SEQ ID NO: 7225401 - DNA, 22 bp, Homo sapiens
tggccacatatgtgggacagct

SEQ ID NO: 7225402 - DNA, 22 bp, Homo sapiens
tggccacatatgtgggacagct

SEQ ID NO: 7225403 - DNA, 22 bp, Homo sapiens
tggccacatatgtgggacagct

SEQ ID NO: 7225404 - DNA, 22 bp, Homo sapiens
tggccacatcctttccttgtca

SEQ ID NO: 7225405 - DNA, 22 bp, Homo sapiens
tggccacatcctttccttgtca

SEQ ID NO: 7225406 - DNA, 22 bp, Homo sapiens
tggccacatcctttccttgtca

SEQ ID NO: 7225407 - DNA, 22 bp, Homo sapiens
tggccacatctgaaatgagtgt

SEQ ID NO: 7225408 - DNA, 22 bp, Homo sapiens
tggccacatgcgtctgtgaggc

SEQ ID NO: 7225409 - DNA, 22 bp, Homo sapiens
tggccacatgcgtctgtgaggc

SEQ ID NO: 7225410 - DNA, 22 bp, Homo sapiens
tggcattgcttctgaagtggag

SEQ ID NO: 7225411 - DNA, 22 bp, Homo sapiens
tggcattggtaccaaagctgta

SEQ ID NO: 7225412 - DNA, 22 bp, Homo sapiens
tggcattggttgccaggctgtg

SEQ ID NO: 7225413 - DNA, 22 bp, Homo sapiens
tggcatgttctcttagcagctc

SEQ ID NO: 7225414 - DNA, 22 bp, Homo sapiens
tggcatgttgagaggcaagatt

SEQ ID NO: 7225415 - DNA, 22 bp, Homo sapiens
tggcatgtttaaatggcaataa

SEQ ID NO: 7225416 - DNA, 22 bp, Homo sapiens
tggcatgtttaatgtactgtat

SEQ ID NO: 7225417 - DNA, 22 bp, Homo sapiens
tggcatgtttcatggctgcaaa

SEQ ID NO: 7225418 - DNA, 22 bp, Homo sapiens
tggcatgtttcatggctgcaaa

SEQ ID NO: 7225419 - DNA, 22 bp, Homo sapiens
tggcatgtttgcttgtgcatat

SEQ ID NO: 7225420 - DNA, 19 bp, Homo sapiens
tggcatgtttggctaagga

SEQ ID NO: 7225421 - DNA, 22 bp, Homo sapiens
tggcatggtcaaggctatgtta

SEQ ID NO: 7225422 - DNA, 22 bp, Homo sapiens
tggcatggtggagtgacgggca

SEQ ID NO: 7225423 - DNA, 22 bp, Homo sapiens
tggcatgtaacatctccagatt

SEQ ID NO: 7225424 - DNA, 22 bp, Homo sapiens
tggcatgtaacatctccagatt

SEQ ID NO: 7225425 - DNA, 22 bp, Homo sapiens
tggcatgtacccaggaatggac

SEQ ID NO: 7225426 - DNA, 22 bp, Homo sapiens
tggcatgtagtaggtgctataa

SEQ ID NO: 7225427 - DNA, 22 bp, Homo sapiens
tggcatgtattagttggcagtt

SEQ ID NO: 7225428 - DNA, 22 bp, Homo sapiens
tggcatgtccacttcaacagtt

SEQ ID NO: 7225429 - DNA, 22 bp, Homo sapiens
tggcatgtggcagctggttcag

SEQ ID NO: 7225430 - DNA, 22 bp, Homo sapiens
tggcatgtggcagctggttcag

SEQ ID NO: 7225431 - DNA, 22 bp, Homo sapiens
tggcatgtggctttgagtcatc

SEQ ID NO: 7225432 - DNA, 22 bp, Homo sapiens
tggcatgttaaataagatcata

SEQ ID NO: 7225433 - DNA, 22 bp, Homo sapiens
tggcatttagttgcgtattgca

SEQ ID NO: 7225434 - DNA, 22 bp, Homo sapiens
tggcattgtcagaataagtgac

SEQ ID NO: 7225435 - DNA, 22 bp, Homo sapiens
tggcatttcagtattttcataa

SEQ ID NO: 7225436 - DNA, 22 bp, Homo sapiens
tggcatttctggccatttgtgt

SEQ ID NO: 7225437 - DNA, 22 bp, Homo sapiens
tggcatttctgttagactctca

SEQ ID NO: 7225438 - DNA, 22 bp, Homo sapiens
tggccacacccacctagaggag

SEQ ID NO: 7225439 - DNA, 22 bp, Homo sapiens
tggccacacccacctagaggag

SEQ ID NO: 7225440 - DNA, 22 bp, Homo sapiens
tggccacactgcccccactggg

SEQ ID NO: 7225441 - DNA, 22 bp, Homo sapiens
tggccacactgcccccactggg

SEQ ID NO: 7225442 - DNA, 22 bp, Homo sapiens
tggccacagcctctgccagttc

SEQ ID NO: 7225443 - DNA, 22 bp, Homo sapiens
tggccacagcctctgccagttc

SEQ ID NO: 7225444 - DNA, 22 bp, Homo sapiens
tggccacagcctctgccagttc

SEQ ID NO: 7225445 - DNA, 23 bp, Homo sapiens
tggccacagggtgctccattgta

SEQ ID NO: 7225446 - DNA, 23 bp, Homo sapiens
tggccacagtccatgcatgccca

SEQ ID NO: 7225447 - DNA, 23 bp, Homo sapiens
tggccacagtccatgcatgccca

SEQ ID NO: 7225448 - DNA, 23 bp, Homo sapiens
tggccacagtccatgcatgccca

SEQ ID NO: 7225449 - DNA, 22 bp, Homo sapiens
tggccaggtgtgggttctcaga

SEQ ID NO: 7225450 - DNA, 23 bp, Homo sapiens
tggccaggtagaggaggtagtga

SEQ ID NO: 7225451 - DNA, 23 bp, Homo sapiens
tggccaggtagaggaggtagtga

SEQ ID NO: 7225452 - DNA, 23 bp, Homo sapiens
tggccaggtagaggaggtagtga

SEQ ID NO: 7225453 - DNA, 23 bp, Homo sapiens
tggccaggtagaggaggtagtga

SEQ ID NO: 7225454 - DNA, 23 bp, Homo sapiens
tggccaggtagaggaggtagtga

SEQ ID NO: 7225455 - DNA, 19 bp, Homo sapiens
tggccaggtactgtctgct

SEQ ID NO: 7225456 - DNA, 22 bp, Homo sapiens
tggccaggttgggctttgcagc

SEQ ID NO: 7225457 - DNA, 22 bp, Homo sapiens
tggccaggttgggctttgcagc

SEQ ID NO: 7225458 - DNA, 22 bp, Homo sapiens
tggccaggttgggctttgcagc

SEQ ID NO: 7225459 - DNA, 22 bp, Homo sapiens
tggccagtaatagcttctggtg

SEQ ID NO: 7225460 - DNA, 22 bp, Homo sapiens
tggccagtaatagcttctggtg

SEQ ID NO: 7225461 - DNA, 22 bp, Homo sapiens
tggccagtagagctcagatagt

SEQ ID NO: 7225462 - DNA, 22 bp, Homo sapiens
tggccagtagataggcaggcaa

SEQ ID NO: 7225463 - DNA, 22 bp, Homo sapiens
tggccagtagataggcaggcaa

SEQ ID NO: 7225464 - DNA, 19 bp, Homo sapiens
tggccaggtactgtctgct

SEQ ID NO: 7225465 - DNA, 19 bp, Homo sapiens
tggccaggtactgtctgct

SEQ ID NO: 7225466 - DNA, 19 bp, Homo sapiens
tggccaggtactgtctgct

SEQ ID NO: 7225467 - DNA, 19 bp, Homo sapiens
tggccaggtactgtctgct

SEQ ID NO: 7225468 - DNA, 23 bp, Homo sapiens
tggccagggtactacacccaccc

SEQ ID NO: 7225469 - DNA, 23 bp, Homo sapiens
tggccagggtactacacccaccc

SEQ ID NO: 7225470 - DNA, 22 bp, Homo sapiens
tggccaggctggtctggaacgc

SEQ ID NO: 7225471 - DNA, 22 bp, Homo sapiens
tggccaggctggtctggaacgc

SEQ ID NO: 7225472 - DNA, 22 bp, Homo sapiens
tggccaggcctcttggtgccca

SEQ ID NO: 7225473 - DNA, 22 bp, Homo sapiens
tggccaggctggtctggaacgc

SEQ ID NO: 7225474 - DNA, 22 bp, Homo sapiens
tggccaggcctcttggtgccca

SEQ ID NO: 7225475 - DNA, 22 bp, Homo sapiens
tggccaggcctcttggtgccca

SEQ ID NO: 7225476 - DNA, 22 bp, Homo sapiens
tggccaggctggtctggaacgc

SEQ ID NO: 7225477 - DNA, 22 bp, Homo sapiens
tggccaggggagttcccctcca

SEQ ID NO: 7225478 - DNA, 22 bp, Homo sapiens
tggccaggggagttcccctcca

SEQ ID NO: 7225479 - DNA, 22 bp, Homo sapiens
tggccaggggagttcccctcca

SEQ ID NO: 7225480 - DNA, 22 bp, Homo sapiens
tggccagcccttcagccatgcc

SEQ ID NO: 7225481 - DNA, 22 bp, Homo sapiens
tggccagcccttcagccatgcc

SEQ ID NO: 7225482 - DNA, 22 bp, Homo sapiens
tggccagcccttcagccatgcc

SEQ ID NO: 7225483 - DNA, 22 bp, Homo sapiens
tggccagccataaaagaaccca

SEQ ID NO: 7225484 - DNA, 22 bp, Homo sapiens
tggccagcccttcagccatgcc

SEQ ID NO: 7225485 - DNA, 22 bp, Homo sapiens
tggccagcccttcagccatgcc

SEQ ID NO: 7225486 - DNA, 22 bp, Homo sapiens
tggccagagtccagtgagcctt

SEQ ID NO: 7225487 - DNA, 22 bp, Homo sapiens
tggccagattcatgcatgtatc

SEQ ID NO: 7225488 - DNA, 22 bp, Homo sapiens
tggccagattcatgcatgtatc

SEQ ID NO: 7225489 - DNA, 22 bp, Homo sapiens
tggccagcagagttcactctct

SEQ ID NO: 7225490 - DNA, 22 bp, Homo sapiens
tggccagcagagttcactctct

SEQ ID NO: 7225491 - DNA, 22 bp, Homo sapiens
tggccagccagaaagaagcctt

SEQ ID NO: 7225492 - DNA, 21 bp, Homo sapiens
tggccagctggagtctccaca

SEQ ID NO: 7225493 - DNA, 22 bp, Homo sapiens
tggccaggcattcagataagac

SEQ ID NO: 7225494 - DNA, 21 bp, Homo sapiens
tggccagctgctcgtctcctc

SEQ ID NO: 7225495 - DNA, 21 bp, Homo sapiens
tggccagctggagtctccaca

SEQ ID NO: 7225496 - DNA, 22 bp, Homo sapiens
tggccagccttgtcatcgcttt

SEQ ID NO: 7225497 - DNA, 22 bp, Homo sapiens
tggccagccttgtcatcgcttt

SEQ ID NO: 7225498 - DNA, 21 bp, Homo sapiens
tggccagctgctcgtctcctc

SEQ ID NO: 7225499 - DNA, 22 bp, Homo sapiens
tggccaggccggggacagaact

SEQ ID NO: 7225500 - DNA, 22 bp, Homo sapiens
tggccaggccggggacagaact

SEQ ID NO: 7225501 - DNA, 17 bp, Homo sapiens
tggccaggccccgccag

SEQ ID NO: 7225502 - DNA, 17 bp, Homo sapiens
tggccaggccccgccag

SEQ ID NO: 7225503 - DNA, 22 bp, Homo sapiens
tggccaggcctcttggtgccca

SEQ ID NO: 7225504 - DNA, 22 bp, Homo sapiens
tggccaggcctcttggtgccca

SEQ ID NO: 7225505 - DNA, 22 bp, Homo sapiens
tggccaggcctcttggtgccca

SEQ ID NO: 7225506 - DNA, 22 bp, Homo sapiens
tggccaggccggggacagaact

SEQ ID NO: 7225507 - DNA, 22 bp, Homo sapiens
tggccaggccggggacagaact

SEQ ID NO: 7225508 - DNA, 22 bp, Homo sapiens
tggcccagagcactgctgggca

SEQ ID NO: 7225509 - DNA, 22 bp, Homo sapiens
tggcccagagcactgctgggca

SEQ ID NO: 7225510 - DNA, 22 bp, Homo sapiens
tggcccagagcactgctgggca

SEQ ID NO: 7225511 - DNA, 15 bp, Homo sapiens
tggcccacccgttga

SEQ ID NO: 7225512 - DNA, 22 bp, Homo sapiens
tggcccagactctgctcttatc

SEQ ID NO: 7225513 - DNA, 21 bp, Homo sapiens
tggccatttatccttatgaga

SEQ ID NO: 7225514 - DNA, 22 bp, Homo sapiens
tggcccaaagcagcccagcagg

SEQ ID NO: 7225515 - DNA, 22 bp, Homo sapiens
tggcccagctgcagatggtgga

SEQ ID NO: 7225516 - DNA, 22 bp, Homo sapiens
tggcccagctgcagatggtgga

SEQ ID NO: 7225517 - DNA, 22 bp, Homo sapiens
tggcccagctcagggtgggcgg

SEQ ID NO: 7225518 - DNA, 22 bp, Homo sapiens
tggcccagctgcagatggtgga

SEQ ID NO: 7225519 - DNA, 22 bp, Homo sapiens
tggcccagctgcagatggtgga

SEQ ID NO: 7225520 - DNA, 22 bp, Homo sapiens
tggcccagctcagggtgggcgg

SEQ ID NO: 7225521 - DNA, 22 bp, Homo sapiens
tggcccagctcagggtgggcgg

SEQ ID NO: 7225522 - DNA, 22 bp, Homo sapiens
tggcccagctcagggtgggcgg

SEQ ID NO: 7225523 - DNA, 22 bp, Homo sapiens
tggcccagctcagggtgggcgg

SEQ ID NO: 7225524 - DNA, 22 bp, Homo sapiens
tggcccagccctgctctagggc

SEQ ID NO: 7225525 - DNA, 22 bp, Homo sapiens
tggccatgaaggaggcagcaga

SEQ ID NO: 7225526 - DNA, 22 bp, Homo sapiens
tggccatgaaggaggcagcaga

SEQ ID NO: 7225527 - DNA, 22 bp, Homo sapiens
tggccagtgttggctagggaca

SEQ ID NO: 7225528 - DNA, 22 bp, Homo sapiens
tggccagtttgctcaggcagtc

SEQ ID NO: 7225529 - DNA, 22 bp, Homo sapiens
tggccagtttgctcaggcagtc

SEQ ID NO: 7225530 - DNA, 22 bp, Homo sapiens
tggccagtttgctcaggcagtc

SEQ ID NO: 7225531 - DNA, 22 bp, Homo sapiens
tggccatgacatggaggctttg

SEQ ID NO: 7225532 - DNA, 22 bp, Homo sapiens
tggccatgacatggaggctttg

SEQ ID NO: 7225533 - DNA, 22 bp, Homo sapiens
tggccatgggatagtgcagggg

SEQ ID NO: 7225534 - DNA, 22 bp, Homo sapiens
tggccatgggatagtgcagggg

SEQ ID NO: 7225535 - DNA, 22 bp, Homo sapiens
tggccagtctgtggaagccagg

SEQ ID NO: 7225536 - DNA, 22 bp, Homo sapiens
tggccagtcttagctgtgcctg

SEQ ID NO: 7225537 - DNA, 22 bp, Homo sapiens
tggccagtgcctgccagtgcag

SEQ ID NO: 7225538 - DNA, 22 bp, Homo sapiens
tggccagtggactaagttctga

SEQ ID NO: 7225539 - DNA, 22 bp, Homo sapiens
tggccagtggggttgagcagga

SEQ ID NO: 7225540 - DNA, 22 bp, Homo sapiens
tggccagtggggttgagcagga

SEQ ID NO: 7225541 - DNA, 22 bp, Homo sapiens
tggccagtgtcggaggccagga

SEQ ID NO: 7225542 - DNA, 22 bp, Homo sapiens
tggccagtgtcggaggccagga

SEQ ID NO: 7225543 - DNA, 22 bp, Homo sapiens
tggccagtgttggctagggaca

SEQ ID NO: 7225544 - DNA, 22 bp, Homo sapiens
tggcccagggagttcatggtgt

SEQ ID NO: 7225545 - DNA, 22 bp, Homo sapiens
tggcccagggcacagcagggag

SEQ ID NO: 7225546 - DNA, 22 bp, Homo sapiens
tggcccagggcacagcagggag

SEQ ID NO: 7225547 - DNA, 22 bp, Homo sapiens
tggcccagggcacagcagggag

SEQ ID NO: 7225548 - DNA, 22 bp, Homo sapiens
tggcccagggcacagcagggag

SEQ ID NO: 7225549 - DNA, 22 bp, Homo sapiens
tggcccaggggctcttggtgtt

SEQ ID NO: 7225550 - DNA, 22 bp, Homo sapiens
tggcccaggggctcttggtgtt

SEQ ID NO: 7225551 - DNA, 22 bp, Homo sapiens
tggcccaggggctcttggtgtt

SEQ ID NO: 7225552 - DNA, 22 bp, Homo sapiens
tggcccaggggctcttggtgtt

SEQ ID NO: 7225553 - DNA, 22 bp, Homo sapiens
tggcccaggggctcttggtgtt

SEQ ID NO: 7225554 - DNA, 22 bp, Homo sapiens
tggcccaggtgcaagagacaga

SEQ ID NO: 7225555 - DNA, 22 bp, Homo sapiens
tggcccaggtgcaagagacaga

SEQ ID NO: 7225556 - DNA, 22 bp, Homo sapiens
tggcccagggtctacagcctca

SEQ ID NO: 7225557 - DNA, 22 bp, Homo sapiens
tggcccagggtctacagcctca

SEQ ID NO: 7225558 - DNA, 22 bp, Homo sapiens
tggcccagggtctacagcctca

SEQ ID NO: 7225559 - DNA, 22 bp, Homo sapiens
tggcccaggtctctctgagccc

SEQ ID NO: 7225560 - DNA, 22 bp, Homo sapiens
tggcccaggtctctctgagccc

SEQ ID NO: 7225561 - DNA, 22 bp, Homo sapiens
tggcccaggtctctctgagccc

SEQ ID NO: 7225562 - DNA, 22 bp, Homo sapiens
tggcccaggccaaagccctgga

SEQ ID NO: 7225563 - DNA, 22 bp, Homo sapiens
tggcccaggccaaagccctgga

SEQ ID NO: 7225564 - DNA, 22 bp, Homo sapiens
tggcccaggccaaagccctgga

SEQ ID NO: 7225565 - DNA, 22 bp, Homo sapiens
tggcccaggccaaagccctgga

SEQ ID NO: 7225566 - DNA, 22 bp, Homo sapiens
tggcccaggccaaagccctgga

SEQ ID NO: 7225567 - DNA, 22 bp, Homo sapiens
tggcccaggccaaagccctgga

SEQ ID NO: 7225568 - DNA, 22 bp, Homo sapiens
tggcccaggaggccagagggca

SEQ ID NO: 7225569 - DNA, 22 bp, Homo sapiens
tggcccagctgcagatggtgga

SEQ ID NO: 7225570 - DNA, 22 bp, Homo sapiens
tggcccagctgcagatggtgga

SEQ ID NO: 7225571 - DNA, 22 bp, Homo sapiens
tggcccaggaggccagagggca

SEQ ID NO: 7225572 - DNA, 22 bp, Homo sapiens
tggcccaggaggccagagggca

SEQ ID NO: 7225573 - DNA, 22 bp, Homo sapiens
tggcccaggaggccagagggca

SEQ ID NO: 7225574 - DNA, 22 bp, Homo sapiens
tggcccagggagttcatggtgt

SEQ ID NO: 7225575 - DNA, 22 bp, Homo sapiens
tggcccaggcgaggtgggcaga

SEQ ID NO: 7225576 - DNA, 22 bp, Homo sapiens
tggcccagggagttcatggtgt

SEQ ID NO: 7225577 - DNA, 22 bp, Homo sapiens
tggcccagggagttcatggtgt

SEQ ID NO: 7225578 - DNA, 22 bp, Homo sapiens
tggcccaggcgaggtgggcaga

SEQ ID NO: 7225579 - DNA, 22 bp, Homo sapiens
tggcccaggcgaggtgggcaga

SEQ ID NO: 7225580 - DNA, 22 bp, Homo sapiens
tggcccaggcgaggtgggcaga

SEQ ID NO: 7225581 - DNA, 22 bp, Homo sapiens
tggcccaggcgaggtgggcaga

SEQ ID NO: 7225582 - DNA, 22 bp, Homo sapiens
tggcccaggcgaggtgggcaga

SEQ ID NO: 7225583 - DNA, 22 bp, Homo sapiens
tggcccaggccaaagccctgga

SEQ ID NO: 7225584 - DNA, 22 bp, Homo sapiens
tggcccagtgcttatgctctga

SEQ ID NO: 7225585 - DNA, 22 bp, Homo sapiens
tggcccagtgcttatgctctga

SEQ ID NO: 7225586 - DNA, 22 bp, Homo sapiens
tggcccggctctgagctgtgct

SEQ ID NO: 7225587 - DNA, 22 bp, Homo sapiens
tggcccgggagttttgaagagt

SEQ ID NO: 7225588 - DNA, 22 bp, Homo sapiens
tggcccagtcagcaggagaggg

SEQ ID NO: 7225589 - DNA, 22 bp, Homo sapiens
tggcccagtcagcaggagaggg

SEQ ID NO: 7225590 - DNA, 22 bp, Homo sapiens
tggcccagtcagcaggagaggg

SEQ ID NO: 7225591 - DNA, 22 bp, Homo sapiens
tggcccagtcagcaggagaggg

SEQ ID NO: 7225592 - DNA, 22 bp, Homo sapiens
tggcccagtatgtataatctta

SEQ ID NO: 7225593 - DNA, 22 bp, Homo sapiens
tggcccagtatgtataatctta

SEQ ID NO: 7225594 - DNA, 22 bp, Homo sapiens
tggcccagtatgtataatctta

SEQ ID NO: 7225595 - DNA, 22 bp, Homo sapiens
tggcccaggtgcacccagaggc

SEQ ID NO: 7225596 - DNA, 22 bp, Homo sapiens
tggcccaggtgcacccagaggc

SEQ ID NO: 7225597 - DNA, 22 bp, Homo sapiens
tggcccaggtgcaagagacaga

SEQ ID NO: 7225598 - DNA, 22 bp, Homo sapiens
tggcccaggtgcaagagacaga

SEQ ID NO: 7225599 - DNA, 22 bp, Homo sapiens
tggcccaggtgcacccagaggc

SEQ ID NO: 7225600 - DNA, 22 bp, Homo sapiens
tggcccaggtgcacccagaggc

SEQ ID NO: 7225601 - DNA, 22 bp, Homo sapiens
tggcccagtagaaaagggatcg

SEQ ID NO: 7225602 - DNA, 22 bp, Homo sapiens
tggcccagtagaaaagggatcg

SEQ ID NO: 7225603 - DNA, 22 bp, Homo sapiens
tggcccagtagaaaagggatcg

SEQ ID NO: 7225604 - DNA, 23 bp, Homo sapiens
tggccctgaatctgtcctggagg

SEQ ID NO: 7225605 - DNA, 23 bp, Homo sapiens
tggccctgaatctgtcctggagg

SEQ ID NO: 7225606 - DNA, 23 bp, Homo sapiens
tggccctgaatctgtcctggagg

SEQ ID NO: 7225607 - DNA, 22 bp, Homo sapiens
tggccctgaaggccttgagcat

SEQ ID NO: 7225608 - DNA, 22 bp, Homo sapiens
tggccctgaatcaaggccagca

SEQ ID NO: 7225609 - DNA, 22 bp, Homo sapiens
tggccctgaatcaaggccagca

SEQ ID NO: 7225610 - DNA, 22 bp, Homo sapiens
tggccctgaatcaaggccagca

SEQ ID NO: 7225611 - DNA, 22 bp, Homo sapiens
tggccctgaatcaaggccagca

SEQ ID NO: 7225612 - DNA, 22 bp, Homo sapiens
tggccctgaatcaaggccagca

SEQ ID NO: 7225613 - DNA, 22 bp, Homo sapiens
tggccctcagtcttgctcctgc

SEQ ID NO: 7225614 - DNA, 22 bp, Homo sapiens
tggccctcagcactgagacctt

SEQ ID NO: 7225615 - DNA, 22 bp, Homo sapiens
tggccctcagtcttgctcctgc

SEQ ID NO: 7225616 - DNA, 22 bp, Homo sapiens
tggccctcagtcttgctcctgc

SEQ ID NO: 7225617 - DNA, 17 bp, Homo sapiens
tggccctagactccagc

SEQ ID NO: 7225618 - DNA, 22 bp, Homo sapiens
tggccctcagcactgagacctt

SEQ ID NO: 7225619 - DNA, 22 bp, Homo sapiens
tggccctcagcactgagacctt

SEQ ID NO: 7225620 - DNA, 22 bp, Homo sapiens
tggccctcgtccgacaggtggg

SEQ ID NO: 7225621 - DNA, 22 bp, Homo sapiens
tggccctcgtccgacaggtggg

SEQ ID NO: 7225622 - DNA, 22 bp, Homo sapiens
tggccctcgtccgacaggtggg

SEQ ID NO: 7225623 - DNA, 22 bp, Homo sapiens
tggccctcgtccgacaggtggg

SEQ ID NO: 7225624 - DNA, 22 bp, Homo sapiens
tggccctcgtccgacaggtggg

SEQ ID NO: 7225625 - DNA, 22 bp, Homo sapiens
tggccctctgcaagattctgga

SEQ ID NO: 7225626 - DNA, 22 bp, Homo sapiens
tggccctgaaggccttgagcat

SEQ ID NO: 7225627 - DNA, 22 bp, Homo sapiens
tggccctgaaggccttgagcat

SEQ ID NO: 7225628 - DNA, 22 bp, Homo sapiens
tggccctgcagaactagcctgg

SEQ ID NO: 7225629 - DNA, 22 bp, Homo sapiens
tggccctgccactcactgctga

SEQ ID NO: 7225630 - DNA, 22 bp, Homo sapiens
tggccctgccactcactgctga

SEQ ID NO: 7225631 - DNA, 22 bp, Homo sapiens
tggccctgcagaactagcctgg

SEQ ID NO: 7225632 - DNA, 22 bp, Homo sapiens
tggccctgcagaactagcctgg

SEQ ID NO: 7225633 - DNA, 22 bp, Homo sapiens
tggccctgcacccagagcagtt

SEQ ID NO: 7225634 - DNA, 22 bp, Homo sapiens
tggccctgcacccagagcagtt

SEQ ID NO: 7225635 - DNA, 22 bp, Homo sapiens
tggccctgcacccagagcagtt

SEQ ID NO: 7225636 - DNA, 22 bp, Homo sapiens
tggccctgaggggctgtgcccc

SEQ ID NO: 7225637 - DNA, 22 bp, Homo sapiens
tggccctgagggctcggagcca

SEQ ID NO: 7225638 - DNA, 22 bp, Homo sapiens
tggccctgagggctcggagcca

SEQ ID NO: 7225639 - DNA, 22 bp, Homo sapiens
tggccctgagggctcggagcca

SEQ ID NO: 7225640 - DNA, 22 bp, Homo sapiens
tggccctgagggctcggagcca

SEQ ID NO: 7225641 - DNA, 22 bp, Homo sapiens
tggccctgagggctcggagcca

SEQ ID NO: 7225642 - DNA, 22 bp, Homo sapiens
tggccctgaggggctgtgcccc

SEQ ID NO: 7225643 - DNA, 22 bp, Homo sapiens
tggccctgcacccagagcagtt

SEQ ID NO: 7225644 - DNA, 22 bp, Homo sapiens
tggccctgcacccagagcagtt

SEQ ID NO: 7225645 - DNA, 22 bp, Homo sapiens
tggccctgcacccagagcagtt

SEQ ID NO: 7225646 - DNA, 22 bp, Homo sapiens
tggccctgactgatgtggaggg

SEQ ID NO: 7225647 - DNA, 22 bp, Homo sapiens
tggccctgactgatgtggaggg

SEQ ID NO: 7225648 - DNA, 22 bp, Homo sapiens
tggccctgacttggaggcctga

SEQ ID NO: 7225649 - DNA, 22 bp, Homo sapiens
tggccctgacttggaggcctga

SEQ ID NO: 7225650 - DNA, 22 bp, Homo sapiens
tggccctgacttggaggcctga

SEQ ID NO: 7225651 - DNA, 22 bp, Homo sapiens
tggccctgacttggaggcctga

SEQ ID NO: 7225652 - DNA, 22 bp, Homo sapiens
tggccctgacttggaggcctga

SEQ ID NO: 7225653 - DNA, 22 bp, Homo sapiens
tggccctgacttggaggcctga

SEQ ID NO: 7225654 - DNA, 22 bp, Homo sapiens
tggccctgacttggaggcctga

SEQ ID NO: 7225655 - DNA, 22 bp, Homo sapiens
tggccctgacttggaggcctga

SEQ ID NO: 7225656 - DNA, 22 bp, Homo sapiens
tggccctgaggacccagtgtgg

SEQ ID NO: 7225657 - DNA, 22 bp, Homo sapiens
tggccctgaggacccagtgtgg

SEQ ID NO: 7225658 - DNA, 22 bp, Homo sapiens
tggccctgaggacccagtgtgg

SEQ ID NO: 7225659 - DNA, 22 bp, Homo sapiens
tggccctgacaggtcctgggca

SEQ ID NO: 7225660 - DNA, 22 bp, Homo sapiens
tggccctgacaggtcctgggca

SEQ ID NO: 7225661 - DNA, 22 bp, Homo sapiens
tggccctgactgatgtggaggg

SEQ ID NO: 7225662 - DNA, 22 bp, Homo sapiens
tggccctgactgatgtggaggg

SEQ ID NO: 7225663 - DNA, 22 bp, Homo sapiens
tggccctgactgatgtggaggg

SEQ ID NO: 7225664 - DNA, 22 bp, Homo sapiens
tggccctgactgatgtggaggg

SEQ ID NO: 7225665 - DNA, 22 bp, Homo sapiens
tggccctgacaggtcctgggca

SEQ ID NO: 7225666 - DNA, 22 bp, Homo sapiens
tggccctgacaggtcctgggca

SEQ ID NO: 7225667 - DNA, 22 bp, Homo sapiens
tggccctgacacgtggtactgg

SEQ ID NO: 7225668 - DNA, 22 bp, Homo sapiens
tggccctgtgactgagttctag

SEQ ID NO: 7225669 - DNA, 23 bp, Homo sapiens
tggccctgtgcatgctgcttccc

SEQ ID NO: 7225670 - DNA, 22 bp, Homo sapiens
tggccctgtctgcacacaggat

SEQ ID NO: 7225671 - DNA, 22 bp, Homo sapiens
tggccctgtgactgagttctag

SEQ ID NO: 7225672 - DNA, 22 bp, Homo sapiens
tggccctgtgactgagttctag

SEQ ID NO: 7225673 - DNA, 22 bp, Homo sapiens
tggccctgtcctcatttcatct

SEQ ID NO: 7225674 - DNA, 22 bp, Homo sapiens
tggccctgtctgcacacaggat

SEQ ID NO: 7225675 - DNA, 22 bp, Homo sapiens
tggccctgtctgcacacaggat

SEQ ID NO: 7225676 - DNA, 22 bp, Homo sapiens
tggccctgtctgcacacaggat

SEQ ID NO: 7225677 - DNA, 22 bp, Homo sapiens
tggccctgtctgcacacaggat

SEQ ID NO: 7225678 - DNA, 22 bp, Homo sapiens
tggccctggtggcacagcctgc

SEQ ID NO: 7225679 - DNA, 22 bp, Homo sapiens
tggccctgtccctggagcctgg

SEQ ID NO: 7225680 - DNA, 22 bp, Homo sapiens
tggccctgtccctggagcctgg

SEQ ID NO: 7225681 - DNA, 22 bp, Homo sapiens
tggccctgtccctggagcctgg

SEQ ID NO: 7225682 - DNA, 22 bp, Homo sapiens
tggccctgtccctggagcctgg

SEQ ID NO: 7225683 - DNA, 22 bp, Homo sapiens
tggccctgtccctggagcctgg

SEQ ID NO: 7225684 - DNA, 22 bp, Homo sapiens
tggccctgtccctggagcctgg

SEQ ID NO: 7225685 - DNA, 22 bp, Homo sapiens
tggccctgtccctggagcctgg

SEQ ID NO: 7225686 - DNA, 22 bp, Homo sapiens
tggccctgtccctggagcctgg

SEQ ID NO: 7225687 - DNA, 22 bp, Homo sapiens
tggccctgggtggaatgtccca

SEQ ID NO: 7225688 - DNA, 22 bp, Homo sapiens
tggccctggtggcacagcctgc

SEQ ID NO: 7225689 - DNA, 22 bp, Homo sapiens
tggccctgggtggaatgtccca

SEQ ID NO: 7225690 - DNA, 22 bp, Homo sapiens
tggccctggtggcacagcctgc

SEQ ID NO: 7225691 - DNA, 22 bp, Homo sapiens
tggccctggtggcacagcctgc

SEQ ID NO: 7225692 - DNA, 22 bp, Homo sapiens
tggccctgccactcactgctga

SEQ ID NO: 7225693 - DNA, 22 bp, Homo sapiens
tggccctgccactcactgctga

SEQ ID NO: 7225694 - DNA, 22 bp, Homo sapiens
tggccctgccctcttcatcttt

SEQ ID NO: 7225695 - DNA, 22 bp, Homo sapiens
tggccctgccgcactatcctca

SEQ ID NO: 7225696 - DNA, 22 bp, Homo sapiens
tggccctgccgcactatcctca

SEQ ID NO: 7225697 - DNA, 22 bp, Homo sapiens
tggccctgccgcactatcctca

SEQ ID NO: 7225698 - DNA, 22 bp, Homo sapiens
tggccctgccgccacgacgtct

SEQ ID NO: 7225699 - DNA, 22 bp, Homo sapiens
tggccctgccgccacgacgtct

SEQ ID NO: 7225700 - DNA, 21 bp, Homo sapiens
tggccctggccacggctgcca

SEQ ID NO: 7225701 - DNA, 22 bp, Homo sapiens
tggccctggctgagttagattt

SEQ ID NO: 7225702 - DNA, 22 bp, Homo sapiens
tggccctggctgagttagattt

SEQ ID NO: 7225703 - DNA, 22 bp, Homo sapiens
tggccctgggcagaggcaacat

SEQ ID NO: 7225704 - DNA, 22 bp, Homo sapiens
tggccctgggcagaggcaacat

SEQ ID NO: 7225705 - DNA, 22 bp, Homo sapiens
tggccctgggcagaggcaacat

SEQ ID NO: 7225706 - DNA, 22 bp, Homo sapiens
tggccctgggcagaggcaacat

SEQ ID NO: 7225707 - DNA, 22 bp, Homo sapiens
tggccctgggcagaggcaacat

SEQ ID NO: 7225708 - DNA, 22 bp, Homo sapiens
tggccctgggcatctttcgtga

SEQ ID NO: 7225709 - DNA, 22 bp, Homo sapiens
tggcccttgtcctgggagagtt

SEQ ID NO: 7225710 - DNA, 22 bp, Homo sapiens
tggcccttctgagcacagggcc

SEQ ID NO: 7225711 - DNA, 22 bp, Homo sapiens
tggcccttgtcctgggagagtt

SEQ ID NO: 7225712 - DNA, 22 bp, Homo sapiens
tggccctttgggtgcaggggca

SEQ ID NO: 7225713 - DNA, 22 bp, Homo sapiens
tggccctttgggtgcaggggca

SEQ ID NO: 7225714 - DNA, 22 bp, Homo sapiens
tggccctttggtttatgactga

SEQ ID NO: 7225715 - DNA, 22 bp, Homo sapiens
tggcccttttgtgaagtggcca

SEQ ID NO: 7225716 - DNA, 22 bp, Homo sapiens
tggccgggaagggacagtgtgg

SEQ ID NO: 7225717 - DNA, 22 bp, Homo sapiens
tggccgggccgggcgcctccac

SEQ ID NO: 7225718 - DNA, 22 bp, Homo sapiens
tggccggggctgatggacagtg

SEQ ID NO: 7225719 - DNA, 22 bp, Homo sapiens
tggccggggctgatggacagtg

SEQ ID NO: 7225720 - DNA, 20 bp, Homo sapiens
tggccctgttttctccaggc

SEQ ID NO: 7225721 - DNA, 22 bp, Homo sapiens
tggcccttcaaattccctagtc

SEQ ID NO: 7225722 - DNA, 22 bp, Homo sapiens
tggcccttctgagcacagggcc

SEQ ID NO: 7225723 - DNA, 22 bp, Homo sapiens
tggccctgttctgtacctcata

SEQ ID NO: 7225724 - DNA, 20 bp, Homo sapiens
tggccctgttttctccaggc

SEQ ID NO: 7225725 - DNA, 20 bp, Homo sapiens
tggccctgttttctccaggc

SEQ ID NO: 7225726 - DNA, 22 bp, Homo sapiens
tggccctgtggcttcagaacag

SEQ ID NO: 7225727 - DNA, 22 bp, Homo sapiens
tggccctgtggaggtcagtgag

SEQ ID NO: 7225728 - DNA, 22 bp, Homo sapiens
tggccctgtggaggtcagtgag

SEQ ID NO: 7225729 - DNA, 22 bp, Homo sapiens
tggccctgtggaggtcagtgag

SEQ ID NO: 7225730 - DNA, 23 bp, Homo sapiens
tggccctgtgcatgctgcttccc

SEQ ID NO: 7225731 - DNA, 22 bp, Homo sapiens
tggccctgtggaggtcagtgag

SEQ ID NO: 7225732 - DNA, 22 bp, Homo sapiens
tggccctgtggaggtcagtgag

SEQ ID NO: 7225733 - DNA, 22 bp, Homo sapiens
tggccctgtgtcctgctgccag

SEQ ID NO: 7225734 - DNA, 22 bp, Homo sapiens
tggccctgtgtcctgctgccag

SEQ ID NO: 7225735 - DNA, 22 bp, Homo sapiens
tggccctgtgtcctgctgccag

SEQ ID NO: 7225736 - DNA, 22 bp, Homo sapiens
tggccctgtgtcctgctgccag

SEQ ID NO: 7225737 - DNA, 22 bp, Homo sapiens
tggccctgttctgtacctcata

SEQ ID NO: 7225738 - DNA, 22 bp, Homo sapiens
tggccctgtgtgcaggctgcac

SEQ ID NO: 7225739 - DNA, 22 bp, Homo sapiens
tggccctgtgtgcaggctgcac

SEQ ID NO: 7225740 - DNA, 22 bp, Homo sapiens
tggccctgtgtgcaggctgcac

SEQ ID NO: 7225741 - DNA, 22 bp, Homo sapiens
tggccctgtgtgcaggctgcac

SEQ ID NO: 7225742 - DNA, 22 bp, Homo sapiens
tggccctgtgtgcaggctgcac

SEQ ID NO: 7225743 - DNA, 22 bp, Homo sapiens
tggccctgtgtgcaggctgcac

SEQ ID NO: 7225744 - DNA, 20 bp, Homo sapiens
tggcctctgagatgccacgg

SEQ ID NO: 7225745 - DNA, 20 bp, Homo sapiens
tggcctctgtagaggccaag

SEQ ID NO: 7225746 - DNA, 22 bp, Homo sapiens
tggcctctgggaaagcagattc

SEQ ID NO: 7225747 - DNA, 22 bp, Homo sapiens
tggcctctggctgaggactaac

SEQ ID NO: 7225748 - DNA, 22 bp, Homo sapiens
tggcctcttaaggatgacacaa

SEQ ID NO: 7225749 - DNA, 22 bp, Homo sapiens
tggcctcttacgacatagcctt

SEQ ID NO: 7225750 - DNA, 22 bp, Homo sapiens
tggcctcttaggacatcctcta

SEQ ID NO: 7225751 - DNA, 22 bp, Homo sapiens
tggcctcttaggacatcctcta

SEQ ID NO: 7225752 - DNA, 22 bp, Homo sapiens
tggcctgaattatggcagatct

SEQ ID NO: 7225753 - DNA, 22 bp, Homo sapiens
tggcctgcaaagtcttcttgct

SEQ ID NO: 7225754 - DNA, 22 bp, Homo sapiens
tggcctgaggctcggcatgggt

SEQ ID NO: 7225755 - DNA, 22 bp, Homo sapiens
tggcctgaggctcggcatgggt

SEQ ID NO: 7225756 - DNA, 22 bp, Homo sapiens
tggcctgagttgtctgcaggcc

SEQ ID NO: 7225757 - DNA, 22 bp, Homo sapiens
tggcctgagttgtctgcaggcc

SEQ ID NO: 7225758 - DNA, 22 bp, Homo sapiens
tggcctgcagaggctgtggggc

SEQ ID NO: 7225759 - DNA, 22 bp, Homo sapiens
tggcctgcagaggctgtggggc

SEQ ID NO: 7225760 - DNA, 22 bp, Homo sapiens
tggcctgcagaggctgtggggc

SEQ ID NO: 7225761 - DNA, 23 bp, Homo sapiens
tggcctgcagagtttctgctggg

SEQ ID NO: 7225762 - DNA, 23 bp, Homo sapiens
tggcctgcagagtttctgctggg

SEQ ID NO: 7225763 - DNA, 23 bp, Homo sapiens
tggcctgcagagtttctgctggg

SEQ ID NO: 7225764 - DNA, 23 bp, Homo sapiens
tggcctgcagagtttctgctggg

SEQ ID NO: 7225765 - DNA, 22 bp, Homo sapiens
tggcctgcagctctcagggaag

SEQ ID NO: 7225766 - DNA, 22 bp, Homo sapiens
tggcctgcattggctttggtgt

SEQ ID NO: 7225767 - DNA, 22 bp, Homo sapiens
tggcctgccactgccacgccac

SEQ ID NO: 7225768 - DNA, 22 bp, Homo sapiens
tggcctgcccaagtcaatcgga

SEQ ID NO: 7225769 - DNA, 22 bp, Homo sapiens
tggcctgcccagagcagctctg

SEQ ID NO: 7225770 - DNA, 22 bp, Homo sapiens
tggcctgcccagagcagctctg

SEQ ID NO: 7225771 - DNA, 22 bp, Homo sapiens
tggcctgcccagagcagctctg

SEQ ID NO: 7225772 - DNA, 22 bp, Homo sapiens
tggcctgcccagagcagctctg

SEQ ID NO: 7225773 - DNA, 22 bp, Homo sapiens
tggcctgccccgagatcctggc

SEQ ID NO: 7225774 - DNA, 22 bp, Homo sapiens
tggcctgcctcccggcttcttt

SEQ ID NO: 7225775 - DNA, 22 bp, Homo sapiens
tggcctggccacatccagcagg

SEQ ID NO: 7225776 - DNA, 22 bp, Homo sapiens
tggcctggccctgaggccctgt

SEQ ID NO: 7225777 - DNA, 22 bp, Homo sapiens
tggcctggccctgaggccctgt

SEQ ID NO: 7225778 - DNA, 22 bp, Homo sapiens
tggcctggccacatccagcagg

SEQ ID NO: 7225779 - DNA, 22 bp, Homo sapiens
tggcctggcagagcaaggcctg

SEQ ID NO: 7225780 - DNA, 22 bp, Homo sapiens
tggcctggcagagcaaggcctg

SEQ ID NO: 7225781 - DNA, 18 bp, Homo sapiens
tggcctggagacaactct

SEQ ID NO: 7225782 - DNA, 23 bp, Homo sapiens
tggcctggagagaaaagatgagt

SEQ ID NO: 7225783 - DNA, 23 bp, Homo sapiens
tggcctggagagaaaagatgagt

SEQ ID NO: 7225784 - DNA, 18 bp, Homo sapiens
tggcctggagacaactct

SEQ ID NO: 7225785 - DNA, 22 bp, Homo sapiens
tggcctggaaaaatgcagatgg

SEQ ID NO: 7225786 - DNA, 22 bp, Homo sapiens
tggcctggaaaaatgcagatgg

SEQ ID NO: 7225787 - DNA, 22 bp, Homo sapiens
tggcctggaaaaatgcagatgg

SEQ ID NO: 7225788 - DNA, 22 bp, Homo sapiens
tggcctggaaaaatgcagatgg

SEQ ID NO: 7225789 - DNA, 22 bp, Homo sapiens
tggcctgctttcttaggtgttc

SEQ ID NO: 7225790 - DNA, 22 bp, Homo sapiens
tggcctgctttcatttgatgct

SEQ ID NO: 7225791 - DNA, 22 bp, Homo sapiens
tggcctgctttcttaggtgttc

SEQ ID NO: 7225792 - DNA, 22 bp, Homo sapiens
tggcctgctttcttaggtgttc

SEQ ID NO: 7225793 - DNA, 22 bp, Homo sapiens
tggcctgcctgggagcagcagg

SEQ ID NO: 7225794 - DNA, 22 bp, Homo sapiens
tggcctgccttcgctgagctga

SEQ ID NO: 7225795 - DNA, 22 bp, Homo sapiens
tggcctgccttcgctgagctga

SEQ ID NO: 7225796 - DNA, 22 bp, Homo sapiens
tggcctgccttcgctgagctga

SEQ ID NO: 7225797 - DNA, 22 bp, Homo sapiens
tggcctgctcacagtcagatgg

SEQ ID NO: 7225798 - DNA, 22 bp, Homo sapiens
tggcctgccttcgctgagctga

SEQ ID NO: 7225799 - DNA, 22 bp, Homo sapiens
tggcctgctctgactttggggg

SEQ ID NO: 7225800 - DNA, 22 bp, Homo sapiens
tggcctggaacctggcagggac

SEQ ID NO: 7225801 - DNA, 22 bp, Homo sapiens
tggcctggaacctggcagggac

SEQ ID NO: 7225802 - DNA, 22 bp, Homo sapiens
tggcctggaacctggcagggac

SEQ ID NO: 7225803 - DNA, 22 bp, Homo sapiens
tggcctggaacctggcagggac

SEQ ID NO: 7225804 - DNA, 22 bp, Homo sapiens
tggcctggaaaaatgcagatgg

SEQ ID NO: 7225805 - DNA, 22 bp, Homo sapiens
tggcctggaacctggcagggac

SEQ ID NO: 7225806 - DNA, 22 bp, Homo sapiens
tggcctggaagagaggtcgagg

SEQ ID NO: 7225807 - DNA, 22 bp, Homo sapiens
tggcctggaagagaggtcgagg

SEQ ID NO: 7225808 - DNA, 22 bp, Homo sapiens
tggcctggaacctggcagggac

SEQ ID NO: 7225809 - DNA, 22 bp, Homo sapiens
tggcctggaagagaggtcgagg

SEQ ID NO: 7225810 - DNA, 22 bp, Homo sapiens
tggcctggaagagaggtcgagg

SEQ ID NO: 7225811 - DNA, 22 bp, Homo sapiens
tggcctggaacctggcagggac

SEQ ID NO: 7225812 - DNA, 22 bp, Homo sapiens
tggcagctgcgttgtgtttctg

SEQ ID NO: 7225813 - DNA, 22 bp, Homo sapiens
tggcagctggagggcaatggcc

SEQ ID NO: 7225814 - DNA, 22 bp, Homo sapiens
tggcaggaaagtaacagagcac

SEQ ID NO: 7225815 - DNA, 22 bp, Homo sapiens
tggcaggaaaaagggccagagg

SEQ ID NO: 7225816 - DNA, 22 bp, Homo sapiens
tggcaggaaaaagggccagagg

SEQ ID NO: 7225817 - DNA, 22 bp, Homo sapiens
tggcagctgcaggcctcctgag

SEQ ID NO: 7225818 - DNA, 22 bp, Homo sapiens
tggcagctgcaggcctcctgag

SEQ ID NO: 7225819 - DNA, 22 bp, Homo sapiens
tggcagctgccatgtccacgtg

SEQ ID NO: 7225820 - DNA, 22 bp, Homo sapiens
tggcagctgattagatggtgcc

SEQ ID NO: 7225821 - DNA, 22 bp, Homo sapiens
tggcagctgagtgcaccccctc

SEQ ID NO: 7225822 - DNA, 22 bp, Homo sapiens
tggcagctgaggggaggctttg

SEQ ID NO: 7225823 - DNA, 22 bp, Homo sapiens
tggcaggaagacgtggggcacc

SEQ ID NO: 7225824 - DNA, 22 bp, Homo sapiens
tggcaggaaccaggaggctctc

SEQ ID NO: 7225825 - DNA, 22 bp, Homo sapiens
tggcaggaaccaggaggctctc

SEQ ID NO: 7225826 - DNA, 22 bp, Homo sapiens
tggcaggaaagtaacagagcac

SEQ ID NO: 7225827 - DNA, 22 bp, Homo sapiens
tggcaggaaagtaacagagcac

SEQ ID NO: 7225828 - DNA, 22 bp, Homo sapiens
tggcaggaaagtaacagagcac

SEQ ID NO: 7225829 - DNA, 22 bp, Homo sapiens
tggcaggaaagtaacagagcac

SEQ ID NO: 7225830 - DNA, 22 bp, Homo sapiens
tggcaggaaataccctgcctag

SEQ ID NO: 7225831 - DNA, 22 bp, Homo sapiens
tggcaggaaataccctgcctag

SEQ ID NO: 7225832 - DNA, 18 bp, Homo sapiens
tggcaggaaatgcacttt

SEQ ID NO: 7225833 - DNA, 22 bp, Homo sapiens
tggcaggagacacatggcatag

SEQ ID NO: 7225834 - DNA, 20 bp, Homo sapiens
tggcaggagccactggaagc

SEQ ID NO: 7225835 - DNA, 20 bp, Homo sapiens
tggcaggactggctccaccc

SEQ ID NO: 7225836 - DNA, 20 bp, Homo sapiens
tggcaggactggctccaccc

SEQ ID NO: 7225837 - DNA, 20 bp, Homo sapiens
tggcaggaatagggccagag

SEQ ID NO: 7225838 - DNA, 20 bp, Homo sapiens
tggcaggactggctccaccc

SEQ ID NO: 7225839 - DNA, 20 bp, Homo sapiens
tggcaggaatagggccagag

SEQ ID NO: 7225840 - DNA, 22 bp, Homo sapiens
tggcaggaaggagactcagccc

SEQ ID NO: 7225841 - DNA, 20 bp, Homo sapiens
tggcaggaatagggccagag

SEQ ID NO: 7225842 - DNA, 22 bp, Homo sapiens
tggcaggaagacgtggggcacc

SEQ ID NO: 7225843 - DNA, 22 bp, Homo sapiens
tggcaggaagacgtggggcacc

SEQ ID NO: 7225844 - DNA, 22 bp, Homo sapiens
tggcaggaagcatctataggtc

SEQ ID NO: 7225845 - DNA, 22 bp, Homo sapiens
tggcaggaggatgaggcggcta

SEQ ID NO: 7225846 - DNA, 22 bp, Homo sapiens
tggcaggaggatgaggcggcta

SEQ ID NO: 7225847 - DNA, 22 bp, Homo sapiens
tggcaggagcctgcggggaggt

SEQ ID NO: 7225848 - DNA, 20 bp, Homo sapiens
tggcaggagccactggaagc

SEQ ID NO: 7225849 - DNA, 22 bp, Homo sapiens
tggcaggagcctgcggggaggt

SEQ ID NO: 7225850 - DNA, 22 bp, Homo sapiens
tggcaggagcctgcggggaggt

SEQ ID NO: 7225851 - DNA, 20 bp, Homo sapiens
tggcaggaggcagcagtgga

SEQ ID NO: 7225852 - DNA, 20 bp, Homo sapiens
tggcaggaggcagcagtgga

SEQ ID NO: 7225853 - DNA, 20 bp, Homo sapiens
tggcaggaggcagcagtgga

SEQ ID NO: 7225854 - DNA, 20 bp, Homo sapiens
tggcaggaggcagcagtgga

SEQ ID NO: 7225855 - DNA, 20 bp, Homo sapiens
tggcaggaggcagcagtgga

SEQ ID NO: 7225856 - DNA, 22 bp, Homo sapiens
tggcaggaggttttctccagga

SEQ ID NO: 7225857 - DNA, 22 bp, Homo sapiens
tggcaggatctttgagagtgaa

SEQ ID NO: 7225858 - DNA, 21 bp, Homo sapiens
tggcaggggtagtagtacagc

SEQ ID NO: 7225859 - DNA, 21 bp, Homo sapiens
tggcaggggtagtagtacagc

SEQ ID NO: 7225860 - DNA, 21 bp, Homo sapiens
tggcaggggtagtagtacagc

SEQ ID NO: 7225861 - DNA, 21 bp, Homo sapiens
tggcaggggtagtagtacagc

SEQ ID NO: 7225862 - DNA, 21 bp, Homo sapiens
tggcaggggtagtagtacagc

SEQ ID NO: 7225863 - DNA, 18 bp, Homo sapiens
tggcaggggcagtacgcc

SEQ ID NO: 7225864 - DNA, 18 bp, Homo sapiens
tggcaggggcagtacgcc

SEQ ID NO: 7225865 - DNA, 22 bp, Homo sapiens
tggcagggtacaccttaacacc

SEQ ID NO: 7225866 - DNA, 22 bp, Homo sapiens
tggcagggtacaccttaacacc

SEQ ID NO: 7225867 - DNA, 22 bp, Homo sapiens
tggcagggtacaccttaacacc

SEQ ID NO: 7225868 - DNA, 22 bp, Homo sapiens
tggcagggtacaccttaacacc

SEQ ID NO: 7225869 - DNA, 21 bp, Homo sapiens
tggcaggggtagtagtacagc

SEQ ID NO: 7225870 - DNA, 21 bp, Homo sapiens
tggcaggggtagtagtacagc

SEQ ID NO: 7225871 - DNA, 18 bp, Homo sapiens
tggcaggggcagtacgcc

SEQ ID NO: 7225872 - DNA, 18 bp, Homo sapiens
tggcaggggcagtacgcc

SEQ ID NO: 7225873 - DNA, 18 bp, Homo sapiens
tggcaggggcagtacgcc

SEQ ID NO: 7225874 - DNA, 18 bp, Homo sapiens
tggcaggggcagtacgcc

SEQ ID NO: 7225875 - DNA, 18 bp, Homo sapiens
tggcaggggcagtacgcc

SEQ ID NO: 7225876 - DNA, 18 bp, Homo sapiens
tggcaggggcagtacgcc

SEQ ID NO: 7225877 - DNA, 22 bp, Homo sapiens
tggcaggggaggtgcttgctta

SEQ ID NO: 7225878 - DNA, 22 bp, Homo sapiens
tggcaggggaggtgcttgctta

SEQ ID NO: 7225879 - DNA, 22 bp, Homo sapiens
tggcaggggaggtgcttgctta

SEQ ID NO: 7225880 - DNA, 22 bp, Homo sapiens
tggcaggggaggtgcttgctta

SEQ ID NO: 7225881 - DNA, 22 bp, Homo sapiens
tggcaggggaggtgcttgctta

SEQ ID NO: 7225882 - DNA, 22 bp, Homo sapiens
tggcaggggaggtgcttgctta

SEQ ID NO: 7225883 - DNA, 22 bp, Homo sapiens
tggcaggggaggtgcttgctta

SEQ ID NO: 7225884 - DNA, 22 bp, Homo sapiens
tggcagggcctgctcatcatcc

SEQ ID NO: 7225885 - DNA, 22 bp, Homo sapiens
tggcagggcctgctcatcatcc

SEQ ID NO: 7225886 - DNA, 22 bp, Homo sapiens
tggcagggcctgctcatcatcc

SEQ ID NO: 7225887 - DNA, 22 bp, Homo sapiens
tggcagggcctgctcatcatcc

SEQ ID NO: 7225888 - DNA, 22 bp, Homo sapiens
tggcagggcctgctcatcatcc

SEQ ID NO: 7225889 - DNA, 22 bp, Homo sapiens
tggcagggcctgctcatcatcc

SEQ ID NO: 7225890 - DNA, 22 bp, Homo sapiens
tggcagggcctgaatcttatac

SEQ ID NO: 7225891 - DNA, 22 bp, Homo sapiens
tggcagggcctgaatcttatac

SEQ ID NO: 7225892 - DNA, 22 bp, Homo sapiens
tggcagggcctgaatcttatac

SEQ ID NO: 7225893 - DNA, 22 bp, Homo sapiens
tggcagggcctgaatcttatac

SEQ ID NO: 7225894 - DNA, 22 bp, Homo sapiens
tggcagggcctgaatcttatac

SEQ ID NO: 7225895 - DNA, 22 bp, Homo sapiens
tggcagggagttgcaggatttc

SEQ ID NO: 7225896 - DNA, 22 bp, Homo sapiens
tggcagggagttgcaggatttc

SEQ ID NO: 7225897 - DNA, 22 bp, Homo sapiens
tggcagggagttgcaggatttc

SEQ ID NO: 7225898 - DNA, 22 bp, Homo sapiens
tggcagggagttgcaggatttc

SEQ ID NO: 7225899 - DNA, 22 bp, Homo sapiens
tggcagggagttgcaggatttc

SEQ ID NO: 7225900 - DNA, 22 bp, Homo sapiens
tggcagggagttgcaggatttc

SEQ ID NO: 7225901 - DNA, 22 bp, Homo sapiens
tggcagggagttgcaggatttc

SEQ ID NO: 7225902 - DNA, 22 bp, Homo sapiens
tggcagggagttgcaggatttc

SEQ ID NO: 7225903 - DNA, 22 bp, Homo sapiens
tggcagggagttgcaggatttc

SEQ ID NO: 7225904 - DNA, 22 bp, Homo sapiens
tggcagggagttgcaggatttc

SEQ ID NO: 7225905 - DNA, 22 bp, Homo sapiens
tggcagggcctaccccaatatc

SEQ ID NO: 7225906 - DNA, 22 bp, Homo sapiens
tggcagggcctaccccaatatc

SEQ ID NO: 7225907 - DNA, 22 bp, Homo sapiens
tggcagggcctaccccaatatc

SEQ ID NO: 7225908 - DNA, 22 bp, Homo sapiens
tggcagggcctaccccaatatc

SEQ ID NO: 7225909 - DNA, 22 bp, Homo sapiens
tggcagggcctaccccaatatc

SEQ ID NO: 7225910 - DNA, 22 bp, Homo sapiens
tggcagggagttcgttcacaac

SEQ ID NO: 7225911 - DNA, 22 bp, Homo sapiens
tggcagggagttcgttcacaac

SEQ ID NO: 7225912 - DNA, 22 bp, Homo sapiens
tggcagggagttcgttcacaac

SEQ ID NO: 7225913 - DNA, 22 bp, Homo sapiens
tggcagggagttcgttcacaac

SEQ ID NO: 7225914 - DNA, 22 bp, Homo sapiens
tggcagggagttcgttcacaac

SEQ ID NO: 7225915 - DNA, 22 bp, Homo sapiens
tggcagggagttcgttcacaac

SEQ ID NO: 7225916 - DNA, 18 bp, Homo sapiens
tggcagggaggaaatata

SEQ ID NO: 7225917 - DNA, 19 bp, Homo sapiens
tggcagggagtgatattag

SEQ ID NO: 7225918 - DNA, 19 bp, Homo sapiens
tggcagggagtgatattag

SEQ ID NO: 7225919 - DNA, 19 bp, Homo sapiens
tggcagggagtgatattag

SEQ ID NO: 7225920 - DNA, 19 bp, Homo sapiens
tggcagggagtgatattag

SEQ ID NO: 7225921 - DNA, 19 bp, Homo sapiens
tggcagggagtgatattag

SEQ ID NO: 7225922 - DNA, 22 bp, Homo sapiens
tggcagggagccaccggtcatg

SEQ ID NO: 7225923 - DNA, 18 bp, Homo sapiens
tggcagggaggaaatata

SEQ ID NO: 7225924 - DNA, 18 bp, Homo sapiens
tggcagggaggaaatata

SEQ ID NO: 7225925 - DNA, 18 bp, Homo sapiens
tggcagggaggaaatata

SEQ ID NO: 7225926 - DNA, 18 bp, Homo sapiens
tggcagggaggaaatata

SEQ ID NO: 7225927 - DNA, 18 bp, Homo sapiens
tggcagggaggaaatata

SEQ ID NO: 7225928 - DNA, 18 bp, Homo sapiens
tggcagggaggaaatata

SEQ ID NO: 7225929 - DNA, 18 bp, Homo sapiens
tggcagggaggaaatata

SEQ ID NO: 7225930 - DNA, 22 bp, Homo sapiens
tggcagggagccaccggtcatg

SEQ ID NO: 7225931 - DNA, 22 bp, Homo sapiens
tggcagggagccaccggtcatg

SEQ ID NO: 7225932 - DNA, 22 bp, Homo sapiens
tggcaggcattgatgcgagttc

SEQ ID NO: 7225933 - DNA, 22 bp, Homo sapiens
tggcaggcattgatgcgagttc

SEQ ID NO: 7225934 - DNA, 22 bp, Homo sapiens
tggcaggatctttgagagtgaa

SEQ ID NO: 7225935 - DNA, 22 bp, Homo sapiens
tggcaggatctttgagagtgaa

SEQ ID NO: 7225936 - DNA, 22 bp, Homo sapiens
tggcaggatctttgagagtgaa

SEQ ID NO: 7225937 - DNA, 22 bp, Homo sapiens
tggcaggatctttgagagtgaa

SEQ ID NO: 7225938 - DNA, 22 bp, Homo sapiens
tggcaggatctttgagagtgaa

SEQ ID NO: 7225939 - DNA, 22 bp, Homo sapiens
tggcaggatttgcccggaagga

SEQ ID NO: 7225940 - DNA, 22 bp, Homo sapiens
tggcaggcaagttcagctccac

SEQ ID NO: 7225941 - DNA, 22 bp, Homo sapiens
tggcaggcaagttcagctccac

SEQ ID NO: 7225942 - DNA, 22 bp, Homo sapiens
tggcaggcagagagcggccttt

SEQ ID NO: 7225943 - DNA, 22 bp, Homo sapiens
tggcaggcagagagcggccttt

SEQ ID NO: 7225944 - DNA, 22 bp, Homo sapiens
tggcaggcagagagcggccttt

SEQ ID NO: 7225945 - DNA, 21 bp, Homo sapiens
tggcaggcagctggaagcttg

SEQ ID NO: 7225946 - DNA, 21 bp, Homo sapiens
tggcaggcagctggaagcttg

SEQ ID NO: 7225947 - DNA, 21 bp, Homo sapiens
tggcaggcagctggaagcttg

SEQ ID NO: 7225948 - DNA, 21 bp, Homo sapiens
tggcaggcagctggaagcttg

SEQ ID NO: 7225949 - DNA, 22 bp, Homo sapiens
tggcaggcagctggcatcctaa

SEQ ID NO: 7225950 - DNA, 22 bp, Homo sapiens
tggcaggcagctggcatcctaa

SEQ ID NO: 7225951 - DNA, 22 bp, Homo sapiens
tggcaggcaggcagccttctga

SEQ ID NO: 7225952 - DNA, 22 bp, Homo sapiens
tggcaggcaggcagccttctga

SEQ ID NO: 7225953 - DNA, 22 bp, Homo sapiens
tggcaggcagtgtgggagctgg

SEQ ID NO: 7225954 - DNA, 22 bp, Homo sapiens
tggcaggcagtgtgggagctgg

SEQ ID NO: 7225955 - DNA, 22 bp, Homo sapiens
tggcagccttctctgagaaggt

SEQ ID NO: 7225956 - DNA, 22 bp, Homo sapiens
tggcagcctgcgtgaaggagct

SEQ ID NO: 7225957 - DNA, 22 bp, Homo sapiens
tggcagcctgcgtgaaggagct

SEQ ID NO: 7225958 - DNA, 22 bp, Homo sapiens
tggcagcctgcgtgaaggagct

SEQ ID NO: 7225959 - DNA, 22 bp, Homo sapiens
tggcagccatctgagggtgggg

SEQ ID NO: 7225960 - DNA, 22 bp, Homo sapiens
tggcagccatctgagggtgggg

SEQ ID NO: 7225961 - DNA, 22 bp, Homo sapiens
tggcagccatctgagggtgggg

SEQ ID NO: 7225962 - DNA, 22 bp, Homo sapiens
tggcagcctcagacaaggacct

SEQ ID NO: 7225963 - DNA, 22 bp, Homo sapiens
tggcagcctcagacaaggacct

SEQ ID NO: 7225964 - DNA, 22 bp, Homo sapiens
tggcagcctcccagctgcattc

SEQ ID NO: 7225965 - DNA, 22 bp, Homo sapiens
tggcagcattttttccagaaca

SEQ ID NO: 7225966 - DNA, 22 bp, Homo sapiens
tggcagcattttttccagaaca

SEQ ID NO: 7225967 - DNA, 19 bp, Homo sapiens
tggcagcattggtaccttg

SEQ ID NO: 7225968 - DNA, 22 bp, Homo sapiens
tggcagcattaattattcaggt

SEQ ID NO: 7225969 - DNA, 19 bp, Homo sapiens
tggcagcattggtaccttg

SEQ ID NO: 7225970 - DNA, 22 bp, Homo sapiens
tggcagccacatctcgtggatt

SEQ ID NO: 7225971 - DNA, 22 bp, Homo sapiens
tggcagcattttttccagaaca

SEQ ID NO: 7225972 - DNA, 22 bp, Homo sapiens
tggcagccacatctcgtggatt

SEQ ID NO: 7225973 - DNA, 22 bp, Homo sapiens
tggcagccacatctcgtggatt

SEQ ID NO: 7225974 - DNA, 22 bp, Homo sapiens
tggcagccatcagagcaggggt

SEQ ID NO: 7225975 - DNA, 22 bp, Homo sapiens
tggcagccttctctgagaaggt

SEQ ID NO: 7225976 - DNA, 22 bp, Homo sapiens
tggcagctacagacagaggtga

SEQ ID NO: 7225977 - DNA, 22 bp, Homo sapiens
tggcagctagatagtgtgttta

SEQ ID NO: 7225978 - DNA, 22 bp, Homo sapiens
tggcagctatggtctaagggcc

SEQ ID NO: 7225979 - DNA, 22 bp, Homo sapiens
tggcagctcatttggaaatgga

SEQ ID NO: 7225980 - DNA, 22 bp, Homo sapiens
tggcagctcccagagcttccaa

SEQ ID NO: 7225981 - DNA, 22 bp, Homo sapiens
tggcagctcccagagcttccaa

SEQ ID NO: 7225982 - DNA, 22 bp, Homo sapiens
tggcagctccgggtaggggctg

SEQ ID NO: 7225983 - DNA, 22 bp, Homo sapiens
tggcagctcctggggccagcac

SEQ ID NO: 7225984 - DNA, 22 bp, Homo sapiens
tggcagctcctggggccagcac

SEQ ID NO: 7225985 - DNA, 22 bp, Homo sapiens
tggcagcagacatctgaggtct

SEQ ID NO: 7225986 - DNA, 22 bp, Homo sapiens
tggcagcagacatctgaggtct

SEQ ID NO: 7225987 - DNA, 22 bp, Homo sapiens
tggcagcagacatctgaggtct

SEQ ID NO: 7225988 - DNA, 22 bp, Homo sapiens
tggcagcagacatctgaggtct

SEQ ID NO: 7225989 - DNA, 22 bp, Homo sapiens
tggcagcagacaaaaggccatt

SEQ ID NO: 7225990 - DNA, 22 bp, Homo sapiens
tggcagcagacaaaaggccatt

SEQ ID NO: 7225991 - DNA, 23 bp, Homo sapiens
tggcagcagatcttaaagtgacc

SEQ ID NO: 7225992 - DNA, 22 bp, Homo sapiens
tggcagcagcaaatggcatatc

SEQ ID NO: 7225993 - DNA, 22 bp, Homo sapiens
tggcagcagcaaatggcatatc

SEQ ID NO: 7225994 - DNA, 22 bp, Homo sapiens
tggcagcagcaaatggcatatc

SEQ ID NO: 7225995 - DNA, 22 bp, Homo sapiens
tggcagcagcaaatggcatatc

SEQ ID NO: 7225996 - DNA, 22 bp, Homo sapiens
tggcagcagccatggaaggccc

SEQ ID NO: 7225997 - DNA, 22 bp, Homo sapiens
tggcagcagccatggaaggccc

SEQ ID NO: 7225998 - DNA, 22 bp, Homo sapiens
tggcagcagccatggaaggccc

SEQ ID NO: 7225999 - DNA, 22 bp, Homo sapiens
tggcagcagccatggaaggccc

SEQ ID NO: 7226000 - DNA, 22 bp, Homo sapiens
tggcagcagccatggaaggccc

SEQ ID NO: 7226001 - DNA, 22 bp, Homo sapiens
tggcagcagccatggaaggccc

SEQ ID NO: 7226002 - DNA, 18 bp, Homo sapiens
tggcagcaggaagccatt

SEQ ID NO: 7226003 - DNA, 18 bp, Homo sapiens
tggcagcaggaagccatt

SEQ ID NO: 7226004 - DNA, 22 bp, Homo sapiens
tggcagcagctaacttaggcag

SEQ ID NO: 7226005 - DNA, 22 bp, Homo sapiens
tggcagcagctaacttaggcag

SEQ ID NO: 7226006 - DNA, 18 bp, Homo sapiens
tggcagcaggaagccatt

SEQ ID NO: 7226007 - DNA, 22 bp, Homo sapiens
tggcagcatgttatgtaaggaa

SEQ ID NO: 7226008 - DNA, 22 bp, Homo sapiens
tggcagcatgtcccggcctcag

SEQ ID NO: 7226009 - DNA, 22 bp, Homo sapiens
tggcagcatgtcccggcctcag

SEQ ID NO: 7226010 - DNA, 22 bp, Homo sapiens
tggcagcatgtcccggcctcag

SEQ ID NO: 7226011 - DNA, 22 bp, Homo sapiens
tggcagcagtggaggtagaaag

SEQ ID NO: 7226012 - DNA, 22 bp, Homo sapiens
tggcagcagtagccaccccagc

SEQ ID NO: 7226013 - DNA, 22 bp, Homo sapiens
tggcagcagtggaggtagaaag

SEQ ID NO: 7226014 - DNA, 22 bp, Homo sapiens
tggcagcagtggaggtagaaag

SEQ ID NO: 7226015 - DNA, 22 bp, Homo sapiens
tggcagcagtggaggtagaaag

SEQ ID NO: 7226016 - DNA, 22 bp, Homo sapiens
tggcagcagtagccaccccagc

SEQ ID NO: 7226017 - DNA, 22 bp, Homo sapiens
tggcagcagtagccaccccagc

SEQ ID NO: 7226018 - DNA, 22 bp, Homo sapiens
tggcagcagggcccctggagga

SEQ ID NO: 7226019 - DNA, 22 bp, Homo sapiens
tggcagcagggcccctggagga

SEQ ID NO: 7226020 - DNA, 22 bp, Homo sapiens
tggcagcagggcccctggagga

SEQ ID NO: 7226021 - DNA, 18 bp, Homo sapiens
tggcagcaggaagccatt

SEQ ID NO: 7226022 - DNA, 22 bp, Homo sapiens
tggcagcagggaggccagtgtt

SEQ ID NO: 7226023 - DNA, 22 bp, Homo sapiens
tggcagcagggaggccagtgtt

SEQ ID NO: 7226024 - DNA, 22 bp, Homo sapiens
tggcagcagggaggccagtgtt

SEQ ID NO: 7226025 - DNA, 22 bp, Homo sapiens
tggcagcagggaggccagtgtt

SEQ ID NO: 7226026 - DNA, 22 bp, Homo sapiens
tggcagcagggaggccagtgtt

SEQ ID NO: 7226027 - DNA, 20 bp, Homo sapiens
tggcagagttgtcccaccca

SEQ ID NO: 7226028 - DNA, 20 bp, Homo sapiens
tggcagagttgtcccaccca

SEQ ID NO: 7226029 - DNA, 20 bp, Homo sapiens
tggcagagttgtcccaccca

SEQ ID NO: 7226030 - DNA, 20 bp, Homo sapiens
tggcagagttgtcccaccca

SEQ ID NO: 7226031 - DNA, 22 bp, Homo sapiens
tggcagagttggaggtggaaga

SEQ ID NO: 7226032 - DNA, 22 bp, Homo sapiens
tggcagagttggaggtggaaga

SEQ ID NO: 7226033 - DNA, 22 bp, Homo sapiens
tggcagagttggaggtggaaga

SEQ ID NO: 7226034 - DNA, 22 bp, Homo sapiens
tggcagagttggaggtggaaga

SEQ ID NO: 7226035 - DNA, 22 bp, Homo sapiens
tggcagagttggaggtggaaga

SEQ ID NO: 7226036 - DNA, 21 bp, Homo sapiens
tggcagagttgagtagttatg

SEQ ID NO: 7226037 - DNA, 21 bp, Homo sapiens
tggcagagttgagtagttatg

SEQ ID NO: 7226038 - DNA, 20 bp, Homo sapiens
tggcagagttgtcccaccca

SEQ ID NO: 7226039 - DNA, 20 bp, Homo sapiens
tggcagagttgtcccaccca

SEQ ID NO: 7226040 - DNA, 22 bp, Homo sapiens
tggcagcacttgaacttgagcc

SEQ ID NO: 7226041 - DNA, 22 bp, Homo sapiens
tggcagcagacaaaaggccatt

SEQ ID NO: 7226042 - DNA, 22 bp, Homo sapiens
tggcagcagaacatgaaaccca

SEQ ID NO: 7226043 - DNA, 22 bp, Homo sapiens
tggcagcagacaaaaggccatt

SEQ ID NO: 7226044 - DNA, 22 bp, Homo sapiens
tggcagagttcgctgtgccttt

SEQ ID NO: 7226045 - DNA, 22 bp, Homo sapiens
tggcagagttcgctgtgccttt

SEQ ID NO: 7226046 - DNA, 22 bp, Homo sapiens
tggcagagttcgctgtgccttt

SEQ ID NO: 7226047 - DNA, 22 bp, Homo sapiens
tggcagagttcgctcctattca

SEQ ID NO: 7226048 - DNA, 22 bp, Homo sapiens
tggcagagttcgctgtgccttt

SEQ ID NO: 7226049 - DNA, 22 bp, Homo sapiens
tggcagagttcgctgtgccttt

SEQ ID NO: 7226050 - DNA, 22 bp, Homo sapiens
tggcagagttcgctcctattca

SEQ ID NO: 7226051 - DNA, 22 bp, Homo sapiens
tggcagagttatgggtatttat

SEQ ID NO: 7226052 - DNA, 22 bp, Homo sapiens
tggcagagttatgggtatttat

SEQ ID NO: 7226053 - DNA, 18 bp, Homo sapiens
tggcagagtgtctgttct

SEQ ID NO: 7226054 - DNA, 18 bp, Homo sapiens
tggcagagtgtctgttct

SEQ ID NO: 7226055 - DNA, 22 bp, Homo sapiens
tggcagagtggaccatactcaa

SEQ ID NO: 7226056 - DNA, 22 bp, Homo sapiens
tggcagagtggaccatactcaa

SEQ ID NO: 7226057 - DNA, 22 bp, Homo sapiens
tggcagagtggaccatactcaa

SEQ ID NO: 7226058 - DNA, 22 bp, Homo sapiens
tggcagagtggaccatactcaa

SEQ ID NO: 7226059 - DNA, 22 bp, Homo sapiens
tggcagagtggaccatactcaa

SEQ ID NO: 7226060 - DNA, 22 bp, Homo sapiens
tggcagagtggaccatactcaa

SEQ ID NO: 7226061 - DNA, 22 bp, Homo sapiens
tggcagagtgcggcatcccctg

SEQ ID NO: 7226062 - DNA, 22 bp, Homo sapiens
tggcagagtgcggcatcccctg

SEQ ID NO: 7226063 - DNA, 22 bp, Homo sapiens
tggcagagtgcggcatcccctg

SEQ ID NO: 7226064 - DNA, 22 bp, Homo sapiens
tggcagagtgcggcatcccctg

SEQ ID NO: 7226065 - DNA, 22 bp, Homo sapiens
tggcagagtgcggcatcccctg

SEQ ID NO: 7226066 - DNA, 21 bp, Homo sapiens
tggcagagtgcagtctataca

SEQ ID NO: 7226067 - DNA, 21 bp, Homo sapiens
tggcagagtgcagtctataca

SEQ ID NO: 7226068 - DNA, 21 bp, Homo sapiens
tggcagagtgcagtctataca

SEQ ID NO: 7226069 - DNA, 22 bp, Homo sapiens
tggcagagtgcagaagaggcat

SEQ ID NO: 7226070 - DNA, 22 bp, Homo sapiens
tggcagagtgcagaagaggcat

SEQ ID NO: 7226071 - DNA, 22 bp, Homo sapiens
tggcagagtgcagaagaggcat

SEQ ID NO: 7226072 - DNA, 22 bp, Homo sapiens
tggcagagtgcagaagaggcat

SEQ ID NO: 7226073 - DNA, 22 bp, Homo sapiens
tggcagagtgcagaagaggcat

SEQ ID NO: 7226074 - DNA, 22 bp, Homo sapiens
tggcagagtgcagaagaggcat

SEQ ID NO: 7226075 - DNA, 22 bp, Homo sapiens
tggcagagtgcagaagaggcat

SEQ ID NO: 7226076 - DNA, 22 bp, Homo sapiens
tggcagagtctgggcttgggca

SEQ ID NO: 7226077 - DNA, 22 bp, Homo sapiens
tggcagagtctgggcttgggca

SEQ ID NO: 7226078 - DNA, 22 bp, Homo sapiens
tggcagagtctgggcttgggca

SEQ ID NO: 7226079 - DNA, 22 bp, Homo sapiens
tggcagagtctgggcttgggca

SEQ ID NO: 7226080 - DNA, 22 bp, Homo sapiens
tggcagagtctgggcttgggca

SEQ ID NO: 7226081 - DNA, 22 bp, Homo sapiens
tggcagagtctgggcttgggca

SEQ ID NO: 7226082 - DNA, 22 bp, Homo sapiens
tggcagagtctgggcttgggca

SEQ ID NO: 7226083 - DNA, 22 bp, Homo sapiens
tggcagagtctctcctttccag

SEQ ID NO: 7226084 - DNA, 22 bp, Homo sapiens
tggcagagtctgggcttgggca

SEQ ID NO: 7226085 - DNA, 22 bp, Homo sapiens
tggcagagtctctcctttccag

SEQ ID NO: 7226086 - DNA, 22 bp, Homo sapiens
tggcagagtctctcctttccag

SEQ ID NO: 7226087 - DNA, 22 bp, Homo sapiens
tggcagagtctctcctttccag

SEQ ID NO: 7226088 - DNA, 22 bp, Homo sapiens
tggcagagtcatcacatctgga

SEQ ID NO: 7226089 - DNA, 22 bp, Homo sapiens
tggcagagtcatcacatctgga

SEQ ID NO: 7226090 - DNA, 22 bp, Homo sapiens
tggcagagtcatcacatctgga

SEQ ID NO: 7226091 - DNA, 22 bp, Homo sapiens
tggcagagtaggatggccctgt

SEQ ID NO: 7226092 - DNA, 22 bp, Homo sapiens
tggcagagtcatcacatctgga

SEQ ID NO: 7226093 - DNA, 22 bp, Homo sapiens
tggcagagtcatcacatctgga

SEQ ID NO: 7226094 - DNA, 22 bp, Homo sapiens
tggcagagtaggatggccctgt

SEQ ID NO: 7226095 - DNA, 22 bp, Homo sapiens
tggcagagtaggatggccctgt

SEQ ID NO: 7226096 - DNA, 22 bp, Homo sapiens
tggcagagtaggatggccctgt

SEQ ID NO: 7226097 - DNA, 16 bp, Homo sapiens
tggcagaggttcagcc

SEQ ID NO: 7226098 - DNA, 22 bp, Homo sapiens
tggcagagtaggatggccctgt

SEQ ID NO: 7226099 - DNA, 22 bp, Homo sapiens
tggcagagtaggatggccctgt

SEQ ID NO: 7226100 - DNA, 22 bp, Homo sapiens
tggcactaagacggtgcttccc

SEQ ID NO: 7226101 - DNA, 22 bp, Homo sapiens
tggcacgacaattggcaccaat

SEQ ID NO: 7226102 - DNA, 22 bp, Homo sapiens
tggcacgttggattgggagttc

SEQ ID NO: 7226103 - DNA, 22 bp, Homo sapiens
tggcacgacaattggcaccaat

SEQ ID NO: 7226104 - DNA, 22 bp, Homo sapiens
tggcacgacaattggcaccaat

SEQ ID NO: 7226105 - DNA, 22 bp, Homo sapiens
tggcacgacaattggcaccaat

SEQ ID NO: 7226106 - DNA, 22 bp, Homo sapiens
tggcacgacaattggcaccaat

SEQ ID NO: 7226107 - DNA, 22 bp, Homo sapiens
tggcacgacaattggcaccaat

SEQ ID NO: 7226108 - DNA, 22 bp, Homo sapiens
tggcacctgaacttagaggtgt

SEQ ID NO: 7226109 - DNA, 22 bp, Homo sapiens
tggcacctgaacttagaggtgt

SEQ ID NO: 7226110 - DNA, 22 bp, Homo sapiens
tggcacctggtgcagggtggcc

SEQ ID NO: 7226111 - DNA, 22 bp, Homo sapiens
tggcactgacagggtgctcaag

SEQ ID NO: 7226112 - DNA, 22 bp, Homo sapiens
tggcactgacagggtgctcaag

SEQ ID NO: 7226113 - DNA, 22 bp, Homo sapiens
tggcactgaagctggaaagcct

SEQ ID NO: 7226114 - DNA, 22 bp, Homo sapiens
tggcactgaagctggaaagcct

SEQ ID NO: 7226115 - DNA, 22 bp, Homo sapiens
tggcactgaagctggaaagcct

SEQ ID NO: 7226116 - DNA, 22 bp, Homo sapiens
tggcactgaaaaaggagaggtt

SEQ ID NO: 7226117 - DNA, 22 bp, Homo sapiens
tggcactgaaaaaggagaggtt

SEQ ID NO: 7226118 - DNA, 22 bp, Homo sapiens
tggcactcactctcagagtctg

SEQ ID NO: 7226119 - DNA, 22 bp, Homo sapiens
tggcactcactctcagagtctg

SEQ ID NO: 7226120 - DNA, 22 bp, Homo sapiens
tggcactcactctcagagtctg

SEQ ID NO: 7226121 - DNA, 20 bp, Homo sapiens
tggcaccaggtggtggcccc

SEQ ID NO: 7226122 - DNA, 20 bp, Homo sapiens
tggcaccaggtggtggcccc

SEQ ID NO: 7226123 - DNA, 22 bp, Homo sapiens
tggcaccaggcggggtggctgt

SEQ ID NO: 7226124 - DNA, 22 bp, Homo sapiens
tggcaccagggaacaagcattt

SEQ ID NO: 7226125 - DNA, 22 bp, Homo sapiens
tggcaccagcacctagatgggg

SEQ ID NO: 7226126 - DNA, 22 bp, Homo sapiens
tggcaccaaaagcagacgtatt

SEQ ID NO: 7226127 - DNA, 22 bp, Homo sapiens
tggcacagttaaagttgtagaa

SEQ ID NO: 7226128 - DNA, 22 bp, Homo sapiens
tggcacagttaaagttgtagaa

SEQ ID NO: 7226129 - DNA, 22 bp, Homo sapiens
tggcacatagaaaaggatcaat

SEQ ID NO: 7226130 - DNA, 22 bp, Homo sapiens
tggcacatagcaggtactcagt

SEQ ID NO: 7226131 - DNA, 22 bp, Homo sapiens
tggcacatagtaggtgctcaat

SEQ ID NO: 7226132 - DNA, 22 bp, Homo sapiens
tggcacatagtaggtgctcaat

SEQ ID NO: 7226133 - DNA, 22 bp, Homo sapiens
tggcacatgatgttgtggcatc

SEQ ID NO: 7226134 - DNA, 22 bp, Homo sapiens
tggcacatggtaagactcagta

SEQ ID NO: 7226135 - DNA, 22 bp, Homo sapiens
tggcacatggtaagactcagta

SEQ ID NO: 7226136 - DNA, 22 bp, Homo sapiens
tggcacatggtaagtgcttaac

SEQ ID NO: 7226137 - DNA, 22 bp, Homo sapiens
tggcacatggttaatcataatt

SEQ ID NO: 7226138 - DNA, 22 bp, Homo sapiens
tggcacatggttaatcataatt

SEQ ID NO: 7226139 - DNA, 22 bp, Homo sapiens
tggcacttattcatatcatgga

SEQ ID NO: 7226140 - DNA, 22 bp, Homo sapiens
tggcacttccactgtggctgct

SEQ ID NO: 7226141 - DNA, 22 bp, Homo sapiens
tggcactgtggatttcacaagt

SEQ ID NO: 7226142 - DNA, 22 bp, Homo sapiens
tggcactgtggatttcacaagt

SEQ ID NO: 7226143 - DNA, 22 bp, Homo sapiens
tggcacttaaaaattattcttc

SEQ ID NO: 7226144 - DNA, 22 bp, Homo sapiens
tggcacttaatgcatgtgctat

SEQ ID NO: 7226145 - DNA, 22 bp, Homo sapiens
tggcacttagcagggaaggtgt

SEQ ID NO: 7226146 - DNA, 22 bp, Homo sapiens
tggcacttagcagggaaggtgt

SEQ ID NO: 7226147 - DNA, 22 bp, Homo sapiens
tggcactgtcaccaatgctgtc

SEQ ID NO: 7226148 - DNA, 22 bp, Homo sapiens
tggcactgtcaccaatgctgtc

SEQ ID NO: 7226149 - DNA, 22 bp, Homo sapiens
tggcactgggatgctactgtta

SEQ ID NO: 7226150 - DNA, 22 bp, Homo sapiens
tggcactgtagccactactgcc

SEQ ID NO: 7226151 - DNA, 22 bp, Homo sapiens
tggcactgggacagatgctctc

SEQ ID NO: 7226152 - DNA, 22 bp, Homo sapiens
tggcactgggacagatgctctc

SEQ ID NO: 7226153 - DNA, 22 bp, Homo sapiens
tggcactgggatgctactgtta

SEQ ID NO: 7226154 - DNA, 22 bp, Homo sapiens
tggcactggaatcgtagccttg

SEQ ID NO: 7226155 - DNA, 22 bp, Homo sapiens
tggcactggcgcaggatggcgg

SEQ ID NO: 7226156 - DNA, 22 bp, Homo sapiens
tggcactgcctggcagggcccc

SEQ ID NO: 7226157 - DNA, 22 bp, Homo sapiens
tggcactgcctggcagggcccc

SEQ ID NO: 7226158 - DNA, 21 bp, Homo sapiens
tggcactgcttagcaggttcc

SEQ ID NO: 7226159 - DNA, 21 bp, Homo sapiens
tggcactgcttagcaggttcc

SEQ ID NO: 7226160 - DNA, 22 bp, Homo sapiens
tggcactgccaacctgctaggt

SEQ ID NO: 7226161 - DNA, 22 bp, Homo sapiens
tggcactgccaacctgctaggt

SEQ ID NO: 7226162 - DNA, 22 bp, Homo sapiens
tggcactgcactttaagattta

SEQ ID NO: 7226163 - DNA, 22 bp, Homo sapiens
tggcactgagcagccgcggcag

SEQ ID NO: 7226164 - DNA, 22 bp, Homo sapiens
tggcactgagcagccgcggcag

SEQ ID NO: 7226165 - DNA, 22 bp, Homo sapiens
tggcactgccaacctgctaggt

SEQ ID NO: 7226166 - DNA, 22 bp, Homo sapiens
tggcactgccaacctgctaggt

SEQ ID NO: 7226167 - DNA, 22 bp, Homo sapiens
tggcagagagagtgcagtcgac

SEQ ID NO: 7226168 - DNA, 22 bp, Homo sapiens
tggcagagagagtgcagtcgac

SEQ ID NO: 7226169 - DNA, 22 bp, Homo sapiens
tggcagagagagtgcagtcgac

SEQ ID NO: 7226170 - DNA, 22 bp, Homo sapiens
tggcagagagagtgcagtcgac

SEQ ID NO: 7226171 - DNA, 22 bp, Homo sapiens
tggcagagagagtgcagtcgac

SEQ ID NO: 7226172 - DNA, 22 bp, Homo sapiens
tggcagagagactctccttgat

SEQ ID NO: 7226173 - DNA, 22 bp, Homo sapiens
tggcagagagactctccttgat

SEQ ID NO: 7226174 - DNA, 22 bp, Homo sapiens
tggcagagagactctccttgat

SEQ ID NO: 7226175 - DNA, 22 bp, Homo sapiens
tggcagagagactctccttgat

SEQ ID NO: 7226176 - DNA, 22 bp, Homo sapiens
tggcagagactcctcctgggag

SEQ ID NO: 7226177 - DNA, 22 bp, Homo sapiens
tggcagagagactctccttgat

SEQ ID NO: 7226178 - DNA, 22 bp, Homo sapiens
tggcagagactcctcctgggag

SEQ ID NO: 7226179 - DNA, 22 bp, Homo sapiens
tggcagagactcctcctgggag

SEQ ID NO: 7226180 - DNA, 22 bp, Homo sapiens
tggcagagactcctcctgggag

SEQ ID NO: 7226181 - DNA, 22 bp, Homo sapiens
tggcagagactcctcctgggag

SEQ ID NO: 7226182 - DNA, 22 bp, Homo sapiens
tggcagagactcctcctgggag

SEQ ID NO: 7226183 - DNA, 23 bp, Homo sapiens
tggcagagacccagaatctacat

SEQ ID NO: 7226184 - DNA, 23 bp, Homo sapiens
tggcagagacccagaatctacat

SEQ ID NO: 7226185 - DNA, 23 bp, Homo sapiens
tggcagagacccagaatctacat

SEQ ID NO: 7226186 - DNA, 22 bp, Homo sapiens
tggcagagacaaggccgggcct

SEQ ID NO: 7226187 - DNA, 22 bp, Homo sapiens
tggcagagacaaggccgggcct

SEQ ID NO: 7226188 - DNA, 22 bp, Homo sapiens
tggcagagacaaggccgggcct

SEQ ID NO: 7226189 - DNA, 22 bp, Homo sapiens
tggcagagacaaggccgggcct

SEQ ID NO: 7226190 - DNA, 22 bp, Homo sapiens
tggcagagacaaggccgggcct

SEQ ID NO: 7226191 - DNA, 22 bp, Homo sapiens
tggcagagacaaggccgggcct

SEQ ID NO: 7226192 - DNA, 22 bp, Homo sapiens
tggcagagaataaatcttgact

SEQ ID NO: 7226193 - DNA, 22 bp, Homo sapiens
tggcagagaataaatcttgact

SEQ ID NO: 7226194 - DNA, 22 bp, Homo sapiens
tggcagagaacctgggctttgt

SEQ ID NO: 7226195 - DNA, 22 bp, Homo sapiens
tggcagagaataaatcttgact

SEQ ID NO: 7226196 - DNA, 22 bp, Homo sapiens
tggcagagaacctgggctttgt

SEQ ID NO: 7226197 - DNA, 22 bp, Homo sapiens
tggcagagaacctgggctttgt

SEQ ID NO: 7226198 - DNA, 22 bp, Homo sapiens
tggcagagaacacggctgatct

SEQ ID NO: 7226199 - DNA, 22 bp, Homo sapiens
tggcagagaacacggctgatct

SEQ ID NO: 7226200 - DNA, 22 bp, Homo sapiens
tggcagagaacacggctgatct

SEQ ID NO: 7226201 - DNA, 22 bp, Homo sapiens
tggcagagaacacggctgatct

SEQ ID NO: 7226202 - DNA, 16 bp, Homo sapiens
tggcagaggttcagcc

SEQ ID NO: 7226203 - DNA, 22 bp, Homo sapiens
tggcagaggtatattgggagga

SEQ ID NO: 7226204 - DNA, 22 bp, Homo sapiens
tggcagaggtatattgggagga

SEQ ID NO: 7226205 - DNA, 22 bp, Homo sapiens
tggcagaggaaaaagtcactgg

SEQ ID NO: 7226206 - DNA, 22 bp, Homo sapiens
tggcagaggaaaaagtcactgg

SEQ ID NO: 7226207 - DNA, 22 bp, Homo sapiens
tggcagagctggctgcggatga

SEQ ID NO: 7226208 - DNA, 22 bp, Homo sapiens
tggcagagctggctgcggatga

SEQ ID NO: 7226209 - DNA, 22 bp, Homo sapiens
tggcagaggaaaaagtcactgg

SEQ ID NO: 7226210 - DNA, 22 bp, Homo sapiens
tggcagagctggctgcggatga

SEQ ID NO: 7226211 - DNA, 22 bp, Homo sapiens
tggcagagctggctgcggatga

SEQ ID NO: 7226212 - DNA, 22 bp, Homo sapiens
tggcagagccttgccaaactcc

SEQ ID NO: 7226213 - DNA, 22 bp, Homo sapiens
tggcagagctggctgcggatga

SEQ ID NO: 7226214 - DNA, 22 bp, Homo sapiens
tggcagagccttgccaaactcc

SEQ ID NO: 7226215 - DNA, 22 bp, Homo sapiens
tggcagagccttgccaaactcc

SEQ ID NO: 7226216 - DNA, 22 bp, Homo sapiens
tggcagagcccagactccagtc

SEQ ID NO: 7226217 - DNA, 22 bp, Homo sapiens
tggcagagccttgccaaactcc

SEQ ID NO: 7226218 - DNA, 22 bp, Homo sapiens
tggcagagcccagactccagtc

SEQ ID NO: 7226219 - DNA, 22 bp, Homo sapiens
tggcagagcccagactccagtc

SEQ ID NO: 7226220 - DNA, 22 bp, Homo sapiens
tggcagagcccagactccagtc

SEQ ID NO: 7226221 - DNA, 22 bp, Homo sapiens
tggcagagcccagactccagtc

SEQ ID NO: 7226222 - DNA, 22 bp, Homo sapiens
tggcagagcccagaactgagca

SEQ ID NO: 7226223 - DNA, 22 bp, Homo sapiens
tggcagagcccagaactgagca

SEQ ID NO: 7226224 - DNA, 22 bp, Homo sapiens
tggcagagcccagaactgagca

SEQ ID NO: 7226225 - DNA, 22 bp, Homo sapiens
tggcagagcccagaactgagca

SEQ ID NO: 7226226 - DNA, 22 bp, Homo sapiens
tggcagagcccagaactgagca

SEQ ID NO: 7226227 - DNA, 22 bp, Homo sapiens
tggcagagatgaagagttgttt

SEQ ID NO: 7226228 - DNA, 22 bp, Homo sapiens
tggcagagatgaagagttgttt

SEQ ID NO: 7226229 - DNA, 22 bp, Homo sapiens
tggcagagatgaagagttgttt

SEQ ID NO: 7226230 - DNA, 22 bp, Homo sapiens
tggcagagcaaaaagatagaat

SEQ ID NO: 7226231 - DNA, 22 bp, Homo sapiens
tggcagagcaaaaagatagaat

SEQ ID NO: 7226232 - DNA, 22 bp, Homo sapiens
tggcagagcaaaaagatagaat

SEQ ID NO: 7226233 - DNA, 22 bp, Homo sapiens
tggcagagcaaaaagatagaat

SEQ ID NO: 7226234 - DNA, 22 bp, Homo sapiens
tggcaaaggaaatgatttaaga

SEQ ID NO: 7226235 - DNA, 22 bp, Homo sapiens
tggcaaagacgctagctaagat

SEQ ID NO: 7226236 - DNA, 22 bp, Homo sapiens
tggcaaagattaccacatctac

SEQ ID NO: 7226237 - DNA, 22 bp, Homo sapiens
tggcaaattttggcaagctgaa

SEQ ID NO: 7226238 - DNA, 22 bp, Homo sapiens
tggcaacaagaaaggcagaggg

SEQ ID NO: 7226239 - DNA, 22 bp, Homo sapiens
tggcaacacctggaagacatgg

SEQ ID NO: 7226240 - DNA, 22 bp, Homo sapiens
tggcaacatggacaggtctgcc

SEQ ID NO: 7226241 - DNA, 22 bp, Homo sapiens
tggcaacatgtcgaagtgctgt

SEQ ID NO: 7226242 - DNA, 22 bp, Homo sapiens
tggcaatataatcatctgctct

SEQ ID NO: 7226243 - DNA, 22 bp, Homo sapiens
tggcaatacttgtcttggccgc

SEQ ID NO: 7226244 - DNA, 22 bp, Homo sapiens
tggcaatataatcatctgctct

SEQ ID NO: 7226245 - DNA, 22 bp, Homo sapiens
tggcaatatgctttcagtggcc

SEQ ID NO: 7226246 - DNA, 22 bp, Homo sapiens
tggcaatatgctttcagtggcc

SEQ ID NO: 7226247 - DNA, 22 bp, Homo sapiens
tggcaataaagaccaacaggtt

SEQ ID NO: 7226248 - DNA, 22 bp, Homo sapiens
tggcaataaatacatctgggca

SEQ ID NO: 7226249 - DNA, 22 bp, Homo sapiens
tggcaataaatacatctgggca

SEQ ID NO: 7226250 - DNA, 22 bp, Homo sapiens
tggcaatacataatcttaatgg

SEQ ID NO: 7226251 - DNA, 22 bp, Homo sapiens
tggcaacatgtcgaagtgctgt

SEQ ID NO: 7226252 - DNA, 22 bp, Homo sapiens
tggcaacatgtcgaagtgctgt

SEQ ID NO: 7226253 - DNA, 22 bp, Homo sapiens
tggcaaccgcatggcctgcttc

SEQ ID NO: 7226254 - DNA, 22 bp, Homo sapiens
tggcaaccgcatggcctgcttc

SEQ ID NO: 7226255 - DNA, 22 bp, Homo sapiens
tggcaactcctgactctactca

SEQ ID NO: 7226256 - DNA, 20 bp, Homo sapiens
tggattctggagctgccctc

SEQ ID NO: 7226257 - DNA, 22 bp, Homo sapiens
tggattcacaccattctcctgc

SEQ ID NO: 7226258 - DNA, 22 bp, Homo sapiens
tggattcacaccattctcctgc

SEQ ID NO: 7226259 - DNA, 22 bp, Homo sapiens
tggattcacaccattctcctgc

SEQ ID NO: 7226260 - DNA, 22 bp, Homo sapiens
tggattccacgcctgctcctgt

SEQ ID NO: 7226261 - DNA, 20 bp, Homo sapiens
tggattccctcctgggactc

SEQ ID NO: 7226262 - DNA, 19 bp, Homo sapiens
tggatttatattctttatc

SEQ ID NO: 7226263 - DNA, 22 bp, Homo sapiens
tggatttgagatgtgttcagat

SEQ ID NO: 7226264 - DNA, 22 bp, Homo sapiens
tggatttgctaccttctgatat

SEQ ID NO: 7226265 - DNA, 22 bp, Homo sapiens
tggattcaaatttcagctctgt

SEQ ID NO: 7226266 - DNA, 22 bp, Homo sapiens
tggattcaaatttcagctctgt

SEQ ID NO: 7226267 - DNA, 22 bp, Homo sapiens
tggatgtgagagcatcatgttc

SEQ ID NO: 7226268 - DNA, 22 bp, Homo sapiens
tggatgtttgaagttgcatgtg

SEQ ID NO: 7226269 - DNA, 22 bp, Homo sapiens
tggattaaagattaaaatgaca

SEQ ID NO: 7226270 - DNA, 22 bp, Homo sapiens
tggatgtctcagcttgagctgc

SEQ ID NO: 7226271 - DNA, 22 bp, Homo sapiens
tggatgtgagaaggatcaggct

SEQ ID NO: 7226272 - DNA, 22 bp, Homo sapiens
tggatgtcaaaggagtttccag

SEQ ID NO: 7226273 - DNA, 20 bp, Homo sapiens
tggatgtcaaattaggctgg

SEQ ID NO: 7226274 - DNA, 22 bp, Homo sapiens
tggatgtcatagttggatatac

SEQ ID NO: 7226275 - DNA, 22 bp, Homo sapiens
tggatgggttgaaatgtgagcc

SEQ ID NO: 7226276 - DNA, 22 bp, Homo sapiens
tggatggggcagcttaggtgtg

SEQ ID NO: 7226277 - DNA, 22 bp, Homo sapiens
tggatgggttgaaatgtgagcc

SEQ ID NO: 7226278 - DNA, 22 bp, Homo sapiens
tggatgggttgaaatgtgagcc

SEQ ID NO: 7226279 - DNA, 22 bp, Homo sapiens
tggatggttctgggcggcagca

SEQ ID NO: 7226280 - DNA, 22 bp, Homo sapiens
tggatggttgaaaacgggcagt

SEQ ID NO: 7226281 - DNA, 22 bp, Homo sapiens
tggatgtagatgctcttgctga

SEQ ID NO: 7226282 - DNA, 22 bp, Homo sapiens
tggatgggttgaaatgtgagcc

SEQ ID NO: 7226283 - DNA, 21 bp, Homo sapiens
tggcacagcaagtgggctcat

SEQ ID NO: 7226284 - DNA, 19 bp, Homo sapiens
tggcacagatttcctccct

SEQ ID NO: 7226285 - DNA, 19 bp, Homo sapiens
tggcacagatttcctccct

SEQ ID NO: 7226286 - DNA, 22 bp, Homo sapiens
tggcacagcaagagtttgggaa

SEQ ID NO: 7226287 - DNA, 17 bp, Homo sapiens
tggcacagaggtgctat

SEQ ID NO: 7226288 - DNA, 22 bp, Homo sapiens
tggcacagagggacccagcagc

SEQ ID NO: 7226289 - DNA, 22 bp, Homo sapiens
tggcacagagggacccagcagc

SEQ ID NO: 7226290 - DNA, 17 bp, Homo sapiens
tggcacagaggtgctat

SEQ ID NO: 7226291 - DNA, 17 bp, Homo sapiens
tggcacagaggtgctat

SEQ ID NO: 7226292 - DNA, 17 bp, Homo sapiens
tggcacagaggtgctat

SEQ ID NO: 7226293 - DNA, 22 bp, Homo sapiens
tggcacagactgggccaaggaa

SEQ ID NO: 7226294 - DNA, 22 bp, Homo sapiens
tggcacagactgggccaaggaa

SEQ ID NO: 7226295 - DNA, 22 bp, Homo sapiens
tggcacagactgggccaaggaa

SEQ ID NO: 7226296 - DNA, 22 bp, Homo sapiens
tggcacagactgggccaaggaa

SEQ ID NO: 7226297 - DNA, 22 bp, Homo sapiens
tggcacagactgggccaaggaa

SEQ ID NO: 7226298 - DNA, 16 bp, Homo sapiens
tggcacagagcagata

SEQ ID NO: 7226299 - DNA, 16 bp, Homo sapiens
tggcacagagcagata

SEQ ID NO: 7226300 - DNA, 23 bp, Homo sapiens
tggcacagaggaccatgctttgc

SEQ ID NO: 7226301 - DNA, 23 bp, Homo sapiens
tggcacagaggaccatgctttgc

SEQ ID NO: 7226302 - DNA, 22 bp, Homo sapiens
tggcacagagggacccagcagc

SEQ ID NO: 7226303 - DNA, 22 bp, Homo sapiens
tggcacagagggacccagcagc

SEQ ID NO: 7226304 - DNA, 22 bp, Homo sapiens
tggcacagttaaagttgtagaa

SEQ ID NO: 7226305 - DNA, 22 bp, Homo sapiens
tggcacagcctccatgtcgtcc

SEQ ID NO: 7226306 - DNA, 22 bp, Homo sapiens
tggcacagcctttaaagtacca

SEQ ID NO: 7226307 - DNA, 22 bp, Homo sapiens
tggcacagcctttaaagtacca

SEQ ID NO: 7226308 - DNA, 22 bp, Homo sapiens
tggcacagcttgtcataaactc

SEQ ID NO: 7226309 - DNA, 22 bp, Homo sapiens
tggcacagtgctggatggtgct

SEQ ID NO: 7226310 - DNA, 22 bp, Homo sapiens
tggcacagcccattcagagaag

SEQ ID NO: 7226311 - DNA, 22 bp, Homo sapiens
tggcacagcccattcagagaag

SEQ ID NO: 7226312 - DNA, 22 bp, Homo sapiens
tggcacagcccagagctcttga

SEQ ID NO: 7226313 - DNA, 22 bp, Homo sapiens
tggcacagcccattcagagaag

SEQ ID NO: 7226314 - DNA, 22 bp, Homo sapiens
tggcacagcccggattctatga

SEQ ID NO: 7226315 - DNA, 22 bp, Homo sapiens
tggcacagcctccatgtcgtcc

SEQ ID NO: 7226316 - DNA, 21 bp, Homo sapiens
tggcacagcaagtgggctcat

SEQ ID NO: 7226317 - DNA, 21 bp, Homo sapiens
tggcacagcaagtgggctcat

SEQ ID NO: 7226318 - DNA, 23 bp, Homo sapiens
tggcacagcaggtgtgctttgtt

SEQ ID NO: 7226319 - DNA, 23 bp, Homo sapiens
tggcacagcaggtgtgctttgtt

SEQ ID NO: 7226320 - DNA, 23 bp, Homo sapiens
tggcacagcaggtgtgctttgtt

SEQ ID NO: 7226321 - DNA, 22 bp, Homo sapiens
tggcacagccactgaatcggga

SEQ ID NO: 7226322 - DNA, 22 bp, Homo sapiens
tggcacagccactgaatcggga

SEQ ID NO: 7226323 - DNA, 22 bp, Homo sapiens
tggcacagccactgaatcggga

SEQ ID NO: 7226324 - DNA, 22 bp, Homo sapiens
tggcacagccatcttctcctgc

SEQ ID NO: 7226325 - DNA, 22 bp, Homo sapiens
tggcacagcccagagctcttga

SEQ ID NO: 7226326 - DNA, 22 bp, Homo sapiens
tggcacagcccagagctcttga

SEQ ID NO: 7226327 - DNA, 22 bp, Homo sapiens
tggcacagacagcacagcaatg

SEQ ID NO: 7226328 - DNA, 22 bp, Homo sapiens
tggcacagacagatcaggagtc

SEQ ID NO: 7226329 - DNA, 22 bp, Homo sapiens
tggcacagacagcacagcaatg

SEQ ID NO: 7226330 - DNA, 22 bp, Homo sapiens
tggcacagacagcacagcaatg

SEQ ID NO: 7226331 - DNA, 22 bp, Homo sapiens
tggcacagacagcacagcaatg

SEQ ID NO: 7226332 - DNA, 22 bp, Homo sapiens
tggcacagaccttatcttctct

SEQ ID NO: 7226333 - DNA, 22 bp, Homo sapiens
tggcacagaccttatcttctct

SEQ ID NO: 7226334 - DNA, 22 bp, Homo sapiens
tggcacagaccttatcttctct

SEQ ID NO: 7226335 - DNA, 22 bp, Homo sapiens
tggcacagacagcacagcaatg

SEQ ID NO: 7226336 - DNA, 22 bp, Homo sapiens
tggcacagacatttaatagcct

SEQ ID NO: 7226337 - DNA, 21 bp, Homo sapiens
tggcacagaaaggaaagttca

SEQ ID NO: 7226338 - DNA, 21 bp, Homo sapiens
tggcacagaaaggaaagttca

SEQ ID NO: 7226339 - DNA, 21 bp, Homo sapiens
tggcacagaaaggaaagttca

SEQ ID NO: 7226340 - DNA, 20 bp, Homo sapiens
tggcacagaacccttgccta

SEQ ID NO: 7226341 - DNA, 20 bp, Homo sapiens
tggcacagaacccttgccta

SEQ ID NO: 7226342 - DNA, 20 bp, Homo sapiens
tggcacagaacccttgccta

SEQ ID NO: 7226343 - DNA, 22 bp, Homo sapiens
tggcacagacagatcaggagtc

SEQ ID NO: 7226344 - DNA, 22 bp, Homo sapiens
tggcacagacagatcaggagtc

SEQ ID NO: 7226345 - DNA, 22 bp, Homo sapiens
tggcacagacagatcaggagtc

SEQ ID NO: 7226346 - DNA, 22 bp, Homo sapiens
tggcacagacagatcaggagtc

SEQ ID NO: 7226347 - DNA, 22 bp, Homo sapiens
tggcacacagagaagacacttg

SEQ ID NO: 7226348 - DNA, 22 bp, Homo sapiens
tggcacaaaagtaattgcagtt

SEQ ID NO: 7226349 - DNA, 22 bp, Homo sapiens
tggcacaagggctattccttag

SEQ ID NO: 7226350 - DNA, 22 bp, Homo sapiens
tggcacagaaaaatgctccatt

SEQ ID NO: 7226351 - DNA, 22 bp, Homo sapiens
tggcacagaaaaatgctccatt

SEQ ID NO: 7226352 - DNA, 22 bp, Homo sapiens
tggcaatttcacatggcttaac

SEQ ID NO: 7226353 - DNA, 22 bp, Homo sapiens
tggcaattttaggtggtttagt

SEQ ID NO: 7226354 - DNA, 22 bp, Homo sapiens
tggcaattggcaatttcgtatg

SEQ ID NO: 7226355 - DNA, 22 bp, Homo sapiens
tggcaattgtccactgtctgcc

SEQ ID NO: 7226356 - DNA, 23 bp, Homo sapiens
tggcaattcctgagctctgagaa

SEQ ID NO: 7226357 - DNA, 22 bp, Homo sapiens
tggcaattctctacctttctca

SEQ ID NO: 7226358 - DNA, 22 bp, Homo sapiens
tggcaatgtggaatggtccagg

SEQ ID NO: 7226359 - DNA, 22 bp, Homo sapiens
tggcaatgtggcatcaacgaag

SEQ ID NO: 7226360 - DNA, 22 bp, Homo sapiens
tggcaatgtggcatcaacgaag

SEQ ID NO: 7226361 - DNA, 22 bp, Homo sapiens
tggcaatgttagcaaagcattt

SEQ ID NO: 7226362 - DNA, 22 bp, Homo sapiens
tggcaattcctgagctctgaga

SEQ ID NO: 7226363 - DNA, 22 bp, Homo sapiens
tggcaatattaacagtacttat

SEQ ID NO: 7226364 - DNA, 22 bp, Homo sapiens
tggcaatgagcaggtgctctgg

SEQ ID NO: 7226365 - DNA, 22 bp, Homo sapiens
tggcaatgagcaggtgctctgg

SEQ ID NO: 7226366 - DNA, 22 bp, Homo sapiens
tggcaatgaggtcagatgtctt

SEQ ID NO: 7226367 - DNA, 22 bp, Homo sapiens
tggaaggggagctggaaagggg

SEQ ID NO: 7226368 - DNA, 22 bp, Homo sapiens
tggaaggggagctggaaagggg

SEQ ID NO: 7226369 - DNA, 22 bp, Homo sapiens
tggaaggggagctggaaagggg

SEQ ID NO: 7226370 - DNA, 22 bp, Homo sapiens
tggaaggggagctggaaagggg

SEQ ID NO: 7226371 - DNA, 22 bp, Homo sapiens
tggaaggggagctggaaagggg

SEQ ID NO: 7226372 - DNA, 22 bp, Homo sapiens
tggaagggagtgacagtcagag

SEQ ID NO: 7226373 - DNA, 22 bp, Homo sapiens
tggaagggagtgacagtcagag

SEQ ID NO: 7226374 - DNA, 22 bp, Homo sapiens
tggaagggagtgacagtcagag

SEQ ID NO: 7226375 - DNA, 22 bp, Homo sapiens
tggaagggagtgacagtcagag

SEQ ID NO: 7226376 - DNA, 22 bp, Homo sapiens
tggaagggagtgacagtcagag

SEQ ID NO: 7226377 - DNA, 22 bp, Homo sapiens
tggaaggagactgggaagtgtg

SEQ ID NO: 7226378 - DNA, 22 bp, Homo sapiens
tggaaggagactgggaagtgtg

SEQ ID NO: 7226379 - DNA, 22 bp, Homo sapiens
tggaaggagactgggaagtgtg

SEQ ID NO: 7226380 - DNA, 22 bp, Homo sapiens
tggaaggaagccaaggaaggtt

SEQ ID NO: 7226381 - DNA, 22 bp, Homo sapiens
tggaaggaagccaaggaaggtt

SEQ ID NO: 7226382 - DNA, 22 bp, Homo sapiens
tggaaggaagccaaggaaggtt

SEQ ID NO: 7226383 - DNA, 22 bp, Homo sapiens
tggaaggagctaaggacctggg

SEQ ID NO: 7226384 - DNA, 22 bp, Homo sapiens
tggaaggagctaaggacctggg

SEQ ID NO: 7226385 - DNA, 22 bp, Homo sapiens
tggaaggagctaaggacctggg

SEQ ID NO: 7226386 - DNA, 22 bp, Homo sapiens
tggaaggcaacggagtgagctg

SEQ ID NO: 7226387 - DNA, 22 bp, Homo sapiens
tggaaggagctaaggacctggg

SEQ ID NO: 7226388 - DNA, 22 bp, Homo sapiens
tggaaggagactgggaagtgtg

SEQ ID NO: 7226389 - DNA, 22 bp, Homo sapiens
tggaaggggttacgcagcagga

SEQ ID NO: 7226390 - DNA, 22 bp, Homo sapiens
tggaaggggttacgcagcagga

SEQ ID NO: 7226391 - DNA, 22 bp, Homo sapiens
tggaaggggttacgcagcagga

SEQ ID NO: 7226392 - DNA, 22 bp, Homo sapiens
tggaaggggttacgcagcagga

SEQ ID NO: 7226393 - DNA, 20 bp, Homo sapiens
tggaaggtcccagaggaatt

SEQ ID NO: 7226394 - DNA, 22 bp, Homo sapiens
tggaaggggttacgcagcagga

SEQ ID NO: 7226395 - DNA, 16 bp, Homo sapiens
tggaaggggtctccgg

SEQ ID NO: 7226396 - DNA, 22 bp, Homo sapiens
tggaaggggttacgcagcagga

SEQ ID NO: 7226397 - DNA, 22 bp, Homo sapiens
tggaagggggaagacagctctg

SEQ ID NO: 7226398 - DNA, 16 bp, Homo sapiens
tggaaggggtctccgg

SEQ ID NO: 7226399 - DNA, 22 bp, Homo sapiens
tggaaggggccaggcgcggagt

SEQ ID NO: 7226400 - DNA, 22 bp, Homo sapiens
tggaaggggccaggcgcggagt

SEQ ID NO: 7226401 - DNA, 22 bp, Homo sapiens
tggaaggggagttgttccacgt

SEQ ID NO: 7226402 - DNA, 22 bp, Homo sapiens
tggaaggggccaggcgcggagt

SEQ ID NO: 7226403 - DNA, 22 bp, Homo sapiens
tggaaggggagttgttccacgt

SEQ ID NO: 7226404 - DNA, 22 bp, Homo sapiens
tggaaggggagctggaaagggg

SEQ ID NO: 7226405 - DNA, 22 bp, Homo sapiens
tggaagggggaagacagctctg

SEQ ID NO: 7226406 - DNA, 22 bp, Homo sapiens
tggaagggggaagacagctctg

SEQ ID NO: 7226407 - DNA, 22 bp, Homo sapiens
tggaagggggaagacagctctg

SEQ ID NO: 7226408 - DNA, 22 bp, Homo sapiens
tggaaggggccaggcgcggagt

SEQ ID NO: 7226409 - DNA, 22 bp, Homo sapiens
tggaaggggccaggcgcggagt

SEQ ID NO: 7226410 - DNA, 22 bp, Homo sapiens
tggaataactcaccaaggtcat

SEQ ID NO: 7226411 - DNA, 22 bp, Homo sapiens
tggaagttgaatctcagtcatg

SEQ ID NO: 7226412 - DNA, 22 bp, Homo sapiens
tggaataaaatgtcagttctta

SEQ ID NO: 7226413 - DNA, 22 bp, Homo sapiens
tggaataaagcagctttagttc

SEQ ID NO: 7226414 - DNA, 20 bp, Homo sapiens
tggaagttctgttgcattgg

SEQ ID NO: 7226415 - DNA, 23 bp, Homo sapiens
tggaagtgtcttgggtattccag

SEQ ID NO: 7226416 - DNA, 22 bp, Homo sapiens
tggaagtgtctacatgtggagt

SEQ ID NO: 7226417 - DNA, 22 bp, Homo sapiens
tggaagtgtctacatgtggagt

SEQ ID NO: 7226418 - DNA, 22 bp, Homo sapiens
tggaagtggcagaggaagtggt

SEQ ID NO: 7226419 - DNA, 23 bp, Homo sapiens
tggaagtggcagggagacaaagc

SEQ ID NO: 7226420 - DNA, 21 bp, Homo sapiens
tggaagtggttcatttgctgc

SEQ ID NO: 7226421 - DNA, 22 bp, Homo sapiens
tggaagtggcagaaaatgaaca

SEQ ID NO: 7226422 - DNA, 22 bp, Homo sapiens
tggaagtgctcttctgaccaac

SEQ ID NO: 7226423 - DNA, 17 bp, Homo sapiens
tggaagtgaggacactg

SEQ ID NO: 7226424 - DNA, 17 bp, Homo sapiens
tggaagtgaggacactg

SEQ ID NO: 7226425 - DNA, 22 bp, Homo sapiens
tggaagtgatgctgaggtgacg

SEQ ID NO: 7226426 - DNA, 22 bp, Homo sapiens
tggaagtgatgctgaggtgacg

SEQ ID NO: 7226427 - DNA, 22 bp, Homo sapiens
tggaagtgattacaatgtagta

SEQ ID NO: 7226428 - DNA, 22 bp, Homo sapiens
tggaatctgtgctgttttagtg

SEQ ID NO: 7226429 - DNA, 23 bp, Homo sapiens
tggaatcagccttttttccaagg

SEQ ID NO: 7226430 - DNA, 23 bp, Homo sapiens
tggaatcagccttttttccaagg

SEQ ID NO: 7226431 - DNA, 22 bp, Homo sapiens
tggaatcagttacatgtggttg

SEQ ID NO: 7226432 - DNA, 22 bp, Homo sapiens
tggaatcattgctgtgttgctt

SEQ ID NO: 7226433 - DNA, 22 bp, Homo sapiens
tggaatcattggagagctgtaa

SEQ ID NO: 7226434 - DNA, 18 bp, Homo sapiens
tggaatcattgtcaccat

SEQ ID NO: 7226435 - DNA, 22 bp, Homo sapiens
tggaatccaattatcagcatgg

SEQ ID NO: 7226436 - DNA, 21 bp, Homo sapiens
tggaatccccaagaaagcagc

SEQ ID NO: 7226437 - DNA, 22 bp, Homo sapiens
tggaatcccgcaatggaggatt

SEQ ID NO: 7226438 - DNA, 22 bp, Homo sapiens
tggaatcccgcaatggaggatt

SEQ ID NO: 7226439 - DNA, 18 bp, Homo sapiens
tggaatcctgatgctggg

SEQ ID NO: 7226440 - DNA, 22 bp, Homo sapiens
tggaatactgtaaagaaaaatc

SEQ ID NO: 7226441 - DNA, 22 bp, Homo sapiens
tggaatcaagaactttggttat

SEQ ID NO: 7226442 - DNA, 22 bp, Homo sapiens
tggaatcacctgttggtttgca

SEQ ID NO: 7226443 - DNA, 22 bp, Homo sapiens
tggaatcagactcctgcatttt

SEQ ID NO: 7226444 - DNA, 19 bp, Homo sapiens
tggaatcagcaagaatatt

SEQ ID NO: 7226445 - DNA, 23 bp, Homo sapiens
tggaataataaggtacattaaca

SEQ ID NO: 7226446 - DNA, 23 bp, Homo sapiens
tggaataataaggtacattaaca

SEQ ID NO: 7226447 - DNA, 23 bp, Homo sapiens
tggaataataaggtacattaaca

SEQ ID NO: 7226448 - DNA, 22 bp, Homo sapiens
tggaataatgaccacagaaaca

SEQ ID NO: 7226449 - DNA, 22 bp, Homo sapiens
tggaataactcaccaaggtcat

SEQ ID NO: 7226450 - DNA, 22 bp, Homo sapiens
tggaataaggaatctttcagaa

SEQ ID NO: 7226451 - DNA, 20 bp, Homo sapiens
tggaataagttaagttgttt

SEQ ID NO: 7226452 - DNA, 22 bp, Homo sapiens
tggaaggaaaggtagcagagaa

SEQ ID NO: 7226453 - DNA, 22 bp, Homo sapiens
tggaaggaaaggtagcagagaa

SEQ ID NO: 7226454 - DNA, 22 bp, Homo sapiens
tggaaggaaaggtagcagagaa

SEQ ID NO: 7226455 - DNA, 22 bp, Homo sapiens
tggaaggaaaggtagcagagaa

SEQ ID NO: 7226456 - DNA, 22 bp, Homo sapiens
tggaaggaaaggtagcagagaa

SEQ ID NO: 7226457 - DNA, 22 bp, Homo sapiens
tggaaggaagccaaggaaggtt

SEQ ID NO: 7226458 - DNA, 22 bp, Homo sapiens
tggaaggaagccaaggaaggtt

SEQ ID NO: 7226459 - DNA, 22 bp, Homo sapiens
tggaaggaagccaaggaaggtt

SEQ ID NO: 7226460 - DNA, 22 bp, Homo sapiens
tggaaggaagccaaggaaggtt

SEQ ID NO: 7226461 - DNA, 22 bp, Homo sapiens
tggaaggaagccaaggaaggtt

SEQ ID NO: 7226462 - DNA, 22 bp, Homo sapiens
tggaaggaacagagtttgaaac

SEQ ID NO: 7226463 - DNA, 22 bp, Homo sapiens
tggaaggaacagagtttgaaac

SEQ ID NO: 7226464 - DNA, 22 bp, Homo sapiens
tggaaggaaaggtagcagagaa

SEQ ID NO: 7226465 - DNA, 17 bp, Homo sapiens
tggaagcttcatgttgg

SEQ ID NO: 7226466 - DNA, 18 bp, Homo sapiens
tggaagctggtgagcaga

SEQ ID NO: 7226467 - DNA, 17 bp, Homo sapiens
tggaagcttcatgttgg

SEQ ID NO: 7226468 - DNA, 22 bp, Homo sapiens
tggaagcttttgagattgttgc

SEQ ID NO: 7226469 - DNA, 18 bp, Homo sapiens
tggaagctggcagatttt

SEQ ID NO: 7226470 - DNA, 22 bp, Homo sapiens
tggaagccgtagggtttgggaa

SEQ ID NO: 7226471 - DNA, 22 bp, Homo sapiens
tggaagcagagagctatcacca

SEQ ID NO: 7226472 - DNA, 22 bp, Homo sapiens
tggaagcagtcacttcctagtt

SEQ ID NO: 7226473 - DNA, 23 bp, Homo sapiens
tggaagcaatcactgtagtgaat

SEQ ID NO: 7226474 - DNA, 22 bp, Homo sapiens
tggaagcacaggatcagtggaa

SEQ ID NO: 7226475 - DNA, 22 bp, Homo sapiens
tggaagcacaggatcagtggaa

SEQ ID NO: 7226476 - DNA, 22 bp, Homo sapiens
tggaagcatcacttcttgcctg

SEQ ID NO: 7226477 - DNA, 22 bp, Homo sapiens
tggaagcatcacttcttgcctg

SEQ ID NO: 7226478 - DNA, 22 bp, Homo sapiens
tggaagccaggcccgctcctaa

SEQ ID NO: 7226479 - DNA, 22 bp, Homo sapiens
tggaagcccagaaggaagcaga

SEQ ID NO: 7226480 - DNA, 22 bp, Homo sapiens
tggaagcccagaaggaagcaga

SEQ ID NO: 7226481 - DNA, 22 bp, Homo sapiens
tggaagagggagctgggtggcc

SEQ ID NO: 7226482 - DNA, 22 bp, Homo sapiens
tggaagataagagattgggaag

SEQ ID NO: 7226483 - DNA, 22 bp, Homo sapiens
tggaagatgaataaagattcta

SEQ ID NO: 7226484 - DNA, 22 bp, Homo sapiens
tggaagaggcccatgactgcct

SEQ ID NO: 7226485 - DNA, 22 bp, Homo sapiens
tggaagaggccagaaagtggga

SEQ ID NO: 7226486 - DNA, 19 bp, Homo sapiens
tggaagaggaagggaaata

SEQ ID NO: 7226487 - DNA, 19 bp, Homo sapiens
tggaagaggaagggaaata

SEQ ID NO: 7226488 - DNA, 20 bp, Homo sapiens
tggaagaggagatgcctctg

SEQ ID NO: 7226489 - DNA, 19 bp, Homo sapiens
tggaagaggaagggaaata

SEQ ID NO: 7226490 - DNA, 22 bp, Homo sapiens
tggaagagaaaggagtggatct

SEQ ID NO: 7226491 - DNA, 22 bp, Homo sapiens
tggaagagaaaggagtggatct

SEQ ID NO: 7226492 - DNA, 23 bp, Homo sapiens
tggaagactcctctcttggctgc

SEQ ID NO: 7226493 - DNA, 22 bp, Homo sapiens
tggaagaccagacttcccgaac

SEQ ID NO: 7226494 - DNA, 22 bp, Homo sapiens
tggaagacggaaatctgtagat

SEQ ID NO: 7226495 - DNA, 22 bp, Homo sapiens
tggaagacatactgttttctta

SEQ ID NO: 7226496 - DNA, 22 bp, Homo sapiens
tggaagacattttggaccttgg

SEQ ID NO: 7226497 - DNA, 22 bp, Homo sapiens
tggaagacattttggaccttgg

SEQ ID NO: 7226498 - DNA, 22 bp, Homo sapiens
tggaagaccagacttcccgaac

SEQ ID NO: 7226499 - DNA, 22 bp, Homo sapiens
tggacctgagcctggccctgcc

SEQ ID NO: 7226500 - DNA, 22 bp, Homo sapiens
tggacctgagcctggccctgcc

SEQ ID NO: 7226501 - DNA, 22 bp, Homo sapiens
tggacctgaagaataggaagta

SEQ ID NO: 7226502 - DNA, 22 bp, Homo sapiens
tggacctgaagaataggaagta

SEQ ID NO: 7226503 - DNA, 22 bp, Homo sapiens
tggacctgctggatgggcaggt

SEQ ID NO: 7226504 - DNA, 22 bp, Homo sapiens
tggacctgctggatgggcaggt

SEQ ID NO: 7226505 - DNA, 22 bp, Homo sapiens
tggacctggggtggcctcctct

SEQ ID NO: 7226506 - DNA, 22 bp, Homo sapiens
tggacctggggtggcctcctct

SEQ ID NO: 7226507 - DNA, 22 bp, Homo sapiens
tggaccccagacaagccagggt

SEQ ID NO: 7226508 - DNA, 22 bp, Homo sapiens
tggaccccctcaaggcagagct

SEQ ID NO: 7226509 - DNA, 22 bp, Homo sapiens
tggaccctgaagcaacagggag

SEQ ID NO: 7226510 - DNA, 23 bp, Homo sapiens
tggaccctgcacaccagctctac

SEQ ID NO: 7226511 - DNA, 22 bp, Homo sapiens
tggaccctttatgcggaacagg

SEQ ID NO: 7226512 - DNA, 22 bp, Homo sapiens
tggaccggcagtggctatacag

SEQ ID NO: 7226513 - DNA, 22 bp, Homo sapiens
tggactctatgatgcgccagca

SEQ ID NO: 7226514 - DNA, 22 bp, Homo sapiens
tggactctaagcagaggatcta

SEQ ID NO: 7226515 - DNA, 22 bp, Homo sapiens
tggactctgaactggcactgac

SEQ ID NO: 7226516 - DNA, 22 bp, Homo sapiens
tggactggaatgctgatcctct

SEQ ID NO: 7226517 - DNA, 22 bp, Homo sapiens
tggactgggctaatggcagaca

SEQ ID NO: 7226518 - DNA, 21 bp, Homo sapiens
tggactggtgagtttaggctg

SEQ ID NO: 7226519 - DNA, 19 bp, Homo sapiens
tggacctgtgcccatggct

SEQ ID NO: 7226520 - DNA, 22 bp, Homo sapiens
tggactatcatatctctgtgca

SEQ ID NO: 7226521 - DNA, 22 bp, Homo sapiens
tggactcaagtccaagttcacg

SEQ ID NO: 7226522 - DNA, 22 bp, Homo sapiens
tggactcaccttgagttagcca

SEQ ID NO: 7226523 - DNA, 22 bp, Homo sapiens
tggactcagaagtgttctttta

SEQ ID NO: 7226524 - DNA, 22 bp, Homo sapiens
tggactcagaagtgttctttta

SEQ ID NO: 7226525 - DNA, 22 bp, Homo sapiens
tggactcagagttggtggcagt

SEQ ID NO: 7226526 - DNA, 22 bp, Homo sapiens
tggactcagagttggtggcagt

SEQ ID NO: 7226527 - DNA, 22 bp, Homo sapiens
tggactcagagttggtggcagt

SEQ ID NO: 7226528 - DNA, 22 bp, Homo sapiens
tggactcagtgctgccattccc

SEQ ID NO: 7226529 - DNA, 22 bp, Homo sapiens
tggactcagtgctgccattccc

SEQ ID NO: 7226530 - DNA, 22 bp, Homo sapiens
tggactccagtgtctgtgttct

SEQ ID NO: 7226531 - DNA, 22 bp, Homo sapiens
tggactcccagagctgctctcc

SEQ ID NO: 7226532 - DNA, 22 bp, Homo sapiens
tggacaggctcctaggggttcc

SEQ ID NO: 7226533 - DNA, 22 bp, Homo sapiens
tggacaggctcctaggggttcc

SEQ ID NO: 7226534 - DNA, 22 bp, Homo sapiens
tggacaggctcctaggggttcc

SEQ ID NO: 7226535 - DNA, 22 bp, Homo sapiens
tggacagggcagagaccgagtc

SEQ ID NO: 7226536 - DNA, 22 bp, Homo sapiens
tggacagggcagagaccgagtc

SEQ ID NO: 7226537 - DNA, 22 bp, Homo sapiens
tggacaggctcctaggggttcc

SEQ ID NO: 7226538 - DNA, 22 bp, Homo sapiens
tggacagggcagagaccgagtc

SEQ ID NO: 7226539 - DNA, 22 bp, Homo sapiens
tggacagggcagagaccgagtc

SEQ ID NO: 7226540 - DNA, 20 bp, Homo sapiens
tggacaggggcataggttgc

SEQ ID NO: 7226541 - DNA, 20 bp, Homo sapiens
tggacaggggcataggttgc

SEQ ID NO: 7226542 - DNA, 20 bp, Homo sapiens
tggacaggggcataggttgc

SEQ ID NO: 7226543 - DNA, 20 bp, Homo sapiens
tggacaggggcataggttgc

SEQ ID NO: 7226544 - DNA, 20 bp, Homo sapiens
tggacaggggcataggttgc

SEQ ID NO: 7226545 - DNA, 20 bp, Homo sapiens
tggacaggggcataggttgc

SEQ ID NO: 7226546 - DNA, 18 bp, Homo sapiens
tggacagggtggagaaaa

SEQ ID NO: 7226547 - DNA, 18 bp, Homo sapiens
tggacagggtggagaaaa

SEQ ID NO: 7226548 - DNA, 18 bp, Homo sapiens
tggacagggtggagaaaa

SEQ ID NO: 7226549 - DNA, 18 bp, Homo sapiens
tggacagggtggagaaaa

SEQ ID NO: 7226550 - DNA, 18 bp, Homo sapiens
tggacagggtggagaaaa

SEQ ID NO: 7226551 - DNA, 18 bp, Homo sapiens
tggacagggtggagaaaa

SEQ ID NO: 7226552 - DNA, 22 bp, Homo sapiens
tggacaggggctgctgttgtca

SEQ ID NO: 7226553 - DNA, 22 bp, Homo sapiens
tggacaggggctgctgttgtca

SEQ ID NO: 7226554 - DNA, 22 bp, Homo sapiens
tggacaggggctgctgttgtca

SEQ ID NO: 7226555 - DNA, 22 bp, Homo sapiens
tggacaggggctgctgttgtca

SEQ ID NO: 7226556 - DNA, 22 bp, Homo sapiens
tggacaggggctgctgttgtca

SEQ ID NO: 7226557 - DNA, 23 bp, Homo sapiens
tggacagggtaactggtggtttt

SEQ ID NO: 7226558 - DNA, 23 bp, Homo sapiens
tggacagggtaactggtggtttt

SEQ ID NO: 7226559 - DNA, 23 bp, Homo sapiens
tggacagggtaactggtggtttt

SEQ ID NO: 7226560 - DNA, 23 bp, Homo sapiens
tggacagggtaactggtggtttt

SEQ ID NO: 7226561 - DNA, 23 bp, Homo sapiens
tggacagggtaactggtggtttt

SEQ ID NO: 7226562 - DNA, 22 bp, Homo sapiens
tggacaggtgcacacagcagcc

SEQ ID NO: 7226563 - DNA, 22 bp, Homo sapiens
tggacaggtgagtgactcaggg

SEQ ID NO: 7226564 - DNA, 22 bp, Homo sapiens
tggacaggtgagtgactcaggg

SEQ ID NO: 7226565 - DNA, 22 bp, Homo sapiens
tggacaggtgagtgactcaggg

SEQ ID NO: 7226566 - DNA, 22 bp, Homo sapiens
tggacaggtgagtgactcaggg

SEQ ID NO: 7226567 - DNA, 22 bp, Homo sapiens
tggacattccacccatatcaga

SEQ ID NO: 7226568 - DNA, 21 bp, Homo sapiens
tggacatttacccttcaggga

SEQ ID NO: 7226569 - DNA, 22 bp, Homo sapiens
tggacatttggaatactatatt

SEQ ID NO: 7226570 - DNA, 22 bp, Homo sapiens
tggaccatgagctgcaggtgtt

SEQ ID NO: 7226571 - DNA, 20 bp, Homo sapiens
tggaccataaacaccaggta

SEQ ID NO: 7226572 - DNA, 21 bp, Homo sapiens
tggaccaggaaggtggtggtg

SEQ ID NO: 7226573 - DNA, 22 bp, Homo sapiens
tggaccagggtcccagagtatg

SEQ ID NO: 7226574 - DNA, 22 bp, Homo sapiens
tggaccagcagccccagtgcct

SEQ ID NO: 7226575 - DNA, 22 bp, Homo sapiens
tggaccagcagccccagtgcct

SEQ ID NO: 7226576 - DNA, 22 bp, Homo sapiens
tggaccagctcctcgggagacg

SEQ ID NO: 7226577 - DNA, 22 bp, Homo sapiens
tggacaggatctgagactgaga

SEQ ID NO: 7226578 - DNA, 22 bp, Homo sapiens
tggacaggatctgagactgaga

SEQ ID NO: 7226579 - DNA, 22 bp, Homo sapiens
tggacaggatctgagactgaga

SEQ ID NO: 7226580 - DNA, 22 bp, Homo sapiens
tggacaggcaagcaagacatac

SEQ ID NO: 7226581 - DNA, 22 bp, Homo sapiens
tggacaggcaagcaagacatac

SEQ ID NO: 7226582 - DNA, 22 bp, Homo sapiens
tggacaggcaagcaagacatac

SEQ ID NO: 7226583 - DNA, 22 bp, Homo sapiens
tggacaggcaagcaagacatac

SEQ ID NO: 7226584 - DNA, 22 bp, Homo sapiens
tggacaggcaagcaagacatac

SEQ ID NO: 7226585 - DNA, 22 bp, Homo sapiens
tggacaggatctgagactgaga

SEQ ID NO: 7226586 - DNA, 22 bp, Homo sapiens
tggacaggatctgagactgaga

SEQ ID NO: 7226587 - DNA, 22 bp, Homo sapiens
tggacaggatctgagactgaga

SEQ ID NO: 7226588 - DNA, 22 bp, Homo sapiens
tggacaggatagtgcagtacgc

SEQ ID NO: 7226589 - DNA, 23 bp, Homo sapiens
tggacaggacccccttcggaccc

SEQ ID NO: 7226590 - DNA, 22 bp, Homo sapiens
tggacaggatagtgcagtacgc

SEQ ID NO: 7226591 - DNA, 22 bp, Homo sapiens
tggacaggatagtgcagtacgc

SEQ ID NO: 7226592 - DNA, 22 bp, Homo sapiens
tggacaggatagtgcagtacgc

SEQ ID NO: 7226593 - DNA, 22 bp, Homo sapiens
tggacagcttgcagagccaccc

SEQ ID NO: 7226594 - DNA, 22 bp, Homo sapiens
tggacagcttgcagagccaccc

SEQ ID NO: 7226595 - DNA, 22 bp, Homo sapiens
tggacagcttgcagagccaccc

SEQ ID NO: 7226596 - DNA, 23 bp, Homo sapiens
tggacaggacccccttcggaccc

SEQ ID NO: 7226597 - DNA, 23 bp, Homo sapiens
tggacaggacccccttcggaccc

SEQ ID NO: 7226598 - DNA, 23 bp, Homo sapiens
tggacaggacccccttcggaccc

SEQ ID NO: 7226599 - DNA, 23 bp, Homo sapiens
tggacaggacccccttcggaccc

SEQ ID NO: 7226600 - DNA, 22 bp, Homo sapiens
tggacagcaaacatggagagaa

SEQ ID NO: 7226601 - DNA, 23 bp, Homo sapiens
tggacagcagcagcagtgtcacc

SEQ ID NO: 7226602 - DNA, 22 bp, Homo sapiens
tggacagcgaaagtgcctggga

SEQ ID NO: 7226603 - DNA, 22 bp, Homo sapiens
tggacagcgaaagtgcctggga

SEQ ID NO: 7226604 - DNA, 23 bp, Homo sapiens
tggacagcagcagcagtgtcacc

SEQ ID NO: 7226605 - DNA, 22 bp, Homo sapiens
tggacagcgaaagtgcctggga

SEQ ID NO: 7226606 - DNA, 22 bp, Homo sapiens
tggacagcgaaagtgcctggga

SEQ ID NO: 7226607 - DNA, 22 bp, Homo sapiens
tggacaacatagtgagacctca

SEQ ID NO: 7226608 - DNA, 22 bp, Homo sapiens
tggacaatcaatggaggtaagt

SEQ ID NO: 7226609 - DNA, 18 bp, Homo sapiens
tggacacatggcctgggt

SEQ ID NO: 7226610 - DNA, 22 bp, Homo sapiens
tggacacatcactgcagccact

SEQ ID NO: 7226611 - DNA, 22 bp, Homo sapiens
tggacagaaacccgagtgatct

SEQ ID NO: 7226612 - DNA, 20 bp, Homo sapiens
tggacagaattagacacttt

SEQ ID NO: 7226613 - DNA, 20 bp, Homo sapiens
tggacagaattagacacttt

SEQ ID NO: 7226614 - DNA, 22 bp, Homo sapiens
tggacactggagattcgtcagt

SEQ ID NO: 7226615 - DNA, 22 bp, Homo sapiens
tggacagagaggaaggccattt

SEQ ID NO: 7226616 - DNA, 20 bp, Homo sapiens
tggacagaattagacacttt

SEQ ID NO: 7226617 - DNA, 22 bp, Homo sapiens
tggacagagaggaaggccattt

SEQ ID NO: 7226618 - DNA, 22 bp, Homo sapiens
tggacagagaggaaggccattt

SEQ ID NO: 7226619 - DNA, 22 bp, Homo sapiens
tggacagagaggaaggccattt

SEQ ID NO: 7226620 - DNA, 22 bp, Homo sapiens
tggacagagaggaaggccattt

SEQ ID NO: 7226621 - DNA, 22 bp, Homo sapiens
tggacagagctgacagtatata

SEQ ID NO: 7226622 - DNA, 22 bp, Homo sapiens
tggacagagctgacagtatata

SEQ ID NO: 7226623 - DNA, 22 bp, Homo sapiens
tggacagagctgacagtatata

SEQ ID NO: 7226624 - DNA, 22 bp, Homo sapiens
tggacagcaaacatggagagaa

SEQ ID NO: 7226625 - DNA, 22 bp, Homo sapiens
tggacagagctgacagtatata

SEQ ID NO: 7226626 - DNA, 22 bp, Homo sapiens
tggaatgagctggctaataacc

SEQ ID NO: 7226627 - DNA, 22 bp, Homo sapiens
tggaatgagctggctaataacc

SEQ ID NO: 7226628 - DNA, 22 bp, Homo sapiens
tggaatgaaggagatggccttt

SEQ ID NO: 7226629 - DNA, 22 bp, Homo sapiens
tggaatgaaaagtacttcagaa

SEQ ID NO: 7226630 - DNA, 22 bp, Homo sapiens
tggaatgaaaatggagatcttg

SEQ ID NO: 7226631 - DNA, 21 bp, Homo sapiens
tggaatgaggctgagcagtgc

SEQ ID NO: 7226632 - DNA, 21 bp, Homo sapiens
tggaatgaggctgagcagtgc

SEQ ID NO: 7226633 - DNA, 22 bp, Homo sapiens
tggaatgcagtgggagcttacc

SEQ ID NO: 7226634 - DNA, 22 bp, Homo sapiens
tggaatgcatggctctgtgacg

SEQ ID NO: 7226635 - DNA, 22 bp, Homo sapiens
tggaatggaaacaaactgagga

SEQ ID NO: 7226636 - DNA, 22 bp, Homo sapiens
tggaatgccgggccaggctccg

SEQ ID NO: 7226637 - DNA, 22 bp, Homo sapiens
tggaatgccgggccaggctccg

SEQ ID NO: 7226638 - DNA, 22 bp, Homo sapiens
tggaatggaaacaaactgagga

SEQ ID NO: 7226639 - DNA, 22 bp, Homo sapiens
tggacaacatagtgagacctca

SEQ ID NO: 7226640 - DNA, 22 bp, Homo sapiens
tggacaacatagtgagacctca

SEQ ID NO: 7226641 - DNA, 22 bp, Homo sapiens
tggacaaatagcatgacacttg

SEQ ID NO: 7226642 - DNA, 22 bp, Homo sapiens
tggaatgttttcctaaatcaga

SEQ ID NO: 7226643 - DNA, 22 bp, Homo sapiens
tggaatgttttcctaaatcaga

SEQ ID NO: 7226644 - DNA, 22 bp, Homo sapiens
tggaattatctgaagtgatttg

SEQ ID NO: 7226645 - DNA, 22 bp, Homo sapiens
tggaatggaaacaaactgagga

SEQ ID NO: 7226646 - DNA, 22 bp, Homo sapiens
tggaatgttatgatgatggtaa

SEQ ID NO: 7226647 - DNA, 19 bp, Homo sapiens
tggaatgttccaaggaggc

SEQ ID NO: 7226648 - DNA, 19 bp, Homo sapiens
tggaatgttccaaggaggc

SEQ ID NO: 7226649 - DNA, 19 bp, Homo sapiens
tggaatgttccaaggaggc

SEQ ID NO: 7226650 - DNA, 22 bp, Homo sapiens
tggaatgttgataaacataggc

SEQ ID NO: 7226651 - DNA, 22 bp, Homo sapiens
tggaatgttgataaacataggc

SEQ ID NO: 7226652 - DNA, 22 bp, Homo sapiens
tggaatgttgcataagatctga

SEQ ID NO: 7226653 - DNA, 22 bp, Homo sapiens
tggaatgttgcataagatctga

SEQ ID NO: 7226654 - DNA, 22 bp, Homo sapiens
tggaatgttgctctgccttgcg

SEQ ID NO: 7226655 - DNA, 22 bp, Homo sapiens
tggaatgttgctctgccttgcg

SEQ ID NO: 7226656 - DNA, 22 bp, Homo sapiens
tggaatgttgggatttaagtgt

SEQ ID NO: 7226657 - DNA, 22 bp, Homo sapiens
tggaatgttgggatttaagtgt

SEQ ID NO: 7226658 - DNA, 22 bp, Homo sapiens
tggaatgttgggatttaagtgt

SEQ ID NO: 7226659 - DNA, 22 bp, Homo sapiens
tggaatgttgtgtataggtcag

SEQ ID NO: 7226660 - DNA, 22 bp, Homo sapiens
tggaatgttgtgtataggtcag

SEQ ID NO: 7226661 - DNA, 22 bp, Homo sapiens
tggaatgtttccccagcctgca

SEQ ID NO: 7226662 - DNA, 22 bp, Homo sapiens
tggaatgtttccccagcctgca

SEQ ID NO: 7226663 - DNA, 23 bp, Homo sapiens
tggaatgtttcttgtactgaatg

SEQ ID NO: 7226664 - DNA, 23 bp, Homo sapiens
tggaatgtttcttgtactgaatg

SEQ ID NO: 7226665 - DNA, 22 bp, Homo sapiens
tggaatgtttgacttattcagt

SEQ ID NO: 7226666 - DNA, 22 bp, Homo sapiens
tggaatgtttgacttattcagt

SEQ ID NO: 7226667 - DNA, 22 bp, Homo sapiens
tggaatgtttgacttattcagt

SEQ ID NO: 7226668 - DNA, 22 bp, Homo sapiens
tgcttctttttatcttggagta

SEQ ID NO: 7226669 - DNA, 22 bp, Homo sapiens
tgcttgactctggaataaaatg

SEQ ID NO: 7226670 - DNA, 22 bp, Homo sapiens
tgcttgaacaaggataaatttg

SEQ ID NO: 7226671 - DNA, 22 bp, Homo sapiens
tgcttgaagcctacattcgtca

SEQ ID NO: 7226672 - DNA, 22 bp, Homo sapiens
tgcttgatttggcagtgtattc

SEQ ID NO: 7226673 - DNA, 22 bp, Homo sapiens
tgcttgattagggaagtcacat

SEQ ID NO: 7226674 - DNA, 22 bp, Homo sapiens
tgcttgagacacatatgaattt

SEQ ID NO: 7226675 - DNA, 22 bp, Homo sapiens
tgcttgatgagtgtgccaagca

SEQ ID NO: 7226676 - DNA, 22 bp, Homo sapiens
tgcttgatggctcttctttcta

SEQ ID NO: 7226677 - DNA, 22 bp, Homo sapiens
tgcttgattaagccttgtttgc

SEQ ID NO: 7226678 - DNA, 19 bp, Homo sapiens
tgcttgcctgcctttccca

SEQ ID NO: 7226679 - DNA, 22 bp, Homo sapiens
tgcttgctatgcatcctgaact

SEQ ID NO: 7226680 - DNA, 21 bp, Homo sapiens
tgcttgtctgcctagaggctt

SEQ ID NO: 7226681 - DNA, 22 bp, Homo sapiens
tgcttgtcttcaggaatgctga

SEQ ID NO: 7226682 - DNA, 22 bp, Homo sapiens
tgcttgtcttcaggattatggt

SEQ ID NO: 7226683 - DNA, 22 bp, Homo sapiens
tgcttgtgacagaactgtgtcc

SEQ ID NO: 7226684 - DNA, 22 bp, Homo sapiens
tgcttgtgacagaactgtgtcc

SEQ ID NO: 7226685 - DNA, 22 bp, Homo sapiens
tgctttaaccatcttgtttgga

SEQ ID NO: 7226686 - DNA, 22 bp, Homo sapiens
tgctttaagacactaagtttga

SEQ ID NO: 7226687 - DNA, 22 bp, Homo sapiens
tgctttaagagattgttagtac

SEQ ID NO: 7226688 - DNA, 22 bp, Homo sapiens
tgctttataaccatttctgtgg

SEQ ID NO: 7226689 - DNA, 22 bp, Homo sapiens
tgcttgtgtgagggcctgggag

SEQ ID NO: 7226690 - DNA, 22 bp, Homo sapiens
tgctttaaaatggactgttttg

SEQ ID NO: 7226691 - DNA, 22 bp, Homo sapiens
tgctttaaaatggactgttttg

SEQ ID NO: 7226692 - DNA, 22 bp, Homo sapiens
tgctttaaaatggactgttttg

SEQ ID NO: 7226693 - DNA, 22 bp, Homo sapiens
tgctttaaaatggactgttttg

SEQ ID NO: 7226694 - DNA, 22 bp, Homo sapiens
tgctttaaatatgaattagcat

SEQ ID NO: 7226695 - DNA, 22 bp, Homo sapiens
tgctttaaatatgaattagcat

SEQ ID NO: 7226696 - DNA, 22 bp, Homo sapiens
tgctttaacataagatatcttt

SEQ ID NO: 7226697 - DNA, 22 bp, Homo sapiens
tgcttctgtttgtttctgtcat

SEQ ID NO: 7226698 - DNA, 22 bp, Homo sapiens
tgcttctgtttcattgatctta

SEQ ID NO: 7226699 - DNA, 22 bp, Homo sapiens
tgcttctgtttcattgatctta

SEQ ID NO: 7226700 - DNA, 22 bp, Homo sapiens
tgcttcttactcatatgctgat

SEQ ID NO: 7226701 - DNA, 22 bp, Homo sapiens
tgcttctgttctttcacctacg

SEQ ID NO: 7226702 - DNA, 22 bp, Homo sapiens
tgcttctgttctttcacctacg

SEQ ID NO: 7226703 - DNA, 22 bp, Homo sapiens
tgcttctgttacataccagaac

SEQ ID NO: 7226704 - DNA, 17 bp, Homo sapiens
tgcttctgtattgctgg

SEQ ID NO: 7226705 - DNA, 22 bp, Homo sapiens
tgcttctgtattttgggcttga

SEQ ID NO: 7226706 - DNA, 22 bp, Homo sapiens
tgcttctgggtcccagcctggc

SEQ ID NO: 7226707 - DNA, 22 bp, Homo sapiens
tgcttctgggtaggcctcagga

SEQ ID NO: 7226708 - DNA, 22 bp, Homo sapiens
tgcttctgggtcccagcctggc

SEQ ID NO: 7226709 - DNA, 22 bp, Homo sapiens
tgcttctgggtaggcctcagga

SEQ ID NO: 7226710 - DNA, 22 bp, Homo sapiens
tgcttctgggtaggcctcagga

SEQ ID NO: 7226711 - DNA, 19 bp, Homo sapiens
tgcttctggggcttctcca

SEQ ID NO: 7226712 - DNA, 19 bp, Homo sapiens
tgcttctggggcttctcca

SEQ ID NO: 7226713 - DNA, 19 bp, Homo sapiens
tgcttctggggcttctcca

SEQ ID NO: 7226714 - DNA, 22 bp, Homo sapiens
tgcttctgggcctggtgttccc

SEQ ID NO: 7226715 - DNA, 22 bp, Homo sapiens
tgcttctggggacaggctgcct

SEQ ID NO: 7226716 - DNA, 22 bp, Homo sapiens
tgcttctgggcctggtgttccc

SEQ ID NO: 7226717 - DNA, 22 bp, Homo sapiens
tgcttctggggacaggctgcct

SEQ ID NO: 7226718 - DNA, 22 bp, Homo sapiens
tgcttctggggacaggctgcct

SEQ ID NO: 7226719 - DNA, 22 bp, Homo sapiens
tgcttctggagtaacagggtga

SEQ ID NO: 7226720 - DNA, 19 bp, Homo sapiens
tgcttctggaatgcaaggc

SEQ ID NO: 7226721 - DNA, 22 bp, Homo sapiens
tgcttctggagtaacagggtga

SEQ ID NO: 7226722 - DNA, 22 bp, Homo sapiens
tgcttctgctgatattttgtga

SEQ ID NO: 7226723 - DNA, 22 bp, Homo sapiens
tgcttctgctttacttggttca

SEQ ID NO: 7226724 - DNA, 22 bp, Homo sapiens
tgcttctgctttacttggttca

SEQ ID NO: 7226725 - DNA, 19 bp, Homo sapiens
tgcttctggaaccatgatc

SEQ ID NO: 7226726 - DNA, 22 bp, Homo sapiens
tgctttctgctctggaaacagg

SEQ ID NO: 7226727 - DNA, 22 bp, Homo sapiens
tgctttctgtttttcatataat

SEQ ID NO: 7226728 - DNA, 17 bp, Homo sapiens
tgctttcttcctgccct

SEQ ID NO: 7226729 - DNA, 17 bp, Homo sapiens
tgctttcttcctgccct

SEQ ID NO: 7226730 - DNA, 22 bp, Homo sapiens
tgctttctttagctcctgagtc

SEQ ID NO: 7226731 - DNA, 22 bp, Homo sapiens
tgctttgaaagataatactgtc

SEQ ID NO: 7226732 - DNA, 22 bp, Homo sapiens
tgctttgacagggatgacatga

SEQ ID NO: 7226733 - DNA, 22 bp, Homo sapiens
tgctttgacagggatgacatga

SEQ ID NO: 7226734 - DNA, 22 bp, Homo sapiens
tgctttgacagggatgacatga

SEQ ID NO: 7226735 - DNA, 20 bp, Homo sapiens
tgctttgatggaaatacagc

SEQ ID NO: 7226736 - DNA, 20 bp, Homo sapiens
tgctttgatggaaatacagc

SEQ ID NO: 7226737 - DNA, 22 bp, Homo sapiens
tgctttgcaaataatagaatgt

SEQ ID NO: 7226738 - DNA, 22 bp, Homo sapiens
tgctttgctctcactgtaaggt

SEQ ID NO: 7226739 - DNA, 22 bp, Homo sapiens
tgctttctcctgtctgaaagat

SEQ ID NO: 7226740 - DNA, 18 bp, Homo sapiens
tgctttctagcttcagat

SEQ ID NO: 7226741 - DNA, 22 bp, Homo sapiens
tgctttattcgacatctggtag

SEQ ID NO: 7226742 - DNA, 22 bp, Homo sapiens
tgctttattcgacatctggtag

SEQ ID NO: 7226743 - DNA, 22 bp, Homo sapiens
tgctttattgcatcagtgtggg

SEQ ID NO: 7226744 - DNA, 22 bp, Homo sapiens
tgctttatgttatcagaagggt

SEQ ID NO: 7226745 - DNA, 22 bp, Homo sapiens
tgctttattaagagagaaattt

SEQ ID NO: 7226746 - DNA, 22 bp, Homo sapiens
tgctttattcagggtttacccc

SEQ ID NO: 7226747 - DNA, 22 bp, Homo sapiens
tgctttattaagagagaaattt

SEQ ID NO: 7226748 - DNA, 22 bp, Homo sapiens
tgctttattcagtctctgccat

SEQ ID NO: 7226749 - DNA, 22 bp, Homo sapiens
tgctttattcccttctgatgtg

SEQ ID NO: 7226750 - DNA, 18 bp, Homo sapiens
tgctttatgcttatataa

SEQ ID NO: 7226751 - DNA, 20 bp, Homo sapiens
tgctttatgctatactttgt

SEQ ID NO: 7226752 - DNA, 18 bp, Homo sapiens
tgctttatgcttatataa

SEQ ID NO: 7226753 - DNA, 20 bp, Homo sapiens
tgctttatgctatactttgt

SEQ ID NO: 7226754 - DNA, 18 bp, Homo sapiens
tgctttatgcttatataa

SEQ ID NO: 7226755 - DNA, 22 bp, Homo sapiens
tgctttatggagcccatctcat

SEQ ID NO: 7226756 - DNA, 22 bp, Homo sapiens
tgctttatggatttgtgtcctg

SEQ ID NO: 7226757 - DNA, 21 bp, Homo sapiens
tgctttatgggaaaaatgtca

SEQ ID NO: 7226758 - DNA, 21 bp, Homo sapiens
tgctttatgggaaaaatgtca

SEQ ID NO: 7226759 - DNA, 21 bp, Homo sapiens
tgctttatgggaaaaatgtca

SEQ ID NO: 7226760 - DNA, 22 bp, Homo sapiens
tgctttatgtggctgatactca

SEQ ID NO: 7226761 - DNA, 22 bp, Homo sapiens
tgctttatgttatcagaagggt

SEQ ID NO: 7226762 - DNA, 22 bp, Homo sapiens
tgctttataacttagtttatgg

SEQ ID NO: 7226763 - DNA, 22 bp, Homo sapiens
tgctttataacttagtttatgg

SEQ ID NO: 7226764 - DNA, 22 bp, Homo sapiens
tgctttataacttagtttatgg

SEQ ID NO: 7226765 - DNA, 22 bp, Homo sapiens
tgctttatagacaaggaagtag

SEQ ID NO: 7226766 - DNA, 22 bp, Homo sapiens
tgctttatagacaaggaagtag

SEQ ID NO: 7226767 - DNA, 22 bp, Homo sapiens
tgctttataggggattgcaggc

SEQ ID NO: 7226768 - DNA, 22 bp, Homo sapiens
tgctttatatctctcttcttag

SEQ ID NO: 7226769 - DNA, 22 bp, Homo sapiens
tgctttatatctctcttcttag

SEQ ID NO: 7226770 - DNA, 22 bp, Homo sapiens
tgctttatcaaagctatagtga

SEQ ID NO: 7226771 - DNA, 22 bp, Homo sapiens
tgctttatcaaagctatagtga

SEQ ID NO: 7226772 - DNA, 22 bp, Homo sapiens
tgctttatctgacttggcgctg

SEQ ID NO: 7226773 - DNA, 22 bp, Homo sapiens
tgctttatctgtgagaacctga

SEQ ID NO: 7226774 - DNA, 23 bp, Homo sapiens
tggaaagcggacctggggcagag

SEQ ID NO: 7226775 - DNA, 22 bp, Homo sapiens
tggaaaggacagttgctgatag

SEQ ID NO: 7226776 - DNA, 22 bp, Homo sapiens
tggaaaggaggcttgtggaata

SEQ ID NO: 7226777 - DNA, 22 bp, Homo sapiens
tggaaagggacttatgagttcc

SEQ ID NO: 7226778 - DNA, 22 bp, Homo sapiens
tggaaaggtaggatttcaagac

SEQ ID NO: 7226779 - DNA, 22 bp, Homo sapiens
tggaaaggtgtaaagcagaacc

SEQ ID NO: 7226780 - DNA, 22 bp, Homo sapiens
tggaaaggtgtaaagcagaacc

SEQ ID NO: 7226781 - DNA, 22 bp, Homo sapiens
tggaaagtgagacatatttata

SEQ ID NO: 7226782 - DNA, 22 bp, Homo sapiens
tggaaagtttctgatttcctaa

SEQ ID NO: 7226783 - DNA, 22 bp, Homo sapiens
tggaaatacaagaagtatgtca

SEQ ID NO: 7226784 - DNA, 22 bp, Homo sapiens
tggaaatacttgccataaaact

SEQ ID NO: 7226785 - DNA, 22 bp, Homo sapiens
tggaaatacttgccataaaact

SEQ ID NO: 7226786 - DNA, 22 bp, Homo sapiens
tggaaatatacaatgtgtctct

SEQ ID NO: 7226787 - DNA, 22 bp, Homo sapiens
tggaaatatgctccattctttt

SEQ ID NO: 7226788 - DNA, 22 bp, Homo sapiens
tggaaatagttgtgagtcaggc

SEQ ID NO: 7226789 - DNA, 22 bp, Homo sapiens
tggaaatatacaatgtgtctct

SEQ ID NO: 7226790 - DNA, 22 bp, Homo sapiens
tggaaatagctccagtttcatt

SEQ ID NO: 7226791 - DNA, 22 bp, Homo sapiens
tggaaatagtaatgcataagtg

SEQ ID NO: 7226792 - DNA, 22 bp, Homo sapiens
tggaaatagtaatgcataagtg

SEQ ID NO: 7226793 - DNA, 22 bp, Homo sapiens
tggaaatagtaatgcataagtg

SEQ ID NO: 7226794 - DNA, 22 bp, Homo sapiens
tggaaatagttgtgagtcaggc

SEQ ID NO: 7226795 - DNA, 22 bp, Homo sapiens
tggaaatacttgccataaaact

SEQ ID NO: 7226796 - DNA, 22 bp, Homo sapiens
tggaaatagatagtatcattca

SEQ ID NO: 7226797 - DNA, 22 bp, Homo sapiens
tggaaatagctccagttaagca

SEQ ID NO: 7226798 - DNA, 22 bp, Homo sapiens
tggaaatagctccagttaagca

SEQ ID NO: 7226799 - DNA, 22 bp, Homo sapiens
tggaaatagctccagtttcatt

SEQ ID NO: 7226800 - DNA, 22 bp, Homo sapiens
tggaaatagctccagtttcatt

SEQ ID NO: 7226801 - DNA, 22 bp, Homo sapiens
tggaaatggatctgatgagtct

SEQ ID NO: 7226802 - DNA, 22 bp, Homo sapiens
tggaaatggatctgatgagtct

SEQ ID NO: 7226803 - DNA, 19 bp, Homo sapiens
tggaaatggaagctcagcc

SEQ ID NO: 7226804 - DNA, 21 bp, Homo sapiens
tggaaatggaatactttggat

SEQ ID NO: 7226805 - DNA, 23 bp, Homo sapiens
tggaaatctgggtgaggacagaa

SEQ ID NO: 7226806 - DNA, 21 bp, Homo sapiens
tggaaatgagcgttcagcttt

SEQ ID NO: 7226807 - DNA, 19 bp, Homo sapiens
tggaaatggaagctcagcc

SEQ ID NO: 7226808 - DNA, 22 bp, Homo sapiens
tggaaatattgggtaatagttg

SEQ ID NO: 7226809 - DNA, 22 bp, Homo sapiens
tggaaatattgggtaatagttg

SEQ ID NO: 7226810 - DNA, 22 bp, Homo sapiens
tggaaatatttgctcattatct

SEQ ID NO: 7226811 - DNA, 23 bp, Homo sapiens
tggaaatctgggtgaggacagaa

SEQ ID NO: 7226812 - DNA, 22 bp, Homo sapiens
tggaacctggcctgagctacca

SEQ ID NO: 7226813 - DNA, 22 bp, Homo sapiens
tggaagaaaattcaatcgagtt

SEQ ID NO: 7226814 - DNA, 22 bp, Homo sapiens
tggaagaaaattcaatcgagtt

SEQ ID NO: 7226815 - DNA, 22 bp, Homo sapiens
tggaacaatcccggtttagctc

SEQ ID NO: 7226816 - DNA, 22 bp, Homo sapiens
tggaacaattcttgaagggaat

SEQ ID NO: 7226817 - DNA, 22 bp, Homo sapiens
tggaacaattcttgaagggaat

SEQ ID NO: 7226818 - DNA, 22 bp, Homo sapiens
tggaacacacttcaaggagaaa

SEQ ID NO: 7226819 - DNA, 22 bp, Homo sapiens
tggaacacaggactatcagctg

SEQ ID NO: 7226820 - DNA, 22 bp, Homo sapiens
tggaacacagtgattgatagcg

SEQ ID NO: 7226821 - DNA, 22 bp, Homo sapiens
tggaacacatctaaggaagcag

SEQ ID NO: 7226822 - DNA, 22 bp, Homo sapiens
tggaacacatctcgctgcaggg

SEQ ID NO: 7226823 - DNA, 22 bp, Homo sapiens
tggaacaccttgctccagaaag

SEQ ID NO: 7226824 - DNA, 22 bp, Homo sapiens
tggaacactgatcattgccttt

SEQ ID NO: 7226825 - DNA, 22 bp, Homo sapiens
tggaacactgtggatgagaaga

SEQ ID NO: 7226826 - DNA, 22 bp, Homo sapiens
tggaacactttgttgaaatgca

SEQ ID NO: 7226827 - DNA, 22 bp, Homo sapiens
tggaacaaaatatttatgtttg

SEQ ID NO: 7226828 - DNA, 22 bp, Homo sapiens
tggaaattactaacacttagag

SEQ ID NO: 7226829 - DNA, 22 bp, Homo sapiens
tggaacaaattacaattaactt

SEQ ID NO: 7226830 - DNA, 22 bp, Homo sapiens
tggaacaaattacaattaactt

SEQ ID NO: 7226831 - DNA, 22 bp, Homo sapiens
tggaacaaattttggggacctt

SEQ ID NO: 7226832 - DNA, 22 bp, Homo sapiens
tggaacaaattttggggacctt

SEQ ID NO: 7226833 - DNA, 22 bp, Homo sapiens
tggaacaacatgctggaaaatt

SEQ ID NO: 7226834 - DNA, 22 bp, Homo sapiens
tggaacaaaatatttatgtttg

SEQ ID NO: 7226835 - DNA, 22 bp, Homo sapiens
tggaacaaacatggtgatggct

SEQ ID NO: 7226836 - DNA, 22 bp, Homo sapiens
tggaacaaacatggtgatggct

SEQ ID NO: 7226837 - DNA, 22 bp, Homo sapiens
tggaacaaacatggtgatggct

SEQ ID NO: 7226838 - DNA, 19 bp, Homo sapiens
tggaacaaactgcaatgac

SEQ ID NO: 7226839 - DNA, 19 bp, Homo sapiens
tggaacaaactgcaatgac

SEQ ID NO: 7226840 - DNA, 22 bp, Homo sapiens
tggaacaacatgctggaaaatt

SEQ ID NO: 7226841 - DNA, 22 bp, Homo sapiens
tggaacaactccctcggagcct

SEQ ID NO: 7226842 - DNA, 22 bp, Homo sapiens
tggaacaactccctcggagcct

SEQ ID NO: 7226843 - DNA, 22 bp, Homo sapiens
tggaacaagaagcaggtcgctt

SEQ ID NO: 7226844 - DNA, 22 bp, Homo sapiens
tggaacaagaagcaggtcgctt

SEQ ID NO: 7226845 - DNA, 22 bp, Homo sapiens
tggaacaagacagcatagagct

SEQ ID NO: 7226846 - DNA, 22 bp, Homo sapiens
tggaacaagacagcatagagct

SEQ ID NO: 7226847 - DNA, 22 bp, Homo sapiens
tggaacaagggcgtggcggtcg

SEQ ID NO: 7226848 - DNA, 22 bp, Homo sapiens
tggaacaagggcgtggcggtcg

SEQ ID NO: 7226849 - DNA, 22 bp, Homo sapiens
tggaacaagggttcatttaaat

SEQ ID NO: 7226850 - DNA, 22 bp, Homo sapiens
tggaacaagggttcatttaaat

SEQ ID NO: 7226851 - DNA, 22 bp, Homo sapiens
tggaacaatcccggtttagctc

SEQ ID NO: 7226852 - DNA, 21 bp, Homo sapiens
tggaaaacatttaaatagcaa

SEQ ID NO: 7226853 - DNA, 21 bp, Homo sapiens
tggaaaacatttaaatagcaa

SEQ ID NO: 7226854 - DNA, 21 bp, Homo sapiens
tggaaaacatttaaatagcaa

SEQ ID NO: 7226855 - DNA, 22 bp, Homo sapiens
tggaaaatcaggggacattgat

SEQ ID NO: 7226856 - DNA, 22 bp, Homo sapiens
tggaaaatatttaggtgaatga

SEQ ID NO: 7226857 - DNA, 22 bp, Homo sapiens
tggaaacaaagtcataagctca

SEQ ID NO: 7226858 - DNA, 22 bp, Homo sapiens
tggaaacaaagtcataagctca

SEQ ID NO: 7226859 - DNA, 22 bp, Homo sapiens
tggaaacacccacgcatgcata

SEQ ID NO: 7226860 - DNA, 17 bp, Homo sapiens
tggaaacaaaacttatt

SEQ ID NO: 7226861 - DNA, 22 bp, Homo sapiens
tggaaaattagtagtgaaaggc

SEQ ID NO: 7226862 - DNA, 17 bp, Homo sapiens
tggaaacaaaacttatt

SEQ ID NO: 7226863 - DNA, 17 bp, Homo sapiens
tggaaacaaaacttatt

SEQ ID NO: 7226864 - DNA, 22 bp, Homo sapiens
tggaaaatgtgactattctaaa

SEQ ID NO: 7226865 - DNA, 22 bp, Homo sapiens
tggaaaatgtgactattctaaa

SEQ ID NO: 7226866 - DNA, 22 bp, Homo sapiens
tggaaaattagtagtgaaaggc

SEQ ID NO: 7226867 - DNA, 22 bp, Homo sapiens
tggaaacactcaagcttatatt

SEQ ID NO: 7226868 - DNA, 22 bp, Homo sapiens
tggaaacactgcatgttcaccc

SEQ ID NO: 7226869 - DNA, 22 bp, Homo sapiens
tggaaacacccacgcatgcata

SEQ ID NO: 7226870 - DNA, 22 bp, Homo sapiens
tggaaacactcaagcttatatt

SEQ ID NO: 7226871 - DNA, 22 bp, Homo sapiens
tggaaacagatcataactaagc

SEQ ID NO: 7226872 - DNA, 22 bp, Homo sapiens
tggaaacagatcataactaagc

SEQ ID NO: 7226873 - DNA, 21 bp, Homo sapiens
tggaaacagcgccatctgccg

SEQ ID NO: 7226874 - DNA, 22 bp, Homo sapiens
tggaaacatctctgcctttatt

SEQ ID NO: 7226875 - DNA, 22 bp, Homo sapiens
tggaaagatgaagatgtttaag

SEQ ID NO: 7226876 - DNA, 23 bp, Homo sapiens
tggaaacattctgaatgtccatc

SEQ ID NO: 7226877 - DNA, 22 bp, Homo sapiens
tgctttgggtctctctagtttc

SEQ ID NO: 7226878 - DNA, 21 bp, Homo sapiens
tgctttgggaattctcagtct

SEQ ID NO: 7226879 - DNA, 22 bp, Homo sapiens
tgctttggccactagaattcag

SEQ ID NO: 7226880 - DNA, 22 bp, Homo sapiens
tgctttggagagaccattttca

SEQ ID NO: 7226881 - DNA, 22 bp, Homo sapiens
tgctttggatctatttgctgag

SEQ ID NO: 7226882 - DNA, 22 bp, Homo sapiens
tgctttgtgacagattagtttt

SEQ ID NO: 7226883 - DNA, 22 bp, Homo sapiens
tgctttgtgatatgctgtgtct

SEQ ID NO: 7226884 - DNA, 22 bp, Homo sapiens
tgctttgtgatatgctgtgtct

SEQ ID NO: 7226885 - DNA, 22 bp, Homo sapiens
tgctttgtgtttgaatagataa

SEQ ID NO: 7226886 - DNA, 22 bp, Homo sapiens
tgcttttaagaacaatgctgct

SEQ ID NO: 7226887 - DNA, 22 bp, Homo sapiens
tgcttttaggagattaaaatta

SEQ ID NO: 7226888 - DNA, 22 bp, Homo sapiens
tgcttttaggagattaaaatta

SEQ ID NO: 7226889 - DNA, 22 bp, Homo sapiens
tgcttttaggagattaaaatta

SEQ ID NO: 7226890 - DNA, 22 bp, Homo sapiens
tgctttttagtactgtcttatt

SEQ ID NO: 7226891 - DNA, 22 bp, Homo sapiens
tgcttttaggagattaaaatta

SEQ ID NO: 7226892 - DNA, 20 bp, Homo sapiens
tgcttttatacctataatga

SEQ ID NO: 7226893 - DNA, 20 bp, Homo sapiens
tgcttttatacctataatga

SEQ ID NO: 7226894 - DNA, 22 bp, Homo sapiens
tgcttttatttaatatcttgca

SEQ ID NO: 7226895 - DNA, 22 bp, Homo sapiens
tgcttttatttaatatcttgca

SEQ ID NO: 7226896 - DNA, 22 bp, Homo sapiens
tggaaaaaaattggctagcttc

SEQ ID NO: 7226897 - DNA, 22 bp, Homo sapiens
tggaaaaaaattggctagcttc

SEQ ID NO: 7226898 - DNA, 22 bp, Homo sapiens
tggaaaaactgagacttagaca

SEQ ID NO: 7226899 - DNA, 22 bp, Homo sapiens
tggaaaaactgagacttagaca

SEQ ID NO: 7226900 - DNA, 21 bp, Homo sapiens
tggaaaaatgtggcctagtga

SEQ ID NO: 7226901 - DNA, 21 bp, Homo sapiens
tggaaaaatgtggcctagtga

SEQ ID NO: 7226902 - DNA, 20 bp, Homo sapiens
tggagggattgttggcaaat

SEQ ID NO: 7226903 - DNA, 22 bp, Homo sapiens
tggagggatacaaagatgaaaa

SEQ ID NO: 7226904 - DNA, 22 bp, Homo sapiens
tggagggatacaaagatgaaaa

SEQ ID NO: 7226905 - DNA, 20 bp, Homo sapiens
tggagggattgttggcaaat

SEQ ID NO: 7226906 - DNA, 23 bp, Homo sapiens
tggagggcagaataacagactac

SEQ ID NO: 7226907 - DNA, 23 bp, Homo sapiens
tggagggcagaataacagactac

SEQ ID NO: 7226908 - DNA, 22 bp, Homo sapiens
tggagggcatagctgttctttc

SEQ ID NO: 7226909 - DNA, 22 bp, Homo sapiens
tggagggcatctgtggtcaggc

SEQ ID NO: 7226910 - DNA, 22 bp, Homo sapiens
tggagggcatctgtggtcaggc

SEQ ID NO: 7226911 - DNA, 22 bp, Homo sapiens
tggagggcatctgtggtcaggc

SEQ ID NO: 7226912 - DNA, 22 bp, Homo sapiens
tggagggcgcttagatggaggg

SEQ ID NO: 7226913 - DNA, 22 bp, Homo sapiens
tggagggcgcttagatggaggg

SEQ ID NO: 7226914 - DNA, 22 bp, Homo sapiens
tggagggcatctgtggtcaggc

SEQ ID NO: 7226915 - DNA, 22 bp, Homo sapiens
tggagggcatgctgtccatggg

SEQ ID NO: 7226916 - DNA, 22 bp, Homo sapiens
tggagggaacccaggctgctct

SEQ ID NO: 7226917 - DNA, 22 bp, Homo sapiens
tggagggaacccaggctgctct

SEQ ID NO: 7226918 - DNA, 22 bp, Homo sapiens
tggagggaacccaggctgctct

SEQ ID NO: 7226919 - DNA, 22 bp, Homo sapiens
tggagggaacccaggctgctct

SEQ ID NO: 7226920 - DNA, 22 bp, Homo sapiens
tggagggatacaaagatgaaaa

SEQ ID NO: 7226921 - DNA, 22 bp, Homo sapiens
tggagggaacccaggctgctct

SEQ ID NO: 7226922 - DNA, 22 bp, Homo sapiens
tggagggaacccaggctgctct

SEQ ID NO: 7226923 - DNA, 22 bp, Homo sapiens
tggagggaacaaaggagtccca

SEQ ID NO: 7226924 - DNA, 22 bp, Homo sapiens
tggagggaacaaaggagtccca

SEQ ID NO: 7226925 - DNA, 22 bp, Homo sapiens
tggagggaacaaaggagtccca

SEQ ID NO: 7226926 - DNA, 22 bp, Homo sapiens
tggagggaacaaaggagtccca

SEQ ID NO: 7226927 - DNA, 22 bp, Homo sapiens
tggaggctggtttctgctgagg

SEQ ID NO: 7226928 - DNA, 22 bp, Homo sapiens
tggaggctggtttctgctgagg

SEQ ID NO: 7226929 - DNA, 22 bp, Homo sapiens
tggaggctggtttctgctgagg

SEQ ID NO: 7226930 - DNA, 22 bp, Homo sapiens
tggaggctggagtgcagtggcg

SEQ ID NO: 7226931 - DNA, 22 bp, Homo sapiens
tggaggctggagtgcagtggcg

SEQ ID NO: 7226932 - DNA, 22 bp, Homo sapiens
tggaggctgtgtgcatgagacc

SEQ ID NO: 7226933 - DNA, 22 bp, Homo sapiens
tggaggctggtttctgctgagg

SEQ ID NO: 7226934 - DNA, 22 bp, Homo sapiens
tggaggctggtttctgctgagg

SEQ ID NO: 7226935 - DNA, 22 bp, Homo sapiens
tggaggctgtgtgcatgagacc

SEQ ID NO: 7226936 - DNA, 22 bp, Homo sapiens
tggaggctgtgtgcatgagacc

SEQ ID NO: 7226937 - DNA, 22 bp, Homo sapiens
tggaggctgtgtgcatgagacc

SEQ ID NO: 7226938 - DNA, 22 bp, Homo sapiens
tggaggctgtgtgcatgagacc

SEQ ID NO: 7226939 - DNA, 22 bp, Homo sapiens
tggaggctgtgtgcatgagacc

SEQ ID NO: 7226940 - DNA, 22 bp, Homo sapiens
tggaggtgtataaggtagcttc

SEQ ID NO: 7226941 - DNA, 22 bp, Homo sapiens
tggaggtgtataaggtagcttc

SEQ ID NO: 7226942 - DNA, 22 bp, Homo sapiens
tggaggtgtataaggtagcttc

SEQ ID NO: 7226943 - DNA, 20 bp, Homo sapiens
tggaggtggtctgctgtcct

SEQ ID NO: 7226944 - DNA, 20 bp, Homo sapiens
tggaggtggtctgctgtcct

SEQ ID NO: 7226945 - DNA, 22 bp, Homo sapiens
tggaggtggtgcccagcaattt

SEQ ID NO: 7226946 - DNA, 22 bp, Homo sapiens
tggaggtggtgcccagcaattt

SEQ ID NO: 7226947 - DNA, 20 bp, Homo sapiens
tggaggtggtctgctgtcct

SEQ ID NO: 7226948 - DNA, 20 bp, Homo sapiens
tggaggtggtctgctgtcct

SEQ ID NO: 7226949 - DNA, 20 bp, Homo sapiens
tggaggtggtctgctgtcct

SEQ ID NO: 7226950 - DNA, 20 bp, Homo sapiens
tggaggtggtctgctgtcct

SEQ ID NO: 7226951 - DNA, 22 bp, Homo sapiens
tggaggtggggctcaggaatct

SEQ ID NO: 7226952 - DNA, 22 bp, Homo sapiens
tggaggtggggctcaggaatct

SEQ ID NO: 7226953 - DNA, 22 bp, Homo sapiens
tggaggtggggctcaggaatct

SEQ ID NO: 7226954 - DNA, 22 bp, Homo sapiens
tggaggtggggctcaggaatct

SEQ ID NO: 7226955 - DNA, 22 bp, Homo sapiens
tggaggtggggctcaggaatct

SEQ ID NO: 7226956 - DNA, 22 bp, Homo sapiens
tggaggtgggagggactgtcct

SEQ ID NO: 7226957 - DNA, 22 bp, Homo sapiens
tggaggtgggagggactgtcct

SEQ ID NO: 7226958 - DNA, 22 bp, Homo sapiens
tggaggtgggagggactgtcct

SEQ ID NO: 7226959 - DNA, 22 bp, Homo sapiens
tggaggtgggagggactgtcct

SEQ ID NO: 7226960 - DNA, 22 bp, Homo sapiens
tggaggtggcatctgacagctg

SEQ ID NO: 7226961 - DNA, 22 bp, Homo sapiens
tggaggtggcatctgacagctg

SEQ ID NO: 7226962 - DNA, 22 bp, Homo sapiens
tggaggtggcacaagggaggtc

SEQ ID NO: 7226963 - DNA, 22 bp, Homo sapiens
tggaggtggcacaagggaggtc

SEQ ID NO: 7226964 - DNA, 22 bp, Homo sapiens
tggaggtggcacaagggaggtc

SEQ ID NO: 7226965 - DNA, 22 bp, Homo sapiens
tggaggtggcacaagggaggtc

SEQ ID NO: 7226966 - DNA, 22 bp, Homo sapiens
tggagggctctttcacctggta

SEQ ID NO: 7226967 - DNA, 22 bp, Homo sapiens
tggagggctaagctgagggata

SEQ ID NO: 7226968 - DNA, 22 bp, Homo sapiens
tggagggctaagctgagggata

SEQ ID NO: 7226969 - DNA, 22 bp, Homo sapiens
tggagggctaagctgagggata

SEQ ID NO: 7226970 - DNA, 22 bp, Homo sapiens
tggagggcgcttagatggaggg

SEQ ID NO: 7226971 - DNA, 22 bp, Homo sapiens
tggagggcgcttagatggaggg

SEQ ID NO: 7226972 - DNA, 22 bp, Homo sapiens
tggagggctctttcacctggta

SEQ ID NO: 7226973 - DNA, 22 bp, Homo sapiens
tggagggctctttcacctggta

SEQ ID NO: 7226974 - DNA, 18 bp, Homo sapiens
tggagggcttgctgcagc

SEQ ID NO: 7226975 - DNA, 18 bp, Homo sapiens
tggagggcttgctgcagc

SEQ ID NO: 7226976 - DNA, 22 bp, Homo sapiens
tggaggtggagttggaaactga

SEQ ID NO: 7226977 - DNA, 22 bp, Homo sapiens
tggaggtggagttggaaactga

SEQ ID NO: 7226978 - DNA, 18 bp, Homo sapiens
tggagggcttgctgcagc

SEQ ID NO: 7226979 - DNA, 22 bp, Homo sapiens
tggaggtggagttggaaactga

SEQ ID NO: 7226980 - DNA, 22 bp, Homo sapiens
tggaggtggagttggaaactga

SEQ ID NO: 7226981 - DNA, 22 bp, Homo sapiens
tggaggtggagttggaaactga

SEQ ID NO: 7226982 - DNA, 22 bp, Homo sapiens
tggaggtggagttggaaactga

SEQ ID NO: 7226983 - DNA, 22 bp, Homo sapiens
tggaggtggcacaagggaggtc

SEQ ID NO: 7226984 - DNA, 22 bp, Homo sapiens
tggaggtggcacaagggaggtc

SEQ ID NO: 7226985 - DNA, 22 bp, Homo sapiens
tggagtgcaatagtaataaggt

SEQ ID NO: 7226986 - DNA, 22 bp, Homo sapiens
tggagtgaagtaaagaggacaa

SEQ ID NO: 7226987 - DNA, 22 bp, Homo sapiens
tggagtgaagtaaagaggacaa

SEQ ID NO: 7226988 - DNA, 20 bp, Homo sapiens
tggagtgctgtgttgagaag

SEQ ID NO: 7226989 - DNA, 20 bp, Homo sapiens
tggagtgctgtgttgagaag

SEQ ID NO: 7226990 - DNA, 21 bp, Homo sapiens
tggagtgcactcagagttggt

SEQ ID NO: 7226991 - DNA, 22 bp, Homo sapiens
tggagtggacttcatgaggcca

SEQ ID NO: 7226992 - DNA, 22 bp, Homo sapiens
tggagtggacttcatgaggcca

SEQ ID NO: 7226993 - DNA, 22 bp, Homo sapiens
tggagtctgtgatgctctgggt

SEQ ID NO: 7226994 - DNA, 22 bp, Homo sapiens
tggagtcctagtattggaaaca

SEQ ID NO: 7226995 - DNA, 22 bp, Homo sapiens
tggagtccccgagaggcctgca

SEQ ID NO: 7226996 - DNA, 22 bp, Homo sapiens
tggagtccgctccaagttctct

SEQ ID NO: 7226997 - DNA, 22 bp, Homo sapiens
tggagtcatgatggctgctgat

SEQ ID NO: 7226998 - DNA, 22 bp, Homo sapiens
tggagtcatgatggctgctgat

SEQ ID NO: 7226999 - DNA, 22 bp, Homo sapiens
tggagtcatgatggctgctgat

SEQ ID NO: 7227000 - DNA, 20 bp, Homo sapiens
tggagtcatgggacactcac

SEQ ID NO: 7227001 - DNA, 22 bp, Homo sapiens
tggagtcacttccatatgggaa

SEQ ID NO: 7227002 - DNA, 22 bp, Homo sapiens
tggagtcactttctcttccagt

SEQ ID NO: 7227003 - DNA, 22 bp, Homo sapiens
tggagtaagaatgggcagttca

SEQ ID NO: 7227004 - DNA, 22 bp, Homo sapiens
tggagtcacagtgacctgagtc

SEQ ID NO: 7227005 - DNA, 22 bp, Homo sapiens
tggagtcacagtgacctgagtc

SEQ ID NO: 7227006 - DNA, 22 bp, Homo sapiens
tggagtcagagggggaagtcac

SEQ ID NO: 7227007 - DNA, 22 bp, Homo sapiens
tggagtcagctagacctgtgtt

SEQ ID NO: 7227008 - DNA, 18 bp, Homo sapiens
tggagtcagtgacaccag

SEQ ID NO: 7227009 - DNA, 22 bp, Homo sapiens
tggagtcagtggctattgggca

SEQ ID NO: 7227010 - DNA, 22 bp, Homo sapiens
tggagtcatcttaatctaggca

SEQ ID NO: 7227011 - DNA, 16 bp, Homo sapiens
tggaggtgtttctagt

SEQ ID NO: 7227012 - DNA, 16 bp, Homo sapiens
tggaggtgtttctagt

SEQ ID NO: 7227013 - DNA, 22 bp, Homo sapiens
tggaggtgtccaactcgtgggt

SEQ ID NO: 7227014 - DNA, 22 bp, Homo sapiens
tggaggtgtggagtcaaaggga

SEQ ID NO: 7227015 - DNA, 22 bp, Homo sapiens
tggaggtgtccaactcgtgggt

SEQ ID NO: 7227016 - DNA, 22 bp, Homo sapiens
tggaggtgtccaactcgtgggt

SEQ ID NO: 7227017 - DNA, 22 bp, Homo sapiens
tggaggtgtccaactcgtgggt

SEQ ID NO: 7227018 - DNA, 22 bp, Homo sapiens
tggaggtgtataaggtagcttc

SEQ ID NO: 7227019 - DNA, 22 bp, Homo sapiens
tggaggtgtccaactcgtgggt

SEQ ID NO: 7227020 - DNA, 22 bp, Homo sapiens
tggaggtgtataaggtagcttc

SEQ ID NO: 7227021 - DNA, 22 bp, Homo sapiens
tggaggtgtataaggtagcttc

SEQ ID NO: 7227022 - DNA, 22 bp, Homo sapiens
tggaggtgtataaggtagcttc

SEQ ID NO: 7227023 - DNA, 23 bp, Homo sapiens
tggataaagctgtgctgcatagg

SEQ ID NO: 7227024 - DNA, 21 bp, Homo sapiens
tggataaaggcacttttcatc

SEQ ID NO: 7227025 - DNA, 22 bp, Homo sapiens
tggataaactcactgtaagttg

SEQ ID NO: 7227026 - DNA, 22 bp, Homo sapiens
tggataaactcactgtaagttg

SEQ ID NO: 7227027 - DNA, 20 bp, Homo sapiens
tggagttgttctgctaggtc

SEQ ID NO: 7227028 - DNA, 20 bp, Homo sapiens
tggagttgttctgctaggtc

SEQ ID NO: 7227029 - DNA, 22 bp, Homo sapiens
tggagtgggcaatgtaggcaag

SEQ ID NO: 7227030 - DNA, 22 bp, Homo sapiens
tggagtgggcaatgtaggcaag

SEQ ID NO: 7227031 - DNA, 22 bp, Homo sapiens
tggagtggacttcatgaggcca

SEQ ID NO: 7227032 - DNA, 22 bp, Homo sapiens
tggagtgggcaatgtaggcaag

SEQ ID NO: 7227033 - DNA, 22 bp, Homo sapiens
tggagtgggcaatgtaggcaag

SEQ ID NO: 7227034 - DNA, 22 bp, Homo sapiens
tggagttaaaaacaggatgcac

SEQ ID NO: 7227035 - DNA, 22 bp, Homo sapiens
tggagttaaaaacaggatgcac

SEQ ID NO: 7227036 - DNA, 22 bp, Homo sapiens
tggagttagataaacctgggta

SEQ ID NO: 7227037 - DNA, 23 bp, Homo sapiens
tggagttgatgtccttctgtgct

SEQ ID NO: 7227038 - DNA, 22 bp, Homo sapiens
tggatggattgacgaaggcagc

SEQ ID NO: 7227039 - DNA, 22 bp, Homo sapiens
tggatggccccactggatccat

SEQ ID NO: 7227040 - DNA, 22 bp, Homo sapiens
tggatggccccactggatccat

SEQ ID NO: 7227041 - DNA, 22 bp, Homo sapiens
tggatgggttgaaatgtgagcc

SEQ ID NO: 7227042 - DNA, 22 bp, Homo sapiens
tggatggagactgatatgggta

SEQ ID NO: 7227043 - DNA, 22 bp, Homo sapiens
tggatgcttaaatcgtttgaat

SEQ ID NO: 7227044 - DNA, 22 bp, Homo sapiens
tggatgctgtaggacacgctct

SEQ ID NO: 7227045 - DNA, 19 bp, Homo sapiens
tggatggagcctgtggttg

SEQ ID NO: 7227046 - DNA, 22 bp, Homo sapiens
tggatggattgacgaaggcagc

SEQ ID NO: 7227047 - DNA, 22 bp, Homo sapiens
tggatacagctgatagcaggat

SEQ ID NO: 7227048 - DNA, 22 bp, Homo sapiens
tggatacaaaaacaatctctac

SEQ ID NO: 7227049 - DNA, 22 bp, Homo sapiens
tggatatccttgttaactttct

SEQ ID NO: 7227050 - DNA, 22 bp, Homo sapiens
tggataaatagatacacttgca

SEQ ID NO: 7227051 - DNA, 22 bp, Homo sapiens
tggataaatgtgcagatgacat

SEQ ID NO: 7227052 - DNA, 22 bp, Homo sapiens
tggatacagaagccttggctgt

SEQ ID NO: 7227053 - DNA, 22 bp, Homo sapiens
tggatatgggccatggaaaaaa

SEQ ID NO: 7227054 - DNA, 22 bp, Homo sapiens
tggatatgttggaggtgaaggt

SEQ ID NO: 7227055 - DNA, 23 bp, Homo sapiens
tggatatttcagagatacttcag

SEQ ID NO: 7227056 - DNA, 23 bp, Homo sapiens
tggatatttcagagatacttcag

SEQ ID NO: 7227057 - DNA, 22 bp, Homo sapiens
tggatgctcacttctgcagggt

SEQ ID NO: 7227058 - DNA, 22 bp, Homo sapiens
tggatgctgagaacactgcctg

SEQ ID NO: 7227059 - DNA, 22 bp, Homo sapiens
tggaggcaactgaagatgtagt

SEQ ID NO: 7227060 - DNA, 22 bp, Homo sapiens
tggaggatgcctggggaggcct

SEQ ID NO: 7227061 - DNA, 22 bp, Homo sapiens
tggaggattaatctggaaagat

SEQ ID NO: 7227062 - DNA, 22 bp, Homo sapiens
tggaggatgccatccaggatac

SEQ ID NO: 7227063 - DNA, 22 bp, Homo sapiens
tggaggagtgtgattgtctgcc

SEQ ID NO: 7227064 - DNA, 22 bp, Homo sapiens
tggaggagtgtgattgtctgcc

SEQ ID NO: 7227065 - DNA, 22 bp, Homo sapiens
tggaggatgagtgtgggctctg

SEQ ID NO: 7227066 - DNA, 22 bp, Homo sapiens
tggaggatgccatccaggatac

SEQ ID NO: 7227067 - DNA, 22 bp, Homo sapiens
tggaggatgcctggggaggcct

SEQ ID NO: 7227068 - DNA, 22 bp, Homo sapiens
tggaggatgcctggggaggcct

SEQ ID NO: 7227069 - DNA, 22 bp, Homo sapiens
tggaggatgcctggggaggcct

SEQ ID NO: 7227070 - DNA, 22 bp, Homo sapiens
tggaggagtgtgattgtctgcc

SEQ ID NO: 7227071 - DNA, 22 bp, Homo sapiens
tggaggagtgtgattgtctgcc

SEQ ID NO: 7227072 - DNA, 22 bp, Homo sapiens
tggaggagggctggtgtctgta

SEQ ID NO: 7227073 - DNA, 22 bp, Homo sapiens
tggaggagtagattttcagagg

SEQ ID NO: 7227074 - DNA, 22 bp, Homo sapiens
tggaggagtagattttcagagg

SEQ ID NO: 7227075 - DNA, 22 bp, Homo sapiens
tggaggagtagattttcagagg

SEQ ID NO: 7227076 - DNA, 22 bp, Homo sapiens
tggaggagggctggtgtctgta

SEQ ID NO: 7227077 - DNA, 22 bp, Homo sapiens
tggaggagggctggtgtctgta

SEQ ID NO: 7227078 - DNA, 22 bp, Homo sapiens
tggaggagggctggtgtctgta

SEQ ID NO: 7227079 - DNA, 22 bp, Homo sapiens
tggaggaggaacttcttatctc

SEQ ID NO: 7227080 - DNA, 22 bp, Homo sapiens
tggaggaggaacttcttatctc

SEQ ID NO: 7227081 - DNA, 19 bp, Homo sapiens
tggaggagaggaaaagtca

SEQ ID NO: 7227082 - DNA, 19 bp, Homo sapiens
tggaggagaggaaaagtca

SEQ ID NO: 7227083 - DNA, 19 bp, Homo sapiens
tggaggagaggaaaagtca

SEQ ID NO: 7227084 - DNA, 22 bp, Homo sapiens
tggaggagaccattccactcag

SEQ ID NO: 7227085 - DNA, 22 bp, Homo sapiens
tggaggagaatttatggtcgaa

SEQ ID NO: 7227086 - DNA, 22 bp, Homo sapiens
tggaggagaccattccactcag

SEQ ID NO: 7227087 - DNA, 22 bp, Homo sapiens
tggaggagaatttatggtcgaa

SEQ ID NO: 7227088 - DNA, 22 bp, Homo sapiens
tggaggagaatttatggtcgaa

SEQ ID NO: 7227089 - DNA, 22 bp, Homo sapiens
tggaggagaactccctggctac

SEQ ID NO: 7227090 - DNA, 22 bp, Homo sapiens
tggaggagaatttatggtcgaa

SEQ ID NO: 7227091 - DNA, 22 bp, Homo sapiens
tggagctggggtttgaatctgg

SEQ ID NO: 7227092 - DNA, 23 bp, Homo sapiens
tggagctgggctcagaccctggg

SEQ ID NO: 7227093 - DNA, 23 bp, Homo sapiens
tggagctgggcagctgggaaagt

SEQ ID NO: 7227094 - DNA, 23 bp, Homo sapiens
tggagctgggatttgatttgatt

SEQ ID NO: 7227095 - DNA, 23 bp, Homo sapiens
tggagctgggatttgatttgatt

SEQ ID NO: 7227096 - DNA, 23 bp, Homo sapiens
tggagctgggcagctgggaaagt

SEQ ID NO: 7227097 - DNA, 23 bp, Homo sapiens
tggagctgggcagctgggaaagt

SEQ ID NO: 7227098 - DNA, 22 bp, Homo sapiens
tggagctgggatttgaactgca

SEQ ID NO: 7227099 - DNA, 22 bp, Homo sapiens
tggagcttgggactcttggtag

SEQ ID NO: 7227100 - DNA, 22 bp, Homo sapiens
tggaggaaaaaaccaggcagag

SEQ ID NO: 7227101 - DNA, 22 bp, Homo sapiens
tggaggaaaaaaccaggcagag

SEQ ID NO: 7227102 - DNA, 22 bp, Homo sapiens
tggaggaaaaaaccaggcagag

SEQ ID NO: 7227103 - DNA, 20 bp, Homo sapiens
tggagctgtggtaaggagca

SEQ ID NO: 7227104 - DNA, 22 bp, Homo sapiens
tggaggaaaaaaccaggcagag

SEQ ID NO: 7227105 - DNA, 22 bp, Homo sapiens
tggagctgtcactcagaaccaa

SEQ ID NO: 7227106 - DNA, 20 bp, Homo sapiens
tggagctgtggtaaggagca

SEQ ID NO: 7227107 - DNA, 20 bp, Homo sapiens
tggagctgtggtaaggagca

SEQ ID NO: 7227108 - DNA, 22 bp, Homo sapiens
tggagctggtaaacagtgacat

SEQ ID NO: 7227109 - DNA, 22 bp, Homo sapiens
tggagctggttctggggaagct

SEQ ID NO: 7227110 - DNA, 22 bp, Homo sapiens
tggagctggttctggggaagct

SEQ ID NO: 7227111 - DNA, 20 bp, Homo sapiens
tggagctgtaatcttgtctg

SEQ ID NO: 7227112 - DNA, 22 bp, Homo sapiens
tggaggcactaaatggccacaa

SEQ ID NO: 7227113 - DNA, 20 bp, Homo sapiens
tggaggcagagccagaggga

SEQ ID NO: 7227114 - DNA, 20 bp, Homo sapiens
tggaggcagagccagaggga

SEQ ID NO: 7227115 - DNA, 20 bp, Homo sapiens
tggaggcagagccagaggga

SEQ ID NO: 7227116 - DNA, 20 bp, Homo sapiens
tggaggcagagccagaggga

SEQ ID NO: 7227117 - DNA, 20 bp, Homo sapiens
tggaggcagagccagaggga

SEQ ID NO: 7227118 - DNA, 20 bp, Homo sapiens
tggaggcacctgtggagatc

SEQ ID NO: 7227119 - DNA, 20 bp, Homo sapiens
tggaggcacctgtggagatc

SEQ ID NO: 7227120 - DNA, 20 bp, Homo sapiens
tggaggcacctgtggagatc

SEQ ID NO: 7227121 - DNA, 22 bp, Homo sapiens
tggaggcactaaatggccacaa

SEQ ID NO: 7227122 - DNA, 22 bp, Homo sapiens
tggaggcactaaatggccacaa

SEQ ID NO: 7227123 - DNA, 22 bp, Homo sapiens
tggaggcaactgaagatgtagt

SEQ ID NO: 7227124 - DNA, 22 bp, Homo sapiens
tggaggcaactgaagatgtagt

SEQ ID NO: 7227125 - DNA, 22 bp, Homo sapiens
tggaggcaactgaagatgtagt

SEQ ID NO: 7227126 - DNA, 22 bp, Homo sapiens
tggaggcaactgaagatgtagt

SEQ ID NO: 7227127 - DNA, 19 bp, Homo sapiens
tggaggcaagacatggagg

SEQ ID NO: 7227128 - DNA, 19 bp, Homo sapiens
tggaggcaagacatggagg

SEQ ID NO: 7227129 - DNA, 19 bp, Homo sapiens
tggaggcaagacatggagg

SEQ ID NO: 7227130 - DNA, 19 bp, Homo sapiens
tggaggcaagacatggagg

SEQ ID NO: 7227131 - DNA, 22 bp, Homo sapiens
tggaggcaccactggctgcccg

SEQ ID NO: 7227132 - DNA, 22 bp, Homo sapiens
tggaggcaccactggctgcccg

SEQ ID NO: 7227133 - DNA, 22 bp, Homo sapiens
tggaggcaccactggctgcccg

SEQ ID NO: 7227134 - DNA, 20 bp, Homo sapiens
tggaggcacctgtggagatc

SEQ ID NO: 7227135 - DNA, 20 bp, Homo sapiens
tggaggcacctgtggagatc

SEQ ID NO: 7227136 - DNA, 20 bp, Homo sapiens
tggaggcacctgtggagatc

SEQ ID NO: 7227137 - DNA, 22 bp, Homo sapiens
tggaggcagatacactgtaaaa

SEQ ID NO: 7227138 - DNA, 22 bp, Homo sapiens
tggaggcaggagacagggcaaa

SEQ ID NO: 7227139 - DNA, 22 bp, Homo sapiens
tggaggcaggagacagggcaaa

SEQ ID NO: 7227140 - DNA, 22 bp, Homo sapiens
tggaggcaggagacagggcaaa

SEQ ID NO: 7227141 - DNA, 22 bp, Homo sapiens
tggaggcaggagacagggcaaa

SEQ ID NO: 7227142 - DNA, 22 bp, Homo sapiens
tggaggcaggagacagggcaaa

SEQ ID NO: 7227143 - DNA, 20 bp, Homo sapiens
tggaggcagagccagaggga

SEQ ID NO: 7227144 - DNA, 18 bp, Homo sapiens
tggaggcagagttctggc

SEQ ID NO: 7227145 - DNA, 18 bp, Homo sapiens
tggaggcagagttctggc

SEQ ID NO: 7227146 - DNA, 22 bp, Homo sapiens
tggaggcagatacactgtaaaa

SEQ ID NO: 7227147 - DNA, 22 bp, Homo sapiens
tggaggcagatacactgtaaaa

SEQ ID NO: 7227148 - DNA, 22 bp, Homo sapiens
tggaggcagatacactgtaaaa

SEQ ID NO: 7227149 - DNA, 23 bp, Homo sapiens
tggaggcaggatgctaaggagtc

SEQ ID NO: 7227150 - DNA, 22 bp, Homo sapiens
tggaggcaggggatacaggtca

SEQ ID NO: 7227151 - DNA, 22 bp, Homo sapiens
tggaggcaggggatacaggtca

SEQ ID NO: 7227152 - DNA, 22 bp, Homo sapiens
tggaggcaggggatacaggtca

SEQ ID NO: 7227153 - DNA, 22 bp, Homo sapiens
tggaggcaggggatacaggtca

SEQ ID NO: 7227154 - DNA, 23 bp, Homo sapiens
tggaggcaggatgctaaggagtc

SEQ ID NO: 7227155 - DNA, 22 bp, Homo sapiens
tggaggcaggagacagggcaaa

SEQ ID NO: 7227156 - DNA, 22 bp, Homo sapiens
tggaggcaggagacagggcaaa

SEQ ID NO: 7227157 - DNA, 23 bp, Homo sapiens
tggaggcaggatgctaaggagtc

SEQ ID NO: 7227158 - DNA, 22 bp, Homo sapiens
tggaggcaggtggaggagtgaa

SEQ ID NO: 7227159 - DNA, 22 bp, Homo sapiens
tggaggcaggtggaggagtgaa

SEQ ID NO: 7227160 - DNA, 22 bp, Homo sapiens
tggaggcaggtggaggagtgaa

SEQ ID NO: 7227161 - DNA, 22 bp, Homo sapiens
tggaggcaggtggaggagtgaa

SEQ ID NO: 7227162 - DNA, 22 bp, Homo sapiens
tggaggcaggtggaggagtgaa

SEQ ID NO: 7227163 - DNA, 22 bp, Homo sapiens
tggaggcaggtggaggagtgaa

SEQ ID NO: 7227164 - DNA, 22 bp, Homo sapiens
tggaggcaggtggaggagtgaa

SEQ ID NO: 7227165 - DNA, 19 bp, Homo sapiens
tggaggcctcaggaaaaga

SEQ ID NO: 7227166 - DNA, 22 bp, Homo sapiens
tggaggccggactgagaggcat

SEQ ID NO: 7227167 - DNA, 22 bp, Homo sapiens
tggaggccggactgagaggcat

SEQ ID NO: 7227168 - DNA, 20 bp, Homo sapiens
tggaggcctgcaggtttggg

SEQ ID NO: 7227169 - DNA, 22 bp, Homo sapiens
tggaggcgagagcgcgcgggct

SEQ ID NO: 7227170 - DNA, 22 bp, Homo sapiens
tggaggctggagtgcagtggcg

SEQ ID NO: 7227171 - DNA, 22 bp, Homo sapiens
tggaggctggagtgcagtggcg

SEQ ID NO: 7227172 - DNA, 22 bp, Homo sapiens
tggaggccgcgtagtctgagca

SEQ ID NO: 7227173 - DNA, 22 bp, Homo sapiens
tggaggccggactgagaggcat

SEQ ID NO: 7227174 - DNA, 22 bp, Homo sapiens
tggaggccgaattagagcgttg

SEQ ID NO: 7227175 - DNA, 22 bp, Homo sapiens
tggaggccgaattagagcgttg

SEQ ID NO: 7227176 - DNA, 22 bp, Homo sapiens
tggaggccgcaatgcagtttcc

SEQ ID NO: 7227177 - DNA, 22 bp, Homo sapiens
tggaggccgcgtagtctgagca

SEQ ID NO: 7227178 - DNA, 22 bp, Homo sapiens
tggaggccgcgtagtctgagca

SEQ ID NO: 7227179 - DNA, 22 bp, Homo sapiens
tggaggccgcaatgcagtttcc

SEQ ID NO: 7227180 - DNA, 22 bp, Homo sapiens
tggaggcccccaggcaacagca

SEQ ID NO: 7227181 - DNA, 22 bp, Homo sapiens
tggaggcccccaggcaacagca

SEQ ID NO: 7227182 - DNA, 22 bp, Homo sapiens
tggaggcccccaggcaacagca

SEQ ID NO: 7227183 - DNA, 22 bp, Homo sapiens
tggaggccgaattagagcgttg

SEQ ID NO: 7227184 - DNA, 22 bp, Homo sapiens
tggaggcccacactgggtagat

SEQ ID NO: 7227185 - DNA, 22 bp, Homo sapiens
tggaggcccacactgggtagat

SEQ ID NO: 7227186 - DNA, 22 bp, Homo sapiens
tggaggcccacactgggtagat

SEQ ID NO: 7227187 - DNA, 22 bp, Homo sapiens
tggaggccatgccagagcccta

SEQ ID NO: 7227188 - DNA, 22 bp, Homo sapiens
tggaggccatgccagagcccta

SEQ ID NO: 7227189 - DNA, 19 bp, Homo sapiens
tggaggccaggacacaggt

SEQ ID NO: 7227190 - DNA, 22 bp, Homo sapiens
tggaggcagtcacctgaagtca

SEQ ID NO: 7227191 - DNA, 19 bp, Homo sapiens
tggaggccaggacacaggt

SEQ ID NO: 7227192 - DNA, 19 bp, Homo sapiens
tggaggccaggacacaggt

SEQ ID NO: 7227193 - DNA, 22 bp, Homo sapiens
tggaggcagtcaaatgactgac

SEQ ID NO: 7227194 - DNA, 22 bp, Homo sapiens
tggaggcagtcaaatgactgac

SEQ ID NO: 7227195 - DNA, 22 bp, Homo sapiens
tggaggcagtcacctgaagtca

SEQ ID NO: 7227196 - DNA, 22 bp, Homo sapiens
tggaggcagtaactgagcaaca

SEQ ID NO: 7227197 - DNA, 22 bp, Homo sapiens
tggaggcagtaactgagcaaca

SEQ ID NO: 7227198 - DNA, 22 bp, Homo sapiens
tggaggcagtcaaatgactgac

SEQ ID NO: 7227199 - DNA, 22 bp, Homo sapiens
tggaggcagtaactgagcaaca

SEQ ID NO: 7227200 - DNA, 22 bp, Homo sapiens
tggaggcagtaactgagcaaca

SEQ ID NO: 7227201 - DNA, 22 bp, Homo sapiens
tggaggcaggttagccagacga

SEQ ID NO: 7227202 - DNA, 22 bp, Homo sapiens
tggaggcaggttagccagacga

SEQ ID NO: 7227203 - DNA, 22 bp, Homo sapiens
tggagagcagggctggagttca

SEQ ID NO: 7227204 - DNA, 18 bp, Homo sapiens
tggagagcagcagtgggg

SEQ ID NO: 7227205 - DNA, 18 bp, Homo sapiens
tggagagcagcagtgggg

SEQ ID NO: 7227206 - DNA, 20 bp, Homo sapiens
tggagagcctctggactgtg

SEQ ID NO: 7227207 - DNA, 22 bp, Homo sapiens
tggagagcccgagacatcctgt

SEQ ID NO: 7227208 - DNA, 22 bp, Homo sapiens
tggagagcccgagacatcctgt

SEQ ID NO: 7227209 - DNA, 21 bp, Homo sapiens
tggagagcccttgcctgagtc

SEQ ID NO: 7227210 - DNA, 22 bp, Homo sapiens
tggagagcactgtctcattttg

SEQ ID NO: 7227211 - DNA, 22 bp, Homo sapiens
tggagagcacagttcctgcttc

SEQ ID NO: 7227212 - DNA, 22 bp, Homo sapiens
tggagagcaagtcgcagacatg

SEQ ID NO: 7227213 - DNA, 22 bp, Homo sapiens
tggagagcaatgaggggcaggc

SEQ ID NO: 7227214 - DNA, 22 bp, Homo sapiens
tggagagcaatgaggggcaggc

SEQ ID NO: 7227215 - DNA, 22 bp, Homo sapiens
tggagagcaatgaggggcaggc

SEQ ID NO: 7227216 - DNA, 22 bp, Homo sapiens
tggagagcaagtcgcagacatg

SEQ ID NO: 7227217 - DNA, 22 bp, Homo sapiens
tggagagcaagtcgcagacatg

SEQ ID NO: 7227218 - DNA, 22 bp, Homo sapiens
tggagagcaagtcgcagacatg

SEQ ID NO: 7227219 - DNA, 22 bp, Homo sapiens
tggagagctcctatttgctgtc

SEQ ID NO: 7227220 - DNA, 22 bp, Homo sapiens
tggagagctatttggacctcca

SEQ ID NO: 7227221 - DNA, 22 bp, Homo sapiens
tggagagctccagaagctaaac

SEQ ID NO: 7227222 - DNA, 22 bp, Homo sapiens
tggagagcgtgcttagcactct

SEQ ID NO: 7227223 - DNA, 22 bp, Homo sapiens
tggagagcctggagtccctgat

SEQ ID NO: 7227224 - DNA, 22 bp, Homo sapiens
tggagagcctggagtccctgat

SEQ ID NO: 7227225 - DNA, 22 bp, Homo sapiens
tggagagccttcccggcatcgc

SEQ ID NO: 7227226 - DNA, 22 bp, Homo sapiens
tggagagcgcgacgggaggaag

SEQ ID NO: 7227227 - DNA, 22 bp, Homo sapiens
tggagagcgcgacgggaggaag

SEQ ID NO: 7227228 - DNA, 22 bp, Homo sapiens
tggagagcgcgacgggaggaag

SEQ ID NO: 7227229 - DNA, 22 bp, Homo sapiens
tggagaggaaagtgcagttttg

SEQ ID NO: 7227230 - DNA, 22 bp, Homo sapiens
tggagagctggttcaaagcaga

SEQ ID NO: 7227231 - DNA, 22 bp, Homo sapiens
tggagagctggttcaaagcaga

SEQ ID NO: 7227232 - DNA, 22 bp, Homo sapiens
tggagagctgttgaaatgcaga

SEQ ID NO: 7227233 - DNA, 19 bp, Homo sapiens
tggagaggaaatgctgctc

SEQ ID NO: 7227234 - DNA, 22 bp, Homo sapiens
tggagaggaaagtgcagttttg

SEQ ID NO: 7227235 - DNA, 19 bp, Homo sapiens
tggagaggaaatgctgctc

SEQ ID NO: 7227236 - DNA, 19 bp, Homo sapiens
tggagaggaaatgctgctc

SEQ ID NO: 7227237 - DNA, 22 bp, Homo sapiens
tggagagaagaggcagtgtgct

SEQ ID NO: 7227238 - DNA, 22 bp, Homo sapiens
tggagagaagaggcagtgtgct

SEQ ID NO: 7227239 - DNA, 22 bp, Homo sapiens
tggagagaagaggcagtgtgct

SEQ ID NO: 7227240 - DNA, 22 bp, Homo sapiens
tggagagaagaggcagtgtgct

SEQ ID NO: 7227241 - DNA, 22 bp, Homo sapiens
tggagagaagaggcagtgtgct

SEQ ID NO: 7227242 - DNA, 22 bp, Homo sapiens
tggagagagtcgggatagtaca

SEQ ID NO: 7227243 - DNA, 22 bp, Homo sapiens
tggagagagtcgggatagtaca

SEQ ID NO: 7227244 - DNA, 22 bp, Homo sapiens
tggagagaacagtgtctgaaag

SEQ ID NO: 7227245 - DNA, 22 bp, Homo sapiens
tggagagaacagtgtctgaaag
